United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 93

SEQ ID NO: 3933469 - DNA, 16 bp, Homo sapiens
ccccaaccccgcggtg

SEQ ID NO: 3933470 - DNA, 23 bp, Homo sapiens
ccccaacccgtggaggctgctcg

SEQ ID NO: 3933471 - DNA, 17 bp, Homo sapiens
ccccaactccttccagc

SEQ ID NO: 3933472 - DNA, 14 bp, Homo sapiens
ccccaagcagccag

SEQ ID NO: 3933473 - DNA, 14 bp, Homo sapiens
ccccaagcctctgc

SEQ ID NO: 3933474 - DNA, 22 bp, Homo sapiens
ccccaagcctctgccccaaggg

SEQ ID NO: 3933475 - DNA, 14 bp, Homo sapiens
ccccaagctgtttt

SEQ ID NO: 3933476 - DNA, 17 bp, Homo sapiens
ccccaagctgttttctt

SEQ ID NO: 3933477 - DNA, 21 bp, Homo sapiens
ccccacacgtgctcgcagcct

SEQ ID NO: 3933478 - DNA, 23 bp, Homo sapiens
ccccacacgtgctcgcagcctgg

SEQ ID NO: 3933479 - DNA, 18 bp, Homo sapiens
cccagcccagctggtggg

SEQ ID NO: 3933480 - DNA, 20 bp, Homo sapiens
cccagccctccccgcagtgg

SEQ ID NO: 3933481 - DNA, 14 bp, Homo sapiens
cccagccctgccag

SEQ ID NO: 3933482 - DNA, 16 bp, Homo sapiens
cccagccctgccagga

SEQ ID NO: 3933483 - DNA, 18 bp, Homo sapiens
cccagccctgccaggagg

SEQ ID NO: 3933484 - DNA, 14 bp, Homo sapiens
cccagccctggctc

SEQ ID NO: 3933485 - DNA, 15 bp, Homo sapiens
cccagccctggctct

SEQ ID NO: 3933486 - DNA, 16 bp, Homo sapiens
cccagcccttctgcct

SEQ ID NO: 3933487 - DNA, 20 bp, Homo sapiens
cccagcccttctgcctttct

SEQ ID NO: 3933488 - DNA, 18 bp, Homo sapiens
cccagcctccaagctcca

SEQ ID NO: 3933489 - DNA, 16 bp, Homo sapiens
cccagcctgggcctat

SEQ ID NO: 3933490 - DNA, 13 bp, Homo sapiens
cccagcctgtcct

SEQ ID NO: 3933491 - DNA, 21 bp, Homo sapiens
cccagcgattccctctcccag

SEQ ID NO: 3933492 - DNA, 17 bp, Homo sapiens
cccagcgcggcttggcc

SEQ ID NO: 3933493 - DNA, 22 bp, Homo sapiens
cccagcgcggcttggccgccat

SEQ ID NO: 3933494 - DNA, 23 bp, Homo sapiens
cccagcgcggcttggccgccatc

SEQ ID NO: 3933495 - DNA, 24 bp, Homo sapiens
cccagcgtttagtttctagaggcc

SEQ ID NO: 3933496 - DNA, 23 bp, Homo sapiens
cccagctacattcctcagctgcc

SEQ ID NO: 3933497 - DNA, 24 bp, Homo sapiens
cccagctacattcctcagctgcca

SEQ ID NO: 3933498 - DNA, 20 bp, Homo sapiens
cccagctactctgtccaggc

SEQ ID NO: 3933499 - DNA, 24 bp, Homo sapiens
cccagctactctgtccaggccact

SEQ ID NO: 3933500 - DNA, 15 bp, Homo sapiens
cccagctagggctgg

SEQ ID NO: 3933501 - DNA, 18 bp, Homo sapiens
cccagctatggccccagg

SEQ ID NO: 3933502 - DNA, 21 bp, Homo sapiens
cccagctatggccccagggtt

SEQ ID NO: 3933503 - DNA, 13 bp, Homo sapiens
cccagctctccct

SEQ ID NO: 3933504 - DNA, 14 bp, Homo sapiens
cccagctctccctc

SEQ ID NO: 3933505 - DNA, 15 bp, Homo sapiens
cccagctctccctct

SEQ ID NO: 3933506 - DNA, 19 bp, Homo sapiens
cccagctggtgggaagcgt

SEQ ID NO: 3933507 - DNA, 17 bp, Homo sapiens
cccagctgtagccatgg

SEQ ID NO: 3933508 - DNA, 16 bp, Homo sapiens
cccagcttcctggtgt

SEQ ID NO: 3933509 - DNA, 17 bp, Homo sapiens
cccagctttatctgtca

SEQ ID NO: 3933510 - DNA, 16 bp, Homo sapiens
cccaggacaagcatgg

SEQ ID NO: 3933511 - DNA, 21 bp, Homo sapiens
cccaggacaagcatggtccca

SEQ ID NO: 3933512 - DNA, 18 bp, Homo sapiens
cccaggagagccagccct

SEQ ID NO: 3933513 - DNA, 19 bp, Homo sapiens
cccaggagagccagccctc

SEQ ID NO: 3933514 - DNA, 21 bp, Homo sapiens
cccaggagagccagccctccc

SEQ ID NO: 3933515 - DNA, 22 bp, Homo sapiens
cccaggagagccagccctccct

SEQ ID NO: 3933516 - DNA, 22 bp, Homo sapiens
cccaggagctgagtcacctcct

SEQ ID NO: 3933517 - DNA, 23 bp, Homo sapiens
cccaggagctgagtcacctcctc

SEQ ID NO: 3933518 - DNA, 16 bp, Homo sapiens
cccaggatcccagagc

SEQ ID NO: 3933519 - DNA, 17 bp, Homo sapiens
cccaggatcccagagct

SEQ ID NO: 3933520 - DNA, 17 bp, Homo sapiens
cccaggccccatgacct

SEQ ID NO: 3933521 - DNA, 21 bp, Homo sapiens
cccaggccccatgacctccag

SEQ ID NO: 3933522 - DNA, 12 bp, Homo sapiens
cccaggccctcc

SEQ ID NO: 3933523 - DNA, 15 bp, Homo sapiens
cccaggccctccatg

SEQ ID NO: 3933524 - DNA, 14 bp, Homo sapiens
cccaggccctccct

SEQ ID NO: 3933525 - DNA, 13 bp, Homo sapiens
cccaggccgcctg

SEQ ID NO: 3933526 - DNA, 19 bp, Homo sapiens
cccaggccgcctgccatac

SEQ ID NO: 3933527 - DNA, 14 bp, Homo sapiens
cccaggccgttccc

SEQ ID NO: 3933528 - DNA, 13 bp, Homo sapiens
cccaggcctccag

SEQ ID NO: 3933529 - DNA, 14 bp, Homo sapiens
cccaggcctccagc

SEQ ID NO: 3933530 - DNA, 17 bp, Homo sapiens
cccaggcctccagcctc

SEQ ID NO: 3933531 - DNA, 19 bp, Homo sapiens
cccaggcctccagcctctc

SEQ ID NO: 3933532 - DNA, 22 bp, Homo sapiens
cccaggctccatggggaagtgc

SEQ ID NO: 3933533 - DNA, 15 bp, Homo sapiens
cccaggctctgggaa

SEQ ID NO: 3933534 - DNA, 18 bp, Homo sapiens
cccaggctgcactgcagt

SEQ ID NO: 3933535 - DNA, 14 bp, Homo sapiens
cccaggctggcctg

SEQ ID NO: 3933536 - DNA, 20 bp, Homo sapiens
cccagggagcaatgggaggg

SEQ ID NO: 3933537 - DNA, 17 bp, Homo sapiens
cccagggcacaggagct

SEQ ID NO: 3933538 - DNA, 22 bp, Homo sapiens
cccagggcacaggagctacctg

SEQ ID NO: 3933539 - DNA, 11 bp, Homo sapiens
cccagggcccc

SEQ ID NO: 3933540 - DNA, 13 bp, Homo sapiens
cccagggcccctc

SEQ ID NO: 3933541 - DNA, 17 bp, Homo sapiens
cccagggcccctccctc

SEQ ID NO: 3933542 - DNA, 21 bp, Homo sapiens
cccagggcccctccctctgcc

SEQ ID NO: 3933543 - DNA, 22 bp, Homo sapiens
cccagggcccctccctctgccc

SEQ ID NO: 3933544 - DNA, 13 bp, Homo sapiens
cccagggcctggg

SEQ ID NO: 3933545 - DNA, 14 bp, Homo sapiens
cccagggcctgggg

SEQ ID NO: 3933546 - DNA, 22 bp, Homo sapiens
ccctggcttttcactgctggct

SEQ ID NO: 3933547 - DNA, 20 bp, Homo sapiens
ccctgggatgggaccaggga

SEQ ID NO: 3933548 - DNA, 17 bp, Homo sapiens
ccctgggattcaggaaa

SEQ ID NO: 3933549 - DNA, 19 bp, Homo sapiens
ccctgggcacccacctcca

SEQ ID NO: 3933550 - DNA, 21 bp, Homo sapiens
ccctgggcatcttctggcttg

SEQ ID NO: 3933551 - DNA, 18 bp, Homo sapiens
ccctgggcccctccacgc

SEQ ID NO: 3933552 - DNA, 22 bp, Homo sapiens
ccctgggcccctccacgcctcc

SEQ ID NO: 3933553 - DNA, 13 bp, Homo sapiens
ccctgggcctcag

SEQ ID NO: 3933554 - DNA, 23 bp, Homo sapiens
ccctgggcctcagttcaacctgg

SEQ ID NO: 3933555 - DNA, 13 bp, Homo sapiens
ccctgggcctgct

SEQ ID NO: 3933556 - DNA, 19 bp, Homo sapiens
ccctggggatatgcaaccc

SEQ ID NO: 3933557 - DNA, 13 bp, Homo sapiens
ccctggggcctgt

SEQ ID NO: 3933558 - DNA, 17 bp, Homo sapiens
ccctggggcctgtactg

SEQ ID NO: 3933559 - DNA, 18 bp, Homo sapiens
ccctggggcctgtactgc

SEQ ID NO: 3933560 - DNA, 19 bp, Homo sapiens
ccctgggggaagccctgga

SEQ ID NO: 3933561 - DNA, 20 bp, Homo sapiens
ccctgggggaagccctggat

SEQ ID NO: 3933562 - DNA, 13 bp, Homo sapiens
ccctgggggccag

SEQ ID NO: 3933563 - DNA, 14 bp, Homo sapiens
ccctgggggccagc

SEQ ID NO: 3933564 - DNA, 19 bp, Homo sapiens
ccctgggtgccattcccag

SEQ ID NO: 3933565 - DNA, 15 bp, Homo sapiens
ccctggtcctgaggg

SEQ ID NO: 3933566 - DNA, 20 bp, Homo sapiens
ccccagatctgcctgggcct

SEQ ID NO: 3933567 - DNA, 22 bp, Homo sapiens
ccccagatctgcctgggcctgt

SEQ ID NO: 3933568 - DNA, 16 bp, Homo sapiens
ccccagccccctaaga

SEQ ID NO: 3933569 - DNA, 16 bp, Homo sapiens
ccccagcccttctgcc

SEQ ID NO: 3933570 - DNA, 20 bp, Homo sapiens
ccccagcctgggcctatgga

SEQ ID NO: 3933571 - DNA, 17 bp, Homo sapiens
ccccagctagggctgga

SEQ ID NO: 3933572 - DNA, 23 bp, Homo sapiens
ccccagctggcctctagaacacc

SEQ ID NO: 3933573 - DNA, 15 bp, Homo sapiens
ccccaggcatcccat

SEQ ID NO: 3933574 - DNA, 15 bp, Homo sapiens
ccccaggccaggcca

SEQ ID NO: 3933575 - DNA, 16 bp, Homo sapiens
ccccaggccctccctg

SEQ ID NO: 3933576 - DNA, 16 bp, Homo sapiens
ccccaggcctccagcc

SEQ ID NO: 3933577 - DNA, 18 bp, Homo sapiens
ccccaggcctccagcctc

SEQ ID NO: 3933578 - DNA, 15 bp, Homo sapiens
ccccaggcctctgtg

SEQ ID NO: 3933579 - DNA, 22 bp, Homo sapiens
ccccagggacaaaacactgtgt

SEQ ID NO: 3933580 - DNA, 12 bp, Homo sapiens
ccccagggcaca

SEQ ID NO: 3933581 - DNA, 17 bp, Homo sapiens
ccccagggcacaggagc

SEQ ID NO: 3933582 - DNA, 22 bp, Homo sapiens
ccccagggcagggaaactggct

SEQ ID NO: 3933583 - DNA, 22 bp, Homo sapiens
ccccagggcccctccctctgcc

SEQ ID NO: 3933584 - DNA, 12 bp, Homo sapiens
ccccagggccct

SEQ ID NO: 3933585 - DNA, 12 bp, Homo sapiens
ccccagggcctg

SEQ ID NO: 3933586 - DNA, 13 bp, Homo sapiens
ccccagggcctgg

SEQ ID NO: 3933587 - DNA, 18 bp, Homo sapiens
ccccaggtgccaccaata

SEQ ID NO: 3933588 - DNA, 21 bp, Homo sapiens
ccccaggtgccaccaataaaa

SEQ ID NO: 3933589 - DNA, 22 bp, Homo sapiens
ccccaggtgccaccaataaaaa

SEQ ID NO: 3933590 - DNA, 14 bp, Homo sapiens
ccccaggtgccagt

SEQ ID NO: 3933591 - DNA, 14 bp, Homo sapiens
ccccagttctgctc

SEQ ID NO: 3933592 - DNA, 16 bp, Homo sapiens
ccccagttctgctcct

SEQ ID NO: 3933593 - DNA, 17 bp, Homo sapiens
ccccagttctgctcctc

SEQ ID NO: 3933594 - DNA, 16 bp, Homo sapiens
ccccatcagcaccatg

SEQ ID NO: 3933595 - DNA, 21 bp, Homo sapiens
ccccatcagcaccatggaggc

SEQ ID NO: 3933596 - DNA, 14 bp, Homo sapiens
ccccatcccttcct

SEQ ID NO: 3933597 - DNA, 14 bp, Homo sapiens
ccccatctccccag

SEQ ID NO: 3933598 - DNA, 16 bp, Homo sapiens
ccccatgacctccagc

SEQ ID NO: 3933599 - DNA, 13 bp, Homo sapiens
ccccatgctctgc

SEQ ID NO: 3933600 - DNA, 15 bp, Homo sapiens
ccccatgctctgccc

SEQ ID NO: 3933601 - DNA, 17 bp, Homo sapiens
ccccatgctctgcccca

SEQ ID NO: 3933602 - DNA, 21 bp, Homo sapiens
ccccatgctctgccccaagcc

SEQ ID NO: 3933603 - DNA, 13 bp, Homo sapiens
ccccatgggcttg

SEQ ID NO: 3933604 - DNA, 14 bp, Homo sapiens
ccccatgggcttgg

SEQ ID NO: 3933605 - DNA, 15 bp, Homo sapiens
ccccatgtctctcag

SEQ ID NO: 3933606 - DNA, 23 bp, Homo sapiens
ccccattcttcctagttttctcc

SEQ ID NO: 3933607 - DNA, 11 bp, Homo sapiens
cccccaagcct

SEQ ID NO: 3933608 - DNA, 20 bp, Homo sapiens
cccccagaacctcaagtcta

SEQ ID NO: 3933609 - DNA, 12 bp, Homo sapiens
cccccagacaga

SEQ ID NO: 3933610 - DNA, 23 bp, Homo sapiens
cccccagcactaaggccgtgtct

SEQ ID NO: 3933611 - DNA, 12 bp, Homo sapiens
cccccagcctgg

SEQ ID NO: 3933612 - DNA, 13 bp, Homo sapiens
cccccagcctggg

SEQ ID NO: 3933613 - DNA, 14 bp, Homo sapiens
cccccagcctgggc

SEQ ID NO: 3933614 - DNA, 16 bp, Homo sapiens
cccccagcctgggcct

SEQ ID NO: 3933615 - DNA, 23 bp, Homo sapiens
cccccagctttgctaccaaagca

SEQ ID NO: 3933616 - DNA, 16 bp, Homo sapiens
cccccagtgccacaga

SEQ ID NO: 3933617 - DNA, 19 bp, Homo sapiens
cccccatctccccaggcct

SEQ ID NO: 3933618 - DNA, 14 bp, Homo sapiens
cccccatgtggctg

SEQ ID NO: 3933619 - DNA, 16 bp, Homo sapiens
cccccgacactgctgc

SEQ ID NO: 3933620 - DNA, 18 bp, Homo sapiens
cccccgacagcccagcct

SEQ ID NO: 3933621 - DNA, 17 bp, Homo sapiens
cccccgccacggccacc

SEQ ID NO: 3933622 - DNA, 13 bp, Homo sapiens
ccccctcatctca

SEQ ID NO: 3933623 - DNA, 13 bp, Homo sapiens
ccccctccagctc

SEQ ID NO: 3933624 - DNA, 16 bp, Homo sapiens
ccccctccaggcatgc

SEQ ID NO: 3933625 - DNA, 23 bp, Homo sapiens
ccccctgagtcaactggagcaag

SEQ ID NO: 3933626 - DNA, 20 bp, Homo sapiens
ccccctggatgtcccctgtc

SEQ ID NO: 3933627 - DNA, 18 bp, Homo sapiens
cccccttgaatctgcagg

SEQ ID NO: 3933628 - DNA, 20 bp, Homo sapiens
cccccttgaatctgcaggga

SEQ ID NO: 3933629 - DNA, 14 bp, Homo sapiens
ccccgacactgctg

SEQ ID NO: 3933630 - DNA, 16 bp, Homo sapiens
ccccgacactgctgca

SEQ ID NO: 3933631 - DNA, 13 bp, Homo sapiens
ccctctcccaggc

SEQ ID NO: 3933632 - DNA, 14 bp, Homo sapiens
ccctctcccaggcc

SEQ ID NO: 3933633 - DNA, 12 bp, Homo sapiens
ccctctcctgcc

SEQ ID NO: 3933634 - DNA, 17 bp, Homo sapiens
ccctctcctgcctactc

SEQ ID NO: 3933635 - DNA, 13 bp, Homo sapiens
ccctctcttccct

SEQ ID NO: 3933636 - DNA, 15 bp, Homo sapiens
ccctctcttccctat

SEQ ID NO: 3933637 - DNA, 17 bp, Homo sapiens
ccctctcttccctatta

SEQ ID NO: 3933638 - DNA, 21 bp, Homo sapiens
ccctctgagaattccaaggag

SEQ ID NO: 3933639 - DNA, 12 bp, Homo sapiens
ccctctgcccca

SEQ ID NO: 3933640 - DNA, 16 bp, Homo sapiens
ccctctgccccaagca

SEQ ID NO: 3933641 - DNA, 22 bp, Homo sapiens
ccctctgccccaagcagccagc

SEQ ID NO: 3933642 - DNA, 13 bp, Homo sapiens
ccctctgccctgt

SEQ ID NO: 3933643 - DNA, 16 bp, Homo sapiens
ccctctggccctgcct

SEQ ID NO: 3933644 - DNA, 15 bp, Homo sapiens
ccctctgggcagctg

SEQ ID NO: 3933645 - DNA, 20 bp, Homo sapiens
ccctctgtcatcactccctg

SEQ ID NO: 3933646 - DNA, 12 bp, Homo sapiens
ccctcttccttc

SEQ ID NO: 3933647 - DNA, 19 bp, Homo sapiens
ccctcttgacccatctccc

SEQ ID NO: 3933648 - DNA, 12 bp, Homo sapiens
ccctctttctac

SEQ ID NO: 3933649 - DNA, 22 bp, Homo sapiens
ccctctttctacattctcatct

SEQ ID NO: 3933650 - DNA, 16 bp, Homo sapiens
cctcagctgccaagca

SEQ ID NO: 3933651 - DNA, 19 bp, Homo sapiens
cctcagctgccaagcactc

SEQ ID NO: 3933652 - DNA, 16 bp, Homo sapiens
cctcagggacaacatt

SEQ ID NO: 3933653 - DNA, 23 bp, Homo sapiens
cctcagggatcttgcattcccag

SEQ ID NO: 3933654 - DNA, 17 bp, Homo sapiens
cctcaggggtggagaag

SEQ ID NO: 3933655 - DNA, 15 bp, Homo sapiens
cctcagtcagttccc

SEQ ID NO: 3933656 - DNA, 20 bp, Homo sapiens
cctcagtcagttcccggagc

SEQ ID NO: 3933657 - DNA, 21 bp, Homo sapiens
cctcagtcagttcccggagca

SEQ ID NO: 3933658 - DNA, 13 bp, Homo sapiens
cctcagtgccact

SEQ ID NO: 3933659 - DNA, 19 bp, Homo sapiens
cctcagtgccacttgacat

SEQ ID NO: 3933660 - DNA, 19 bp, Homo sapiens
cctcagtttctccatcagc

SEQ ID NO: 3933661 - DNA, 23 bp, Homo sapiens
cctcagtttttcggtgggacagc

SEQ ID NO: 3933662 - DNA, 17 bp, Homo sapiens
cctcatcctccttcttc

SEQ ID NO: 3933663 - DNA, 11 bp, Homo sapiens
cctcatctcct

SEQ ID NO: 3933664 - DNA, 15 bp, Homo sapiens
cctcatgccacacct

SEQ ID NO: 3933665 - DNA, 19 bp, Homo sapiens
cctcatgcctggcccccct

SEQ ID NO: 3933666 - DNA, 15 bp, Homo sapiens
cctcattcaggaaaa

SEQ ID NO: 3933667 - DNA, 15 bp, Homo sapiens
cctcattcccctcgt

SEQ ID NO: 3933668 - DNA, 17 bp, Homo sapiens
cctcattcgcctgtggg

SEQ ID NO: 3933669 - DNA, 20 bp, Homo sapiens
cctcatttatccctcaaccc

SEQ ID NO: 3933670 - DNA, 14 bp, Homo sapiens
cctccaaactcctg

SEQ ID NO: 3933671 - DNA, 15 bp, Homo sapiens
cctccaaactcctgc

SEQ ID NO: 3933672 - DNA, 16 bp, Homo sapiens
cctccaaactcctgcc

SEQ ID NO: 3933673 - DNA, 19 bp, Homo sapiens
cctccaaactcctgcctgt

SEQ ID NO: 3933674 - DNA, 18 bp, Homo sapiens
cctccaacaataaagagc

SEQ ID NO: 3933675 - DNA, 17 bp, Homo sapiens
cctccaagccattcact

SEQ ID NO: 3933676 - DNA, 22 bp, Homo sapiens
cctccaatcccaccaaccctca

SEQ ID NO: 3933677 - DNA, 14 bp, Homo sapiens
cctccacagtgctg

SEQ ID NO: 3933678 - DNA, 18 bp, Homo sapiens
cctccacagtgctgcttc

SEQ ID NO: 3933679 - DNA, 19 bp, Homo sapiens
cctccacccccgccacggc

SEQ ID NO: 3933680 - DNA, 18 bp, Homo sapiens
cctccacctctccttgga

SEQ ID NO: 3933681 - DNA, 14 bp, Homo sapiens
cctccacctcttca

SEQ ID NO: 3933682 - DNA, 19 bp, Homo sapiens
cctccaccttgctcttctt

SEQ ID NO: 3933683 - DNA, 17 bp, Homo sapiens
cctccacgcctcctggc

SEQ ID NO: 3933684 - DNA, 22 bp, Homo sapiens
cctccacgggggcggcaggctg

SEQ ID NO: 3933685 - DNA, 15 bp, Homo sapiens
cctccactcactcca

SEQ ID NO: 3933686 - DNA, 16 bp, Homo sapiens
cctccactcactccag

SEQ ID NO: 3933687 - DNA, 21 bp, Homo sapiens
cctccactcactccagcccaa

SEQ ID NO: 3933688 - DNA, 14 bp, Homo sapiens
cctccactccacct

SEQ ID NO: 3933689 - DNA, 16 bp, Homo sapiens
cctccactccacctcc

SEQ ID NO: 3933690 - DNA, 21 bp, Homo sapiens
cctccactcccccacctgaca

SEQ ID NO: 3933691 - DNA, 17 bp, Homo sapiens
cctccagacagatacag

SEQ ID NO: 3933692 - DNA, 18 bp, Homo sapiens
cctccagaccctgcctga

SEQ ID NO: 3933693 - DNA, 16 bp, Homo sapiens
cctccagagacaggaa

SEQ ID NO: 3933694 - DNA, 11 bp, Homo sapiens
cctccagagcc

SEQ ID NO: 3933695 - DNA, 16 bp, Homo sapiens
cctccagagccagcct

SEQ ID NO: 3933696 - DNA, 19 bp, Homo sapiens
cctccagagccagcctggg

SEQ ID NO: 3933697 - DNA, 17 bp, Homo sapiens
cctccagcctctcccgg

SEQ ID NO: 3933698 - DNA, 18 bp, Homo sapiens
cctccagcctctcccggc

SEQ ID NO: 3933699 - DNA, 13 bp, Homo sapiens
cctccagctccag

SEQ ID NO: 3933700 - DNA, 10 bp, Homo sapiens
cctccaggca

SEQ ID NO: 3933701 - DNA, 16 bp, Homo sapiens
cctccaggcatgctgg

SEQ ID NO: 3933702 - DNA, 21 bp, Homo sapiens
cctccagggaatccgcctgca

SEQ ID NO: 3933703 - DNA, 12 bp, Homo sapiens
cctccagggcca

SEQ ID NO: 3933704 - DNA, 16 bp, Homo sapiens
cctccagggccacgtg

SEQ ID NO: 3933705 - DNA, 19 bp, Homo sapiens
cctccagggccacgtgcca

SEQ ID NO: 3933706 - DNA, 22 bp, Homo sapiens
cctccagggccacgtgccaggc

SEQ ID NO: 3933707 - DNA, 16 bp, Homo sapiens
cctccatgctgcctcc

SEQ ID NO: 3933708 - DNA, 15 bp, Homo sapiens
cctccattctgacca

SEQ ID NO: 3933709 - DNA, 22 bp, Homo sapiens
cctccatttctctccaggaagt

SEQ ID NO: 3933710 - DNA, 12 bp, Homo sapiens
cctcccaacctc

SEQ ID NO: 3933711 - DNA, 16 bp, Homo sapiens
cctcccaacctcaatg

SEQ ID NO: 3933712 - DNA, 18 bp, Homo sapiens
cctcccaataaagctgga

SEQ ID NO: 3933713 - DNA, 18 bp, Homo sapiens
cctcccaccccactccag

SEQ ID NO: 3933714 - DNA, 21 bp, Homo sapiens
cctcccaccccactccagccc

SEQ ID NO: 3933715 - DNA, 12 bp, Homo sapiens
cctcccagatcc

SEQ ID NO: 3933716 - DNA, 13 bp, Homo sapiens
cctcccagcccta

SEQ ID NO: 3933717 - DNA, 20 bp, Homo sapiens
cctcccagccctatggatgt

SEQ ID NO: 3933718 - DNA, 17 bp, Homo sapiens
cctcccatcccctggac

SEQ ID NO: 3933719 - DNA, 18 bp, Homo sapiens
cctcccatggccttccct

SEQ ID NO: 3933720 - DNA, 19 bp, Homo sapiens
cctcccatgttgcatgcct

SEQ ID NO: 3933721 - DNA, 19 bp, Homo sapiens
cctccccaaacccatcaga

SEQ ID NO: 3933722 - DNA, 23 bp, Homo sapiens
cctccccacagtcctcacagcct

SEQ ID NO: 3933723 - DNA, 12 bp, Homo sapiens
cctccccagggg

SEQ ID NO: 3933724 - DNA, 13 bp, Homo sapiens
cctccccccactg

SEQ ID NO: 3933725 - DNA, 15 bp, Homo sapiens
cctccccccactgca

SEQ ID NO: 3933726 - DNA, 16 bp, Homo sapiens
cctccccccactgcag

SEQ ID NO: 3933727 - DNA, 20 bp, Homo sapiens
cctccccccactgcaggccc

SEQ ID NO: 3933728 - DNA, 14 bp, Homo sapiens
cctccccctgccag

SEQ ID NO: 3933729 - DNA, 20 bp, Homo sapiens
cctccccctgccagtgcctt

SEQ ID NO: 3933730 - DNA, 13 bp, Homo sapiens
cctccccctgctg

SEQ ID NO: 3933731 - DNA, 15 bp, Homo sapiens
cctcccctatccacc

SEQ ID NO: 3933732 - DNA, 18 bp, Homo sapiens
cctcccctatccacccag

SEQ ID NO: 3933733 - DNA, 20 bp, Homo sapiens
cctcccctgcccccatccca

SEQ ID NO: 3933734 - DNA, 17 bp, Homo sapiens
cctcccgggagcacaga

SEQ ID NO: 3933735 - DNA, 18 bp, Homo sapiens
cctccctcctctggccca

SEQ ID NO: 3933736 - DNA, 21 bp, Homo sapiens
ccgagcagctgagcagggccg

SEQ ID NO: 3933737 - DNA, 12 bp, Homo sapiens
ccgagcccagct

SEQ ID NO: 3933738 - DNA, 16 bp, Homo sapiens
ccgagcccagctacat

SEQ ID NO: 3933739 - DNA, 21 bp, Homo sapiens
ccgagcccagctacattcctc

SEQ ID NO: 3933740 - DNA, 21 bp, Homo sapiens
ccgagctactctcttgccagc

SEQ ID NO: 3933741 - DNA, 23 bp, Homo sapiens
ccgagctactctcttgccagcat

SEQ ID NO: 3933742 - DNA, 22 bp, Homo sapiens
ccgagtctcttctccactggat

SEQ ID NO: 3933743 - DNA, 14 bp, Homo sapiens
ccgattaatttatg

SEQ ID NO: 3933744 - DNA, 15 bp, Homo sapiens
ccgattaatttatgg

SEQ ID NO: 3933745 - DNA, 23 bp, Homo sapiens
ccgcaagttcagggaagcaggca

SEQ ID NO: 3933746 - DNA, 16 bp, Homo sapiens
ccgcaccagctgctct

SEQ ID NO: 3933747 - DNA, 18 bp, Homo sapiens
ccgcaccagctgctctgc

SEQ ID NO: 3933748 - DNA, 22 bp, Homo sapiens
ccgcaccagctgctctgcccct

SEQ ID NO: 3933749 - DNA, 17 bp, Homo sapiens
ccgcaccccagagtgtg

SEQ ID NO: 3933750 - DNA, 14 bp, Homo sapiens
ccgcactcacccat

SEQ ID NO: 3933751 - DNA, 23 bp, Homo sapiens
ccgcagccagccggtgcctggcg

SEQ ID NO: 3933752 - DNA, 23 bp, Homo sapiens
ccgcagcccgtgaagcagtgcct

SEQ ID NO: 3933753 - DNA, 15 bp, Homo sapiens
ccgcagggacgggga

SEQ ID NO: 3933754 - DNA, 15 bp, Homo sapiens
ccgcagtccccagcc

SEQ ID NO: 3933755 - DNA, 19 bp, Homo sapiens
ccgcagtgcccccacccag

SEQ ID NO: 3933756 - DNA, 19 bp, Homo sapiens
ccgcatcttctccatctgg

SEQ ID NO: 3933757 - DNA, 19 bp, Homo sapiens
ccgccatccgggacgcttc

SEQ ID NO: 3933758 - DNA, 19 bp, Homo sapiens
ccgcccaaggggacttgtg

SEQ ID NO: 3933759 - DNA, 24 bp, Homo sapiens
ccgccctgggctgtctgtcaccag

SEQ ID NO: 3933760 - DNA, 15 bp, Homo sapiens
ccgcctcccagcctg

SEQ ID NO: 3933761 - DNA, 16 bp, Homo sapiens
ccgcctctgcccgcag

SEQ ID NO: 3933762 - DNA, 15 bp, Homo sapiens
ccgcctgcagaggac

SEQ ID NO: 3933763 - DNA, 20 bp, Homo sapiens
ccgcctgccataccgctggg

SEQ ID NO: 3933764 - DNA, 20 bp, Homo sapiens
ccgcggtaggtaagggccgc

SEQ ID NO: 3933765 - DNA, 17 bp, Homo sapiens
ccgcggtgctctggcgg

SEQ ID NO: 3933766 - DNA, 16 bp, Homo sapiens
ccgcgtctaccctggg

SEQ ID NO: 3933767 - DNA, 11 bp, Homo sapiens
ccgctcagccc

SEQ ID NO: 3933768 - DNA, 19 bp, Homo sapiens
ccgctcagccctccctgcc

SEQ ID NO: 3933769 - DNA, 13 bp, Homo sapiens
ccgctccagatct

SEQ ID NO: 3933770 - DNA, 18 bp, Homo sapiens
ccgctccagatctgcact

SEQ ID NO: 3933771 - DNA, 21 bp, Homo sapiens
ccgctcctttacctaccacct

SEQ ID NO: 3933772 - DNA, 21 bp, Homo sapiens
ccgctgccaccacgtctgcca

SEQ ID NO: 3933773 - DNA, 23 bp, Homo sapiens
ccgctgccaccacgtctgccagg

SEQ ID NO: 3933774 - DNA, 15 bp, Homo sapiens
ccgctgccgctgcac

SEQ ID NO: 3933775 - DNA, 16 bp, Homo sapiens
ccgctgccgctgcacc

SEQ ID NO: 3933776 - DNA, 19 bp, Homo sapiens
ccgctgcctaagtggctgc

SEQ ID NO: 3933777 - DNA, 20 bp, Homo sapiens
ccgctgcctaagtggctgct

SEQ ID NO: 3933778 - DNA, 17 bp, Homo sapiens
ccgctgccttttgctgc

SEQ ID NO: 3933779 - DNA, 18 bp, Homo sapiens
ccgctggggaacagagcg

SEQ ID NO: 3933780 - DNA, 16 bp, Homo sapiens
ccgctgtcgccccagg

SEQ ID NO: 3933781 - DNA, 20 bp, Homo sapiens
ccgctgtgagcccctggtcc

SEQ ID NO: 3933782 - DNA, 18 bp, Homo sapiens
ccgcttcacccctgcact

SEQ ID NO: 3933783 - DNA, 12 bp, Homo sapiens
ccgcttcccaga

SEQ ID NO: 3933784 - DNA, 13 bp, Homo sapiens
ccgcttcccagag

SEQ ID NO: 3933785 - DNA, 15 bp, Homo sapiens
ccgcttcccagaggc

SEQ ID NO: 3933786 - DNA, 13 bp, Homo sapiens
ccgcttcctgttt

SEQ ID NO: 3933787 - DNA, 16 bp, Homo sapiens
ccgcttgtccagcgcc

SEQ ID NO: 3933788 - DNA, 22 bp, Homo sapiens
ccggaccaagatgggcacatga

SEQ ID NO: 3933789 - DNA, 23 bp, Homo sapiens
ccggacggacgttggttctgcac

SEQ ID NO: 3933790 - DNA, 16 bp, Homo sapiens
ccggagaattgcctct

SEQ ID NO: 3933791 - DNA, 15 bp, Homo sapiens
ccggagcacagccct

SEQ ID NO: 3933792 - DNA, 21 bp, Homo sapiens
ccggagcacagccctgggagg

SEQ ID NO: 3933793 - DNA, 21 bp, Homo sapiens
ccggagctttcaaagaaggaa

SEQ ID NO: 3933794 - DNA, 15 bp, Homo sapiens
ccggaggggcctggc

SEQ ID NO: 3933795 - DNA, 21 bp, Homo sapiens
ccggaggggttgcgggggagc

SEQ ID NO: 3933796 - DNA, 20 bp, Homo sapiens
ccggcaaccccagttctgct

SEQ ID NO: 3933797 - DNA, 14 bp, Homo sapiens
ccggcaccccctgc

SEQ ID NO: 3933798 - DNA, 20 bp, Homo sapiens
ccggcaccccctgcagcttg

SEQ ID NO: 3933799 - DNA, 16 bp, Homo sapiens
ccggccagggcctggt

SEQ ID NO: 3933800 - DNA, 18 bp, Homo sapiens
ccggcccagagacccctt

SEQ ID NO: 3933801 - DNA, 18 bp, Homo sapiens
ccggcccagcctaggccc

SEQ ID NO: 3933802 - DNA, 15 bp, Homo sapiens
ccggcctccactccc

SEQ ID NO: 3933803 - DNA, 23 bp, Homo sapiens
ccggcctccactcccccacctga

SEQ ID NO: 3933804 - DNA, 20 bp, Homo sapiens
ccggcctgctcccagcagcc

SEQ ID NO: 3933805 - DNA, 13 bp, Homo sapiens
ccggcgctgcagg

SEQ ID NO: 3933806 - DNA, 13 bp, Homo sapiens
ccggctaactctg

SEQ ID NO: 3933807 - DNA, 14 bp, Homo sapiens
ccggctgcctgccg

SEQ ID NO: 3933808 - DNA, 13 bp, Homo sapiens
ccggctgcttcct

SEQ ID NO: 3933809 - DNA, 22 bp, Homo sapiens
ccgggacgcttccagaccacct

SEQ ID NO: 3933810 - DNA, 17 bp, Homo sapiens
ccgggagaggactctgc

SEQ ID NO: 3933811 - DNA, 16 bp, Homo sapiens
ccgggagcctccccct

SEQ ID NO: 3933812 - DNA, 21 bp, Homo sapiens
ccgggcaggtcctgcccatgt

SEQ ID NO: 3933813 - DNA, 22 bp, Homo sapiens
ccgggcatggtggcgcaagcct

SEQ ID NO: 3933814 - DNA, 18 bp, Homo sapiens
ccgggccactccttcctg

SEQ ID NO: 3933815 - DNA, 21 bp, Homo sapiens
ccgggccactccttcctgccc

SEQ ID NO: 3933816 - DNA, 17 bp, Homo sapiens
ccgggccatgctttcct

SEQ ID NO: 3933817 - DNA, 13 bp, Homo sapiens
ccgggcctggggc

SEQ ID NO: 3933818 - DNA, 16 bp, Homo sapiens
ccgggcggaaggggac

SEQ ID NO: 3933819 - DNA, 12 bp, Homo sapiens
ccgggctctgac

SEQ ID NO: 3933820 - DNA, 23 bp, Homo sapiens
ccgggctgcccttcgctgccagg

SEQ ID NO: 3933821 - DNA, 19 bp, Homo sapiens
cctaaggatctctcaggag

SEQ ID NO: 3933822 - DNA, 22 bp, Homo sapiens
cctaaggatctctcaggagcac

SEQ ID NO: 3933823 - DNA, 24 bp, Homo sapiens
cctaaggatctctcaggagcacag

SEQ ID NO: 3933824 - DNA, 15 bp, Homo sapiens
cctaagtggctgctg

SEQ ID NO: 3933825 - DNA, 22 bp, Homo sapiens
cctaagtgggaagtgaagcccc

SEQ ID NO: 3933826 - DNA, 23 bp, Homo sapiens
cctaagtgggaagtgaagcccct

SEQ ID NO: 3933827 - DNA, 17 bp, Homo sapiens
cctaatcaggctgaggt

SEQ ID NO: 3933828 - DNA, 21 bp, Homo sapiens
cctaatctcatacctctgacc

SEQ ID NO: 3933829 - DNA, 21 bp, Homo sapiens
cctaattcctggcatgacact

SEQ ID NO: 3933830 - DNA, 13 bp, Homo sapiens
cctacaaaatgga

SEQ ID NO: 3933831 - DNA, 20 bp, Homo sapiens
cctacacccttggacttgag

SEQ ID NO: 3933832 - DNA, 14 bp, Homo sapiens
cctacacctccctc

SEQ ID NO: 3933833 - DNA, 21 bp, Homo sapiens
cctacagaaatactgctctga

SEQ ID NO: 3933834 - DNA, 18 bp, Homo sapiens
cctaccaaatataaactt

SEQ ID NO: 3933835 - DNA, 12 bp, Homo sapiens
cctaccaatgca

SEQ ID NO: 3933836 - DNA, 13 bp, Homo sapiens
cctaccaatgcat

SEQ ID NO: 3933837 - DNA, 22 bp, Homo sapiens
cctaccaatgcatgcagccact

SEQ ID NO: 3933838 - DNA, 17 bp, Homo sapiens
cctaccaccccttcctg

SEQ ID NO: 3933839 - DNA, 17 bp, Homo sapiens
cctaccaccttccctct

SEQ ID NO: 3933840 - DNA, 15 bp, Homo sapiens
cctaccatgctgctt

SEQ ID NO: 3933841 - DNA, 14 bp, Homo sapiens
cctacccactcttt

SEQ ID NO: 3933842 - DNA, 16 bp, Homo sapiens
cctacccactctttgc

SEQ ID NO: 3933843 - DNA, 20 bp, Homo sapiens
cctacccactctttgctaca

SEQ ID NO: 3933844 - DNA, 22 bp, Homo sapiens
cctacccagagattgcttctca

SEQ ID NO: 3933845 - DNA, 19 bp, Homo sapiens
cctaccccacctcatgcct

SEQ ID NO: 3933846 - DNA, 22 bp, Homo sapiens
cctacccttgtaccccatccct

SEQ ID NO: 3933847 - DNA, 19 bp, Homo sapiens
cctaccgagtctcttctcc

SEQ ID NO: 3933848 - DNA, 21 bp, Homo sapiens
cctaccgagtctcttctccac

SEQ ID NO: 3933849 - DNA, 17 bp, Homo sapiens
cctcaaatgtcagagct

SEQ ID NO: 3933850 - DNA, 15 bp, Homo sapiens
cctcaagaacacctt

SEQ ID NO: 3933851 - DNA, 15 bp, Homo sapiens
cctcaatgccctgcc

SEQ ID NO: 3933852 - DNA, 14 bp, Homo sapiens
cctcaatgtgacca

SEQ ID NO: 3933853 - DNA, 15 bp, Homo sapiens
cctcacagcctctcc

SEQ ID NO: 3933854 - DNA, 19 bp, Homo sapiens
cctcacagcctctccctta

SEQ ID NO: 3933855 - DNA, 16 bp, Homo sapiens
cctcacaggagcagac

SEQ ID NO: 3933856 - DNA, 18 bp, Homo sapiens
cctcacaggagcagacag

SEQ ID NO: 3933857 - DNA, 19 bp, Homo sapiens
cctcacagtgacccttccc

SEQ ID NO: 3933858 - DNA, 24 bp, Homo sapiens
cctcacagtgacccttcccaatca

SEQ ID NO: 3933859 - DNA, 21 bp, Homo sapiens
cctcacccccaggtgttgcca

SEQ ID NO: 3933860 - DNA, 16 bp, Homo sapiens
cctcaccccgtctggg

SEQ ID NO: 3933861 - DNA, 17 bp, Homo sapiens
cctcaccccgtctgggg

SEQ ID NO: 3933862 - DNA, 23 bp, Homo sapiens
cctcactatggtatgctggccag

SEQ ID NO: 3933863 - DNA, 17 bp, Homo sapiens
cctcactctggcctcag

SEQ ID NO: 3933864 - DNA, 15 bp, Homo sapiens
cctcactctgtcagc

SEQ ID NO: 3933865 - DNA, 14 bp, Homo sapiens
cctcacttccctgg

SEQ ID NO: 3933866 - DNA, 18 bp, Homo sapiens
cctcagaccaactctctc

SEQ ID NO: 3933867 - DNA, 20 bp, Homo sapiens
cctcagaccaactctctcct

SEQ ID NO: 3933868 - DNA, 14 bp, Homo sapiens
cctcagagcaggct

SEQ ID NO: 3933869 - DNA, 12 bp, Homo sapiens
cctcagagctct

SEQ ID NO: 3933870 - DNA, 15 bp, Homo sapiens
cctcagccaaacaca

SEQ ID NO: 3933871 - DNA, 16 bp, Homo sapiens
cctcagccatgaggag

SEQ ID NO: 3933872 - DNA, 21 bp, Homo sapiens
cctcagccatgaggagttgct

SEQ ID NO: 3933873 - DNA, 16 bp, Homo sapiens
cctcagccctcagaac

SEQ ID NO: 3933874 - DNA, 17 bp, Homo sapiens
cctcagcctcccagagt

SEQ ID NO: 3933875 - DNA, 14 bp, Homo sapiens
cctcagctcagcct

SEQ ID NO: 3933876 - DNA, 13 bp, Homo sapiens
cctcagctgcaca

SEQ ID NO: 3933877 - DNA, 14 bp, Homo sapiens
cctcagctgcacat

SEQ ID NO: 3933878 - DNA, 15 bp, Homo sapiens
cctcagctgccaagc

SEQ ID NO: 3933879 - DNA, 13 bp, Homo sapiens
cctctctctaagt

SEQ ID NO: 3933880 - DNA, 19 bp, Homo sapiens
cctctctctaagtttagaa

SEQ ID NO: 3933881 - DNA, 16 bp, Homo sapiens
cctctctcttcccagc

SEQ ID NO: 3933882 - DNA, 12 bp, Homo sapiens
cctctctgctat

SEQ ID NO: 3933883 - DNA, 15 bp, Homo sapiens
cctctctgctccaga

SEQ ID NO: 3933884 - DNA, 13 bp, Homo sapiens
cctctcttcagcc

SEQ ID NO: 3933885 - DNA, 21 bp, Homo sapiens
cctctgaaatttcccacaccc

SEQ ID NO: 3933886 - DNA, 19 bp, Homo sapiens
cctctgagaattccaagga

SEQ ID NO: 3933887 - DNA, 17 bp, Homo sapiens
cctctgaggccagcctg

SEQ ID NO: 3933888 - DNA, 19 bp, Homo sapiens
cctctgaggccagcctggc

SEQ ID NO: 3933889 - DNA, 22 bp, Homo sapiens
cctctgaggccagcctggcctc

SEQ ID NO: 3933890 - DNA, 15 bp, Homo sapiens
cctctgatacccaga

SEQ ID NO: 3933891 - DNA, 20 bp, Homo sapiens
cctctgatacccagagcatt

SEQ ID NO: 3933892 - DNA, 11 bp, Homo sapiens
cctctgccacc

SEQ ID NO: 3933893 - DNA, 14 bp, Homo sapiens
cctctgccccaagc

SEQ ID NO: 3933894 - DNA, 17 bp, Homo sapiens
cctctgccccaagcagc

SEQ ID NO: 3933895 - DNA, 21 bp, Homo sapiens
cctctgccccaagcagccagc

SEQ ID NO: 3933896 - DNA, 22 bp, Homo sapiens
cctctgccccaagcagccagcc

SEQ ID NO: 3933897 - DNA, 23 bp, Homo sapiens
cctctgccccaagcagccagcca

SEQ ID NO: 3933898 - DNA, 16 bp, Homo sapiens
cctctgccccaagggg

SEQ ID NO: 3933899 - DNA, 19 bp, Homo sapiens
cctctgccccaaggggccc

SEQ ID NO: 3933900 - DNA, 16 bp, Homo sapiens
cctctgccctgcctcc

SEQ ID NO: 3933901 - DNA, 18 bp, Homo sapiens
cctctgccctgcctccct

SEQ ID NO: 3933902 - DNA, 13 bp, Homo sapiens
cctctgccctgta

SEQ ID NO: 3933903 - DNA, 15 bp, Homo sapiens
cctctgcctgtctcc

SEQ ID NO: 3933904 - DNA, 13 bp, Homo sapiens
cctctggatccct

SEQ ID NO: 3933905 - DNA, 18 bp, Homo sapiens
cctctggatcctgctgtg

SEQ ID NO: 3933906 - DNA, 21 bp, Homo sapiens
cctctgtcatcactccctgga

SEQ ID NO: 3933907 - DNA, 22 bp, Homo sapiens
cctctgtcatcactccctggat

SEQ ID NO: 3933908 - DNA, 15 bp, Homo sapiens
cctctgtctcgagcg

SEQ ID NO: 3933909 - DNA, 19 bp, Homo sapiens
cctctgtctcgagcgccct

SEQ ID NO: 3933910 - DNA, 21 bp, Homo sapiens
cctctgtctcgagcgccctgc

SEQ ID NO: 3933911 - DNA, 19 bp, Homo sapiens
cctctgtgtcctctcccct

SEQ ID NO: 3933912 - DNA, 13 bp, Homo sapiens
cctctgtgtcctt

SEQ ID NO: 3933913 - DNA, 21 bp, Homo sapiens
cctcttaaagctgcctgtagt

SEQ ID NO: 3933914 - DNA, 23 bp, Homo sapiens
cctcttaaagctgcctgtagtta

SEQ ID NO: 3933915 - DNA, 13 bp, Homo sapiens
cctcttcaccccc

SEQ ID NO: 3933916 - DNA, 17 bp, Homo sapiens
cctcttcaccccccact

SEQ ID NO: 3933917 - DNA, 15 bp, Homo sapiens
cctcttccacccatt

SEQ ID NO: 3933918 - DNA, 18 bp, Homo sapiens
cctcttctattttgtaaa

SEQ ID NO: 3933919 - DNA, 16 bp, Homo sapiens
cctcttcttcttcaga

SEQ ID NO: 3933920 - DNA, 17 bp, Homo sapiens
cctcttcttcttcagaa

SEQ ID NO: 3933921 - DNA, 22 bp, Homo sapiens
cctcttgccactgcctcttcct

SEQ ID NO: 3933922 - DNA, 15 bp, Homo sapiens
cctcttgcctctctc

SEQ ID NO: 3933923 - DNA, 17 bp, Homo sapiens
cctcttgcctctctcag

SEQ ID NO: 3933924 - DNA, 12 bp, Homo sapiens
cctcttgttgca

SEQ ID NO: 3933925 - DNA, 17 bp, Homo sapiens
cctcttgttgcagagat

SEQ ID NO: 3933926 - DNA, 22 bp, Homo sapiens
cctctttactcccttcctggcc

SEQ ID NO: 3933927 - DNA, 23 bp, Homo sapiens
cctctttactcccttcctggcct

SEQ ID NO: 3933928 - DNA, 16 bp, Homo sapiens
cctcttttccctctct

SEQ ID NO: 3933929 - DNA, 18 bp, Homo sapiens
cctcttttccctctctag

SEQ ID NO: 3933930 - DNA, 12 bp, Homo sapiens
cctgaaaaactg

SEQ ID NO: 3933931 - DNA, 20 bp, Homo sapiens
cctgaaaaactgatcaaaaa

SEQ ID NO: 3933932 - DNA, 22 bp, Homo sapiens
cctgaaaaactgatcaaaaata

SEQ ID NO: 3933933 - DNA, 23 bp, Homo sapiens
cctgaaaaactgatcaaaaataa

SEQ ID NO: 3933934 - DNA, 13 bp, Homo sapiens
cctgaaaacccag

SEQ ID NO: 3933935 - DNA, 19 bp, Homo sapiens
cctgaaaacgaaggggccc

SEQ ID NO: 3933936 - DNA, 21 bp, Homo sapiens
cctgaaaacgaaggggccccg

SEQ ID NO: 3933937 - DNA, 15 bp, Homo sapiens
cctgaaatttcagat

SEQ ID NO: 3933938 - DNA, 16 bp, Homo sapiens
cctgaacaagaattgg

SEQ ID NO: 3933939 - DNA, 19 bp, Homo sapiens
cctgaaccccatgggcttg

SEQ ID NO: 3933940 - DNA, 12 bp, Homo sapiens
cctgaagccaga

SEQ ID NO: 3933941 - DNA, 13 bp, Homo sapiens
cctgaagccagat

SEQ ID NO: 3933942 - DNA, 17 bp, Homo sapiens
cctgaagcctctgccct

SEQ ID NO: 3933943 - DNA, 23 bp, Homo sapiens
cctgaagcctctgccctgcctcc

SEQ ID NO: 3933944 - DNA, 18 bp, Homo sapiens
cctgaagggtgacatccc

SEQ ID NO: 3933945 - DNA, 20 bp, Homo sapiens
cctgaatggttccatgcctg

SEQ ID NO: 3933946 - DNA, 21 bp, Homo sapiens
cctgaatggttccatgcctga

SEQ ID NO: 3933947 - DNA, 14 bp, Homo sapiens
cctgacaagcactg

SEQ ID NO: 3933948 - DNA, 20 bp, Homo sapiens
cctgacaagcactgctaggc

SEQ ID NO: 3933949 - DNA, 16 bp, Homo sapiens
cctgacaatggcagct

SEQ ID NO: 3933950 - DNA, 17 bp, Homo sapiens
cctgacaatggcagcta

SEQ ID NO: 3933951 - DNA, 20 bp, Homo sapiens
cctgacaggttcccagcagc

SEQ ID NO: 3933952 - DNA, 15 bp, Homo sapiens
cctgacccagtcccc

SEQ ID NO: 3933953 - DNA, 15 bp, Homo sapiens
cctgacccctgcacc

SEQ ID NO: 3933954 - DNA, 23 bp, Homo sapiens
cctgaccctccaccgcagaagga

SEQ ID NO: 3933955 - DNA, 16 bp, Homo sapiens
cctgaccctccctacc

SEQ ID NO: 3933956 - DNA, 14 bp, Homo sapiens
cctgacctcccagc

SEQ ID NO: 3933957 - DNA, 13 bp, Homo sapiens
cctgacctgaggc

SEQ ID NO: 3933958 - DNA, 13 bp, Homo sapiens
cctgacgccctgc

SEQ ID NO: 3933959 - DNA, 14 bp, Homo sapiens
cctgacgccctgcg

SEQ ID NO: 3933960 - DNA, 19 bp, Homo sapiens
cctgacggacgtcctgctg

SEQ ID NO: 3933961 - DNA, 20 bp, Homo sapiens
cctgactccagtgagctgga

SEQ ID NO: 3933962 - DNA, 17 bp, Homo sapiens
cctgactccctgtgggg

SEQ ID NO: 3933963 - DNA, 17 bp, Homo sapiens
cctgagatcagagtcct

SEQ ID NO: 3933964 - DNA, 12 bp, Homo sapiens
cctgagcactgc

SEQ ID NO: 3933965 - DNA, 22 bp, Homo sapiens
cctgatcattacatggctgtgg

SEQ ID NO: 3933966 - DNA, 15 bp, Homo sapiens
cctgatgccccttcc

SEQ ID NO: 3933967 - DNA, 16 bp, Homo sapiens
cctgatgccccttccc

SEQ ID NO: 3933968 - DNA, 14 bp, Homo sapiens
cctgatgctgcccc

SEQ ID NO: 3933969 - DNA, 16 bp, Homo sapiens
cctgatgctgccccgt

SEQ ID NO: 3933970 - DNA, 21 bp, Homo sapiens
cctgatggcacttagctatca

SEQ ID NO: 3933971 - DNA, 12 bp, Homo sapiens
cctgatggccaa

SEQ ID NO: 3933972 - DNA, 13 bp, Homo sapiens
cctgatggccaag

SEQ ID NO: 3933973 - DNA, 17 bp, Homo sapiens
cctgatggccaagagca

SEQ ID NO: 3933974 - DNA, 19 bp, Homo sapiens
cctgatggccaagagcatc

SEQ ID NO: 3933975 - DNA, 18 bp, Homo sapiens
cctgatttagatatgcaa

SEQ ID NO: 3933976 - DNA, 17 bp, Homo sapiens
cctgatttcagggaaat

SEQ ID NO: 3933977 - DNA, 17 bp, Homo sapiens
cctgatttctctgaaca

SEQ ID NO: 3933978 - DNA, 15 bp, Homo sapiens
cctgcaagccccagg

SEQ ID NO: 3933979 - DNA, 16 bp, Homo sapiens
cctgcaagccccaggg

SEQ ID NO: 3933980 - DNA, 12 bp, Homo sapiens
cctgcaaggact

SEQ ID NO: 3933981 - DNA, 22 bp, Homo sapiens
cctgcacaaagcccttccatgt

SEQ ID NO: 3933982 - DNA, 22 bp, Homo sapiens
cctgcaccagcccttccctgct

SEQ ID NO: 3933983 - DNA, 15 bp, Homo sapiens
cctgcaccctggaaa

SEQ ID NO: 3933984 - DNA, 20 bp, Homo sapiens
cctgcaccctggaaagggga

SEQ ID NO: 3933985 - DNA, 20 bp, Homo sapiens
cctgcacctccccccactgc

SEQ ID NO: 3933986 - DNA, 22 bp, Homo sapiens
cctgcacctccccccactgcag

SEQ ID NO: 3933987 - DNA, 22 bp, Homo sapiens
cctgcacgccaccgctgccttt

SEQ ID NO: 3933988 - DNA, 15 bp, Homo sapiens
cctgcagaccctgcc

SEQ ID NO: 3933989 - DNA, 16 bp, Homo sapiens
cctgcagaccctgccc

SEQ ID NO: 3933990 - DNA, 18 bp, Homo sapiens
cctgcagaccctgccctt

SEQ ID NO: 3933991 - DNA, 22 bp, Homo sapiens
cctgcagaggaccacagtgggt

SEQ ID NO: 3933992 - DNA, 12 bp, Homo sapiens
cctgcagcctcc

SEQ ID NO: 3933993 - DNA, 17 bp, Homo sapiens
cctgcagcctcccccac

SEQ ID NO: 3933994 - DNA, 15 bp, Homo sapiens
cctgcagcctggtag

SEQ ID NO: 3933995 - DNA, 20 bp, Homo sapiens
cctgcagcttgtagccagcc

SEQ ID NO: 3933996 - DNA, 21 bp, Homo sapiens
cctgcagcttgtagccagccg

SEQ ID NO: 3933997 - DNA, 16 bp, Homo sapiens
cctgcaggaacgagca

SEQ ID NO: 3933998 - DNA, 18 bp, Homo sapiens
cctgcaggaacgagcact

SEQ ID NO: 3933999 - DNA, 20 bp, Homo sapiens
cctgcagtactttacctcct

SEQ ID NO: 3934000 - DNA, 21 bp, Homo sapiens
cctgcatccccttggctgtga

SEQ ID NO: 3934001 - DNA, 23 bp, Homo sapiens
cctgcatccccttggctgtgagg

SEQ ID NO: 3934002 - DNA, 16 bp, Homo sapiens
cctgcatccggagaat

SEQ ID NO: 3934003 - DNA, 18 bp, Homo sapiens
cctgcatgtgttgtacaa

SEQ ID NO: 3934004 - DNA, 13 bp, Homo sapiens
cctgccacctgtc

SEQ ID NO: 3934005 - DNA, 15 bp, Homo sapiens
cctgccacctgtctg

SEQ ID NO: 3934006 - DNA, 17 bp, Homo sapiens
cctgccacctgtctgtc

SEQ ID NO: 3934007 - DNA, 21 bp, Homo sapiens
cctgccagagcccaagtgcca

SEQ ID NO: 3934008 - DNA, 22 bp, Homo sapiens
cctgccagagcccaagtgccat

SEQ ID NO: 3934009 - DNA, 22 bp, Homo sapiens
cctgccagcaggccagggactc

SEQ ID NO: 3934010 - DNA, 12 bp, Homo sapiens
cctgccagccat

SEQ ID NO: 3934011 - DNA, 17 bp, Homo sapiens
cctgccagccatcacaa

SEQ ID NO: 3934012 - DNA, 15 bp, Homo sapiens
cctgccagctgcctt

SEQ ID NO: 3934013 - DNA, 17 bp, Homo sapiens
cctgccagctgccttcc

SEQ ID NO: 3934014 - DNA, 14 bp, Homo sapiens
cctgccaggaggct

SEQ ID NO: 3934015 - DNA, 20 bp, Homo sapiens
cctgccaggaggctgcggcc

SEQ ID NO: 3934016 - DNA, 14 bp, Homo sapiens
cctgccagtgcctt

SEQ ID NO: 3934017 - DNA, 17 bp, Homo sapiens
cctgccagtgccttacc

SEQ ID NO: 3934018 - DNA, 17 bp, Homo sapiens
cctgccataccgctggg

SEQ ID NO: 3934019 - DNA, 13 bp, Homo sapiens
cctgcccaatgct

SEQ ID NO: 3934020 - DNA, 20 bp, Homo sapiens
cctgcccacttcagcccagc

SEQ ID NO: 3934021 - DNA, 12 bp, Homo sapiens
cctgcccaggag

SEQ ID NO: 3934022 - DNA, 20 bp, Homo sapiens
cctgcccaggagagccagcc

SEQ ID NO: 3934023 - DNA, 14 bp, Homo sapiens
cctgcccatacccc

SEQ ID NO: 3934024 - DNA, 12 bp, Homo sapiens
cctgcccatgtg

SEQ ID NO: 3934025 - DNA, 22 bp, Homo sapiens
cctgccccaactccttccagct

SEQ ID NO: 3934026 - DNA, 17 bp, Homo sapiens
cctgccccagggctccc

SEQ ID NO: 3934027 - DNA, 13 bp, Homo sapiens
cctgcccccatct

SEQ ID NO: 3934028 - DNA, 19 bp, Homo sapiens
cctgcccccatctccccag

SEQ ID NO: 3934029 - DNA, 22 bp, Homo sapiens
cctgcccccatctccccaggcc

SEQ ID NO: 3934030 - DNA, 21 bp, Homo sapiens
cctgcccccgacagcccagcc

SEQ ID NO: 3934031 - DNA, 15 bp, Homo sapiens
cctgcccctcgcctt

SEQ ID NO: 3934032 - DNA, 14 bp, Homo sapiens
cctgccctcccatg

SEQ ID NO: 3934033 - DNA, 11 bp, Homo sapiens
cctgccctgcc

SEQ ID NO: 3934034 - DNA, 12 bp, Homo sapiens
cctgccctggag

SEQ ID NO: 3934035 - DNA, 21 bp, Homo sapiens
cctgccctgttgtgtatagat

SEQ ID NO: 3934036 - DNA, 22 bp, Homo sapiens
cctgcccttgtttggggcagga

SEQ ID NO: 3934037 - DNA, 18 bp, Homo sapiens
cctgccgacctcgtcctc

SEQ ID NO: 3934038 - DNA, 14 bp, Homo sapiens
cctgccgcctcaat

SEQ ID NO: 3934039 - DNA, 21 bp, Homo sapiens
cctgcctaggaattcccagcc

SEQ ID NO: 3934040 - DNA, 16 bp, Homo sapiens
cctgcctatccatcct

SEQ ID NO: 3934041 - DNA, 17 bp, Homo sapiens
cctgcctatccatcctg

SEQ ID NO: 3934042 - DNA, 18 bp, Homo sapiens
cctgcctatccatcctgc

SEQ ID NO: 3934043 - DNA, 15 bp, Homo sapiens
cctgcctccctttct

SEQ ID NO: 3934044 - DNA, 18 bp, Homo sapiens
cctgcctccctttctggg

SEQ ID NO: 3934045 - DNA, 21 bp, Homo sapiens
cctgcctccctttctgggagg

SEQ ID NO: 3934046 - DNA, 17 bp, Homo sapiens
cctgcctgagcccagga

SEQ ID NO: 3934047 - DNA, 18 bp, Homo sapiens
cctgcctgagcccaggag

SEQ ID NO: 3934048 - DNA, 21 bp, Homo sapiens
cctgcctgagcccaggagctg

SEQ ID NO: 3934049 - DNA, 13 bp, Homo sapiens
cctgtgcagcagc

SEQ ID NO: 3934050 - DNA, 14 bp, Homo sapiens
cctgtgcagcagcc

SEQ ID NO: 3934051 - DNA, 16 bp, Homo sapiens
cctgtgcagcagccca

SEQ ID NO: 3934052 - DNA, 19 bp, Homo sapiens
cctgtgcagcagcccagct

SEQ ID NO: 3934053 - DNA, 22 bp, Homo sapiens
cctgtgcagcagcccagcttcc

SEQ ID NO: 3934054 - DNA, 14 bp, Homo sapiens
cctgtgcccctcag

SEQ ID NO: 3934055 - DNA, 15 bp, Homo sapiens
cctgtgcccctcaga

SEQ ID NO: 3934056 - DNA, 20 bp, Homo sapiens
cctgtgcctcctcaccccca

SEQ ID NO: 3934057 - DNA, 15 bp, Homo sapiens
cctgtgcctgaccct

SEQ ID NO: 3934058 - DNA, 15 bp, Homo sapiens
cctgtgctactttgc

SEQ ID NO: 3934059 - DNA, 19 bp, Homo sapiens
cctgtgctactttgccttt

SEQ ID NO: 3934060 - DNA, 23 bp, Homo sapiens
cctgtgctactttgccttttgca

SEQ ID NO: 3934061 - DNA, 15 bp, Homo sapiens
cctgtgctgaggact

SEQ ID NO: 3934062 - DNA, 19 bp, Homo sapiens
cctgtgctgaggactccct

SEQ ID NO: 3934063 - DNA, 15 bp, Homo sapiens
cctgtggcagaccgg

SEQ ID NO: 3934064 - DNA, 14 bp, Homo sapiens
cctgtggccaggag

SEQ ID NO: 3934065 - DNA, 16 bp, Homo sapiens
cctgtggcggtgcctg

SEQ ID NO: 3934066 - DNA, 19 bp, Homo sapiens
cctgtggcggtgcctgggt

SEQ ID NO: 3934067 - DNA, 22 bp, Homo sapiens
cctgtgggaagagaagggaagc

SEQ ID NO: 3934068 - DNA, 16 bp, Homo sapiens
cctgtgggagcctcgc

SEQ ID NO: 3934069 - DNA, 14 bp, Homo sapiens
cctgtgggagcctg

SEQ ID NO: 3934070 - DNA, 15 bp, Homo sapiens
cctgtgggagcctgc

SEQ ID NO: 3934071 - DNA, 14 bp, Homo sapiens
cctgtggggcctga

SEQ ID NO: 3934072 - DNA, 14 bp, Homo sapiens
cctgtgggggtggc

SEQ ID NO: 3934073 - DNA, 18 bp, Homo sapiens
cctgtgggggtggccatc

SEQ ID NO: 3934074 - DNA, 21 bp, Homo sapiens
cctgtggtcttggaagtgtgt

SEQ ID NO: 3934075 - DNA, 13 bp, Homo sapiens
cctgtgtagctgt

SEQ ID NO: 3934076 - DNA, 14 bp, Homo sapiens
cctgtgtagctgtg

SEQ ID NO: 3934077 - DNA, 22 bp, Homo sapiens
cctgtgtagctgtgacctgctg

SEQ ID NO: 3934078 - DNA, 18 bp, Homo sapiens
cctgtgtccagcagctgc

SEQ ID NO: 3934079 - DNA, 17 bp, Homo sapiens
cctgtgtggacaggact

SEQ ID NO: 3934080 - DNA, 20 bp, Homo sapiens
cctgtgtggggaggcagctc

SEQ ID NO: 3934081 - DNA, 22 bp, Homo sapiens
cctgttacttgaaataccagtg

SEQ ID NO: 3934082 - DNA, 21 bp, Homo sapiens
cctgttcactctacttagcat

SEQ ID NO: 3934083 - DNA, 23 bp, Homo sapiens
cctgttggacccgctctggacca

SEQ ID NO: 3934084 - DNA, 15 bp, Homo sapiens
cctgtttaatattta

SEQ ID NO: 3934085 - DNA, 19 bp, Homo sapiens
cctgttttatactgtactt

SEQ ID NO: 3934086 - DNA, 22 bp, Homo sapiens
ccttaaaggcaccatctaatag

SEQ ID NO: 3934087 - DNA, 12 bp, Homo sapiens
ccttaaattttt

SEQ ID NO: 3934088 - DNA, 19 bp, Homo sapiens
ccttaagggttgaaggcag

SEQ ID NO: 3934089 - DNA, 15 bp, Homo sapiens
ccttaatattattgg

SEQ ID NO: 3934090 - DNA, 23 bp, Homo sapiens
ccttaatcaggtcctcagagaat

SEQ ID NO: 3934091 - DNA, 17 bp, Homo sapiens
ccttaccaactttctgt

SEQ ID NO: 3934092 - DNA, 13 bp, Homo sapiens
ccttacctcctgc

SEQ ID NO: 3934093 - DNA, 20 bp, Homo sapiens
ccttactacttcttggaaaa

SEQ ID NO: 3934094 - DNA, 22 bp, Homo sapiens
ccttactacttcttggaaaaaa

SEQ ID NO: 3934095 - DNA, 14 bp, Homo sapiens
ccttactcacctct

SEQ ID NO: 3934096 - DNA, 21 bp, Homo sapiens
ccttactcacctctctctaag

SEQ ID NO: 3934097 - DNA, 13 bp, Homo sapiens
ccttactcctgtg

SEQ ID NO: 3934098 - DNA, 16 bp, Homo sapiens
ccttagattagctctg

SEQ ID NO: 3934099 - DNA, 21 bp, Homo sapiens
ccttagattagctctggacca

SEQ ID NO: 3934100 - DNA, 14 bp, Homo sapiens
ccttagcacttctt

SEQ ID NO: 3934101 - DNA, 16 bp, Homo sapiens
ccttagcacttctttc

SEQ ID NO: 3934102 - DNA, 18 bp, Homo sapiens
ccttaggcattatttaat

SEQ ID NO: 3934103 - DNA, 17 bp, Homo sapiens
ccttatccaggactctg

SEQ ID NO: 3934104 - DNA, 19 bp, Homo sapiens
ccttatgtaattattttct

SEQ ID NO: 3934105 - DNA, 13 bp, Homo sapiens
ccttatgtattat

SEQ ID NO: 3934106 - DNA, 20 bp, Homo sapiens
ccttatgtattattttctat

SEQ ID NO: 3934107 - DNA, 14 bp, Homo sapiens
ccttcaaccattcc

SEQ ID NO: 3934108 - DNA, 24 bp, Homo sapiens
ccttcaactgaaaagactcagtgt

SEQ ID NO: 3934109 - DNA, 12 bp, Homo sapiens
ccttcacagtgt

SEQ ID NO: 3934110 - DNA, 13 bp, Homo sapiens
ccttcagggccag

SEQ ID NO: 3934111 - DNA, 15 bp, Homo sapiens
ccttcagggccagaa

SEQ ID NO: 3934112 - DNA, 18 bp, Homo sapiens
ccttcagggccagaagga

SEQ ID NO: 3934113 - DNA, 15 bp, Homo sapiens
ccttcagtgcccacc

SEQ ID NO: 3934114 - DNA, 18 bp, Homo sapiens
ccttcagtgcccaccaac

SEQ ID NO: 3934115 - DNA, 20 bp, Homo sapiens
ccttcatctggattccagag

SEQ ID NO: 3934116 - DNA, 17 bp, Homo sapiens
ccttccaccgggcctga

SEQ ID NO: 3934117 - DNA, 17 bp, Homo sapiens
ccttccacctcctagag

SEQ ID NO: 3934118 - DNA, 20 bp, Homo sapiens
ccttccacggatccatgtag

SEQ ID NO: 3934119 - DNA, 21 bp, Homo sapiens
ccttccacggatccatgtagc

SEQ ID NO: 3934120 - DNA, 13 bp, Homo sapiens
ccttccagacata

SEQ ID NO: 3934121 - DNA, 23 bp, Homo sapiens
ccttccatgtcgcctctgcattc

SEQ ID NO: 3934122 - DNA, 17 bp, Homo sapiens
ccttcccaatcagcact

SEQ ID NO: 3934123 - DNA, 21 bp, Homo sapiens
ccttcccaatcagcactgaaa

SEQ ID NO: 3934124 - DNA, 18 bp, Homo sapiens
ccttcccagctctccctc

SEQ ID NO: 3934125 - DNA, 19 bp, Homo sapiens
ccttcccagctctccctct

SEQ ID NO: 3934126 - DNA, 21 bp, Homo sapiens
ccttcccagctctccctctgg

SEQ ID NO: 3934127 - DNA, 13 bp, Homo sapiens
ccttccccaagaa

SEQ ID NO: 3934128 - DNA, 13 bp, Homo sapiens
ccttccccagact

SEQ ID NO: 3934129 - DNA, 15 bp, Homo sapiens
ccttcccctacacct

SEQ ID NO: 3934130 - DNA, 14 bp, Homo sapiens
ccttcccctgcctg

SEQ ID NO: 3934131 - DNA, 14 bp, Homo sapiens
ccttcccctgtggt

SEQ ID NO: 3934132 - DNA, 18 bp, Homo sapiens
ccttccccttttgcctgg

SEQ ID NO: 3934133 - DNA, 19 bp, Homo sapiens
ccttccccttttgcctggc

SEQ ID NO: 3934134 - DNA, 20 bp, Homo sapiens
ccttcccgccgcccgacccc

SEQ ID NO: 3934135 - DNA, 15 bp, Homo sapiens
cctgcttttccagga

SEQ ID NO: 3934136 - DNA, 16 bp, Homo sapiens
cctgcttttccaggat

SEQ ID NO: 3934137 - DNA, 18 bp, Homo sapiens
cctgcttttccaggatcc

SEQ ID NO: 3934138 - DNA, 13 bp, Homo sapiens
cctggaaccaatc

SEQ ID NO: 3934139 - DNA, 17 bp, Homo sapiens
cctggaagctgtgtcct

SEQ ID NO: 3934140 - DNA, 20 bp, Homo sapiens
cctggaagctgtgtccttgc

SEQ ID NO: 3934141 - DNA, 16 bp, Homo sapiens
cctggaattcagcacc

SEQ ID NO: 3934142 - DNA, 17 bp, Homo sapiens
cctggaattcagcaccc

SEQ ID NO: 3934143 - DNA, 21 bp, Homo sapiens
cctggaattcagcaccctggg

SEQ ID NO: 3934144 - DNA, 18 bp, Homo sapiens
cctggacagctgtgcctc

SEQ ID NO: 3934145 - DNA, 22 bp, Homo sapiens
cctggacagctgtgcctcgctc

SEQ ID NO: 3934146 - DNA, 21 bp, Homo sapiens
cctggacatttgccttgctgg

SEQ ID NO: 3934147 - DNA, 17 bp, Homo sapiens
cctggaccgcttcccag

SEQ ID NO: 3934148 - DNA, 21 bp, Homo sapiens
cctggaccgcttcccagaggc

SEQ ID NO: 3934149 - DNA, 13 bp, Homo sapiens
cctggacctgagt

SEQ ID NO: 3934150 - DNA, 14 bp, Homo sapiens
cctggactgggagg

SEQ ID NO: 3934151 - DNA, 18 bp, Homo sapiens
cctggactgggaggtaga

SEQ ID NO: 3934152 - DNA, 13 bp, Homo sapiens
cctggagaactag

SEQ ID NO: 3934153 - DNA, 23 bp, Homo sapiens
cctggagaactagaacctggagg

SEQ ID NO: 3934154 - DNA, 14 bp, Homo sapiens
cctggagagccaga

SEQ ID NO: 3934155 - DNA, 23 bp, Homo sapiens
cctggagagccagaacctggagg

SEQ ID NO: 3934156 - DNA, 14 bp, Homo sapiens
cctggagagctaga

SEQ ID NO: 3934157 - DNA, 19 bp, Homo sapiens
cctggagagctagaaccta

SEQ ID NO: 3934158 - DNA, 21 bp, Homo sapiens
cctggagagctagaacctaga

SEQ ID NO: 3934159 - DNA, 17 bp, Homo sapiens
cctggagaggggcctgg

SEQ ID NO: 3934160 - DNA, 12 bp, Homo sapiens
cctggaggacct

SEQ ID NO: 3934161 - DNA, 17 bp, Homo sapiens
cctggaggacctgagcc

SEQ ID NO: 3934162 - DNA, 13 bp, Homo sapiens
cctggagggaggc

SEQ ID NO: 3934163 - DNA, 19 bp, Homo sapiens
cctggagggctagaaccta

SEQ ID NO: 3934164 - DNA, 20 bp, Homo sapiens
cctggagggctagaacctag

SEQ ID NO: 3934165 - DNA, 18 bp, Homo sapiens
cctgggggcagtgactgg

SEQ ID NO: 3934166 - DNA, 22 bp, Homo sapiens
cctgggggccagctggtgctgc

SEQ ID NO: 3934167 - DNA, 12 bp, Homo sapiens
cctgggggcctg

SEQ ID NO: 3934168 - DNA, 13 bp, Homo sapiens
cctgggggcctgg

SEQ ID NO: 3934169 - DNA, 14 bp, Homo sapiens
cctgggggcctggc

SEQ ID NO: 3934170 - DNA, 15 bp, Homo sapiens
cctgggggcctggct

SEQ ID NO: 3934171 - DNA, 15 bp, Homo sapiens
cctgggggtggcagg

SEQ ID NO: 3934172 - DNA, 17 bp, Homo sapiens
cctgggggtggcaggca

SEQ ID NO: 3934173 - DNA, 22 bp, Homo sapiens
cctgggggtggcaggcacacag

SEQ ID NO: 3934174 - DNA, 18 bp, Homo sapiens
cctgggggttctttcttc

SEQ ID NO: 3934175 - DNA, 23 bp, Homo sapiens
cctgggggttctttcttcctctg

SEQ ID NO: 3934176 - DNA, 20 bp, Homo sapiens
cctgggtgagaatcctgcct

SEQ ID NO: 3934177 - DNA, 17 bp, Homo sapiens
cctgggtggctactctg

SEQ ID NO: 3934178 - DNA, 20 bp, Homo sapiens
cctgggtggggctgctcctc

SEQ ID NO: 3934179 - DNA, 21 bp, Homo sapiens
cctgggtggggctgctcctcc

SEQ ID NO: 3934180 - DNA, 16 bp, Homo sapiens
cctgggttttctaact

SEQ ID NO: 3934181 - DNA, 21 bp, Homo sapiens
cctggtcacaggactctgcct

SEQ ID NO: 3934182 - DNA, 22 bp, Homo sapiens
cctggtcacaggactctgcctc

SEQ ID NO: 3934183 - DNA, 15 bp, Homo sapiens
cctggtccctcgtcc

SEQ ID NO: 3934184 - DNA, 23 bp, Homo sapiens
cctggtcctgagggtccccacct

SEQ ID NO: 3934185 - DNA, 17 bp, Homo sapiens
cctggtgcactggcccc

SEQ ID NO: 3934186 - DNA, 13 bp, Homo sapiens
cctggtggggcag

SEQ ID NO: 3934187 - DNA, 14 bp, Homo sapiens
cctggtggggcagc

SEQ ID NO: 3934188 - DNA, 14 bp, Homo sapiens
cctggtgtcaggca

SEQ ID NO: 3934189 - DNA, 16 bp, Homo sapiens
cctgtaatcccagcag

SEQ ID NO: 3934190 - DNA, 18 bp, Homo sapiens
cctgtaatcccagctact

SEQ ID NO: 3934191 - DNA, 23 bp, Homo sapiens
cctgtaatcccagctactcagga

SEQ ID NO: 3934192 - DNA, 16 bp, Homo sapiens
cctgtactgcctgctt

SEQ ID NO: 3934193 - DNA, 21 bp, Homo sapiens
cctgtagcagtgagaaaaagc

SEQ ID NO: 3934194 - DNA, 13 bp, Homo sapiens
cctgtagctctgc

SEQ ID NO: 3934195 - DNA, 15 bp, Homo sapiens
cctgtagttaggaaa

SEQ ID NO: 3934196 - DNA, 18 bp, Homo sapiens
cctgtagttaggaaataa

SEQ ID NO: 3934197 - DNA, 23 bp, Homo sapiens
cctgtagttaggaaataaaacct

SEQ ID NO: 3934198 - DNA, 20 bp, Homo sapiens
cctgtataatctctctcctg

SEQ ID NO: 3934199 - DNA, 22 bp, Homo sapiens
cctgtatagttaggatagcatt

SEQ ID NO: 3934200 - DNA, 17 bp, Homo sapiens
cctgtatgtctccagta

SEQ ID NO: 3934201 - DNA, 16 bp, Homo sapiens
cctgtatttgttccca

SEQ ID NO: 3934202 - DNA, 14 bp, Homo sapiens
cctgtcaccaagct

SEQ ID NO: 3934203 - DNA, 18 bp, Homo sapiens
cctgtcatcccctacact

SEQ ID NO: 3934204 - DNA, 12 bp, Homo sapiens
cctgtccaacct

SEQ ID NO: 3934205 - DNA, 22 bp, Homo sapiens
cctgtcccaccaactctgcact

SEQ ID NO: 3934206 - DNA, 13 bp, Homo sapiens
cctgtcccgcctt

SEQ ID NO: 3934207 - DNA, 12 bp, Homo sapiens
cctgtccctacc

SEQ ID NO: 3934208 - DNA, 18 bp, Homo sapiens
cctgtccctacccactct

SEQ ID NO: 3934209 - DNA, 14 bp, Homo sapiens
cctgtcccttcttg

SEQ ID NO: 3934210 - DNA, 16 bp, Homo sapiens
cctgtcccttcttggg

SEQ ID NO: 3934211 - DNA, 13 bp, Homo sapiens
cctgtcctgcctc

SEQ ID NO: 3934212 - DNA, 22 bp, Homo sapiens
cctgtcctgcctctctgctcca

SEQ ID NO: 3934213 - DNA, 23 bp, Homo sapiens
cctgtcctgcctctctgctccag

SEQ ID NO: 3934214 - DNA, 16 bp, Homo sapiens
cctgtcctggtacagc

SEQ ID NO: 3934215 - DNA, 18 bp, Homo sapiens
cctgtcgagacacttgcc

SEQ ID NO: 3934216 - DNA, 14 bp, Homo sapiens
cctgtctctgcctg

SEQ ID NO: 3934217 - DNA, 16 bp, Homo sapiens
cctgtctctgcctgcg

SEQ ID NO: 3934218 - DNA, 20 bp, Homo sapiens
cctgtctgtctgtctgtccc

SEQ ID NO: 3934219 - DNA, 22 bp, Homo sapiens
cctgtgaaagactcaatgagct

SEQ ID NO: 3934220 - DNA, 14 bp, Homo sapiens
cctgtgaacccagg

SEQ ID NO: 3934221 - DNA, 18 bp, Homo sapiens
cctgtgaacccaggacaa

SEQ ID NO: 3934222 - DNA, 13 bp, Homo sapiens
cctgtgaggcagg

SEQ ID NO: 3934223 - DNA, 17 bp, Homo sapiens
cctgtgaggcaggggcg

SEQ ID NO: 3934224 - DNA, 18 bp, Homo sapiens
ccttccctccccacagtc

SEQ ID NO: 3934225 - DNA, 21 bp, Homo sapiens
ccttcccttctctccttccct

SEQ ID NO: 3934226 - DNA, 17 bp, Homo sapiens
ccttccgctcctttacc

SEQ ID NO: 3934227 - DNA, 13 bp, Homo sapiens
ccttcctcatccc

SEQ ID NO: 3934228 - DNA, 15 bp, Homo sapiens
ccttcctcctccaca

SEQ ID NO: 3934229 - DNA, 23 bp, Homo sapiens
ccttcctcctccacagtgctgct

SEQ ID NO: 3934230 - DNA, 13 bp, Homo sapiens
ccttcctggacag

SEQ ID NO: 3934231 - DNA, 17 bp, Homo sapiens
ccttcctggacagctgt

SEQ ID NO: 3934232 - DNA, 11 bp, Homo sapiens
ccttcctggcc

SEQ ID NO: 3934233 - DNA, 23 bp, Homo sapiens
ccttcctggcctcactggctggg

SEQ ID NO: 3934234 - DNA, 19 bp, Homo sapiens
ccttcctgtcccacctctt

SEQ ID NO: 3934235 - DNA, 16 bp, Homo sapiens
ccttccttccctggct

SEQ ID NO: 3934236 - DNA, 13 bp, Homo sapiens
ccttcctttcctc

SEQ ID NO: 3934237 - DNA, 15 bp, Homo sapiens
ccttcgatacaccgg

SEQ ID NO: 3934238 - DNA, 15 bp, Homo sapiens
ccttcgctgccagga

SEQ ID NO: 3934239 - DNA, 17 bp, Homo sapiens
ccttcgctgccaggaca

SEQ ID NO: 3934240 - DNA, 21 bp, Homo sapiens
ccttcgctgccaggacacctg

SEQ ID NO: 3934241 - DNA, 17 bp, Homo sapiens
ccttcgtgtctctccca

SEQ ID NO: 3934242 - DNA, 16 bp, Homo sapiens
ccttctctccttccct

SEQ ID NO: 3934243 - DNA, 12 bp, Homo sapiens
ccttctgcaccc

SEQ ID NO: 3934244 - DNA, 11 bp, Homo sapiens
ccttctgctgc

SEQ ID NO: 3934245 - DNA, 16 bp, Homo sapiens
ccttctgcttctccct

SEQ ID NO: 3934246 - DNA, 22 bp, Homo sapiens
ccttctggaggacacacagtct

SEQ ID NO: 3934247 - DNA, 11 bp, Homo sapiens
ccttctgggca

SEQ ID NO: 3934248 - DNA, 19 bp, Homo sapiens
ccttctggtacaatccttt

SEQ ID NO: 3934249 - DNA, 15 bp, Homo sapiens
ccttctggttgcttc

SEQ ID NO: 3934250 - DNA, 20 bp, Homo sapiens
ccttcttattctcactccac

SEQ ID NO: 3934251 - DNA, 22 bp, Homo sapiens
ccttcttattctcactccacca

SEQ ID NO: 3934252 - DNA, 19 bp, Homo sapiens
ccttcttcacccagctaat

SEQ ID NO: 3934253 - DNA, 16 bp, Homo sapiens
ccttcttccctgtttt

SEQ ID NO: 3934254 - DNA, 21 bp, Homo sapiens
ccttcttcggggaactcctgg

SEQ ID NO: 3934255 - DNA, 15 bp, Homo sapiens
ccttcttggcttctg

SEQ ID NO: 3934256 - DNA, 17 bp, Homo sapiens
ccttcttggcttctggg

SEQ ID NO: 3934257 - DNA, 15 bp, Homo sapiens
ccttctttaaatcaa

SEQ ID NO: 3934258 - DNA, 17 bp, Homo sapiens
ccttctttcctcttccc

SEQ ID NO: 3934259 - DNA, 20 bp, Homo sapiens
ccttctttctcttccctcct

SEQ ID NO: 3934260 - DNA, 16 bp, Homo sapiens
ccttctttttcttctt

SEQ ID NO: 3934261 - DNA, 19 bp, Homo sapiens
ccttgaatctgcagggagc

SEQ ID NO: 3934262 - DNA, 19 bp, Homo sapiens
ccttgagacctcagccatg

SEQ ID NO: 3934263 - DNA, 23 bp, Homo sapiens
ccttgagcactcagtctagtgaa

SEQ ID NO: 3934264 - DNA, 18 bp, Homo sapiens
ccttgatttaaaatatca

SEQ ID NO: 3934265 - DNA, 23 bp, Homo sapiens
ccttgcaaagaccataaagtcca

SEQ ID NO: 3934266 - DNA, 17 bp, Homo sapiens
ccttgcacccctcactc

SEQ ID NO: 3934267 - DNA, 14 bp, Homo sapiens
ccttgcattagaaa

SEQ ID NO: 3934268 - DNA, 21 bp, Homo sapiens
ccttgcccagagatgcctcca

SEQ ID NO: 3934269 - DNA, 16 bp, Homo sapiens
ccttgcccgccagcct

SEQ ID NO: 3934270 - DNA, 17 bp, Homo sapiens
ccttgcccgccagcctc

SEQ ID NO: 3934271 - DNA, 19 bp, Homo sapiens
ccttgcccgccagcctcag

SEQ ID NO: 3934272 - DNA, 20 bp, Homo sapiens
ccttgcccgccagcctcagt

SEQ ID NO: 3934273 - DNA, 13 bp, Homo sapiens
ccttgccctgacc

SEQ ID NO: 3934274 - DNA, 16 bp, Homo sapiens
ccttgcccttgccctg

SEQ ID NO: 3934275 - DNA, 17 bp, Homo sapiens
ccttgcccttgccctga

SEQ ID NO: 3934276 - DNA, 18 bp, Homo sapiens
ccttgctagacagccagg

SEQ ID NO: 3934277 - DNA, 22 bp, Homo sapiens
ccttgctcaccaagctgttcca

SEQ ID NO: 3934278 - DNA, 15 bp, Homo sapiens
ccttgctcagtgcct

SEQ ID NO: 3934279 - DNA, 20 bp, Homo sapiens
ccttgctcagtgcctcctgg

SEQ ID NO: 3934280 - DNA, 22 bp, Homo sapiens
ccttgctctcccctgccctgct

SEQ ID NO: 3934281 - DNA, 17 bp, Homo sapiens
ccttgctcttctttctg

SEQ ID NO: 3934282 - DNA, 22 bp, Homo sapiens
ccttgctttgggctttgcaggc

SEQ ID NO: 3934283 - DNA, 21 bp, Homo sapiens
ccttggagagcagctggctct

SEQ ID NO: 3934284 - DNA, 22 bp, Homo sapiens
ccttggagagcagctggctctc

SEQ ID NO: 3934285 - DNA, 18 bp, Homo sapiens
ccttggataatgctgttg

SEQ ID NO: 3934286 - DNA, 18 bp, Homo sapiens
ccttggatgtagtctgag

SEQ ID NO: 3934287 - DNA, 21 bp, Homo sapiens
ccttggctgtgaggcccctgg

SEQ ID NO: 3934288 - DNA, 20 bp, Homo sapiens
ccttggcttttgcttggcag

SEQ ID NO: 3934289 - DNA, 16 bp, Homo sapiens
ccttgggctcctggct

SEQ ID NO: 3934290 - DNA, 17 bp, Homo sapiens
ccttgggctcctggctg

SEQ ID NO: 3934291 - DNA, 21 bp, Homo sapiens
ccttgggctcctggctgccag

SEQ ID NO: 3934292 - DNA, 23 bp, Homo sapiens
ccttgggctcctggctgccaggc

SEQ ID NO: 3934293 - DNA, 14 bp, Homo sapiens
ccttggggcacagt

SEQ ID NO: 3934294 - DNA, 13 bp, Homo sapiens
ccttggggcctgg

SEQ ID NO: 3934295 - DNA, 16 bp, Homo sapiens
ccttggggcctggctt

SEQ ID NO: 3934296 - DNA, 21 bp, Homo sapiens
ccttggggtaagccagagcct

SEQ ID NO: 3934297 - DNA, 17 bp, Homo sapiens
ccttggtgtccacctgg

SEQ ID NO: 3934298 - DNA, 18 bp, Homo sapiens
ccttggtgtccacctggc

SEQ ID NO: 3934299 - DNA, 17 bp, Homo sapiens
ccttgtaccccatccct

SEQ ID NO: 3934300 - DNA, 14 bp, Homo sapiens
ccttgtcaggaccc

SEQ ID NO: 3934301 - DNA, 15 bp, Homo sapiens
ccttgtcctctcccg

SEQ ID NO: 3934302 - DNA, 13 bp, Homo sapiens
ccttgtcctgcca

SEQ ID NO: 3934303 - DNA, 14 bp, Homo sapiens
ccttgtcctgccag

SEQ ID NO: 3934304 - DNA, 21 bp, Homo sapiens
ccttgtcctgccagctgcctt

SEQ ID NO: 3934305 - DNA, 22 bp, Homo sapiens
ccttgtctctcattctctttct

SEQ ID NO: 3934306 - DNA, 14 bp, Homo sapiens
ccttgtgccctgcc

SEQ ID NO: 3934307 - DNA, 16 bp, Homo sapiens
ccttgtgccctgcccc

SEQ ID NO: 3934308 - DNA, 21 bp, Homo sapiens
ccttgtgtcagagctgggagt

SEQ ID NO: 3934309 - DNA, 16 bp, Homo sapiens
ccttgtgtttctgtgg

SEQ ID NO: 3934310 - DNA, 13 bp, Homo sapiens
ccttgttgcatga

SEQ ID NO: 3934311 - DNA, 22 bp, Homo sapiens
ccttgtttgattttagctgcag

SEQ ID NO: 3934312 - DNA, 17 bp, Homo sapiens
ccttgtttggggcagga

SEQ ID NO: 3934313 - DNA, 20 bp, Homo sapiens
cctttaaagacttaagatta

SEQ ID NO: 3934314 - DNA, 15 bp, Homo sapiens
cctttaggcagcctg

SEQ ID NO: 3934315 - DNA, 16 bp, Homo sapiens
cctttaggcagcctgc

SEQ ID NO: 3934316 - DNA, 15 bp, Homo sapiens
cctttaggtctggtt

SEQ ID NO: 3934317 - DNA, 13 bp, Homo sapiens
cctttatctctgt

SEQ ID NO: 3934318 - DNA, 13 bp, Homo sapiens
cctttattgtgat

SEQ ID NO: 3934319 - DNA, 16 bp, Homo sapiens
cctttcaaatttcaca

SEQ ID NO: 3934320 - DNA, 15 bp, Homo sapiens
cctttcacaaccttc

SEQ ID NO: 3934321 - DNA, 15 bp, Homo sapiens
cctttcagctgtgaa

SEQ ID NO: 3934322 - DNA, 20 bp, Homo sapiens
cctttcccatgctgaattat

SEQ ID NO: 3934323 - DNA, 13 bp, Homo sapiens
cctttccccagac

SEQ ID NO: 3934324 - DNA, 16 bp, Homo sapiens
cctttccgctgtcgcc

SEQ ID NO: 3934325 - DNA, 21 bp, Homo sapiens
cctttccgctgtcgccccagg

SEQ ID NO: 3934326 - DNA, 16 bp, Homo sapiens
cctttcctccccacct

SEQ ID NO: 3934327 - DNA, 19 bp, Homo sapiens
cctttcctctgcagcactt

SEQ ID NO: 3934328 - DNA, 13 bp, Homo sapiens
cctttctccagcc

SEQ ID NO: 3934329 - DNA, 15 bp, Homo sapiens
cctttctccagccag

SEQ ID NO: 3934330 - DNA, 17 bp, Homo sapiens
cctttctccagccagca

SEQ ID NO: 3934331 - DNA, 18 bp, Homo sapiens
cctttctccagccagcaa

SEQ ID NO: 3934332 - DNA, 13 bp, Homo sapiens
cctttctgtgtgc

SEQ ID NO: 3934333 - DNA, 19 bp, Homo sapiens
cctttgaggcaaaggccag

SEQ ID NO: 3934334 - DNA, 14 bp, Homo sapiens
cctttgataaatgt

SEQ ID NO: 3934335 - DNA, 18 bp, Homo sapiens
cctttgcaggcccagcag

SEQ ID NO: 3934336 - DNA, 20 bp, Homo sapiens
cctttgcaggcccagcagac

SEQ ID NO: 3934337 - DNA, 20 bp, Homo sapiens
cctttgcattccatgatttt

SEQ ID NO: 3934338 - DNA, 19 bp, Homo sapiens
cctttggatgaccagaaca

SEQ ID NO: 3934339 - DNA, 14 bp, Homo sapiens
cctttgggaagggg

SEQ ID NO: 3934340 - DNA, 14 bp, Homo sapiens
cctttggtgcagag

SEQ ID NO: 3934341 - DNA, 19 bp, Homo sapiens
cctttgtcatcattgtata

SEQ ID NO: 3934342 - DNA, 18 bp, Homo sapiens
cctttgtcatctttcttc

SEQ ID NO: 3934343 - DNA, 23 bp, Homo sapiens
cctttgtcatctttcttctattt

SEQ ID NO: 3934344 - DNA, 13 bp, Homo sapiens
ccttttaaaagaa

SEQ ID NO: 3934345 - DNA, 13 bp, Homo sapiens
ccttttacagctc

SEQ ID NO: 3934346 - DNA, 14 bp, Homo sapiens
ccttttaggctcag

SEQ ID NO: 3934347 - DNA, 19 bp, Homo sapiens
ccttttataccagagacct

SEQ ID NO: 3934348 - DNA, 17 bp, Homo sapiens
ccttttattctgtacct

SEQ ID NO: 3934349 - DNA, 16 bp, Homo sapiens
ccttttctctcccata

SEQ ID NO: 3934350 - DNA, 14 bp, Homo sapiens
ccttttctttttcc

SEQ ID NO: 3934351 - DNA, 20 bp, Homo sapiens
ccttttctttttcccttgaa

SEQ ID NO: 3934352 - DNA, 22 bp, Homo sapiens
ccttttctttttcccttgaact

SEQ ID NO: 3934353 - DNA, 18 bp, Homo sapiens
ccttttgatggggagaaa

SEQ ID NO: 3934354 - DNA, 19 bp, Homo sapiens
ccttttgatggggagaaag

SEQ ID NO: 3934355 - DNA, 13 bp, Homo sapiens
ccttttgctgctg

SEQ ID NO: 3934356 - DNA, 15 bp, Homo sapiens
ccttttgctgctgct

SEQ ID NO: 3934357 - DNA, 18 bp, Homo sapiens
ccttttgcttgaaaccaa

SEQ ID NO: 3934358 - DNA, 14 bp, Homo sapiens
ccttttgtccccag

SEQ ID NO: 3934359 - DNA, 17 bp, Homo sapiens
ccttttgtccccagggc

SEQ ID NO: 3934360 - DNA, 19 bp, Homo sapiens
ccttttgtccccagggccc

SEQ ID NO: 3934361 - DNA, 11 bp, Homo sapiens
ccttttgtgta

SEQ ID NO: 3934362 - DNA, 16 bp, Homo sapiens
cctttttctacctttt

SEQ ID NO: 3934363 - DNA, 14 bp, Homo sapiens
cctttttgcagtat

SEQ ID NO: 3934364 - DNA, 22 bp, Homo sapiens
ccttttttatttttttaagctg

SEQ ID NO: 3934365 - DNA, 23 bp, Homo sapiens
cgaaacacaaaccacaactgaca

SEQ ID NO: 3934366 - DNA, 15 bp, Homo sapiens
cgaaccaaggcagcc

SEQ ID NO: 3934367 - DNA, 16 bp, Homo sapiens
cgaaccaaggcagcct

SEQ ID NO: 3934368 - DNA, 21 bp, Homo sapiens
cgaagagggaatggatgggga

SEQ ID NO: 3934369 - DNA, 10 bp, Homo sapiens
cgaagcccag

SEQ ID NO: 3934370 - DNA, 17 bp, Homo sapiens
cgaagctaacagggaag

SEQ ID NO: 3934371 - DNA, 22 bp, Homo sapiens
cgaagctaacagggaaggcagg

SEQ ID NO: 3934372 - DNA, 19 bp, Homo sapiens
cgaaggggccccggggctg

SEQ ID NO: 3934373 - DNA, 13 bp, Homo sapiens
cgaataaatgttc

SEQ ID NO: 3934374 - DNA, 14 bp, Homo sapiens
cgaataaatgttca

SEQ ID NO: 3934375 - DNA, 14 bp, Homo sapiens
cgaatctacagaac

SEQ ID NO: 3934376 - DNA, 24 bp, Homo sapiens
cgaatgcctgtcagtttcatggag

SEQ ID NO: 3934377 - DNA, 22 bp, Homo sapiens
cgaattaatagcttttattgta

SEQ ID NO: 3934378 - DNA, 13 bp, Homo sapiens
cgacactgctgca

SEQ ID NO: 3934379 - DNA, 12 bp, Homo sapiens
cgacagcccagc

SEQ ID NO: 3934380 - DNA, 17 bp, Homo sapiens
cgacagcccagcctagc

SEQ ID NO: 3934381 - DNA, 12 bp, Homo sapiens
cgacagcctggc

SEQ ID NO: 3934382 - DNA, 13 bp, Homo sapiens
cgaccccatctca

SEQ ID NO: 3934383 - DNA, 14 bp, Homo sapiens
cgacctcgtcctcc

SEQ ID NO: 3934384 - DNA, 13 bp, Homo sapiens
cgacggcggcggc

SEQ ID NO: 3934385 - DNA, 14 bp, Homo sapiens
cgactgcaacagga

SEQ ID NO: 3934386 - DNA, 20 bp, Homo sapiens
cgactgcacagcggcccctg

SEQ ID NO: 3934387 - DNA, 13 bp, Homo sapiens
cgagaacaacagt

SEQ ID NO: 3934388 - DNA, 21 bp, Homo sapiens
cgagagcctgctcccccaccc

SEQ ID NO: 3934389 - DNA, 15 bp, Homo sapiens
cgagatcccatctct

SEQ ID NO: 3934390 - DNA, 16 bp, Homo sapiens
cgagattgcgccactg

SEQ ID NO: 3934391 - DNA, 20 bp, Homo sapiens
cgagcaaagtctaaagttta

SEQ ID NO: 3934392 - DNA, 15 bp, Homo sapiens
cgagcaaccgtggcc

SEQ ID NO: 3934393 - DNA, 12 bp, Homo sapiens
cgagcacccacg

SEQ ID NO: 3934394 - DNA, 19 bp, Homo sapiens
cgagcactggccagagagg

SEQ ID NO: 3934395 - DNA, 11 bp, Homo sapiens
cgagcagctga

SEQ ID NO: 3934396 - DNA, 13 bp, Homo sapiens
cgagcagctgagc

SEQ ID NO: 3934397 - DNA, 17 bp, Homo sapiens
cggcaggagcaggaaca

SEQ ID NO: 3934398 - DNA, 15 bp, Homo sapiens
cggccaggcgggaga

SEQ ID NO: 3934399 - DNA, 18 bp, Homo sapiens
cggccagggcctggtgtg

SEQ ID NO: 3934400 - DNA, 19 bp, Homo sapiens
cggcccacagctcccaccc

SEQ ID NO: 3934401 - DNA, 22 bp, Homo sapiens
cggcccacagctcccaccccac

SEQ ID NO: 3934402 - DNA, 15 bp, Homo sapiens
cggcccaggcctcca

SEQ ID NO: 3934403 - DNA, 15 bp, Homo sapiens
cggccgcattccctg

SEQ ID NO: 3934404 - DNA, 18 bp, Homo sapiens
cggccgcattccctgagt

SEQ ID NO: 3934405 - DNA, 24 bp, Homo sapiens
cggccgggctgcccttcgctgcca

SEQ ID NO: 3934406 - DNA, 14 bp, Homo sapiens
cggcctgctcccag

SEQ ID NO: 3934407 - DNA, 18 bp, Homo sapiens
cgtggccctgccctctcc

SEQ ID NO: 3934408 - DNA, 16 bp, Homo sapiens
cgtggcccttcctgga

SEQ ID NO: 3934409 - DNA, 17 bp, Homo sapiens
cgtggcccttcctggac

SEQ ID NO: 3934410 - DNA, 20 bp, Homo sapiens
cgtggcccttcctggacagc

SEQ ID NO: 3934411 - DNA, 22 bp, Homo sapiens
cgtggcccttcctggacagctg

SEQ ID NO: 3934412 - DNA, 20 bp, Homo sapiens
cgtggccttgttctgtcacc

SEQ ID NO: 3934413 - DNA, 23 bp, Homo sapiens
cgtggctgtgctctcaccagctg

SEQ ID NO: 3934414 - DNA, 12 bp, Homo sapiens
cgtggctgtggc

SEQ ID NO: 3934415 - DNA, 16 bp, Homo sapiens
cgtggctgtggcacag

SEQ ID NO: 3934416 - DNA, 18 bp, Homo sapiens
cgtggcttcccgctcagc

SEQ ID NO: 3934417 - DNA, 21 bp, Homo sapiens
cgtggcttcccgctcagccct

SEQ ID NO: 3934418 - DNA, 22 bp, Homo sapiens
cgtgggagacaagaaatccctg

SEQ ID NO: 3934419 - DNA, 14 bp, Homo sapiens
cgtgtcccaaggag

SEQ ID NO: 3934420 - DNA, 17 bp, Homo sapiens
cgtgtcccaaggagctg

SEQ ID NO: 3934421 - DNA, 13 bp, Homo sapiens
cgtgtttacaaaa

SEQ ID NO: 3934422 - DNA, 19 bp, Homo sapiens
cgtgtttacaaaaggcagc

SEQ ID NO: 3934423 - DNA, 19 bp, Homo sapiens
cgttccccttggcttcctc

SEQ ID NO: 3934424 - DNA, 19 bp, Homo sapiens
cgttccgtcccaaacagag

SEQ ID NO: 3934425 - DNA, 14 bp, Homo sapiens
cgttctccagccca

SEQ ID NO: 3934426 - DNA, 21 bp, Homo sapiens
cgttggaatcacctggagggc

SEQ ID NO: 3934427 - DNA, 13 bp, Homo sapiens
cgttggagccact

SEQ ID NO: 3934428 - DNA, 21 bp, Homo sapiens
cgtttagtttctagaggcctc

SEQ ID NO: 3934429 - DNA, 14 bp, Homo sapiens
cgttttcatcctgg

SEQ ID NO: 3934430 - DNA, 20 bp, Homo sapiens
cgttttcatcctggcctcct

SEQ ID NO: 3934431 - DNA, 23 bp, Homo sapiens
cgttttgtgtggtggcacctcct

SEQ ID NO: 3934432 - DNA, 18 bp, Homo sapiens
cgtttttgtgctgtgggc

SEQ ID NO: 3934433 - DNA, 19 bp, Homo sapiens
cgtttttgtgctgtgggca

SEQ ID NO: 3934434 - DNA, 11 bp, Homo sapiens
ctaaaaataaa

SEQ ID NO: 3934435 - DNA, 22 bp, Homo sapiens
ctaaaaatattataacttaaaa

SEQ ID NO: 3934436 - DNA, 15 bp, Homo sapiens
ctaaaacctgagcta

SEQ ID NO: 3934437 - DNA, 14 bp, Homo sapiens
ctaaaagtaaacat

SEQ ID NO: 3934438 - DNA, 13 bp, Homo sapiens
ctaaaataaaaac

SEQ ID NO: 3934439 - DNA, 15 bp, Homo sapiens
ctaaaataaaaacca

SEQ ID NO: 3934440 - DNA, 17 bp, Homo sapiens
ctaaaataaaaaccaga

SEQ ID NO: 3934441 - DNA, 23 bp, Homo sapiens
ctaaaatatttattttttttaag

SEQ ID NO: 3934442 - DNA, 24 bp, Homo sapiens
ctaaaatttttctagaagatatca

SEQ ID NO: 3934443 - DNA, 12 bp, Homo sapiens
ctaaacagatat

SEQ ID NO: 3934444 - DNA, 13 bp, Homo sapiens
ctaaacagatata

SEQ ID NO: 3934445 - DNA, 19 bp, Homo sapiens
ctaaacccaaataaatgtg

SEQ ID NO: 3934446 - DNA, 19 bp, Homo sapiens
ctaaacccccgctccagat

SEQ ID NO: 3934447 - DNA, 21 bp, Homo sapiens
ctaaacgactccgagaacaac

SEQ ID NO: 3934448 - DNA, 16 bp, Homo sapiens
ctaaagtatgtaaagt

SEQ ID NO: 3934449 - DNA, 13 bp, Homo sapiens
ctaaagtttacag

SEQ ID NO: 3934450 - DNA, 21 bp, Homo sapiens
ctaaagtttacagtaaataaa

SEQ ID NO: 3934451 - DNA, 16 bp, Homo sapiens
ctaaatactgtacata

SEQ ID NO: 3934452 - DNA, 18 bp, Homo sapiens
ctaaatactgtacataga

SEQ ID NO: 3934453 - DNA, 16 bp, Homo sapiens
ctaaatatatgtctgt

SEQ ID NO: 3934454 - DNA, 17 bp, Homo sapiens
ctaaatgcaaacactgt

SEQ ID NO: 3934455 - DNA, 14 bp, Homo sapiens
ctaaatgctggtct

SEQ ID NO: 3934456 - DNA, 22 bp, Homo sapiens
ctaaatgtggacatcatgaagc

SEQ ID NO: 3934457 - DNA, 15 bp, Homo sapiens
ctaaattctttattt

SEQ ID NO: 3934458 - DNA, 12 bp, Homo sapiens
ctaaattgtata

SEQ ID NO: 3934459 - DNA, 17 bp, Homo sapiens
ctaaattgtatacattt

SEQ ID NO: 3934460 - DNA, 14 bp, Homo sapiens
ctaacacccagtct

SEQ ID NO: 3934461 - DNA, 16 bp, Homo sapiens
ctaacactcagaagcc

SEQ ID NO: 3934462 - DNA, 17 bp, Homo sapiens
ctaacataaaatctgtg

SEQ ID NO: 3934463 - DNA, 15 bp, Homo sapiens
ctaacatatgtatta

SEQ ID NO: 3934464 - DNA, 17 bp, Homo sapiens
ctaaccccaacgcacag

SEQ ID NO: 3934465 - DNA, 13 bp, Homo sapiens
ctaacccctttcc

SEQ ID NO: 3934466 - DNA, 12 bp, Homo sapiens
ctaacctcagcc

SEQ ID NO: 3934467 - DNA, 12 bp, Homo sapiens
ctaacgcctgag

SEQ ID NO: 3934468 - DNA, 13 bp, Homo sapiens
ctaacgcctgagc

SEQ ID NO: 3934469 - DNA, 14 bp, Homo sapiens
ctaacgcctgagcc

SEQ ID NO: 3934470 - DNA, 21 bp, Homo sapiens
ctaacgcctgagcccagggag

SEQ ID NO: 3934471 - DNA, 21 bp, Homo sapiens
ctaacgggggtgcggcaggag

SEQ ID NO: 3934472 - DNA, 22 bp, Homo sapiens
ctaactaaggtcccataataaa

SEQ ID NO: 3934473 - DNA, 20 bp, Homo sapiens
ctaactccagtctcctgaca

SEQ ID NO: 3934474 - DNA, 14 bp, Homo sapiens
ctaactccagtgaa

SEQ ID NO: 3934475 - DNA, 13 bp, Homo sapiens
ctaactctggcac

SEQ ID NO: 3934476 - DNA, 14 bp, Homo sapiens
ctaactggactggt

SEQ ID NO: 3934477 - DNA, 14 bp, Homo sapiens
ctaactgtaaatca

SEQ ID NO: 3934478 - DNA, 16 bp, Homo sapiens
ctaactgtaaatcact

SEQ ID NO: 3934479 - DNA, 23 bp, Homo sapiens
ctaactgtaaatcacttgtaaat

SEQ ID NO: 3934480 - DNA, 16 bp, Homo sapiens
ctaagaagtccccagg

SEQ ID NO: 3934481 - DNA, 19 bp, Homo sapiens
ctaagaagtccccaggtca

SEQ ID NO: 3934482 - DNA, 13 bp, Homo sapiens
ctaagacctcccc

SEQ ID NO: 3934483 - DNA, 15 bp, Homo sapiens
ctaagagaatgaatt

SEQ ID NO: 3934484 - DNA, 20 bp, Homo sapiens
ctaagagctagcgctgccgc

SEQ ID NO: 3934485 - DNA, 20 bp, Homo sapiens
ctaagaggctatttaaaagt

SEQ ID NO: 3934486 - DNA, 24 bp, Homo sapiens
ctaagatgagatttgccagcacag

SEQ ID NO: 3934487 - DNA, 14 bp, Homo sapiens
ctaagcagctggga

SEQ ID NO: 3934488 - DNA, 16 bp, Homo sapiens
ctaagcagtgcttgta

SEQ ID NO: 3934489 - DNA, 23 bp, Homo sapiens
ctaagcctgttgctgaagtcatt

SEQ ID NO: 3934490 - DNA, 13 bp, Homo sapiens
ctaagctgcagct

SEQ ID NO: 3934491 - DNA, 17 bp, Homo sapiens
ctaagctgcagcttcct

SEQ ID NO: 3934492 - DNA, 19 bp, Homo sapiens
ctaagctggagctcttgga

SEQ ID NO: 3934493 - DNA, 14 bp, Homo sapiens
cggtgtaaaaccat

SEQ ID NO: 3934494 - DNA, 16 bp, Homo sapiens
cgtaattaaaagaatt

SEQ ID NO: 3934495 - DNA, 12 bp, Homo sapiens
cgtaattttatt

SEQ ID NO: 3934496 - DNA, 18 bp, Homo sapiens
cgtaattttattattaga

SEQ ID NO: 3934497 - DNA, 14 bp, Homo sapiens
cgtacatgtgaggc

SEQ ID NO: 3934498 - DNA, 13 bp, Homo sapiens
cgtaccagccagg

SEQ ID NO: 3934499 - DNA, 23 bp, Homo sapiens
cgtacttaactgtgtgaagaaat

SEQ ID NO: 3934500 - DNA, 13 bp, Homo sapiens
cgtagttccctga

SEQ ID NO: 3934501 - DNA, 22 bp, Homo sapiens
cgtagttccctgaaaacccaga

SEQ ID NO: 3934502 - DNA, 16 bp, Homo sapiens
cgtatttatatttgga

SEQ ID NO: 3934503 - DNA, 20 bp, Homo sapiens
cgtattttaaaagccacata

SEQ ID NO: 3934504 - DNA, 14 bp, Homo sapiens
cgtcaccacctctc

SEQ ID NO: 3934505 - DNA, 23 bp, Homo sapiens
cgtcaggagagacgcagccctgg

SEQ ID NO: 3934506 - DNA, 19 bp, Homo sapiens
cgtcatggcttaatgttta

SEQ ID NO: 3934507 - DNA, 20 bp, Homo sapiens
cgtcatggcttaatgtttat

SEQ ID NO: 3934508 - DNA, 21 bp, Homo sapiens
cgtccacaggggcaggcctgg

SEQ ID NO: 3934509 - DNA, 22 bp, Homo sapiens
cgtccacaggggcaggcctggg

SEQ ID NO: 3934510 - DNA, 14 bp, Homo sapiens
cgtccacccaggct

SEQ ID NO: 3934511 - DNA, 17 bp, Homo sapiens
cgtccacccaggctgca

SEQ ID NO: 3934512 - DNA, 20 bp, Homo sapiens
cgtccacccaggctgcactg

SEQ ID NO: 3934513 - DNA, 16 bp, Homo sapiens
cgtccatggcaccagc

SEQ ID NO: 3934514 - DNA, 18 bp, Homo sapiens
cgtccatggcaccagccc

SEQ ID NO: 3934515 - DNA, 22 bp, Homo sapiens
cgtcccaaacagagggccacac

SEQ ID NO: 3934516 - DNA, 14 bp, Homo sapiens
cgtcccctgcctca

SEQ ID NO: 3934517 - DNA, 13 bp, Homo sapiens
cgtcccctgctac

SEQ ID NO: 3934518 - DNA, 14 bp, Homo sapiens
cgtccctgcccaga

SEQ ID NO: 3934519 - DNA, 13 bp, Homo sapiens
cgtcctccccctg

SEQ ID NO: 3934520 - DNA, 19 bp, Homo sapiens
cgtcctgcagaggaccaca

SEQ ID NO: 3934521 - DNA, 22 bp, Homo sapiens
cgtcctgcccccgacagcccag

SEQ ID NO: 3934522 - DNA, 16 bp, Homo sapiens
cgtccttactcctgtg

SEQ ID NO: 3934523 - DNA, 20 bp, Homo sapiens
cgtccttactcctgtgggag

SEQ ID NO: 3934524 - DNA, 15 bp, Homo sapiens
cgtctaccctgggat

SEQ ID NO: 3934525 - DNA, 16 bp, Homo sapiens
cgtctccctaaaataa

SEQ ID NO: 3934526 - DNA, 17 bp, Homo sapiens
cgtctccctaaaataaa

SEQ ID NO: 3934527 - DNA, 19 bp, Homo sapiens
cgtctccctaaaataaaaa

SEQ ID NO: 3934528 - DNA, 23 bp, Homo sapiens
cgtctccctaaaataaaaaccag

SEQ ID NO: 3934529 - DNA, 19 bp, Homo sapiens
cgtctctctttctccctca

SEQ ID NO: 3934530 - DNA, 16 bp, Homo sapiens
cgtctgccccaccctc

SEQ ID NO: 3934531 - DNA, 15 bp, Homo sapiens
cgtctgcctggaaat

SEQ ID NO: 3934532 - DNA, 17 bp, Homo sapiens
cgtctggggttcagccc

SEQ ID NO: 3934533 - DNA, 18 bp, Homo sapiens
cgtctggggttcagcccc

SEQ ID NO: 3934534 - DNA, 19 bp, Homo sapiens
cgtctggggttcagcccct

SEQ ID NO: 3934535 - DNA, 11 bp, Homo sapiens
cgtctgtccca

SEQ ID NO: 3934536 - DNA, 19 bp, Homo sapiens
cgtcttctgtatactgtgg

SEQ ID NO: 3934537 - DNA, 17 bp, Homo sapiens
cgtgaaaccccgtctct

SEQ ID NO: 3934538 - DNA, 14 bp, Homo sapiens
cgtgaactgcgtgc

SEQ ID NO: 3934539 - DNA, 18 bp, Homo sapiens
cgtgaactgcgtgccagt

SEQ ID NO: 3934540 - DNA, 13 bp, Homo sapiens
cgtgaagcagtgc

SEQ ID NO: 3934541 - DNA, 17 bp, Homo sapiens
cgtgaagcagtgcctcg

SEQ ID NO: 3934542 - DNA, 21 bp, Homo sapiens
cgtgaagcagtgcctcgaggc

SEQ ID NO: 3934543 - DNA, 14 bp, Homo sapiens
cgtgaatgtctcag

SEQ ID NO: 3934544 - DNA, 17 bp, Homo sapiens
cgtgacccttcagggcc

SEQ ID NO: 3934545 - DNA, 20 bp, Homo sapiens
cgtgacccttcagggccaga

SEQ ID NO: 3934546 - DNA, 14 bp, Homo sapiens
cgtgactcacccaa

SEQ ID NO: 3934547 - DNA, 17 bp, Homo sapiens
cgtgactcacccaagca

SEQ ID NO: 3934548 - DNA, 17 bp, Homo sapiens
cgtgagagaatctgcct

SEQ ID NO: 3934549 - DNA, 18 bp, Homo sapiens
cgtgagagaatctgcctg

SEQ ID NO: 3934550 - DNA, 13 bp, Homo sapiens
cgtgagccaggta

SEQ ID NO: 3934551 - DNA, 21 bp, Homo sapiens
cgtgagccaggtaatgaggga

SEQ ID NO: 3934552 - DNA, 22 bp, Homo sapiens
cgtgagctatgattatgccact

SEQ ID NO: 3934553 - DNA, 20 bp, Homo sapiens
cgtgatttggaagagaggca

SEQ ID NO: 3934554 - DNA, 21 bp, Homo sapiens
cgtgatttggaagagaggcac

SEQ ID NO: 3934555 - DNA, 23 bp, Homo sapiens
cgtgatttggaagagaggcacct

SEQ ID NO: 3934556 - DNA, 20 bp, Homo sapiens
cgtgcacagcgcgggcggag

SEQ ID NO: 3934557 - DNA, 23 bp, Homo sapiens
cgtgccaagtccaggtcctggtg

SEQ ID NO: 3934558 - DNA, 13 bp, Homo sapiens
cgtgccaggcccg

SEQ ID NO: 3934559 - DNA, 19 bp, Homo sapiens
cgtgccgggagaggactct

SEQ ID NO: 3934560 - DNA, 21 bp, Homo sapiens
cgtgccgggagaggactctgc

SEQ ID NO: 3934561 - DNA, 15 bp, Homo sapiens
cgtgccttcagctct

SEQ ID NO: 3934562 - DNA, 16 bp, Homo sapiens
cgtgccttcagctcta

SEQ ID NO: 3934563 - DNA, 21 bp, Homo sapiens
cgtgcctttctctggctccag

SEQ ID NO: 3934564 - DNA, 22 bp, Homo sapiens
cgtgcctttctctggctccaga

SEQ ID NO: 3934565 - DNA, 23 bp, Homo sapiens
cgtgcctttctctggctccagaa

SEQ ID NO: 3934566 - DNA, 19 bp, Homo sapiens
cgtgcgtgtgtgtgtgttt

SEQ ID NO: 3934567 - DNA, 15 bp, Homo sapiens
cgtgctcgcagcctg

SEQ ID NO: 3934568 - DNA, 18 bp, Homo sapiens
cgtgcttagcctcctgac

SEQ ID NO: 3934569 - DNA, 15 bp, Homo sapiens
cgtgctttatttatg

SEQ ID NO: 3934570 - DNA, 19 bp, Homo sapiens
cgtgctttatttatggctt

SEQ ID NO: 3934571 - DNA, 14 bp, Homo sapiens
cgtggaccttcctg

SEQ ID NO: 3934572 - DNA, 17 bp, Homo sapiens
cgtggaccttcctgcca

SEQ ID NO: 3934573 - DNA, 17 bp, Homo sapiens
cgtggagcagaatcagt

SEQ ID NO: 3934574 - DNA, 13 bp, Homo sapiens
cgtggaggctgct

SEQ ID NO: 3934575 - DNA, 15 bp, Homo sapiens
cgtggaggctgctcg

SEQ ID NO: 3934576 - DNA, 17 bp, Homo sapiens
cgtggagggtaggggag

SEQ ID NO: 3934577 - DNA, 21 bp, Homo sapiens
cgtggagggtaggggagtgtg

SEQ ID NO: 3934578 - DNA, 15 bp, Homo sapiens
cgtggcaaatataaa

SEQ ID NO: 3934579 - DNA, 21 bp, Homo sapiens
ctcagggacagagacacctgc

SEQ ID NO: 3934580 - DNA, 11 bp, Homo sapiens
ctcagggctgg

SEQ ID NO: 3934581 - DNA, 16 bp, Homo sapiens
ctcagggctggagtgc

SEQ ID NO: 3934582 - DNA, 23 bp, Homo sapiens
ctcaggggccagtgagggctggg

SEQ ID NO: 3934583 - DNA, 20 bp, Homo sapiens
ctcagggggtcagcagagtt

SEQ ID NO: 3934584 - DNA, 17 bp, Homo sapiens
ctcaggggtggagaagt

SEQ ID NO: 3934585 - DNA, 15 bp, Homo sapiens
ctcaggtcactccag

SEQ ID NO: 3934586 - DNA, 17 bp, Homo sapiens
ctcaggtccctgcaggg

SEQ ID NO: 3934587 - DNA, 18 bp, Homo sapiens
ctcaggtccctgcagggc

SEQ ID NO: 3934588 - DNA, 17 bp, Homo sapiens
ctcaggtgccactccct

SEQ ID NO: 3934589 - DNA, 23 bp, Homo sapiens
ctcaggtgccactccctgagctt

SEQ ID NO: 3934590 - DNA, 21 bp, Homo sapiens
ctcagtaagtatctggaggaa

SEQ ID NO: 3934591 - DNA, 20 bp, Homo sapiens
ctcagtcagttcccggagca

SEQ ID NO: 3934592 - DNA, 15 bp, Homo sapiens
ctcagtccagatgcc

SEQ ID NO: 3934593 - DNA, 13 bp, Homo sapiens
ctcagtgccactt

SEQ ID NO: 3934594 - DNA, 20 bp, Homo sapiens
ctcagtgccacttgacattc

SEQ ID NO: 3934595 - DNA, 21 bp, Homo sapiens
ctcagtgccacttgacattcc

SEQ ID NO: 3934596 - DNA, 22 bp, Homo sapiens
ctcagtgccacttgacattcct

SEQ ID NO: 3934597 - DNA, 23 bp, Homo sapiens
ctcagtgccacttgacattcctt

SEQ ID NO: 3934598 - DNA, 14 bp, Homo sapiens
ctcagtgcctcctg

SEQ ID NO: 3934599 - DNA, 21 bp, Homo sapiens
ctcagtgctctcctaccccac

SEQ ID NO: 3934600 - DNA, 13 bp, Homo sapiens
ctcagttaaaatg

SEQ ID NO: 3934601 - DNA, 13 bp, Homo sapiens
ctcagttattcag

SEQ ID NO: 3934602 - DNA, 18 bp, Homo sapiens
ctcagttcaacctggtgg

SEQ ID NO: 3934603 - DNA, 21 bp, Homo sapiens
ctcagttcaacctggtggcac

SEQ ID NO: 3934604 - DNA, 17 bp, Homo sapiens
ctcagtttccccatttg

SEQ ID NO: 3934605 - DNA, 21 bp, Homo sapiens
ctcagtttttcggtgggacag

SEQ ID NO: 3934606 - DNA, 22 bp, Homo sapiens
ctcagtttttcggtgggacagc

SEQ ID NO: 3934607 - DNA, 18 bp, Homo sapiens
ctcatatgtagccctcat

SEQ ID NO: 3934608 - DNA, 12 bp, Homo sapiens
ctcatatttaaa

SEQ ID NO: 3934609 - DNA, 16 bp, Homo sapiens
ctcatattttgtatat

SEQ ID NO: 3934610 - DNA, 17 bp, Homo sapiens
ctcatcacccagtcctg

SEQ ID NO: 3934611 - DNA, 19 bp, Homo sapiens
ctcatcacccagtcctggc

SEQ ID NO: 3934612 - DNA, 13 bp, Homo sapiens
ctcatcatattgt

SEQ ID NO: 3934613 - DNA, 15 bp, Homo sapiens
ctcatcatattgtat

SEQ ID NO: 3934614 - DNA, 22 bp, Homo sapiens
ctcatcatattgtatgtaagta

SEQ ID NO: 3934615 - DNA, 15 bp, Homo sapiens
ctcatccctcggaag

SEQ ID NO: 3934616 - DNA, 12 bp, Homo sapiens
ctcatcctcctt

SEQ ID NO: 3934617 - DNA, 19 bp, Homo sapiens
ctcatcctgtgtggggagg

SEQ ID NO: 3934618 - DNA, 12 bp, Homo sapiens
ctcatctcactg

SEQ ID NO: 3934619 - DNA, 15 bp, Homo sapiens
ctcatcttgccccct

SEQ ID NO: 3934620 - DNA, 18 bp, Homo sapiens
ctcatgccacaccttctt

SEQ ID NO: 3934621 - DNA, 20 bp, Homo sapiens
ctcatgcctggcccccctcc

SEQ ID NO: 3934622 - DNA, 21 bp, Homo sapiens
ctcatgcctggcccccctcca

SEQ ID NO: 3934623 - DNA, 22 bp, Homo sapiens
ctcatggcgtaatgggcctgcc

SEQ ID NO: 3934624 - DNA, 12 bp, Homo sapiens
ctcatgtgatcc

SEQ ID NO: 3934625 - DNA, 16 bp, Homo sapiens
ctcatgtgatcctttt

SEQ ID NO: 3934626 - DNA, 17 bp, Homo sapiens
ctcatgtgtgctgtgct

SEQ ID NO: 3934627 - DNA, 14 bp, Homo sapiens
ctcatgttgttccc

SEQ ID NO: 3934628 - DNA, 13 bp, Homo sapiens
ctcattacccagg

SEQ ID NO: 3934629 - DNA, 17 bp, Homo sapiens
ctcattccaacagtgag

SEQ ID NO: 3934630 - DNA, 18 bp, Homo sapiens
ctcattccaccttcccat

SEQ ID NO: 3934631 - DNA, 12 bp, Homo sapiens
ctcattccccag

SEQ ID NO: 3934632 - DNA, 12 bp, Homo sapiens
ctcattcccctc

SEQ ID NO: 3934633 - DNA, 13 bp, Homo sapiens
ctcattcccctcg

SEQ ID NO: 3934634 - DNA, 17 bp, Homo sapiens
ctcattctctttctttt

SEQ ID NO: 3934635 - DNA, 21 bp, Homo sapiens
ctcattctgttgcccaggctg

SEQ ID NO: 3934636 - DNA, 16 bp, Homo sapiens
ctcatttctaaaagaa

SEQ ID NO: 3934637 - DNA, 22 bp, Homo sapiens
ctcattttaggcctcctctctg

SEQ ID NO: 3934638 - DNA, 23 bp, Homo sapiens
ctcatttttttttttgtttctga

SEQ ID NO: 3934639 - DNA, 16 bp, Homo sapiens
ctccaaacaccggcag

SEQ ID NO: 3934640 - DNA, 13 bp, Homo sapiens
ctccaaactcctg

SEQ ID NO: 3934641 - DNA, 14 bp, Homo sapiens
ctccaaaggggctg

SEQ ID NO: 3934642 - DNA, 18 bp, Homo sapiens
ctccaaaggggctgctgg

SEQ ID NO: 3934643 - DNA, 19 bp, Homo sapiens
ctccaaaggggctgctggg

SEQ ID NO: 3934644 - DNA, 22 bp, Homo sapiens
ctccaacagcttgaccagacct

SEQ ID NO: 3934645 - DNA, 12 bp, Homo sapiens
ctccaaggacca

SEQ ID NO: 3934646 - DNA, 15 bp, Homo sapiens
ctccaatcctttcca

SEQ ID NO: 3934647 - DNA, 14 bp, Homo sapiens
ctccaattgtaaaa

SEQ ID NO: 3934648 - DNA, 13 bp, Homo sapiens
ctccacagtgctg

SEQ ID NO: 3934649 - DNA, 20 bp, Homo sapiens
ctccacattaagtggctttt

SEQ ID NO: 3934650 - DNA, 12 bp, Homo sapiens
ctccaccaccca

SEQ ID NO: 3934651 - DNA, 16 bp, Homo sapiens
ctccaccacccaaaag

SEQ ID NO: 3934652 - DNA, 20 bp, Homo sapiens
ctccaccctcaccaggatga

SEQ ID NO: 3934653 - DNA, 15 bp, Homo sapiens
ctccaccgctgccta

SEQ ID NO: 3934654 - DNA, 16 bp, Homo sapiens
ctccaccgctgcctaa

SEQ ID NO: 3934655 - DNA, 18 bp, Homo sapiens
ctccacctcagccttgga

SEQ ID NO: 3934656 - DNA, 16 bp, Homo sapiens
ctccaccttgctcttc

SEQ ID NO: 3934657 - DNA, 20 bp, Homo sapiens
ctccaccttgttacacatta

SEQ ID NO: 3934658 - DNA, 15 bp, Homo sapiens
ctccacgcctcctgg

SEQ ID NO: 3934659 - DNA, 18 bp, Homo sapiens
ctccacgcctcctggcca

SEQ ID NO: 3934660 - DNA, 20 bp, Homo sapiens
ctccacgcctcctggccaga

SEQ ID NO: 3934661 - DNA, 19 bp, Homo sapiens
ctccacggtgcgtggctgt

SEQ ID NO: 3934662 - DNA, 21 bp, Homo sapiens
ctccacggtgcgtggctgtgg

SEQ ID NO: 3934663 - DNA, 13 bp, Homo sapiens
ctccactccccca

SEQ ID NO: 3934664 - DNA, 16 bp, Homo sapiens
ctccactcccccacct

SEQ ID NO: 3934665 - DNA, 23 bp, Homo sapiens
ctcacaagtagggagctcactcc

SEQ ID NO: 3934666 - DNA, 17 bp, Homo sapiens
ctcacagaacccttgga

SEQ ID NO: 3934667 - DNA, 16 bp, Homo sapiens
ctcacagagccaactc

SEQ ID NO: 3934668 - DNA, 17 bp, Homo sapiens
ctcacagttcctcgccc

SEQ ID NO: 3934669 - DNA, 19 bp, Homo sapiens
ctcaccagctgctgctctg

SEQ ID NO: 3934670 - DNA, 13 bp, Homo sapiens
ctcaccaggaagg

SEQ ID NO: 3934671 - DNA, 23 bp, Homo sapiens
ctaagtaaaaccacagcagttga

SEQ ID NO: 3934672 - DNA, 22 bp, Homo sapiens
ctaagtgggaagtgaagcccct

SEQ ID NO: 3934673 - DNA, 20 bp, Homo sapiens
ctaagtggggtgcatccccc

SEQ ID NO: 3934674 - DNA, 18 bp, Homo sapiens
ctaagtttagaagcgctc

SEQ ID NO: 3934675 - DNA, 23 bp, Homo sapiens
ctaagtttagaagcgctcatctg

SEQ ID NO: 3934676 - DNA, 13 bp, Homo sapiens
ctaataaaagcat

SEQ ID NO: 3934677 - DNA, 19 bp, Homo sapiens
ctaatagaaccaagaattc

SEQ ID NO: 3934678 - DNA, 18 bp, Homo sapiens
ctaatattaaaaatatgg

SEQ ID NO: 3934679 - DNA, 19 bp, Homo sapiens
ctaatcaagagtgagtgaa

SEQ ID NO: 3934680 - DNA, 19 bp, Homo sapiens
ctaatcagcattctcactc

SEQ ID NO: 3934681 - DNA, 12 bp, Homo sapiens
ctaatcctccaa

SEQ ID NO: 3934682 - DNA, 18 bp, Homo sapiens
ctaatctcatacctctga

SEQ ID NO: 3934683 - DNA, 22 bp, Homo sapiens
ctaatctcatacctctgaccaa

SEQ ID NO: 3934684 - DNA, 14 bp, Homo sapiens
ctaatgaaattgag

SEQ ID NO: 3934685 - DNA, 17 bp, Homo sapiens
ctaatgaaattgagaag

SEQ ID NO: 3934686 - DNA, 23 bp, Homo sapiens
ctaatgaagggaaaggatatttt

SEQ ID NO: 3934687 - DNA, 15 bp, Homo sapiens
ctaattaaaatctgg

SEQ ID NO: 3934688 - DNA, 18 bp, Homo sapiens
ctaattaaaatctggaaa

SEQ ID NO: 3934689 - DNA, 19 bp, Homo sapiens
ctaattaaaatctggaaat

SEQ ID NO: 3934690 - DNA, 23 bp, Homo sapiens
ctaattaaggtttgccctgcctg

SEQ ID NO: 3934691 - DNA, 15 bp, Homo sapiens
ctaattcaatttatg

SEQ ID NO: 3934692 - DNA, 15 bp, Homo sapiens
ctaattcctttctat

SEQ ID NO: 3934693 - DNA, 19 bp, Homo sapiens
ctaattggaagaaattcct

SEQ ID NO: 3934694 - DNA, 21 bp, Homo sapiens
ctaattggaagaaattcctgt

SEQ ID NO: 3934695 - DNA, 22 bp, Homo sapiens
ctaattggaagaaattcctgta

SEQ ID NO: 3934696 - DNA, 14 bp, Homo sapiens
ctaatttaaaaaat

SEQ ID NO: 3934697 - DNA, 18 bp, Homo sapiens
ctaatttaaaccagcaga

SEQ ID NO: 3934698 - DNA, 19 bp, Homo sapiens
ctaatttaaaccagcagaa

SEQ ID NO: 3934699 - DNA, 23 bp, Homo sapiens
ctaatttaaaccagcagaaaagt

SEQ ID NO: 3934700 - DNA, 15 bp, Homo sapiens
ctaatttatacaaaa

SEQ ID NO: 3934701 - DNA, 13 bp, Homo sapiens
ctacaaaatggag

SEQ ID NO: 3934702 - DNA, 16 bp, Homo sapiens
ctacaacaagagttta

SEQ ID NO: 3934703 - DNA, 13 bp, Homo sapiens
ctacaaccagagc

SEQ ID NO: 3934704 - DNA, 14 bp, Homo sapiens
ctacaaccagagcc

SEQ ID NO: 3934705 - DNA, 15 bp, Homo sapiens
ctacaaccagagccc

SEQ ID NO: 3934706 - DNA, 19 bp, Homo sapiens
ctacaaccagagcccccca

SEQ ID NO: 3934707 - DNA, 16 bp, Homo sapiens
ctacaagcatatttga

SEQ ID NO: 3934708 - DNA, 15 bp, Homo sapiens
ctacaaggacaatgc

SEQ ID NO: 3934709 - DNA, 13 bp, Homo sapiens
ctacaataaatgc

SEQ ID NO: 3934710 - DNA, 16 bp, Homo sapiens
ctacaataaatgctga

SEQ ID NO: 3934711 - DNA, 17 bp, Homo sapiens
ctacaataaatgctgaa

SEQ ID NO: 3934712 - DNA, 22 bp, Homo sapiens
ctacaataaatgctgaatgaat

SEQ ID NO: 3934713 - DNA, 20 bp, Homo sapiens
ctacacagtgggaactctga

SEQ ID NO: 3934714 - DNA, 16 bp, Homo sapiens
ctacaccactctggca

SEQ ID NO: 3934715 - DNA, 14 bp, Homo sapiens
ctacacctccctcc

SEQ ID NO: 3934716 - DNA, 15 bp, Homo sapiens
ctacactaataaatg

SEQ ID NO: 3934717 - DNA, 17 bp, Homo sapiens
ctacagaaatactgctc

SEQ ID NO: 3934718 - DNA, 20 bp, Homo sapiens
ctacagaaatactgctctga

SEQ ID NO: 3934719 - DNA, 15 bp, Homo sapiens
ctacagaacaaagaa

SEQ ID NO: 3934720 - DNA, 16 bp, Homo sapiens
ctacagaacaaagaac

SEQ ID NO: 3934721 - DNA, 14 bp, Homo sapiens
ctacagattttaga

SEQ ID NO: 3934722 - DNA, 14 bp, Homo sapiens
ctacagcctcagaa

SEQ ID NO: 3934723 - DNA, 16 bp, Homo sapiens
ctacaggtgcaagcca

SEQ ID NO: 3934724 - DNA, 17 bp, Homo sapiens
ctacaggtgcaagccac

SEQ ID NO: 3934725 - DNA, 18 bp, Homo sapiens
ctacatactatggaattt

SEQ ID NO: 3934726 - DNA, 16 bp, Homo sapiens
ctacatcttcagctcc

SEQ ID NO: 3934727 - DNA, 22 bp, Homo sapiens
ctacatcttcagctcccatagc

SEQ ID NO: 3934728 - DNA, 19 bp, Homo sapiens
ctacattcctcagctgcca

SEQ ID NO: 3934729 - DNA, 22 bp, Homo sapiens
ctacattcctcagctgccaagc

SEQ ID NO: 3934730 - DNA, 19 bp, Homo sapiens
ctaccaaatataaacttgt

SEQ ID NO: 3934731 - DNA, 17 bp, Homo sapiens
ctaccaaggcccagcta

SEQ ID NO: 3934732 - DNA, 18 bp, Homo sapiens
ctaccaccccttcctgtc

SEQ ID NO: 3934733 - DNA, 13 bp, Homo sapiens
ctacccaaccact

SEQ ID NO: 3934734 - DNA, 16 bp, Homo sapiens
ctacccaaccactcaa

SEQ ID NO: 3934735 - DNA, 14 bp, Homo sapiens
ctaccccaccacga

SEQ ID NO: 3934736 - DNA, 16 bp, Homo sapiens
ctaccccccaaaaaaa

SEQ ID NO: 3934737 - DNA, 16 bp, Homo sapiens
ctacccgagcccagct

SEQ ID NO: 3934738 - DNA, 16 bp, Homo sapiens
ctacccggcccagaga

SEQ ID NO: 3934739 - DNA, 15 bp, Homo sapiens
ctaccctccagagtg

SEQ ID NO: 3934740 - DNA, 22 bp, Homo sapiens
ctacccttgtaccccatccctt

SEQ ID NO: 3934741 - DNA, 22 bp, Homo sapiens
ctacccttgttagttattttag

SEQ ID NO: 3934742 - DNA, 19 bp, Homo sapiens
ctaccgagtctcttctcca

SEQ ID NO: 3934743 - DNA, 12 bp, Homo sapiens
ctacctgccctc

SEQ ID NO: 3934744 - DNA, 16 bp, Homo sapiens
ctacctgccctctctc

SEQ ID NO: 3934745 - DNA, 17 bp, Homo sapiens
ctacctgccctctctca

SEQ ID NO: 3934746 - DNA, 18 bp, Homo sapiens
ctacctgccctctctcag

SEQ ID NO: 3934747 - DNA, 22 bp, Homo sapiens
ctacctgccctctctcagttat

SEQ ID NO: 3934748 - DNA, 16 bp, Homo sapiens
ctacctgctgctgcta

SEQ ID NO: 3934749 - DNA, 11 bp, Homo sapiens
ctacctgtgtg

SEQ ID NO: 3934750 - DNA, 19 bp, Homo sapiens
ctaccttaaaatgtaaaac

SEQ ID NO: 3934751 - DNA, 16 bp, Homo sapiens
ctaccttctgacctcc

SEQ ID NO: 3934752 - DNA, 19 bp, Homo sapiens
ctacctttttttctctcct

SEQ ID NO: 3934753 - DNA, 20 bp, Homo sapiens
ctacctttttttctctccta

SEQ ID NO: 3934754 - DNA, 17 bp, Homo sapiens
ctacgttctccagccca

SEQ ID NO: 3934755 - DNA, 21 bp, Homo sapiens
ctacgttctccagcccacacc

SEQ ID NO: 3934756 - DNA, 14 bp, Homo sapiens
ctactaaagtgcct

SEQ ID NO: 3934757 - DNA, 18 bp, Homo sapiens
ctactaaagtgcctaccc

SEQ ID NO: 3934758 - DNA, 18 bp, Homo sapiens
ctccactcccccacctga

SEQ ID NO: 3934759 - DNA, 21 bp, Homo sapiens
ctccactcccccacctgacaa

SEQ ID NO: 3934760 - DNA, 13 bp, Homo sapiens
ctccactctcctt

SEQ ID NO: 3934761 - DNA, 13 bp, Homo sapiens
ctccactgccttc

SEQ ID NO: 3934762 - DNA, 14 bp, Homo sapiens
ctccactggatgga

SEQ ID NO: 3934763 - DNA, 13 bp, Homo sapiens
ctccactggctcc

SEQ ID NO: 3934764 - DNA, 13 bp, Homo sapiens
ctccactgtcacc

SEQ ID NO: 3934765 - DNA, 14 bp, Homo sapiens
ctccagaatctgct

SEQ ID NO: 3934766 - DNA, 17 bp, Homo sapiens
ctccagaatctgctgtt

SEQ ID NO: 3934767 - DNA, 19 bp, Homo sapiens
ctccagaatctgctgttgc

SEQ ID NO: 3934768 - DNA, 20 bp, Homo sapiens
ctccagaatctgctgttgcc

SEQ ID NO: 3934769 - DNA, 13 bp, Homo sapiens
ctccagacagata

SEQ ID NO: 3934770 - DNA, 15 bp, Homo sapiens
ctccagacccctggc

SEQ ID NO: 3934771 - DNA, 16 bp, Homo sapiens
ctccagacccctgtgg

SEQ ID NO: 3934772 - DNA, 15 bp, Homo sapiens
ctccagaccctgcct

SEQ ID NO: 3934773 - DNA, 16 bp, Homo sapiens
ctccagaccctgcctg

SEQ ID NO: 3934774 - DNA, 19 bp, Homo sapiens
ctccagaccctgcctgagc

SEQ ID NO: 3934775 - DNA, 23 bp, Homo sapiens
ctccagagggacagggtggaccc

SEQ ID NO: 3934776 - DNA, 15 bp, Homo sapiens
ctccagagtctgagc

SEQ ID NO: 3934777 - DNA, 20 bp, Homo sapiens
ctccagagtgtgcagactga

SEQ ID NO: 3934778 - DNA, 17 bp, Homo sapiens
ctccagatctgcactgg

SEQ ID NO: 3934779 - DNA, 16 bp, Homo sapiens
ctccagccagcaatga

SEQ ID NO: 3934780 - DNA, 17 bp, Homo sapiens
ctccagcccacacccct

SEQ ID NO: 3934781 - DNA, 22 bp, Homo sapiens
ctccagcccacacccctccaaa

SEQ ID NO: 3934782 - DNA, 12 bp, Homo sapiens
ctccagccctgt

SEQ ID NO: 3934783 - DNA, 14 bp, Homo sapiens
ctccagcctctccc

SEQ ID NO: 3934784 - DNA, 19 bp, Homo sapiens
ctccagcctctcccggctg

SEQ ID NO: 3934785 - DNA, 14 bp, Homo sapiens
ctccagcctgggca

SEQ ID NO: 3934786 - DNA, 12 bp, Homo sapiens
ctccagctccag

SEQ ID NO: 3934787 - DNA, 19 bp, Homo sapiens
ctccagctccagtttccaa

SEQ ID NO: 3934788 - DNA, 17 bp, Homo sapiens
ctccaggatggtgcagg

SEQ ID NO: 3934789 - DNA, 16 bp, Homo sapiens
ctccaggcatgctggc

SEQ ID NO: 3934790 - DNA, 19 bp, Homo sapiens
ctccaggcatgctggcctc

SEQ ID NO: 3934791 - DNA, 23 bp, Homo sapiens
ctccaggcatgctggcctcccaa

SEQ ID NO: 3934792 - DNA, 13 bp, Homo sapiens
ctccagggctgcc

SEQ ID NO: 3934793 - DNA, 15 bp, Homo sapiens
ctccagggctgcccc

SEQ ID NO: 3934794 - DNA, 16 bp, Homo sapiens
ctccagggctgcccct

SEQ ID NO: 3934795 - DNA, 18 bp, Homo sapiens
ctccagggctgcccctgt

SEQ ID NO: 3934796 - DNA, 16 bp, Homo sapiens
ctccagggtcttgggc

SEQ ID NO: 3934797 - DNA, 19 bp, Homo sapiens
ctccaggtccggaggggtt

SEQ ID NO: 3934798 - DNA, 20 bp, Homo sapiens
ctccagtattcttgtcaaaa

SEQ ID NO: 3934799 - DNA, 16 bp, Homo sapiens
ctccagtctcctgaca

SEQ ID NO: 3934800 - DNA, 18 bp, Homo sapiens
ctccagtctcctgacatt

SEQ ID NO: 3934801 - DNA, 22 bp, Homo sapiens
ctccagtttccaagttcctgca

SEQ ID NO: 3934802 - DNA, 16 bp, Homo sapiens
ctccataatgccactg

SEQ ID NO: 3934803 - DNA, 17 bp, Homo sapiens
ctccataatgccactgg

SEQ ID NO: 3934804 - DNA, 17 bp, Homo sapiens
ctccatatctccttccc

SEQ ID NO: 3934805 - DNA, 15 bp, Homo sapiens
ctccatccggctcct

SEQ ID NO: 3934806 - DNA, 13 bp, Homo sapiens
ctccatctccact

SEQ ID NO: 3934807 - DNA, 14 bp, Homo sapiens
ctccatgcccaacc

SEQ ID NO: 3934808 - DNA, 14 bp, Homo sapiens
ctccatgctgcctc

SEQ ID NO: 3934809 - DNA, 14 bp, Homo sapiens
ctccatggaggagg

SEQ ID NO: 3934810 - DNA, 22 bp, Homo sapiens
ctccatggccaccccgtgccac

SEQ ID NO: 3934811 - DNA, 17 bp, Homo sapiens
ctccatgggctagtgtg

SEQ ID NO: 3934812 - DNA, 21 bp, Homo sapiens
ctccatggggaagtgctcccc

SEQ ID NO: 3934813 - DNA, 22 bp, Homo sapiens
ctccatgtggccccaggtgcca

SEQ ID NO: 3934814 - DNA, 22 bp, Homo sapiens
ctccattaggatttgccccttc

SEQ ID NO: 3934815 - DNA, 19 bp, Homo sapiens
ctccatttcaactccagaa

SEQ ID NO: 3934816 - DNA, 17 bp, Homo sapiens
ctccatttctctccagg

SEQ ID NO: 3934817 - DNA, 17 bp, Homo sapiens
ctcccaaagctcagact

SEQ ID NO: 3934818 - DNA, 20 bp, Homo sapiens
ctcccaaagctcagacttgc

SEQ ID NO: 3934819 - DNA, 16 bp, Homo sapiens
ctcccaacctcaatgc

SEQ ID NO: 3934820 - DNA, 22 bp, Homo sapiens
ctcccaacctcaatgccctgcc

SEQ ID NO: 3934821 - DNA, 14 bp, Homo sapiens
ctcccacaggccct

SEQ ID NO: 3934822 - DNA, 20 bp, Homo sapiens
ctcccacaggcccttcctct

SEQ ID NO: 3934823 - DNA, 14 bp, Homo sapiens
ctcccaccaggcta

SEQ ID NO: 3934824 - DNA, 11 bp, Homo sapiens
ctcccacccca

SEQ ID NO: 3934825 - DNA, 15 bp, Homo sapiens
ctcccaccccactcc

SEQ ID NO: 3934826 - DNA, 16 bp, Homo sapiens
ctcccaccccactcca

SEQ ID NO: 3934827 - DNA, 17 bp, Homo sapiens
ctcccaccccactccag

SEQ ID NO: 3934828 - DNA, 19 bp, Homo sapiens
ctcccaccccactccagcc

SEQ ID NO: 3934829 - DNA, 20 bp, Homo sapiens
ctcccaccccactccagccc

SEQ ID NO: 3934830 - DNA, 21 bp, Homo sapiens
ctcccaccccactccagccct

SEQ ID NO: 3934831 - DNA, 18 bp, Homo sapiens
ctcccaccccatgcatta

SEQ ID NO: 3934832 - DNA, 16 bp, Homo sapiens
ctcccaccccggcctc

SEQ ID NO: 3934833 - DNA, 17 bp, Homo sapiens
ctcccaccccggcctcc

SEQ ID NO: 3934834 - DNA, 21 bp, Homo sapiens
ctcccacgtgggagacaagaa

SEQ ID NO: 3934835 - DNA, 17 bp, Homo sapiens
ctcccagagtgctagga

SEQ ID NO: 3934836 - DNA, 19 bp, Homo sapiens
ctcccagcaagtttcacct

SEQ ID NO: 3934837 - DNA, 18 bp, Homo sapiens
ctcccagccctatggatg

SEQ ID NO: 3934838 - DNA, 12 bp, Homo sapiens
ctcccagccctg

SEQ ID NO: 3934839 - DNA, 16 bp, Homo sapiens
ctcccagccctgccag

SEQ ID NO: 3934840 - DNA, 19 bp, Homo sapiens
ctcccagccctgccaggag

SEQ ID NO: 3934841 - DNA, 18 bp, Homo sapiens
ctcccaggaactgggcca

SEQ ID NO: 3934842 - DNA, 17 bp, Homo sapiens
ctcccaggcactgtctt

SEQ ID NO: 3934843 - DNA, 12 bp, Homo sapiens
ctcccaggcccc

SEQ ID NO: 3934844 - DNA, 14 bp, Homo sapiens
ctcctttgcactga

SEQ ID NO: 3934845 - DNA, 16 bp, Homo sapiens
ctcctttgcactgagg

SEQ ID NO: 3934846 - DNA, 20 bp, Homo sapiens
ctcctttgcactgagggcca

SEQ ID NO: 3934847 - DNA, 22 bp, Homo sapiens
ctcctttgcactgagggccaca

SEQ ID NO: 3934848 - DNA, 15 bp, Homo sapiens
ctccttttgctgtct

SEQ ID NO: 3934849 - DNA, 19 bp, Homo sapiens
ctccttttgtccccagggc

SEQ ID NO: 3934850 - DNA, 20 bp, Homo sapiens
ctccttttgtccccagggcc

SEQ ID NO: 3934851 - DNA, 14 bp, Homo sapiens
ctcgaaccaaggca

SEQ ID NO: 3934852 - DNA, 14 bp, Homo sapiens
ctcgagaccatcct

SEQ ID NO: 3934853 - DNA, 15 bp, Homo sapiens
ctcgagaccatcctg

SEQ ID NO: 3934854 - DNA, 18 bp, Homo sapiens
ctcgagaccatcctggcc

SEQ ID NO: 3934855 - DNA, 15 bp, Homo sapiens
ctcgagcccagatgg

SEQ ID NO: 3934856 - DNA, 23 bp, Homo sapiens
ctcgagccccctggatgtcccct

SEQ ID NO: 3934857 - DNA, 19 bp, Homo sapiens
ctcgagcgccctgcagacc

SEQ ID NO: 3934858 - DNA, 23 bp, Homo sapiens
ctcgagcgccctgcagaccctgc

SEQ ID NO: 3934859 - DNA, 18 bp, Homo sapiens
ctcgaggcaccggcgctg

SEQ ID NO: 3934860 - DNA, 19 bp, Homo sapiens
ctcgaggcaccggcgctgc

SEQ ID NO: 3934861 - DNA, 20 bp, Homo sapiens
ctcgaggcaccggcgctgca

SEQ ID NO: 3934862 - DNA, 15 bp, Homo sapiens
ctcgcagcaggtgca

SEQ ID NO: 3934863 - DNA, 22 bp, Homo sapiens
ctcgcagcaggtgcaagagaca

SEQ ID NO: 3934864 - DNA, 23 bp, Homo sapiens
ctcgcagcaggtgcaagagacag

SEQ ID NO: 3934865 - DNA, 15 bp, Homo sapiens
ctcgcagcctggcgg

SEQ ID NO: 3934866 - DNA, 22 bp, Homo sapiens
ctcgcagcctggcggggcagga

SEQ ID NO: 3934867 - DNA, 14 bp, Homo sapiens
ctcgcaggtctcag

SEQ ID NO: 3934868 - DNA, 15 bp, Homo sapiens
ctcgcagtcgcagga

SEQ ID NO: 3934869 - DNA, 14 bp, Homo sapiens
ctcgccccacccag

SEQ ID NO: 3934870 - DNA, 16 bp, Homo sapiens
ctcgccggccttgttt

SEQ ID NO: 3934871 - DNA, 12 bp, Homo sapiens
ctcgcctaggcc

SEQ ID NO: 3934872 - DNA, 18 bp, Homo sapiens
ctcgcctaggcctgtgag

SEQ ID NO: 3934873 - DNA, 16 bp, Homo sapiens
ctcgcctgggcccagg

SEQ ID NO: 3934874 - DNA, 18 bp, Homo sapiens
ctcgcctgggcccaggct

SEQ ID NO: 3934875 - DNA, 16 bp, Homo sapiens
ctcgctccccactctg

SEQ ID NO: 3934876 - DNA, 17 bp, Homo sapiens
ctcgctccccactctgc

SEQ ID NO: 3934877 - DNA, 21 bp, Homo sapiens
ctcgctccccactctgctctg

SEQ ID NO: 3934878 - DNA, 23 bp, Homo sapiens
ctcgctccccactctgctctgat

SEQ ID NO: 3934879 - DNA, 22 bp, Homo sapiens
ctcgctccctgtagctctgcct

SEQ ID NO: 3934880 - DNA, 14 bp, Homo sapiens
ctcgctcttgggag

SEQ ID NO: 3934881 - DNA, 12 bp, Homo sapiens
ctcgctgctgct

SEQ ID NO: 3934882 - DNA, 24 bp, Homo sapiens
ctcgctgctgctactacccgagcc

SEQ ID NO: 3934883 - DNA, 13 bp, Homo sapiens
ctcggacccacca

SEQ ID NO: 3934884 - DNA, 23 bp, Homo sapiens
ctcggacccaccaaactgcacac

SEQ ID NO: 3934885 - DNA, 12 bp, Homo sapiens
ctcggagaagag

SEQ ID NO: 3934886 - DNA, 17 bp, Homo sapiens
ctcggccccctccatcg

SEQ ID NO: 3934887 - DNA, 15 bp, Homo sapiens
ctcgggacacctgcc

SEQ ID NO: 3934888 - DNA, 21 bp, Homo sapiens
ctcgggaggctgagacaggag

SEQ ID NO: 3934889 - DNA, 20 bp, Homo sapiens
ctcggggcccttggggcctg

SEQ ID NO: 3934890 - DNA, 24 bp, Homo sapiens
ctcggggcccttggggcctggctt

SEQ ID NO: 3934891 - DNA, 17 bp, Homo sapiens
ctcggggtgcacaggag

SEQ ID NO: 3934892 - DNA, 18 bp, Homo sapiens
ctcggggtgcacaggagg

SEQ ID NO: 3934893 - DNA, 12 bp, Homo sapiens
ctcgtaccagcc

SEQ ID NO: 3934894 - DNA, 15 bp, Homo sapiens
ctcgtccacaggggc

SEQ ID NO: 3934895 - DNA, 16 bp, Homo sapiens
ctcgtccacaggggca

SEQ ID NO: 3934896 - DNA, 18 bp, Homo sapiens
ctcgtccacaggggcagg

SEQ ID NO: 3934897 - DNA, 19 bp, Homo sapiens
ctcgtccacaggggcaggc

SEQ ID NO: 3934898 - DNA, 20 bp, Homo sapiens
ctcgtccacaggggcaggcc

SEQ ID NO: 3934899 - DNA, 21 bp, Homo sapiens
ctcgtccacaggggcaggcct

SEQ ID NO: 3934900 - DNA, 14 bp, Homo sapiens
ctcgtcctccccct

SEQ ID NO: 3934901 - DNA, 20 bp, Homo sapiens
ctcgtcctccccctgccagt

SEQ ID NO: 3934902 - DNA, 16 bp, Homo sapiens
ctcgtggacacctgcc

SEQ ID NO: 3934903 - DNA, 19 bp, Homo sapiens
ctcgtggacacctgccctg

SEQ ID NO: 3934904 - DNA, 11 bp, Homo sapiens
ctcgtggcctt

SEQ ID NO: 3934905 - DNA, 17 bp, Homo sapiens
ctcgtggtagaagccag

SEQ ID NO: 3934906 - DNA, 18 bp, Homo sapiens
ctcgtgtgatttcctaca

SEQ ID NO: 3934907 - DNA, 18 bp, Homo sapiens
ctctaaaaataaaatgat

SEQ ID NO: 3934908 - DNA, 19 bp, Homo sapiens
ctctaaattctttatttct

SEQ ID NO: 3934909 - DNA, 21 bp, Homo sapiens
ctctaacccccagtgccacag

SEQ ID NO: 3934910 - DNA, 12 bp, Homo sapiens
ctctaacgcctg

SEQ ID NO: 3934911 - DNA, 16 bp, Homo sapiens
ctctaacgcctgagcc

SEQ ID NO: 3934912 - DNA, 22 bp, Homo sapiens
ctctaacgcctgagcccaggga

SEQ ID NO: 3934913 - DNA, 19 bp, Homo sapiens
ctctaagccactcttccaa

SEQ ID NO: 3934914 - DNA, 15 bp, Homo sapiens
ctctaagctggagct

SEQ ID NO: 3934915 - DNA, 13 bp, Homo sapiens
ctctaagtctcca

SEQ ID NO: 3934916 - DNA, 17 bp, Homo sapiens
ctctacaaactcccact

SEQ ID NO: 3934917 - DNA, 17 bp, Homo sapiens
ctctacccggcccagag

SEQ ID NO: 3934918 - DNA, 19 bp, Homo sapiens
ctctacccggcccagagac

SEQ ID NO: 3934919 - DNA, 14 bp, Homo sapiens
ctctacgccaaagt

SEQ ID NO: 3934920 - DNA, 21 bp, Homo sapiens
ctctacttctttttctttgag

SEQ ID NO: 3934921 - DNA, 17 bp, Homo sapiens
ctctagaacacccactg

SEQ ID NO: 3934922 - DNA, 19 bp, Homo sapiens
ctctagaacacccactggc

SEQ ID NO: 3934923 - DNA, 20 bp, Homo sapiens
ctctagaacacccactggcc

SEQ ID NO: 3934924 - DNA, 11 bp, Homo sapiens
ctctagaacat

SEQ ID NO: 3934925 - DNA, 20 bp, Homo sapiens
ctctagcctgggccagagaa

SEQ ID NO: 3934926 - DNA, 12 bp, Homo sapiens
ctctagctggca

SEQ ID NO: 3934927 - DNA, 15 bp, Homo sapiens
ctctagctggcagga

SEQ ID NO: 3934928 - DNA, 18 bp, Homo sapiens
ctctagctggcaggacac

SEQ ID NO: 3934929 - DNA, 14 bp, Homo sapiens
ctctagtcttgctt

SEQ ID NO: 3934930 - DNA, 21 bp, Homo sapiens
ctctagtcttgctttgctgtc

SEQ ID NO: 3934931 - DNA, 19 bp, Homo sapiens
ctctagtgacttcctggtg

SEQ ID NO: 3934932 - DNA, 20 bp, Homo sapiens
ctctagttttcagccttggg

SEQ ID NO: 3934933 - DNA, 22 bp, Homo sapiens
ctctatatttagattgttaaaa

SEQ ID NO: 3934934 - DNA, 15 bp, Homo sapiens
ctctatcccaagcca

SEQ ID NO: 3934935 - DNA, 20 bp, Homo sapiens
ctctattaagatttccaagt

SEQ ID NO: 3934936 - DNA, 15 bp, Homo sapiens
ctctatttaatattt

SEQ ID NO: 3934937 - DNA, 15 bp, Homo sapiens
ctctcaagctagcca

SEQ ID NO: 3934938 - DNA, 20 bp, Homo sapiens
ctctcaagctagccagaggg

SEQ ID NO: 3934939 - DNA, 21 bp, Homo sapiens
ctctcaatattcaataaagct

SEQ ID NO: 3934940 - DNA, 21 bp, Homo sapiens
ctctcacacacatagattaat

SEQ ID NO: 3934941 - DNA, 17 bp, Homo sapiens
ctctcaggagcacaggc

SEQ ID NO: 3934942 - DNA, 19 bp, Homo sapiens
ctctcaggaggcgcagccc

SEQ ID NO: 3934943 - DNA, 21 bp, Homo sapiens
ctctcaggaggcgcagcccga

SEQ ID NO: 3934944 - DNA, 22 bp, Homo sapiens
ctctcaggaggcgcagcccgaa

SEQ ID NO: 3934945 - DNA, 16 bp, Homo sapiens
ctctcaggagtatctt

SEQ ID NO: 3934946 - DNA, 20 bp, Homo sapiens
ctctcaggggccagtgaggg

SEQ ID NO: 3934947 - DNA, 13 bp, Homo sapiens
ctctcagttattc

SEQ ID NO: 3934948 - DNA, 14 bp, Homo sapiens
ctctcagttattca

SEQ ID NO: 3934949 - DNA, 20 bp, Homo sapiens
ctctcagttattcagattga

SEQ ID NO: 3934950 - DNA, 16 bp, Homo sapiens
ctctcatgcctgcctg

SEQ ID NO: 3934951 - DNA, 15 bp, Homo sapiens
ctctcattccccagg

SEQ ID NO: 3934952 - DNA, 16 bp, Homo sapiens
ctctccaaaggggctg

SEQ ID NO: 3934953 - DNA, 18 bp, Homo sapiens
ctctccaaaggggctgct

SEQ ID NO: 3934954 - DNA, 21 bp, Homo sapiens
ctctccaaaggggctgctggg

SEQ ID NO: 3934955 - DNA, 23 bp, Homo sapiens
ctctccaaaggggctgctggggc

SEQ ID NO: 3934956 - DNA, 20 bp, Homo sapiens
ctctccacctcagccttgga

SEQ ID NO: 3934957 - DNA, 11 bp, Homo sapiens
ctctccactgc

SEQ ID NO: 3934958 - DNA, 14 bp, Homo sapiens
ctctccactgcctt

SEQ ID NO: 3934959 - DNA, 18 bp, Homo sapiens
ctctccatgcccaaccta

SEQ ID NO: 3934960 - DNA, 22 bp, Homo sapiens
ctctcccaccccggcctccact

SEQ ID NO: 3934961 - DNA, 21 bp, Homo sapiens
ctctcccacgatgtcaaggac

SEQ ID NO: 3934962 - DNA, 11 bp, Homo sapiens
ctctcccatac

SEQ ID NO: 3934963 - DNA, 18 bp, Homo sapiens
ctctcccccgcccaaggc

SEQ ID NO: 3934964 - DNA, 12 bp, Homo sapiens
ctctcccctccc

SEQ ID NO: 3934965 - DNA, 19 bp, Homo sapiens
ctctcccggctgcctgccg

SEQ ID NO: 3934966 - DNA, 22 bp, Homo sapiens
ctctccctctggccctgccttc

SEQ ID NO: 3934967 - DNA, 14 bp, Homo sapiens
ctctcccttttaaa

SEQ ID NO: 3934968 - DNA, 21 bp, Homo sapiens
ctctcctaccccacctcatgc

SEQ ID NO: 3934969 - DNA, 22 bp, Homo sapiens
ctctcctaccccacctcatgcc

SEQ ID NO: 3934970 - DNA, 15 bp, Homo sapiens
ctctcctagcccctg

SEQ ID NO: 3934971 - DNA, 13 bp, Homo sapiens
ctctcctcagact

SEQ ID NO: 3934972 - DNA, 18 bp, Homo sapiens
ctctcctcagactgctca

SEQ ID NO: 3934973 - DNA, 20 bp, Homo sapiens
ctctcctcggccccctccat

SEQ ID NO: 3934974 - DNA, 15 bp, Homo sapiens
ctctcctctgcctca

SEQ ID NO: 3934975 - DNA, 15 bp, Homo sapiens
ctctcctcttgccac

SEQ ID NO: 3934976 - DNA, 16 bp, Homo sapiens
ctctcctcttgccact

SEQ ID NO: 3934977 - DNA, 22 bp, Homo sapiens
ctctcctcttgccactgcctct

SEQ ID NO: 3934978 - DNA, 12 bp, Homo sapiens
ctctccttccct

SEQ ID NO: 3934979 - DNA, 14 bp, Homo sapiens
ctctccttccctct

SEQ ID NO: 3934980 - DNA, 21 bp, Homo sapiens
ctctccttcgtgtctctccca

SEQ ID NO: 3934981 - DNA, 16 bp, Homo sapiens
ctctccttcttccctg

SEQ ID NO: 3934982 - DNA, 12 bp, Homo sapiens
ctctccttggaa

SEQ ID NO: 3934983 - DNA, 15 bp, Homo sapiens
ctctccttgggctcc

SEQ ID NO: 3934984 - DNA, 16 bp, Homo sapiens
ctctccttgggctcct

SEQ ID NO: 3934985 - DNA, 19 bp, Homo sapiens
ctctccttgggctcctggc

SEQ ID NO: 3934986 - DNA, 23 bp, Homo sapiens
ctctcgagttctcctatcttctc

SEQ ID NO: 3934987 - DNA, 15 bp, Homo sapiens
ctctcggggcccttg

SEQ ID NO: 3934988 - DNA, 23 bp, Homo sapiens
ctctcggggcccttggggcctgg

SEQ ID NO: 3934989 - DNA, 19 bp, Homo sapiens
ctctcgggttgtgtgtctg

SEQ ID NO: 3934990 - DNA, 14 bp, Homo sapiens
ctctctaagccaca

SEQ ID NO: 3934991 - DNA, 20 bp, Homo sapiens
ctctctacccggcccagaga

SEQ ID NO: 3934992 - DNA, 14 bp, Homo sapiens
ctctctcctgtcca

SEQ ID NO: 3934993 - DNA, 15 bp, Homo sapiens
ctctctcctgtccaa

SEQ ID NO: 3934994 - DNA, 19 bp, Homo sapiens
ctctctcctgtccaaccta

SEQ ID NO: 3934995 - DNA, 13 bp, Homo sapiens
ctctctctccctt

SEQ ID NO: 3934996 - DNA, 17 bp, Homo sapiens
ctctctgcagccagccc

SEQ ID NO: 3934997 - DNA, 19 bp, Homo sapiens
ctctctgcagccagcccag

SEQ ID NO: 3934998 - DNA, 20 bp, Homo sapiens
ctctctgcagccagcccagc

SEQ ID NO: 3934999 - DNA, 19 bp, Homo sapiens
ctctctggccttttcctat

SEQ ID NO: 3935000 - DNA, 23 bp, Homo sapiens
ctctctggggcagggttattcct

SEQ ID NO: 3935001 - DNA, 13 bp, Homo sapiens
ctctcttccctat

SEQ ID NO: 3935002 - DNA, 13 bp, Homo sapiens
ctctcttgccagc

SEQ ID NO: 3935003 - DNA, 14 bp, Homo sapiens
ctctcttgccagca

SEQ ID NO: 3935004 - DNA, 23 bp, Homo sapiens
ctctgaaaagcaattgccctgta

SEQ ID NO: 3935005 - DNA, 14 bp, Homo sapiens
ctctgaaatttccc

SEQ ID NO: 3935006 - DNA, 20 bp, Homo sapiens
ctctgaaatttcccacaccc

SEQ ID NO: 3935007 - DNA, 19 bp, Homo sapiens
ctgaaatctcagaattcct

SEQ ID NO: 3935008 - DNA, 14 bp, Homo sapiens
ctgaaatttcagat

SEQ ID NO: 3935009 - DNA, 14 bp, Homo sapiens
ctgaacaagaattg

SEQ ID NO: 3935010 - DNA, 16 bp, Homo sapiens
ctgaacaagaattgga

SEQ ID NO: 3935011 - DNA, 14 bp, Homo sapiens
ctgaacaatgaatg

SEQ ID NO: 3935012 - DNA, 17 bp, Homo sapiens
ctgaacacatactagaa

SEQ ID NO: 3935013 - DNA, 14 bp, Homo sapiens
ctgaaccccatggg

SEQ ID NO: 3935014 - DNA, 16 bp, Homo sapiens
ctgaaccccatgggct

SEQ ID NO: 3935015 - DNA, 19 bp, Homo sapiens
ctgaaccccatgggcttgg

SEQ ID NO: 3935016 - DNA, 18 bp, Homo sapiens
ctgaacctcagtttcctc

SEQ ID NO: 3935017 - DNA, 20 bp, Homo sapiens
ctgaacctcagtttcctcat

SEQ ID NO: 3935018 - DNA, 15 bp, Homo sapiens
ctgaagaaaatgaag

SEQ ID NO: 3935019 - DNA, 22 bp, Homo sapiens
ctgaagacaaaccactgtacat

SEQ ID NO: 3935020 - DNA, 15 bp, Homo sapiens
ctgaagccagatcca

SEQ ID NO: 3935021 - DNA, 23 bp, Homo sapiens
ctgaagcctctgccctgcctccc

SEQ ID NO: 3935022 - DNA, 15 bp, Homo sapiens
ctgaagctattgatg

SEQ ID NO: 3935023 - DNA, 20 bp, Homo sapiens
ctgaaggggcacaccactgc

SEQ ID NO: 3935024 - DNA, 20 bp, Homo sapiens
ctgaagggggcggcctatga

SEQ ID NO: 3935025 - DNA, 15 bp, Homo sapiens
ctgaagggtgacatc

SEQ ID NO: 3935026 - DNA, 21 bp, Homo sapiens
ctgaagggtgacatcccagga

SEQ ID NO: 3935027 - DNA, 15 bp, Homo sapiens
ctgaaggttcctgag

SEQ ID NO: 3935028 - DNA, 22 bp, Homo sapiens
ctgaagtcattgtcgctcagca

SEQ ID NO: 3935029 - DNA, 16 bp, Homo sapiens
ctgaagttaacagaga

SEQ ID NO: 3935030 - DNA, 13 bp, Homo sapiens
ctgaatccgtggt

SEQ ID NO: 3935031 - DNA, 15 bp, Homo sapiens
ctctgattttcaaag

SEQ ID NO: 3935032 - DNA, 19 bp, Homo sapiens
ctctgattttcaaagcttt

SEQ ID NO: 3935033 - DNA, 20 bp, Homo sapiens
ctctgattttcaaagctttt

SEQ ID NO: 3935034 - DNA, 13 bp, Homo sapiens
ctctgcaaagact

SEQ ID NO: 3935035 - DNA, 20 bp, Homo sapiens
ctctgcaaagactagatcct

SEQ ID NO: 3935036 - DNA, 13 bp, Homo sapiens
ctctgcactccat

SEQ ID NO: 3935037 - DNA, 14 bp, Homo sapiens
ctctgcactccatg

SEQ ID NO: 3935038 - DNA, 19 bp, Homo sapiens
ctctgcactccatggccac

SEQ ID NO: 3935039 - DNA, 23 bp, Homo sapiens
ctctgcactccatggccaccccg

SEQ ID NO: 3935040 - DNA, 13 bp, Homo sapiens
ctctgcagccagc

SEQ ID NO: 3935041 - DNA, 17 bp, Homo sapiens
ctctgcagccagcccag

SEQ ID NO: 3935042 - DNA, 10 bp, Homo sapiens
ctctgccacc

SEQ ID NO: 3935043 - DNA, 19 bp, Homo sapiens
ctctgccaccaccccataa

SEQ ID NO: 3935044 - DNA, 16 bp, Homo sapiens
ctctgccatgcccaga

SEQ ID NO: 3935045 - DNA, 12 bp, Homo sapiens
ctctgccccaag

SEQ ID NO: 3935046 - DNA, 15 bp, Homo sapiens
ctctgccccaagcag

SEQ ID NO: 3935047 - DNA, 19 bp, Homo sapiens
ctctgccccaagcagccag

SEQ ID NO: 3935048 - DNA, 21 bp, Homo sapiens
ctctgccccaaggggcccaca

SEQ ID NO: 3935049 - DNA, 18 bp, Homo sapiens
ctctgccccagaggcctc

SEQ ID NO: 3935050 - DNA, 22 bp, Homo sapiens
ctctgccccagaggcctctctc

SEQ ID NO: 3935051 - DNA, 16 bp, Homo sapiens
ctctgccccttctgtt

SEQ ID NO: 3935052 - DNA, 14 bp, Homo sapiens
ctctgccccttggg

SEQ ID NO: 3935053 - DNA, 13 bp, Homo sapiens
ctctgccctgcct

SEQ ID NO: 3935054 - DNA, 18 bp, Homo sapiens
ctctgccctgcctccctt

SEQ ID NO: 3935055 - DNA, 23 bp, Homo sapiens
ctctgccctgcctccctttctgg

SEQ ID NO: 3935056 - DNA, 18 bp, Homo sapiens
ctctgcggtggtgccaga

SEQ ID NO: 3935057 - DNA, 23 bp, Homo sapiens
ctctgcgtgcagggacaaagagg

SEQ ID NO: 3935058 - DNA, 23 bp, Homo sapiens
ctctgctatatgccttaagccaa

SEQ ID NO: 3935059 - DNA, 13 bp, Homo sapiens
ctctgctccagag

SEQ ID NO: 3935060 - DNA, 12 bp, Homo sapiens
ctctgctctagc

SEQ ID NO: 3935061 - DNA, 15 bp, Homo sapiens
ctctgctctagccag

SEQ ID NO: 3935062 - DNA, 17 bp, Homo sapiens
ctctgctctagccagga

SEQ ID NO: 3935063 - DNA, 19 bp, Homo sapiens
ctctgctctagccaggagt

SEQ ID NO: 3935064 - DNA, 15 bp, Homo sapiens
ctctgctctgatgca

SEQ ID NO: 3935065 - DNA, 14 bp, Homo sapiens
ctctgctggcctgg

SEQ ID NO: 3935066 - DNA, 19 bp, Homo sapiens
ctctgcttacccttcacct

SEQ ID NO: 3935067 - DNA, 22 bp, Homo sapiens
ctctgcttgcatcacttggggt

SEQ ID NO: 3935068 - DNA, 17 bp, Homo sapiens
ctctggaaaactcagga

SEQ ID NO: 3935069 - DNA, 18 bp, Homo sapiens
ctctggaaaactcaggat

SEQ ID NO: 3935070 - DNA, 19 bp, Homo sapiens
ctctggaaaatgtgaccca

SEQ ID NO: 3935071 - DNA, 17 bp, Homo sapiens
ctctggaagccccccac

SEQ ID NO: 3935072 - DNA, 22 bp, Homo sapiens
ctctggaccaaccctgtttcct

SEQ ID NO: 3935073 - DNA, 13 bp, Homo sapiens
ctctggaccagcc

SEQ ID NO: 3935074 - DNA, 20 bp, Homo sapiens
ctctggaccagcctgttgga

SEQ ID NO: 3935075 - DNA, 19 bp, Homo sapiens
ctctggaggctgcagagct

SEQ ID NO: 3935076 - DNA, 20 bp, Homo sapiens
ctctggatcctgctgtggcc

SEQ ID NO: 3935077 - DNA, 21 bp, Homo sapiens
ctctggatcctgctgtggcct

SEQ ID NO: 3935078 - DNA, 23 bp, Homo sapiens
ctctggatcctgctgtggcctca

SEQ ID NO: 3935079 - DNA, 13 bp, Homo sapiens
ctctggatggcac

SEQ ID NO: 3935080 - DNA, 19 bp, Homo sapiens
ctctggatggcaccagagg

SEQ ID NO: 3935081 - DNA, 11 bp, Homo sapiens
ctctggcagcc

SEQ ID NO: 3935082 - DNA, 15 bp, Homo sapiens
ctctggcagccacac

SEQ ID NO: 3935083 - DNA, 13 bp, Homo sapiens
ctctggccaccct

SEQ ID NO: 3935084 - DNA, 14 bp, Homo sapiens
ctctggccaccctg

SEQ ID NO: 3935085 - DNA, 17 bp, Homo sapiens
ctctggccaccctggcc

SEQ ID NO: 3935086 - DNA, 19 bp, Homo sapiens
ctctggccaccctggcccg

SEQ ID NO: 3935087 - DNA, 16 bp, Homo sapiens
ctctggccaggcatgg

SEQ ID NO: 3935088 - DNA, 13 bp, Homo sapiens
ctctggcccagcc

SEQ ID NO: 3935089 - DNA, 19 bp, Homo sapiens
ctctggcccagcctaccct

SEQ ID NO: 3935090 - DNA, 16 bp, Homo sapiens
ctctggccttttccta

SEQ ID NO: 3935091 - DNA, 15 bp, Homo sapiens
ctctggcggcttcct

SEQ ID NO: 3935092 - DNA, 20 bp, Homo sapiens
ctctggcggcttcctgtcca

SEQ ID NO: 3935093 - DNA, 13 bp, Homo sapiens
ctctggctccaga

SEQ ID NO: 3935094 - DNA, 22 bp, Homo sapiens
ctctggctccgaaaaactttgt

SEQ ID NO: 3935095 - DNA, 18 bp, Homo sapiens
ctctggctttgtctctag

SEQ ID NO: 3935096 - DNA, 19 bp, Homo sapiens
ctctgggaaataagagaga

SEQ ID NO: 3935097 - DNA, 15 bp, Homo sapiens
ctctgggctcagggc

SEQ ID NO: 3935098 - DNA, 16 bp, Homo sapiens
ctctggggccctgggc

SEQ ID NO: 3935099 - DNA, 17 bp, Homo sapiens
ctctggggccctgggcc

SEQ ID NO: 3935100 - DNA, 19 bp, Homo sapiens
ctgcagcttcctgtcaaca

SEQ ID NO: 3935101 - DNA, 18 bp, Homo sapiens
ctgcagcttgtagccagc

SEQ ID NO: 3935102 - DNA, 21 bp, Homo sapiens
ctgcagcttgtagccagccgg

SEQ ID NO: 3935103 - DNA, 22 bp, Homo sapiens
ctgcagcttgtagccagccggg

SEQ ID NO: 3935104 - DNA, 21 bp, Homo sapiens
ctgcagctttacatgcaattt

SEQ ID NO: 3935105 - DNA, 18 bp, Homo sapiens
ctgcaggaacgagcactg

SEQ ID NO: 3935106 - DNA, 21 bp, Homo sapiens
ctgcaggaacgagcactggcc

SEQ ID NO: 3935107 - DNA, 12 bp, Homo sapiens
ctgcaggcacct

SEQ ID NO: 3935108 - DNA, 23 bp, Homo sapiens
ctgcaggtacttcctcctgatgg

SEQ ID NO: 3935109 - DNA, 15 bp, Homo sapiens
ctgcagtagtctctg

SEQ ID NO: 3935110 - DNA, 16 bp, Homo sapiens
ctgcagtagtctctgt

SEQ ID NO: 3935111 - DNA, 14 bp, Homo sapiens
ctgcagttcctgag

SEQ ID NO: 3935112 - DNA, 17 bp, Homo sapiens
ctgcatatcggaggtgg

SEQ ID NO: 3935113 - DNA, 18 bp, Homo sapiens
ctgcatatcggaggtggt

SEQ ID NO: 3935114 - DNA, 22 bp, Homo sapiens
ctgcatatcggaggtggtggag

SEQ ID NO: 3935115 - DNA, 15 bp, Homo sapiens
ctgcatccccttggc

SEQ ID NO: 3935116 - DNA, 19 bp, Homo sapiens
ctgcatccgtagttccctg

SEQ ID NO: 3935117 - DNA, 21 bp, Homo sapiens
ctgcatccgtagttccctgaa

SEQ ID NO: 3935118 - DNA, 17 bp, Homo sapiens
ctgcatctactcaggcc

SEQ ID NO: 3935119 - DNA, 18 bp, Homo sapiens
ctgcatgctctggaagcc

SEQ ID NO: 3935120 - DNA, 17 bp, Homo sapiens
ctgcatttataaatgtg

SEQ ID NO: 3935121 - DNA, 17 bp, Homo sapiens
ctgcatttgtgaaatga

SEQ ID NO: 3935122 - DNA, 14 bp, Homo sapiens
ctgccaaggtgtgg

SEQ ID NO: 3935123 - DNA, 17 bp, Homo sapiens
ctgccaaggtgtggcct

SEQ ID NO: 3935124 - DNA, 13 bp, Homo sapiens
ctgccacacttca

SEQ ID NO: 3935125 - DNA, 13 bp, Homo sapiens
ctgccacagagag

SEQ ID NO: 3935126 - DNA, 16 bp, Homo sapiens
ctgccaccacgtctgc

SEQ ID NO: 3935127 - DNA, 18 bp, Homo sapiens
ctgccaccacgtctgcca

SEQ ID NO: 3935128 - DNA, 22 bp, Homo sapiens
ctgccaccacgtctgccaggcc

SEQ ID NO: 3935129 - DNA, 23 bp, Homo sapiens
ctgccaccacgtctgccaggccc

SEQ ID NO: 3935130 - DNA, 17 bp, Homo sapiens
ctgccaccagtcactgt

SEQ ID NO: 3935131 - DNA, 17 bp, Homo sapiens
ctgccaccatcctgctg

SEQ ID NO: 3935132 - DNA, 22 bp, Homo sapiens
ctgccacctcccctatccaccc

SEQ ID NO: 3935133 - DNA, 11 bp, Homo sapiens
ctgccacctgt

SEQ ID NO: 3935134 - DNA, 13 bp, Homo sapiens
ctgccacctgtct

SEQ ID NO: 3935135 - DNA, 14 bp, Homo sapiens
ctgccacctgtctg

SEQ ID NO: 3935136 - DNA, 15 bp, Homo sapiens
ctgccacctgtctgt

SEQ ID NO: 3935137 - DNA, 17 bp, Homo sapiens
ctgccacctgtctgtct

SEQ ID NO: 3935138 - DNA, 18 bp, Homo sapiens
ctgccacctgtctgtctg

SEQ ID NO: 3935139 - DNA, 18 bp, Homo sapiens
ctgccagagcccaagtgc

SEQ ID NO: 3935140 - DNA, 19 bp, Homo sapiens
ctgccagagcccaagtgcc

SEQ ID NO: 3935141 - DNA, 15 bp, Homo sapiens
ctgccagcaacgcag

SEQ ID NO: 3935142 - DNA, 12 bp, Homo sapiens
ctgccagccatc

SEQ ID NO: 3935143 - DNA, 13 bp, Homo sapiens
ctgccagccatca

SEQ ID NO: 3935144 - DNA, 12 bp, Homo sapiens
ctgccagctgcc

SEQ ID NO: 3935145 - DNA, 15 bp, Homo sapiens
ctgccaggacacctg

SEQ ID NO: 3935146 - DNA, 18 bp, Homo sapiens
ctgccaggacacctgccc

SEQ ID NO: 3935147 - DNA, 20 bp, Homo sapiens
ctgccaggacacctgcccca

SEQ ID NO: 3935148 - DNA, 16 bp, Homo sapiens
ctgccaggaggctgcg

SEQ ID NO: 3935149 - DNA, 18 bp, Homo sapiens
ctgccaggagggacaaag

SEQ ID NO: 3935150 - DNA, 23 bp, Homo sapiens
ctgccaggagggacaaaggagcc

SEQ ID NO: 3935151 - DNA, 17 bp, Homo sapiens
ctgccaggcacctggcc

SEQ ID NO: 3935152 - DNA, 18 bp, Homo sapiens
ctgccaggcacctggcct

SEQ ID NO: 3935153 - DNA, 22 bp, Homo sapiens
ctgccaggcacctggcctgctg

SEQ ID NO: 3935154 - DNA, 23 bp, Homo sapiens
ctgccaggcacctggcctgctgg

SEQ ID NO: 3935155 - DNA, 12 bp, Homo sapiens
ctgccaggccca

SEQ ID NO: 3935156 - DNA, 20 bp, Homo sapiens
ctgccaggcccatctcaggt

SEQ ID NO: 3935157 - DNA, 17 bp, Homo sapiens
ctgcctttggaagaaac

SEQ ID NO: 3935158 - DNA, 18 bp, Homo sapiens
ctgccttttgctgctgct

SEQ ID NO: 3935159 - DNA, 19 bp, Homo sapiens
ctgcgagaggtccctgctt

SEQ ID NO: 3935160 - DNA, 16 bp, Homo sapiens
ctgcggctgctgtgtg

SEQ ID NO: 3935161 - DNA, 14 bp, Homo sapiens
ctgcgggttttaat

SEQ ID NO: 3935162 - DNA, 20 bp, Homo sapiens
ctgcgtgcagggacaaagag

SEQ ID NO: 3935163 - DNA, 14 bp, Homo sapiens
ctgcgttggagcca

SEQ ID NO: 3935164 - DNA, 15 bp, Homo sapiens
ctgcgttggagccac

SEQ ID NO: 3935165 - DNA, 16 bp, Homo sapiens
ctgcgttggagccact

SEQ ID NO: 3935166 - DNA, 17 bp, Homo sapiens
ctgcgttggagccactc

SEQ ID NO: 3935167 - DNA, 22 bp, Homo sapiens
ctgcgttggagccactcctgtc

SEQ ID NO: 3935168 - DNA, 19 bp, Homo sapiens
ctgctaaatactgtacata

SEQ ID NO: 3935169 - DNA, 17 bp, Homo sapiens
ctgctaccaaggcccag

SEQ ID NO: 3935170 - DNA, 19 bp, Homo sapiens
ctgctaccaaggcccagct

SEQ ID NO: 3935171 - DNA, 23 bp, Homo sapiens
ctgctactacccgagcccagcta

SEQ ID NO: 3935172 - DNA, 19 bp, Homo sapiens
ctgctactcctgtgctctg

SEQ ID NO: 3935173 - DNA, 15 bp, Homo sapiens
ctgctagctgtagaa

SEQ ID NO: 3935174 - DNA, 18 bp, Homo sapiens
ctgctaggcgagtgccag

SEQ ID NO: 3935175 - DNA, 22 bp, Homo sapiens
ctgctaggcgagtgccaggact

SEQ ID NO: 3935176 - DNA, 19 bp, Homo sapiens
ctgctatattttcatgact

SEQ ID NO: 3935177 - DNA, 14 bp, Homo sapiens
ctgctattaaatta

SEQ ID NO: 3935178 - DNA, 20 bp, Homo sapiens
ctgctcaagaagacatggag

SEQ ID NO: 3935179 - DNA, 20 bp, Homo sapiens
ctgctcatcacccagtcctg

SEQ ID NO: 3935180 - DNA, 20 bp, Homo sapiens
ctgctccagagagaggatgc

SEQ ID NO: 3935181 - DNA, 16 bp, Homo sapiens
ctgctcccagcagccc

SEQ ID NO: 3935182 - DNA, 22 bp, Homo sapiens
ctgctcccagcagccctaagga

SEQ ID NO: 3935183 - DNA, 16 bp, Homo sapiens
ctgctccccagccctg

SEQ ID NO: 3935184 - DNA, 22 bp, Homo sapiens
ctgctcccccaccccctcccca

SEQ ID NO: 3935185 - DNA, 23 bp, Homo sapiens
ctgctcctaaacccccgctccag

SEQ ID NO: 3935186 - DNA, 11 bp, Homo sapiens
ctgctcctcca

SEQ ID NO: 3935187 - DNA, 14 bp, Homo sapiens
ctgctcctccaggg

SEQ ID NO: 3935188 - DNA, 22 bp, Homo sapiens
ctgctcctccagggccacgtgc

SEQ ID NO: 3935189 - DNA, 13 bp, Homo sapiens
ctgctcctctcca

SEQ ID NO: 3935190 - DNA, 15 bp, Homo sapiens
ctgctcctctccagg

SEQ ID NO: 3935191 - DNA, 19 bp, Homo sapiens
ctgctcggggtgcacagga

SEQ ID NO: 3935192 - DNA, 20 bp, Homo sapiens
ctgctcggggtgcacaggag

SEQ ID NO: 3935193 - DNA, 23 bp, Homo sapiens
ctgctcggggtgcacaggagggg

SEQ ID NO: 3935194 - DNA, 16 bp, Homo sapiens
ctgctctagccaggag

SEQ ID NO: 3935195 - DNA, 23 bp, Homo sapiens
ctgctctagccaggagtctgtgc

SEQ ID NO: 3935196 - DNA, 14 bp, Homo sapiens
ctgctctagctggc

SEQ ID NO: 3935197 - DNA, 15 bp, Homo sapiens
ctgctctagctggca

SEQ ID NO: 3935198 - DNA, 20 bp, Homo sapiens
ctgctctagctggcaggaca

SEQ ID NO: 3935199 - DNA, 16 bp, Homo sapiens
ctgctctcatgcctgc

SEQ ID NO: 3935200 - DNA, 14 bp, Homo sapiens
ctgctctcctcttg

SEQ ID NO: 3935201 - DNA, 20 bp, Homo sapiens
ctgctctcctcttgccactg

SEQ ID NO: 3935202 - DNA, 21 bp, Homo sapiens
ctgctctcctcttgccactgc

SEQ ID NO: 3935203 - DNA, 16 bp, Homo sapiens
ctgctctcttcaggag

SEQ ID NO: 3935204 - DNA, 19 bp, Homo sapiens
ctgctctgaggcttccaga

SEQ ID NO: 3935205 - DNA, 20 bp, Homo sapiens
ctgctctgaggcttccagag

SEQ ID NO: 3935206 - DNA, 12 bp, Homo sapiens
ctgctctgatgc

SEQ ID NO: 3935207 - DNA, 18 bp, Homo sapiens
ctgctctgatgcatcaga

SEQ ID NO: 3935208 - DNA, 20 bp, Homo sapiens
ctgctggggcatgtgtgcct

SEQ ID NO: 3935209 - DNA, 22 bp, Homo sapiens
ctgctggggcatgtgtgcctgt

SEQ ID NO: 3935210 - DNA, 22 bp, Homo sapiens
ctgctggtgcagagctgaagat

SEQ ID NO: 3935211 - DNA, 20 bp, Homo sapiens
ctgctgtaactgctgagcca

SEQ ID NO: 3935212 - DNA, 14 bp, Homo sapiens
ctgctgtcctttta

SEQ ID NO: 3935213 - DNA, 22 bp, Homo sapiens
ctgctgtgcaccttacattcct

SEQ ID NO: 3935214 - DNA, 16 bp, Homo sapiens
ctgctgtggcctcact

SEQ ID NO: 3935215 - DNA, 17 bp, Homo sapiens
ctgctgtggcctcactt

SEQ ID NO: 3935216 - DNA, 19 bp, Homo sapiens
ctgctgtggcctcacttcc

SEQ ID NO: 3935217 - DNA, 21 bp, Homo sapiens
ctgctgtggcctcacttccct

SEQ ID NO: 3935218 - DNA, 22 bp, Homo sapiens
ctgctgtggcctcacttccctg

SEQ ID NO: 3935219 - DNA, 23 bp, Homo sapiens
ctgctgtggcctcacttccctgg

SEQ ID NO: 3935220 - DNA, 18 bp, Homo sapiens
ctgctgttgccatagccc

SEQ ID NO: 3935221 - DNA, 18 bp, Homo sapiens
ctgcttacccttcacctt

SEQ ID NO: 3935222 - DNA, 21 bp, Homo sapiens
ctgcttcagtgtatggaaata

SEQ ID NO: 3935223 - DNA, 21 bp, Homo sapiens
ctgcttcctaggccccagagc

SEQ ID NO: 3935224 - DNA, 17 bp, Homo sapiens
ctgcttctgtccaggac

SEQ ID NO: 3935225 - DNA, 21 bp, Homo sapiens
ctgcttcttcaagcacctgca

SEQ ID NO: 3935226 - DNA, 19 bp, Homo sapiens
ctgcttcttcatcttgaca

SEQ ID NO: 3935227 - DNA, 20 bp, Homo sapiens
ctgcttgactatcacataca

SEQ ID NO: 3935228 - DNA, 19 bp, Homo sapiens
ctgcttggggggtgatgag

SEQ ID NO: 3935229 - DNA, 21 bp, Homo sapiens
ctgcttgtccctgcccagaat

SEQ ID NO: 3935230 - DNA, 13 bp, Homo sapiens
ctgcttgtgggcc

SEQ ID NO: 3935231 - DNA, 16 bp, Homo sapiens
ctgctttgggctgccc

SEQ ID NO: 3935232 - DNA, 19 bp, Homo sapiens
ctgctttgggctgccctgg

SEQ ID NO: 3935233 - DNA, 20 bp, Homo sapiens
ctgcttttccaggatcctgc

SEQ ID NO: 3935234 - DNA, 21 bp, Homo sapiens
ctgcttttccaggatcctgca

SEQ ID NO: 3935235 - DNA, 14 bp, Homo sapiens
ctgctttttgacat

SEQ ID NO: 3935236 - DNA, 17 bp, Homo sapiens
ctgctttttggcacagt

SEQ ID NO: 3935237 - DNA, 15 bp, Homo sapiens
ctggaaaagaggagt

SEQ ID NO: 3935238 - DNA, 18 bp, Homo sapiens
ctggaaaatgtgacccag

SEQ ID NO: 3935239 - DNA, 21 bp, Homo sapiens
ctggaaagactgattgtttta

SEQ ID NO: 3935240 - DNA, 22 bp, Homo sapiens
ctggaaataaacctggagatga

SEQ ID NO: 3935241 - DNA, 19 bp, Homo sapiens
ctggaaatctgttttgtat

SEQ ID NO: 3935242 - DNA, 21 bp, Homo sapiens
ctggaaatctgttttgtatat

SEQ ID NO: 3935243 - DNA, 12 bp, Homo sapiens
ctggaaattttg

SEQ ID NO: 3935244 - DNA, 13 bp, Homo sapiens
ctggaaccaggga

SEQ ID NO: 3935245 - DNA, 23 bp, Homo sapiens
ctggaagcatgtaggagaatcca

SEQ ID NO: 3935246 - DNA, 17 bp, Homo sapiens
ctggaagccccccacct

SEQ ID NO: 3935247 - DNA, 11 bp, Homo sapiens
ctggaagctga

SEQ ID NO: 3935248 - DNA, 17 bp, Homo sapiens
ctggaagctgagcaggc

SEQ ID NO: 3935249 - DNA, 15 bp, Homo sapiens
ctggaagctgggagg

SEQ ID NO: 3935250 - DNA, 22 bp, Homo sapiens
ctggaagctgtgtccttgcacc

SEQ ID NO: 3935251 - DNA, 12 bp, Homo sapiens
ctggaaggcagg

SEQ ID NO: 3935252 - DNA, 15 bp, Homo sapiens
ctggaaggcagggca

SEQ ID NO: 3935253 - DNA, 19 bp, Homo sapiens
ctggaaggcagggcagagg

SEQ ID NO: 3935254 - DNA, 20 bp, Homo sapiens
ctggaaggcagggcagaggg

SEQ ID NO: 3935255 - DNA, 18 bp, Homo sapiens
ctggaatacatgaaatat

SEQ ID NO: 3935256 - DNA, 16 bp, Homo sapiens
ctggaatcaaggaatc

SEQ ID NO: 3935257 - DNA, 20 bp, Homo sapiens
ctggaatcaaggaatcctga

SEQ ID NO: 3935258 - DNA, 20 bp, Homo sapiens
ctggaatcaatttcccagaa

SEQ ID NO: 3935259 - DNA, 19 bp, Homo sapiens
ctggaattcagcaccctgg

SEQ ID NO: 3935260 - DNA, 21 bp, Homo sapiens
ctggaattcagcaccctgggt

SEQ ID NO: 3935261 - DNA, 21 bp, Homo sapiens
ctggaattctaaatgctggtc

SEQ ID NO: 3935262 - DNA, 12 bp, Homo sapiens
ctggacaaccca

SEQ ID NO: 3935263 - DNA, 13 bp, Homo sapiens
ctggacaacccag

SEQ ID NO: 3935264 - DNA, 15 bp, Homo sapiens
ctggacaagcagagg

SEQ ID NO: 3935265 - DNA, 18 bp, Homo sapiens
ctggacaagcagaggtgg

SEQ ID NO: 3935266 - DNA, 23 bp, Homo sapiens
ctggacaagccaacttgtaaata

SEQ ID NO: 3935267 - DNA, 15 bp, Homo sapiens
ctggacagctgtgcc

SEQ ID NO: 3935268 - DNA, 18 bp, Homo sapiens
ctggacagctgtgcctcg

SEQ ID NO: 3935269 - DNA, 19 bp, Homo sapiens
ctggacagctgtgcctcgc

SEQ ID NO: 3935270 - DNA, 18 bp, Homo sapiens
ctggacatttgccttgct

SEQ ID NO: 3935271 - DNA, 21 bp, Homo sapiens
ctggaccaaccctgtttcctg

SEQ ID NO: 3935272 - DNA, 14 bp, Homo sapiens
ctggaccactgggc

SEQ ID NO: 3935273 - DNA, 19 bp, Homo sapiens
ctggaccagatcctactct

SEQ ID NO: 3935274 - DNA, 13 bp, Homo sapiens
ctggaccccgcct

SEQ ID NO: 3935275 - DNA, 20 bp, Homo sapiens
ctggaccgcttcccagaggc

SEQ ID NO: 3935276 - DNA, 19 bp, Homo sapiens
ctggacctatgtcctaagg

SEQ ID NO: 3935277 - DNA, 22 bp, Homo sapiens
ctggacctccccctcttggtcc

SEQ ID NO: 3935278 - DNA, 12 bp, Homo sapiens
ctggacctgagt

SEQ ID NO: 3935279 - DNA, 19 bp, Homo sapiens
ctggacgatagcttggagg

SEQ ID NO: 3935280 - DNA, 22 bp, Homo sapiens
ctggacgcccagctgaggctgg

SEQ ID NO: 3935281 - DNA, 18 bp, Homo sapiens
ctggacggggactgggga

SEQ ID NO: 3935282 - DNA, 23 bp, Homo sapiens
ctggacggggactggggatgtgg

SEQ ID NO: 3935283 - DNA, 23 bp, Homo sapiens
ctggactcctctgtccaggcact

SEQ ID NO: 3935284 - DNA, 18 bp, Homo sapiens
ctggactctggcacccag

SEQ ID NO: 3935285 - DNA, 15 bp, Homo sapiens
ctggactgaggacca

SEQ ID NO: 3935286 - DNA, 13 bp, Homo sapiens
ctggactgggagg

SEQ ID NO: 3935287 - DNA, 14 bp, Homo sapiens
ctggactgggaggt

SEQ ID NO: 3935288 - DNA, 16 bp, Homo sapiens
ctggactgggaggtag

SEQ ID NO: 3935289 - DNA, 20 bp, Homo sapiens
ctggactgggttttgtctct

SEQ ID NO: 3935290 - DNA, 19 bp, Homo sapiens
ctggactgtcatagaaatt

SEQ ID NO: 3935291 - DNA, 22 bp, Homo sapiens
ctggagaactagaacctggagg

SEQ ID NO: 3935292 - DNA, 23 bp, Homo sapiens
ctggagaactagaacctggaggg

SEQ ID NO: 3935293 - DNA, 23 bp, Homo sapiens
gaccaagatgggcacatgaggag

SEQ ID NO: 3935294 - DNA, 17 bp, Homo sapiens
gaccacacctccctgaa

SEQ ID NO: 3935295 - DNA, 20 bp, Homo sapiens
gaccacacctccctgaacca

SEQ ID NO: 3935296 - DNA, 17 bp, Homo sapiens
gaccacagtgggtggca

SEQ ID NO: 3935297 - DNA, 12 bp, Homo sapiens
gaccacctgcca

SEQ ID NO: 3935298 - DNA, 16 bp, Homo sapiens
gaccacgggcctcagt

SEQ ID NO: 3935299 - DNA, 18 bp, Homo sapiens
gaccacgggcctcagttt

SEQ ID NO: 3935300 - DNA, 17 bp, Homo sapiens
gaccagacctagacctg

SEQ ID NO: 3935301 - DNA, 20 bp, Homo sapiens
gaccagacctagacctgggc

SEQ ID NO: 3935302 - DNA, 20 bp, Homo sapiens
gaccagcctccatgctgcct

SEQ ID NO: 3935303 - DNA, 21 bp, Homo sapiens
gaccagcctccatgctgcctc

SEQ ID NO: 3935304 - DNA, 22 bp, Homo sapiens
gaccaggactatagcccaggtc

SEQ ID NO: 3935305 - DNA, 22 bp, Homo sapiens
gaccagggatgggggatgggcc

SEQ ID NO: 3935306 - DNA, 22 bp, Homo sapiens
gaccaggggtgatttcagagag

SEQ ID NO: 3935307 - DNA, 15 bp, Homo sapiens
gaccagtactgggaa

SEQ ID NO: 3935308 - DNA, 20 bp, Homo sapiens
gaccagtactgggaaggagg

SEQ ID NO: 3935309 - DNA, 16 bp, Homo sapiens
gaccagtcccagagca

SEQ ID NO: 3935310 - DNA, 17 bp, Homo sapiens
gaccagtcccagagcag

SEQ ID NO: 3935311 - DNA, 17 bp, Homo sapiens
gaccagttctggccagg

SEQ ID NO: 3935312 - DNA, 15 bp, Homo sapiens
gaccagttgggagca

SEQ ID NO: 3935313 - DNA, 19 bp, Homo sapiens
gaccataacagccaacagg

SEQ ID NO: 3935314 - DNA, 19 bp, Homo sapiens
gaccatcctggcccctcca

SEQ ID NO: 3935315 - DNA, 17 bp, Homo sapiens
gaccattgacctcagct

SEQ ID NO: 3935316 - DNA, 18 bp, Homo sapiens
gaccattgacctcagctg

SEQ ID NO: 3935317 - DNA, 14 bp, Homo sapiens
gaccattgtcttcc

SEQ ID NO: 3935318 - DNA, 12 bp, Homo sapiens
gacccaaagacc

SEQ ID NO: 3935319 - DNA, 15 bp, Homo sapiens
gacccaagaggtggg

SEQ ID NO: 3935320 - DNA, 16 bp, Homo sapiens
gacccaagaggtgggg

SEQ ID NO: 3935321 - DNA, 17 bp, Homo sapiens
gacccaatgctcctgga

SEQ ID NO: 3935322 - DNA, 16 bp, Homo sapiens
gacccactcacacttg

SEQ ID NO: 3935323 - DNA, 18 bp, Homo sapiens
gacccagagtggagtctg

SEQ ID NO: 3935324 - DNA, 22 bp, Homo sapiens
gacccagagtggagtctgagtc

SEQ ID NO: 3935325 - DNA, 16 bp, Homo sapiens
gacccagctactctgt

SEQ ID NO: 3935326 - DNA, 19 bp, Homo sapiens
gacccagctactctgtcca

SEQ ID NO: 3935327 - DNA, 13 bp, Homo sapiens
gacccaggccctc

SEQ ID NO: 3935328 - DNA, 15 bp, Homo sapiens
gacccagtccctggg

SEQ ID NO: 3935329 - DNA, 16 bp, Homo sapiens
gacccagtccctgggg

SEQ ID NO: 3935330 - DNA, 16 bp, Homo sapiens
gaccccaaagagcctg

SEQ ID NO: 3935331 - DNA, 14 bp, Homo sapiens
gaccccactggact

SEQ ID NO: 3935332 - DNA, 16 bp, Homo sapiens
gaccccagctagggct

SEQ ID NO: 3935333 - DNA, 21 bp, Homo sapiens
gaccccaggatcccagagctt

SEQ ID NO: 3935334 - DNA, 17 bp, Homo sapiens
gaccccagggcacagga

SEQ ID NO: 3935335 - DNA, 21 bp, Homo sapiens
gaccccagggcacaggagcta

SEQ ID NO: 3935336 - DNA, 19 bp, Homo sapiens
gaccccatcacctactcac

SEQ ID NO: 3935337 - DNA, 14 bp, Homo sapiens
gaccccatctcatt

SEQ ID NO: 3935338 - DNA, 18 bp, Homo sapiens
gacccccactctcattcc

SEQ ID NO: 3935339 - DNA, 19 bp, Homo sapiens
gacccccactctcattccc

SEQ ID NO: 3935340 - DNA, 13 bp, Homo sapiens
gaccccctgagtc

SEQ ID NO: 3935341 - DNA, 17 bp, Homo sapiens
gaccccctggccctgcc

SEQ ID NO: 3935342 - DNA, 21 bp, Homo sapiens
gacccctggcttttcactgct

SEQ ID NO: 3935343 - DNA, 22 bp, Homo sapiens
gacccctggcttttcactgctg

SEQ ID NO: 3935344 - DNA, 11 bp, Homo sapiens
gacccctgtgg

SEQ ID NO: 3935345 - DNA, 15 bp, Homo sapiens
gacccctgtggcaga

SEQ ID NO: 3935346 - DNA, 22 bp, Homo sapiens
gaccccttcctttcctctgcag

SEQ ID NO: 3935347 - DNA, 12 bp, Homo sapiens
gaccccttggct

SEQ ID NO: 3935348 - DNA, 16 bp, Homo sapiens
gacccgctctggacca

SEQ ID NO: 3935349 - DNA, 19 bp, Homo sapiens
gacccggaggggcctggca

SEQ ID NO: 3935350 - DNA, 20 bp, Homo sapiens
gacccggcaccccctgcagc

SEQ ID NO: 3935351 - DNA, 21 bp, Homo sapiens
gacccggcaccccctgcagct

SEQ ID NO: 3935352 - DNA, 15 bp, Homo sapiens
gaccctacaggagag

SEQ ID NO: 3935353 - DNA, 11 bp, Homo sapiens
gaccctacccc

SEQ ID NO: 3935354 - DNA, 21 bp, Homo sapiens
gaccctacttcctgcactgac

SEQ ID NO: 3935355 - DNA, 17 bp, Homo sapiens
gaccctccccgcacccc

SEQ ID NO: 3935356 - DNA, 16 bp, Homo sapiens
gaccctcgcagcaggt

SEQ ID NO: 3935357 - DNA, 15 bp, Homo sapiens
gaccctctgaatggt

SEQ ID NO: 3935358 - DNA, 16 bp, Homo sapiens
gaccctgagactccag

SEQ ID NO: 3935359 - DNA, 17 bp, Homo sapiens
gaccctgagactccaga

SEQ ID NO: 3935360 - DNA, 16 bp, Homo sapiens
gaccctgcccataccc

SEQ ID NO: 3935361 - DNA, 11 bp, Homo sapiens
gaccctgccct

SEQ ID NO: 3935362 - DNA, 16 bp, Homo sapiens
gaccctgcctgagccc

SEQ ID NO: 3935363 - DNA, 17 bp, Homo sapiens
gaccctgcctgagccca

SEQ ID NO: 3935364 - DNA, 21 bp, Homo sapiens
gaccctgcctgagcccaggag

SEQ ID NO: 3935365 - DNA, 20 bp, Homo sapiens
gaccctggaattcagcaccc

SEQ ID NO: 3935366 - DNA, 23 bp, Homo sapiens
gaccctggaattcagcaccctgg

SEQ ID NO: 3935367 - DNA, 15 bp, Homo sapiens
gacccttcagggcca

SEQ ID NO: 3935368 - DNA, 16 bp, Homo sapiens
gacccttcagggccag

SEQ ID NO: 3935369 - DNA, 21 bp, Homo sapiens
gaccctttccttccttccctg

SEQ ID NO: 3935370 - DNA, 20 bp, Homo sapiens
gaccgcgtagagagccgggc

SEQ ID NO: 3935371 - DNA, 22 bp, Homo sapiens
gaccgctacaccactctggcag

SEQ ID NO: 3935372 - DNA, 23 bp, Homo sapiens
gaccgctacaccactctggcagc

SEQ ID NO: 3935373 - DNA, 17 bp, Homo sapiens
gaccgggctctgacagc

SEQ ID NO: 3935374 - DNA, 13 bp, Homo sapiens
gaccgggggccag

SEQ ID NO: 3935375 - DNA, 17 bp, Homo sapiens
gaccgggtgggcctggc

SEQ ID NO: 3935376 - DNA, 18 bp, Homo sapiens
gaccgggtgggcctggcc

SEQ ID NO: 3935377 - DNA, 21 bp, Homo sapiens
gaccgtgatttggaagagagg

SEQ ID NO: 3935378 - DNA, 23 bp, Homo sapiens
gaccgtgatttggaagagaggca

SEQ ID NO: 3935379 - DNA, 10 bp, Homo sapiens
gacacctgcc

SEQ ID NO: 3935380 - DNA, 12 bp, Homo sapiens
gacacctgcccc

SEQ ID NO: 3935381 - DNA, 22 bp, Homo sapiens
gacacctgccccagcgcggctt

SEQ ID NO: 3935382 - DNA, 12 bp, Homo sapiens
gacacctgccct

SEQ ID NO: 3935383 - DNA, 16 bp, Homo sapiens
gacacctgccctgccc

SEQ ID NO: 3935384 - DNA, 20 bp, Homo sapiens
gacacggtaggccaagctga

SEQ ID NO: 3935385 - DNA, 23 bp, Homo sapiens
gacacggtaggccaagctgaagt

SEQ ID NO: 3935386 - DNA, 18 bp, Homo sapiens
gacactaagttatagtat

SEQ ID NO: 3935387 - DNA, 20 bp, Homo sapiens
gacactaagttatagtatat

SEQ ID NO: 3935388 - DNA, 16 bp, Homo sapiens
gacactgctgcaccag

SEQ ID NO: 3935389 - DNA, 19 bp, Homo sapiens
gacactgctgcaccagagt

SEQ ID NO: 3935390 - DNA, 19 bp, Homo sapiens
gacacttatggggacagca

SEQ ID NO: 3935391 - DNA, 15 bp, Homo sapiens
gacacttgccttctt

SEQ ID NO: 3935392 - DNA, 23 bp, Homo sapiens
gacagaatgatatccagtaagca

SEQ ID NO: 3935393 - DNA, 14 bp, Homo sapiens
gacagaatgatgga

SEQ ID NO: 3935394 - DNA, 23 bp, Homo sapiens
gacagacacttctaaatgaagtg

SEQ ID NO: 3935395 - DNA, 21 bp, Homo sapiens
gacagagacacctgcacctcc

SEQ ID NO: 3935396 - DNA, 12 bp, Homo sapiens
gacagagagaga

SEQ ID NO: 3935397 - DNA, 15 bp, Homo sapiens
gacagagcccccaag

SEQ ID NO: 3935398 - DNA, 17 bp, Homo sapiens
gacagagcccccaagcc

SEQ ID NO: 3935399 - DNA, 17 bp, Homo sapiens
gacagaggggcagggga

SEQ ID NO: 3935400 - DNA, 19 bp, Homo sapiens
gacagatacatagatggac

SEQ ID NO: 3935401 - DNA, 23 bp, Homo sapiens
gacagatagacagtgctgccctg

SEQ ID NO: 3935402 - DNA, 17 bp, Homo sapiens
gacagatgtcagccgag

SEQ ID NO: 3935403 - DNA, 23 bp, Homo sapiens
gacagcagtcttcttcacccgct

SEQ ID NO: 3935404 - DNA, 10 bp, Homo sapiens
gacagcccca

SEQ ID NO: 3935405 - DNA, 12 bp, Homo sapiens
gacagccccagg

SEQ ID NO: 3935406 - DNA, 17 bp, Homo sapiens
gacagccccagggccct

SEQ ID NO: 3935407 - DNA, 18 bp, Homo sapiens
gacagccctgcggagacc

SEQ ID NO: 3935408 - DNA, 15 bp, Homo sapiens
gacagccgcctggag

SEQ ID NO: 3935409 - DNA, 23 bp, Homo sapiens
gacagcctgtggcggtgcctggg

SEQ ID NO: 3935410 - DNA, 13 bp, Homo sapiens
gacagctgacaga

SEQ ID NO: 3935411 - DNA, 16 bp, Homo sapiens
gacagctgacagatac

SEQ ID NO: 3935412 - DNA, 15 bp, Homo sapiens
gacagctgcttgtgg

SEQ ID NO: 3935413 - DNA, 13 bp, Homo sapiens
gacagctgtgcct

SEQ ID NO: 3935414 - DNA, 15 bp, Homo sapiens
gacagctgtgcctcg

SEQ ID NO: 3935415 - DNA, 17 bp, Homo sapiens
gacagctgtgcctcgct

SEQ ID NO: 3935416 - DNA, 18 bp, Homo sapiens
gacaggaaaatcctctgg

SEQ ID NO: 3935417 - DNA, 17 bp, Homo sapiens
gacaggaaagccctccc

SEQ ID NO: 3935418 - DNA, 19 bp, Homo sapiens
gacaggaaagccctccccc

SEQ ID NO: 3935419 - DNA, 21 bp, Homo sapiens
gacaggactaacactcagaag

SEQ ID NO: 3935420 - DNA, 19 bp, Homo sapiens
gacaggaggggcccacaat

SEQ ID NO: 3935421 - DNA, 14 bp, Homo sapiens
gacaggcccaagag

SEQ ID NO: 3935422 - DNA, 18 bp, Homo sapiens
gacaggcccaagagatga

SEQ ID NO: 3935423 - DNA, 21 bp, Homo sapiens
gacaggcccaagagatgaaga

SEQ ID NO: 3935424 - DNA, 19 bp, Homo sapiens
gacagggcaatcttgtcca

SEQ ID NO: 3935425 - DNA, 14 bp, Homo sapiens
gacagggcatggcc

SEQ ID NO: 3935426 - DNA, 15 bp, Homo sapiens
gacagggcatggcca

SEQ ID NO: 3935427 - DNA, 22 bp, Homo sapiens
gacagggcatggccaggtggcc

SEQ ID NO: 3935428 - DNA, 17 bp, Homo sapiens
gacagggtctcactatg

SEQ ID NO: 3935429 - DNA, 19 bp, Homo sapiens
gacagtatatttgaaactg

SEQ ID NO: 3935430 - DNA, 14 bp, Homo sapiens
gacagtattctcag

SEQ ID NO: 3935431 - DNA, 18 bp, Homo sapiens
gacagtcccttgctgaca

SEQ ID NO: 3935432 - DNA, 16 bp, Homo sapiens
gacagtgcccatgcaa

SEQ ID NO: 3935433 - DNA, 14 bp, Homo sapiens
gacagtgctgccct

SEQ ID NO: 3935434 - DNA, 15 bp, Homo sapiens
gacagtgctgccctg

SEQ ID NO: 3935435 - DNA, 17 bp, Homo sapiens
gacagttactcttcagt

SEQ ID NO: 3935436 - DNA, 21 bp, Homo sapiens
gacagttactcttcagtttta

SEQ ID NO: 3935437 - DNA, 14 bp, Homo sapiens
gacagttcaagaaa

SEQ ID NO: 3935438 - DNA, 22 bp, Homo sapiens
gacatcacttgtacaaaataaa

SEQ ID NO: 3935439 - DNA, 13 bp, Homo sapiens
gacatccaggagg

SEQ ID NO: 3935440 - DNA, 16 bp, Homo sapiens
gacatcttatttactt

SEQ ID NO: 3935441 - DNA, 16 bp, Homo sapiens
gacatgaatgcacact

SEQ ID NO: 3935442 - DNA, 12 bp, Homo sapiens
gacatgcactga

SEQ ID NO: 3935443 - DNA, 13 bp, Homo sapiens
gacatgcactgac

SEQ ID NO: 3935444 - DNA, 15 bp, Homo sapiens
gacatgcactgaccc

SEQ ID NO: 3935445 - DNA, 21 bp, Homo sapiens
gacatgccaccctctccatgc

SEQ ID NO: 3935446 - DNA, 24 bp, Homo sapiens
gacatgccaccctctccatgccca

SEQ ID NO: 3935447 - DNA, 15 bp, Homo sapiens
gacatgccatccatt

SEQ ID NO: 3935448 - DNA, 19 bp, Homo sapiens
gacatggagactcctgccc

SEQ ID NO: 3935449 - DNA, 12 bp, Homo sapiens
gacatggggcat

SEQ ID NO: 3935450 - DNA, 14 bp, Homo sapiens
gacatgtgcctgta

SEQ ID NO: 3935451 - DNA, 15 bp, Homo sapiens
gacatgttatatatt

SEQ ID NO: 3935452 - DNA, 15 bp, Homo sapiens
gacatgttgtaaatt

SEQ ID NO: 3935453 - DNA, 14 bp, Homo sapiens
gacatgtttttgtt

SEQ ID NO: 3935454 - DNA, 14 bp, Homo sapiens
gacattaaacctgg

SEQ ID NO: 3935455 - DNA, 22 bp, Homo sapiens
gacatttctatcttgaatttca

SEQ ID NO: 3935456 - DNA, 18 bp, Homo sapiens
gacatttgacagtgtggg

SEQ ID NO: 3935457 - DNA, 15 bp, Homo sapiens
gacatttgccttgct

SEQ ID NO: 3935458 - DNA, 21 bp, Homo sapiens
gaccaacatggagaaaccctg

SEQ ID NO: 3935459 - DNA, 18 bp, Homo sapiens
gaccaaccctgtttcctg

SEQ ID NO: 3935460 - DNA, 12 bp, Homo sapiens
gaccaactggct

SEQ ID NO: 3935461 - DNA, 18 bp, Homo sapiens
gaccaactggcttctgtg

SEQ ID NO: 3935462 - DNA, 14 bp, Homo sapiens
gaccaagagagaaa

SEQ ID NO: 3935463 - DNA, 15 bp, Homo sapiens
gaccaagagagaaag

SEQ ID NO: 3935464 - DNA, 17 bp, Homo sapiens
gaccaagatgggcacat

SEQ ID NO: 3935465 - DNA, 14 bp, Homo sapiens
gaagcaggcagagc

SEQ ID NO: 3935466 - DNA, 15 bp, Homo sapiens
gaagcagtgagccgc

SEQ ID NO: 3935467 - DNA, 16 bp, Homo sapiens
gaagcagtgcctcgag

SEQ ID NO: 3935468 - DNA, 19 bp, Homo sapiens
gaagcagtgcctcgaggca

SEQ ID NO: 3935469 - DNA, 16 bp, Homo sapiens
gaagcatgtaggagaa

SEQ ID NO: 3935470 - DNA, 17 bp, Homo sapiens
gaagccaacttggcttt

SEQ ID NO: 3935471 - DNA, 16 bp, Homo sapiens
gaagccacgctgtcct

SEQ ID NO: 3935472 - DNA, 18 bp, Homo sapiens
gaagccacgctgtcctct

SEQ ID NO: 3935473 - DNA, 22 bp, Homo sapiens
gaagccaggagcaaatgtttct

SEQ ID NO: 3935474 - DNA, 15 bp, Homo sapiens
gaagccatctttctt

SEQ ID NO: 3935475 - DNA, 19 bp, Homo sapiens
gaagcccaataaacctctt

SEQ ID NO: 3935476 - DNA, 16 bp, Homo sapiens
gaagcccaggctgaag

SEQ ID NO: 3935477 - DNA, 19 bp, Homo sapiens
gaagcccaggctgaagagt

SEQ ID NO: 3935478 - DNA, 15 bp, Homo sapiens
gaagcccagtttccc

SEQ ID NO: 3935479 - DNA, 19 bp, Homo sapiens
gaagccccatttgcacagg

SEQ ID NO: 3935480 - DNA, 12 bp, Homo sapiens
gaagccctcctt

SEQ ID NO: 3935481 - DNA, 15 bp, Homo sapiens
gaagccctccttcca

SEQ ID NO: 3935482 - DNA, 18 bp, Homo sapiens
gaagccctggatttcaga

SEQ ID NO: 3935483 - DNA, 21 bp, Homo sapiens
gaagccctggatttcagaaag

SEQ ID NO: 3935484 - DNA, 16 bp, Homo sapiens
gaagccgtctgactcc

SEQ ID NO: 3935485 - DNA, 23 bp, Homo sapiens
gaagccgtctgactccagagtct

SEQ ID NO: 3935486 - DNA, 18 bp, Homo sapiens
gaagcctaaataaaaagt

SEQ ID NO: 3935487 - DNA, 18 bp, Homo sapiens
gaagcctccgtcaggaga

SEQ ID NO: 3935488 - DNA, 22 bp, Homo sapiens
gaagcctgggggcctggctggc

SEQ ID NO: 3935489 - DNA, 20 bp, Homo sapiens
gaagcctgttttgttggaag

SEQ ID NO: 3935490 - DNA, 13 bp, Homo sapiens
gaagcctttggga

SEQ ID NO: 3935491 - DNA, 15 bp, Homo sapiens
gaagcgctcatctgg

SEQ ID NO: 3935492 - DNA, 17 bp, Homo sapiens
gaagcggagcttgcagt

SEQ ID NO: 3935493 - DNA, 19 bp, Homo sapiens
gaagcggagcttgcagtga

SEQ ID NO: 3935494 - DNA, 15 bp, Homo sapiens
gaagctaacagggaa

SEQ ID NO: 3935495 - DNA, 17 bp, Homo sapiens
gaagctaacagggaagg

SEQ ID NO: 3935496 - DNA, 20 bp, Homo sapiens
gaagctaacagggaaggcag

SEQ ID NO: 3935497 - DNA, 14 bp, Homo sapiens
gaagctccactgtc

SEQ ID NO: 3935498 - DNA, 19 bp, Homo sapiens
gaagctccactgtcaccct

SEQ ID NO: 3935499 - DNA, 23 bp, Homo sapiens
gaagctccactgtcaccctccac

SEQ ID NO: 3935500 - DNA, 12 bp, Homo sapiens
gaagctgagcag

SEQ ID NO: 3935501 - DNA, 13 bp, Homo sapiens
gaagctgagcagg

SEQ ID NO: 3935502 - DNA, 19 bp, Homo sapiens
gaagctgaggatcctcaca

SEQ ID NO: 3935503 - DNA, 16 bp, Homo sapiens
gaagctgccctgccca

SEQ ID NO: 3935504 - DNA, 13 bp, Homo sapiens
gaagctgggggaa

SEQ ID NO: 3935505 - DNA, 19 bp, Homo sapiens
gaagctgtactcagagcag

SEQ ID NO: 3935506 - DNA, 21 bp, Homo sapiens
gaagctgtactcagagcagag

SEQ ID NO: 3935507 - DNA, 22 bp, Homo sapiens
gaagctgtactcagagcagagc

SEQ ID NO: 3935508 - DNA, 17 bp, Homo sapiens
gaagctgtgtccttgca

SEQ ID NO: 3935509 - DNA, 22 bp, Homo sapiens
gaagctgtgtccttgcacctgc

SEQ ID NO: 3935510 - DNA, 24 bp, Homo sapiens
gaagctgtgtccttgcacctgcat

SEQ ID NO: 3935511 - DNA, 15 bp, Homo sapiens
gaagcttcagaagtt

SEQ ID NO: 3935512 - DNA, 15 bp, Homo sapiens
gaagctttgaaggcc

SEQ ID NO: 3935513 - DNA, 20 bp, Homo sapiens
gaaggaactctggcttccag

SEQ ID NO: 3935514 - DNA, 23 bp, Homo sapiens
gaaggaaggagactcacctctgc

SEQ ID NO: 3935515 - DNA, 18 bp, Homo sapiens
gaaggaaggcagggagga

SEQ ID NO: 3935516 - DNA, 19 bp, Homo sapiens
gaaggaaggcagggaggag

SEQ ID NO: 3935517 - DNA, 22 bp, Homo sapiens
gaaggaaggctccatctccagt

SEQ ID NO: 3935518 - DNA, 18 bp, Homo sapiens
gaaggaatagccagagag

SEQ ID NO: 3935519 - DNA, 23 bp, Homo sapiens
gaaggaatagccagagaggagca

SEQ ID NO: 3935520 - DNA, 16 bp, Homo sapiens
gaaggagaaggaagga

SEQ ID NO: 3935521 - DNA, 13 bp, Homo sapiens
gaaggagggcaga

SEQ ID NO: 3935522 - DNA, 19 bp, Homo sapiens
gaaggcaaagcccctggaa

SEQ ID NO: 3935523 - DNA, 18 bp, Homo sapiens
gaaggcacaggtgtaaat

SEQ ID NO: 3935524 - DNA, 15 bp, Homo sapiens
gaaggcaggcagggc

SEQ ID NO: 3935525 - DNA, 18 bp, Homo sapiens
gaaggcagggaggaggca

SEQ ID NO: 3935526 - DNA, 17 bp, Homo sapiens
gaaggcagggcagaggg

SEQ ID NO: 3935527 - DNA, 17 bp, Homo sapiens
gaaggcagtctgaaccc

SEQ ID NO: 3935528 - DNA, 13 bp, Homo sapiens
gaaggccacatgt

SEQ ID NO: 3935529 - DNA, 19 bp, Homo sapiens
gaaggcctcttgtgctcac

SEQ ID NO: 3935530 - DNA, 12 bp, Homo sapiens
gaaggcgaggag

SEQ ID NO: 3935531 - DNA, 13 bp, Homo sapiens
gaaggcgaggaga

SEQ ID NO: 3935532 - DNA, 14 bp, Homo sapiens
gaaggcgaggagag

SEQ ID NO: 3935533 - DNA, 13 bp, Homo sapiens
gaaggcgtgcaag

SEQ ID NO: 3935534 - DNA, 20 bp, Homo sapiens
gaaggcgtgcaaggggctca

SEQ ID NO: 3935535 - DNA, 19 bp, Homo sapiens
gaaggctacttcggggctg

SEQ ID NO: 3935536 - DNA, 22 bp, Homo sapiens
gaaggctacttcggggctggga

SEQ ID NO: 3935537 - DNA, 19 bp, Homo sapiens
gaaggctgcctaaggagga

SEQ ID NO: 3935538 - DNA, 15 bp, Homo sapiens
gaaggctggggccag

SEQ ID NO: 3935539 - DNA, 17 bp, Homo sapiens
gaagggaagcctcttca

SEQ ID NO: 3935540 - DNA, 22 bp, Homo sapiens
gaagggagttgctcactcagga

SEQ ID NO: 3935541 - DNA, 21 bp, Homo sapiens
gaaactccttttgctgtcttt

SEQ ID NO: 3935542 - DNA, 15 bp, Homo sapiens
gaaactgccagcaac

SEQ ID NO: 3935543 - DNA, 19 bp, Homo sapiens
gaaagaaaagaccctgaga

SEQ ID NO: 3935544 - DNA, 23 bp, Homo sapiens
gaaagaaacgtacttaactgtgt

SEQ ID NO: 3935545 - DNA, 14 bp, Homo sapiens
gaaagactattcaa

SEQ ID NO: 3935546 - DNA, 10 bp, Homo sapiens
gaaagagacc

SEQ ID NO: 3935547 - DNA, 20 bp, Homo sapiens
gaaagaggcagcttgaaact

SEQ ID NO: 3935548 - DNA, 14 bp, Homo sapiens
gaaagaggtgaccc

SEQ ID NO: 3935549 - DNA, 19 bp, Homo sapiens
gaaagaggtgaccccaggg

SEQ ID NO: 3935550 - DNA, 20 bp, Homo sapiens
gaaagaggtgaccccagggc

SEQ ID NO: 3935551 - DNA, 22 bp, Homo sapiens
gaaagcagcagctaggactgag

SEQ ID NO: 3935552 - DNA, 18 bp, Homo sapiens
gaaagccctcccccttcc

SEQ ID NO: 3935553 - DNA, 13 bp, Homo sapiens
gaaagctgagacc

SEQ ID NO: 3935554 - DNA, 21 bp, Homo sapiens
gaaagctgagaccctcgccac

SEQ ID NO: 3935555 - DNA, 22 bp, Homo sapiens
gaaagcttaggctgcttattgg

SEQ ID NO: 3935556 - DNA, 22 bp, Homo sapiens
gaacagctcttcactcagccac

SEQ ID NO: 3935557 - DNA, 19 bp, Homo sapiens
gaacagtcacccttctggg

SEQ ID NO: 3935558 - DNA, 19 bp, Homo sapiens
gaacatgcacatttatata

SEQ ID NO: 3935559 - DNA, 15 bp, Homo sapiens
gaacatggagagcta

SEQ ID NO: 3935560 - DNA, 19 bp, Homo sapiens
gaacatgtcggagtagaaa

SEQ ID NO: 3935561 - DNA, 18 bp, Homo sapiens
gaacatgtgggaggaaga

SEQ ID NO: 3935562 - DNA, 23 bp, Homo sapiens
gaacattcgaggtgtcaccctgc

SEQ ID NO: 3935563 - DNA, 22 bp, Homo sapiens
gaacatttcttatgatttttaa

SEQ ID NO: 3935564 - DNA, 17 bp, Homo sapiens
gaaccaaagagactgga

SEQ ID NO: 3935565 - DNA, 21 bp, Homo sapiens
gaaccaaagagactggagcat

SEQ ID NO: 3935566 - DNA, 13 bp, Homo sapiens
gaaccaagcttca

SEQ ID NO: 3935567 - DNA, 19 bp, Homo sapiens
gaaccaagcttcagagcct

SEQ ID NO: 3935568 - DNA, 22 bp, Homo sapiens
gaaccaagcttcagagcctagc

SEQ ID NO: 3935569 - DNA, 20 bp, Homo sapiens
gaaccaaggcagcctccaga

SEQ ID NO: 3935570 - DNA, 21 bp, Homo sapiens
gaaccaaggcagcctccagag

SEQ ID NO: 3935571 - DNA, 18 bp, Homo sapiens
gaaccagggagaccgagc

SEQ ID NO: 3935572 - DNA, 17 bp, Homo sapiens
gaaccagggaggagagg

SEQ ID NO: 3935573 - DNA, 12 bp, Homo sapiens
gaacccacctgc

SEQ ID NO: 3935574 - DNA, 14 bp, Homo sapiens
gaacccacctgctg

SEQ ID NO: 3935575 - DNA, 15 bp, Homo sapiens
gaacccagccctggg

SEQ ID NO: 3935576 - DNA, 17 bp, Homo sapiens
gaacccagccctggggt

SEQ ID NO: 3935577 - DNA, 13 bp, Homo sapiens
gaacccaggacaa

SEQ ID NO: 3935578 - DNA, 13 bp, Homo sapiens
gaacccctgtgtc

SEQ ID NO: 3935579 - DNA, 17 bp, Homo sapiens
gaacccttgtgcttggt

SEQ ID NO: 3935580 - DNA, 20 bp, Homo sapiens
gaacctaccagttggccatg

SEQ ID NO: 3935581 - DNA, 20 bp, Homo sapiens
gaacctagtactctctgctc

SEQ ID NO: 3935582 - DNA, 22 bp, Homo sapiens
gaacctcaagtctagaaaccag

SEQ ID NO: 3935583 - DNA, 15 bp, Homo sapiens
gaacctggagggcta

SEQ ID NO: 3935584 - DNA, 16 bp, Homo sapiens
gaacctggaggggcta

SEQ ID NO: 3935585 - DNA, 21 bp, Homo sapiens
gaacctgtactgggttatttt

SEQ ID NO: 3935586 - DNA, 21 bp, Homo sapiens
gaacgatatgtagcagaaagg

SEQ ID NO: 3935587 - DNA, 21 bp, Homo sapiens
gaacgcagaggcggaaacctt

SEQ ID NO: 3935588 - DNA, 22 bp, Homo sapiens
gaacgcagaggcggaaaccttg

SEQ ID NO: 3935589 - DNA, 13 bp, Homo sapiens
gaacgctcttagc

SEQ ID NO: 3935590 - DNA, 21 bp, Homo sapiens
gaacgctcttagctttctcag

SEQ ID NO: 3935591 - DNA, 23 bp, Homo sapiens
gaacggagccccaggcctctgtg

SEQ ID NO: 3935592 - DNA, 22 bp, Homo sapiens
gaacggcatgtgaattctgtga

SEQ ID NO: 3935593 - DNA, 14 bp, Homo sapiens
gaacgtgactgccc

SEQ ID NO: 3935594 - DNA, 13 bp, Homo sapiens
gaactcagagccc

SEQ ID NO: 3935595 - DNA, 17 bp, Homo sapiens
gaactcagagcccctcc

SEQ ID NO: 3935596 - DNA, 11 bp, Homo sapiens
gaactcccagc

SEQ ID NO: 3935597 - DNA, 19 bp, Homo sapiens
gaactcccagcaacacaag

SEQ ID NO: 3935598 - DNA, 13 bp, Homo sapiens
gaactcctgagct

SEQ ID NO: 3935599 - DNA, 11 bp, Homo sapiens
gaactctgaca

SEQ ID NO: 3935600 - DNA, 19 bp, Homo sapiens
gaactctgacaagggctga

SEQ ID NO: 3935601 - DNA, 18 bp, Homo sapiens
gaactgaattaagttatt

SEQ ID NO: 3935602 - DNA, 17 bp, Homo sapiens
gaactgaccccctcccc

SEQ ID NO: 3935603 - DNA, 13 bp, Homo sapiens
gaactgagccaaa

SEQ ID NO: 3935604 - DNA, 19 bp, Homo sapiens
gaactggacgcccagctga

SEQ ID NO: 3935605 - DNA, 16 bp, Homo sapiens
gaactggccaagctga

SEQ ID NO: 3935606 - DNA, 23 bp, Homo sapiens
gaactggttcaagagacactgct

SEQ ID NO: 3935607 - DNA, 16 bp, Homo sapiens
gaactgttctggcctc

SEQ ID NO: 3935608 - DNA, 23 bp, Homo sapiens
gaacttacacttggagcccgtgc

SEQ ID NO: 3935609 - DNA, 22 bp, Homo sapiens
gaacttcaagaagtaagagcta

SEQ ID NO: 3935610 - DNA, 14 bp, Homo sapiens
gaacttcaatcact

SEQ ID NO: 3935611 - DNA, 21 bp, Homo sapiens
gaacttcgaccctttctctga

SEQ ID NO: 3935612 - DNA, 17 bp, Homo sapiens
gaacttgaggacacatg

SEQ ID NO: 3935613 - DNA, 22 bp, Homo sapiens
gaacttgctgctgagtgcacca

SEQ ID NO: 3935614 - DNA, 22 bp, Homo sapiens
gaagaaaactatcctgcgggtt

SEQ ID NO: 3935615 - DNA, 16 bp, Homo sapiens
gaagaaagaacggaag

SEQ ID NO: 3935616 - DNA, 17 bp, Homo sapiens
gaagaaagaggtgaccc

SEQ ID NO: 3935617 - DNA, 23 bp, Homo sapiens
gaagaaagaggtgaccccagggc

SEQ ID NO: 3935618 - DNA, 23 bp, Homo sapiens
gaagaaagggtctgataaacaca

SEQ ID NO: 3935619 - DNA, 18 bp, Homo sapiens
gaagaaattcctgtagca

SEQ ID NO: 3935620 - DNA, 22 bp, Homo sapiens
gaagaaattcctgtagcatctt

SEQ ID NO: 3935621 - DNA, 20 bp, Homo sapiens
gaagaacatccaaggagaaa

SEQ ID NO: 3935622 - DNA, 23 bp, Homo sapiens
gaagaattgaacccaggaggtgg

SEQ ID NO: 3935623 - DNA, 15 bp, Homo sapiens
gaagaattttcagac

SEQ ID NO: 3935624 - DNA, 21 bp, Homo sapiens
gaagaattttcagaccccagc

SEQ ID NO: 3935625 - DNA, 21 bp, Homo sapiens
gaagacaaaccactgtacata

SEQ ID NO: 3935626 - DNA, 23 bp, Homo sapiens
gaagacaaaccactgtacatata

SEQ ID NO: 3935627 - DNA, 21 bp, Homo sapiens
gaagaccacatccacacacgc

SEQ ID NO: 3935628 - DNA, 23 bp, Homo sapiens
gaagacccagtgtaaagaataaa

SEQ ID NO: 3935629 - DNA, 14 bp, Homo sapiens
gaagacttcttggg

SEQ ID NO: 3935630 - DNA, 12 bp, Homo sapiens
gaagagaaattt

SEQ ID NO: 3935631 - DNA, 12 bp, Homo sapiens
gaagagaagctg

SEQ ID NO: 3935632 - DNA, 18 bp, Homo sapiens
gaagagaagctgagaaga

SEQ ID NO: 3935633 - DNA, 12 bp, Homo sapiens
gaagagaggcac

SEQ ID NO: 3935634 - DNA, 19 bp, Homo sapiens
gaagagaggcacctgctgg

SEQ ID NO: 3935635 - DNA, 16 bp, Homo sapiens
gaagagatcaggaaga

SEQ ID NO: 3935636 - DNA, 12 bp, Homo sapiens
gaagagcagcct

SEQ ID NO: 3935637 - DNA, 22 bp, Homo sapiens
gaagagcagcctgatggccaag

SEQ ID NO: 3935638 - DNA, 16 bp, Homo sapiens
gaagagcagctggtca

SEQ ID NO: 3935639 - DNA, 15 bp, Homo sapiens
gaagagctgttcaca

SEQ ID NO: 3935640 - DNA, 16 bp, Homo sapiens
gaagaggaagcaagaa

SEQ ID NO: 3935641 - DNA, 20 bp, Homo sapiens
gaaaaaattaagagatacat

SEQ ID NO: 3935642 - DNA, 21 bp, Homo sapiens
gaaaaaattaagagatacatt

SEQ ID NO: 3935643 - DNA, 18 bp, Homo sapiens
gaaaaaccaatgattcat

SEQ ID NO: 3935644 - DNA, 23 bp, Homo sapiens
gaaaaactctgggaaataagaga

SEQ ID NO: 3935645 - DNA, 22 bp, Homo sapiens
gaaaaagaaatgcaaaaatctc

SEQ ID NO: 3935646 - DNA, 21 bp, Homo sapiens
gaaaaagctcctgtcctccca

SEQ ID NO: 3935647 - DNA, 16 bp, Homo sapiens
gaaaaagttgcagtct

SEQ ID NO: 3935648 - DNA, 17 bp, Homo sapiens
gaaaaatccagaaagaa

SEQ ID NO: 3935649 - DNA, 11 bp, Homo sapiens
gaaaaatggag

SEQ ID NO: 3935650 - DNA, 20 bp, Homo sapiens
gaaaacaggacttaaaatga

SEQ ID NO: 3935651 - DNA, 17 bp, Homo sapiens
gaaaacattcatccagt

SEQ ID NO: 3935652 - DNA, 12 bp, Homo sapiens
gaaaaccaggga

SEQ ID NO: 3935653 - DNA, 13 bp, Homo sapiens
gaaaacccagaga

SEQ ID NO: 3935654 - DNA, 14 bp, Homo sapiens
gaaaacccagagag

SEQ ID NO: 3935655 - DNA, 17 bp, Homo sapiens
gaaaactaacaaccaac

SEQ ID NO: 3935656 - DNA, 20 bp, Homo sapiens
gaaaactgaaaatctaatat

SEQ ID NO: 3935657 - DNA, 16 bp, Homo sapiens
gaaaactgtaaataca

SEQ ID NO: 3935658 - DNA, 12 bp, Homo sapiens
ctttactccctt

SEQ ID NO: 3935659 - DNA, 16 bp, Homo sapiens
ctttactcccttcctg

SEQ ID NO: 3935660 - DNA, 22 bp, Homo sapiens
ctttagaatgagagtgtgaaat

SEQ ID NO: 3935661 - DNA, 13 bp, Homo sapiens
ctttagagtagca

SEQ ID NO: 3935662 - DNA, 16 bp, Homo sapiens
ctttagctatgtggat

SEQ ID NO: 3935663 - DNA, 16 bp, Homo sapiens
ctttagcttctctgcc

SEQ ID NO: 3935664 - DNA, 14 bp, Homo sapiens
ctttaggcagcctg

SEQ ID NO: 3935665 - DNA, 13 bp, Homo sapiens
ctttatatttagt

SEQ ID NO: 3935666 - DNA, 14 bp, Homo sapiens
ctttatcagtgatg

SEQ ID NO: 3935667 - DNA, 13 bp, Homo sapiens
ctttatctgtgac

SEQ ID NO: 3935668 - DNA, 16 bp, Homo sapiens
ctttattaattcatta

SEQ ID NO: 3935669 - DNA, 12 bp, Homo sapiens
ctttatttatgg

SEQ ID NO: 3935670 - DNA, 16 bp, Homo sapiens
ctttatttatggctta

SEQ ID NO: 3935671 - DNA, 22 bp, Homo sapiens
ctttatttatggcttataaatg

SEQ ID NO: 3935672 - DNA, 18 bp, Homo sapiens
ctttcaaagaaggaattc

SEQ ID NO: 3935673 - DNA, 14 bp, Homo sapiens
ctttcaaggaaagt

SEQ ID NO: 3935674 - DNA, 16 bp, Homo sapiens
ctttcacaaaaaagaa

SEQ ID NO: 3935675 - DNA, 16 bp, Homo sapiens
ctttcacaaccttctg

SEQ ID NO: 3935676 - DNA, 20 bp, Homo sapiens
ctttcagagaggtctcaggt

SEQ ID NO: 3935677 - DNA, 19 bp, Homo sapiens
ctttcagcactcagaaaag

SEQ ID NO: 3935678 - DNA, 21 bp, Homo sapiens
ctttcaggggggttgtgaggc

SEQ ID NO: 3935679 - DNA, 13 bp, Homo sapiens
cttggacttcctg

SEQ ID NO: 3935680 - DNA, 16 bp, Homo sapiens
cttggacttcctgggg

SEQ ID NO: 3935681 - DNA, 18 bp, Homo sapiens
cttggacttcctggggcc

SEQ ID NO: 3935682 - DNA, 15 bp, Homo sapiens
cttggagagacacag

SEQ ID NO: 3935683 - DNA, 16 bp, Homo sapiens
cttggagagacacagc

SEQ ID NO: 3935684 - DNA, 23 bp, Homo sapiens
cttggagggatggagaggcggcc

SEQ ID NO: 3935685 - DNA, 23 bp, Homo sapiens
cttggataatgctgttgcctcat

SEQ ID NO: 3935686 - DNA, 19 bp, Homo sapiens
cttggcagtattccatggg

SEQ ID NO: 3935687 - DNA, 17 bp, Homo sapiens
cttggcttttgcttggc

SEQ ID NO: 3935688 - DNA, 16 bp, Homo sapiens
cttgggaactccactc

SEQ ID NO: 3935689 - DNA, 14 bp, Homo sapiens
cttgggagtcagga

SEQ ID NO: 3935690 - DNA, 19 bp, Homo sapiens
cttgggcacccccagcctg

SEQ ID NO: 3935691 - DNA, 20 bp, Homo sapiens
cttgggcatccacccagtgc

SEQ ID NO: 3935692 - DNA, 13 bp, Homo sapiens
cttgggctactgg

SEQ ID NO: 3935693 - DNA, 20 bp, Homo sapiens
cttgggctactggcagctcc

SEQ ID NO: 3935694 - DNA, 21 bp, Homo sapiens
cttgggctactggcagctcct

SEQ ID NO: 3935695 - DNA, 14 bp, Homo sapiens
cttgggctcctggc

SEQ ID NO: 3935696 - DNA, 17 bp, Homo sapiens
cttgggctcctggctgc

SEQ ID NO: 3935697 - DNA, 19 bp, Homo sapiens
cttgggctcctggctgcca

SEQ ID NO: 3935698 - DNA, 23 bp, Homo sapiens
cttgggctcctggctgccaggcg

SEQ ID NO: 3935699 - DNA, 22 bp, Homo sapiens
cttggggagacctctactgcct

SEQ ID NO: 3935700 - DNA, 12 bp, Homo sapiens
cttggggagcag

SEQ ID NO: 3935701 - DNA, 13 bp, Homo sapiens
cttggggcctggc

SEQ ID NO: 3935702 - DNA, 13 bp, Homo sapiens
cttgagcagaccg

SEQ ID NO: 3935703 - DNA, 15 bp, Homo sapiens
cttgagcccaggagt

SEQ ID NO: 3935704 - DNA, 13 bp, Homo sapiens
cttgaggacacat

SEQ ID NO: 3935705 - DNA, 17 bp, Homo sapiens
cttgaggattttgagta

SEQ ID NO: 3935706 - DNA, 23 bp, Homo sapiens
cttgagtctttaatcccagtttg

SEQ ID NO: 3935707 - DNA, 22 bp, Homo sapiens
cttgatactaaaagttcttctc

SEQ ID NO: 3935708 - DNA, 15 bp, Homo sapiens
cttgatctgtatata

SEQ ID NO: 3935709 - DNA, 18 bp, Homo sapiens
cttgattcacaatgaaat

SEQ ID NO: 3935710 - DNA, 14 bp, Homo sapiens
cttgcacatctctg

SEQ ID NO: 3935711 - DNA, 13 bp, Homo sapiens
cttgcacctgcat

SEQ ID NO: 3935712 - DNA, 20 bp, Homo sapiens
cttgcatcctcctcccaact

SEQ ID NO: 3935713 - DNA, 16 bp, Homo sapiens
cttgcattcccagtgg

SEQ ID NO: 3935714 - DNA, 14 bp, Homo sapiens
cttgccactgcctc

SEQ ID NO: 3935715 - DNA, 19 bp, Homo sapiens
cttgcccagagatgcctcc

SEQ ID NO: 3935716 - DNA, 23 bp, Homo sapiens
cttgcccagagatgcctccaccg

SEQ ID NO: 3935717 - DNA, 16 bp, Homo sapiens
cttgcccccatccctc

SEQ ID NO: 3935718 - DNA, 22 bp, Homo sapiens
cttgcccccatccctcggaccc

SEQ ID NO: 3935719 - DNA, 23 bp, Homo sapiens
cttgcccgccagcctcagtgcca

SEQ ID NO: 3935720 - DNA, 12 bp, Homo sapiens
cttgccctgacc

SEQ ID NO: 3935721 - DNA, 18 bp, Homo sapiens
cttgccctgacctcccag

SEQ ID NO: 3935722 - DNA, 15 bp, Homo sapiens
cttgccgagagaggc

SEQ ID NO: 3935723 - DNA, 14 bp, Homo sapiens
cttgccgagcctaa

SEQ ID NO: 3935724 - DNA, 14 bp, Homo sapiens
cttgcctaggccaa

SEQ ID NO: 3935725 - DNA, 19 bp, Homo sapiens
cttgcctgaggctcaagag

SEQ ID NO: 3935726 - DNA, 22 bp, Homo sapiens
cttgcctgaggctcaagaggcc

SEQ ID NO: 3935727 - DNA, 19 bp, Homo sapiens
cttgccttcttcacccagc

SEQ ID NO: 3935728 - DNA, 20 bp, Homo sapiens
cttgccttcttcacccagct

SEQ ID NO: 3935729 - DNA, 16 bp, Homo sapiens
cttgcgtcctgcagag

SEQ ID NO: 3935730 - DNA, 18 bp, Homo sapiens
cttgcgtcctgcagagga

SEQ ID NO: 3935731 - DNA, 15 bp, Homo sapiens
cttgctattggaatg

SEQ ID NO: 3935732 - DNA, 22 bp, Homo sapiens
cttgctatttgagcatgcacag

SEQ ID NO: 3935733 - DNA, 18 bp, Homo sapiens
cttgctcagtgcctcctg

SEQ ID NO: 3935734 - DNA, 21 bp, Homo sapiens
cttgctcagtgcctcctggcc

SEQ ID NO: 3935735 - DNA, 22 bp, Homo sapiens
cttgctcagtgcctcctggccg

SEQ ID NO: 3935736 - DNA, 17 bp, Homo sapiens
cttgctccagggtcttg

SEQ ID NO: 3935737 - DNA, 20 bp, Homo sapiens
cttgctccagggtcttgggc

SEQ ID NO: 3935738 - DNA, 21 bp, Homo sapiens
cttgctccagggtcttgggct

SEQ ID NO: 3935739 - DNA, 20 bp, Homo sapiens
cttgctctcccctgccctgc

SEQ ID NO: 3935740 - DNA, 19 bp, Homo sapiens
cttgctcttcagtgggaga

SEQ ID NO: 3935741 - DNA, 18 bp, Homo sapiens
cttgctgaatttcaggca

SEQ ID NO: 3935742 - DNA, 18 bp, Homo sapiens
cttgctgacatggctttg

SEQ ID NO: 3935743 - DNA, 16 bp, Homo sapiens
cttgctgtatatgcag

SEQ ID NO: 3935744 - DNA, 22 bp, Homo sapiens
cttgcttagtatggttctcaga

SEQ ID NO: 3935745 - DNA, 23 bp, Homo sapiens
cttgcttagtatggttctcagat

SEQ ID NO: 3935746 - DNA, 12 bp, Homo sapiens
cttgcttctgca

SEQ ID NO: 3935747 - DNA, 15 bp, Homo sapiens
cttgcttctgcagca

SEQ ID NO: 3935748 - DNA, 20 bp, Homo sapiens
cttgcttctgcagcaactcc

SEQ ID NO: 3935749 - DNA, 12 bp, Homo sapiens
cttgctttgctg

SEQ ID NO: 3935750 - DNA, 15 bp, Homo sapiens
cttgctttgctgtct

SEQ ID NO: 3935751 - DNA, 18 bp, Homo sapiens
cttgctttgctgtctggt

SEQ ID NO: 3935752 - DNA, 12 bp, Homo sapiens
cttgctttgggc

SEQ ID NO: 3935753 - DNA, 21 bp, Homo sapiens
cttgctttgggctttgcaggc

SEQ ID NO: 3935754 - DNA, 20 bp, Homo sapiens
cttggaaaaaaattacaaaa

SEQ ID NO: 3935755 - DNA, 17 bp, Homo sapiens
cttggaaaaagaaagaa

SEQ ID NO: 3935756 - DNA, 18 bp, Homo sapiens
cttggaaaaagaaagaaa

SEQ ID NO: 3935757 - DNA, 22 bp, Homo sapiens
cttggaagtgtgtggaaggcag

SEQ ID NO: 3935758 - DNA, 21 bp, Homo sapiens
cttggaagtttcatatattgt

SEQ ID NO: 3935759 - DNA, 12 bp, Homo sapiens
cttggaatgaat

SEQ ID NO: 3935760 - DNA, 15 bp, Homo sapiens
cttggacctctgctc

SEQ ID NO: 3935761 - DNA, 17 bp, Homo sapiens
cttggacctctgctctg

SEQ ID NO: 3935762 - DNA, 14 bp, Homo sapiens
cttggactcctccc

SEQ ID NO: 3935763 - DNA, 15 bp, Homo sapiens
gagtctgaggtcctg

SEQ ID NO: 3935764 - DNA, 17 bp, Homo sapiens
gagtctgaggtcctgag

SEQ ID NO: 3935765 - DNA, 18 bp, Homo sapiens
gagtctgaggtcctgagc

SEQ ID NO: 3935766 - DNA, 23 bp, Homo sapiens
gagtctgaggtcctgagcactgc

SEQ ID NO: 3935767 - DNA, 14 bp, Homo sapiens
gagtctgagtctga

SEQ ID NO: 3935768 - DNA, 16 bp, Homo sapiens
gagtcttggcctgcct

SEQ ID NO: 3935769 - DNA, 18 bp, Homo sapiens
gagtgaaagggctatggc

SEQ ID NO: 3935770 - DNA, 22 bp, Homo sapiens
gagtgaaagggctatggcaagg

SEQ ID NO: 3935771 - DNA, 19 bp, Homo sapiens
gagtgaacaactatttata

SEQ ID NO: 3935772 - DNA, 21 bp, Homo sapiens
gagtgaacaactatttataaa

SEQ ID NO: 3935773 - DNA, 15 bp, Homo sapiens
gagtgacggtcccac

SEQ ID NO: 3935774 - DNA, 18 bp, Homo sapiens
gagtgacggtcccacact

SEQ ID NO: 3935775 - DNA, 20 bp, Homo sapiens
gaccgtgtcccaaggagctg

SEQ ID NO: 3935776 - DNA, 16 bp, Homo sapiens
gacctagacctgggcc

SEQ ID NO: 3935777 - DNA, 23 bp, Homo sapiens
gacctatgtcctaaggacacact

SEQ ID NO: 3935778 - DNA, 11 bp, Homo sapiens
gacctcagcca

SEQ ID NO: 3935779 - DNA, 16 bp, Homo sapiens
gacctcagctgcacat

SEQ ID NO: 3935780 - DNA, 17 bp, Homo sapiens
gacctcagctgcacatt

SEQ ID NO: 3935781 - DNA, 20 bp, Homo sapiens
gacctcagctgcacattcct

SEQ ID NO: 3935782 - DNA, 16 bp, Homo sapiens
gacctccagctttcct

SEQ ID NO: 3935783 - DNA, 18 bp, Homo sapiens
gacctccagctttcctgt

SEQ ID NO: 3935784 - DNA, 13 bp, Homo sapiens
gacctcgtcctcc

SEQ ID NO: 3935785 - DNA, 21 bp, Homo sapiens
gacctcgtcctccccctgcca

SEQ ID NO: 3935786 - DNA, 16 bp, Homo sapiens
gacctcgtttgggagt

SEQ ID NO: 3935787 - DNA, 14 bp, Homo sapiens
gacctctgatccct

SEQ ID NO: 3935788 - DNA, 21 bp, Homo sapiens
gacctgacaccgtccctcagt

SEQ ID NO: 3935789 - DNA, 22 bp, Homo sapiens
gacctgacaccgtccctcagtg

SEQ ID NO: 3935790 - DNA, 12 bp, Homo sapiens
gacctgagcctg

SEQ ID NO: 3935791 - DNA, 14 bp, Homo sapiens
gacctgagcctgcc

SEQ ID NO: 3935792 - DNA, 16 bp, Homo sapiens
gacctgaggcagatga

SEQ ID NO: 3935793 - DNA, 20 bp, Homo sapiens
gacctgaggctcctgtgcta

SEQ ID NO: 3935794 - DNA, 17 bp, Homo sapiens
gacctgagtcggcccca

SEQ ID NO: 3935795 - DNA, 23 bp, Homo sapiens
gacctgatcattacatggctgtg

SEQ ID NO: 3935796 - DNA, 18 bp, Homo sapiens
gacctgcctctcacacac

SEQ ID NO: 3935797 - DNA, 16 bp, Homo sapiens
gacctgctgagctctg

SEQ ID NO: 3935798 - DNA, 18 bp, Homo sapiens
gacctgctgagctctgag

SEQ ID NO: 3935799 - DNA, 22 bp, Homo sapiens
gacctgctgagctctgagaggc

SEQ ID NO: 3935800 - DNA, 20 bp, Homo sapiens
gacctgggccaaaagggcag

SEQ ID NO: 3935801 - DNA, 21 bp, Homo sapiens
gacctgggccaaaagggcagc

SEQ ID NO: 3935802 - DNA, 21 bp, Homo sapiens
gacctgtctgtcgctgggctg

SEQ ID NO: 3935803 - DNA, 23 bp, Homo sapiens
gacctgtgttcttgctgagcacc

SEQ ID NO: 3935804 - DNA, 18 bp, Homo sapiens
gaccttggagagacacag

SEQ ID NO: 3935805 - DNA, 14 bp, Homo sapiens
gaccttgttgcatg

SEQ ID NO: 3935806 - DNA, 20 bp, Homo sapiens
gaccttgttgcatgatgtat

SEQ ID NO: 3935807 - DNA, 17 bp, Homo sapiens
gacctttcagctgtgaa

SEQ ID NO: 3935808 - DNA, 14 bp, Homo sapiens
gacgcaagggagaa

SEQ ID NO: 3935809 - DNA, 21 bp, Homo sapiens
gacgcagccctgggggccagc

SEQ ID NO: 3935810 - DNA, 23 bp, Homo sapiens
gacgcagccctgggggccagctg

SEQ ID NO: 3935811 - DNA, 11 bp, Homo sapiens
gacgccctgcg

SEQ ID NO: 3935812 - DNA, 18 bp, Homo sapiens
gacgcgggctgtgcctta

SEQ ID NO: 3935813 - DNA, 11 bp, Homo sapiens
gacgcttccag

SEQ ID NO: 3935814 - DNA, 13 bp, Homo sapiens
gacgcttccagac

SEQ ID NO: 3935815 - DNA, 16 bp, Homo sapiens
gacgcttccagaccac

SEQ ID NO: 3935816 - DNA, 18 bp, Homo sapiens
gacgcttccagaccacct

SEQ ID NO: 3935817 - DNA, 16 bp, Homo sapiens
gacggcagagacccca

SEQ ID NO: 3935818 - DNA, 14 bp, Homo sapiens
gacggctggacctg

SEQ ID NO: 3935819 - DNA, 17 bp, Homo sapiens
gacgggaggcctcagtt

SEQ ID NO: 3935820 - DNA, 18 bp, Homo sapiens
gacgggaggcctcagttc

SEQ ID NO: 3935821 - DNA, 19 bp, Homo sapiens
gacggtcctttaggcagcc

SEQ ID NO: 3935822 - DNA, 21 bp, Homo sapiens
gacggtcctttaggcagcctg

SEQ ID NO: 3935823 - DNA, 23 bp, Homo sapiens
gacggtcctttaggcagcctgcc

SEQ ID NO: 3935824 - DNA, 23 bp, Homo sapiens
gacggtgctcgcttctcctccag

SEQ ID NO: 3935825 - DNA, 14 bp, Homo sapiens
gacgtcaagtctcc

SEQ ID NO: 3935826 - DNA, 18 bp, Homo sapiens
gacgtcaagtctccttcc

SEQ ID NO: 3935827 - DNA, 19 bp, Homo sapiens
gacgtcatcggaggctggg

SEQ ID NO: 3935828 - DNA, 21 bp, Homo sapiens
gacgtcatcggaggctgggcc

SEQ ID NO: 3935829 - DNA, 19 bp, Homo sapiens
gacgtgaatgtctcagcga

SEQ ID NO: 3935830 - DNA, 23 bp, Homo sapiens
gacgtttttgtgctgtgggcagc

SEQ ID NO: 3935831 - DNA, 21 bp, Homo sapiens
gactaacactcagaagcctgg

SEQ ID NO: 3935832 - DNA, 21 bp, Homo sapiens
gactaacataaaatctgtgaa

SEQ ID NO: 3935833 - DNA, 18 bp, Homo sapiens
gactaactatcaaataga

SEQ ID NO: 3935834 - DNA, 23 bp, Homo sapiens
gactaagccctgtcgagacactt

SEQ ID NO: 3935835 - DNA, 13 bp, Homo sapiens
gactaattaaaat

SEQ ID NO: 3935836 - DNA, 18 bp, Homo sapiens
gactaattaaaatctgga

SEQ ID NO: 3935837 - DNA, 16 bp, Homo sapiens
gactactatttgaagc

SEQ ID NO: 3935838 - DNA, 20 bp, Homo sapiens
gactagaacctggagggctg

SEQ ID NO: 3935839 - DNA, 20 bp, Homo sapiens
gactagaggcagggagggga

SEQ ID NO: 3935840 - DNA, 22 bp, Homo sapiens
gactagaggcagggaggggact

SEQ ID NO: 3935841 - DNA, 14 bp, Homo sapiens
gactataaacatta

SEQ ID NO: 3935842 - DNA, 17 bp, Homo sapiens
gactatagcccaggtcc

SEQ ID NO: 3935843 - DNA, 13 bp, Homo sapiens
gactatatacatg

SEQ ID NO: 3935844 - DNA, 13 bp, Homo sapiens
gactatttatgaa

SEQ ID NO: 3935845 - DNA, 17 bp, Homo sapiens
gactcacaagaagacca

SEQ ID NO: 3935846 - DNA, 22 bp, Homo sapiens
gactcacaagaagaccagactg

SEQ ID NO: 3935847 - DNA, 15 bp, Homo sapiens
gactcaggttgtctg

SEQ ID NO: 3935848 - DNA, 12 bp, Homo sapiens
gactcagtgttc

SEQ ID NO: 3935849 - DNA, 12 bp, Homo sapiens
gactcatatatt

SEQ ID NO: 3935850 - DNA, 20 bp, Homo sapiens
gactcattccctagatcttt

SEQ ID NO: 3935851 - DNA, 16 bp, Homo sapiens
gactccaaagaaatgt

SEQ ID NO: 3935852 - DNA, 17 bp, Homo sapiens
gactccagaatctgctg

SEQ ID NO: 3935853 - DNA, 22 bp, Homo sapiens
gactccagaatctgctgttgcc

SEQ ID NO: 3935854 - DNA, 14 bp, Homo sapiens
gactccagagtctg

SEQ ID NO: 3935855 - DNA, 17 bp, Homo sapiens
gactccagagtctgagc

SEQ ID NO: 3935856 - DNA, 18 bp, Homo sapiens
gactccagagtctgagcc

SEQ ID NO: 3935857 - DNA, 12 bp, Homo sapiens
gactccagcctg

SEQ ID NO: 3935858 - DNA, 14 bp, Homo sapiens
gactccctcccctg

SEQ ID NO: 3935859 - DNA, 13 bp, Homo sapiens
gactcctgccctg

SEQ ID NO: 3935860 - DNA, 21 bp, Homo sapiens
gactcctgtctgtcctggagg

SEQ ID NO: 3935861 - DNA, 19 bp, Homo sapiens
gaggatcacagtgctgaga

SEQ ID NO: 3935862 - DNA, 23 bp, Homo sapiens
gaggatctagcttcatgcctcag

SEQ ID NO: 3935863 - DNA, 22 bp, Homo sapiens
gaggatgaatagatgtgatcac

SEQ ID NO: 3935864 - DNA, 15 bp, Homo sapiens
gaggatggagagagg

SEQ ID NO: 3935865 - DNA, 13 bp, Homo sapiens
gaggatgttctgg

SEQ ID NO: 3935866 - DNA, 22 bp, Homo sapiens
gaggatgttctggacctccccc

SEQ ID NO: 3935867 - DNA, 13 bp, Homo sapiens
gaggattttgagt

SEQ ID NO: 3935868 - DNA, 17 bp, Homo sapiens
gaggcaagagacagaat

SEQ ID NO: 3935869 - DNA, 15 bp, Homo sapiens
gaggcaccagctctg

SEQ ID NO: 3935870 - DNA, 15 bp, Homo sapiens
gaggcacctgctgga

SEQ ID NO: 3935871 - DNA, 22 bp, Homo sapiens
gaggcagacttccctgaatgta

SEQ ID NO: 3935872 - DNA, 20 bp, Homo sapiens
gaggcagctccaacagcttg

SEQ ID NO: 3935873 - DNA, 21 bp, Homo sapiens
gaggcaggctccccctgcctt

SEQ ID NO: 3935874 - DNA, 17 bp, Homo sapiens
gaggcagggaggggact

SEQ ID NO: 3935875 - DNA, 19 bp, Homo sapiens
gaggcagggcaaatgacat

SEQ ID NO: 3935876 - DNA, 23 bp, Homo sapiens
gaggcagggcaaatgacatgcac

SEQ ID NO: 3935877 - DNA, 18 bp, Homo sapiens
gaggcagggccttgccca

SEQ ID NO: 3935878 - DNA, 13 bp, Homo sapiens
gaggcatggccct

SEQ ID NO: 3935879 - DNA, 21 bp, Homo sapiens
gaggcatgtgatgtgcaagga

SEQ ID NO: 3935880 - DNA, 12 bp, Homo sapiens
gaggccaaggca

SEQ ID NO: 3935881 - DNA, 13 bp, Homo sapiens
gaggccaaggcag

SEQ ID NO: 3935882 - DNA, 15 bp, Homo sapiens
gaggccaaggcaggt

SEQ ID NO: 3935883 - DNA, 12 bp, Homo sapiens
gaggccaaggtg

SEQ ID NO: 3935884 - DNA, 13 bp, Homo sapiens
gaggccagcctgg

SEQ ID NO: 3935885 - DNA, 20 bp, Homo sapiens
gaggccagcctggcctcctg

SEQ ID NO: 3935886 - DNA, 14 bp, Homo sapiens
gaggcccagcctgt

SEQ ID NO: 3935887 - DNA, 14 bp, Homo sapiens
gaggcccagggagc

SEQ ID NO: 3935888 - DNA, 15 bp, Homo sapiens
gaggcccagggagca

SEQ ID NO: 3935889 - DNA, 14 bp, Homo sapiens
gaggccccaggccc

SEQ ID NO: 3935890 - DNA, 18 bp, Homo sapiens
gaggccgaagctaacagg

SEQ ID NO: 3935891 - DNA, 11 bp, Homo sapiens
gaggcctcagt

SEQ ID NO: 3935892 - DNA, 22 bp, Homo sapiens
gaggcctcttggacctctgctc

SEQ ID NO: 3935893 - DNA, 13 bp, Homo sapiens
gaggcctgatgct

SEQ ID NO: 3935894 - DNA, 15 bp, Homo sapiens
gaggcctgatgctgc

SEQ ID NO: 3935895 - DNA, 18 bp, Homo sapiens
gaggcctgatgctgcccc

SEQ ID NO: 3935896 - DNA, 17 bp, Homo sapiens
gaggcctggccaggcac

SEQ ID NO: 3935897 - DNA, 16 bp, Homo sapiens
gaggcctggccttgtc

SEQ ID NO: 3935898 - DNA, 21 bp, Homo sapiens
gaggcctggccttgtcaggac

SEQ ID NO: 3935899 - DNA, 21 bp, Homo sapiens
gaggccttacttaaacccagc

SEQ ID NO: 3935900 - DNA, 14 bp, Homo sapiens
gaggcctttaacca

SEQ ID NO: 3935901 - DNA, 13 bp, Homo sapiens
gaggcgaataaat

SEQ ID NO: 3935902 - DNA, 15 bp, Homo sapiens
gaggcgcagcccgaa

SEQ ID NO: 3935903 - DNA, 21 bp, Homo sapiens
gaggcgcagcccgaagcccag

SEQ ID NO: 3935904 - DNA, 20 bp, Homo sapiens
gaggcgccccaacccgtgga

SEQ ID NO: 3935905 - DNA, 21 bp, Homo sapiens
gaggcgccccaacccgtggag

SEQ ID NO: 3935906 - DNA, 22 bp, Homo sapiens
gaggcgccccaacccgtggagg

SEQ ID NO: 3935907 - DNA, 15 bp, Homo sapiens
gaggcggaaaccttg

SEQ ID NO: 3935908 - DNA, 20 bp, Homo sapiens
gaggcggaggttgcagtgag

SEQ ID NO: 3935909 - DNA, 23 bp, Homo sapiens
gaggctaagatgagatttgccag

SEQ ID NO: 3935910 - DNA, 16 bp, Homo sapiens
gaggctatagctggga

SEQ ID NO: 3935911 - DNA, 15 bp, Homo sapiens
gaggctcaacaataa

SEQ ID NO: 3935912 - DNA, 19 bp, Homo sapiens
gaggctcaagaggcccagg

SEQ ID NO: 3935913 - DNA, 22 bp, Homo sapiens
gaggctcaagaggcccagggag

SEQ ID NO: 3935914 - DNA, 13 bp, Homo sapiens
gaggctcctgtcc

SEQ ID NO: 3935915 - DNA, 22 bp, Homo sapiens
gaggctcctgtgctactttgcc

SEQ ID NO: 3935916 - DNA, 13 bp, Homo sapiens
gaggctgaggcag

SEQ ID NO: 3935917 - DNA, 20 bp, Homo sapiens
gaggctgcagaaggccaaga

SEQ ID NO: 3935918 - DNA, 19 bp, Homo sapiens
gaggctgcatgctctggaa

SEQ ID NO: 3935919 - DNA, 22 bp, Homo sapiens
gaggctgcatgctctggaagcc

SEQ ID NO: 3935920 - DNA, 18 bp, Homo sapiens
gaggctgctcggggtgca

SEQ ID NO: 3935921 - DNA, 23 bp, Homo sapiens
gaggctgctcggggtgcacagga

SEQ ID NO: 3935922 - DNA, 15 bp, Homo sapiens
gaggctggaggcagg

SEQ ID NO: 3935923 - DNA, 17 bp, Homo sapiens
gaggctggaggcagggc

SEQ ID NO: 3935924 - DNA, 17 bp, Homo sapiens
gaggctgggccagcctc

SEQ ID NO: 3935925 - DNA, 22 bp, Homo sapiens
gaggctggtgctgtggccaggg

SEQ ID NO: 3935926 - DNA, 21 bp, Homo sapiens
gaggcttccaggctcttcctg

SEQ ID NO: 3935927 - DNA, 22 bp, Homo sapiens
gaggcttcttcagatcagtgct

SEQ ID NO: 3935928 - DNA, 15 bp, Homo sapiens
gagggaacagacagg

SEQ ID NO: 3935929 - DNA, 17 bp, Homo sapiens
gagggacaaaggagcct

SEQ ID NO: 3935930 - DNA, 18 bp, Homo sapiens
gagggactgtcgctgctt

SEQ ID NO: 3935931 - DNA, 20 bp, Homo sapiens
gagggagcagacaggaggaa

SEQ ID NO: 3935932 - DNA, 23 bp, Homo sapiens
gagggatcacagggccccagaag

SEQ ID NO: 3935933 - DNA, 15 bp, Homo sapiens
gagggatgagagtgg

SEQ ID NO: 3935934 - DNA, 16 bp, Homo sapiens
gagggcactggtggcc

SEQ ID NO: 3935935 - DNA, 18 bp, Homo sapiens
gagggcactggtggcccg

SEQ ID NO: 3935936 - DNA, 15 bp, Homo sapiens
gagggcagaggctgg

SEQ ID NO: 3935937 - DNA, 16 bp, Homo sapiens
gagggcagaggctgga

SEQ ID NO: 3935938 - DNA, 17 bp, Homo sapiens
gagggcagcagccagcc

SEQ ID NO: 3935939 - DNA, 17 bp, Homo sapiens
gagggcagtacctggga

SEQ ID NO: 3935940 - DNA, 20 bp, Homo sapiens
gagggcagttcgcagccacc

SEQ ID NO: 3935941 - DNA, 18 bp, Homo sapiens
gagggcatgcgcacaagg

SEQ ID NO: 3935942 - DNA, 18 bp, Homo sapiens
gagggccaagacttggca

SEQ ID NO: 3935943 - DNA, 17 bp, Homo sapiens
gagggccaagagagaca

SEQ ID NO: 3935944 - DNA, 12 bp, Homo sapiens
gagggcccagct

SEQ ID NO: 3935945 - DNA, 16 bp, Homo sapiens
gagggctagaacctgg

SEQ ID NO: 3935946 - DNA, 21 bp, Homo sapiens
gagggctagaatctggagagc

SEQ ID NO: 3935947 - DNA, 16 bp, Homo sapiens
gaatgatttccaaaga

SEQ ID NO: 3935948 - DNA, 22 bp, Homo sapiens
gaatgcacactagcctctccag

SEQ ID NO: 3935949 - DNA, 20 bp, Homo sapiens
gaatgcctcaatgtgaccag

SEQ ID NO: 3935950 - DNA, 20 bp, Homo sapiens
gaatgccttccgggccgggc

SEQ ID NO: 3935951 - DNA, 21 bp, Homo sapiens
gaatgctgagacccccggagc

SEQ ID NO: 3935952 - DNA, 11 bp, Homo sapiens
gaatggagcag

SEQ ID NO: 3935953 - DNA, 22 bp, Homo sapiens
gaatggcaaagcggttgcttct

SEQ ID NO: 3935954 - DNA, 21 bp, Homo sapiens
gaatggggcgatcaagtccag

SEQ ID NO: 3935955 - DNA, 15 bp, Homo sapiens
gaatggtcagttgta

SEQ ID NO: 3935956 - DNA, 14 bp, Homo sapiens
gaatggtgcagaaa

SEQ ID NO: 3935957 - DNA, 16 bp, Homo sapiens
gaatgttccctgcacc

SEQ ID NO: 3935958 - DNA, 20 bp, Homo sapiens
gaatgttccctgcaccctgg

SEQ ID NO: 3935959 - DNA, 16 bp, Homo sapiens
gaattatatctaattt

SEQ ID NO: 3935960 - DNA, 21 bp, Homo sapiens
gaattatatctaatttataca

SEQ ID NO: 3935961 - DNA, 12 bp, Homo sapiens
gaattattttgt

SEQ ID NO: 3935962 - DNA, 22 bp, Homo sapiens
gaattatttttgtgtttctaaa

SEQ ID NO: 3935963 - DNA, 16 bp, Homo sapiens
gaattcagcaccctgg

SEQ ID NO: 3935964 - DNA, 19 bp, Homo sapiens
gaattcagcaccctgggtg

SEQ ID NO: 3935965 - DNA, 15 bp, Homo sapiens
gaattcctgaagcca

SEQ ID NO: 3935966 - DNA, 17 bp, Homo sapiens
gaattcctgaagccaga

SEQ ID NO: 3935967 - DNA, 14 bp, Homo sapiens
gaattctagaaaat

SEQ ID NO: 3935968 - DNA, 23 bp, Homo sapiens
gaattctgcaactagccaaggct

SEQ ID NO: 3935969 - DNA, 18 bp, Homo sapiens
gaattctgtgaagaatga

SEQ ID NO: 3935970 - DNA, 21 bp, Homo sapiens
gaattcttatgcttataatat

SEQ ID NO: 3935971 - DNA, 14 bp, Homo sapiens
gaattgagctgcag

SEQ ID NO: 3935972 - DNA, 22 bp, Homo sapiens
gaattgcctgcagagagaagcc

SEQ ID NO: 3935973 - DNA, 17 bp, Homo sapiens
gaattgggagcttggga

SEQ ID NO: 3935974 - DNA, 17 bp, Homo sapiens
gaattgtccatgtgctt

SEQ ID NO: 3935975 - DNA, 19 bp, Homo sapiens
gaattgtccatgtgcttcc

SEQ ID NO: 3935976 - DNA, 14 bp, Homo sapiens
gaattgtccccagt

SEQ ID NO: 3935977 - DNA, 23 bp, Homo sapiens
gaattgtccccagtttgcagaaa

SEQ ID NO: 3935978 - DNA, 15 bp, Homo sapiens
gaatttcctatctgt

SEQ ID NO: 3935979 - DNA, 20 bp, Homo sapiens
gaatttctttgtcattcaag

SEQ ID NO: 3935980 - DNA, 13 bp, Homo sapiens
gaatttgggcctc

SEQ ID NO: 3935981 - DNA, 14 bp, Homo sapiens
gaatttgtattttg

SEQ ID NO: 3935982 - DNA, 15 bp, Homo sapiens
gaattttagaagaga

SEQ ID NO: 3935983 - DNA, 16 bp, Homo sapiens
gacaaaaacagcctca

SEQ ID NO: 3935984 - DNA, 18 bp, Homo sapiens
gacaaaaacagcctcaca

SEQ ID NO: 3935985 - DNA, 13 bp, Homo sapiens
gacaaaatgtttt

SEQ ID NO: 3935986 - DNA, 18 bp, Homo sapiens
gacaaaattttataagca

SEQ ID NO: 3935987 - DNA, 19 bp, Homo sapiens
gacaaaccactgtacatat

SEQ ID NO: 3935988 - DNA, 18 bp, Homo sapiens
gacaaagttccaaaatgc

SEQ ID NO: 3935989 - DNA, 13 bp, Homo sapiens
gacaacagactga

SEQ ID NO: 3935990 - DNA, 18 bp, Homo sapiens
gacaacatcccacagtgg

SEQ ID NO: 3935991 - DNA, 14 bp, Homo sapiens
gacaacattttatt

SEQ ID NO: 3935992 - DNA, 16 bp, Homo sapiens
gacaacattttattac

SEQ ID NO: 3935993 - DNA, 11 bp, Homo sapiens
gacaacccaga

SEQ ID NO: 3935994 - DNA, 14 bp, Homo sapiens
gacaacctgtgcag

SEQ ID NO: 3935995 - DNA, 15 bp, Homo sapiens
gacaagaaatccctg

SEQ ID NO: 3935996 - DNA, 12 bp, Homo sapiens
gacaagaagctg

SEQ ID NO: 3935997 - DNA, 14 bp, Homo sapiens
gacaagaagctgct

SEQ ID NO: 3935998 - DNA, 16 bp, Homo sapiens
gacaagcactgctagg

SEQ ID NO: 3935999 - DNA, 21 bp, Homo sapiens
gacaagcatggtcccacatcc

SEQ ID NO: 3936000 - DNA, 19 bp, Homo sapiens
gacaagccaacttgtaaat

SEQ ID NO: 3936001 - DNA, 22 bp, Homo sapiens
gacaagccaacttgtaaataca

SEQ ID NO: 3936002 - DNA, 13 bp, Homo sapiens
gacaagccctggc

SEQ ID NO: 3936003 - DNA, 21 bp, Homo sapiens
gacaaggtagacatggatttg

SEQ ID NO: 3936004 - DNA, 19 bp, Homo sapiens
gacaagtgagagagcaagt

SEQ ID NO: 3936005 - DNA, 14 bp, Homo sapiens
gacaagtggagggg

SEQ ID NO: 3936006 - DNA, 15 bp, Homo sapiens
gacaagtggaggggg

SEQ ID NO: 3936007 - DNA, 14 bp, Homo sapiens
gacaatataaactg

SEQ ID NO: 3936008 - DNA, 19 bp, Homo sapiens
gacaatgatgtgagtaccc

SEQ ID NO: 3936009 - DNA, 13 bp, Homo sapiens
gacaatgccttgg

SEQ ID NO: 3936010 - DNA, 14 bp, Homo sapiens
gacaatggcagcta

SEQ ID NO: 3936011 - DNA, 13 bp, Homo sapiens
gacacaggcctgt

SEQ ID NO: 3936012 - DNA, 16 bp, Homo sapiens
gacacaggcctgtgta

SEQ ID NO: 3936013 - DNA, 23 bp, Homo sapiens
gacacagtgttccagctgcctgg

SEQ ID NO: 3936014 - DNA, 17 bp, Homo sapiens
gacacatcccggcctct

SEQ ID NO: 3936015 - DNA, 21 bp, Homo sapiens
gacacattttctcctaggaga

SEQ ID NO: 3936016 - DNA, 22 bp, Homo sapiens
gacacattttctcctaggagaa

SEQ ID NO: 3936017 - DNA, 18 bp, Homo sapiens
gacaccccttatccagga

SEQ ID NO: 3936018 - DNA, 15 bp, Homo sapiens
gacaccgtccctcag

SEQ ID NO: 3936019 - DNA, 17 bp, Homo sapiens
gacaccgtccctcagtg

SEQ ID NO: 3936020 - DNA, 18 bp, Homo sapiens
gacaccgtccctcagtga

SEQ ID NO: 3936021 - DNA, 9 bp, Homo sapiens
gacacctgc

SEQ ID NO: 3936022 - DNA, 13 bp, Homo sapiens
gacacctgcacct

SEQ ID NO: 3936023 - DNA, 16 bp, Homo sapiens
gacacctgcacctccc

SEQ ID NO: 3936024 - DNA, 17 bp, Homo sapiens
gacacctgcacctcccc

SEQ ID NO: 3936025 - DNA, 22 bp, Homo sapiens
gacacctgcacctccccccact

SEQ ID NO: 3936026 - DNA, 23 bp, Homo sapiens
gatgcagaggtaaaagtgtgagc

SEQ ID NO: 3936027 - DNA, 13 bp, Homo sapiens
gatgcctccaccg

SEQ ID NO: 3936028 - DNA, 22 bp, Homo sapiens
gatgcgagcgctatcttcacat

SEQ ID NO: 3936029 - DNA, 12 bp, Homo sapiens
gatgctccaggg

SEQ ID NO: 3936030 - DNA, 15 bp, Homo sapiens
gatgctccagggcag

SEQ ID NO: 3936031 - DNA, 16 bp, Homo sapiens
gatgctccagggcagc

SEQ ID NO: 3936032 - DNA, 11 bp, Homo sapiens
gatgctgggga

SEQ ID NO: 3936033 - DNA, 17 bp, Homo sapiens
gatggaccctcgcagca

SEQ ID NO: 3936034 - DNA, 18 bp, Homo sapiens
gatggaccctcgcagcag

SEQ ID NO: 3936035 - DNA, 20 bp, Homo sapiens
gatggaccctcgcagcaggt

SEQ ID NO: 3936036 - DNA, 20 bp, Homo sapiens
gatggaccgggtgggcctgg

SEQ ID NO: 3936037 - DNA, 21 bp, Homo sapiens
gatggaccgggtgggcctggc

SEQ ID NO: 3936038 - DNA, 14 bp, Homo sapiens
gatggactctgaaa

SEQ ID NO: 3936039 - DNA, 12 bp, Homo sapiens
gatggagaagga

SEQ ID NO: 3936040 - DNA, 13 bp, Homo sapiens
gatggaggagaag

SEQ ID NO: 3936041 - DNA, 16 bp, Homo sapiens
gatggatggacagaat

SEQ ID NO: 3936042 - DNA, 15 bp, Homo sapiens
gatggatttgaagca

SEQ ID NO: 3936043 - DNA, 16 bp, Homo sapiens
gatggccaagagcatc

SEQ ID NO: 3936044 - DNA, 13 bp, Homo sapiens
gatggcgcgggag

SEQ ID NO: 3936045 - DNA, 17 bp, Homo sapiens
gatggctgtgcctctgc

SEQ ID NO: 3936046 - DNA, 16 bp, Homo sapiens
gatgggaaagcattgt

SEQ ID NO: 3936047 - DNA, 16 bp, Homo sapiens
gatgggaagatggtag

SEQ ID NO: 3936048 - DNA, 13 bp, Homo sapiens
gatgggacatcaa

SEQ ID NO: 3936049 - DNA, 14 bp, Homo sapiens
gatgggaccaggga

SEQ ID NO: 3936050 - DNA, 20 bp, Homo sapiens
gatgggaccagggatggggg

SEQ ID NO: 3936051 - DNA, 18 bp, Homo sapiens
gatgggcattgggctgac

SEQ ID NO: 3936052 - DNA, 21 bp, Homo sapiens
gatgggctgtttcgtgtagtg

SEQ ID NO: 3936053 - DNA, 18 bp, Homo sapiens
gatggggacactaatgaa

SEQ ID NO: 3936054 - DNA, 12 bp, Homo sapiens
gatggggagaaa

SEQ ID NO: 3936055 - DNA, 13 bp, Homo sapiens
gatggggagaaag

SEQ ID NO: 3936056 - DNA, 17 bp, Homo sapiens
gatgggggatgggccag

SEQ ID NO: 3936057 - DNA, 22 bp, Homo sapiens
gatgggtattaaacttgtcaga

SEQ ID NO: 3936058 - DNA, 17 bp, Homo sapiens
gatggtagcagataaag

SEQ ID NO: 3936059 - DNA, 18 bp, Homo sapiens
gatggtcacacagagata

SEQ ID NO: 3936060 - DNA, 16 bp, Homo sapiens
gatggtgagctgggaa

SEQ ID NO: 3936061 - DNA, 18 bp, Homo sapiens
gatggttcccctgttcac

SEQ ID NO: 3936062 - DNA, 16 bp, Homo sapiens
gatgtaaacagtgcct

SEQ ID NO: 3936063 - DNA, 19 bp, Homo sapiens
gatgtaaacagtgcctgct

SEQ ID NO: 3936064 - DNA, 18 bp, Homo sapiens
gatgtaactattgaattg

SEQ ID NO: 3936065 - DNA, 12 bp, Homo sapiens
gatgtagaactt

SEQ ID NO: 3936066 - DNA, 21 bp, Homo sapiens
gatgtagggtaaggtgccttc

SEQ ID NO: 3936067 - DNA, 18 bp, Homo sapiens
gatgtatttttgtaccct

SEQ ID NO: 3936068 - DNA, 20 bp, Homo sapiens
gatgtcaaatatctcagagg

SEQ ID NO: 3936069 - DNA, 14 bp, Homo sapiens
gatgtcagccttgc

SEQ ID NO: 3936070 - DNA, 21 bp, Homo sapiens
gatgtcatgtacttcctgtgt

SEQ ID NO: 3936071 - DNA, 17 bp, Homo sapiens
gatgtcccaacttgtaa

SEQ ID NO: 3936072 - DNA, 22 bp, Homo sapiens
gatgtcctctttactcccttcc

SEQ ID NO: 3936073 - DNA, 14 bp, Homo sapiens
gatgtctaatagtt

SEQ ID NO: 3936074 - DNA, 17 bp, Homo sapiens
gatgtctcttgtagaag

SEQ ID NO: 3936075 - DNA, 14 bp, Homo sapiens
gatgtgaacacatc

SEQ ID NO: 3936076 - DNA, 22 bp, Homo sapiens
gatgtgaattgcctgcagagag

SEQ ID NO: 3936077 - DNA, 20 bp, Homo sapiens
gatgtgattcaaaagatgcc

SEQ ID NO: 3936078 - DNA, 17 bp, Homo sapiens
gatgtggagctcctgct

SEQ ID NO: 3936079 - DNA, 19 bp, Homo sapiens
gatgtggcaaagtgctgta

SEQ ID NO: 3936080 - DNA, 12 bp, Homo sapiens
gatgtggccctg

SEQ ID NO: 3936081 - DNA, 13 bp, Homo sapiens
gatgtggccctgg

SEQ ID NO: 3936082 - DNA, 13 bp, Homo sapiens
gatgtgtggggca

SEQ ID NO: 3936083 - DNA, 16 bp, Homo sapiens
gatgtgttttgcacgt

SEQ ID NO: 3936084 - DNA, 17 bp, Homo sapiens
gatgtgttttgcacgtc

SEQ ID NO: 3936085 - DNA, 23 bp, Homo sapiens
gatgtgttttgcacgtcttgcta

SEQ ID NO: 3936086 - DNA, 20 bp, Homo sapiens
gatgttacatcacagtgttt

SEQ ID NO: 3936087 - DNA, 17 bp, Homo sapiens
gatgttctggacctccc

SEQ ID NO: 3936088 - DNA, 17 bp, Homo sapiens
gatgttgtttgggagag

SEQ ID NO: 3936089 - DNA, 16 bp, Homo sapiens
gatgtttccagaaaat

SEQ ID NO: 3936090 - DNA, 17 bp, Homo sapiens
gatgtttccagaaaata

SEQ ID NO: 3936091 - DNA, 20 bp, Homo sapiens
gatgtttccagaaaatataa

SEQ ID NO: 3936092 - DNA, 10 bp, Homo sapiens
gatgtttgtt

SEQ ID NO: 3936093 - DNA, 17 bp, Homo sapiens
gatgtttgttgctagga

SEQ ID NO: 3936094 - DNA, 14 bp, Homo sapiens
gcacagctgcttgt

SEQ ID NO: 3936095 - DNA, 23 bp, Homo sapiens
gcacagctgcttgtcctgctctc

SEQ ID NO: 3936096 - DNA, 15 bp, Homo sapiens
gcacaggaaaaggta

SEQ ID NO: 3936097 - DNA, 16 bp, Homo sapiens
gcacaggactgattct

SEQ ID NO: 3936098 - DNA, 12 bp, Homo sapiens
gcacaggagcta

SEQ ID NO: 3936099 - DNA, 15 bp, Homo sapiens
gcacaggagctacct

SEQ ID NO: 3936100 - DNA, 21 bp, Homo sapiens
gcacaggagctacctgtgtgg

SEQ ID NO: 3936101 - DNA, 23 bp, Homo sapiens
gcacaggagggggtcgtggagag

SEQ ID NO: 3936102 - DNA, 15 bp, Homo sapiens
gcacaggcaggaaga

SEQ ID NO: 3936103 - DNA, 16 bp, Homo sapiens
gcacagggcagtggga

SEQ ID NO: 3936104 - DNA, 12 bp, Homo sapiens
gcacaggggccc

SEQ ID NO: 3936105 - DNA, 16 bp, Homo sapiens
gcacaggggccccaga

SEQ ID NO: 3936106 - DNA, 19 bp, Homo sapiens
gcacagttgtctattctga

SEQ ID NO: 3936107 - DNA, 23 bp, Homo sapiens
gcacagttgtctattctgagcct

SEQ ID NO: 3936108 - DNA, 18 bp, Homo sapiens
gcacagttttctgagaaa

SEQ ID NO: 3936109 - DNA, 19 bp, Homo sapiens
gcacatagagatatgcaca

SEQ ID NO: 3936110 - DNA, 18 bp, Homo sapiens
gcacatatgggtgctggc

SEQ ID NO: 3936111 - DNA, 14 bp, Homo sapiens
gcagggaggggact

SEQ ID NO: 3936112 - DNA, 14 bp, Homo sapiens
gcagggccggggaa

SEQ ID NO: 3936113 - DNA, 23 bp, Homo sapiens
gcagggccggggaactggccaag

SEQ ID NO: 3936114 - DNA, 18 bp, Homo sapiens
gcagggccttgcccagag

SEQ ID NO: 3936115 - DNA, 18 bp, Homo sapiens
gcagggctctcctggctt

SEQ ID NO: 3936116 - DNA, 17 bp, Homo sapiens
gcaggggtgggagagcc

SEQ ID NO: 3936117 - DNA, 17 bp, Homo sapiens
gcagggtctagaaggct

SEQ ID NO: 3936118 - DNA, 18 bp, Homo sapiens
gcaggtacttcctcctga

SEQ ID NO: 3936119 - DNA, 22 bp, Homo sapiens
gcaggtacttcctcctgatggc

SEQ ID NO: 3936120 - DNA, 21 bp, Homo sapiens
gcaggtattttaactgtgtga

SEQ ID NO: 3936121 - DNA, 14 bp, Homo sapiens
gcaggtcctgccca

SEQ ID NO: 3936122 - DNA, 21 bp, Homo sapiens
gcaggtctcagcccgggacag

SEQ ID NO: 3936123 - DNA, 14 bp, Homo sapiens
gcaggtgcaagaga

SEQ ID NO: 3936124 - DNA, 19 bp, Homo sapiens
gcaggtgcaagagacagag

SEQ ID NO: 3936125 - DNA, 21 bp, Homo sapiens
gcaggtgcaagagacagagcc

SEQ ID NO: 3936126 - DNA, 18 bp, Homo sapiens
gcaggtgcagatgggctg

SEQ ID NO: 3936127 - DNA, 16 bp, Homo sapiens
gcaggttagaacctag

SEQ ID NO: 3936128 - DNA, 16 bp, Homo sapiens
gcagtaaactttctct

SEQ ID NO: 3936129 - DNA, 14 bp, Homo sapiens
gcagtacctgggaa

SEQ ID NO: 3936130 - DNA, 22 bp, Homo sapiens
gcagtacctgggaaaggaccca

SEQ ID NO: 3936131 - DNA, 12 bp, Homo sapiens
gcagtagtctct

SEQ ID NO: 3936132 - DNA, 15 bp, Homo sapiens
gcagtatctctctgc

SEQ ID NO: 3936133 - DNA, 15 bp, Homo sapiens
gcagtccagaataag

SEQ ID NO: 3936134 - DNA, 16 bp, Homo sapiens
gcagtccccagccctt

SEQ ID NO: 3936135 - DNA, 16 bp, Homo sapiens
gcagtccccagtcacc

SEQ ID NO: 3936136 - DNA, 18 bp, Homo sapiens
gcagtcccgtggagggta

SEQ ID NO: 3936137 - DNA, 12 bp, Homo sapiens
gcagtccgcagt

SEQ ID NO: 3936138 - DNA, 22 bp, Homo sapiens
gcagtcgcaggatccgctgcca

SEQ ID NO: 3936139 - DNA, 23 bp, Homo sapiens
gcagtcgcaggatccgctgccac

SEQ ID NO: 3936140 - DNA, 17 bp, Homo sapiens
gcagtcgtaagggttgc

SEQ ID NO: 3936141 - DNA, 12 bp, Homo sapiens
gcagtctcagaa

SEQ ID NO: 3936142 - DNA, 21 bp, Homo sapiens
gcagtctcagaaagccttcca

SEQ ID NO: 3936143 - DNA, 19 bp, Homo sapiens
gcagtctgaacccttgtgc

SEQ ID NO: 3936144 - DNA, 14 bp, Homo sapiens
gcagtgactggcag

SEQ ID NO: 3936145 - DNA, 15 bp, Homo sapiens
gcagtgactggcagg

SEQ ID NO: 3936146 - DNA, 20 bp, Homo sapiens
gcagtgagaaaaagctcctg

SEQ ID NO: 3936147 - DNA, 23 bp, Homo sapiens
gcagtgagaaaaagctcctgtcc

SEQ ID NO: 3936148 - DNA, 17 bp, Homo sapiens
gcagtgagcttctatta

SEQ ID NO: 3936149 - DNA, 19 bp, Homo sapiens
gcagtgagttacagcgaga

SEQ ID NO: 3936150 - DNA, 16 bp, Homo sapiens
gcagtgatagttgact

SEQ ID NO: 3936151 - DNA, 14 bp, Homo sapiens
gcagtgatggcgcg

SEQ ID NO: 3936152 - DNA, 22 bp, Homo sapiens
gcagtgcaagagactctggcct

SEQ ID NO: 3936153 - DNA, 19 bp, Homo sapiens
gcagtgctgattcagcctg

SEQ ID NO: 3936154 - DNA, 16 bp, Homo sapiens
gcagtgcttctctaca

SEQ ID NO: 3936155 - DNA, 18 bp, Homo sapiens
gcagtggtaagctctggc

SEQ ID NO: 3936156 - DNA, 18 bp, Homo sapiens
gcagtgtcatcagaagat

SEQ ID NO: 3936157 - DNA, 22 bp, Homo sapiens
gcagtgtgtccttggggcacag

SEQ ID NO: 3936158 - DNA, 20 bp, Homo sapiens
gcagtgttccccatctgggt

SEQ ID NO: 3936159 - DNA, 21 bp, Homo sapiens
gcagtgttccccatctgggtc

SEQ ID NO: 3936160 - DNA, 17 bp, Homo sapiens
gcagttccatgaagaca

SEQ ID NO: 3936161 - DNA, 19 bp, Homo sapiens
gcagttccatgaagacacg

SEQ ID NO: 3936162 - DNA, 15 bp, Homo sapiens
gcagttcgcagccac

SEQ ID NO: 3936163 - DNA, 17 bp, Homo sapiens
gcagttcgcagccaccc

SEQ ID NO: 3936164 - DNA, 15 bp, Homo sapiens
gcagttgaaaagact

SEQ ID NO: 3936165 - DNA, 13 bp, Homo sapiens
gcagtttaaagca

SEQ ID NO: 3936166 - DNA, 19 bp, Homo sapiens
gcataagattaaaggaagg

SEQ ID NO: 3936167 - DNA, 13 bp, Homo sapiens
gcatacctttatt

SEQ ID NO: 3936168 - DNA, 17 bp, Homo sapiens
gcatagaaactgaggag

SEQ ID NO: 3936169 - DNA, 23 bp, Homo sapiens
gcatagaaactgaggagtagctg

SEQ ID NO: 3936170 - DNA, 18 bp, Homo sapiens
gcatagattccctgagca

SEQ ID NO: 3936171 - DNA, 13 bp, Homo sapiens
gcatatttatatt

SEQ ID NO: 3936172 - DNA, 15 bp, Homo sapiens
gcatcacctctgtaa

SEQ ID NO: 3936173 - DNA, 19 bp, Homo sapiens
gcatcgtagaagagatgtg

SEQ ID NO: 3936174 - DNA, 22 bp, Homo sapiens
gcatcgtagaagagatgtggca

SEQ ID NO: 3936175 - DNA, 12 bp, Homo sapiens
gcatctcagccc

SEQ ID NO: 3936176 - DNA, 14 bp, Homo sapiens
gcatctcagcccac

SEQ ID NO: 3936177 - DNA, 21 bp, Homo sapiens
gcatctcattgtagagcttgg

SEQ ID NO: 3936178 - DNA, 19 bp, Homo sapiens
gcatcttctggagtctcca

SEQ ID NO: 3936179 - DNA, 15 bp, Homo sapiens
gcatgaaagagaaag

SEQ ID NO: 3936180 - DNA, 16 bp, Homo sapiens
gcatgatctgaaaaat

SEQ ID NO: 3936181 - DNA, 11 bp, Homo sapiens
gcatgatttat

SEQ ID NO: 3936182 - DNA, 22 bp, Homo sapiens
gcatgatttatatatggcatat

SEQ ID NO: 3936183 - DNA, 15 bp, Homo sapiens
gcatgcacagctgct

SEQ ID NO: 3936184 - DNA, 16 bp, Homo sapiens
gcatgcacagctgctt

SEQ ID NO: 3936185 - DNA, 22 bp, Homo sapiens
gcatgcacagctgcttgtcctg

SEQ ID NO: 3936186 - DNA, 19 bp, Homo sapiens
gcatgcctctgatatggga

SEQ ID NO: 3936187 - DNA, 14 bp, Homo sapiens
gcatgcgcacaagg

SEQ ID NO: 3936188 - DNA, 14 bp, Homo sapiens
gcatgctctctgca

SEQ ID NO: 3936189 - DNA, 15 bp, Homo sapiens
gcatggactctgggt

SEQ ID NO: 3936190 - DNA, 14 bp, Homo sapiens
gcatggatttctgt

SEQ ID NO: 3936191 - DNA, 14 bp, Homo sapiens
gcatggccaggtgg

SEQ ID NO: 3936192 - DNA, 17 bp, Homo sapiens
gcatggccaggtggcca

SEQ ID NO: 3936193 - DNA, 12 bp, Homo sapiens
gcatggccctgg

SEQ ID NO: 3936194 - DNA, 14 bp, Homo sapiens
gcatgggagggagg

SEQ ID NO: 3936195 - DNA, 18 bp, Homo sapiens
gcatgggagggagggaga

SEQ ID NO: 3936196 - DNA, 19 bp, Homo sapiens
gcatggtcccacatccctg

SEQ ID NO: 3936197 - DNA, 21 bp, Homo sapiens
gcatggtcccacatccctggg

SEQ ID NO: 3936198 - DNA, 20 bp, Homo sapiens
gcatggtcctggaggatgac

SEQ ID NO: 3936199 - DNA, 22 bp, Homo sapiens
gcatggttccttccctgggaag

SEQ ID NO: 3936200 - DNA, 16 bp, Homo sapiens
gcatgtaaaatgcagt

SEQ ID NO: 3936201 - DNA, 22 bp, Homo sapiens
gcatgtacaaaagtaccataga

SEQ ID NO: 3936202 - DNA, 12 bp, Homo sapiens
gcatgtatgtgt

SEQ ID NO: 3936203 - DNA, 13 bp, Homo sapiens
gcatgtgaattct

SEQ ID NO: 3936204 - DNA, 22 bp, Homo sapiens
gcatgtgaattctgtgaagaat

SEQ ID NO: 3936205 - DNA, 14 bp, Homo sapiens
gcatgtgagcacat

SEQ ID NO: 3936206 - DNA, 17 bp, Homo sapiens
gcatgtgtgcctgtggc

SEQ ID NO: 3936207 - DNA, 19 bp, Homo sapiens
gcatgtgtgcctgtggcag

SEQ ID NO: 3936208 - DNA, 20 bp, Homo sapiens
gcatgtgtgcctgtggcaga

SEQ ID NO: 3936209 - DNA, 11 bp, Homo sapiens
gcatgtgtgta

SEQ ID NO: 3936210 - DNA, 18 bp, Homo sapiens
gcatgtgtgtgtctgtct

SEQ ID NO: 3936211 - DNA, 19 bp, Homo sapiens
gcattaaattttaaggtag

SEQ ID NO: 3936212 - DNA, 13 bp, Homo sapiens
gcattaacttaaa

SEQ ID NO: 3936213 - DNA, 16 bp, Homo sapiens
gcattacatttccaaa

SEQ ID NO: 3936214 - DNA, 16 bp, Homo sapiens
gcattagaaatagaca

SEQ ID NO: 3936215 - DNA, 22 bp, Homo sapiens
gcattaggcttttaagaaacac

SEQ ID NO: 3936216 - DNA, 18 bp, Homo sapiens
gcattatttaatgtttga

SEQ ID NO: 3936217 - DNA, 16 bp, Homo sapiens
gcattcagcacacccc

SEQ ID NO: 3936218 - DNA, 17 bp, Homo sapiens
gcattccccgctgccca

SEQ ID NO: 3936219 - DNA, 13 bp, Homo sapiens
gcattctcactcc

SEQ ID NO: 3936220 - DNA, 15 bp, Homo sapiens
gcattctgagctggg

SEQ ID NO: 3936221 - DNA, 20 bp, Homo sapiens
gcattcttttaaagttttat

SEQ ID NO: 3936222 - DNA, 15 bp, Homo sapiens
gcattgggctgacac

SEQ ID NO: 3936223 - DNA, 16 bp, Homo sapiens
gcattggggggccggg

SEQ ID NO: 3936224 - DNA, 18 bp, Homo sapiens
gcattggggggccgggca

SEQ ID NO: 3936225 - DNA, 19 bp, Homo sapiens
gcattgttattgtggaaga

SEQ ID NO: 3936226 - DNA, 21 bp, Homo sapiens
gcatttagttttatggcatga

SEQ ID NO: 3936227 - DNA, 23 bp, Homo sapiens
gcatttagttttatggcatgatt

SEQ ID NO: 3936228 - DNA, 12 bp, Homo sapiens
gcatttcctggg

SEQ ID NO: 3936229 - DNA, 12 bp, Homo sapiens
gcatttgtgaaa

SEQ ID NO: 3936230 - DNA, 16 bp, Homo sapiens
gcatttgtgttattat

SEQ ID NO: 3936231 - DNA, 15 bp, Homo sapiens
gcattttaaaagcaa

SEQ ID NO: 3936232 - DNA, 22 bp, Homo sapiens
gcattttactacttgttacctt

SEQ ID NO: 3936233 - DNA, 22 bp, Homo sapiens
gcattttcacattttgcctttc

SEQ ID NO: 3936234 - DNA, 13 bp, Homo sapiens
gccaaacacagag

SEQ ID NO: 3936235 - DNA, 14 bp, Homo sapiens
gccaaacacagagc

SEQ ID NO: 3936236 - DNA, 21 bp, Homo sapiens
gccaaagcaaaagaagtaaaa

SEQ ID NO: 3936237 - DNA, 17 bp, Homo sapiens
gccaaagtgcagccctt

SEQ ID NO: 3936238 - DNA, 20 bp, Homo sapiens
gccaaagtgcagcccttcct

SEQ ID NO: 3936239 - DNA, 15 bp, Homo sapiens
gccaaattatttgtg

SEQ ID NO: 3936240 - DNA, 23 bp, Homo sapiens
gccaaattatttgtgtaatagaa

SEQ ID NO: 3936241 - DNA, 12 bp, Homo sapiens
gccaacagcagc

SEQ ID NO: 3936242 - DNA, 13 bp, Homo sapiens
gccaacagccccc

SEQ ID NO: 3936243 - DNA, 22 bp, Homo sapiens
gccaacaggtggcaggaccagg

SEQ ID NO: 3936244 - DNA, 23 bp, Homo sapiens
gccaacaggtggcaggaccagga

SEQ ID NO: 3936245 - DNA, 23 bp, Homo sapiens
gccaactcactcttatgaaatgg

SEQ ID NO: 3936246 - DNA, 13 bp, Homo sapiens
gccaacttgtaaa

SEQ ID NO: 3936247 - DNA, 17 bp, Homo sapiens
gccaacttgtaaataca

SEQ ID NO: 3936248 - DNA, 22 bp, Homo sapiens
gccaagacttggcaacagaagc

SEQ ID NO: 3936249 - DNA, 23 bp, Homo sapiens
gccaagacttggcaacagaagca

SEQ ID NO: 3936250 - DNA, 20 bp, Homo sapiens
gccaagagcatcgtgaccct

SEQ ID NO: 3936251 - DNA, 18 bp, Homo sapiens
gccaagatcgcgccactg

SEQ ID NO: 3936252 - DNA, 16 bp, Homo sapiens
gccaagcccacctgca

SEQ ID NO: 3936253 - DNA, 15 bp, Homo sapiens
gccaagctgaggtgc

SEQ ID NO: 3936254 - DNA, 15 bp, Homo sapiens
gccaagtccaggtcc

SEQ ID NO: 3936255 - DNA, 14 bp, Homo sapiens
gccaagttatattg

SEQ ID NO: 3936256 - DNA, 19 bp, Homo sapiens
gccaattaaaatatatata

SEQ ID NO: 3936257 - DNA, 22 bp, Homo sapiens
gccaattaaaatatatataaat

SEQ ID NO: 3936258 - DNA, 14 bp, Homo sapiens
gccacaagaaattt

SEQ ID NO: 3936259 - DNA, 16 bp, Homo sapiens
gccacaagaaatttga

SEQ ID NO: 3936260 - DNA, 20 bp, Homo sapiens
gccacaccacagcaagccgg

SEQ ID NO: 3936261 - DNA, 23 bp, Homo sapiens
gccacacttcaggctcttctcct

SEQ ID NO: 3936262 - DNA, 19 bp, Homo sapiens
gccacacttctcaggacac

SEQ ID NO: 3936263 - DNA, 18 bp, Homo sapiens
gccacagaagccaggagc

SEQ ID NO: 3936264 - DNA, 13 bp, Homo sapiens
gccacagagaaga

SEQ ID NO: 3936265 - DNA, 14 bp, Homo sapiens
gccacagccccaca

SEQ ID NO: 3936266 - DNA, 16 bp, Homo sapiens
gccacagccccacagc

SEQ ID NO: 3936267 - DNA, 20 bp, Homo sapiens
gccacagccccacagcaccc

SEQ ID NO: 3936268 - DNA, 22 bp, Homo sapiens
gccaccaccccataatctcatt

SEQ ID NO: 3936269 - DNA, 16 bp, Homo sapiens
gccaccactagagctg

SEQ ID NO: 3936270 - DNA, 12 bp, Homo sapiens
gccaccaggatg

SEQ ID NO: 3936271 - DNA, 15 bp, Homo sapiens
gccaccatcctgctg

SEQ ID NO: 3936272 - DNA, 12 bp, Homo sapiens
gccaccctgagg

SEQ ID NO: 3936273 - DNA, 13 bp, Homo sapiens
gccaccctgagga

SEQ ID NO: 3936274 - DNA, 22 bp, Homo sapiens
gccaccctgaggagtctgaggt

SEQ ID NO: 3936275 - DNA, 14 bp, Homo sapiens
gccaccctggcccg

SEQ ID NO: 3936276 - DNA, 23 bp, Homo sapiens
gccaccctggcccgcccctcgct

SEQ ID NO: 3936277 - DNA, 13 bp, Homo sapiens
gccacctcccacc

SEQ ID NO: 3936278 - DNA, 14 bp, Homo sapiens
gccacctcccaccc

SEQ ID NO: 3936279 - DNA, 17 bp, Homo sapiens
gccacctcccaccccac

SEQ ID NO: 3936280 - DNA, 22 bp, Homo sapiens
gccacctcccaccccactccag

SEQ ID NO: 3936281 - DNA, 23 bp, Homo sapiens
gccacctcccaccccactccagc

SEQ ID NO: 3936282 - DNA, 15 bp, Homo sapiens
gccacctcccctatc

SEQ ID NO: 3936283 - DNA, 10 bp, Homo sapiens
gccacctgtc

SEQ ID NO: 3936284 - DNA, 15 bp, Homo sapiens
gccacctgtctgtct

SEQ ID NO: 3936285 - DNA, 15 bp, Homo sapiens
gccacgctgtcctct

SEQ ID NO: 3936286 - DNA, 22 bp, Homo sapiens
gccacgctgtcctctcgagccc

SEQ ID NO: 3936287 - DNA, 13 bp, Homo sapiens
gccacggccaccc

SEQ ID NO: 3936288 - DNA, 16 bp, Homo sapiens
gccacggggaggggga

SEQ ID NO: 3936289 - DNA, 17 bp, Homo sapiens
gccacggggagggggac

SEQ ID NO: 3936290 - DNA, 22 bp, Homo sapiens
gccacgttccttactgcagaat

SEQ ID NO: 3936291 - DNA, 19 bp, Homo sapiens
gccactccagacccctggc

SEQ ID NO: 3936292 - DNA, 22 bp, Homo sapiens
gccactccagacccctggcttt

SEQ ID NO: 3936293 - DNA, 13 bp, Homo sapiens
gccactccctgag

SEQ ID NO: 3936294 - DNA, 15 bp, Homo sapiens
gccactccctgagct

SEQ ID NO: 3936295 - DNA, 19 bp, Homo sapiens
gccactccctgagctttgg

SEQ ID NO: 3936296 - DNA, 20 bp, Homo sapiens
gccactccctgagctttggg

SEQ ID NO: 3936297 - DNA, 14 bp, Homo sapiens
gccactccttcctg

SEQ ID NO: 3936298 - DNA, 17 bp, Homo sapiens
gccactccttcctgccc

SEQ ID NO: 3936299 - DNA, 23 bp, Homo sapiens
gccactcgggaggctgagacagg

SEQ ID NO: 3936300 - DNA, 13 bp, Homo sapiens
gccactcttccaa

SEQ ID NO: 3936301 - DNA, 15 bp, Homo sapiens
gccactgccagcagc

SEQ ID NO: 3936302 - DNA, 16 bp, Homo sapiens
gccactgccaggcacc

SEQ ID NO: 3936303 - DNA, 19 bp, Homo sapiens
gccactgccaggcacctgg

SEQ ID NO: 3936304 - DNA, 22 bp, Homo sapiens
gccactgccaggcacctggcct

SEQ ID NO: 3936305 - DNA, 23 bp, Homo sapiens
gccactgccaggcacctggcctg

SEQ ID NO: 3936306 - DNA, 17 bp, Homo sapiens
gccactgcctcttcctc

SEQ ID NO: 3936307 - DNA, 17 bp, Homo sapiens
gccactgggtctcactc

SEQ ID NO: 3936308 - DNA, 19 bp, Homo sapiens
gccactgggtctcactcct

SEQ ID NO: 3936309 - DNA, 20 bp, Homo sapiens
gccactgggtctcactcctg

SEQ ID NO: 3936310 - DNA, 23 bp, Homo sapiens
gccactggtgttaagatatattt

SEQ ID NO: 3936311 - DNA, 17 bp, Homo sapiens
gccactgtggccagagc

SEQ ID NO: 3936312 - DNA, 19 bp, Homo sapiens
gccactgtggccagagctg

SEQ ID NO: 3936313 - DNA, 20 bp, Homo sapiens
gccacttcttaaaggcctgg

SEQ ID NO: 3936314 - DNA, 17 bp, Homo sapiens
gccacttgacattcctt

SEQ ID NO: 3936315 - DNA, 16 bp, Homo sapiens
gccacttggtttttgg

SEQ ID NO: 3936316 - DNA, 17 bp, Homo sapiens
gccactttaagagagaa

SEQ ID NO: 3936317 - DNA, 20 bp, Homo sapiens
gccactttaagagagaaatc

SEQ ID NO: 3936318 - DNA, 19 bp, Homo sapiens
gccagaaggagggcagagc

SEQ ID NO: 3936319 - DNA, 22 bp, Homo sapiens
gccagaaggagggcagagccat

SEQ ID NO: 3936320 - DNA, 23 bp, Homo sapiens
gccagaaggagggcagagccatg

SEQ ID NO: 3936321 - DNA, 16 bp, Homo sapiens
gccagacacatggcta

SEQ ID NO: 3936322 - DNA, 19 bp, Homo sapiens
gccagacgctgccgctgcc

SEQ ID NO: 3936323 - DNA, 18 bp, Homo sapiens
gccagactggcacagttt

SEQ ID NO: 3936324 - DNA, 19 bp, Homo sapiens
gccagactggcacagtttt

SEQ ID NO: 3936325 - DNA, 16 bp, Homo sapiens
gccagagaagataatg

SEQ ID NO: 3936326 - DNA, 20 bp, Homo sapiens
gccagagacggaagcctttt

SEQ ID NO: 3936327 - DNA, 13 bp, Homo sapiens
gccagagaggagc

SEQ ID NO: 3936328 - DNA, 18 bp, Homo sapiens
gccagagaggagcacctg

SEQ ID NO: 3936329 - DNA, 16 bp, Homo sapiens
gccagagagggcccag

SEQ ID NO: 3936330 - DNA, 13 bp, Homo sapiens
gccagagcctggg

SEQ ID NO: 3936331 - DNA, 14 bp, Homo sapiens
gccagagcctgggg

SEQ ID NO: 3936332 - DNA, 17 bp, Homo sapiens
gccagagcctggggctc

SEQ ID NO: 3936333 - DNA, 19 bp, Homo sapiens
gccagagcctggggctcta

SEQ ID NO: 3936334 - DNA, 14 bp, Homo sapiens
gccagagctggaag

SEQ ID NO: 3936335 - DNA, 16 bp, Homo sapiens
gccagagctggaaggc

SEQ ID NO: 3936336 - DNA, 18 bp, Homo sapiens
gccagagctggaaggcag

SEQ ID NO: 3936337 - DNA, 15 bp, Homo sapiens
gccagagctttgttt

SEQ ID NO: 3936338 - DNA, 18 bp, Homo sapiens
gccagcaaaccaggactc

SEQ ID NO: 3936339 - DNA, 21 bp, Homo sapiens
gccagcaatgatgtccagaag

SEQ ID NO: 3936340 - DNA, 14 bp, Homo sapiens
gccagcaccctctc

SEQ ID NO: 3936341 - DNA, 20 bp, Homo sapiens
gccagcaccctctcctgggg

SEQ ID NO: 3936342 - DNA, 21 bp, Homo sapiens
gccagcagaacatgtgggagg

SEQ ID NO: 3936343 - DNA, 21 bp, Homo sapiens
gccagcattttcacattttgc

SEQ ID NO: 3936344 - DNA, 22 bp, Homo sapiens
gccagccagtcttgcctaggcc

SEQ ID NO: 3936345 - DNA, 22 bp, Homo sapiens
gctcaggcagacaagagctgct

SEQ ID NO: 3936346 - DNA, 23 bp, Homo sapiens
gctcaggcagacaagagctgctg

SEQ ID NO: 3936347 - DNA, 12 bp, Homo sapiens
gctcagggctgg

SEQ ID NO: 3936348 - DNA, 13 bp, Homo sapiens
gctcagggctgga

SEQ ID NO: 3936349 - DNA, 23 bp, Homo sapiens
gctcagggctggagtgcgctctt

SEQ ID NO: 3936350 - DNA, 13 bp, Homo sapiens
gctcaggtgcaag

SEQ ID NO: 3936351 - DNA, 15 bp, Homo sapiens
gctcaggtgcaagtg

SEQ ID NO: 3936352 - DNA, 13 bp, Homo sapiens
gctcagtgcctcc

SEQ ID NO: 3936353 - DNA, 18 bp, Homo sapiens
gctcatattttgtatata

SEQ ID NO: 3936354 - DNA, 15 bp, Homo sapiens
gctcatcacccagtc

SEQ ID NO: 3936355 - DNA, 17 bp, Homo sapiens
gctcatcacccagtcct

SEQ ID NO: 3936356 - DNA, 20 bp, Homo sapiens
gctcatcacccagtcctggc

SEQ ID NO: 3936357 - DNA, 22 bp, Homo sapiens
gctcatggcgtaatgggcctgc

SEQ ID NO: 3936358 - DNA, 21 bp, Homo sapiens
gctccaacagcttgaccagac

SEQ ID NO: 3936359 - DNA, 20 bp, Homo sapiens
gctccacggtgcgtggctgt

SEQ ID NO: 3936360 - DNA, 23 bp, Homo sapiens
gctccacggtgcgtggctgtggc

SEQ ID NO: 3936361 - DNA, 21 bp, Homo sapiens
gctccagatctgcactgggtg

SEQ ID NO: 3936362 - DNA, 21 bp, Homo sapiens
gctccagcatccagcctgtgt

SEQ ID NO: 3936363 - DNA, 14 bp, Homo sapiens
gctccagggtcttg

SEQ ID NO: 3936364 - DNA, 18 bp, Homo sapiens
gctccagggtcttgggct

SEQ ID NO: 3936365 - DNA, 20 bp, Homo sapiens
gctccagggtcttgggctac

SEQ ID NO: 3936366 - DNA, 23 bp, Homo sapiens
gctccagggtcttgggctactgg

SEQ ID NO: 3936367 - DNA, 24 bp, Homo sapiens
gctccagggtcttgggctactggc

SEQ ID NO: 3936368 - DNA, 18 bp, Homo sapiens
gctccaggtccggagggg

SEQ ID NO: 3936369 - DNA, 21 bp, Homo sapiens
gctccaggtccggaggggttg

SEQ ID NO: 3936370 - DNA, 23 bp, Homo sapiens
gctccagtttccaagttcctgca

SEQ ID NO: 3936371 - DNA, 15 bp, Homo sapiens
gctccatggaggagg

SEQ ID NO: 3936372 - DNA, 22 bp, Homo sapiens
gctccatggaggaggtgtccca

SEQ ID NO: 3936373 - DNA, 11 bp, Homo sapiens
gctccatgggg

SEQ ID NO: 3936374 - DNA, 17 bp, Homo sapiens
gctcccacaggcccttc

SEQ ID NO: 3936375 - DNA, 11 bp, Homo sapiens
gctcccagggc

SEQ ID NO: 3936376 - DNA, 20 bp, Homo sapiens
gctcccatagcgctggctca

SEQ ID NO: 3936377 - DNA, 15 bp, Homo sapiens
gctcccatctcctga

SEQ ID NO: 3936378 - DNA, 20 bp, Homo sapiens
gctccccacacgtgctcgca

SEQ ID NO: 3936379 - DNA, 24 bp, Homo sapiens
gctccccacgagtcacctgcaagc

SEQ ID NO: 3936380 - DNA, 22 bp, Homo sapiens
gctccccactctgctctgatgc

SEQ ID NO: 3936381 - DNA, 16 bp, Homo sapiens
gctccccagccctggc

SEQ ID NO: 3936382 - DNA, 16 bp, Homo sapiens
gctcccccgcagtccc

SEQ ID NO: 3936383 - DNA, 15 bp, Homo sapiens
gctcccctcggagaa

SEQ ID NO: 3936384 - DNA, 18 bp, Homo sapiens
gctcccctcggagaagag

SEQ ID NO: 3936385 - DNA, 20 bp, Homo sapiens
gctcccgagctactctcttg

SEQ ID NO: 3936386 - DNA, 13 bp, Homo sapiens
gctccctcctgga

SEQ ID NO: 3936387 - DNA, 16 bp, Homo sapiens
gctccctcctggagca

SEQ ID NO: 3936388 - DNA, 22 bp, Homo sapiens
gctccctgtgacaaaattttat

SEQ ID NO: 3936389 - DNA, 13 bp, Homo sapiens
gctccctttctct

SEQ ID NO: 3936390 - DNA, 15 bp, Homo sapiens
gctcctcccctcttg

SEQ ID NO: 3936391 - DNA, 14 bp, Homo sapiens
gctcctcccggtgc

SEQ ID NO: 3936392 - DNA, 19 bp, Homo sapiens
gctcctcccggtgcccaag

SEQ ID NO: 3936393 - DNA, 12 bp, Homo sapiens
gctcctctccag

SEQ ID NO: 3936394 - DNA, 14 bp, Homo sapiens
gctcctctccaggc

SEQ ID NO: 3936395 - DNA, 16 bp, Homo sapiens
gctcctctccaggcac

SEQ ID NO: 3936396 - DNA, 21 bp, Homo sapiens
gctcctctccttgggctcctg

SEQ ID NO: 3936397 - DNA, 14 bp, Homo sapiens
gctcctctgctgct

SEQ ID NO: 3936398 - DNA, 15 bp, Homo sapiens
gctcctctgctgctc

SEQ ID NO: 3936399 - DNA, 17 bp, Homo sapiens
gctcctctgctgctccc

SEQ ID NO: 3936400 - DNA, 17 bp, Homo sapiens
gctcctctgtctcgagc

SEQ ID NO: 3936401 - DNA, 21 bp, Homo sapiens
gctcctctgtctcgagcgccc

SEQ ID NO: 3936402 - DNA, 23 bp, Homo sapiens
gctcctctgtctcgagcgccctg

SEQ ID NO: 3936403 - DNA, 18 bp, Homo sapiens
gctcctcttaccgtagcc

SEQ ID NO: 3936404 - DNA, 14 bp, Homo sapiens
gctcctggctgcca

SEQ ID NO: 3936405 - DNA, 16 bp, Homo sapiens
gctcctggctgccagg

SEQ ID NO: 3936406 - DNA, 19 bp, Homo sapiens
gctcctggctgccaggcgt

SEQ ID NO: 3936407 - DNA, 23 bp, Homo sapiens
gctcctgtccctacccactcttt

SEQ ID NO: 3936408 - DNA, 18 bp, Homo sapiens
gctccttgggtcctgcaa

SEQ ID NO: 3936409 - DNA, 16 bp, Homo sapiens
gctcctttctccagcc

SEQ ID NO: 3936410 - DNA, 14 bp, Homo sapiens
gctccttttgtccc

SEQ ID NO: 3936411 - DNA, 12 bp, Homo sapiens
gctcgcagcctg

SEQ ID NO: 3936412 - DNA, 13 bp, Homo sapiens
gctcgccccaccc

SEQ ID NO: 3936413 - DNA, 21 bp, Homo sapiens
gctcgctccctgtagctctgc

SEQ ID NO: 3936414 - DNA, 16 bp, Homo sapiens
gctcggggtgcacagg

SEQ ID NO: 3936415 - DNA, 19 bp, Homo sapiens
gctcggggtgcacaggagg

SEQ ID NO: 3936416 - DNA, 22 bp, Homo sapiens
gctcgtggccttccccttttgc

SEQ ID NO: 3936417 - DNA, 14 bp, Homo sapiens
gctctaacgcctga

SEQ ID NO: 3936418 - DNA, 23 bp, Homo sapiens
gctctagattgagagaagagaca

SEQ ID NO: 3936419 - DNA, 19 bp, Homo sapiens
gctctagctggcaggacac

SEQ ID NO: 3936420 - DNA, 20 bp, Homo sapiens
gctctcaggggccagtgagg

SEQ ID NO: 3936421 - DNA, 13 bp, Homo sapiens
gctctcatgcctg

SEQ ID NO: 3936422 - DNA, 21 bp, Homo sapiens
gctctccaaaggggctgctgg

SEQ ID NO: 3936423 - DNA, 18 bp, Homo sapiens
gctctccacctcagcctt

SEQ ID NO: 3936424 - DNA, 20 bp, Homo sapiens
gctctccacctcagccttgg

SEQ ID NO: 3936425 - DNA, 16 bp, Homo sapiens
gctctcccctgccctg

SEQ ID NO: 3936426 - DNA, 18 bp, Homo sapiens
gctctccctctggccctg

SEQ ID NO: 3936427 - DNA, 21 bp, Homo sapiens
gctctccctctggccctgcct

SEQ ID NO: 3936428 - DNA, 23 bp, Homo sapiens
gctctccctctggccctgccttc

SEQ ID NO: 3936429 - DNA, 19 bp, Homo sapiens
gctctctgcagccagccca

SEQ ID NO: 3936430 - DNA, 12 bp, Homo sapiens
gctactcagcag

SEQ ID NO: 3936431 - DNA, 17 bp, Homo sapiens
gctactcagcagccctc

SEQ ID NO: 3936432 - DNA, 24 bp, Homo sapiens
gctactcagcagccctcctcaccc

SEQ ID NO: 3936433 - DNA, 14 bp, Homo sapiens
gctactcaggaggc

SEQ ID NO: 3936434 - DNA, 14 bp, Homo sapiens
gctactcctgtgct

SEQ ID NO: 3936435 - DNA, 15 bp, Homo sapiens
gctactctgtccagg

SEQ ID NO: 3936436 - DNA, 16 bp, Homo sapiens
gctactctgtccaggc

SEQ ID NO: 3936437 - DNA, 19 bp, Homo sapiens
gctactctgtccaggccac

SEQ ID NO: 3936438 - DNA, 13 bp, Homo sapiens
gctactctgtgcc

SEQ ID NO: 3936439 - DNA, 23 bp, Homo sapiens
gctactctgtgccagagcctggg

SEQ ID NO: 3936440 - DNA, 13 bp, Homo sapiens
gctacttaagaga

SEQ ID NO: 3936441 - DNA, 16 bp, Homo sapiens
gctacttaagagaaat

SEQ ID NO: 3936442 - DNA, 18 bp, Homo sapiens
gctacttcggggctggga

SEQ ID NO: 3936443 - DNA, 16 bp, Homo sapiens
gctactttgccttttg

SEQ ID NO: 3936444 - DNA, 20 bp, Homo sapiens
gctagaacctagaagggcta

SEQ ID NO: 3936445 - DNA, 15 bp, Homo sapiens
gctagaacctggaga

SEQ ID NO: 3936446 - DNA, 13 bp, Homo sapiens
gctagaaggccac

SEQ ID NO: 3936447 - DNA, 20 bp, Homo sapiens
gctagaagttgggttgttct

SEQ ID NO: 3936448 - DNA, 19 bp, Homo sapiens
gctagaatctggagagcta

SEQ ID NO: 3936449 - DNA, 21 bp, Homo sapiens
gctagagatatggcagcgaaa

SEQ ID NO: 3936450 - DNA, 19 bp, Homo sapiens
gctagccaactcctccttg

SEQ ID NO: 3936451 - DNA, 12 bp, Homo sapiens
gctagccagagg

SEQ ID NO: 3936452 - DNA, 13 bp, Homo sapiens
gctagccagaggg

SEQ ID NO: 3936453 - DNA, 22 bp, Homo sapiens
gctagcgctgccgcaccccaga

SEQ ID NO: 3936454 - DNA, 18 bp, Homo sapiens
gctagctgtagaaatgta

SEQ ID NO: 3936455 - DNA, 19 bp, Homo sapiens
gctaggactgaggagtggg

SEQ ID NO: 3936456 - DNA, 15 bp, Homo sapiens
gctaggagcaaagcc

SEQ ID NO: 3936457 - DNA, 18 bp, Homo sapiens
gctaggagcaaagcctgt

SEQ ID NO: 3936458 - DNA, 14 bp, Homo sapiens
gccagcccagccca

SEQ ID NO: 3936459 - DNA, 10 bp, Homo sapiens
gccagcccta

SEQ ID NO: 3936460 - DNA, 10 bp, Homo sapiens
gccagccctc

SEQ ID NO: 3936461 - DNA, 14 bp, Homo sapiens
gccagccctccctg

SEQ ID NO: 3936462 - DNA, 17 bp, Homo sapiens
gccagccctccctgtcc

SEQ ID NO: 3936463 - DNA, 13 bp, Homo sapiens
gccagccctgcct

SEQ ID NO: 3936464 - DNA, 16 bp, Homo sapiens
gccagccgccctgggc

SEQ ID NO: 3936465 - DNA, 17 bp, Homo sapiens
gccagccgccctgggct

SEQ ID NO: 3936466 - DNA, 15 bp, Homo sapiens
gccagccggtgcctg

SEQ ID NO: 3936467 - DNA, 18 bp, Homo sapiens
gccagccgtgatgctcag

SEQ ID NO: 3936468 - DNA, 14 bp, Homo sapiens
gccagcctcagctc

SEQ ID NO: 3936469 - DNA, 15 bp, Homo sapiens
gccagcctcagctca

SEQ ID NO: 3936470 - DNA, 12 bp, Homo sapiens
gccagcctcagt

SEQ ID NO: 3936471 - DNA, 13 bp, Homo sapiens
gccagcctcagtg

SEQ ID NO: 3936472 - DNA, 16 bp, Homo sapiens
gccagcctcagtgcca

SEQ ID NO: 3936473 - DNA, 17 bp, Homo sapiens
gccagcctcagtgccac

SEQ ID NO: 3936474 - DNA, 23 bp, Homo sapiens
gccagcctcagtgccacttgaca

SEQ ID NO: 3936475 - DNA, 19 bp, Homo sapiens
gccagcctgctccttccca

SEQ ID NO: 3936476 - DNA, 15 bp, Homo sapiens
gccagcctggcctcc

SEQ ID NO: 3936477 - DNA, 15 bp, Homo sapiens
gccagcctgggactc

SEQ ID NO: 3936478 - DNA, 21 bp, Homo sapiens
gccagctctagttttcagcct

SEQ ID NO: 3936479 - DNA, 13 bp, Homo sapiens
gccagctgccttc

SEQ ID NO: 3936480 - DNA, 14 bp, Homo sapiens
gccagctggtgctg

SEQ ID NO: 3936481 - DNA, 23 bp, Homo sapiens
gccagcttcctgtgggccaggag

SEQ ID NO: 3936482 - DNA, 15 bp, Homo sapiens
gccaggaatctgcca

SEQ ID NO: 3936483 - DNA, 16 bp, Homo sapiens
gccaggaatctgccat

SEQ ID NO: 3936484 - DNA, 10 bp, Homo sapiens
gccaggacac

SEQ ID NO: 3936485 - DNA, 14 bp, Homo sapiens
gccaggagagagat

SEQ ID NO: 3936486 - DNA, 16 bp, Homo sapiens
gccaggaggctgcggc

SEQ ID NO: 3936487 - DNA, 15 bp, Homo sapiens
gccaggaggtcctcc

SEQ ID NO: 3936488 - DNA, 17 bp, Homo sapiens
gccaggaggtcctcctc

SEQ ID NO: 3936489 - DNA, 19 bp, Homo sapiens
gccaggaggttggtgactg

SEQ ID NO: 3936490 - DNA, 23 bp, Homo sapiens
gccaggaggttggtgactgaaac

SEQ ID NO: 3936491 - DNA, 15 bp, Homo sapiens
gccaggagtctgtgc

SEQ ID NO: 3936492 - DNA, 20 bp, Homo sapiens
gccaggcaccccctggagag

SEQ ID NO: 3936493 - DNA, 13 bp, Homo sapiens
gccaggcacctgg

SEQ ID NO: 3936494 - DNA, 14 bp, Homo sapiens
gccaggcacctggc

SEQ ID NO: 3936495 - DNA, 19 bp, Homo sapiens
gccaggcacctggcctgct

SEQ ID NO: 3936496 - DNA, 20 bp, Homo sapiens
gccaggcaggggtgggagag

SEQ ID NO: 3936497 - DNA, 16 bp, Homo sapiens
gccaggccaccaggat

SEQ ID NO: 3936498 - DNA, 19 bp, Homo sapiens
gccaggccaccaggatggc

SEQ ID NO: 3936499 - DNA, 18 bp, Homo sapiens
gccaggcccatctcaggt

SEQ ID NO: 3936500 - DNA, 23 bp, Homo sapiens
gccaggcgggagatggacccctc

SEQ ID NO: 3936501 - DNA, 18 bp, Homo sapiens
gccaggcgttggtgccac

SEQ ID NO: 3936502 - DNA, 21 bp, Homo sapiens
gccaggcgttggtgccacttc

SEQ ID NO: 3936503 - DNA, 16 bp, Homo sapiens
gccaggctctgcctgg

SEQ ID NO: 3936504 - DNA, 16 bp, Homo sapiens
gccagggcaggctacc

SEQ ID NO: 3936505 - DNA, 13 bp, Homo sapiens
gccagggccaggg

SEQ ID NO: 3936506 - DNA, 19 bp, Homo sapiens
gccaggggctgctcatcac

SEQ ID NO: 3936507 - DNA, 20 bp, Homo sapiens
gccaggggctgctcatcacc

SEQ ID NO: 3936508 - DNA, 18 bp, Homo sapiens
gccaggggtctccctgga

SEQ ID NO: 3936509 - DNA, 21 bp, Homo sapiens
gccaggggtctccctggagtg

SEQ ID NO: 3936510 - DNA, 15 bp, Homo sapiens
gccagggtgagagct

SEQ ID NO: 3936511 - DNA, 12 bp, Homo sapiens
gccagtatttct

SEQ ID NO: 3936512 - DNA, 14 bp, Homo sapiens
gccagtcctagagc

SEQ ID NO: 3936513 - DNA, 23 bp, Homo sapiens
gccagtcctagagctcctgtccc

SEQ ID NO: 3936514 - DNA, 24 bp, Homo sapiens
gccagtcctagagctcctgtccct

SEQ ID NO: 3936515 - DNA, 15 bp, Homo sapiens
gccagtctgggctgc

SEQ ID NO: 3936516 - DNA, 18 bp, Homo sapiens
gccagtgactttttctga

SEQ ID NO: 3936517 - DNA, 10 bp, Homo sapiens
gccagtgcct

SEQ ID NO: 3936518 - DNA, 15 bp, Homo sapiens
gccagtgccttacct

SEQ ID NO: 3936519 - DNA, 18 bp, Homo sapiens
gccagtgtaaggcatagg

SEQ ID NO: 3936520 - DNA, 17 bp, Homo sapiens
gccagtttcaccatttc

SEQ ID NO: 3936521 - DNA, 16 bp, Homo sapiens
gccatagagtttaaca

SEQ ID NO: 3936522 - DNA, 16 bp, Homo sapiens
gccatattcacacctc

SEQ ID NO: 3936523 - DNA, 22 bp, Homo sapiens
gccatcagggtgggccactctc

SEQ ID NO: 3936524 - DNA, 24 bp, Homo sapiens
gccatcagggtgggccactctccc

SEQ ID NO: 3936525 - DNA, 12 bp, Homo sapiens
gccatccctggg

SEQ ID NO: 3936526 - DNA, 14 bp, Homo sapiens
gccatccctgggcc

SEQ ID NO: 3936527 - DNA, 15 bp, Homo sapiens
gccatccgggacgct

SEQ ID NO: 3936528 - DNA, 16 bp, Homo sapiens
gccatccgggacgctt

SEQ ID NO: 3936529 - DNA, 19 bp, Homo sapiens
gccatccgggacgcttcca

SEQ ID NO: 3936530 - DNA, 17 bp, Homo sapiens
gccatgccactgccagg

SEQ ID NO: 3936531 - DNA, 18 bp, Homo sapiens
gccatgccactgccaggc

SEQ ID NO: 3936532 - DNA, 13 bp, Homo sapiens
gccatgcccagag

SEQ ID NO: 3936533 - DNA, 14 bp, Homo sapiens
gccatgcccagaga

SEQ ID NO: 3936534 - DNA, 17 bp, Homo sapiens
gccatgcctcatgccac

SEQ ID NO: 3936535 - DNA, 15 bp, Homo sapiens
gccatgctgaaggga

SEQ ID NO: 3936536 - DNA, 18 bp, Homo sapiens
gccatgctttccttttct

SEQ ID NO: 3936537 - DNA, 17 bp, Homo sapiens
gccatggaataaaccat

SEQ ID NO: 3936538 - DNA, 13 bp, Homo sapiens
gccatggagttgt

SEQ ID NO: 3936539 - DNA, 17 bp, Homo sapiens
gccatggctcaggcaag

SEQ ID NO: 3936540 - DNA, 13 bp, Homo sapiens
gccatgggcctgg

SEQ ID NO: 3936541 - DNA, 16 bp, Homo sapiens
gccatgggcctgggcc

SEQ ID NO: 3936542 - DNA, 18 bp, Homo sapiens
gccatgggcctgggcctg

SEQ ID NO: 3936543 - DNA, 23 bp, Homo sapiens
gccatggtctctcgggcccccca

SEQ ID NO: 3936544 - DNA, 18 bp, Homo sapiens
gccatggtgacacacagc

SEQ ID NO: 3936545 - DNA, 16 bp, Homo sapiens
gccatgtggagtggac

SEQ ID NO: 3936546 - DNA, 15 bp, Homo sapiens
gccatttgctttttc

SEQ ID NO: 3936547 - DNA, 16 bp, Homo sapiens
gccattttcttgcctg

SEQ ID NO: 3936548 - DNA, 20 bp, Homo sapiens
gccattttcttgcctgaggc

SEQ ID NO: 3936549 - DNA, 13 bp, Homo sapiens
gcccaacctcctg

SEQ ID NO: 3936550 - DNA, 14 bp, Homo sapiens
gcccaacctcctga

SEQ ID NO: 3936551 - DNA, 21 bp, Homo sapiens
gcccaagaatagatgctgact

SEQ ID NO: 3936552 - DNA, 22 bp, Homo sapiens
gcccaagaatagatgctgactg

SEQ ID NO: 3936553 - DNA, 20 bp, Homo sapiens
gcccaagaggactgagactg

SEQ ID NO: 3936554 - DNA, 18 bp, Homo sapiens
gcccaagaggtctgagcc

SEQ ID NO: 3936555 - DNA, 17 bp, Homo sapiens
gcccaagtgccatccca

SEQ ID NO: 3936556 - DNA, 20 bp, Homo sapiens
gcccaatgctttgggaggcc

SEQ ID NO: 3936557 - DNA, 21 bp, Homo sapiens
gcccaatgctttgggaggcca

SEQ ID NO: 3936558 - DNA, 15 bp, Homo sapiens
gcccacaaaggggag

SEQ ID NO: 3936559 - DNA, 23 bp, Homo sapiens
gcccacaagccttactcacctct

SEQ ID NO: 3936560 - DNA, 18 bp, Homo sapiens
gcccacagacagatccca

SEQ ID NO: 3936561 - DNA, 18 bp, Homo sapiens
gcccacagagatgcatgc

SEQ ID NO: 3936562 - DNA, 13 bp, Homo sapiens
gcccacagctccc

SEQ ID NO: 3936563 - DNA, 14 bp, Homo sapiens
gcccacagctccca

SEQ ID NO: 3936564 - DNA, 19 bp, Homo sapiens
gcccacagctcccacccca

SEQ ID NO: 3936565 - DNA, 20 bp, Homo sapiens
gcccacatagtgatggttcc

SEQ ID NO: 3936566 - DNA, 21 bp, Homo sapiens
gcccacgcccgactagcaggc

SEQ ID NO: 3936567 - DNA, 23 bp, Homo sapiens
gcccacttagccgtccatggcac

SEQ ID NO: 3936568 - DNA, 17 bp, Homo sapiens
gcccacttcagcccagc

SEQ ID NO: 3936569 - DNA, 18 bp, Homo sapiens
gcccagaattcccagctg

SEQ ID NO: 3936570 - DNA, 21 bp, Homo sapiens
gcccagaattcccagctgtct

SEQ ID NO: 3936571 - DNA, 17 bp, Homo sapiens
gcccagagaccccttcc

SEQ ID NO: 3936572 - DNA, 20 bp, Homo sapiens
gcccagagatgcctccaccg

SEQ ID NO: 3936573 - DNA, 22 bp, Homo sapiens
gcccagagatgcctccaccgct

SEQ ID NO: 3936574 - DNA, 16 bp, Homo sapiens
gcccagagctggaaca

SEQ ID NO: 3936575 - DNA, 14 bp, Homo sapiens
gcccagcctaccct

SEQ ID NO: 3936576 - DNA, 20 bp, Homo sapiens
gcccagcctgtcctggtaca

SEQ ID NO: 3936577 - DNA, 15 bp, Homo sapiens
gcccagctgtagcca

SEQ ID NO: 3936578 - DNA, 18 bp, Homo sapiens
gcccagctgtagccatgg

SEQ ID NO: 3936579 - DNA, 20 bp, Homo sapiens
gcccagctgtagccatggct

SEQ ID NO: 3936580 - DNA, 22 bp, Homo sapiens
gcccagctgtagccatggctca

SEQ ID NO: 3936581 - DNA, 14 bp, Homo sapiens
gcccagcttcctgg

SEQ ID NO: 3936582 - DNA, 17 bp, Homo sapiens
gcccagcttcctggtgt

SEQ ID NO: 3936583 - DNA, 15 bp, Homo sapiens
gcccaggagagccag

SEQ ID NO: 3936584 - DNA, 18 bp, Homo sapiens
gcccaggagagccagccc

SEQ ID NO: 3936585 - DNA, 20 bp, Homo sapiens
gcccaggagagccagccctc

SEQ ID NO: 3936586 - DNA, 21 bp, Homo sapiens
gcccaggagagccagccctcc

SEQ ID NO: 3936587 - DNA, 21 bp, Homo sapiens
gcccaggagctgagtcacctc

SEQ ID NO: 3936588 - DNA, 14 bp, Homo sapiens
gcccaggatgctgc

SEQ ID NO: 3936589 - DNA, 23 bp, Homo sapiens
gcccaggccgttccccttggctt

SEQ ID NO: 3936590 - DNA, 13 bp, Homo sapiens
gcccaggcctcca

SEQ ID NO: 3936591 - DNA, 13 bp, Homo sapiens
gcccagggaggcc

SEQ ID NO: 3936592 - DNA, 16 bp, Homo sapiens
gcccaggtcctctgat

SEQ ID NO: 3936593 - DNA, 16 bp, Homo sapiens
gcccagtcattgggtt

SEQ ID NO: 3936594 - DNA, 17 bp, Homo sapiens
gcccagtgacctgaccg

SEQ ID NO: 3936595 - DNA, 22 bp, Homo sapiens
gcccagtggaacagtcaccctt

SEQ ID NO: 3936596 - DNA, 23 bp, Homo sapiens
gcccataatagttagccctcagt

SEQ ID NO: 3936597 - DNA, 19 bp, Homo sapiens
gcagcactttaaccctctc

SEQ ID NO: 3936598 - DNA, 16 bp, Homo sapiens
gcagcagccagccctg

SEQ ID NO: 3936599 - DNA, 18 bp, Homo sapiens
gcagcagccagccctgcc

SEQ ID NO: 3936600 - DNA, 21 bp, Homo sapiens
gcagcagccagccctgcctgg

SEQ ID NO: 3936601 - DNA, 22 bp, Homo sapiens
gcagcagccagccctgcctgga

SEQ ID NO: 3936602 - DNA, 23 bp, Homo sapiens
gcagcagccagccctgcctggag

SEQ ID NO: 3936603 - DNA, 14 bp, Homo sapiens
gcagcagcccagct

SEQ ID NO: 3936604 - DNA, 20 bp, Homo sapiens
gcagcagctaggactgagga

SEQ ID NO: 3936605 - DNA, 18 bp, Homo sapiens
gcagcagctgggacccct

SEQ ID NO: 3936606 - DNA, 19 bp, Homo sapiens
gcagccacacttctcagga

SEQ ID NO: 3936607 - DNA, 15 bp, Homo sapiens
gcagccaccctgagg

SEQ ID NO: 3936608 - DNA, 20 bp, Homo sapiens
gcagccaccctgaggagtct

SEQ ID NO: 3936609 - DNA, 15 bp, Homo sapiens
gcagccagccagtct

SEQ ID NO: 3936610 - DNA, 11 bp, Homo sapiens
gcagccagccc

SEQ ID NO: 3936611 - DNA, 16 bp, Homo sapiens
gcagccagcccagccc

SEQ ID NO: 3936612 - DNA, 21 bp, Homo sapiens
gcagccagcccagcccagctg

SEQ ID NO: 3936613 - DNA, 23 bp, Homo sapiens
gcagccagcccagcccagctggt

SEQ ID NO: 3936614 - DNA, 22 bp, Homo sapiens
gctgagctctgagaggccctgg

SEQ ID NO: 3936615 - DNA, 23 bp, Homo sapiens
gctgagctctgagaggccctgga

SEQ ID NO: 3936616 - DNA, 12 bp, Homo sapiens
gctgagctggca

SEQ ID NO: 3936617 - DNA, 13 bp, Homo sapiens
gctgaggactccc

SEQ ID NO: 3936618 - DNA, 22 bp, Homo sapiens
gctgaggatcctcacaggagca

SEQ ID NO: 3936619 - DNA, 16 bp, Homo sapiens
gctgaggatgacagag

SEQ ID NO: 3936620 - DNA, 16 bp, Homo sapiens
gctgaggcagaagaat

SEQ ID NO: 3936621 - DNA, 12 bp, Homo sapiens
gctgaggcagga

SEQ ID NO: 3936622 - DNA, 20 bp, Homo sapiens
gctgagggcagttcgcagcc

SEQ ID NO: 3936623 - DNA, 21 bp, Homo sapiens
gctgagggcagttcgcagcca

SEQ ID NO: 3936624 - DNA, 23 bp, Homo sapiens
gctgaggggggccgtgcccaggg

SEQ ID NO: 3936625 - DNA, 15 bp, Homo sapiens
gctgaggtgcccagg

SEQ ID NO: 3936626 - DNA, 16 bp, Homo sapiens
gctgaggtgcccagga

SEQ ID NO: 3936627 - DNA, 19 bp, Homo sapiens
gctgagtcacctcctccac

SEQ ID NO: 3936628 - DNA, 21 bp, Homo sapiens
gctgagtcatgatctccctgc

SEQ ID NO: 3936629 - DNA, 22 bp, Homo sapiens
gctgagtcatgatctccctgcc

SEQ ID NO: 3936630 - DNA, 23 bp, Homo sapiens
gctgagtcatgatctccctgccg

SEQ ID NO: 3936631 - DNA, 19 bp, Homo sapiens
gctgagtggaatgcaggga

SEQ ID NO: 3936632 - DNA, 22 bp, Homo sapiens
gctgagttacttgtctgaggcc

SEQ ID NO: 3936633 - DNA, 17 bp, Homo sapiens
gctgatgaaactcctga

SEQ ID NO: 3936634 - DNA, 17 bp, Homo sapiens
gctgatggagaaggaag

SEQ ID NO: 3936635 - DNA, 16 bp, Homo sapiens
gctgatttccaggccc

SEQ ID NO: 3936636 - DNA, 22 bp, Homo sapiens
gctgatttccaggcccctgagg

SEQ ID NO: 3936637 - DNA, 17 bp, Homo sapiens
gctgcaagggccagagt

SEQ ID NO: 3936638 - DNA, 14 bp, Homo sapiens
gctgcacattcctg

SEQ ID NO: 3936639 - DNA, 17 bp, Homo sapiens
gctgcacattcctggcc

SEQ ID NO: 3936640 - DNA, 19 bp, Homo sapiens
gctgcacattcctggcccc

SEQ ID NO: 3936641 - DNA, 12 bp, Homo sapiens
gctgcaccagag

SEQ ID NO: 3936642 - DNA, 22 bp, Homo sapiens
gctgcaccagagtgaaagggct

SEQ ID NO: 3936643 - DNA, 19 bp, Homo sapiens
gctgcaccatcacacatgc

SEQ ID NO: 3936644 - DNA, 19 bp, Homo sapiens
gctgcagaaggccaagaat

SEQ ID NO: 3936645 - DNA, 18 bp, Homo sapiens
gctgcagcatgaaggcag

SEQ ID NO: 3936646 - DNA, 15 bp, Homo sapiens
gctgcagctgggccc

SEQ ID NO: 3936647 - DNA, 21 bp, Homo sapiens
gctgcagctgggccccatgct

SEQ ID NO: 3936648 - DNA, 17 bp, Homo sapiens
gctgcatatgagtcttt

SEQ ID NO: 3936649 - DNA, 15 bp, Homo sapiens
gctgcatctactcag

SEQ ID NO: 3936650 - DNA, 18 bp, Homo sapiens
gctgcatgcctggtcttt

SEQ ID NO: 3936651 - DNA, 20 bp, Homo sapiens
gctgcatgcctggtctttcc

SEQ ID NO: 3936652 - DNA, 21 bp, Homo sapiens
gctgccaagcactcgagacca

SEQ ID NO: 3936653 - DNA, 16 bp, Homo sapiens
gctgccacacctgagc

SEQ ID NO: 3936654 - DNA, 23 bp, Homo sapiens
gctgccacacttcaggctcttct

SEQ ID NO: 3936655 - DNA, 16 bp, Homo sapiens
gctgccaccacgtctg

SEQ ID NO: 3936656 - DNA, 22 bp, Homo sapiens
gctgccaccacgtctgccaggc

SEQ ID NO: 3936657 - DNA, 23 bp, Homo sapiens
gctgccaccacgtctgccaggcc

SEQ ID NO: 3936658 - DNA, 20 bp, Homo sapiens
gctgccactaacctgtagaa

SEQ ID NO: 3936659 - DNA, 11 bp, Homo sapiens
gctgccaggac

SEQ ID NO: 3936660 - DNA, 12 bp, Homo sapiens
gctgccaggaca

SEQ ID NO: 3936661 - DNA, 14 bp, Homo sapiens
gctgccaggacacc

SEQ ID NO: 3936662 - DNA, 22 bp, Homo sapiens
gctgccaggacacctgccccag

SEQ ID NO: 3936663 - DNA, 20 bp, Homo sapiens
gctgccaggcgttggtgcca

SEQ ID NO: 3936664 - DNA, 22 bp, Homo sapiens
gctgccaggcgttggtgccact

SEQ ID NO: 3936665 - DNA, 19 bp, Homo sapiens
gctgccatgccactgccag

SEQ ID NO: 3936666 - DNA, 22 bp, Homo sapiens
gctgccatgccactgccaggca

SEQ ID NO: 3936667 - DNA, 13 bp, Homo sapiens
gctgcccctgtag

SEQ ID NO: 3936668 - DNA, 18 bp, Homo sapiens
gctgcccttcgctgccag

SEQ ID NO: 3936669 - DNA, 20 bp, Homo sapiens
gctgcccttcgctgccagga

SEQ ID NO: 3936670 - DNA, 17 bp, Homo sapiens
gctgccgaccagagccc

SEQ ID NO: 3936671 - DNA, 15 bp, Homo sapiens
gctgccgcaccccag

SEQ ID NO: 3936672 - DNA, 22 bp, Homo sapiens
gctgccgcaccccagagtgtgg

SEQ ID NO: 3936673 - DNA, 13 bp, Homo sapiens
gctgccgcctccc

SEQ ID NO: 3936674 - DNA, 15 bp, Homo sapiens
gctgccgcctcccag

SEQ ID NO: 3936675 - DNA, 18 bp, Homo sapiens
gctgccgcctcccagcct

SEQ ID NO: 3936676 - DNA, 19 bp, Homo sapiens
gctgccgcctcccagcctg

SEQ ID NO: 3936677 - DNA, 20 bp, Homo sapiens
gctgccgcctcccagcctgg

SEQ ID NO: 3936678 - DNA, 16 bp, Homo sapiens
gctgccgctgcaccac

SEQ ID NO: 3936679 - DNA, 16 bp, Homo sapiens
gctgcctaagtggctg

SEQ ID NO: 3936680 - DNA, 20 bp, Homo sapiens
gctgcctgccgcccaaagag

SEQ ID NO: 3936681 - DNA, 15 bp, Homo sapiens
gctgcctgtagttag

SEQ ID NO: 3936682 - DNA, 20 bp, Homo sapiens
gctgcctgtagttaggaaat

SEQ ID NO: 3936683 - DNA, 19 bp, Homo sapiens
gctgccttttgctgctgct

SEQ ID NO: 3936684 - DNA, 23 bp, Homo sapiens
gctgctactacccgagcccagct

SEQ ID NO: 3936685 - DNA, 14 bp, Homo sapiens
gctgctcatcaccc

SEQ ID NO: 3936686 - DNA, 11 bp, Homo sapiens
gctgctcctcc

SEQ ID NO: 3936687 - DNA, 14 bp, Homo sapiens
gctgctcctccagg

SEQ ID NO: 3936688 - DNA, 19 bp, Homo sapiens
gctgctcggggtgcacagg

SEQ ID NO: 3936689 - DNA, 20 bp, Homo sapiens
gctgctcggggtgcacagga

SEQ ID NO: 3936690 - DNA, 15 bp, Homo sapiens
gctgctctagctggc

SEQ ID NO: 3936691 - DNA, 12 bp, Homo sapiens
gctgctctgccc

SEQ ID NO: 3936692 - DNA, 20 bp, Homo sapiens
gctgctctgccccttgggca

SEQ ID NO: 3936693 - DNA, 17 bp, Homo sapiens
gctgctgaagaggcaag

SEQ ID NO: 3936694 - DNA, 18 bp, Homo sapiens
gctgctgaagttctgagc

SEQ ID NO: 3936695 - DNA, 20 bp, Homo sapiens
gctgctgaagttctgagccg

SEQ ID NO: 3936696 - DNA, 17 bp, Homo sapiens
gctgctgagaacctggc

SEQ ID NO: 3936697 - DNA, 18 bp, Homo sapiens
gctgctgagaacctggcc

SEQ ID NO: 3936698 - DNA, 19 bp, Homo sapiens
gctgctgagaacctggcct

SEQ ID NO: 3936699 - DNA, 21 bp, Homo sapiens
gctctctgcagccagcccagc

SEQ ID NO: 3936700 - DNA, 22 bp, Homo sapiens
gctctctgcagccagcccagcc

SEQ ID NO: 3936701 - DNA, 19 bp, Homo sapiens
gctctctggccttttccta

SEQ ID NO: 3936702 - DNA, 16 bp, Homo sapiens
gctctcttcaggaggc

SEQ ID NO: 3936703 - DNA, 22 bp, Homo sapiens
gctctcttccagaagatgccct

SEQ ID NO: 3936704 - DNA, 17 bp, Homo sapiens
gctctgaaagccagctg

SEQ ID NO: 3936705 - DNA, 15 bp, Homo sapiens
gctctgaacaaacac

SEQ ID NO: 3936706 - DNA, 15 bp, Homo sapiens
gctctgaatctgata

SEQ ID NO: 3936707 - DNA, 23 bp, Homo sapiens
gctctgaatctgataggaaaaga

SEQ ID NO: 3936708 - DNA, 15 bp, Homo sapiens
gctctgagaggccct

SEQ ID NO: 3936709 - DNA, 18 bp, Homo sapiens
gctctgagaggccctgga

SEQ ID NO: 3936710 - DNA, 20 bp, Homo sapiens
gctctgagcaaatgtggctc

SEQ ID NO: 3936711 - DNA, 14 bp, Homo sapiens
gctctgcaggcacc

SEQ ID NO: 3936712 - DNA, 15 bp, Homo sapiens
gctctgcaggcacct

SEQ ID NO: 3936713 - DNA, 14 bp, Homo sapiens
gctctgcatgtgtg

SEQ ID NO: 3936714 - DNA, 15 bp, Homo sapiens
gctctgccccaagcc

SEQ ID NO: 3936715 - DNA, 16 bp, Homo sapiens
gctctgccccaagccc

SEQ ID NO: 3936716 - DNA, 15 bp, Homo sapiens
gctctgccccagagg

SEQ ID NO: 3936717 - DNA, 23 bp, Homo sapiens
gctctgcctggaggatccctcca

SEQ ID NO: 3936718 - DNA, 22 bp, Homo sapiens
gctctgctttttccagattctt

SEQ ID NO: 3936719 - DNA, 15 bp, Homo sapiens
gctctggaagcctgg

SEQ ID NO: 3936720 - DNA, 22 bp, Homo sapiens
gctctggaccaaccctgtttcc

SEQ ID NO: 3936721 - DNA, 17 bp, Homo sapiens
gctctggaccagcctgt

SEQ ID NO: 3936722 - DNA, 15 bp, Homo sapiens
gctctggagccagag

SEQ ID NO: 3936723 - DNA, 14 bp, Homo sapiens
gctctggccaccct

SEQ ID NO: 3936724 - DNA, 17 bp, Homo sapiens
gctctggccaccctggc

SEQ ID NO: 3936725 - DNA, 18 bp, Homo sapiens
gctctggccaccctggcc

SEQ ID NO: 3936726 - DNA, 20 bp, Homo sapiens
gctctggcggcttcctgtcc

SEQ ID NO: 3936727 - DNA, 14 bp, Homo sapiens
gctctgggaagggg

SEQ ID NO: 3936728 - DNA, 15 bp, Homo sapiens
gctctgggaaggggt

SEQ ID NO: 3936729 - DNA, 19 bp, Homo sapiens
gctctgggaaggggtgccc

SEQ ID NO: 3936730 - DNA, 22 bp, Homo sapiens
gctctgggaaggggtgccctct

SEQ ID NO: 3936731 - DNA, 23 bp, Homo sapiens
gctctgggaaggggtgccctctg

SEQ ID NO: 3936732 - DNA, 15 bp, Homo sapiens
gctctgtggcctgtg

SEQ ID NO: 3936733 - DNA, 20 bp, Homo sapiens
gctctgtggcctgtgtccag

SEQ ID NO: 3936734 - DNA, 22 bp, Homo sapiens
gctcttagtgcccgcctaggag

SEQ ID NO: 3936735 - DNA, 24 bp, Homo sapiens
gctcttcaagctgtcccctctgtc

SEQ ID NO: 3936736 - DNA, 17 bp, Homo sapiens
gctcttcactcagccac

SEQ ID NO: 3936737 - DNA, 21 bp, Homo sapiens
gctcttcactcagccacaccc

SEQ ID NO: 3936738 - DNA, 18 bp, Homo sapiens
gctcttcggtttctgagc

SEQ ID NO: 3936739 - DNA, 19 bp, Homo sapiens
gctcttcggtttctgagca

SEQ ID NO: 3936740 - DNA, 20 bp, Homo sapiens
gctcttctaacctcagccaa

SEQ ID NO: 3936741 - DNA, 18 bp, Homo sapiens
gctcttctatttaaaaaa

SEQ ID NO: 3936742 - DNA, 19 bp, Homo sapiens
gctcttctatttaaaaaat

SEQ ID NO: 3936743 - DNA, 23 bp, Homo sapiens
gctcttctcctttcacaaccttc

SEQ ID NO: 3936744 - DNA, 23 bp, Homo sapiens
gctcttgcatcctcctcccaact

SEQ ID NO: 3936745 - DNA, 13 bp, Homo sapiens
gctcttgcctgta

SEQ ID NO: 3936746 - DNA, 16 bp, Homo sapiens
gctcttgcctgtaatc

SEQ ID NO: 3936747 - DNA, 17 bp, Homo sapiens
gctcttggcattttcct

SEQ ID NO: 3936748 - DNA, 13 bp, Homo sapiens
gctctttcagggg

SEQ ID NO: 3936749 - DNA, 21 bp, Homo sapiens
gctctttggggtcagccaggg

SEQ ID NO: 3936750 - DNA, 19 bp, Homo sapiens
gctgaaaatcaaagtaaaa

SEQ ID NO: 3936751 - DNA, 16 bp, Homo sapiens
gctgaacaatgaatgc

SEQ ID NO: 3936752 - DNA, 21 bp, Homo sapiens
gctgaagcctatttatttgaa

SEQ ID NO: 3936753 - DNA, 20 bp, Homo sapiens
gctgaagggaccttgaaggg

SEQ ID NO: 3936754 - DNA, 14 bp, Homo sapiens
gctgaagttctgag

SEQ ID NO: 3936755 - DNA, 22 bp, Homo sapiens
gctgaattattttgttgtgatt

SEQ ID NO: 3936756 - DNA, 22 bp, Homo sapiens
gctgacacctaccatgctgctt

SEQ ID NO: 3936757 - DNA, 15 bp, Homo sapiens
gctgacatggctttg

SEQ ID NO: 3936758 - DNA, 14 bp, Homo sapiens
gctgaccaagagag

SEQ ID NO: 3936759 - DNA, 16 bp, Homo sapiens
gctgaccaagagagaa

SEQ ID NO: 3936760 - DNA, 19 bp, Homo sapiens
gctgacccagtccctgggg

SEQ ID NO: 3936761 - DNA, 23 bp, Homo sapiens
gctgacctgcctctcacacacat

SEQ ID NO: 3936762 - DNA, 20 bp, Homo sapiens
gctgactgatgttgagggaa

SEQ ID NO: 3936763 - DNA, 21 bp, Homo sapiens
gctgactgtactcctcccagg

SEQ ID NO: 3936764 - DNA, 13 bp, Homo sapiens
gctgagaacctgg

SEQ ID NO: 3936765 - DNA, 15 bp, Homo sapiens
gctgagaacctggcc

SEQ ID NO: 3936766 - DNA, 16 bp, Homo sapiens
gctgagaacctggcct

SEQ ID NO: 3936767 - DNA, 17 bp, Homo sapiens
gctgagaacctggcctt

SEQ ID NO: 3936768 - DNA, 12 bp, Homo sapiens
gctgagaagaag

SEQ ID NO: 3936769 - DNA, 17 bp, Homo sapiens
gctgagagacccaagga

SEQ ID NO: 3936770 - DNA, 22 bp, Homo sapiens
gctgagagacccaaggaggaaa

SEQ ID NO: 3936771 - DNA, 17 bp, Homo sapiens
gctgagagccctgctgt

SEQ ID NO: 3936772 - DNA, 12 bp, Homo sapiens
gctgagaggaag

SEQ ID NO: 3936773 - DNA, 17 bp, Homo sapiens
gctgagaggaagatgaa

SEQ ID NO: 3936774 - DNA, 18 bp, Homo sapiens
gctgagaggaagatgaag

SEQ ID NO: 3936775 - DNA, 23 bp, Homo sapiens
gctgagaggaagatgaagagaag

SEQ ID NO: 3936776 - DNA, 22 bp, Homo sapiens
gctgagagtctgaaagacagaa

SEQ ID NO: 3936777 - DNA, 16 bp, Homo sapiens
gctgagcaccctctcc

SEQ ID NO: 3936778 - DNA, 21 bp, Homo sapiens
gctgagcaggcccgacagaga

SEQ ID NO: 3936779 - DNA, 23 bp, Homo sapiens
gctgagcaggcccgacagagaga

SEQ ID NO: 3936780 - DNA, 15 bp, Homo sapiens
gctgagccactcgca

SEQ ID NO: 3936781 - DNA, 20 bp, Homo sapiens
gctgagctcacaaggcagca

SEQ ID NO: 3936782 - DNA, 23 bp, Homo sapiens
gctgagctcacaaggcagcaagg

SEQ ID NO: 3936783 - DNA, 21 bp, Homo sapiens
gctgagctctgagaggccctg

SEQ ID NO: 3936784 - DNA, 21 bp, Homo sapiens
gctgctgagaacctggccttc

SEQ ID NO: 3936785 - DNA, 23 bp, Homo sapiens
gctgctggggcatgtgtgcctgt

SEQ ID NO: 3936786 - DNA, 16 bp, Homo sapiens
gctgctgtaactgctg

SEQ ID NO: 3936787 - DNA, 18 bp, Homo sapiens
gctgctgtaactgctgag

SEQ ID NO: 3936788 - DNA, 22 bp, Homo sapiens
gctgctgtaactgctgagccac

SEQ ID NO: 3936789 - DNA, 12 bp, Homo sapiens
gctgctgtcctt

SEQ ID NO: 3936790 - DNA, 22 bp, Homo sapiens
gctgcttgactatcacatacaa

SEQ ID NO: 3936791 - DNA, 17 bp, Homo sapiens
gctgcttgtcctgctct

SEQ ID NO: 3936792 - DNA, 16 bp, Homo sapiens
gctggaaataaacctg

SEQ ID NO: 3936793 - DNA, 20 bp, Homo sapiens
gctggaaataaacctggaga

SEQ ID NO: 3936794 - DNA, 23 bp, Homo sapiens
gctggaaataaacctggagatga

SEQ ID NO: 3936795 - DNA, 17 bp, Homo sapiens
gctggaagctgggaggt

SEQ ID NO: 3936796 - DNA, 20 bp, Homo sapiens
gctggaaggcagggcagagg

SEQ ID NO: 3936797 - DNA, 23 bp, Homo sapiens
gctggaaggcagggcagagggaa

SEQ ID NO: 3936798 - DNA, 11 bp, Homo sapiens
gctggaatcaa

SEQ ID NO: 3936799 - DNA, 19 bp, Homo sapiens
gctggaatctggagagcta

SEQ ID NO: 3936800 - DNA, 14 bp, Homo sapiens
gctggacaacccag

SEQ ID NO: 3936801 - DNA, 15 bp, Homo sapiens
gctggacaacccaga

SEQ ID NO: 3936802 - DNA, 16 bp, Homo sapiens
gctggacaacccagaa

SEQ ID NO: 3936803 - DNA, 22 bp, Homo sapiens
gctggacctgcacgccaccgct

SEQ ID NO: 3936804 - DNA, 16 bp, Homo sapiens
gctggactctggcacc

SEQ ID NO: 3936805 - DNA, 22 bp, Homo sapiens
gctggagctcttggaagagctc

SEQ ID NO: 3936806 - DNA, 14 bp, Homo sapiens
gctggagctggctt

SEQ ID NO: 3936807 - DNA, 23 bp, Homo sapiens
gctggaggactagaacctggagg

SEQ ID NO: 3936808 - DNA, 14 bp, Homo sapiens
gctggaggcagggc

SEQ ID NO: 3936809 - DNA, 15 bp, Homo sapiens
gctggagtgcagtgg

SEQ ID NO: 3936810 - DNA, 15 bp, Homo sapiens
gctggcaagcaggga

SEQ ID NO: 3936811 - DNA, 23 bp, Homo sapiens
gctggcaaggagttcgtggctgc

SEQ ID NO: 3936812 - DNA, 11 bp, Homo sapiens
gctggcacctc

SEQ ID NO: 3936813 - DNA, 14 bp, Homo sapiens
gctggcacctcaga

SEQ ID NO: 3936814 - DNA, 16 bp, Homo sapiens
gctggcagctgagagc

SEQ ID NO: 3936815 - DNA, 19 bp, Homo sapiens
gctggcagctgagagccct

SEQ ID NO: 3936816 - DNA, 21 bp, Homo sapiens
gctggcaggacacatcccggc

SEQ ID NO: 3936817 - DNA, 12 bp, Homo sapiens
gctggccagcac

SEQ ID NO: 3936818 - DNA, 16 bp, Homo sapiens
gctggccagcaccctc

SEQ ID NO: 3936819 - DNA, 18 bp, Homo sapiens
gctggcctcccaataaag

SEQ ID NO: 3936820 - DNA, 12 bp, Homo sapiens
gctggcctggat

SEQ ID NO: 3936821 - DNA, 15 bp, Homo sapiens
gctggcctggatctc

SEQ ID NO: 3936822 - DNA, 14 bp, Homo sapiens
gctggcctggccgg

SEQ ID NO: 3936823 - DNA, 14 bp, Homo sapiens
gctggctgccttag

SEQ ID NO: 3936824 - DNA, 17 bp, Homo sapiens
gctggctttgccaagct

SEQ ID NO: 3936825 - DNA, 16 bp, Homo sapiens
gctgggaaacagggag

SEQ ID NO: 3936826 - DNA, 22 bp, Homo sapiens
gctgggaagctgtactcagagc

SEQ ID NO: 3936827 - DNA, 22 bp, Homo sapiens
gctgggacccctcccaacctca

SEQ ID NO: 3936828 - DNA, 19 bp, Homo sapiens
gctgggactacaggtgcaa

SEQ ID NO: 3936829 - DNA, 16 bp, Homo sapiens
gctgggagctctgcag

SEQ ID NO: 3936830 - DNA, 15 bp, Homo sapiens
gctgggaggcatggc

SEQ ID NO: 3936831 - DNA, 21 bp, Homo sapiens
gctgggccagcctcagctcag

SEQ ID NO: 3936832 - DNA, 14 bp, Homo sapiens
gctgggccccatgc

SEQ ID NO: 3936833 - DNA, 16 bp, Homo sapiens
gctgggccccatgctc

SEQ ID NO: 3936834 - DNA, 20 bp, Homo sapiens
gctgggccccatgctctgcc

SEQ ID NO: 3936835 - DNA, 21 bp, Homo sapiens
gctgggccccatgctctgccc

SEQ ID NO: 3936836 - DNA, 22 bp, Homo sapiens
gctgggccccatgctctgcccc

SEQ ID NO: 3936837 - DNA, 17 bp, Homo sapiens
gctgggccggccagcct

SEQ ID NO: 3936838 - DNA, 21 bp, Homo sapiens
gctgggctctccacctcagcc

SEQ ID NO: 3936839 - DNA, 22 bp, Homo sapiens
gctgggctctccacctcagcct

SEQ ID NO: 3936840 - DNA, 12 bp, Homo sapiens
gctgggctgtgg

SEQ ID NO: 3936841 - DNA, 12 bp, Homo sapiens
gctggggaacag

SEQ ID NO: 3936842 - DNA, 22 bp, Homo sapiens
gctggggaacagagcgggcctc

SEQ ID NO: 3936843 - DNA, 14 bp, Homo sapiens
gctggggcagaggg

SEQ ID NO: 3936844 - DNA, 18 bp, Homo sapiens
gctggggcagaggggcag

SEQ ID NO: 3936845 - DNA, 19 bp, Homo sapiens
gctggggcagaggggcagc

SEQ ID NO: 3936846 - DNA, 18 bp, Homo sapiens
gctggggcatgtgtgcct

SEQ ID NO: 3936847 - DNA, 22 bp, Homo sapiens
gctggggccagtgtaaggcata

SEQ ID NO: 3936848 - DNA, 13 bp, Homo sapiens
gctggggcctgga

SEQ ID NO: 3936849 - DNA, 16 bp, Homo sapiens
gctgggggaagggtgg

SEQ ID NO: 3936850 - DNA, 15 bp, Homo sapiens
gctggggtacaggtt

SEQ ID NO: 3936851 - DNA, 15 bp, Homo sapiens
gctggtaaactattt

SEQ ID NO: 3936852 - DNA, 20 bp, Homo sapiens
gctggtccagggcctgggaa

SEQ ID NO: 3936853 - DNA, 19 bp, Homo sapiens
gctggtgctgtggccaggg

SEQ ID NO: 3936854 - DNA, 16 bp, Homo sapiens
gctggttggagagcta

SEQ ID NO: 3936855 - DNA, 14 bp, Homo sapiens
gctgtaaataaatg

SEQ ID NO: 3936856 - DNA, 23 bp, Homo sapiens
gctgtaactcagacattccaagg

SEQ ID NO: 3936857 - DNA, 21 bp, Homo sapiens
gctgtaactgctgagccactc

SEQ ID NO: 3936858 - DNA, 13 bp, Homo sapiens
gctgtaagcattc

SEQ ID NO: 3936859 - DNA, 19 bp, Homo sapiens
gctgtaagcattctgagct

SEQ ID NO: 3936860 - DNA, 14 bp, Homo sapiens
gctgtacccttcca

SEQ ID NO: 3936861 - DNA, 20 bp, Homo sapiens
gctgtacccttccacctcct

SEQ ID NO: 3936862 - DNA, 15 bp, Homo sapiens
gctgtactcagagca

SEQ ID NO: 3936863 - DNA, 14 bp, Homo sapiens
gctgtagccatggc

SEQ ID NO: 3936864 - DNA, 19 bp, Homo sapiens
gctgtagccatggctcagg

SEQ ID NO: 3936865 - DNA, 20 bp, Homo sapiens
gctgtagccatggctcaggc

SEQ ID NO: 3936866 - DNA, 22 bp, Homo sapiens
gctgtagccatggctcaggcaa

SEQ ID NO: 3936867 - DNA, 19 bp, Homo sapiens
gctgtatatatatatgtgt

SEQ ID NO: 3936868 - DNA, 20 bp, Homo sapiens
gctgtatatatatatgtgtg

SEQ ID NO: 3936869 - DNA, 18 bp, Homo sapiens
gctgtattcagatcgtat

SEQ ID NO: 3936870 - DNA, 24 bp, Homo sapiens
gctgtattcagatcgtattaatta

SEQ ID NO: 3936871 - DNA, 18 bp, Homo sapiens
gctgtcatggaaaagccc

SEQ ID NO: 3936872 - DNA, 15 bp, Homo sapiens
gctgtccctgtcacc

SEQ ID NO: 3936873 - DNA, 16 bp, Homo sapiens
gctgtcgccccaggcc

SEQ ID NO: 3936874 - DNA, 23 bp, Homo sapiens
gctgtcgccccaggccctccctg

SEQ ID NO: 3936875 - DNA, 16 bp, Homo sapiens
gctgtctgtcaccagc

SEQ ID NO: 3936876 - DNA, 12 bp, Homo sapiens
gctgtgacctgc

SEQ ID NO: 3936877 - DNA, 19 bp, Homo sapiens
gctgtgacctgctgagctc

SEQ ID NO: 3936878 - DNA, 16 bp, Homo sapiens
gctgtgaggcccctgg

SEQ ID NO: 3936879 - DNA, 22 bp, Homo sapiens
gctgtgaggcccctggacaagc

SEQ ID NO: 3936880 - DNA, 15 bp, Homo sapiens
gctgtgcctctgcct

SEQ ID NO: 3936881 - DNA, 16 bp, Homo sapiens
gctgtgcctctgcctg

SEQ ID NO: 3936882 - DNA, 12 bp, Homo sapiens
gctgtgcctgct

SEQ ID NO: 3936883 - DNA, 14 bp, Homo sapiens
gctgtgcctgctag

SEQ ID NO: 3936884 - DNA, 22 bp, Homo sapiens
gctgtgcctgctagagcaaccc

SEQ ID NO: 3936885 - DNA, 18 bp, Homo sapiens
ggagcactggagtgcagg

SEQ ID NO: 3936886 - DNA, 13 bp, Homo sapiens
ggagcagaatcag

SEQ ID NO: 3936887 - DNA, 21 bp, Homo sapiens
ggacctgcacgccaccgctgc

SEQ ID NO: 3936888 - DNA, 18 bp, Homo sapiens
ggacctgtgttcttgctg

SEQ ID NO: 3936889 - DNA, 15 bp, Homo sapiens
ggaccttcctgccac

SEQ ID NO: 3936890 - DNA, 15 bp, Homo sapiens
ggacctttcagctgt

SEQ ID NO: 3936891 - DNA, 15 bp, Homo sapiens
ggcagccaggggctg

SEQ ID NO: 3936892 - DNA, 11 bp, Homo sapiens
ggcagccatgc

SEQ ID NO: 3936893 - DNA, 12 bp, Homo sapiens
ggcagccatgcc

SEQ ID NO: 3936894 - DNA, 13 bp, Homo sapiens
ggcagccatgcct

SEQ ID NO: 3936895 - DNA, 19 bp, Homo sapiens
ggcagccgtgccttcagct

SEQ ID NO: 3936896 - DNA, 22 bp, Homo sapiens
ggcagccgtgccttcagctcta

SEQ ID NO: 3936897 - DNA, 12 bp, Homo sapiens
ggcagcctgccg

SEQ ID NO: 3936898 - DNA, 15 bp, Homo sapiens
ggcagctagactgga

SEQ ID NO: 3936899 - DNA, 16 bp, Homo sapiens
ggcagctcctctcctt

SEQ ID NO: 3936900 - DNA, 19 bp, Homo sapiens
ggcagctcctctccttggg

SEQ ID NO: 3936901 - DNA, 21 bp, Homo sapiens
ggcagctcctctgtctcgagc

SEQ ID NO: 3936902 - DNA, 18 bp, Homo sapiens
ggcagctgagagccctgc

SEQ ID NO: 3936903 - DNA, 16 bp, Homo sapiens
ggcagctggatgagac

SEQ ID NO: 3936904 - DNA, 11 bp, Homo sapiens
ggcagctgggc

SEQ ID NO: 3936905 - DNA, 13 bp, Homo sapiens
ggcagctgggccc

SEQ ID NO: 3936906 - DNA, 14 bp, Homo sapiens
ggcagctgggcccc

SEQ ID NO: 3936907 - DNA, 19 bp, Homo sapiens
ggcagctgggccccaccta

SEQ ID NO: 3936908 - DNA, 21 bp, Homo sapiens
ggcagctgtcatggaaaagcc

SEQ ID NO: 3936909 - DNA, 22 bp, Homo sapiens
ggcagctgtcccctctccctgg

SEQ ID NO: 3936910 - DNA, 22 bp, Homo sapiens
ggcaggaagagagagagagagg

SEQ ID NO: 3936911 - DNA, 12 bp, Homo sapiens
ggcaggacacat

SEQ ID NO: 3936912 - DNA, 14 bp, Homo sapiens
ggcaggaccaggac

SEQ ID NO: 3936913 - DNA, 17 bp, Homo sapiens
ggcaggaggcctggcct

SEQ ID NO: 3936914 - DNA, 14 bp, Homo sapiens
ggcaggagtagctg

SEQ ID NO: 3936915 - DNA, 15 bp, Homo sapiens
ggcaggagtggcagc

SEQ ID NO: 3936916 - DNA, 14 bp, Homo sapiens
ggcaggcagggctc

SEQ ID NO: 3936917 - DNA, 15 bp, Homo sapiens
ggcaggcagggctct

SEQ ID NO: 3936918 - DNA, 13 bp, Homo sapiens
ggcaggctgggtt

SEQ ID NO: 3936919 - DNA, 18 bp, Homo sapiens
ggcagggaaaggctctga

SEQ ID NO: 3936920 - DNA, 13 bp, Homo sapiens
ggcagggagggga

SEQ ID NO: 3936921 - DNA, 20 bp, Homo sapiens
ggcagggccttgcccagaga

SEQ ID NO: 3936922 - DNA, 17 bp, Homo sapiens
ggcagggctctcctggc

SEQ ID NO: 3936923 - DNA, 16 bp, Homo sapiens
ggcagggtgggatgga

SEQ ID NO: 3936924 - DNA, 23 bp, Homo sapiens
ggcagggtgggatggaggagaag

SEQ ID NO: 3936925 - DNA, 16 bp, Homo sapiens
ggcaggtcctgcccat

SEQ ID NO: 3936926 - DNA, 19 bp, Homo sapiens
ggcaggtcctgcccatgtg

SEQ ID NO: 3936927 - DNA, 13 bp, Homo sapiens
ggcaggtgcagat

SEQ ID NO: 3936928 - DNA, 16 bp, Homo sapiens
ggcaggttagaaccta

SEQ ID NO: 3936929 - DNA, 22 bp, Homo sapiens
ggcagtcgtaagggttgcggcg

SEQ ID NO: 3936930 - DNA, 21 bp, Homo sapiens
ggcagtctgaacccttgtgct

SEQ ID NO: 3936931 - DNA, 18 bp, Homo sapiens
ggcagtgactggcaggtg

SEQ ID NO: 3936932 - DNA, 14 bp, Homo sapiens
ggcagtgccagggc

SEQ ID NO: 3936933 - DNA, 16 bp, Homo sapiens
ggcagtgccagggcag

SEQ ID NO: 3936934 - DNA, 12 bp, Homo sapiens
ggcagtgcctcc

SEQ ID NO: 3936935 - DNA, 14 bp, Homo sapiens
ggcagtgcctcctg

SEQ ID NO: 3936936 - DNA, 17 bp, Homo sapiens
ggcagtgcctcctggga

SEQ ID NO: 3936937 - DNA, 17 bp, Homo sapiens
ggcagttcgcagccacc

SEQ ID NO: 3936938 - DNA, 18 bp, Homo sapiens
ggcagtttaaagcacaat

SEQ ID NO: 3936939 - DNA, 18 bp, Homo sapiens
ggcatagaaactgaggag

SEQ ID NO: 3936940 - DNA, 16 bp, Homo sapiens
ggcatcaggcactggt

SEQ ID NO: 3936941 - DNA, 19 bp, Homo sapiens
ggcatcaggcactggtggc

SEQ ID NO: 3936942 - DNA, 20 bp, Homo sapiens
ggcatcaggcactggtggca

SEQ ID NO: 3936943 - DNA, 16 bp, Homo sapiens
ggcatccacccagtgc

SEQ ID NO: 3936944 - DNA, 17 bp, Homo sapiens
ggcatccacccagtgct

SEQ ID NO: 3936945 - DNA, 20 bp, Homo sapiens
ggcatccacccagtgctgcc

SEQ ID NO: 3936946 - DNA, 21 bp, Homo sapiens
ggcatccacccagtgctgcca

SEQ ID NO: 3936947 - DNA, 22 bp, Homo sapiens
ggcatccacccagtgctgccat

SEQ ID NO: 3936948 - DNA, 15 bp, Homo sapiens
ggcatctctaattgg

SEQ ID NO: 3936949 - DNA, 21 bp, Homo sapiens
ggcatgacactctagtgactt

SEQ ID NO: 3936950 - DNA, 19 bp, Homo sapiens
ggcatgagggatcacaggg

SEQ ID NO: 3936951 - DNA, 12 bp, Homo sapiens
ggcatgatttat

SEQ ID NO: 3936952 - DNA, 21 bp, Homo sapiens
ggcatgatttatatatggcat

SEQ ID NO: 3936953 - DNA, 17 bp, Homo sapiens
ggcatggccaggtggcc

SEQ ID NO: 3936954 - DNA, 18 bp, Homo sapiens
ggcatggccaggtggcca

SEQ ID NO: 3936955 - DNA, 17 bp, Homo sapiens
ggcatggccctggggtc

SEQ ID NO: 3936956 - DNA, 14 bp, Homo sapiens
ggcatggctgggaa

SEQ ID NO: 3936957 - DNA, 19 bp, Homo sapiens
ggcatggtacggagatgtt

SEQ ID NO: 3936958 - DNA, 22 bp, Homo sapiens
ggcatggttccttccctgggaa

SEQ ID NO: 3936959 - DNA, 14 bp, Homo sapiens
ggcatgtcagagcc

SEQ ID NO: 3936960 - DNA, 23 bp, Homo sapiens
ggcatgtgaattctgtgaagaat

SEQ ID NO: 3936961 - DNA, 14 bp, Homo sapiens
ggcatgtgtgcctg

SEQ ID NO: 3936962 - DNA, 18 bp, Homo sapiens
ggcattgggctgacacct

SEQ ID NO: 3936963 - DNA, 16 bp, Homo sapiens
ggcattggtctgctga

SEQ ID NO: 3936964 - DNA, 21 bp, Homo sapiens
ggccccgcttgtccagcgcct

SEQ ID NO: 3936965 - DNA, 17 bp, Homo sapiens
ggccccgggctctggcc

SEQ ID NO: 3936966 - DNA, 22 bp, Homo sapiens
ggccccgggctctggccaccct

SEQ ID NO: 3936967 - DNA, 13 bp, Homo sapiens
ggccccggggctg

SEQ ID NO: 3936968 - DNA, 13 bp, Homo sapiens
ggcccctccacgc

SEQ ID NO: 3936969 - DNA, 14 bp, Homo sapiens
ggcccctccagacc

SEQ ID NO: 3936970 - DNA, 20 bp, Homo sapiens
ggcccctgggatgggaccag

SEQ ID NO: 3936971 - DNA, 17 bp, Homo sapiens
ggcccgacagcctggca

SEQ ID NO: 3936972 - DNA, 13 bp, Homo sapiens
ggcccgagcagct

SEQ ID NO: 3936973 - DNA, 16 bp, Homo sapiens
ggcccgagcagctgag

SEQ ID NO: 3936974 - DNA, 23 bp, Homo sapiens
ggcccgagcagctgagcagggcc

SEQ ID NO: 3936975 - DNA, 14 bp, Homo sapiens
ggcccgcccctcgc

SEQ ID NO: 3936976 - DNA, 13 bp, Homo sapiens
ggcccggggctgg

SEQ ID NO: 3936977 - DNA, 22 bp, Homo sapiens
ggcccggggctggcggctactc

SEQ ID NO: 3936978 - DNA, 14 bp, Homo sapiens
ggccctccatgggc

SEQ ID NO: 3936979 - DNA, 16 bp, Homo sapiens
ggccctccatgggcta

SEQ ID NO: 3936980 - DNA, 21 bp, Homo sapiens
ggccctccctgactccctgtg

SEQ ID NO: 3936981 - DNA, 19 bp, Homo sapiens
ggccctcttcttattcatg

SEQ ID NO: 3936982 - DNA, 18 bp, Homo sapiens
ggccctgcacctgtgcag

SEQ ID NO: 3936983 - DNA, 15 bp, Homo sapiens
ggccctgccctctcc

SEQ ID NO: 3936984 - DNA, 17 bp, Homo sapiens
ggccctggatcagcgtg

SEQ ID NO: 3936985 - DNA, 23 bp, Homo sapiens
ggccctggatcagcgtggccttg

SEQ ID NO: 3936986 - DNA, 15 bp, Homo sapiens
ggccctgggcctcag

SEQ ID NO: 3936987 - DNA, 16 bp, Homo sapiens
ggccctgggcctcagt

SEQ ID NO: 3936988 - DNA, 15 bp, Homo sapiens
ggccctggtgtcagg

SEQ ID NO: 3936989 - DNA, 13 bp, Homo sapiens
ggcccttcctctc

SEQ ID NO: 3936990 - DNA, 18 bp, Homo sapiens
ggcccttcctctccactg

SEQ ID NO: 3936991 - DNA, 23 bp, Homo sapiens
ggcccttcctctccactgccttc

SEQ ID NO: 3936992 - DNA, 14 bp, Homo sapiens
ggcccttcctggac

SEQ ID NO: 3936993 - DNA, 21 bp, Homo sapiens
ggcccttcctggacagctgtg

SEQ ID NO: 3936994 - DNA, 20 bp, Homo sapiens
ggcccttggggcctggcttg

SEQ ID NO: 3936995 - DNA, 22 bp, Homo sapiens
ggcccttgtcctgccagctgcc

SEQ ID NO: 3936996 - DNA, 17 bp, Homo sapiens
ggccgacggcggcggcc

SEQ ID NO: 3936997 - DNA, 16 bp, Homo sapiens
ggccgcaagcgcaggg

SEQ ID NO: 3936998 - DNA, 22 bp, Homo sapiens
ggccgcaagcgcagggaggatg

SEQ ID NO: 3936999 - DNA, 13 bp, Homo sapiens
ggccggccagcct

SEQ ID NO: 3937000 - DNA, 16 bp, Homo sapiens
ggccggccagccttgc

SEQ ID NO: 3937001 - DNA, 19 bp, Homo sapiens
ggccgggcaggtcctgccc

SEQ ID NO: 3937002 - DNA, 13 bp, Homo sapiens
ggccgggctgccc

SEQ ID NO: 3937003 - DNA, 14 bp, Homo sapiens
ggccgggctgccct

SEQ ID NO: 3937004 - DNA, 20 bp, Homo sapiens
ggccggggaactggccaagc

SEQ ID NO: 3937005 - DNA, 21 bp, Homo sapiens
ggccggggaactggccaagct

SEQ ID NO: 3937006 - DNA, 16 bp, Homo sapiens
ggccgtgggggttgag

SEQ ID NO: 3937007 - DNA, 13 bp, Homo sapiens
ggccgtgtctctg

SEQ ID NO: 3937008 - DNA, 18 bp, Homo sapiens
ggccgttccccttggctt

SEQ ID NO: 3937009 - DNA, 16 bp, Homo sapiens
ggcctaaaagtaaaca

SEQ ID NO: 3937010 - DNA, 15 bp, Homo sapiens
ggcctatggagagcc

SEQ ID NO: 3937011 - DNA, 21 bp, Homo sapiens
ggcctatggagagccctggga

SEQ ID NO: 3937012 - DNA, 22 bp, Homo sapiens
ggcctcaaagttggggcaggct

SEQ ID NO: 3937013 - DNA, 14 bp, Homo sapiens
ggcctcactggctg

SEQ ID NO: 3937014 - DNA, 23 bp, Homo sapiens
ggcctcactggctggggcagagg

SEQ ID NO: 3937015 - DNA, 14 bp, Homo sapiens
ggcctcacttccct

SEQ ID NO: 3937016 - DNA, 19 bp, Homo sapiens
ggcctcacttccctgggaa

SEQ ID NO: 3937017 - DNA, 21 bp, Homo sapiens
ggcctcagcacccctgtctct

SEQ ID NO: 3937018 - DNA, 15 bp, Homo sapiens
ggcctcagccctcag

SEQ ID NO: 3937019 - DNA, 17 bp, Homo sapiens
ggcctcagtttccccat

SEQ ID NO: 3937020 - DNA, 13 bp, Homo sapiens
ggcctcatccctc

SEQ ID NO: 3937021 - DNA, 14 bp, Homo sapiens
ggcctccactcccc

SEQ ID NO: 3937022 - DNA, 13 bp, Homo sapiens
ggcctccagcctc

SEQ ID NO: 3937023 - DNA, 14 bp, Homo sapiens
ggcctccagcctct

SEQ ID NO: 3937024 - DNA, 18 bp, Homo sapiens
ggcctccagcctctcccg

SEQ ID NO: 3937025 - DNA, 19 bp, Homo sapiens
ggcctcccaataaagctgg

SEQ ID NO: 3937026 - DNA, 20 bp, Homo sapiens
ggcctcccaataaagctgga

SEQ ID NO: 3937027 - DNA, 20 bp, Homo sapiens
ggcctcctctctgccaccac

SEQ ID NO: 3937028 - DNA, 16 bp, Homo sapiens
ggcctcgcctgggccc

SEQ ID NO: 3937029 - DNA, 21 bp, Homo sapiens
ggcctcgcctgggcccaggct

SEQ ID NO: 3937030 - DNA, 23 bp, Homo sapiens
ggcctcgggacacctgccctgcc

SEQ ID NO: 3937031 - DNA, 18 bp, Homo sapiens
ggcctcgtaccagccagg

SEQ ID NO: 3937032 - DNA, 14 bp, Homo sapiens
ggcctcgtgccatg

SEQ ID NO: 3937033 - DNA, 20 bp, Homo sapiens
ggcctcgtgccatgatctgt

SEQ ID NO: 3937034 - DNA, 23 bp, Homo sapiens
ggcctctagaacacccactggcc

SEQ ID NO: 3937035 - DNA, 18 bp, Homo sapiens
ggcctctctcttcccagc

SEQ ID NO: 3937036 - DNA, 16 bp, Homo sapiens
ggcctcttgtgctcac

SEQ ID NO: 3937037 - DNA, 20 bp, Homo sapiens
ggcctgagcaacaaagcgag

SEQ ID NO: 3937038 - DNA, 15 bp, Homo sapiens
ggcctgagctggggc

SEQ ID NO: 3937039 - DNA, 13 bp, Homo sapiens
ggcctgatgctgc

SEQ ID NO: 3937040 - DNA, 21 bp, Homo sapiens
ggcctgcccaatgctttggga

SEQ ID NO: 3937041 - DNA, 11 bp, Homo sapiens
ggcctgcctgt

SEQ ID NO: 3937042 - DNA, 18 bp, Homo sapiens
ggcctgcggccgggctgc

SEQ ID NO: 3937043 - DNA, 20 bp, Homo sapiens
ggcctgcggccgggctgccc

SEQ ID NO: 3937044 - DNA, 17 bp, Homo sapiens
ggcctgcgtgccgggag

SEQ ID NO: 3937045 - DNA, 17 bp, Homo sapiens
ggcctgctcccagcagc

SEQ ID NO: 3937046 - DNA, 11 bp, Homo sapiens
ggcctgctgct

SEQ ID NO: 3937047 - DNA, 23 bp, Homo sapiens
ggcctgctgctgagaacctggcc

SEQ ID NO: 3937048 - DNA, 21 bp, Homo sapiens
ggcctgctgggaaccccgcag

SEQ ID NO: 3937049 - DNA, 23 bp, Homo sapiens
ggcctgctgggaaccccgcagcc

SEQ ID NO: 3937050 - DNA, 17 bp, Homo sapiens
cctgctagctgtagaaa

SEQ ID NO: 3937051 - DNA, 13 bp, Homo sapiens
cctgctcccagca

SEQ ID NO: 3937052 - DNA, 18 bp, Homo sapiens
cctgctcccccaccccct

SEQ ID NO: 3937053 - DNA, 14 bp, Homo sapiens
cctgctcctcccaa

SEQ ID NO: 3937054 - DNA, 16 bp, Homo sapiens
cctgctctcctcttgc

SEQ ID NO: 3937055 - DNA, 22 bp, Homo sapiens
cctgctctcctcttgccactgc

SEQ ID NO: 3937056 - DNA, 14 bp, Homo sapiens
cctgctgagctctg

SEQ ID NO: 3937057 - DNA, 17 bp, Homo sapiens
cctgctgagctctgaga

SEQ ID NO: 3937058 - DNA, 20 bp, Homo sapiens
cctgctgagctctgagaggc

SEQ ID NO: 3937059 - DNA, 22 bp, Homo sapiens
cctgctgccgcctcccagcctg

SEQ ID NO: 3937060 - DNA, 16 bp, Homo sapiens
cctgctgctgagaacc

SEQ ID NO: 3937061 - DNA, 19 bp, Homo sapiens
cctgctgctgagaacctgg

SEQ ID NO: 3937062 - DNA, 20 bp, Homo sapiens
cctgctgctgagaacctggc

SEQ ID NO: 3937063 - DNA, 17 bp, Homo sapiens
cctgctggcacctcaga

SEQ ID NO: 3937064 - DNA, 21 bp, Homo sapiens
cctgctggcacctcagacaat

SEQ ID NO: 3937065 - DNA, 20 bp, Homo sapiens
cctgctgggaaccccgcagc

SEQ ID NO: 3937066 - DNA, 22 bp, Homo sapiens
cctgctgggaaccccgcagccc

SEQ ID NO: 3937067 - DNA, 23 bp, Homo sapiens
cctgctgggaaccccgcagcccg

SEQ ID NO: 3937068 - DNA, 17 bp, Homo sapiens
cctgctgggtaaactgt

SEQ ID NO: 3937069 - DNA, 23 bp, Homo sapiens
cctgctgtgcaccttacattcct

SEQ ID NO: 3937070 - DNA, 12 bp, Homo sapiens
cctgctgtggga

SEQ ID NO: 3937071 - DNA, 23 bp, Homo sapiens
cctgcttggggggtgatgagggc

SEQ ID NO: 3937072 - DNA, 18 bp, Homo sapiens
cctgcttgtccctgccca

SEQ ID NO: 3937073 - DNA, 14 bp, Homo sapiens
cctgctttccctcc

SEQ ID NO: 3937074 - DNA, 16 bp, Homo sapiens
cctgctttccctcccc

SEQ ID NO: 3937075 - DNA, 19 bp, Homo sapiens
cctgctttgggctgccctg

SEQ ID NO: 3937076 - DNA, 21 bp, Homo sapiens
cctgctttgggctgccctggt

SEQ ID NO: 3937077 - DNA, 22 bp, Homo sapiens
cctgctttgggctgccctggtg

SEQ ID NO: 3937078 - DNA, 14 bp, Homo sapiens
cctgcttttccagg

SEQ ID NO: 3937079 - DNA, 19 bp, Homo sapiens
cctgcttttccaggatcct

SEQ ID NO: 3937080 - DNA, 14 bp, Homo sapiens
cctggaaaggggag

SEQ ID NO: 3937081 - DNA, 14 bp, Homo sapiens
cctggaaccaggga

SEQ ID NO: 3937082 - DNA, 21 bp, Homo sapiens
cctggaaccagggaggagagg

SEQ ID NO: 3937083 - DNA, 21 bp, Homo sapiens
cctggaagctgtgtccttgca

SEQ ID NO: 3937084 - DNA, 12 bp, Homo sapiens
cctggaagggct

SEQ ID NO: 3937085 - DNA, 19 bp, Homo sapiens
cctggaattcagcaccctg

SEQ ID NO: 3937086 - DNA, 17 bp, Homo sapiens
cctggacagctgtgcct

SEQ ID NO: 3937087 - DNA, 19 bp, Homo sapiens
cctggaccgcttcccagag

SEQ ID NO: 3937088 - DNA, 16 bp, Homo sapiens
cctggagaactagaga

SEQ ID NO: 3937089 - DNA, 14 bp, Homo sapiens
cctggagaggggcc

SEQ ID NO: 3937090 - DNA, 12 bp, Homo sapiens
cctggagatgat

SEQ ID NO: 3937091 - DNA, 16 bp, Homo sapiens
cctggagatgatgatg

SEQ ID NO: 3937092 - DNA, 13 bp, Homo sapiens
cctggaggacctg

SEQ ID NO: 3937093 - DNA, 14 bp, Homo sapiens
cctggaggacctga

SEQ ID NO: 3937094 - DNA, 16 bp, Homo sapiens
cctggaggacctgagc

SEQ ID NO: 3937095 - DNA, 19 bp, Homo sapiens
cctggaggacctgagcctg

SEQ ID NO: 3937096 - DNA, 22 bp, Homo sapiens
cctggaggacctgagcctgccg

SEQ ID NO: 3937097 - DNA, 14 bp, Homo sapiens
cctggagggaggct

SEQ ID NO: 3937098 - DNA, 12 bp, Homo sapiens
cctggagggcta

SEQ ID NO: 3937099 - DNA, 21 bp, Homo sapiens
cctggaggggctagaacctag

SEQ ID NO: 3937100 - DNA, 16 bp, Homo sapiens
cctggagtcccctggg

SEQ ID NO: 3937101 - DNA, 18 bp, Homo sapiens
cctggagtcccctgggcc

SEQ ID NO: 3937102 - DNA, 21 bp, Homo sapiens
cctggagtcccctgggcctgg

SEQ ID NO: 3937103 - DNA, 21 bp, Homo sapiens
cctggatccatcaggccactt

SEQ ID NO: 3937104 - DNA, 22 bp, Homo sapiens
cctggatgtcccctgtcccacc

SEQ ID NO: 3937105 - DNA, 18 bp, Homo sapiens
cctggcacaggactgatt

SEQ ID NO: 3937106 - DNA, 13 bp, Homo sapiens
ttattcactgtaa

SEQ ID NO: 3937107 - DNA, 19 bp, Homo sapiens
ttattcactgtaagtttat

SEQ ID NO: 3937108 - DNA, 21 bp, Homo sapiens
ttattcatgctttctcctttt

SEQ ID NO: 3937109 - DNA, 12 bp, Homo sapiens
ttattcattcag

SEQ ID NO: 3937110 - DNA, 15 bp, Homo sapiens
ttattcattgtatga

SEQ ID NO: 3937111 - DNA, 20 bp, Homo sapiens
ttattccccattcttcctag

SEQ ID NO: 3937112 - DNA, 13 bp, Homo sapiens
ttattctcctccc

SEQ ID NO: 3937113 - DNA, 13 bp, Homo sapiens
ttattctttttaa

SEQ ID NO: 3937114 - DNA, 16 bp, Homo sapiens
ttattctttttaaagt

SEQ ID NO: 3937115 - DNA, 22 bp, Homo sapiens
ttattgaagaaacagataccat

SEQ ID NO: 3937116 - DNA, 18 bp, Homo sapiens
ttattgacaataatttca

SEQ ID NO: 3937117 - DNA, 18 bp, Homo sapiens
ttattgatttttgtaata

SEQ ID NO: 3937118 - DNA, 22 bp, Homo sapiens
ttattggaagtgttcaagaaat

SEQ ID NO: 3937119 - DNA, 14 bp, Homo sapiens
ttattggaccagaa

SEQ ID NO: 3937120 - DNA, 21 bp, Homo sapiens
ttattgtataaactatcagtt

SEQ ID NO: 3937121 - DNA, 23 bp, Homo sapiens
ttattgtcattactgcctttgga

SEQ ID NO: 3937122 - DNA, 18 bp, Homo sapiens
ttattgtccttcagagct

SEQ ID NO: 3937123 - DNA, 13 bp, Homo sapiens
ttatttaaatgtt

SEQ ID NO: 3937124 - DNA, 15 bp, Homo sapiens
ttatttaagaataaa

SEQ ID NO: 3937125 - DNA, 12 bp, Homo sapiens
ttatttaatgtt

SEQ ID NO: 3937126 - DNA, 14 bp, Homo sapiens
ttatttaatgtttg

SEQ ID NO: 3937127 - DNA, 22 bp, Homo sapiens
ttatttacttgtagaaatctgt

SEQ ID NO: 3937128 - DNA, 20 bp, Homo sapiens
ttatttagttgaaaaatcta

SEQ ID NO: 3937129 - DNA, 22 bp, Homo sapiens
ttatttagttgaaaaatctagt

SEQ ID NO: 3937130 - DNA, 22 bp, Homo sapiens
ttatttatggcttataaatgtg

SEQ ID NO: 3937131 - DNA, 17 bp, Homo sapiens
ttatttccaaataaaat

SEQ ID NO: 3937132 - DNA, 14 bp, Homo sapiens
ttatttgacaaaat

SEQ ID NO: 3937133 - DNA, 18 bp, Homo sapiens
ttatttgttattttcagt

SEQ ID NO: 3937134 - DNA, 17 bp, Homo sapiens
ttattttaaaaaatgaa

SEQ ID NO: 3937135 - DNA, 18 bp, Homo sapiens
ttattttcaagaaactga

SEQ ID NO: 3937136 - DNA, 14 bp, Homo sapiens
ttattttcagtatt

SEQ ID NO: 3937137 - DNA, 17 bp, Homo sapiens
ttattttctttgaaatt

SEQ ID NO: 3937138 - DNA, 18 bp, Homo sapiens
ttattttgtattacatct

SEQ ID NO: 3937139 - DNA, 21 bp, Homo sapiens
ttattttgttgtgattttgta

SEQ ID NO: 3937140 - DNA, 23 bp, Homo sapiens
ttatttttgacagtgttgaaaat

SEQ ID NO: 3937141 - DNA, 16 bp, Homo sapiens
ttatttttgtccctgc

SEQ ID NO: 3937142 - DNA, 14 bp, Homo sapiens
ttattttttctaca

SEQ ID NO: 3937143 - DNA, 18 bp, Homo sapiens
ttcaaaaaaacactagtt

SEQ ID NO: 3937144 - DNA, 21 bp, Homo sapiens
ttcaaaaagtctacgctctcc

SEQ ID NO: 3937145 - DNA, 13 bp, Homo sapiens
ttcaaacaagaat

SEQ ID NO: 3937146 - DNA, 18 bp, Homo sapiens
ttcaaacagtctcaggaa

SEQ ID NO: 3937147 - DNA, 21 bp, Homo sapiens
ttcaaaccatttaattcataa

SEQ ID NO: 3937148 - DNA, 18 bp, Homo sapiens
ttcaaactattgggaggg

SEQ ID NO: 3937149 - DNA, 21 bp, Homo sapiens
ttcaacacattacttgcacaa

SEQ ID NO: 3937150 - DNA, 22 bp, Homo sapiens
ttcaacacattacttgcacaag

SEQ ID NO: 3937151 - DNA, 16 bp, Homo sapiens
ttcaaccagcattcat

SEQ ID NO: 3937152 - DNA, 15 bp, Homo sapiens
ttcaaccagcatttt

SEQ ID NO: 3937153 - DNA, 16 bp, Homo sapiens
ttcaaccagcatttta

SEQ ID NO: 3937154 - DNA, 20 bp, Homo sapiens
ttcaacgcagccctgctttg

SEQ ID NO: 3937155 - DNA, 12 bp, Homo sapiens
ttcaactggctg

SEQ ID NO: 3937156 - DNA, 18 bp, Homo sapiens
ttcaacttggaaaaagaa

SEQ ID NO: 3937157 - DNA, 20 bp, Homo sapiens
ttcaagaaactgaggaattt

SEQ ID NO: 3937158 - DNA, 23 bp, Homo sapiens
ttcaagaaactgaggaattttct

SEQ ID NO: 3937159 - DNA, 23 bp, Homo sapiens
ttccctatcaaaacatatcaatt

SEQ ID NO: 3937160 - DNA, 21 bp, Homo sapiens
ttccctattatttccgggtgg

SEQ ID NO: 3937161 - DNA, 20 bp, Homo sapiens
ttccctccccacagtcctca

SEQ ID NO: 3937162 - DNA, 18 bp, Homo sapiens
ttccctccttcccttctc

SEQ ID NO: 3937163 - DNA, 22 bp, Homo sapiens
ttccctctgagaattccaagga

SEQ ID NO: 3937164 - DNA, 23 bp, Homo sapiens
ttccctctgagaattccaaggag

SEQ ID NO: 3937165 - DNA, 20 bp, Homo sapiens
ttccctctttccccacctct

SEQ ID NO: 3937166 - DNA, 15 bp, Homo sapiens
ttccctgcaccctgg

SEQ ID NO: 3937167 - DNA, 19 bp, Homo sapiens
ttccctgcatttctgagtt

SEQ ID NO: 3937168 - DNA, 23 bp, Homo sapiens
ttccctggcttgtaactccacca

SEQ ID NO: 3937169 - DNA, 23 bp, Homo sapiens
ttccgtcacatatacaaaagcaa

SEQ ID NO: 3937170 - DNA, 20 bp, Homo sapiens
ttcctaaaaataagctttat

SEQ ID NO: 3937171 - DNA, 20 bp, Homo sapiens
ttcctaaagtctctgctgct

SEQ ID NO: 3937172 - DNA, 20 bp, Homo sapiens
ttcctaagcctgttgctgaa

SEQ ID NO: 3937173 - DNA, 18 bp, Homo sapiens
ttcctacagatagtcaaa

SEQ ID NO: 3937174 - DNA, 16 bp, Homo sapiens
ttcctacccaaccact

SEQ ID NO: 3937175 - DNA, 17 bp, Homo sapiens
ttcctacccaaccactc

SEQ ID NO: 3937176 - DNA, 15 bp, Homo sapiens
ttcctagttttctcc

SEQ ID NO: 3937177 - DNA, 18 bp, Homo sapiens
ttcctagttttctcctcc

SEQ ID NO: 3937178 - DNA, 20 bp, Homo sapiens
ttcctattttaaaaccatgc

SEQ ID NO: 3937179 - DNA, 22 bp, Homo sapiens
ttcctattttaaaaccatgcag

SEQ ID NO: 3937180 - DNA, 22 bp, Homo sapiens
ttcctattttcttttccattgc

SEQ ID NO: 3937181 - DNA, 14 bp, Homo sapiens
ttcctcagctgcca

SEQ ID NO: 3937182 - DNA, 20 bp, Homo sapiens
ttcctcatcccctcgtcctg

SEQ ID NO: 3937183 - DNA, 16 bp, Homo sapiens
ttcctccaaactcctg

SEQ ID NO: 3937184 - DNA, 18 bp, Homo sapiens
ttcctccgtccacccagg

SEQ ID NO: 3937185 - DNA, 22 bp, Homo sapiens
ttcctccgtccacccaggctgc

SEQ ID NO: 3937186 - DNA, 23 bp, Homo sapiens
ttcctcctgaagcctctgccctg

SEQ ID NO: 3937187 - DNA, 17 bp, Homo sapiens
ttcctcctgtgtacagg

SEQ ID NO: 3937188 - DNA, 16 bp, Homo sapiens
ttcctcgcctaggcct

SEQ ID NO: 3937189 - DNA, 19 bp, Homo sapiens
ttcctcgcctaggcctgtg

SEQ ID NO: 3937190 - DNA, 15 bp, Homo sapiens
ttcctcgcctctccc

SEQ ID NO: 3937191 - DNA, 19 bp, Homo sapiens
ttcctctcactaaacttta

SEQ ID NO: 3937192 - DNA, 15 bp, Homo sapiens
ttcctctccaattgt

SEQ ID NO: 3937193 - DNA, 18 bp, Homo sapiens
ttcctctgaggaagaagg

SEQ ID NO: 3937194 - DNA, 16 bp, Homo sapiens
ttcctctgcagcactt

SEQ ID NO: 3937195 - DNA, 14 bp, Homo sapiens
cagcctcccagagt

SEQ ID NO: 3937196 - DNA, 12 bp, Homo sapiens
cagcctccccca

SEQ ID NO: 3937197 - DNA, 14 bp, Homo sapiens
cagcctcccccaca

SEQ ID NO: 3937198 - DNA, 19 bp, Homo sapiens
cagcctccccctgctgctc

SEQ ID NO: 3937199 - DNA, 12 bp, Homo sapiens
cagcctcctggg

SEQ ID NO: 3937200 - DNA, 16 bp, Homo sapiens
cagcctcctgggcagt

SEQ ID NO: 3937201 - DNA, 23 bp, Homo sapiens
cagcctctccaggcaccatctcc

SEQ ID NO: 3937202 - DNA, 19 bp, Homo sapiens
cagcctctcccggctgcct

SEQ ID NO: 3937203 - DNA, 23 bp, Homo sapiens
cagcctctcccggctgcctgccg

SEQ ID NO: 3937204 - DNA, 15 bp, Homo sapiens
cagcctcttaaagct

SEQ ID NO: 3937205 - DNA, 16 bp, Homo sapiens
cagcctgatggccaag

SEQ ID NO: 3937206 - DNA, 20 bp, Homo sapiens
cagcctgctccttcccagga

SEQ ID NO: 3937207 - DNA, 22 bp, Homo sapiens
cagcctgctccttcccaggagt

SEQ ID NO: 3937208 - DNA, 21 bp, Homo sapiens
cagcctggcacagggcagtgg

SEQ ID NO: 3937209 - DNA, 15 bp, Homo sapiens
cagcctggcctcctg

SEQ ID NO: 3937210 - DNA, 17 bp, Homo sapiens
cagcctggcggggcagg

SEQ ID NO: 3937211 - DNA, 21 bp, Homo sapiens
cagcctggcggggcaggaggc

SEQ ID NO: 3937212 - DNA, 22 bp, Homo sapiens
cagcctggcggggcaggaggcc

SEQ ID NO: 3937213 - DNA, 16 bp, Homo sapiens
cagcctgggcctatgg

SEQ ID NO: 3937214 - DNA, 18 bp, Homo sapiens
cagcctgggcctatggag

SEQ ID NO: 3937215 - DNA, 21 bp, Homo sapiens
cagcctgggcctatggagagc

SEQ ID NO: 3937216 - DNA, 22 bp, Homo sapiens
cagcctgggcctatggagagcc

SEQ ID NO: 3937217 - DNA, 15 bp, Homo sapiens
cagcctggtgcccat

SEQ ID NO: 3937218 - DNA, 19 bp, Homo sapiens
cagcctggtttagcctgga

SEQ ID NO: 3937219 - DNA, 16 bp, Homo sapiens
cagcctggttttcaca

SEQ ID NO: 3937220 - DNA, 12 bp, Homo sapiens
cagcctgtcctg

SEQ ID NO: 3937221 - DNA, 13 bp, Homo sapiens
cagcctgtcctgg

SEQ ID NO: 3937222 - DNA, 18 bp, Homo sapiens
cagccttgcactgtgggg

SEQ ID NO: 3937223 - DNA, 18 bp, Homo sapiens
cagcgagaggcagagaaa

SEQ ID NO: 3937224 - DNA, 20 bp, Homo sapiens
cagcgattccctctcccagg

SEQ ID NO: 3937225 - DNA, 21 bp, Homo sapiens
cagcgattccctctcccaggc

SEQ ID NO: 3937226 - DNA, 22 bp, Homo sapiens
cagcgccctggagtcccctggg

SEQ ID NO: 3937227 - DNA, 22 bp, Homo sapiens
cagcgcctagtggggtctccct

SEQ ID NO: 3937228 - DNA, 18 bp, Homo sapiens
cagcgcctgccctccctg

SEQ ID NO: 3937229 - DNA, 18 bp, Homo sapiens
cagcgcggcttggccgcc

SEQ ID NO: 3937230 - DNA, 22 bp, Homo sapiens
cagcgcggcttggccgccatcc

SEQ ID NO: 3937231 - DNA, 19 bp, Homo sapiens
cagcgcgggcggaggcggc

SEQ ID NO: 3937232 - DNA, 20 bp, Homo sapiens
ccgcaagcgcagggaggatg

SEQ ID NO: 3937233 - DNA, 17 bp, Homo sapiens
ccgcaagttcagggaag

SEQ ID NO: 3937234 - DNA, 14 bp, Homo sapiens
ccgcaccagctgct

SEQ ID NO: 3937235 - DNA, 13 bp, Homo sapiens
ccgcaccccccaa

SEQ ID NO: 3937236 - DNA, 15 bp, Homo sapiens
ccgcacttggaaagg

SEQ ID NO: 3937237 - DNA, 20 bp, Homo sapiens
ccgcagccagccggtgcctg

SEQ ID NO: 3937238 - DNA, 12 bp, Homo sapiens
ccgcagcccagg

SEQ ID NO: 3937239 - DNA, 17 bp, Homo sapiens
ccgcagtccccagccct

SEQ ID NO: 3937240 - DNA, 12 bp, Homo sapiens
ccgcatcttctc

SEQ ID NO: 3937241 - DNA, 20 bp, Homo sapiens
ccgcatcttctccatctggc

SEQ ID NO: 3937242 - DNA, 23 bp, Homo sapiens
ccgcattccctgagtcaccagga

SEQ ID NO: 3937243 - DNA, 12 bp, Homo sapiens
ccgccacggcca

SEQ ID NO: 3937244 - DNA, 13 bp, Homo sapiens
ccgccacggccac

SEQ ID NO: 3937245 - DNA, 15 bp, Homo sapiens
ccgccacggccaccc

SEQ ID NO: 3937246 - DNA, 19 bp, Homo sapiens
ccgccacggccaccctcct

SEQ ID NO: 3937247 - DNA, 12 bp, Homo sapiens
ccgccagcctca

SEQ ID NO: 3937248 - DNA, 18 bp, Homo sapiens
ccgccagcctcagtgcca

SEQ ID NO: 3937249 - DNA, 19 bp, Homo sapiens
ccgccaggaggtcctcctc

SEQ ID NO: 3937250 - DNA, 22 bp, Homo sapiens
ccgccatccgggacgcttccag

SEQ ID NO: 3937251 - DNA, 23 bp, Homo sapiens
ccgccatccgggacgcttccaga

SEQ ID NO: 3937252 - DNA, 13 bp, Homo sapiens
ccgcccgaccagg

SEQ ID NO: 3937253 - DNA, 18 bp, Homo sapiens
ccgccctgggctgtctgt

SEQ ID NO: 3937254 - DNA, 21 bp, Homo sapiens
ccgccggaccgcgtagagagc

SEQ ID NO: 3937255 - DNA, 23 bp, Homo sapiens
ccgcctcaatgtggttgcaaggc

SEQ ID NO: 3937256 - DNA, 22 bp, Homo sapiens
ccgccttaatctggaaggcccc

SEQ ID NO: 3937257 - DNA, 14 bp, Homo sapiens
ccgccttcctcctc

SEQ ID NO: 3937258 - DNA, 21 bp, Homo sapiens
ccgcgtagagagccgggcccc

SEQ ID NO: 3937259 - DNA, 17 bp, Homo sapiens
ccgcgtctaccctggga

SEQ ID NO: 3937260 - DNA, 16 bp, Homo sapiens
ccgctacaccactctg

SEQ ID NO: 3937261 - DNA, 21 bp, Homo sapiens
ccgctacaccactctggcagc

SEQ ID NO: 3937262 - DNA, 21 bp, Homo sapiens
ccgctaggagagactgaaagc

SEQ ID NO: 3937263 - DNA, 17 bp, Homo sapiens
cctagagctcctgtccc

SEQ ID NO: 3937264 - DNA, 19 bp, Homo sapiens
cctagaggtgggcagctgg

SEQ ID NO: 3937265 - DNA, 22 bp, Homo sapiens
cctagaggtgggcagctgggcc

SEQ ID NO: 3937266 - DNA, 23 bp, Homo sapiens
cctagaggtgggcagctgggccc

SEQ ID NO: 3937267 - DNA, 12 bp, Homo sapiens
cctagcagtgaa

SEQ ID NO: 3937268 - DNA, 13 bp, Homo sapiens
cctagcagtgaac

SEQ ID NO: 3937269 - DNA, 15 bp, Homo sapiens
cctagccacctccca

SEQ ID NO: 3937270 - DNA, 18 bp, Homo sapiens
cctagccacctcccaccc

SEQ ID NO: 3937271 - DNA, 19 bp, Homo sapiens
cctagccacctcccacccc

SEQ ID NO: 3937272 - DNA, 13 bp, Homo sapiens
cctagcccacttg

SEQ ID NO: 3937273 - DNA, 13 bp, Homo sapiens
cctaggagttgag

SEQ ID NO: 3937274 - DNA, 20 bp, Homo sapiens
cctaggccaaatgcacaagc

SEQ ID NO: 3937275 - DNA, 23 bp, Homo sapiens
cctaggccaaatgcacaagctca

SEQ ID NO: 3937276 - DNA, 14 bp, Homo sapiens
cctaggccactcct

SEQ ID NO: 3937277 - DNA, 19 bp, Homo sapiens
cctaggccactcctccaaa

SEQ ID NO: 3937278 - DNA, 20 bp, Homo sapiens
cctaggccactcctccaaag

SEQ ID NO: 3937279 - DNA, 15 bp, Homo sapiens
cctaggccccagagc

SEQ ID NO: 3937280 - DNA, 16 bp, Homo sapiens
cctaggccccagagca

SEQ ID NO: 3937281 - DNA, 15 bp, Homo sapiens
cctaggctccacccc

SEQ ID NO: 3937282 - DNA, 15 bp, Homo sapiens
cctagtactctctgc

SEQ ID NO: 3937283 - DNA, 17 bp, Homo sapiens
cctagtggggtctccct

SEQ ID NO: 3937284 - DNA, 18 bp, Homo sapiens
cctagtggggtctccctc

SEQ ID NO: 3937285 - DNA, 21 bp, Homo sapiens
cctagtggggtctccctctcc

SEQ ID NO: 3937286 - DNA, 15 bp, Homo sapiens
cctagttttctcctc

SEQ ID NO: 3937287 - DNA, 16 bp, Homo sapiens
cctagttttctcctcc

SEQ ID NO: 3937288 - DNA, 18 bp, Homo sapiens
cctagttttctcctccca

SEQ ID NO: 3937289 - DNA, 20 bp, Homo sapiens
cctagttttctcctcccagg

SEQ ID NO: 3937290 - DNA, 23 bp, Homo sapiens
  misc_feature (5)..(5): n is a, c, g or t
  misc_feature (12)..(12): n is a, c, g or t
cctanccccccnacccccagtgt

SEQ ID NO: 3937291 - DNA, 16 bp, Homo sapiens
cctataatgtgtgtat

SEQ ID NO: 3937292 - DNA, 17 bp, Homo sapiens
cctataatgtgtgtatg

SEQ ID NO: 3937293 - DNA, 21 bp, Homo sapiens
cctataccatatgtctgcttc

SEQ ID NO: 3937294 - DNA, 22 bp, Homo sapiens
cctataccatatgtctgcttct

SEQ ID NO: 3937295 - DNA, 16 bp, Homo sapiens
cctatatagtttattg

SEQ ID NO: 3937296 - DNA, 18 bp, Homo sapiens
cctatatgatttatagtt

SEQ ID NO: 3937297 - DNA, 21 bp, Homo sapiens
aaagacgctcaagaatcctct

SEQ ID NO: 3937298 - DNA, 14 bp, Homo sapiens
aaagactaatttaa

SEQ ID NO: 3937299 - DNA, 18 bp, Homo sapiens
aaagactattcaaacagt

SEQ ID NO: 3937300 - DNA, 19 bp, Homo sapiens
aaagactattcaaacagtc

SEQ ID NO: 3937301 - DNA, 15 bp, Homo sapiens
aaagactcagtgttc

SEQ ID NO: 3937302 - DNA, 13 bp, Homo sapiens
aaagactgcagct

SEQ ID NO: 3937303 - DNA, 12 bp, Homo sapiens
aaagagaaaaaa

SEQ ID NO: 3937304 - DNA, 14 bp, Homo sapiens
aaagagaaggagcc

SEQ ID NO: 3937305 - DNA, 18 bp, Homo sapiens
aaagagaataaagacttc

SEQ ID NO: 3937306 - DNA, 10 bp, Homo sapiens
aaagagacca

SEQ ID NO: 3937307 - DNA, 14 bp, Homo sapiens
aaagagaccagcac

SEQ ID NO: 3937308 - DNA, 18 bp, Homo sapiens
aaagagagaaaacttatt

SEQ ID NO: 3937309 - DNA, 22 bp, Homo sapiens
aaagagagaaaacttatttgag

SEQ ID NO: 3937310 - DNA, 24 bp, Homo sapiens
aaagagatccaggaagcatgagtg

SEQ ID NO: 3937311 - DNA, 23 bp, Homo sapiens
aaagagccattggtttttgtagt

SEQ ID NO: 3937312 - DNA, 16 bp, Homo sapiens
aaagaggagaccctgg

SEQ ID NO: 3937313 - DNA, 19 bp, Homo sapiens
aaagaggtgaccccagggc

SEQ ID NO: 3937314 - DNA, 12 bp, Homo sapiens
aaagagttagaa

SEQ ID NO: 3937315 - DNA, 15 bp, Homo sapiens
aaagataaagatgat

SEQ ID NO: 3937316 - DNA, 22 bp, Homo sapiens
aaagatagtatcttttaaaatg

SEQ ID NO: 3937317 - DNA, 20 bp, Homo sapiens
aaagatatatgaatatgaca

SEQ ID NO: 3937318 - DNA, 16 bp, Homo sapiens
aaagatgaaaatattt

SEQ ID NO: 3937319 - DNA, 17 bp, Homo sapiens
aaagatgaaaatatttg

SEQ ID NO: 3937320 - DNA, 21 bp, Homo sapiens
aaagatggctgtgcctctgcc

SEQ ID NO: 3937321 - DNA, 10 bp, Homo sapiens
aaagatgtgt

SEQ ID NO: 3937322 - DNA, 13 bp, Homo sapiens
aaagatgtgttgt

SEQ ID NO: 3937323 - DNA, 20 bp, Homo sapiens
aaagatgtttgtcagatatg

SEQ ID NO: 3937324 - DNA, 15 bp, Homo sapiens
aaagcaaaagaagta

SEQ ID NO: 3937325 - DNA, 19 bp, Homo sapiens
aaagcaaaagaagtaaaag

SEQ ID NO: 3937326 - DNA, 12 bp, Homo sapiens
aaagcaataaaa

SEQ ID NO: 3937327 - DNA, 13 bp, Homo sapiens
aaagcaattatat

SEQ ID NO: 3937328 - DNA, 14 bp, Homo sapiens
aaagcaattgccct

SEQ ID NO: 3937329 - DNA, 17 bp, Homo sapiens
aaagcaattgccctgta

SEQ ID NO: 3937330 - DNA, 22 bp, Homo sapiens
aaagcaccagcttctccaggct

SEQ ID NO: 3937331 - DNA, 13 bp, Homo sapiens
aaagcacctgccg

SEQ ID NO: 3937332 - DNA, 23 bp, Homo sapiens
aaagcagtgtgtccttggggcac

SEQ ID NO: 3937333 - DNA, 13 bp, Homo sapiens
aaagcatgtctca

SEQ ID NO: 3937334 - DNA, 15 bp, Homo sapiens
aaagcattgtaaatg

SEQ ID NO: 3937335 - DNA, 19 bp, Homo sapiens
aaagccacaaccacataca

SEQ ID NO: 3937336 - DNA, 22 bp, Homo sapiens
aaagcccataaggccagaaact

SEQ ID NO: 3937337 - DNA, 11 bp, Homo sapiens
aaagccccacc

SEQ ID NO: 3937338 - DNA, 22 bp, Homo sapiens
aaagcccttccatgtcgcctct

SEQ ID NO: 3937339 - DNA, 15 bp, Homo sapiens
aaagcggttgcttct

SEQ ID NO: 3937340 - DNA, 21 bp, Homo sapiens
aaagcggttgcttctggctcc

SEQ ID NO: 3937341 - DNA, 13 bp, Homo sapiens
aaagctcatattt

SEQ ID NO: 3937342 - DNA, 13 bp, Homo sapiens
aaagctcctgtcc

SEQ ID NO: 3937343 - DNA, 23 bp, Homo sapiens
aaagctgatgatgtctcttgtag

SEQ ID NO: 3937344 - DNA, 16 bp, Homo sapiens
aaagctgcctgtagtt

SEQ ID NO: 3937345 - DNA, 23 bp, Homo sapiens
aaagctgctgagaatctagcctc

SEQ ID NO: 3937346 - DNA, 23 bp, Homo sapiens
aaagctgcttgactatcacatac

SEQ ID NO: 3937347 - DNA, 19 bp, Homo sapiens
aaagcttaaattgcttttg

SEQ ID NO: 3937348 - DNA, 13 bp, Homo sapiens
aaagcttattaaa

SEQ ID NO: 3937349 - DNA, 19 bp, Homo sapiens
aaagcttctatcccaggag

SEQ ID NO: 3937350 - DNA, 16 bp, Homo sapiens
aaagctttctgacaag

SEQ ID NO: 3937351 - DNA, 17 bp, Homo sapiens
aaaggaaatgtttgagt

SEQ ID NO: 3937352 - DNA, 13 bp, Homo sapiens
aaaggaaggaaaa

SEQ ID NO: 3937353 - DNA, 12 bp, Homo sapiens
aaaggagagaag

SEQ ID NO: 3937354 - DNA, 22 bp, Homo sapiens
aaaggagccggaccaagatggg

SEQ ID NO: 3937355 - DNA, 11 bp, Homo sapiens
aaaggagcctg

SEQ ID NO: 3937356 - DNA, 20 bp, Homo sapiens
aaaggatgtaaacagtgcct

SEQ ID NO: 3937357 - DNA, 14 bp, Homo sapiens
aaaggcctctgtcc

SEQ ID NO: 3937358 - DNA, 13 bp, Homo sapiens
aaaggcctggggt

SEQ ID NO: 3937359 - DNA, 19 bp, Homo sapiens
aaaggctaggtacacagct

SEQ ID NO: 3937360 - DNA, 18 bp, Homo sapiens
aaagggaagttgtgcctt

SEQ ID NO: 3937361 - DNA, 21 bp, Homo sapiens
aaagggacccgaagcccaggc

SEQ ID NO: 3937362 - DNA, 20 bp, Homo sapiens
aaagggatggcaagatgtgg

SEQ ID NO: 3937363 - DNA, 12 bp, Homo sapiens
aaagggcagcca

SEQ ID NO: 3937364 - DNA, 15 bp, Homo sapiens
aaagggcagccaggg

SEQ ID NO: 3937365 - DNA, 23 bp, Homo sapiens
aaagggcccacagtgacttttgc

SEQ ID NO: 3937366 - DNA, 22 bp, Homo sapiens
aaaggggagaagggccagccct

SEQ ID NO: 3937367 - DNA, 19 bp, Homo sapiens
aaaggtcattgtggctatc

SEQ ID NO: 3937368 - DNA, 15 bp, Homo sapiens
aaaggttcttcatcc

SEQ ID NO: 3937369 - DNA, 21 bp, Homo sapiens
aaaggttcttcatccctttcc

SEQ ID NO: 3937370 - DNA, 15 bp, Homo sapiens
aaagtaacaaggtgt

SEQ ID NO: 3937371 - DNA, 15 bp, Homo sapiens
aaagtacatttaata

SEQ ID NO: 3937372 - DNA, 14 bp, Homo sapiens
aaagtagaattata

SEQ ID NO: 3937373 - DNA, 23 bp, Homo sapiens
aaagtatatatttatttaagctt

SEQ ID NO: 3937374 - DNA, 15 bp, Homo sapiens
aaagtatattttcct

SEQ ID NO: 3937375 - DNA, 14 bp, Homo sapiens
aaagtatgtgatat

SEQ ID NO: 3937376 - DNA, 19 bp, Homo sapiens
aaagtcaacaaccatgcca

SEQ ID NO: 3937377 - DNA, 22 bp, Homo sapiens
aaagtctaaagtttacagtaaa

SEQ ID NO: 3937378 - DNA, 14 bp, Homo sapiens
aaagtcttgttaat

SEQ ID NO: 3937379 - DNA, 18 bp, Homo sapiens
aaagtgaataaacttcag

SEQ ID NO: 3937380 - DNA, 20 bp, Homo sapiens
aaagtgaataaacttcagca

SEQ ID NO: 3937381 - DNA, 21 bp, Homo sapiens
aaagtgaataaacttcagcac

SEQ ID NO: 3937382 - DNA, 15 bp, Homo sapiens
aaagtgataatttct

SEQ ID NO: 3937383 - DNA, 14 bp, Homo sapiens
aaagtgatctgtcc

SEQ ID NO: 3937384 - DNA, 15 bp, Homo sapiens
aaatgtgtattctgg

SEQ ID NO: 3937385 - DNA, 22 bp, Homo sapiens
aaatgttgttctcttctttaaa

SEQ ID NO: 3937386 - DNA, 13 bp, Homo sapiens
aaatgtttctgca

SEQ ID NO: 3937387 - DNA, 18 bp, Homo sapiens
aaatgtttttattaacaa

SEQ ID NO: 3937388 - DNA, 17 bp, Homo sapiens
aaattaacagtcctaac

SEQ ID NO: 3937389 - DNA, 15 bp, Homo sapiens
aaattactctttctc

SEQ ID NO: 3937390 - DNA, 17 bp, Homo sapiens
aaattagctgtgtgaaa

SEQ ID NO: 3937391 - DNA, 22 bp, Homo sapiens
aaattataacttaaaatatttt

SEQ ID NO: 3937392 - DNA, 20 bp, Homo sapiens
aaattatgagatgatgaaaa

SEQ ID NO: 3937393 - DNA, 14 bp, Homo sapiens
aaattatggtgaaa

SEQ ID NO: 3937394 - DNA, 21 bp, Homo sapiens
aaattatttgtgtaatagaaa

SEQ ID NO: 3937395 - DNA, 17 bp, Homo sapiens
aaattattttaaacaaa

SEQ ID NO: 3937396 - DNA, 23 bp, Homo sapiens
aaattatttttatacaccattgt

SEQ ID NO: 3937397 - DNA, 13 bp, Homo sapiens
aaattcaaaccat

SEQ ID NO: 3937398 - DNA, 23 bp, Homo sapiens
aaattcaaaccatttaattcata

SEQ ID NO: 3937399 - DNA, 22 bp, Homo sapiens
aaattcatttttttcactggag

SEQ ID NO: 3937400 - DNA, 20 bp, Homo sapiens
aaattcctaataagtttgat

SEQ ID NO: 3937401 - DNA, 18 bp, Homo sapiens
aaattcttgaagttcatg

SEQ ID NO: 3937402 - DNA, 15 bp, Homo sapiens
aaattctttatttct

SEQ ID NO: 3937403 - DNA, 11 bp, Homo sapiens
aaattcttttt

SEQ ID NO: 3937404 - DNA, 18 bp, Homo sapiens
aaattgacaacattttat

SEQ ID NO: 3937405 - DNA, 14 bp, Homo sapiens
aaattgcacaattt

SEQ ID NO: 3937406 - DNA, 14 bp, Homo sapiens
aaattgctccttga

SEQ ID NO: 3937407 - DNA, 13 bp, Homo sapiens
aaattgcttttgt

SEQ ID NO: 3937408 - DNA, 23 bp, Homo sapiens
aaattgcttttgttgtgactttt

SEQ ID NO: 3937409 - DNA, 15 bp, Homo sapiens
aaattggaattttct

SEQ ID NO: 3937410 - DNA, 22 bp, Homo sapiens
aaattggtgataagtggaaaaa

SEQ ID NO: 3937411 - DNA, 13 bp, Homo sapiens
aaattgttcctga

SEQ ID NO: 3937412 - DNA, 14 bp, Homo sapiens
aaatttaataaaaa

SEQ ID NO: 3937413 - DNA, 14 bp, Homo sapiens
aaatttgatttcta

SEQ ID NO: 3937414 - DNA, 22 bp, Homo sapiens
aaatttgtccaatggctgtaaa

SEQ ID NO: 3937415 - DNA, 10 bp, Homo sapiens
aaattttaac

SEQ ID NO: 3937416 - DNA, 12 bp, Homo sapiens
aaattttagagc

SEQ ID NO: 3937417 - DNA, 22 bp, Homo sapiens
aaattttataagcaaatttcaa

SEQ ID NO: 3937418 - DNA, 16 bp, Homo sapiens
aaatttttatttttga

SEQ ID NO: 3937419 - DNA, 17 bp, Homo sapiens
aaatttttgtcatttta

SEQ ID NO: 3937420 - DNA, 20 bp, Homo sapiens
aaattttttgatgtcagcct

SEQ ID NO: 3937421 - DNA, 13 bp, Homo sapiens
aacaaaacaacaa

SEQ ID NO: 3937422 - DNA, 17 bp, Homo sapiens
aacaaaacaagaaagaa

SEQ ID NO: 3937423 - DNA, 24 bp, Homo sapiens
aacaaacactgaatcatgttaata

SEQ ID NO: 3937424 - DNA, 15 bp, Homo sapiens
aacaacaacaataac

SEQ ID NO: 3937425 - DNA, 16 bp, Homo sapiens
aacaactaggcttcag

SEQ ID NO: 3937426 - DNA, 23 bp, Homo sapiens
aacaactccctgaacctcagttt

SEQ ID NO: 3937427 - DNA, 12 bp, Homo sapiens
aacaagaattgg

SEQ ID NO: 3937428 - DNA, 19 bp, Homo sapiens
aacaagagcgaaactccgt

SEQ ID NO: 3937429 - DNA, 19 bp, Homo sapiens
aacaaggggctgttacata

SEQ ID NO: 3937430 - DNA, 12 bp, Homo sapiens
aacaaggtgtct

SEQ ID NO: 3937431 - DNA, 16 bp, Homo sapiens
aacaaggttcttctaa

SEQ ID NO: 3937432 - DNA, 17 bp, Homo sapiens
aacaagtcacagctgca

SEQ ID NO: 3937433 - DNA, 19 bp, Homo sapiens
aacaagtcacagctgcagc

SEQ ID NO: 3937434 - DNA, 16 bp, Homo sapiens
aacaataaaacattat

SEQ ID NO: 3937435 - DNA, 13 bp, Homo sapiens
aacaataaagagc

SEQ ID NO: 3937436 - DNA, 14 bp, Homo sapiens
aacaataaagagct

SEQ ID NO: 3937437 - DNA, 12 bp, Homo sapiens
aacaataacaac

SEQ ID NO: 3937438 - DNA, 16 bp, Homo sapiens
aacaatagctattgca

SEQ ID NO: 3937439 - DNA, 17 bp, Homo sapiens
aacaatagctattgcat

SEQ ID NO: 3937440 - DNA, 16 bp, Homo sapiens
aacaatattgtctgaa

SEQ ID NO: 3937441 - DNA, 13 bp, Homo sapiens
aacaatcacactc

SEQ ID NO: 3937442 - DNA, 11 bp, Homo sapiens
aacaatgaatg

SEQ ID NO: 3937443 - DNA, 21 bp, Homo sapiens
aacaatggtttacatgaacac

SEQ ID NO: 3937444 - DNA, 12 bp, Homo sapiens
aacaatgtatgt

SEQ ID NO: 3937445 - DNA, 23 bp, Homo sapiens
aacaatgtatgtgaaagtgtaaa

SEQ ID NO: 3937446 - DNA, 17 bp, Homo sapiens
aacaattaaacagccaa

SEQ ID NO: 3937447 - DNA, 21 bp, Homo sapiens
aacaatttcctttatatttag

SEQ ID NO: 3937448 - DNA, 17 bp, Homo sapiens
aacacaagccacagaag

SEQ ID NO: 3937449 - DNA, 14 bp, Homo sapiens
aacacacaaaggta

SEQ ID NO: 3937450 - DNA, 12 bp, Homo sapiens
aacacacaacag

SEQ ID NO: 3937451 - DNA, 15 bp, Homo sapiens
aacacaccgatgcac

SEQ ID NO: 3937452 - DNA, 15 bp, Homo sapiens
aacacagcaagggtg

SEQ ID NO: 3937453 - DNA, 23 bp, Homo sapiens
aacacagcagttctgcagaggac

SEQ ID NO: 3937454 - DNA, 14 bp, Homo sapiens
aacacagctgctga

SEQ ID NO: 3937455 - DNA, 17 bp, Homo sapiens
aacacagctgctgaaga

SEQ ID NO: 3937456 - DNA, 13 bp, Homo sapiens
aacacagtttagt

SEQ ID NO: 3937457 - DNA, 19 bp, Homo sapiens
aacacagtttagtgcttta

SEQ ID NO: 3937458 - DNA, 14 bp, Homo sapiens
aacacagttttgaa

SEQ ID NO: 3937459 - DNA, 21 bp, Homo sapiens
aacacataactagaaacctga

SEQ ID NO: 3937460 - DNA, 16 bp, Homo sapiens
aacacatcagcttgcc

SEQ ID NO: 3937461 - DNA, 16 bp, Homo sapiens
aacacattacttgcac

SEQ ID NO: 3937462 - DNA, 15 bp, Homo sapiens
aacaccactttgtct

SEQ ID NO: 3937463 - DNA, 18 bp, Homo sapiens
aacaccactttgtctctg

SEQ ID NO: 3937464 - DNA, 21 bp, Homo sapiens
aacacccgccccccccatgtt

SEQ ID NO: 3937465 - DNA, 17 bp, Homo sapiens
aacacctgacacatctt

SEQ ID NO: 3937466 - DNA, 21 bp, Homo sapiens
aacacctttgttttgcactga

SEQ ID NO: 3937467 - DNA, 14 bp, Homo sapiens
aacacgcattgtac

SEQ ID NO: 3937468 - DNA, 14 bp, Homo sapiens
aacactaaaaataa

SEQ ID NO: 3937469 - DNA, 15 bp, Homo sapiens
aacactataaaggtt

SEQ ID NO: 3937470 - DNA, 16 bp, Homo sapiens
aacactcaacaataaa

SEQ ID NO: 3937471 - DNA, 20 bp, Homo sapiens
aacttatatactatttccct

SEQ ID NO: 3937472 - DNA, 13 bp, Homo sapiens
aacttatttgagt

SEQ ID NO: 3937473 - DNA, 17 bp, Homo sapiens
aacttcaaatatagaga

SEQ ID NO: 3937474 - DNA, 15 bp, Homo sapiens
aacttcataaatgtt

SEQ ID NO: 3937475 - DNA, 20 bp, Homo sapiens
aacttcatatatgaggactt

SEQ ID NO: 3937476 - DNA, 20 bp, Homo sapiens
aacttcgaccctttctctga

SEQ ID NO: 3937477 - DNA, 14 bp, Homo sapiens
aacttctaatatat

SEQ ID NO: 3937478 - DNA, 16 bp, Homo sapiens
aacttctaatatattt

SEQ ID NO: 3937479 - DNA, 16 bp, Homo sapiens
aacttgaatctgttac

SEQ ID NO: 3937480 - DNA, 13 bp, Homo sapiens
aacttgaggacac

SEQ ID NO: 3937481 - DNA, 19 bp, Homo sapiens
aacttgaggacacatgtcc

SEQ ID NO: 3937482 - DNA, 20 bp, Homo sapiens
aacttgaggacacatgtcca

SEQ ID NO: 3937483 - DNA, 16 bp, Homo sapiens
aacttgctgaatttca

SEQ ID NO: 3937484 - DNA, 17 bp, Homo sapiens
aacttggaaaaagaaag

SEQ ID NO: 3937485 - DNA, 22 bp, Homo sapiens
aacttggaaaaagaaagaaaca

SEQ ID NO: 3937486 - DNA, 15 bp, Homo sapiens
aacttgtaaatgctg

SEQ ID NO: 3937487 - DNA, 15 bp, Homo sapiens
aacttgtactatgtt

SEQ ID NO: 3937488 - DNA, 20 bp, Homo sapiens
aacttgtcaaaaaacaaaaa

SEQ ID NO: 3937489 - DNA, 17 bp, Homo sapiens
aacttgtgctgagaata

SEQ ID NO: 3937490 - DNA, 20 bp, Homo sapiens
aactttacccaaaaactaaa

SEQ ID NO: 3937491 - DNA, 22 bp, Homo sapiens
aactttagagtagcatgagaga

SEQ ID NO: 3937492 - DNA, 13 bp, Homo sapiens
aactttcattttt

SEQ ID NO: 3937493 - DNA, 18 bp, Homo sapiens
aactttctcttcatactt

SEQ ID NO: 3937494 - DNA, 17 bp, Homo sapiens
aacttttagtaaagtca

SEQ ID NO: 3937495 - DNA, 16 bp, Homo sapiens
aagaaaaaaaaaatat

SEQ ID NO: 3937496 - DNA, 23 bp, Homo sapiens
aagaaaaataccatgtctctaag

SEQ ID NO: 3937497 - DNA, 20 bp, Homo sapiens
aagaaacaggggatcaaagt

SEQ ID NO: 3937498 - DNA, 21 bp, Homo sapiens
aagaaacaggggatcaaagtt

SEQ ID NO: 3937499 - DNA, 22 bp, Homo sapiens
aagaaacaggggatcaaagttc

SEQ ID NO: 3937500 - DNA, 19 bp, Homo sapiens
aagaaactgaggaattttc

SEQ ID NO: 3937501 - DNA, 21 bp, Homo sapiens
aagaaactgaggaattttctt

SEQ ID NO: 3937502 - DNA, 16 bp, Homo sapiens
aagaaagaacggaaga

SEQ ID NO: 3937503 - DNA, 20 bp, Homo sapiens
aagaaagcacctgtttttac

SEQ ID NO: 3937504 - DNA, 23 bp, Homo sapiens
aagaaatccctgtttaatattta

SEQ ID NO: 3937505 - DNA, 16 bp, Homo sapiens
aagaaatgcaaaaatc

SEQ ID NO: 3937506 - DNA, 13 bp, Homo sapiens
aagaaatgtaagg

SEQ ID NO: 3937507 - DNA, 14 bp, Homo sapiens
aagaaatgtaaggg

SEQ ID NO: 3937508 - DNA, 23 bp, Homo sapiens
aagaactgccccatctcctccca

SEQ ID NO: 3937509 - DNA, 14 bp, Homo sapiens
aagaagagacagga

SEQ ID NO: 3937510 - DNA, 15 bp, Homo sapiens
aagaagccctgctgg

SEQ ID NO: 3937511 - DNA, 23 bp, Homo sapiens
aagaaggcacaggtgtaaatata

SEQ ID NO: 3937512 - DNA, 14 bp, Homo sapiens
aagaagtaaatttg

SEQ ID NO: 3937513 - DNA, 17 bp, Homo sapiens
aagaagtaaatttgtcc

SEQ ID NO: 3937514 - DNA, 16 bp, Homo sapiens
aagaatacagaaaatg

SEQ ID NO: 3937515 - DNA, 17 bp, Homo sapiens
aagaatactagaatggt

SEQ ID NO: 3937516 - DNA, 19 bp, Homo sapiens
aagaatataaagttaaaaa

SEQ ID NO: 3937517 - DNA, 17 bp, Homo sapiens
aagaatattcagagaat

SEQ ID NO: 3937518 - DNA, 16 bp, Homo sapiens
aagaatattctatgaa

SEQ ID NO: 3937519 - DNA, 13 bp, Homo sapiens
aagaatgagcatt

SEQ ID NO: 3937520 - DNA, 16 bp, Homo sapiens
aagaatgcaagagtgg

SEQ ID NO: 3937521 - DNA, 22 bp, Homo sapiens
aagaatgcagattcctgggcct

SEQ ID NO: 3937522 - DNA, 23 bp, Homo sapiens
aagaatgcagattcctgggcctg

SEQ ID NO: 3937523 - DNA, 15 bp, Homo sapiens
aagaattatttttgt

SEQ ID NO: 3937524 - DNA, 17 bp, Homo sapiens
aagaattatttttgtgt

SEQ ID NO: 3937525 - DNA, 18 bp, Homo sapiens
aagaattgaacccaggag

SEQ ID NO: 3937526 - DNA, 20 bp, Homo sapiens
aagaattttcagaccccagc

SEQ ID NO: 3937527 - DNA, 22 bp, Homo sapiens
aagaattttcagaccccagcgg

SEQ ID NO: 3937528 - DNA, 17 bp, Homo sapiens
aagacaaaccactgtac

SEQ ID NO: 3937529 - DNA, 20 bp, Homo sapiens
aagacaaaccactgtacata

SEQ ID NO: 3937530 - DNA, 14 bp, Homo sapiens
aagacacacctctg

SEQ ID NO: 3937531 - DNA, 16 bp, Homo sapiens
aagacagaatgtcacc

SEQ ID NO: 3937532 - DNA, 21 bp, Homo sapiens
aagacagcactacagatatca

SEQ ID NO: 3937533 - DNA, 14 bp, Homo sapiens
aagacagtgtgtgt

SEQ ID NO: 3937534 - DNA, 18 bp, Homo sapiens
aagacatgaatgcacact

SEQ ID NO: 3937535 - DNA, 18 bp, Homo sapiens
aagacatgttgtaaatta

SEQ ID NO: 3937536 - DNA, 13 bp, Homo sapiens
aagacatttttat

SEQ ID NO: 3937537 - DNA, 17 bp, Homo sapiens
aagaccacaaaaattga

SEQ ID NO: 3937538 - DNA, 15 bp, Homo sapiens
aagaccgtgtcccaa

SEQ ID NO: 3937539 - DNA, 20 bp, Homo sapiens
aagaccttctccccattctg

SEQ ID NO: 3937540 - DNA, 16 bp, Homo sapiens
aagactaatttaaaaa

SEQ ID NO: 3937541 - DNA, 20 bp, Homo sapiens
aagactatccaacttaacat

SEQ ID NO: 3937542 - DNA, 14 bp, Homo sapiens
aagactattcaaac

SEQ ID NO: 3937543 - DNA, 17 bp, Homo sapiens
aagactgcagctgctga

SEQ ID NO: 3937544 - DNA, 16 bp, Homo sapiens
aagactgttgctcaaa

SEQ ID NO: 3937545 - DNA, 17 bp, Homo sapiens
aagactgttgctcaaat

SEQ ID NO: 3937546 - DNA, 16 bp, Homo sapiens
aagacttggcaacaga

SEQ ID NO: 3937547 - DNA, 17 bp, Homo sapiens
aagacttggcaacagaa

SEQ ID NO: 3937548 - DNA, 20 bp, Homo sapiens
aagacttggcaacagaagca

SEQ ID NO: 3937549 - DNA, 17 bp, Homo sapiens
aagagaaaaagaaatgc

SEQ ID NO: 3937550 - DNA, 11 bp, Homo sapiens
aagagaagctg

SEQ ID NO: 3937551 - DNA, 12 bp, Homo sapiens
aagagaagctga

SEQ ID NO: 3937552 - DNA, 13 bp, Homo sapiens
aagagaaggagca

SEQ ID NO: 3937553 - DNA, 16 bp, Homo sapiens
aagagacactgcttgg

SEQ ID NO: 3937554 - DNA, 14 bp, Homo sapiens
aagagacagaatga

SEQ ID NO: 3937555 - DNA, 13 bp, Homo sapiens
aagagacagagcc

SEQ ID NO: 3937556 - DNA, 18 bp, Homo sapiens
aagagacagagcccccaa

SEQ ID NO: 3937557 - DNA, 19 bp, Homo sapiens
aagagactaatagagacac

SEQ ID NO: 3937558 - DNA, 14 bp, Homo sapiens
aagggtgacatccc

SEQ ID NO: 3937559 - DNA, 16 bp, Homo sapiens
aagggtgacatcccag

SEQ ID NO: 3937560 - DNA, 16 bp, Homo sapiens
aagggtgggaagcttg

SEQ ID NO: 3937561 - DNA, 18 bp, Homo sapiens
aagggttggtgggctggc

SEQ ID NO: 3937562 - DNA, 20 bp, Homo sapiens
aagggttggtgggctggccc

SEQ ID NO: 3937563 - DNA, 15 bp, Homo sapiens
aaggtagagatgtgt

SEQ ID NO: 3937564 - DNA, 18 bp, Homo sapiens
aaggtagcttacctgaca

SEQ ID NO: 3937565 - DNA, 20 bp, Homo sapiens
aaggtagcttacctgacaca

SEQ ID NO: 3937566 - DNA, 18 bp, Homo sapiens
aaggtattccttttgtgt

SEQ ID NO: 3937567 - DNA, 22 bp, Homo sapiens
aaggtattccttttgtgtacag

SEQ ID NO: 3937568 - DNA, 22 bp, Homo sapiens
aaggtcattgtggctatctgca

SEQ ID NO: 3937569 - DNA, 19 bp, Homo sapiens
aaggtctccttactctgag

SEQ ID NO: 3937570 - DNA, 20 bp, Homo sapiens
aaggtctccttactctgagc

SEQ ID NO: 3937571 - DNA, 13 bp, Homo sapiens
aaggtcttcttgt

SEQ ID NO: 3937572 - DNA, 19 bp, Homo sapiens
aaggtcttcttgtgtcctg

SEQ ID NO: 3937573 - DNA, 20 bp, Homo sapiens
aaggtcttcttgtgtcctga

SEQ ID NO: 3937574 - DNA, 11 bp, Homo sapiens
aaggtgcctgt

SEQ ID NO: 3937575 - DNA, 21 bp, Homo sapiens
aaggtgggtccaggaaggcag

SEQ ID NO: 3937576 - DNA, 16 bp, Homo sapiens
aaggttaagccctgag

SEQ ID NO: 3937577 - DNA, 16 bp, Homo sapiens
aaggttccctctgaga

SEQ ID NO: 3937578 - DNA, 16 bp, Homo sapiens
aaggttcttctaaaat

SEQ ID NO: 3937579 - DNA, 22 bp, Homo sapiens
aaggttgacaataaatgtgctt

SEQ ID NO: 3937580 - DNA, 16 bp, Homo sapiens
aagtaaaaccacagca

SEQ ID NO: 3937581 - DNA, 17 bp, Homo sapiens
aagtaaaaccacagcag

SEQ ID NO: 3937582 - DNA, 18 bp, Homo sapiens
aagtaaaaccacagcagt

SEQ ID NO: 3937583 - DNA, 12 bp, Homo sapiens
aagtaaaacttg

SEQ ID NO: 3937584 - DNA, 22 bp, Homo sapiens
aagtaagagctaagttctaagt

SEQ ID NO: 3937585 - DNA, 16 bp, Homo sapiens
aagtaatcactaaccc

SEQ ID NO: 3937586 - DNA, 21 bp, Homo sapiens
aagtaccatagaacagaactg

SEQ ID NO: 3937587 - DNA, 16 bp, Homo sapiens
aagtagaattatatct

SEQ ID NO: 3937588 - DNA, 15 bp, Homo sapiens
aagtaggaaaaataa

SEQ ID NO: 3937589 - DNA, 15 bp, Homo sapiens
aagtaggcatgaggg

SEQ ID NO: 3937590 - DNA, 12 bp, Homo sapiens
aagtagtttgta

SEQ ID NO: 3937591 - DNA, 21 bp, Homo sapiens
aagtatatagtatatttatac

SEQ ID NO: 3937592 - DNA, 23 bp, Homo sapiens
aagtatatagtatatttatactc

SEQ ID NO: 3937593 - DNA, 13 bp, Homo sapiens
aagtatgtaaaca

SEQ ID NO: 3937594 - DNA, 18 bp, Homo sapiens
aagtatgtgatatctgaa

SEQ ID NO: 3937595 - DNA, 22 bp, Homo sapiens
aagtattaggggtaatatattg

SEQ ID NO: 3937596 - DNA, 10 bp, Homo sapiens
aagtatttag

SEQ ID NO: 3937597 - DNA, 18 bp, Homo sapiens
aagtattttatctgtgtt

SEQ ID NO: 3937598 - DNA, 14 bp, Homo sapiens
aagtcaaagtaaaa

SEQ ID NO: 3937599 - DNA, 16 bp, Homo sapiens
aagtcaacactcttct

SEQ ID NO: 3937600 - DNA, 16 bp, Homo sapiens
aagtcaaccaatgtag

SEQ ID NO: 3937601 - DNA, 22 bp, Homo sapiens
aagtcaaccaatgtagaaagct

SEQ ID NO: 3937602 - DNA, 14 bp, Homo sapiens
aagtcacagctgca

SEQ ID NO: 3937603 - DNA, 16 bp, Homo sapiens
aagtcacagctgcagc

SEQ ID NO: 3937604 - DNA, 19 bp, Homo sapiens
aagtcacagctgcagctgg

SEQ ID NO: 3937605 - DNA, 22 bp, Homo sapiens
aagtcacagctgcagctgggcc

SEQ ID NO: 3937606 - DNA, 13 bp, Homo sapiens
aagtcaccaaaat

SEQ ID NO: 3937607 - DNA, 19 bp, Homo sapiens
aagtcaccactccattccc

SEQ ID NO: 3937608 - DNA, 14 bp, Homo sapiens
aagtcactgcacag

SEQ ID NO: 3937609 - DNA, 20 bp, Homo sapiens
aagtcattgtcgctcagcaa

SEQ ID NO: 3937610 - DNA, 19 bp, Homo sapiens
aagtccaacctgcctgtgc

SEQ ID NO: 3937611 - DNA, 16 bp, Homo sapiens
aagtccccgtccccca

SEQ ID NO: 3937612 - DNA, 22 bp, Homo sapiens
aagtcgtccttactcctgtggg

SEQ ID NO: 3937613 - DNA, 19 bp, Homo sapiens
aagtctaaagtttacagta

SEQ ID NO: 3937614 - DNA, 20 bp, Homo sapiens
aagtctaaagtttacagtaa

SEQ ID NO: 3937615 - DNA, 21 bp, Homo sapiens
aagtctaaagtttacagtaaa

SEQ ID NO: 3937616 - DNA, 21 bp, Homo sapiens
aagtctattttaaagacgctc

SEQ ID NO: 3937617 - DNA, 13 bp, Homo sapiens
aagtctctgctgc

SEQ ID NO: 3937618 - DNA, 17 bp, Homo sapiens
aagtctgggatgtagaa

SEQ ID NO: 3937619 - DNA, 18 bp, Homo sapiens
aagtctgggatgtagaac

SEQ ID NO: 3937620 - DNA, 15 bp, Homo sapiens
aagtctgtgtccaat

SEQ ID NO: 3937621 - DNA, 17 bp, Homo sapiens
aagtctgtgtccaatta

SEQ ID NO: 3937622 - DNA, 22 bp, Homo sapiens
aagtctgtgtgatgaactttct

SEQ ID NO: 3937623 - DNA, 23 bp, Homo sapiens
aagtcttaaaataacttatatca

SEQ ID NO: 3937624 - DNA, 17 bp, Homo sapiens
aagtgaagccccttgtc

SEQ ID NO: 3937625 - DNA, 19 bp, Homo sapiens
aagtgaagccccttgtcct

SEQ ID NO: 3937626 - DNA, 12 bp, Homo sapiens
aagtgaataaac

SEQ ID NO: 3937627 - DNA, 13 bp, Homo sapiens
aagtgaataaact

SEQ ID NO: 3937628 - DNA, 17 bp, Homo sapiens
aagtgaataaacttcag

SEQ ID NO: 3937629 - DNA, 14 bp, Homo sapiens
aagtgaatccttaa

SEQ ID NO: 3937630 - DNA, 18 bp, Homo sapiens
aagtgaatgctcaagttt

SEQ ID NO: 3937631 - DNA, 20 bp, Homo sapiens
aagtgactaccagaaagtga

SEQ ID NO: 3937632 - DNA, 22 bp, Homo sapiens
aagtgactaccagaaagtgagg

SEQ ID NO: 3937633 - DNA, 18 bp, Homo sapiens
aagtgagcgattagttga

SEQ ID NO: 3937634 - DNA, 15 bp, Homo sapiens
aagtgataatttctg

SEQ ID NO: 3937635 - DNA, 16 bp, Homo sapiens
aagtgatatcacctct

SEQ ID NO: 3937636 - DNA, 20 bp, Homo sapiens
aagtgatctgtcccctctcc

SEQ ID NO: 3937637 - DNA, 15 bp, Homo sapiens
aagtgccatcccaca

SEQ ID NO: 3937638 - DNA, 16 bp, Homo sapiens
aagtgccatcccacat

SEQ ID NO: 3937639 - DNA, 22 bp, Homo sapiens
aagtgccatcccacattcggac

SEQ ID NO: 3937640 - DNA, 13 bp, Homo sapiens
aagtgctgtttga

SEQ ID NO: 3937641 - DNA, 18 bp, Homo sapiens
aagtgctgtttgagatgt

SEQ ID NO: 3937642 - DNA, 18 bp, Homo sapiens
aagtgcttagaaagttat

SEQ ID NO: 3937643 - DNA, 10 bp, Homo sapiens
aagtggaaaa

SEQ ID NO: 3937644 - DNA, 17 bp, Homo sapiens
aagtggaaaaaagagaa

SEQ ID NO: 3937645 - DNA, 19 bp, Homo sapiens
aatctggagagctagaacc

SEQ ID NO: 3937646 - DNA, 14 bp, Homo sapiens
aatctggctcctgt

SEQ ID NO: 3937647 - DNA, 15 bp, Homo sapiens
aatcttaaaagtgta

SEQ ID NO: 3937648 - DNA, 19 bp, Homo sapiens
aatcttggggggtttttac

SEQ ID NO: 3937649 - DNA, 13 bp, Homo sapiens
aatctttgctgta

SEQ ID NO: 3937650 - DNA, 15 bp, Homo sapiens
aatgaaaaggaagtt

SEQ ID NO: 3937651 - DNA, 15 bp, Homo sapiens
aatgaaaataagtga

SEQ ID NO: 3937652 - DNA, 20 bp, Homo sapiens
aatgaaaattgtatgttaag

SEQ ID NO: 3937653 - DNA, 12 bp, Homo sapiens
aatgaaaccaaa

SEQ ID NO: 3937654 - DNA, 14 bp, Homo sapiens
aatgaaaccaaagc

SEQ ID NO: 3937655 - DNA, 17 bp, Homo sapiens
aatgaaatgctctcctt

SEQ ID NO: 3937656 - DNA, 15 bp, Homo sapiens
aatgaaatgtttttg

SEQ ID NO: 3937657 - DNA, 15 bp, Homo sapiens
aatgaacagcagaaa

SEQ ID NO: 3937658 - DNA, 22 bp, Homo sapiens
aatgaaggttaggatttaacag

SEQ ID NO: 3937659 - DNA, 21 bp, Homo sapiens
aatgaattctctctaaaaata

SEQ ID NO: 3937660 - DNA, 23 bp, Homo sapiens
aatgacacggtaggccaagctga

SEQ ID NO: 3937661 - DNA, 21 bp, Homo sapiens
aatgacagccgctgatgtctg

SEQ ID NO: 3937662 - DNA, 13 bp, Homo sapiens
aatgacagggatg

SEQ ID NO: 3937663 - DNA, 16 bp, Homo sapiens
aatgacatgcactgac

SEQ ID NO: 3937664 - DNA, 19 bp, Homo sapiens
aatgacatgcactgaccct

SEQ ID NO: 3937665 - DNA, 19 bp, Homo sapiens
aatgaccaagaaaaagaaa

SEQ ID NO: 3937666 - DNA, 19 bp, Homo sapiens
aatgaccacgggcctcagt

SEQ ID NO: 3937667 - DNA, 22 bp, Homo sapiens
aatgactgtctaagagatctgg

SEQ ID NO: 3937668 - DNA, 16 bp, Homo sapiens
aatgagacttgctctc

SEQ ID NO: 3937669 - DNA, 17 bp, Homo sapiens
aatgagatcccgcctct

SEQ ID NO: 3937670 - DNA, 22 bp, Homo sapiens
aatgagcattgagacggtgctc

SEQ ID NO: 3937671 - DNA, 18 bp, Homo sapiens
aatgaggagagaaggaca

SEQ ID NO: 3937672 - DNA, 21 bp, Homo sapiens
aatgagggaaattgctatttt

SEQ ID NO: 3937673 - DNA, 14 bp, Homo sapiens
aatgagggactgga

SEQ ID NO: 3937674 - DNA, 21 bp, Homo sapiens
aatgagttcaactttgaggga

SEQ ID NO: 3937675 - DNA, 18 bp, Homo sapiens
aatgatatccagtaagca

SEQ ID NO: 3937676 - DNA, 16 bp, Homo sapiens
aatgatcataagtcta

SEQ ID NO: 3937677 - DNA, 15 bp, Homo sapiens
aatgatgtatgattt

SEQ ID NO: 3937678 - DNA, 23 bp, Homo sapiens
aatgattattttcattacaatgg

SEQ ID NO: 3937679 - DNA, 18 bp, Homo sapiens
aatgattccctcttgcta

SEQ ID NO: 3937680 - DNA, 20 bp, Homo sapiens
aatgattgtaaaatagcttg

SEQ ID NO: 3937681 - DNA, 22 bp, Homo sapiens
aatgatttcatgctatctctgt

SEQ ID NO: 3937682 - DNA, 20 bp, Homo sapiens
aatgcaaacacacaaaggta

SEQ ID NO: 3937683 - DNA, 12 bp, Homo sapiens
aatgcacaattt

SEQ ID NO: 3937684 - DNA, 15 bp, Homo sapiens
aatgcacaatttaga

SEQ ID NO: 3937685 - DNA, 19 bp, Homo sapiens
aatgcacaatttagaaaac

SEQ ID NO: 3937686 - DNA, 17 bp, Homo sapiens
aatgcacactagcctct

SEQ ID NO: 3937687 - DNA, 17 bp, Homo sapiens
aatgcagattcctgggc

SEQ ID NO: 3937688 - DNA, 21 bp, Homo sapiens
aatgcagattcctgggcctgt

SEQ ID NO: 3937689 - DNA, 16 bp, Homo sapiens
aatgcagtccagaata

SEQ ID NO: 3937690 - DNA, 19 bp, Homo sapiens
aatgcagtccagaataagt

SEQ ID NO: 3937691 - DNA, 13 bp, Homo sapiens
aatgcatgatttt

SEQ ID NO: 3937692 - DNA, 20 bp, Homo sapiens
aatgcatgattttatacata

SEQ ID NO: 3937693 - DNA, 22 bp, Homo sapiens
aatgcattataggatcatttgt

SEQ ID NO: 3937694 - DNA, 13 bp, Homo sapiens
aatgccaagataa

SEQ ID NO: 3937695 - DNA, 20 bp, Homo sapiens
aatgcggccgcattccctga

SEQ ID NO: 3937696 - DNA, 19 bp, Homo sapiens
aatgctattgaaattactg

SEQ ID NO: 3937697 - DNA, 22 bp, Homo sapiens
aatgctcccatctcctgatttc

SEQ ID NO: 3937698 - DNA, 16 bp, Homo sapiens
aatgctcgtgtgattt

SEQ ID NO: 3937699 - DNA, 13 bp, Homo sapiens
aatgctctccttt

SEQ ID NO: 3937700 - DNA, 14 bp, Homo sapiens
aatgcttggcactc

SEQ ID NO: 3937701 - DNA, 15 bp, Homo sapiens
aatgctttccaaaac

SEQ ID NO: 3937702 - DNA, 11 bp, Homo sapiens
aatgctttttg

SEQ ID NO: 3937703 - DNA, 14 bp, Homo sapiens
aatgctttttgaat

SEQ ID NO: 3937704 - DNA, 16 bp, Homo sapiens
aatggaaacagggcag

SEQ ID NO: 3937705 - DNA, 22 bp, Homo sapiens
aatggaaacagggcagtgacaa

SEQ ID NO: 3937706 - DNA, 22 bp, Homo sapiens
aatggaaatcatcgaaaattca

SEQ ID NO: 3937707 - DNA, 18 bp, Homo sapiens
aatggaagagaaatctca

SEQ ID NO: 3937708 - DNA, 20 bp, Homo sapiens
aatggaaggtttgtatattg

SEQ ID NO: 3937709 - DNA, 19 bp, Homo sapiens
aatggaatcagcttttaat

SEQ ID NO: 3937710 - DNA, 21 bp, Homo sapiens
aatggaatcagcttttaataa

SEQ ID NO: 3937711 - DNA, 15 bp, Homo sapiens
aatggacttcaaatt

SEQ ID NO: 3937712 - DNA, 13 bp, Homo sapiens
aatggagggtggg

SEQ ID NO: 3937713 - DNA, 15 bp, Homo sapiens
aatggagtgggagat

SEQ ID NO: 3937714 - DNA, 21 bp, Homo sapiens
aatggagtgggagatcagcca

SEQ ID NO: 3937715 - DNA, 23 bp, Homo sapiens
aatggcaaagcggttgcttctgg

SEQ ID NO: 3937716 - DNA, 12 bp, Homo sapiens
aatggcactgat

SEQ ID NO: 3937717 - DNA, 19 bp, Homo sapiens
aatggcagcagttccatga

SEQ ID NO: 3937718 - DNA, 22 bp, Homo sapiens
aatggcagcagttccatgaaga

SEQ ID NO: 3937719 - DNA, 18 bp, Homo sapiens
aatggcagctagactgga

SEQ ID NO: 3937720 - DNA, 17 bp, Homo sapiens
aatggccatttgctttt

SEQ ID NO: 3937721 - DNA, 14 bp, Homo sapiens
aatgggagggggct

SEQ ID NO: 3937722 - DNA, 20 bp, Homo sapiens
aatgggccaattaaaatata

SEQ ID NO: 3937723 - DNA, 13 bp, Homo sapiens
aatgggcctgccc

SEQ ID NO: 3937724 - DNA, 16 bp, Homo sapiens
aatggtccagggttga

SEQ ID NO: 3937725 - DNA, 21 bp, Homo sapiens
aatggtcttctgccagcccat

SEQ ID NO: 3937726 - DNA, 14 bp, Homo sapiens
aatggtgtgggaga

SEQ ID NO: 3937727 - DNA, 21 bp, Homo sapiens
aatggttccatgcctgagggt

SEQ ID NO: 3937728 - DNA, 15 bp, Homo sapiens
aatggttgccttaaa

SEQ ID NO: 3937729 - DNA, 14 bp, Homo sapiens
aatggtttacatga

SEQ ID NO: 3937730 - DNA, 15 bp, Homo sapiens
aatgtaacttttgta

SEQ ID NO: 3937731 - DNA, 22 bp, Homo sapiens
acaaggaccctgttttccacac

SEQ ID NO: 3937732 - DNA, 13 bp, Homo sapiens
acaaggctgggca

SEQ ID NO: 3937733 - DNA, 23 bp, Homo sapiens
acaaggctgggcacctctagtgc

SEQ ID NO: 3937734 - DNA, 21 bp, Homo sapiens
acaagggctgacctgcctctc

SEQ ID NO: 3937735 - DNA, 20 bp, Homo sapiens
acaaggtcaggagttcgaga

SEQ ID NO: 3937736 - DNA, 23 bp, Homo sapiens
acaagtatgaataaagacaccta

SEQ ID NO: 3937737 - DNA, 15 bp, Homo sapiens
acaagtggagggggt

SEQ ID NO: 3937738 - DNA, 13 bp, Homo sapiens
acaagttttgtat

SEQ ID NO: 3937739 - DNA, 14 bp, Homo sapiens
acaataaagactga

SEQ ID NO: 3937740 - DNA, 14 bp, Homo sapiens
acaataaagagctc

SEQ ID NO: 3937741 - DNA, 18 bp, Homo sapiens
acaataaatattctgcat

SEQ ID NO: 3937742 - DNA, 12 bp, Homo sapiens
acaataaatgct

SEQ ID NO: 3937743 - DNA, 13 bp, Homo sapiens
acaataacaacaa

SEQ ID NO: 3937744 - DNA, 15 bp, Homo sapiens
acaataacaacaatg

SEQ ID NO: 3937745 - DNA, 17 bp, Homo sapiens
acaataatgagttcact

SEQ ID NO: 3937746 - DNA, 15 bp, Homo sapiens
acaatatataaaaat

SEQ ID NO: 3937747 - DNA, 17 bp, Homo sapiens
acaatatgattttaaat

SEQ ID NO: 3937748 - DNA, 16 bp, Homo sapiens
acaatatgtttctaaa

SEQ ID NO: 3937749 - DNA, 17 bp, Homo sapiens
acaatattttgtggctt

SEQ ID NO: 3937750 - DNA, 12 bp, Homo sapiens
acaatcacactc

SEQ ID NO: 3937751 - DNA, 17 bp, Homo sapiens
acaatccactctcagga

SEQ ID NO: 3937752 - DNA, 18 bp, Homo sapiens
acaatccactctcaggag

SEQ ID NO: 3937753 - DNA, 20 bp, Homo sapiens
acaatcctgaagaaaccaca

SEQ ID NO: 3937754 - DNA, 22 bp, Homo sapiens
acaatcctttgagttatagttt

SEQ ID NO: 3937755 - DNA, 21 bp, Homo sapiens
acaatctttccttgtctctca

SEQ ID NO: 3937756 - DNA, 18 bp, Homo sapiens
acaatgcaatgaaacaga

SEQ ID NO: 3937757 - DNA, 14 bp, Homo sapiens
acaatgcctctccc

SEQ ID NO: 3937758 - DNA, 17 bp, Homo sapiens
acaatggggtgggccca

SEQ ID NO: 3937759 - DNA, 21 bp, Homo sapiens
acaatggtttacatgaacaca

SEQ ID NO: 3937760 - DNA, 20 bp, Homo sapiens
acaatgtatgtgaaagtgta

SEQ ID NO: 3937761 - DNA, 20 bp, Homo sapiens
acaatgtttcagaagcccca

SEQ ID NO: 3937762 - DNA, 20 bp, Homo sapiens
acaattaaacagccaaataa

SEQ ID NO: 3937763 - DNA, 14 bp, Homo sapiens
acaattactaaatt

SEQ ID NO: 3937764 - DNA, 17 bp, Homo sapiens
acaattactaaattgta

SEQ ID NO: 3937765 - DNA, 17 bp, Homo sapiens
acaattattgtacacta

SEQ ID NO: 3937766 - DNA, 21 bp, Homo sapiens
acaattattgtacactaacat

SEQ ID NO: 3937767 - DNA, 21 bp, Homo sapiens
acaattgatacttcaggtgct

SEQ ID NO: 3937768 - DNA, 20 bp, Homo sapiens
acaatttagaaaacattcat

SEQ ID NO: 3937769 - DNA, 23 bp, Homo sapiens
acaatttagaaaacattcatcca

SEQ ID NO: 3937770 - DNA, 16 bp, Homo sapiens
acaatttcctttatat

SEQ ID NO: 3937771 - DNA, 18 bp, Homo sapiens
acaatttgagcaattcat

SEQ ID NO: 3937772 - DNA, 19 bp, Homo sapiens
acaatttgagcaattcatt

SEQ ID NO: 3937773 - DNA, 23 bp, Homo sapiens
acaatttgcactgttacttttta

SEQ ID NO: 3937774 - DNA, 22 bp, Homo sapiens
acaattttcaggtttcttaaaa

SEQ ID NO: 3937775 - DNA, 22 bp, Homo sapiens
acacaaaccacaactgacacag

SEQ ID NO: 3937776 - DNA, 14 bp, Homo sapiens
acacaagccacaga

SEQ ID NO: 3937777 - DNA, 16 bp, Homo sapiens
acacaaggctgggcac

SEQ ID NO: 3937778 - DNA, 14 bp, Homo sapiens
acacaagtaaacat

SEQ ID NO: 3937779 - DNA, 22 bp, Homo sapiens
acacaatgctattgaaattact

SEQ ID NO: 3937780 - DNA, 15 bp, Homo sapiens
acacaattaattgtc

SEQ ID NO: 3937781 - DNA, 19 bp, Homo sapiens
acacaattgatacttcagg

SEQ ID NO: 3937782 - DNA, 23 bp, Homo sapiens
acacaattgatacttcaggtgct

SEQ ID NO: 3937783 - DNA, 12 bp, Homo sapiens
acacacacacac

SEQ ID NO: 3937784 - DNA, 15 bp, Homo sapiens
acacacacacacata

SEQ ID NO: 3937785 - DNA, 14 bp, Homo sapiens
acacacacagatgt

SEQ ID NO: 3937786 - DNA, 11 bp, Homo sapiens
acacacacata

SEQ ID NO: 3937787 - DNA, 13 bp, Homo sapiens
acacacagaggaa

SEQ ID NO: 3937788 - DNA, 22 bp, Homo sapiens
acacacagatggtcacacagag

SEQ ID NO: 3937789 - DNA, 13 bp, Homo sapiens
acacacatataca

SEQ ID NO: 3937790 - DNA, 15 bp, Homo sapiens
acacacctcaccaga

SEQ ID NO: 3937791 - DNA, 14 bp, Homo sapiens
acacacggatgcac

SEQ ID NO: 3937792 - DNA, 21 bp, Homo sapiens
acacacgtatttatatttgga

SEQ ID NO: 3937793 - DNA, 12 bp, Homo sapiens
acacactgtaaa

SEQ ID NO: 3937794 - DNA, 13 bp, Homo sapiens
acacactgtaaat

SEQ ID NO: 3937795 - DNA, 21 bp, Homo sapiens
acacactgtaaatatccacag

SEQ ID NO: 3937796 - DNA, 16 bp, Homo sapiens
acacagaaatatatat

SEQ ID NO: 3937797 - DNA, 21 bp, Homo sapiens
acacagaaatatatatacata

SEQ ID NO: 3937798 - DNA, 23 bp, Homo sapiens
acacagactgcgatttgtcccag

SEQ ID NO: 3937799 - DNA, 13 bp, Homo sapiens
acacagaggaaga

SEQ ID NO: 3937800 - DNA, 21 bp, Homo sapiens
acacagaggaagagcaggcac

SEQ ID NO: 3937801 - DNA, 21 bp, Homo sapiens
acacagaggttttaaacagtc

SEQ ID NO: 3937802 - DNA, 19 bp, Homo sapiens
acacagatatacacatgga

SEQ ID NO: 3937803 - DNA, 21 bp, Homo sapiens
acacagatggtcacacagaga

SEQ ID NO: 3937804 - DNA, 18 bp, Homo sapiens
acacagcagcactgcaga

SEQ ID NO: 3937805 - DNA, 13 bp, Homo sapiens
acacagcccaaga

SEQ ID NO: 3937806 - DNA, 17 bp, Homo sapiens
acacagcgtccctagca

SEQ ID NO: 3937807 - DNA, 16 bp, Homo sapiens
acacaggcatttcctg

SEQ ID NO: 3937808 - DNA, 18 bp, Homo sapiens
acacaggcatttcctggg

SEQ ID NO: 3937809 - DNA, 12 bp, Homo sapiens
acacaggcctgt

SEQ ID NO: 3937810 - DNA, 16 bp, Homo sapiens
acacaggcctgtgtag

SEQ ID NO: 3937811 - DNA, 16 bp, Homo sapiens
acacagggctctttga

SEQ ID NO: 3937812 - DNA, 15 bp, Homo sapiens
acacagggttttgta

SEQ ID NO: 3937813 - DNA, 17 bp, Homo sapiens
acacaggtcctgaaagt

SEQ ID NO: 3937814 - DNA, 23 bp, Homo sapiens
acacaggtcctgaaagtctgtgt

SEQ ID NO: 3937815 - DNA, 24 bp, Homo sapiens
acacagtaaaaacttgtactatgt

SEQ ID NO: 3937816 - DNA, 22 bp, Homo sapiens
acacagtgggaactctgacaag

SEQ ID NO: 3937817 - DNA, 16 bp, Homo sapiens
acaggaaaatcctctg

SEQ ID NO: 3937818 - DNA, 23 bp, Homo sapiens
acaggaaaatcctctggctggct

SEQ ID NO: 3937819 - DNA, 17 bp, Homo sapiens
acaggaaagccctcccc

SEQ ID NO: 3937820 - DNA, 19 bp, Homo sapiens
acaggaaagccctccccct

SEQ ID NO: 3937821 - DNA, 19 bp, Homo sapiens
acaggactaacactcagaa

SEQ ID NO: 3937822 - DNA, 20 bp, Homo sapiens
acaggactaacactcagaag

SEQ ID NO: 3937823 - DNA, 23 bp, Homo sapiens
acaggactaacactcagaagcct

SEQ ID NO: 3937824 - DNA, 16 bp, Homo sapiens
acaggactctgcctcc

SEQ ID NO: 3937825 - DNA, 19 bp, Homo sapiens
acaggaggggcccacaatg

SEQ ID NO: 3937826 - DNA, 17 bp, Homo sapiens
acaggaggttgtggatg

SEQ ID NO: 3937827 - DNA, 22 bp, Homo sapiens
acaggatcctattctcaccagg

SEQ ID NO: 3937828 - DNA, 12 bp, Homo sapiens
acaggcaattcc

SEQ ID NO: 3937829 - DNA, 22 bp, Homo sapiens
acaggcccaagagatgaagagt

SEQ ID NO: 3937830 - DNA, 22 bp, Homo sapiens
acaggcccggcgcggtggctca

SEQ ID NO: 3937831 - DNA, 13 bp, Homo sapiens
acaggcccttcct

SEQ ID NO: 3937832 - DNA, 22 bp, Homo sapiens
acaggcccttcctctccactgc

SEQ ID NO: 3937833 - DNA, 13 bp, Homo sapiens
acaggcccttggg

SEQ ID NO: 3937834 - DNA, 20 bp, Homo sapiens
acagggaaggcaggcagggc

SEQ ID NO: 3937835 - DNA, 22 bp, Homo sapiens
acagggaaggcaggcagggctc

SEQ ID NO: 3937836 - DNA, 17 bp, Homo sapiens
acagggagcccctagga

SEQ ID NO: 3937837 - DNA, 18 bp, Homo sapiens
acagggagcccctaggaa

SEQ ID NO: 3937838 - DNA, 19 bp, Homo sapiens
acagggcaatcttgtccac

SEQ ID NO: 3937839 - DNA, 14 bp, Homo sapiens
acagggcagtgaca

SEQ ID NO: 3937840 - DNA, 16 bp, Homo sapiens
acaggggatcaaagtt

SEQ ID NO: 3937841 - DNA, 15 bp, Homo sapiens
acaggggcaggcctg

SEQ ID NO: 3937842 - DNA, 17 bp, Homo sapiens
acaggggcaggcctggg

SEQ ID NO: 3937843 - DNA, 22 bp, Homo sapiens
acagggtggaccccctgagtca

SEQ ID NO: 3937844 - DNA, 13 bp, Homo sapiens
acagggttttgta

SEQ ID NO: 3937845 - DNA, 15 bp, Homo sapiens
acaggtctagacttt

SEQ ID NO: 3937846 - DNA, 22 bp, Homo sapiens
acaggtgcaagccactatgtcc

SEQ ID NO: 3937847 - DNA, 18 bp, Homo sapiens
acaggtgtggtgtaattt

SEQ ID NO: 3937848 - DNA, 16 bp, Homo sapiens
acaggttcccagcagc

SEQ ID NO: 3937849 - DNA, 22 bp, Homo sapiens
acaggttcccagcagctgggcc

SEQ ID NO: 3937850 - DNA, 20 bp, Homo sapiens
acagtaaaaacttgtactat

SEQ ID NO: 3937851 - DNA, 23 bp, Homo sapiens
acagtaaaaacttgtactatgtt

SEQ ID NO: 3937852 - DNA, 12 bp, Homo sapiens
acagtaaacatt

SEQ ID NO: 3937853 - DNA, 22 bp, Homo sapiens
acagtaaagtttaaaaaataca

SEQ ID NO: 3937854 - DNA, 12 bp, Homo sapiens
acagtaaataaa

SEQ ID NO: 3937855 - DNA, 13 bp, Homo sapiens
acagtaaataaat

SEQ ID NO: 3937856 - DNA, 18 bp, Homo sapiens
acagtaaataaattgttt

SEQ ID NO: 3937857 - DNA, 19 bp, Homo sapiens
acagtcctaactggtatag

SEQ ID NO: 3937858 - DNA, 18 bp, Homo sapiens
acagtcctcacagcctct

SEQ ID NO: 3937859 - DNA, 19 bp, Homo sapiens
acagtcctcacagcctctc

SEQ ID NO: 3937860 - DNA, 17 bp, Homo sapiens
acagtctcagtccagat

SEQ ID NO: 3937861 - DNA, 20 bp, Homo sapiens
acagtgactttacaggaggt

SEQ ID NO: 3937862 - DNA, 13 bp, Homo sapiens
acagtgagccaag

SEQ ID NO: 3937863 - DNA, 12 bp, Homo sapiens
acagtgagcctg

SEQ ID NO: 3937864 - DNA, 17 bp, Homo sapiens
acagtgagcctgaattt

SEQ ID NO: 3937865 - DNA, 14 bp, Homo sapiens
acagtgaggagggt

SEQ ID NO: 3937866 - DNA, 11 bp, Homo sapiens
acagtgcctgc

SEQ ID NO: 3937867 - DNA, 14 bp, Homo sapiens
acagtgctgccctg

SEQ ID NO: 3937868 - DNA, 15 bp, Homo sapiens
acagtgctgccctgc

SEQ ID NO: 3937869 - DNA, 16 bp, Homo sapiens
acagtggatcatgaaa

SEQ ID NO: 3937870 - DNA, 19 bp, Homo sapiens
acagtggcacggagagaag

SEQ ID NO: 3937871 - DNA, 22 bp, Homo sapiens
acagtggcacggagagaaggcc

SEQ ID NO: 3937872 - DNA, 19 bp, Homo sapiens
acagtgggaactctgacaa

SEQ ID NO: 3937873 - DNA, 17 bp, Homo sapiens
acagtgggtggcacctc

SEQ ID NO: 3937874 - DNA, 21 bp, Homo sapiens
acagtgggtggcacctcctga

SEQ ID NO: 3937875 - DNA, 16 bp, Homo sapiens
acagtgttattttctt

SEQ ID NO: 3937876 - DNA, 22 bp, Homo sapiens
acagtgttattttctttgaaat

SEQ ID NO: 3937877 - DNA, 9 bp, Homo sapiens
acagtgttt

SEQ ID NO: 3937878 - DNA, 19 bp, Homo sapiens
acagtgtttcgacagctga

SEQ ID NO: 3937879 - DNA, 16 bp, Homo sapiens
acagttaactctccca

SEQ ID NO: 3937880 - DNA, 14 bp, Homo sapiens
acagttatttatag

SEQ ID NO: 3937881 - DNA, 12 bp, Homo sapiens
acagttcaagaa

SEQ ID NO: 3937882 - DNA, 21 bp, Homo sapiens
acagttcagttcctctttgca

SEQ ID NO: 3937883 - DNA, 19 bp, Homo sapiens
acagttcttggtgactgtc

SEQ ID NO: 3937884 - DNA, 22 bp, Homo sapiens
acagttcttggtgactgtccca

SEQ ID NO: 3937885 - DNA, 22 bp, Homo sapiens
acagttggcagagaaggcctct

SEQ ID NO: 3937886 - DNA, 21 bp, Homo sapiens
acagttgtctattctgagcct

SEQ ID NO: 3937887 - DNA, 19 bp, Homo sapiens
acagttttctgagaaagac

SEQ ID NO: 3937888 - DNA, 15 bp, Homo sapiens
acagttttgaaagaa

SEQ ID NO: 3937889 - DNA, 23 bp, Homo sapiens
acagttttgtcagtctttcttag

SEQ ID NO: 3937890 - DNA, 13 bp, Homo sapiens
acataaaatatac

SEQ ID NO: 3937891 - DNA, 14 bp, Homo sapiens
acataaaatctgtg

SEQ ID NO: 3937892 - DNA, 17 bp, Homo sapiens
acataaaatctgtgaat

SEQ ID NO: 3937893 - DNA, 18 bp, Homo sapiens
acataaagcaaatagaca

SEQ ID NO: 3937894 - DNA, 12 bp, Homo sapiens
acataacaagaa

SEQ ID NO: 3937895 - DNA, 19 bp, Homo sapiens
acataagaccgtgtcccaa

SEQ ID NO: 3937896 - DNA, 15 bp, Homo sapiens
acataaggagaatgt

SEQ ID NO: 3937897 - DNA, 16 bp, Homo sapiens
acataatcaaagctac

SEQ ID NO: 3937898 - DNA, 17 bp, Homo sapiens
acatacaacacaaagag

SEQ ID NO: 3937899 - DNA, 13 bp, Homo sapiens
acatacaatttgc

SEQ ID NO: 3937900 - DNA, 14 bp, Homo sapiens
acatacaatttgca

SEQ ID NO: 3937901 - DNA, 14 bp, Homo sapiens
acatacatacacat

SEQ ID NO: 3937902 - DNA, 14 bp, Homo sapiens
acatacatacatac

SEQ ID NO: 3937903 - DNA, 15 bp, Homo sapiens
acatacatacataca

SEQ ID NO: 3937904 - DNA, 19 bp, Homo sapiens
accactagggtcctggccc

SEQ ID NO: 3937905 - DNA, 21 bp, Homo sapiens
accactagggtcctggccctc

SEQ ID NO: 3937906 - DNA, 14 bp, Homo sapiens
accactctggcagc

SEQ ID NO: 3937907 - DNA, 13 bp, Homo sapiens
accactgccctgc

SEQ ID NO: 3937908 - DNA, 19 bp, Homo sapiens
accactgccctgcctgccc

SEQ ID NO: 3937909 - DNA, 14 bp, Homo sapiens
accactgtacatat

SEQ ID NO: 3937910 - DNA, 17 bp, Homo sapiens
accagaaaacaaatctt

SEQ ID NO: 3937911 - DNA, 13 bp, Homo sapiens
accagaacaaggt

SEQ ID NO: 3937912 - DNA, 14 bp, Homo sapiens
accagaatcataat

SEQ ID NO: 3937913 - DNA, 17 bp, Homo sapiens
accagacctagacctgg

SEQ ID NO: 3937914 - DNA, 18 bp, Homo sapiens
accagacctagacctggg

SEQ ID NO: 3937915 - DNA, 19 bp, Homo sapiens
accagacctagacctgggc

SEQ ID NO: 3937916 - DNA, 21 bp, Homo sapiens
accagactgtggagaaataaa

SEQ ID NO: 3937917 - DNA, 14 bp, Homo sapiens
accagatcactcaa

SEQ ID NO: 3937918 - DNA, 20 bp, Homo sapiens
accagatgaaataatgttct

SEQ ID NO: 3937919 - DNA, 23 bp, Homo sapiens
accagcaacatctcgagccccct

SEQ ID NO: 3937920 - DNA, 12 bp, Homo sapiens
accagcagaaaa

SEQ ID NO: 3937921 - DNA, 14 bp, Homo sapiens
accagcagaaaagt

SEQ ID NO: 3937922 - DNA, 22 bp, Homo sapiens
accagcagaaaagtgcttagaa

SEQ ID NO: 3937923 - DNA, 18 bp, Homo sapiens
accagcaggtgtggtggc

SEQ ID NO: 3937924 - DNA, 21 bp, Homo sapiens
accagcaggtgtggtggctca

SEQ ID NO: 3937925 - DNA, 21 bp, Homo sapiens
accagccccctggatgggcat

SEQ ID NO: 3937926 - DNA, 18 bp, Homo sapiens
accagcccttccctgctt

SEQ ID NO: 3937927 - DNA, 14 bp, Homo sapiens
accagcctccatgc

SEQ ID NO: 3937928 - DNA, 23 bp, Homo sapiens
accagcctgttggacccgctctg

SEQ ID NO: 3937929 - DNA, 15 bp, Homo sapiens
accagctaactccag

SEQ ID NO: 3937930 - DNA, 21 bp, Homo sapiens
accagctatctgtcatctctc

SEQ ID NO: 3937931 - DNA, 12 bp, Homo sapiens
accagctctgtg

SEQ ID NO: 3937932 - DNA, 16 bp, Homo sapiens
accagctctgtggcct

SEQ ID NO: 3937933 - DNA, 17 bp, Homo sapiens
accagctctgtggcctg

SEQ ID NO: 3937934 - DNA, 19 bp, Homo sapiens
accagctctgtggcctgtg

SEQ ID NO: 3937935 - DNA, 20 bp, Homo sapiens
accagctctgtggcctgtgt

SEQ ID NO: 3937936 - DNA, 14 bp, Homo sapiens
accagctgctctgc

SEQ ID NO: 3937937 - DNA, 17 bp, Homo sapiens
accagctgctctgcccc

SEQ ID NO: 3937938 - DNA, 18 bp, Homo sapiens
accagctgctctgcccct

SEQ ID NO: 3937939 - DNA, 17 bp, Homo sapiens
accaggacaggaccaga

SEQ ID NO: 3937940 - DNA, 20 bp, Homo sapiens
accaggcacgaacccacctg

SEQ ID NO: 3937941 - DNA, 23 bp, Homo sapiens
accaggcacgaacccacctgctg

SEQ ID NO: 3937942 - DNA, 16 bp, Homo sapiens
accagggcgcaagcct

SEQ ID NO: 3937943 - DNA, 22 bp, Homo sapiens
accaggggtgctatgacatgca

SEQ ID NO: 3937944 - DNA, 21 bp, Homo sapiens
accagggtccgcaccagctgc

SEQ ID NO: 3937945 - DNA, 22 bp, Homo sapiens
accagggtccgcaccagctgct

SEQ ID NO: 3937946 - DNA, 23 bp, Homo sapiens
accagggtccgcaccagctgctc

SEQ ID NO: 3937947 - DNA, 22 bp, Homo sapiens
accagggtgcatggcttgggga

SEQ ID NO: 3937948 - DNA, 14 bp, Homo sapiens
accagtacttctaa

SEQ ID NO: 3937949 - DNA, 19 bp, Homo sapiens
accagtatggaagggaggg

SEQ ID NO: 3937950 - DNA, 15 bp, Homo sapiens
accagtcccagagca

SEQ ID NO: 3937951 - DNA, 23 bp, Homo sapiens
accagtgcccaaagtctgtgtga

SEQ ID NO: 3937952 - DNA, 18 bp, Homo sapiens
accagtgtcccctccact

SEQ ID NO: 3937953 - DNA, 14 bp, Homo sapiens
accagttaagaatg

SEQ ID NO: 3937954 - DNA, 21 bp, Homo sapiens
accagttctggccaggagctg

SEQ ID NO: 3937955 - DNA, 19 bp, Homo sapiens
accagttgggagcactgga

SEQ ID NO: 3937956 - DNA, 22 bp, Homo sapiens
accatagttatttacttgaaag

SEQ ID NO: 3937957 - DNA, 19 bp, Homo sapiens
accatatgtctgcttctgt

SEQ ID NO: 3937958 - DNA, 13 bp, Homo sapiens
accatcacacatg

SEQ ID NO: 3937959 - DNA, 17 bp, Homo sapiens
accatcaccctctgggc

SEQ ID NO: 3937960 - DNA, 16 bp, Homo sapiens
accatcctgcagcctc

SEQ ID NO: 3937961 - DNA, 17 bp, Homo sapiens
accatcctggcccctcc

SEQ ID NO: 3937962 - DNA, 13 bp, Homo sapiens
accatctaatagc

SEQ ID NO: 3937963 - DNA, 12 bp, Homo sapiens
accatctccagc

SEQ ID NO: 3937964 - DNA, 20 bp, Homo sapiens
accatcttaaatgacagtga

SEQ ID NO: 3937965 - DNA, 18 bp, Homo sapiens
accatgagaagagggcct

SEQ ID NO: 3937966 - DNA, 21 bp, Homo sapiens
accatgagaagagggcctgtg

SEQ ID NO: 3937967 - DNA, 16 bp, Homo sapiens
accatgcaaatgctat

SEQ ID NO: 3937968 - DNA, 19 bp, Homo sapiens
accatgcagcttcatcaat

SEQ ID NO: 3937969 - DNA, 21 bp, Homo sapiens
accatgcagcttcatcaattt

SEQ ID NO: 3937970 - DNA, 21 bp, Homo sapiens
accatgctgctttttggcaca

SEQ ID NO: 3937971 - DNA, 18 bp, Homo sapiens
accatggacacattttct

SEQ ID NO: 3937972 - DNA, 22 bp, Homo sapiens
accatggaggcaggctccccct

SEQ ID NO: 3937973 - DNA, 12 bp, Homo sapiens
accatgtagttt

SEQ ID NO: 3937974 - DNA, 20 bp, Homo sapiens
accatgtagttttaacagaa

SEQ ID NO: 3937975 - DNA, 20 bp, Homo sapiens
accatgtttgagctcagacc

SEQ ID NO: 3937976 - DNA, 21 bp, Homo sapiens
accatgtttgagctcagaccc

SEQ ID NO: 3937977 - DNA, 13 bp, Homo sapiens
accattgacctca

SEQ ID NO: 3937978 - DNA, 19 bp, Homo sapiens
accattgacctcagctgca

SEQ ID NO: 3937979 - DNA, 24 bp, Homo sapiens
accattgacctcagctgcacattc

SEQ ID NO: 3937980 - DNA, 15 bp, Homo sapiens
accatttaattcata

SEQ ID NO: 3937981 - DNA, 17 bp, Homo sapiens
accatttaattcataat

SEQ ID NO: 3937982 - DNA, 20 bp, Homo sapiens
accatttcagagaggccttt

SEQ ID NO: 3937983 - DNA, 14 bp, Homo sapiens
acccaaaagagaaa

SEQ ID NO: 3937984 - DNA, 14 bp, Homo sapiens
acccaaagcatgga

SEQ ID NO: 3937985 - DNA, 17 bp, Homo sapiens
acccaaagcatggacta

SEQ ID NO: 3937986 - DNA, 13 bp, Homo sapiens
acccaaataaatg

SEQ ID NO: 3937987 - DNA, 17 bp, Homo sapiens
acccaattcaggactgg

SEQ ID NO: 3937988 - DNA, 12 bp, Homo sapiens
acccacacatgt

SEQ ID NO: 3937989 - DNA, 13 bp, Homo sapiens
acccacagcctct

SEQ ID NO: 3937990 - DNA, 17 bp, Homo sapiens
acctgaccggcacctgc

SEQ ID NO: 3937991 - DNA, 18 bp, Homo sapiens
acctgaccggcacctgcg

SEQ ID NO: 3937992 - DNA, 10 bp, Homo sapiens
acctgagcct

SEQ ID NO: 3937993 - DNA, 20 bp, Homo sapiens
acctgagctagaagctggag

SEQ ID NO: 3937994 - DNA, 21 bp, Homo sapiens
acctgatgccccttccccaag

SEQ ID NO: 3937995 - DNA, 21 bp, Homo sapiens
acctgatggcacttagctatc

SEQ ID NO: 3937996 - DNA, 15 bp, Homo sapiens
acctgcaaaaaatag

SEQ ID NO: 3937997 - DNA, 16 bp, Homo sapiens
acctgcaagatttcac

SEQ ID NO: 3937998 - DNA, 12 bp, Homo sapiens
acctgcaagccc

SEQ ID NO: 3937999 - DNA, 16 bp, Homo sapiens
acctgcaagccccagg

SEQ ID NO: 3938000 - DNA, 18 bp, Homo sapiens
acctgcaagccccagggc

SEQ ID NO: 3938001 - DNA, 17 bp, Homo sapiens
acctgcacctcccccca

SEQ ID NO: 3938002 - DNA, 20 bp, Homo sapiens
acctgcacctccccccactg

SEQ ID NO: 3938003 - DNA, 22 bp, Homo sapiens
acctgcacctccccccactgca

SEQ ID NO: 3938004 - DNA, 15 bp, Homo sapiens
acctgcagttcctga

SEQ ID NO: 3938005 - DNA, 17 bp, Homo sapiens
acctgcagttcctgagt

SEQ ID NO: 3938006 - DNA, 17 bp, Homo sapiens
acctgccagccatcaca

SEQ ID NO: 3938007 - DNA, 21 bp, Homo sapiens
acctgcccaacctgctctcct

SEQ ID NO: 3938008 - DNA, 14 bp, Homo sapiens
acctgccccagcgc

SEQ ID NO: 3938009 - DNA, 17 bp, Homo sapiens
acctgccctgccctgcc

SEQ ID NO: 3938010 - DNA, 22 bp, Homo sapiens
acctgccctgccctgccacctg

SEQ ID NO: 3938011 - DNA, 23 bp, Homo sapiens
acctgccctgccctgccacctgt

SEQ ID NO: 3938012 - DNA, 12 bp, Homo sapiens
acctgccgacct

SEQ ID NO: 3938013 - DNA, 17 bp, Homo sapiens
acctgccgacctcgtcc

SEQ ID NO: 3938014 - DNA, 20 bp, Homo sapiens
acctgccgacctcgtcctcc

SEQ ID NO: 3938015 - DNA, 19 bp, Homo sapiens
acctgcctatccatcctgc

SEQ ID NO: 3938016 - DNA, 21 bp, Homo sapiens
acctgcctatccatcctgcga

SEQ ID NO: 3938017 - DNA, 22 bp, Homo sapiens
acctgcctctcacacacataga

SEQ ID NO: 3938018 - DNA, 23 bp, Homo sapiens
acctgcgagaggtccctgcttac

SEQ ID NO: 3938019 - DNA, 17 bp, Homo sapiens
acctgctctcctcttgc

SEQ ID NO: 3938020 - DNA, 15 bp, Homo sapiens
acctgctgagctctg

SEQ ID NO: 3938021 - DNA, 16 bp, Homo sapiens
acctgctgagctctga

SEQ ID NO: 3938022 - DNA, 15 bp, Homo sapiens
acctgctgctgctat

SEQ ID NO: 3938023 - DNA, 19 bp, Homo sapiens
acctgctggaaaccacact

SEQ ID NO: 3938024 - DNA, 23 bp, Homo sapiens
acctgctgtgcaccttacattcc

SEQ ID NO: 3938025 - DNA, 13 bp, Homo sapiens
acctggagaccag

SEQ ID NO: 3938026 - DNA, 20 bp, Homo sapiens
acctggagagccagaacctg

SEQ ID NO: 3938027 - DNA, 22 bp, Homo sapiens
acctggagagctagaacctgga

SEQ ID NO: 3938028 - DNA, 23 bp, Homo sapiens
acctggagagctagaacctggag

SEQ ID NO: 3938029 - DNA, 13 bp, Homo sapiens
acctggagatgat

SEQ ID NO: 3938030 - DNA, 16 bp, Homo sapiens
acctggagatgatgat

SEQ ID NO: 3938031 - DNA, 17 bp, Homo sapiens
acctggagatgatgatg

SEQ ID NO: 3938032 - DNA, 13 bp, Homo sapiens
acctggagggcta

SEQ ID NO: 3938033 - DNA, 23 bp, Homo sapiens
acctggagggctagaacctggag

SEQ ID NO: 3938034 - DNA, 15 bp, Homo sapiens
acctggagggctgga

SEQ ID NO: 3938035 - DNA, 14 bp, Homo sapiens
acctgggaaaacag

SEQ ID NO: 3938036 - DNA, 17 bp, Homo sapiens
acctgggaaaggaccca

SEQ ID NO: 3938037 - DNA, 20 bp, Homo sapiens
acctgggccaaaagggcagc

SEQ ID NO: 3938038 - DNA, 22 bp, Homo sapiens
acctgggccaaaagggcagcca

SEQ ID NO: 3938039 - DNA, 20 bp, Homo sapiens
acctgggccctggggcctgt

SEQ ID NO: 3938040 - DNA, 21 bp, Homo sapiens
acctgggccctggggcctgta

SEQ ID NO: 3938041 - DNA, 23 bp, Homo sapiens
acctgggccctggggcctgtact

SEQ ID NO: 3938042 - DNA, 20 bp, Homo sapiens
acctgggcctttcctgtgcc

SEQ ID NO: 3938043 - DNA, 19 bp, Homo sapiens
acctgtagtcccagctact

SEQ ID NO: 3938044 - DNA, 15 bp, Homo sapiens
acctgtagtgagaaa

SEQ ID NO: 3938045 - DNA, 20 bp, Homo sapiens
acctgtagtgagaaactgat

SEQ ID NO: 3938046 - DNA, 18 bp, Homo sapiens
acctgtcaccgtgagcag

SEQ ID NO: 3938047 - DNA, 17 bp, Homo sapiens
acctgtctcctttctca

SEQ ID NO: 3938048 - DNA, 12 bp, Homo sapiens
acctgtctgtct

SEQ ID NO: 3938049 - DNA, 18 bp, Homo sapiens
acctgtgtattttttaaa

SEQ ID NO: 3938050 - DNA, 17 bp, Homo sapiens
accttaatattattggg

SEQ ID NO: 3938051 - DNA, 22 bp, Homo sapiens
accttaatattattggggttgg

SEQ ID NO: 3938052 - DNA, 17 bp, Homo sapiens
accttaccaactttctg

SEQ ID NO: 3938053 - DNA, 18 bp, Homo sapiens
accttaccaactttctgt

SEQ ID NO: 3938054 - DNA, 12 bp, Homo sapiens
accttcccagct

SEQ ID NO: 3938055 - DNA, 14 bp, Homo sapiens
accttccccagact

SEQ ID NO: 3938056 - DNA, 21 bp, Homo sapiens
accttctcaaaagattgtttt

SEQ ID NO: 3938057 - DNA, 22 bp, Homo sapiens
accttctcaaaagattgtttta

SEQ ID NO: 3938058 - DNA, 13 bp, Homo sapiens
accttctgtggct

SEQ ID NO: 3938059 - DNA, 20 bp, Homo sapiens
accttcttcagccacctctc

SEQ ID NO: 3938060 - DNA, 14 bp, Homo sapiens
accttcttggcttc

SEQ ID NO: 3938061 - DNA, 20 bp, Homo sapiens
accttgaccatcgtccttcc

SEQ ID NO: 3938062 - DNA, 19 bp, Homo sapiens
accttgccaagctttcttc

SEQ ID NO: 3938063 - DNA, 18 bp, Homo sapiens
accttgctcttctttctg

SEQ ID NO: 3938064 - DNA, 22 bp, Homo sapiens
accttgttgcatgatgtatttt

SEQ ID NO: 3938065 - DNA, 17 bp, Homo sapiens
acctttaagtcctctct

SEQ ID NO: 3938066 - DNA, 18 bp, Homo sapiens
acctttaagtcctctctt

SEQ ID NO: 3938067 - DNA, 14 bp, Homo sapiens
acctttattgtgat

SEQ ID NO: 3938068 - DNA, 17 bp, Homo sapiens
acctttcaaatttcaca

SEQ ID NO: 3938069 - DNA, 16 bp, Homo sapiens
acctttcagctgtgaa

SEQ ID NO: 3938070 - DNA, 18 bp, Homo sapiens
acctttcccatgctgaat

SEQ ID NO: 3938071 - DNA, 15 bp, Homo sapiens
acctttccccagaca

SEQ ID NO: 3938072 - DNA, 19 bp, Homo sapiens
acctttgggatcagcctcc

SEQ ID NO: 3938073 - DNA, 12 bp, Homo sapiens
acctttggtgca

SEQ ID NO: 3938074 - DNA, 16 bp, Homo sapiens
acctttggtgcagagg

SEQ ID NO: 3938075 - DNA, 13 bp, Homo sapiens
accttttatacca

SEQ ID NO: 3938076 - DNA, 15 bp, Homo sapiens
actcacctgttactt

SEQ ID NO: 3938077 - DNA, 14 bp, Homo sapiens
actcactccagccc

SEQ ID NO: 3938078 - DNA, 14 bp, Homo sapiens
actcactgtcaatg

SEQ ID NO: 3938079 - DNA, 22 bp, Homo sapiens
actcacttttctttattgctgt

SEQ ID NO: 3938080 - DNA, 19 bp, Homo sapiens
actcagaaaagaaaaccat

SEQ ID NO: 3938081 - DNA, 20 bp, Homo sapiens
actcagaaaagaaaaccatt

SEQ ID NO: 3938082 - DNA, 16 bp, Homo sapiens
actcagaagcctgggg

SEQ ID NO: 3938083 - DNA, 18 bp, Homo sapiens
actcagagcccctccctg

SEQ ID NO: 3938084 - DNA, 13 bp, Homo sapiens
actcagcagccct

SEQ ID NO: 3938085 - DNA, 17 bp, Homo sapiens
actcagcagccctcctc

SEQ ID NO: 3938086 - DNA, 20 bp, Homo sapiens
actcagcagccctcctcacc

SEQ ID NO: 3938087 - DNA, 23 bp, Homo sapiens
actcagcagccctcctcaccccg

SEQ ID NO: 3938088 - DNA, 15 bp, Homo sapiens
actcagccacacccc

SEQ ID NO: 3938089 - DNA, 22 bp, Homo sapiens
actcagctccagaataccttct

SEQ ID NO: 3938090 - DNA, 13 bp, Homo sapiens
actcaggaggctg

SEQ ID NO: 3938091 - DNA, 13 bp, Homo sapiens
actcaggattctc

SEQ ID NO: 3938092 - DNA, 19 bp, Homo sapiens
actcatcctgtgtggggag

SEQ ID NO: 3938093 - DNA, 13 bp, Homo sapiens
actcatctgttat

SEQ ID NO: 3938094 - DNA, 15 bp, Homo sapiens
actcatctgttatcc

SEQ ID NO: 3938095 - DNA, 23 bp, Homo sapiens
actcatctgttatcctgctagct

SEQ ID NO: 3938096 - DNA, 20 bp, Homo sapiens
actcatgttgttcccacaca

SEQ ID NO: 3938097 - DNA, 21 bp, Homo sapiens
actcatgttgttcccacacac

SEQ ID NO: 3938098 - DNA, 13 bp, Homo sapiens
actcattccttca

SEQ ID NO: 3938099 - DNA, 15 bp, Homo sapiens
actcattccttcact

SEQ ID NO: 3938100 - DNA, 15 bp, Homo sapiens
actcatttctaaaag

SEQ ID NO: 3938101 - DNA, 20 bp, Homo sapiens
actcattttaaaaaatggaa

SEQ ID NO: 3938102 - DNA, 21 bp, Homo sapiens
actccaaagaaatgtaaggga

SEQ ID NO: 3938103 - DNA, 22 bp, Homo sapiens
actccaagggtttctgacccaa

SEQ ID NO: 3938104 - DNA, 21 bp, Homo sapiens
actccaccccctccagctcca

SEQ ID NO: 3938105 - DNA, 22 bp, Homo sapiens
actccaccccctccagctccag

SEQ ID NO: 3938106 - DNA, 13 bp, Homo sapiens
actccagacccct

SEQ ID NO: 3938107 - DNA, 16 bp, Homo sapiens
actccagagggacagg

SEQ ID NO: 3938108 - DNA, 14 bp, Homo sapiens
actccagagtctga

SEQ ID NO: 3938109 - DNA, 17 bp, Homo sapiens
actccagagtctgagcc

SEQ ID NO: 3938110 - DNA, 12 bp, Homo sapiens
actccagccctg

SEQ ID NO: 3938111 - DNA, 13 bp, Homo sapiens
actccagccctgt

SEQ ID NO: 3938112 - DNA, 20 bp, Homo sapiens
actccagtctcctgacatta

SEQ ID NO: 3938113 - DNA, 18 bp, Homo sapiens
actccagtggtgaagaaa

SEQ ID NO: 3938114 - DNA, 15 bp, Homo sapiens
actccatggccaccc

SEQ ID NO: 3938115 - DNA, 16 bp, Homo sapiens
actccatggccacccc

SEQ ID NO: 3938116 - DNA, 17 bp, Homo sapiens
actccatggccaccccg

SEQ ID NO: 3938117 - DNA, 20 bp, Homo sapiens
actccatgtgtgctgtcctc

SEQ ID NO: 3938118 - DNA, 18 bp, Homo sapiens
actccattcccaactaga

SEQ ID NO: 3938119 - DNA, 22 bp, Homo sapiens
actccattcccaactagacatt

SEQ ID NO: 3938120 - DNA, 23 bp, Homo sapiens
actccctccatgtggccccaggt

SEQ ID NO: 3938121 - DNA, 22 bp, Homo sapiens
actccctgaacctcagtttcct

SEQ ID NO: 3938122 - DNA, 22 bp, Homo sapiens
actccctgtgggggtggccatc

SEQ ID NO: 3938123 - DNA, 15 bp, Homo sapiens
actcccttcctggcc

SEQ ID NO: 3938124 - DNA, 17 bp, Homo sapiens
actcccttcctggcctc

SEQ ID NO: 3938125 - DNA, 14 bp, Homo sapiens
actccgagaacaac

SEQ ID NO: 3938126 - DNA, 19 bp, Homo sapiens
actccggcctgatgacaga

SEQ ID NO: 3938127 - DNA, 18 bp, Homo sapiens
actccgggaccattgacc

SEQ ID NO: 3938128 - DNA, 14 bp, Homo sapiens
actcctacctggta

SEQ ID NO: 3938129 - DNA, 17 bp, Homo sapiens
actcctataaggagagt

SEQ ID NO: 3938130 - DNA, 21 bp, Homo sapiens
actcctcaaaagcaaatgaga

SEQ ID NO: 3938131 - DNA, 18 bp, Homo sapiens
actcctcagatctgaaca

SEQ ID NO: 3938132 - DNA, 23 bp, Homo sapiens
actcctctaagccactcttccaa

SEQ ID NO: 3938133 - DNA, 15 bp, Homo sapiens
actcctgattttgta

SEQ ID NO: 3938134 - DNA, 20 bp, Homo sapiens
actcctgattttgtagttaa

SEQ ID NO: 3938135 - DNA, 18 bp, Homo sapiens
actcctgccagttgaaaa

SEQ ID NO: 3938136 - DNA, 23 bp, Homo sapiens
actcctgccagttgaaaatggat

SEQ ID NO: 3938137 - DNA, 22 bp, Homo sapiens
actcctgccctgttgtgtatag

SEQ ID NO: 3938138 - DNA, 10 bp, Homo sapiens
actcctgcct

SEQ ID NO: 3938139 - DNA, 17 bp, Homo sapiens
actcctgcctgtgtttg

SEQ ID NO: 3938140 - DNA, 21 bp, Homo sapiens
actcctggtctgaaaatgttg

SEQ ID NO: 3938141 - DNA, 15 bp, Homo sapiens
actcctgtgggagcc

SEQ ID NO: 3938142 - DNA, 16 bp, Homo sapiens
actcctgtgggagcct

SEQ ID NO: 3938143 - DNA, 20 bp, Homo sapiens
actcctgttacttacctaaa

SEQ ID NO: 3938144 - DNA, 15 bp, Homo sapiens
actccttattttgta

SEQ ID NO: 3938145 - DNA, 18 bp, Homo sapiens
actccttattttgtatta

SEQ ID NO: 3938146 - DNA, 11 bp, Homo sapiens
actccttcctg

SEQ ID NO: 3938147 - DNA, 12 bp, Homo sapiens
actccttcctgc

SEQ ID NO: 3938148 - DNA, 18 bp, Homo sapiens
actccttgtggtttatgt

SEQ ID NO: 3938149 - DNA, 19 bp, Homo sapiens
actccttgtggtttatgtc

SEQ ID NO: 3938150 - DNA, 14 bp, Homo sapiens
actcctttcctctg

SEQ ID NO: 3938151 - DNA, 16 bp, Homo sapiens
actcgcagtcgcagga

SEQ ID NO: 3938152 - DNA, 22 bp, Homo sapiens
actcgggaggctgagacaggag

SEQ ID NO: 3938153 - DNA, 22 bp, Homo sapiens
actcggtcaaaatattttttaa

SEQ ID NO: 3938154 - DNA, 14 bp, Homo sapiens
actcgtatatgtct

SEQ ID NO: 3938155 - DNA, 22 bp, Homo sapiens
actctaaattctttatttctgt

SEQ ID NO: 3938156 - DNA, 21 bp, Homo sapiens
actctacctgcaagatttcac

SEQ ID NO: 3938157 - DNA, 16 bp, Homo sapiens
actctacgccaaagtg

SEQ ID NO: 3938158 - DNA, 17 bp, Homo sapiens
actctagcctgggccag

SEQ ID NO: 3938159 - DNA, 18 bp, Homo sapiens
actctagtgacttcctgg

SEQ ID NO: 3938160 - DNA, 16 bp, Homo sapiens
actctatgccccaaat

SEQ ID NO: 3938161 - DNA, 22 bp, Homo sapiens
actctcaggatcaagaaagtgt

SEQ ID NO: 3938162 - DNA, 20 bp, Homo sapiens
agaaagaacggaagaagaga

SEQ ID NO: 3938163 - DNA, 20 bp, Homo sapiens
agaaagaggtgaccccaggg

SEQ ID NO: 3938164 - DNA, 22 bp, Homo sapiens
agaaagaggtgaccccagggca

SEQ ID NO: 3938165 - DNA, 23 bp, Homo sapiens
agaaagaggtgaccccagggcac

SEQ ID NO: 3938166 - DNA, 19 bp, Homo sapiens
agaaaggagctctgaatct

SEQ ID NO: 3938167 - DNA, 16 bp, Homo sapiens
agaaaggattaagata

SEQ ID NO: 3938168 - DNA, 14 bp, Homo sapiens
agaaagggagggct

SEQ ID NO: 3938169 - DNA, 15 bp, Homo sapiens
agaaagggagggctc

SEQ ID NO: 3938170 - DNA, 21 bp, Homo sapiens
agaaagtcgaattaatagctt

SEQ ID NO: 3938171 - DNA, 13 bp, Homo sapiens
agaaagtgcagaa

SEQ ID NO: 3938172 - DNA, 17 bp, Homo sapiens
agaaagtgcagaatcaa

SEQ ID NO: 3938173 - DNA, 12 bp, Homo sapiens
agaaagttattg

SEQ ID NO: 3938174 - DNA, 17 bp, Homo sapiens
agaaatatatatacata

SEQ ID NO: 3938175 - DNA, 20 bp, Homo sapiens
agaaatatatatacatatgt

SEQ ID NO: 3938176 - DNA, 15 bp, Homo sapiens
agaaatatgatttta

SEQ ID NO: 3938177 - DNA, 16 bp, Homo sapiens
agaaatatgattttat

SEQ ID NO: 3938178 - DNA, 19 bp, Homo sapiens
agaaatcacaggggcgggg

SEQ ID NO: 3938179 - DNA, 22 bp, Homo sapiens
agaaatcattgtagaaacacag

SEQ ID NO: 3938180 - DNA, 22 bp, Homo sapiens
agaaatccctgtttaatattta

SEQ ID NO: 3938181 - DNA, 13 bp, Homo sapiens
agaaatgaatgct

SEQ ID NO: 3938182 - DNA, 16 bp, Homo sapiens
agaaatgcaaaaatct

SEQ ID NO: 3938183 - DNA, 22 bp, Homo sapiens
agaaatgcatccattcctcagg

SEQ ID NO: 3938184 - DNA, 17 bp, Homo sapiens
agaaattagctgtgtga

SEQ ID NO: 3938185 - DNA, 16 bp, Homo sapiens
agaaattcctgtagca

SEQ ID NO: 3938186 - DNA, 20 bp, Homo sapiens
agaaattcctgtagcatctt

SEQ ID NO: 3938187 - DNA, 21 bp, Homo sapiens
agaaattctgtcatagaaagt

SEQ ID NO: 3938188 - DNA, 13 bp, Homo sapiens
agaaattctgtgg

SEQ ID NO: 3938189 - DNA, 15 bp, Homo sapiens
agaaattgcctcctt

SEQ ID NO: 3938190 - DNA, 18 bp, Homo sapiens
agaaattgttcctgatgt

SEQ ID NO: 3938191 - DNA, 15 bp, Homo sapiens
agaaatttgatttct

SEQ ID NO: 3938192 - DNA, 13 bp, Homo sapiens
agaaatttttatt

SEQ ID NO: 3938193 - DNA, 18 bp, Homo sapiens
agaaatttttatttttga

SEQ ID NO: 3938194 - DNA, 20 bp, Homo sapiens
agaacaaacacctccccagc

SEQ ID NO: 3938195 - DNA, 13 bp, Homo sapiens
agaacaacaacaa

SEQ ID NO: 3938196 - DNA, 22 bp, Homo sapiens
agaacaacaacaacaataacaa

SEQ ID NO: 3938197 - DNA, 20 bp, Homo sapiens
agaacaagtcacagctgcag

SEQ ID NO: 3938198 - DNA, 23 bp, Homo sapiens
agaacaagtcacagctgcagctg

SEQ ID NO: 3938199 - DNA, 21 bp, Homo sapiens
agaacaatagctattgcatgt

SEQ ID NO: 3938200 - DNA, 15 bp, Homo sapiens
agaacacccctgtgc

SEQ ID NO: 3938201 - DNA, 17 bp, Homo sapiens
agaacataaagcaaata

SEQ ID NO: 3938202 - DNA, 18 bp, Homo sapiens
agaaccaagcttcagagc

SEQ ID NO: 3938203 - DNA, 23 bp, Homo sapiens
agaaccaagcttcagagcctagc

SEQ ID NO: 3938204 - DNA, 19 bp, Homo sapiens
agaaccagagggttgtact

SEQ ID NO: 3938205 - DNA, 14 bp, Homo sapiens
agaacctcctattt

SEQ ID NO: 3938206 - DNA, 12 bp, Homo sapiens
agaacctggaga

SEQ ID NO: 3938207 - DNA, 22 bp, Homo sapiens
agaacctggccttcagtgtacc

SEQ ID NO: 3938208 - DNA, 23 bp, Homo sapiens
agaacgtattttaaaagccacat

SEQ ID NO: 3938209 - DNA, 18 bp, Homo sapiens
agaactagaacctggagg

SEQ ID NO: 3938210 - DNA, 17 bp, Homo sapiens
agaactccttattttgt

SEQ ID NO: 3938211 - DNA, 19 bp, Homo sapiens
agaactccttattttgtat

SEQ ID NO: 3938212 - DNA, 19 bp, Homo sapiens
agaactgaggtcactgggt

SEQ ID NO: 3938213 - DNA, 19 bp, Homo sapiens
agaactgccccatctcctc

SEQ ID NO: 3938214 - DNA, 23 bp, Homo sapiens
agaactgctaaatactgtacata

SEQ ID NO: 3938215 - DNA, 13 bp, Homo sapiens
agaacttcaatca

SEQ ID NO: 3938216 - DNA, 21 bp, Homo sapiens
agaacttcgaccctttctctg

SEQ ID NO: 3938217 - DNA, 23 bp, Homo sapiens
agaagaaaaagttgcagtctcag

SEQ ID NO: 3938218 - DNA, 16 bp, Homo sapiens
agaagaaagaacggaa

SEQ ID NO: 3938219 - DNA, 16 bp, Homo sapiens
agaagaaagaggtgac

SEQ ID NO: 3938220 - DNA, 15 bp, Homo sapiens
agaagaaagtgtaga

SEQ ID NO: 3938221 - DNA, 14 bp, Homo sapiens
agaagaaatgaata

SEQ ID NO: 3938222 - DNA, 15 bp, Homo sapiens
agaagaatattcagg

SEQ ID NO: 3938223 - DNA, 16 bp, Homo sapiens
agaagaatattcagga

SEQ ID NO: 3938224 - DNA, 12 bp, Homo sapiens
agaagacactgc

SEQ ID NO: 3938225 - DNA, 14 bp, Homo sapiens
agaagacatggaga

SEQ ID NO: 3938226 - DNA, 19 bp, Homo sapiens
agaagacatggagactcct

SEQ ID NO: 3938227 - DNA, 21 bp, Homo sapiens
agaagaccacaaaaattgact

SEQ ID NO: 3938228 - DNA, 19 bp, Homo sapiens
agaagacccacgtgctagg

SEQ ID NO: 3938229 - DNA, 24 bp, Homo sapiens
agaagagggcctgtgggagcctgc

SEQ ID NO: 3938230 - DNA, 15 bp, Homo sapiens
agaagataatgttct

SEQ ID NO: 3938231 - DNA, 14 bp, Homo sapiens
agaagatgccctcc

SEQ ID NO: 3938232 - DNA, 22 bp, Homo sapiens
agaagatgccctccaatccttt

SEQ ID NO: 3938233 - DNA, 19 bp, Homo sapiens
agaagatggactctgaaaa

SEQ ID NO: 3938234 - DNA, 17 bp, Homo sapiens
agaagcagtgagccgca

SEQ ID NO: 3938235 - DNA, 23 bp, Homo sapiens
agaagcagtgagccgcatcttct

SEQ ID NO: 3938236 - DNA, 17 bp, Homo sapiens
agaagcatcaccatgca

SEQ ID NO: 3938237 - DNA, 20 bp, Homo sapiens
agaagccacgctgtcctctc

SEQ ID NO: 3938238 - DNA, 12 bp, Homo sapiens
agaagccaggag

SEQ ID NO: 3938239 - DNA, 15 bp, Homo sapiens
agaagccctgctggg

SEQ ID NO: 3938240 - DNA, 21 bp, Homo sapiens
agaagcctgggggcctggctg

SEQ ID NO: 3938241 - DNA, 19 bp, Homo sapiens
agaagcctttgggaagggg

SEQ ID NO: 3938242 - DNA, 16 bp, Homo sapiens
agaagcgctcatctgg

SEQ ID NO: 3938243 - DNA, 18 bp, Homo sapiens
agaagcgctcatctggct

SEQ ID NO: 3938244 - DNA, 18 bp, Homo sapiens
agaagctaaaacctgagc

SEQ ID NO: 3938245 - DNA, 15 bp, Homo sapiens
agaagctcccagatg

SEQ ID NO: 3938246 - DNA, 13 bp, Homo sapiens
agaagctgaggat

SEQ ID NO: 3938247 - DNA, 15 bp, Homo sapiens
agaagctgaggatcc

SEQ ID NO: 3938248 - DNA, 19 bp, Homo sapiens
agagactcaaagagactcc

SEQ ID NO: 3938249 - DNA, 19 bp, Homo sapiens
agagactctcttagggaaa

SEQ ID NO: 3938250 - DNA, 18 bp, Homo sapiens
agagactctggaagcccc

SEQ ID NO: 3938251 - DNA, 23 bp, Homo sapiens
agagactctggaagccccccacc

SEQ ID NO: 3938252 - DNA, 21 bp, Homo sapiens
agagactggagcatctgactc

SEQ ID NO: 3938253 - DNA, 18 bp, Homo sapiens
agagacttggggaccaga

SEQ ID NO: 3938254 - DNA, 13 bp, Homo sapiens
agagagacagaga

SEQ ID NO: 3938255 - DNA, 21 bp, Homo sapiens
agagagacagagacagagaga

SEQ ID NO: 3938256 - DNA, 14 bp, Homo sapiens
agagagagacagag

SEQ ID NO: 3938257 - DNA, 15 bp, Homo sapiens
agagagagagagagg

SEQ ID NO: 3938258 - DNA, 17 bp, Homo sapiens
agagagcttagcctgga

SEQ ID NO: 3938259 - DNA, 15 bp, Homo sapiens
agagaggagcacctg

SEQ ID NO: 3938260 - DNA, 18 bp, Homo sapiens
agagaggcacctgctgga

SEQ ID NO: 3938261 - DNA, 22 bp, Homo sapiens
agagaggcagaagaaccctggc

SEQ ID NO: 3938262 - DNA, 20 bp, Homo sapiens
agagagggccatgcaattca

SEQ ID NO: 3938263 - DNA, 12 bp, Homo sapiens
agagagggccca

SEQ ID NO: 3938264 - DNA, 19 bp, Homo sapiens
agagaggggtacatttccc

SEQ ID NO: 3938265 - DNA, 14 bp, Homo sapiens
agagaggttctggg

SEQ ID NO: 3938266 - DNA, 16 bp, Homo sapiens
agagaggttctgggga

SEQ ID NO: 3938267 - DNA, 21 bp, Homo sapiens
agagaggttctggggaggaag

SEQ ID NO: 3938268 - DNA, 22 bp, Homo sapiens
agagaggttctggggaggaagg

SEQ ID NO: 3938269 - DNA, 16 bp, Homo sapiens
agagagtggctcctcc

SEQ ID NO: 3938270 - DNA, 13 bp, Homo sapiens
agagatatgcaca

SEQ ID NO: 3938271 - DNA, 15 bp, Homo sapiens
agagatcaggaagag

SEQ ID NO: 3938272 - DNA, 13 bp, Homo sapiens
agagatctagaaa

SEQ ID NO: 3938273 - DNA, 17 bp, Homo sapiens
agagatctagaaagtgg

SEQ ID NO: 3938274 - DNA, 19 bp, Homo sapiens
agagatgaagagtgagagg

SEQ ID NO: 3938275 - DNA, 12 bp, Homo sapiens
agagatgcctcc

SEQ ID NO: 3938276 - DNA, 17 bp, Homo sapiens
agagatgtagcagaata

SEQ ID NO: 3938277 - DNA, 19 bp, Homo sapiens
agagattgccccagagccc

SEQ ID NO: 3938278 - DNA, 16 bp, Homo sapiens
agagatttcaacatat

SEQ ID NO: 3938279 - DNA, 18 bp, Homo sapiens
agagcaaatgagggaggg

SEQ ID NO: 3938280 - DNA, 13 bp, Homo sapiens
agagcaacccctg

SEQ ID NO: 3938281 - DNA, 21 bp, Homo sapiens
agagcaacccctgtacccagc

SEQ ID NO: 3938282 - DNA, 14 bp, Homo sapiens
agagcaagtctgga

SEQ ID NO: 3938283 - DNA, 21 bp, Homo sapiens
agagcactaggttcaattccc

SEQ ID NO: 3938284 - DNA, 16 bp, Homo sapiens
agagcactgctccagt

SEQ ID NO: 3938285 - DNA, 14 bp, Homo sapiens
agagcagagagcag

SEQ ID NO: 3938286 - DNA, 18 bp, Homo sapiens
agagcagagcaaatgagg

SEQ ID NO: 3938287 - DNA, 13 bp, Homo sapiens
agagcagcctgat

SEQ ID NO: 3938288 - DNA, 18 bp, Homo sapiens
agagcagcctgatggcca

SEQ ID NO: 3938289 - DNA, 12 bp, Homo sapiens
agagcagctggt

SEQ ID NO: 3938290 - DNA, 17 bp, Homo sapiens
agagcaggctcagactc

SEQ ID NO: 3938291 - DNA, 22 bp, Homo sapiens
agagcaggggtccttggtgtga

SEQ ID NO: 3938292 - DNA, 14 bp, Homo sapiens
agagcatcatgcct

SEQ ID NO: 3938293 - DNA, 23 bp, Homo sapiens
agagcatcatgcctctgaggcca

SEQ ID NO: 3938294 - DNA, 21 bp, Homo sapiens
agagcatcgtgacccttcagg

SEQ ID NO: 3938295 - DNA, 20 bp, Homo sapiens
agagcattacgtgagccagg

SEQ ID NO: 3938296 - DNA, 12 bp, Homo sapiens
agagccagccct

SEQ ID NO: 3938297 - DNA, 13 bp, Homo sapiens
agagccagccctc

SEQ ID NO: 3938298 - DNA, 21 bp, Homo sapiens
agagccagccctccctgtcct

SEQ ID NO: 3938299 - DNA, 22 bp, Homo sapiens
agagccagccctccctgtcctc

SEQ ID NO: 3938300 - DNA, 17 bp, Homo sapiens
agagccagcctgggact

SEQ ID NO: 3938301 - DNA, 18 bp, Homo sapiens
agagccagcctgggactc

SEQ ID NO: 3938302 - DNA, 12 bp, Homo sapiens
agagccagctct

SEQ ID NO: 3938303 - DNA, 13 bp, Homo sapiens
agagccatgggcc

SEQ ID NO: 3938304 - DNA, 15 bp, Homo sapiens
agagcccaagtgcca

SEQ ID NO: 3938305 - DNA, 14 bp, Homo sapiens
agagccccactccc

SEQ ID NO: 3938306 - DNA, 22 bp, Homo sapiens
agagccccactcccggccaggc

SEQ ID NO: 3938307 - DNA, 17 bp, Homo sapiens
agagcccccaagcctct

SEQ ID NO: 3938308 - DNA, 20 bp, Homo sapiens
agagcccccaagcctctgcc

SEQ ID NO: 3938309 - DNA, 23 bp, Homo sapiens
agagcccccaagcctctgcccca

SEQ ID NO: 3938310 - DNA, 21 bp, Homo sapiens
agagccccccgtgtggcttac

SEQ ID NO: 3938311 - DNA, 12 bp, Homo sapiens
agagccctggga

SEQ ID NO: 3938312 - DNA, 16 bp, Homo sapiens
agagccgcaaatcaac

SEQ ID NO: 3938313 - DNA, 15 bp, Homo sapiens
agagcctaagaaaat

SEQ ID NO: 3938314 - DNA, 14 bp, Homo sapiens
agagcctagccacc

SEQ ID NO: 3938315 - DNA, 15 bp, Homo sapiens
agagcctagccacct

SEQ ID NO: 3938316 - DNA, 21 bp, Homo sapiens
agagcctagccacctcccacc

SEQ ID NO: 3938317 - DNA, 15 bp, Homo sapiens
agagcctgctccccc

SEQ ID NO: 3938318 - DNA, 16 bp, Homo sapiens
agagcctgctccccca

SEQ ID NO: 3938319 - DNA, 16 bp, Homo sapiens
agagcctggagaagct

SEQ ID NO: 3938320 - DNA, 12 bp, Homo sapiens
agagcctggggc

SEQ ID NO: 3938321 - DNA, 21 bp, Homo sapiens
agagccttggtgtccacctgg

SEQ ID NO: 3938322 - DNA, 13 bp, Homo sapiens
agagcggctgccc

SEQ ID NO: 3938323 - DNA, 20 bp, Homo sapiens
agagcgggcctcttccctca

SEQ ID NO: 3938324 - DNA, 19 bp, Homo sapiens
agagctagaacatggagag

SEQ ID NO: 3938325 - DNA, 22 bp, Homo sapiens
agagctagaacctggagggcta

SEQ ID NO: 3938326 - DNA, 13 bp, Homo sapiens
agagctaggagca

SEQ ID NO: 3938327 - DNA, 20 bp, Homo sapiens
agagctaggagcaaagcctg

SEQ ID NO: 3938328 - DNA, 21 bp, Homo sapiens
agagctaggagcaaagcctgt

SEQ ID NO: 3938329 - DNA, 15 bp, Homo sapiens
agagctcctgtccct

SEQ ID NO: 3938330 - DNA, 17 bp, Homo sapiens
agagctcctgtccctac

SEQ ID NO: 3938331 - DNA, 18 bp, Homo sapiens
agagctcctgtccctacc

SEQ ID NO: 3938332 - DNA, 19 bp, Homo sapiens
agagctcgctcttgggagt

SEQ ID NO: 3938333 - DNA, 17 bp, Homo sapiens
agagctcttcaagctgt

SEQ ID NO: 3938334 - DNA, 22 bp, Homo sapiens
agagctcttcaagctgtcccct

SEQ ID NO: 3938335 - DNA, 17 bp, Homo sapiens
agcacaagttccagctg

SEQ ID NO: 3938336 - DNA, 23 bp, Homo sapiens
agcacaatgtctcacatgggaca

SEQ ID NO: 3938337 - DNA, 16 bp, Homo sapiens
agcacaccccaaggga

SEQ ID NO: 3938338 - DNA, 21 bp, Homo sapiens
agcacagcagcccctgcacaa

SEQ ID NO: 3938339 - DNA, 22 bp, Homo sapiens
agcacagcagtggagagtgttc

SEQ ID NO: 3938340 - DNA, 14 bp, Homo sapiens
agcacagccctggg

SEQ ID NO: 3938341 - DNA, 17 bp, Homo sapiens
agcacagccctgggagg

SEQ ID NO: 3938342 - DNA, 15 bp, Homo sapiens
agcacaggggcccca

SEQ ID NO: 3938343 - DNA, 21 bp, Homo sapiens
agcacaggggccccagatctg

SEQ ID NO: 3938344 - DNA, 13 bp, Homo sapiens
agcacccacgtga

SEQ ID NO: 3938345 - DNA, 15 bp, Homo sapiens
agcacccaggctcca

SEQ ID NO: 3938346 - DNA, 14 bp, Homo sapiens
agcaccccctcatt

SEQ ID NO: 3938347 - DNA, 13 bp, Homo sapiens
agcacccctgtct

SEQ ID NO: 3938348 - DNA, 15 bp, Homo sapiens
agcacccctgtctct

SEQ ID NO: 3938349 - DNA, 15 bp, Homo sapiens
agcaccctctcctgg

SEQ ID NO: 3938350 - DNA, 16 bp, Homo sapiens
agcaccctctcctggg

SEQ ID NO: 3938351 - DNA, 19 bp, Homo sapiens
agcaccctctcctgggggt

SEQ ID NO: 3938352 - DNA, 12 bp, Homo sapiens
agcaccctgggt

SEQ ID NO: 3938353 - DNA, 18 bp, Homo sapiens
agcacctagtccagtgac

SEQ ID NO: 3938354 - DNA, 13 bp, Homo sapiens
agcacctgaaccc

SEQ ID NO: 3938355 - DNA, 23 bp, Homo sapiens
agcacctgaaccccatgggcttg

SEQ ID NO: 3938356 - DNA, 16 bp, Homo sapiens
agcacctgccgacctc

SEQ ID NO: 3938357 - DNA, 20 bp, Homo sapiens
agcacctgccgacctcgtcc

SEQ ID NO: 3938358 - DNA, 21 bp, Homo sapiens
agcacctgcttcatgctcagc

SEQ ID NO: 3938359 - DNA, 17 bp, Homo sapiens
agcacgattttgcacaa

SEQ ID NO: 3938360 - DNA, 23 bp, Homo sapiens
agcactaggttcaattccctgaa

SEQ ID NO: 3938361 - DNA, 20 bp, Homo sapiens
agcactcagtctagtgaaga

SEQ ID NO: 3938362 - DNA, 17 bp, Homo sapiens
agcactgatttcacaac

SEQ ID NO: 3938363 - DNA, 18 bp, Homo sapiens
agcactgatttcacaaca

SEQ ID NO: 3938364 - DNA, 16 bp, Homo sapiens
agcactgccaggaggg

SEQ ID NO: 3938365 - DNA, 16 bp, Homo sapiens
agcactggagtgcagg

SEQ ID NO: 3938366 - DNA, 19 bp, Homo sapiens
agcactggagtgcagggag

SEQ ID NO: 3938367 - DNA, 14 bp, Homo sapiens
agcactggccagag

SEQ ID NO: 3938368 - DNA, 17 bp, Homo sapiens
agcactgggttgacttt

SEQ ID NO: 3938369 - DNA, 17 bp, Homo sapiens
agcacttctttcctctc

SEQ ID NO: 3938370 - DNA, 22 bp, Homo sapiens
agcacttctttcctctccaatt

SEQ ID NO: 3938371 - DNA, 16 bp, Homo sapiens
agcacttgcgtcctgc

SEQ ID NO: 3938372 - DNA, 19 bp, Homo sapiens
agcacttgcgtcctgcaga

SEQ ID NO: 3938373 - DNA, 20 bp, Homo sapiens
agcacttgcgtcctgcagag

SEQ ID NO: 3938374 - DNA, 22 bp, Homo sapiens
agcacttgcgtcctgcagagga

SEQ ID NO: 3938375 - DNA, 17 bp, Homo sapiens
agcactttaaccctctc

SEQ ID NO: 3938376 - DNA, 19 bp, Homo sapiens
agcactttaaccctctctt

SEQ ID NO: 3938377 - DNA, 20 bp, Homo sapiens
agcactttaaccctctcttc

SEQ ID NO: 3938378 - DNA, 21 bp, Homo sapiens
agcactttaaccctctcttcc

SEQ ID NO: 3938379 - DNA, 23 bp, Homo sapiens
agcactttaaccctctcttccct

SEQ ID NO: 3938380 - DNA, 15 bp, Homo sapiens
agcactttgggaggc

SEQ ID NO: 3938381 - DNA, 13 bp, Homo sapiens
agcagacagagaa

SEQ ID NO: 3938382 - DNA, 16 bp, Homo sapiens
agcagacgcagcagct

SEQ ID NO: 3938383 - DNA, 18 bp, Homo sapiens
agcagagcaaatgaggga

SEQ ID NO: 3938384 - DNA, 17 bp, Homo sapiens
agcagagctgatggaga

SEQ ID NO: 3938385 - DNA, 19 bp, Homo sapiens
agcagagctgatggagaag

SEQ ID NO: 3938386 - DNA, 19 bp, Homo sapiens
agcagaggagtccagggcg

SEQ ID NO: 3938387 - DNA, 22 bp, Homo sapiens
agcagaggagtccagggcggga

SEQ ID NO: 3938388 - DNA, 23 bp, Homo sapiens
agcagaggtggccagagctggga

SEQ ID NO: 3938389 - DNA, 18 bp, Homo sapiens
agcagagtataggatgga

SEQ ID NO: 3938390 - DNA, 16 bp, Homo sapiens
agcagataaagacagc

SEQ ID NO: 3938391 - DNA, 17 bp, Homo sapiens
agcagatggaaagaaag

SEQ ID NO: 3938392 - DNA, 21 bp, Homo sapiens
agcagcacgattttgcacaaa

SEQ ID NO: 3938393 - DNA, 16 bp, Homo sapiens
agcagcattcagcaca

SEQ ID NO: 3938394 - DNA, 17 bp, Homo sapiens
agcagcattcagcacac

SEQ ID NO: 3938395 - DNA, 21 bp, Homo sapiens
agcagccagccagtcttgcct

SEQ ID NO: 3938396 - DNA, 16 bp, Homo sapiens
agcagccagccctgcc

SEQ ID NO: 3938397 - DNA, 18 bp, Homo sapiens
agcagccagccctgcctg

SEQ ID NO: 3938398 - DNA, 19 bp, Homo sapiens
agcagccagccctgcctgg

SEQ ID NO: 3938399 - DNA, 23 bp, Homo sapiens
agcagccagccctgcctggagga

SEQ ID NO: 3938400 - DNA, 12 bp, Homo sapiens
agcagcccagct

SEQ ID NO: 3938401 - DNA, 13 bp, Homo sapiens
agcagccccccag

SEQ ID NO: 3938402 - DNA, 17 bp, Homo sapiens
agcagccccccagcact

SEQ ID NO: 3938403 - DNA, 16 bp, Homo sapiens
agcagccccctgcccg

SEQ ID NO: 3938404 - DNA, 14 bp, Homo sapiens
agcagccctaagga

SEQ ID NO: 3938405 - DNA, 18 bp, Homo sapiens
agcagccctaaggatctc

SEQ ID NO: 3938406 - DNA, 13 bp, Homo sapiens
agcagccctcctc

SEQ ID NO: 3938407 - DNA, 16 bp, Homo sapiens
agcagccctcctcacc

SEQ ID NO: 3938408 - DNA, 23 bp, Homo sapiens
agcagccctcctcaccccgtctg

SEQ ID NO: 3938409 - DNA, 13 bp, Homo sapiens
agcagcctgatgg

SEQ ID NO: 3938410 - DNA, 14 bp, Homo sapiens
agcagcctgatggc

SEQ ID NO: 3938411 - DNA, 18 bp, Homo sapiens
agcagctaggactgagga

SEQ ID NO: 3938412 - DNA, 18 bp, Homo sapiens
agcagctgagcagggccg

SEQ ID NO: 3938413 - DNA, 12 bp, Homo sapiens
agcagctgcggg

SEQ ID NO: 3938414 - DNA, 16 bp, Homo sapiens
agcagctgcgggtctg

SEQ ID NO: 3938415 - DNA, 13 bp, Homo sapiens
agcagctgggccg

SEQ ID NO: 3938416 - DNA, 14 bp, Homo sapiens
agcagctgggccgg

SEQ ID NO: 3938417 - DNA, 18 bp, Homo sapiens
agcagctgggccggccag

SEQ ID NO: 3938418 - DNA, 19 bp, Homo sapiens
agcagctgggccggccagc

SEQ ID NO: 3938419 - DNA, 20 bp, Homo sapiens
agcagctgggccggccagcc

SEQ ID NO: 3938420 - DNA, 17 bp, Homo sapiens
agcagcttcagttgttt

SEQ ID NO: 3938421 - DNA, 16 bp, Homo sapiens
agcaggaacagagact

SEQ ID NO: 3938422 - DNA, 20 bp, Homo sapiens
agcctctgccccaaggggcc

SEQ ID NO: 3938423 - DNA, 18 bp, Homo sapiens
agcctctgccctgcctcc

SEQ ID NO: 3938424 - DNA, 16 bp, Homo sapiens
agcctctgcctgtgca

SEQ ID NO: 3938425 - DNA, 14 bp, Homo sapiens
agcctcttctgcca

SEQ ID NO: 3938426 - DNA, 15 bp, Homo sapiens
agcctgagtctcctg

SEQ ID NO: 3938427 - DNA, 16 bp, Homo sapiens
agcctgagtctcctgt

SEQ ID NO: 3938428 - DNA, 18 bp, Homo sapiens
agcctgagtctcctgtgc

SEQ ID NO: 3938429 - DNA, 18 bp, Homo sapiens
agcctgcaaactcactgc

SEQ ID NO: 3938430 - DNA, 19 bp, Homo sapiens
agcctgcaaactcactgct

SEQ ID NO: 3938431 - DNA, 19 bp, Homo sapiens
agcctgccgccgtctctgt

SEQ ID NO: 3938432 - DNA, 11 bp, Homo sapiens
agcctgctccc

SEQ ID NO: 3938433 - DNA, 15 bp, Homo sapiens
agcctgctcccccac

SEQ ID NO: 3938434 - DNA, 14 bp, Homo sapiens
agcctgctttttaa

SEQ ID NO: 3938435 - DNA, 20 bp, Homo sapiens
agcctggactctaagctgga

SEQ ID NO: 3938436 - DNA, 13 bp, Homo sapiens
agcctggagaagc

SEQ ID NO: 3938437 - DNA, 11 bp, Homo sapiens
agcctggcctc

SEQ ID NO: 3938438 - DNA, 15 bp, Homo sapiens
agcctggcctcctgc

SEQ ID NO: 3938439 - DNA, 18 bp, Homo sapiens
agcctggcggggcaggag

SEQ ID NO: 3938440 - DNA, 19 bp, Homo sapiens
agcctggcggggcaggagg

SEQ ID NO: 3938441 - DNA, 20 bp, Homo sapiens
agcctggcggggcaggaggc

SEQ ID NO: 3938442 - DNA, 17 bp, Homo sapiens
agcctgggactcccagt

SEQ ID NO: 3938443 - DNA, 13 bp, Homo sapiens
agcctgggcaaca

SEQ ID NO: 3938444 - DNA, 13 bp, Homo sapiens
agcctgggccaga

SEQ ID NO: 3938445 - DNA, 16 bp, Homo sapiens
agcctgggccagagaa

SEQ ID NO: 3938446 - DNA, 22 bp, Homo sapiens
agcctgggcctatggagagccc

SEQ ID NO: 3938447 - DNA, 24 bp, Homo sapiens
agcctgggcctatggagagccctg

SEQ ID NO: 3938448 - DNA, 16 bp, Homo sapiens
agcctggggctctaac

SEQ ID NO: 3938449 - DNA, 23 bp, Homo sapiens
agcctggggctctaacgcctgag

SEQ ID NO: 3938450 - DNA, 16 bp, Homo sapiens
agcctgggggcctggc

SEQ ID NO: 3938451 - DNA, 21 bp, Homo sapiens
agcctgggggcctggctggct

SEQ ID NO: 3938452 - DNA, 13 bp, Homo sapiens
agcctgggtgaga

SEQ ID NO: 3938453 - DNA, 17 bp, Homo sapiens
agcctggtgcccatcct

SEQ ID NO: 3938454 - DNA, 17 bp, Homo sapiens
agcctgtaatcccagct

SEQ ID NO: 3938455 - DNA, 23 bp, Homo sapiens
agcctgtcctggtacagcagggt

SEQ ID NO: 3938456 - DNA, 18 bp, Homo sapiens
agcctgtgaacccaggac

SEQ ID NO: 3938457 - DNA, 19 bp, Homo sapiens
agcctgtggcggtgcctgg

SEQ ID NO: 3938458 - DNA, 11 bp, Homo sapiens
agcctgtggga

SEQ ID NO: 3938459 - DNA, 20 bp, Homo sapiens
agcctgtgggagtagaaaaa

SEQ ID NO: 3938460 - DNA, 14 bp, Homo sapiens
agcctgttcatggc

SEQ ID NO: 3938461 - DNA, 19 bp, Homo sapiens
agcctgttcatggcagatg

SEQ ID NO: 3938462 - DNA, 15 bp, Homo sapiens
agcctgttgctgaag

SEQ ID NO: 3938463 - DNA, 14 bp, Homo sapiens
agccttactcacct

SEQ ID NO: 3938464 - DNA, 22 bp, Homo sapiens
agccttcataggcggtcatgtg

SEQ ID NO: 3938465 - DNA, 18 bp, Homo sapiens
agccttgcatcaagggct

SEQ ID NO: 3938466 - DNA, 20 bp, Homo sapiens
agccttgctagacagccagg

SEQ ID NO: 3938467 - DNA, 20 bp, Homo sapiens
agccttggataatgctgttg

SEQ ID NO: 3938468 - DNA, 22 bp, Homo sapiens
agccttggataatgctgttgcc

SEQ ID NO: 3938469 - DNA, 22 bp, Homo sapiens
agccttggtgtccacctggccc

SEQ ID NO: 3938470 - DNA, 16 bp, Homo sapiens
agccttgtgccctgcc

SEQ ID NO: 3938471 - DNA, 19 bp, Homo sapiens
agccttgtgccctgccccc

SEQ ID NO: 3938472 - DNA, 18 bp, Homo sapiens
agcctttggatgaccaga

SEQ ID NO: 3938473 - DNA, 15 bp, Homo sapiens
agcgagctgctctgc

SEQ ID NO: 3938474 - DNA, 17 bp, Homo sapiens
agcgagctgctctgcta

SEQ ID NO: 3938475 - DNA, 18 bp, Homo sapiens
agcgagctgctctgctat

SEQ ID NO: 3938476 - DNA, 22 bp, Homo sapiens
agcgattccctctcccaggccc

SEQ ID NO: 3938477 - DNA, 23 bp, Homo sapiens
agcgattccctctcccaggcccc

SEQ ID NO: 3938478 - DNA, 23 bp, Homo sapiens
agcgcagggaggatgccacagcc

SEQ ID NO: 3938479 - DNA, 12 bp, Homo sapiens
agcgccctgcag

SEQ ID NO: 3938480 - DNA, 22 bp, Homo sapiens
agcgcctagtggggtctccctc

SEQ ID NO: 3938481 - DNA, 19 bp, Homo sapiens
agcgcggcttggccgccat

SEQ ID NO: 3938482 - DNA, 19 bp, Homo sapiens
agcgcgggcggaggcggct

SEQ ID NO: 3938483 - DNA, 18 bp, Homo sapiens
agcgctgccgcaccccag

SEQ ID NO: 3938484 - DNA, 16 bp, Homo sapiens
agcgctttctggaaaa

SEQ ID NO: 3938485 - DNA, 17 bp, Homo sapiens
agcgctttctggaaaag

SEQ ID NO: 3938486 - DNA, 21 bp, Homo sapiens
agcgctttctggaaaagagga

SEQ ID NO: 3938487 - DNA, 20 bp, Homo sapiens
agcgggcctcttccctcagt

SEQ ID NO: 3938488 - DNA, 13 bp, Homo sapiens
agcggttgcttct

SEQ ID NO: 3938489 - DNA, 20 bp, Homo sapiens
agcgtcccctgctactcctg

SEQ ID NO: 3938490 - DNA, 16 bp, Homo sapiens
agcgtccctagcagtg

SEQ ID NO: 3938491 - DNA, 18 bp, Homo sapiens
agcgtccctagcagtgaa

SEQ ID NO: 3938492 - DNA, 15 bp, Homo sapiens
agcgtgccctgcccc

SEQ ID NO: 3938493 - DNA, 20 bp, Homo sapiens
agctaacagggaaggcaggc

SEQ ID NO: 3938494 - DNA, 23 bp, Homo sapiens
agctaactccagtctcctgacat

SEQ ID NO: 3938495 - DNA, 19 bp, Homo sapiens
agctaagccttatgtgagc

SEQ ID NO: 3938496 - DNA, 17 bp, Homo sapiens
agctaagctaggaatga

SEQ ID NO: 3938497 - DNA, 13 bp, Homo sapiens
agctaatctgtag

SEQ ID NO: 3938498 - DNA, 20 bp, Homo sapiens
agctaatctgtagggctgga

SEQ ID NO: 3938499 - DNA, 17 bp, Homo sapiens
agctaattaaggtttgc

SEQ ID NO: 3938500 - DNA, 19 bp, Homo sapiens
agctaattaaggtttgccc

SEQ ID NO: 3938501 - DNA, 20 bp, Homo sapiens
agctacattcctcagctgcc

SEQ ID NO: 3938502 - DNA, 21 bp, Homo sapiens
agctacattcctcagctgcca

SEQ ID NO: 3938503 - DNA, 17 bp, Homo sapiens
agctacccaaaagagaa

SEQ ID NO: 3938504 - DNA, 20 bp, Homo sapiens
agctacccaaaagagaaaaa

SEQ ID NO: 3938505 - DNA, 20 bp, Homo sapiens
agctacctgtgtggacagga

SEQ ID NO: 3938506 - DNA, 22 bp, Homo sapiens
agctacctgtgtggacaggact

SEQ ID NO: 3938507 - DNA, 13 bp, Homo sapiens
agctactctcttg

SEQ ID NO: 3938508 - DNA, 19 bp, Homo sapiens
aggaaaagtcaacatcttc

SEQ ID NO: 3938509 - DNA, 19 bp, Homo sapiens
aggaaaagtgcaatgcgtg

SEQ ID NO: 3938510 - DNA, 13 bp, Homo sapiens
aggaaaatttcac

SEQ ID NO: 3938511 - DNA, 12 bp, Homo sapiens
aggaaacctggc

SEQ ID NO: 3938512 - DNA, 14 bp, Homo sapiens
aggaaagccctccc

SEQ ID NO: 3938513 - DNA, 19 bp, Homo sapiens
aggaaaggggcgagcaccc

SEQ ID NO: 3938514 - DNA, 17 bp, Homo sapiens
aggaaataaaacctttc

SEQ ID NO: 3938515 - DNA, 20 bp, Homo sapiens
aggaaataaaacctttcaaa

SEQ ID NO: 3938516 - DNA, 19 bp, Homo sapiens
aggaaatcaaatatgcaaa

SEQ ID NO: 3938517 - DNA, 22 bp, Homo sapiens
aggaaatcaaatatgcaaagca

SEQ ID NO: 3938518 - DNA, 23 bp, Homo sapiens
aggaaatcaaatatgcaaagcac

SEQ ID NO: 3938519 - DNA, 23 bp, Homo sapiens
aggaacaagagaaaaaactagag

SEQ ID NO: 3938520 - DNA, 23 bp, Homo sapiens
aggaacacccgactcctcaaaag

SEQ ID NO: 3938521 - DNA, 13 bp, Homo sapiens
aggaacagagact

SEQ ID NO: 3938522 - DNA, 16 bp, Homo sapiens
aggaacctcaaactgg

SEQ ID NO: 3938523 - DNA, 13 bp, Homo sapiens
aggaactcccagc

SEQ ID NO: 3938524 - DNA, 23 bp, Homo sapiens
aggaactcccagcaacacaagct

SEQ ID NO: 3938525 - DNA, 21 bp, Homo sapiens
aggaactctggcttccaggta

SEQ ID NO: 3938526 - DNA, 21 bp, Homo sapiens
aggaagaaaccccaagcagca

SEQ ID NO: 3938527 - DNA, 20 bp, Homo sapiens
aggaagaatggtgtgggaga

SEQ ID NO: 3938528 - DNA, 19 bp, Homo sapiens
aggaagagagagagagagg

SEQ ID NO: 3938529 - DNA, 20 bp, Homo sapiens
aggaagagcaggcacatgga

SEQ ID NO: 3938530 - DNA, 16 bp, Homo sapiens
aggaagctctctttcc

SEQ ID NO: 3938531 - DNA, 11 bp, Homo sapiens
aggaaggaaaa

SEQ ID NO: 3938532 - DNA, 21 bp, Homo sapiens
aggaaggagactcacctctgc

SEQ ID NO: 3938533 - DNA, 13 bp, Homo sapiens
aggaaggatggca

SEQ ID NO: 3938534 - DNA, 15 bp, Homo sapiens
aggaaggcagctgct

SEQ ID NO: 3938535 - DNA, 16 bp, Homo sapiens
aggaaggcagctgctc

SEQ ID NO: 3938536 - DNA, 14 bp, Homo sapiens
aggaagggacacac

SEQ ID NO: 3938537 - DNA, 17 bp, Homo sapiens
aggaagggacacacaca

SEQ ID NO: 3938538 - DNA, 21 bp, Homo sapiens
aggaagggtgggaagcttgct

SEQ ID NO: 3938539 - DNA, 14 bp, Homo sapiens
aggaaggtgctgag

SEQ ID NO: 3938540 - DNA, 16 bp, Homo sapiens
aggaaggtgctgagct

SEQ ID NO: 3938541 - DNA, 14 bp, Homo sapiens
aggaaggttttctc

SEQ ID NO: 3938542 - DNA, 18 bp, Homo sapiens
aggaaggttttctccact

SEQ ID NO: 3938543 - DNA, 17 bp, Homo sapiens
aggaagtctaggagctg

SEQ ID NO: 3938544 - DNA, 18 bp, Homo sapiens
aggaagtctaggagctgg

SEQ ID NO: 3938545 - DNA, 12 bp, Homo sapiens
aggaataagaat

SEQ ID NO: 3938546 - DNA, 14 bp, Homo sapiens
aggaatagccagag

SEQ ID NO: 3938547 - DNA, 17 bp, Homo sapiens
aggaatagccagagagg

SEQ ID NO: 3938548 - DNA, 12 bp, Homo sapiens
aggaatcctttg

SEQ ID NO: 3938549 - DNA, 15 bp, Homo sapiens
aggaatcctttgaga

SEQ ID NO: 3938550 - DNA, 16 bp, Homo sapiens
aggaatctacctgtgg

SEQ ID NO: 3938551 - DNA, 18 bp, Homo sapiens
aggaatctacctgtggtg

SEQ ID NO: 3938552 - DNA, 19 bp, Homo sapiens
aggaatctacctgtggtga

SEQ ID NO: 3938553 - DNA, 22 bp, Homo sapiens
aggaatctgaaagtatattttc

SEQ ID NO: 3938554 - DNA, 22 bp, Homo sapiens
aggaatgaccacgggcctcagt

SEQ ID NO: 3938555 - DNA, 24 bp, Homo sapiens
aggaatgcctcctccctgggcaga

SEQ ID NO: 3938556 - DNA, 16 bp, Homo sapiens
aggaatgcctgtgtga

SEQ ID NO: 3938557 - DNA, 15 bp, Homo sapiens
aggacaatgccttgg

SEQ ID NO: 3938558 - DNA, 22 bp, Homo sapiens
aggacacacagtctcagtccag

SEQ ID NO: 3938559 - DNA, 18 bp, Homo sapiens
aggacacatcccggcctc

SEQ ID NO: 3938560 - DNA, 11 bp, Homo sapiens
aggacacatgt

SEQ ID NO: 3938561 - DNA, 13 bp, Homo sapiens
aggacacatgtcc

SEQ ID NO: 3938562 - DNA, 11 bp, Homo sapiens
aggacacctgc

SEQ ID NO: 3938563 - DNA, 13 bp, Homo sapiens
aggacacctgccc

SEQ ID NO: 3938564 - DNA, 14 bp, Homo sapiens
aggacacctgcccc

SEQ ID NO: 3938565 - DNA, 20 bp, Homo sapiens
aggacacctgccccagcgcg

SEQ ID NO: 3938566 - DNA, 23 bp, Homo sapiens
aggacacctgccccagcgcggct

SEQ ID NO: 3938567 - DNA, 16 bp, Homo sapiens
aggacagccgcctgga

SEQ ID NO: 3938568 - DNA, 18 bp, Homo sapiens
aggacagttgggctatgt

SEQ ID NO: 3938569 - DNA, 17 bp, Homo sapiens
aggacatggagagagac

SEQ ID NO: 3938570 - DNA, 18 bp, Homo sapiens
aggacatggagagagact

SEQ ID NO: 3938571 - DNA, 22 bp, Homo sapiens
aggacatggggcatagaaactg

SEQ ID NO: 3938572 - DNA, 21 bp, Homo sapiens
aggacatgtttttgttttctt

SEQ ID NO: 3938573 - DNA, 15 bp, Homo sapiens
aggacattatgtgtg

SEQ ID NO: 3938574 - DNA, 21 bp, Homo sapiens
aggaccaactggcttctgtgc

SEQ ID NO: 3938575 - DNA, 22 bp, Homo sapiens
aggaccacactttgagaacctg

SEQ ID NO: 3938576 - DNA, 14 bp, Homo sapiens
aggacccaggccct

SEQ ID NO: 3938577 - DNA, 15 bp, Homo sapiens
aggacccaggccctc

SEQ ID NO: 3938578 - DNA, 22 bp, Homo sapiens
aggacccggaggggcctggcag

SEQ ID NO: 3938579 - DNA, 23 bp, Homo sapiens
aggaccgtggccctgccctctcc

SEQ ID NO: 3938580 - DNA, 13 bp, Homo sapiens
aggacctgagcct

SEQ ID NO: 3938581 - DNA, 15 bp, Homo sapiens
aggacctgagcctgc

SEQ ID NO: 3938582 - DNA, 17 bp, Homo sapiens
aggacctgagcctgccg

SEQ ID NO: 3938583 - DNA, 16 bp, Homo sapiens
aggacggttgtaagca

SEQ ID NO: 3938584 - DNA, 21 bp, Homo sapiens
aggacgtcatcggaggctggg

SEQ ID NO: 3938585 - DNA, 20 bp, Homo sapiens
aggactaacataaaatctgt

SEQ ID NO: 3938586 - DNA, 20 bp, Homo sapiens
aggactacgttaagggaagg

SEQ ID NO: 3938587 - DNA, 13 bp, Homo sapiens
aggactccccagg

SEQ ID NO: 3938588 - DNA, 16 bp, Homo sapiens
aggactccccaggcca

SEQ ID NO: 3938589 - DNA, 17 bp, Homo sapiens
aggactccccaggccag

SEQ ID NO: 3938590 - DNA, 17 bp, Homo sapiens
aggactccctccatgtg

SEQ ID NO: 3938591 - DNA, 13 bp, Homo sapiens
aggactctgcctc

SEQ ID NO: 3938592 - DNA, 18 bp, Homo sapiens
aggactctgcctcctctt

SEQ ID NO: 3938593 - DNA, 14 bp, Homo sapiens
aggactctgccttt

SEQ ID NO: 3938594 - DNA, 17 bp, Homo sapiens
aggactgaattgtcccc

SEQ ID NO: 3938595 - DNA, 18 bp, Homo sapiens
aggctatttgttcagaga

SEQ ID NO: 3938596 - DNA, 15 bp, Homo sapiens
aggctcaagaggccc

SEQ ID NO: 3938597 - DNA, 19 bp, Homo sapiens
aggctcaagaggcccaggg

SEQ ID NO: 3938598 - DNA, 20 bp, Homo sapiens
aggctcaagaggcccaggga

SEQ ID NO: 3938599 - DNA, 15 bp, Homo sapiens
aggctccatggggaa

SEQ ID NO: 3938600 - DNA, 17 bp, Homo sapiens
aggctccatggggaagt

SEQ ID NO: 3938601 - DNA, 14 bp, Homo sapiens
aggctctgggctca

SEQ ID NO: 3938602 - DNA, 20 bp, Homo sapiens
aggctctgggctcagggctg

SEQ ID NO: 3938603 - DNA, 21 bp, Homo sapiens
aggctctgggctcagggctgg

SEQ ID NO: 3938604 - DNA, 19 bp, Homo sapiens
aggctcttcctggacctga

SEQ ID NO: 3938605 - DNA, 20 bp, Homo sapiens
aggctcttcctggacctgag

SEQ ID NO: 3938606 - DNA, 14 bp, Homo sapiens
aggctcttctcctt

SEQ ID NO: 3938607 - DNA, 13 bp, Homo sapiens
aggctgagacagg

SEQ ID NO: 3938608 - DNA, 18 bp, Homo sapiens
aggctgagacaggagaat

SEQ ID NO: 3938609 - DNA, 14 bp, Homo sapiens
aggctgaggcagaa

SEQ ID NO: 3938610 - DNA, 14 bp, Homo sapiens
aggctgaggtgtct

SEQ ID NO: 3938611 - DNA, 16 bp, Homo sapiens
aggctgcactgcagtg

SEQ ID NO: 3938612 - DNA, 17 bp, Homo sapiens
aggctgcagaaggccaa

SEQ ID NO: 3938613 - DNA, 18 bp, Homo sapiens
aggctgcagaaggccaag

SEQ ID NO: 3938614 - DNA, 17 bp, Homo sapiens
aggctgcatgctctgga

SEQ ID NO: 3938615 - DNA, 19 bp, Homo sapiens
aggctgcatgctctggaag

SEQ ID NO: 3938616 - DNA, 20 bp, Homo sapiens
aggctgcatgctctggaagc

SEQ ID NO: 3938617 - DNA, 20 bp, Homo sapiens
aggctgctcggggtgcacag

SEQ ID NO: 3938618 - DNA, 21 bp, Homo sapiens
aggctgctcggggtgcacagg

SEQ ID NO: 3938619 - DNA, 23 bp, Homo sapiens
aggctgctcggggtgcacaggag

SEQ ID NO: 3938620 - DNA, 14 bp, Homo sapiens
aggctggagaagct

SEQ ID NO: 3938621 - DNA, 15 bp, Homo sapiens
aggctggaggcaggg

SEQ ID NO: 3938622 - DNA, 17 bp, Homo sapiens
aggctggaggcagggcc

SEQ ID NO: 3938623 - DNA, 11 bp, Homo sapiens
aggctggcctg

SEQ ID NO: 3938624 - DNA, 23 bp, Homo sapiens
aggctggcctgatcttggctcac

SEQ ID NO: 3938625 - DNA, 22 bp, Homo sapiens
aggctggctggcccgtcatgtt

SEQ ID NO: 3938626 - DNA, 19 bp, Homo sapiens
aggctggtctcgaactcct

SEQ ID NO: 3938627 - DNA, 19 bp, Homo sapiens
aggctgtggtgagggaaga

SEQ ID NO: 3938628 - DNA, 15 bp, Homo sapiens
aggcttaggtgccag

SEQ ID NO: 3938629 - DNA, 20 bp, Homo sapiens
aggcttcagcatatttatag

SEQ ID NO: 3938630 - DNA, 14 bp, Homo sapiens
aggcttccagagag

SEQ ID NO: 3938631 - DNA, 12 bp, Homo sapiens
aggcttccaggc

SEQ ID NO: 3938632 - DNA, 13 bp, Homo sapiens
aggcttccaggct

SEQ ID NO: 3938633 - DNA, 22 bp, Homo sapiens
aggcttcttcagatcagtgctt

SEQ ID NO: 3938634 - DNA, 23 bp, Homo sapiens
aggctttgccatgggcctgctgc

SEQ ID NO: 3938635 - DNA, 14 bp, Homo sapiens
agggaaaatgaatt

SEQ ID NO: 3938636 - DNA, 23 bp, Homo sapiens
agggaaaccaatagtccccatca

SEQ ID NO: 3938637 - DNA, 14 bp, Homo sapiens
agggaaactgccag

SEQ ID NO: 3938638 - DNA, 19 bp, Homo sapiens
agggaaactgccagcaacg

SEQ ID NO: 3938639 - DNA, 18 bp, Homo sapiens
agggaaaggatattttct

SEQ ID NO: 3938640 - DNA, 13 bp, Homo sapiens
agggaaatggagg

SEQ ID NO: 3938641 - DNA, 13 bp, Homo sapiens
agggaacagacag

SEQ ID NO: 3938642 - DNA, 17 bp, Homo sapiens
agggaacagacaggaga

SEQ ID NO: 3938643 - DNA, 20 bp, Homo sapiens
agggaaccgtctgtttttaa

SEQ ID NO: 3938644 - DNA, 13 bp, Homo sapiens
agggaagagggca

SEQ ID NO: 3938645 - DNA, 14 bp, Homo sapiens
agggaagcaggcag

SEQ ID NO: 3938646 - DNA, 16 bp, Homo sapiens
agggaagcaggcagag

SEQ ID NO: 3938647 - DNA, 14 bp, Homo sapiens
agggaagcagggac

SEQ ID NO: 3938648 - DNA, 12 bp, Homo sapiens
agggaaggcagg

SEQ ID NO: 3938649 - DNA, 15 bp, Homo sapiens
agggaaggcaggcag

SEQ ID NO: 3938650 - DNA, 15 bp, Homo sapiens
agggaagtcttactt

SEQ ID NO: 3938651 - DNA, 20 bp, Homo sapiens
agggaatatgtaagtcagga

SEQ ID NO: 3938652 - DNA, 22 bp, Homo sapiens
agggaatatgtaagtcaggagt

SEQ ID NO: 3938653 - DNA, 18 bp, Homo sapiens
agggaatgttccctgcac

SEQ ID NO: 3938654 - DNA, 23 bp, Homo sapiens
agggaatgttccctgcaccctgg

SEQ ID NO: 3938655 - DNA, 16 bp, Homo sapiens
agggacagtattctca

SEQ ID NO: 3938656 - DNA, 14 bp, Homo sapiens
agggaccttgaagg

SEQ ID NO: 3938657 - DNA, 14 bp, Homo sapiens
agggacgaagaaag

SEQ ID NO: 3938658 - DNA, 15 bp, Homo sapiens
agggacgaagaaagg

SEQ ID NO: 3938659 - DNA, 21 bp, Homo sapiens
agggacgctttgggagaatgt

SEQ ID NO: 3938660 - DNA, 19 bp, Homo sapiens
agggacggggactggccct

SEQ ID NO: 3938661 - DNA, 20 bp, Homo sapiens
agggactcaagggtccagaa

SEQ ID NO: 3938662 - DNA, 22 bp, Homo sapiens
agggactgtcgctgcttcgtgg

SEQ ID NO: 3938663 - DNA, 13 bp, Homo sapiens
agggacttaaaaa

SEQ ID NO: 3938664 - DNA, 17 bp, Homo sapiens
agggagaagaaatccat

SEQ ID NO: 3938665 - DNA, 16 bp, Homo sapiens
agggagaaggatctag

SEQ ID NO: 3938666 - DNA, 13 bp, Homo sapiens
agggagacagaga

SEQ ID NO: 3938667 - DNA, 13 bp, Homo sapiens
agggagagactct

SEQ ID NO: 3938668 - DNA, 17 bp, Homo sapiens
agggagaggagtgactg

SEQ ID NO: 3938669 - DNA, 15 bp, Homo sapiens
agggagagggaggga

SEQ ID NO: 3938670 - DNA, 17 bp, Homo sapiens
agggagcagacaggagg

SEQ ID NO: 3938671 - DNA, 23 bp, Homo sapiens
agggaggagaggaaatgctattg

SEQ ID NO: 3938672 - DNA, 16 bp, Homo sapiens
agggaggccgaagcta

SEQ ID NO: 3938673 - DNA, 15 bp, Homo sapiens
agggagggctctgag

SEQ ID NO: 3938674 - DNA, 20 bp, Homo sapiens
agggagggctctgaggcgcc

SEQ ID NO: 3938675 - DNA, 19 bp, Homo sapiens
agggagggggcgctcagga

SEQ ID NO: 3938676 - DNA, 21 bp, Homo sapiens
agggagggggcgctcaggacc

SEQ ID NO: 3938677 - DNA, 20 bp, Homo sapiens
agggaggggtcctgatttca

SEQ ID NO: 3938678 - DNA, 18 bp, Homo sapiens
agggagttgctcactcag

SEQ ID NO: 3938679 - DNA, 20 bp, Homo sapiens
agggagttgctcactcagga

SEQ ID NO: 3938680 - DNA, 22 bp, Homo sapiens
agggagttgctcactcaggact

SEQ ID NO: 3938681 - DNA, 14 bp, Homo sapiens
agggatacactgaa

SEQ ID NO: 3938682 - DNA, 23 bp, Homo sapiens
aggttgttctgtataaaatgcaa

SEQ ID NO: 3938683 - DNA, 23 bp, Homo sapiens
aggtttcttggggtcccagggaa

SEQ ID NO: 3938684 - DNA, 17 bp, Homo sapiens
aggtttgcacccctcct

SEQ ID NO: 3938685 - DNA, 17 bp, Homo sapiens
aggtttggtccagcctg

SEQ ID NO: 3938686 - DNA, 22 bp, Homo sapiens
aggttttcctcttctattttgt

SEQ ID NO: 3938687 - DNA, 14 bp, Homo sapiens
aggttttctccact

SEQ ID NO: 3938688 - DNA, 16 bp, Homo sapiens
agtaaaaccacagcag

SEQ ID NO: 3938689 - DNA, 14 bp, Homo sapiens
agtaaaacttgctg

SEQ ID NO: 3938690 - DNA, 15 bp, Homo sapiens
agtaaaagctaatta

SEQ ID NO: 3938691 - DNA, 15 bp, Homo sapiens
agtaaagtttaaaaa

SEQ ID NO: 3938692 - DNA, 16 bp, Homo sapiens
agtaaagtttaaaaaa

SEQ ID NO: 3938693 - DNA, 19 bp, Homo sapiens
agtaaatccttatttatat

SEQ ID NO: 3938694 - DNA, 16 bp, Homo sapiens
agtaaatttgtccaat

SEQ ID NO: 3938695 - DNA, 23 bp, Homo sapiens
agtaacaggaaaccacttatcac

SEQ ID NO: 3938696 - DNA, 19 bp, Homo sapiens
agtaactactttttatact

SEQ ID NO: 3938697 - DNA, 20 bp, Homo sapiens
agtaactactttttatactc

SEQ ID NO: 3938698 - DNA, 19 bp, Homo sapiens
agtaactgccatcaagatg

SEQ ID NO: 3938699 - DNA, 19 bp, Homo sapiens
agtaagagctaagttctaa

SEQ ID NO: 3938700 - DNA, 17 bp, Homo sapiens
agtaataaaacccagca

SEQ ID NO: 3938701 - DNA, 20 bp, Homo sapiens
agtaataaaacccagcatgt

SEQ ID NO: 3938702 - DNA, 23 bp, Homo sapiens
agtaataaaacccagcatgtaca

SEQ ID NO: 3938703 - DNA, 19 bp, Homo sapiens
agtaatagtccaatatttg

SEQ ID NO: 3938704 - DNA, 17 bp, Homo sapiens
agtaatgcactctcagt

SEQ ID NO: 3938705 - DNA, 21 bp, Homo sapiens
agtaatgggccaattaaaata

SEQ ID NO: 3938706 - DNA, 23 bp, Homo sapiens
agtaatgggccaattaaaatata

SEQ ID NO: 3938707 - DNA, 20 bp, Homo sapiens
agtacaataataaatcctca

SEQ ID NO: 3938708 - DNA, 21 bp, Homo sapiens
agtacagacgtctcaagactg

SEQ ID NO: 3938709 - DNA, 23 bp, Homo sapiens
agtacagtagcttaaataaattc

SEQ ID NO: 3938710 - DNA, 20 bp, Homo sapiens
agtaccaaatccacaagcca

SEQ ID NO: 3938711 - DNA, 17 bp, Homo sapiens
agtactctctgctctag

SEQ ID NO: 3938712 - DNA, 17 bp, Homo sapiens
agtactttagcctggta

SEQ ID NO: 3938713 - DNA, 19 bp, Homo sapiens
agtagaaaaatctcattcc

SEQ ID NO: 3938714 - DNA, 13 bp, Homo sapiens
agtagaattatat

SEQ ID NO: 3938715 - DNA, 17 bp, Homo sapiens
agtagaattatatctaa

SEQ ID NO: 3938716 - DNA, 13 bp, Homo sapiens
agtagacttatag

SEQ ID NO: 3938717 - DNA, 16 bp, Homo sapiens
agtagatagaaagcaa

SEQ ID NO: 3938718 - DNA, 21 bp, Homo sapiens
agtagatggtgaaatttatta

SEQ ID NO: 3938719 - DNA, 14 bp, Homo sapiens
agtagccaagttat

SEQ ID NO: 3938720 - DNA, 15 bp, Homo sapiens
agtagccctttctgt

SEQ ID NO: 3938721 - DNA, 16 bp, Homo sapiens
agtagccctttctgtg

SEQ ID NO: 3938722 - DNA, 19 bp, Homo sapiens
agtagctatgactgcagat

SEQ ID NO: 3938723 - DNA, 14 bp, Homo sapiens
agtagctgagctca

SEQ ID NO: 3938724 - DNA, 16 bp, Homo sapiens
agtagcttaaataaat

SEQ ID NO: 3938725 - DNA, 17 bp, Homo sapiens
agtagcttaaataaatt

SEQ ID NO: 3938726 - DNA, 19 bp, Homo sapiens
agtagcttaaataaattca

SEQ ID NO: 3938727 - DNA, 21 bp, Homo sapiens
agtagcttaaataaattcaaa

SEQ ID NO: 3938728 - DNA, 18 bp, Homo sapiens
agtaggggaagacatgca

SEQ ID NO: 3938729 - DNA, 17 bp, Homo sapiens
agtagtttgtataactt

SEQ ID NO: 3938730 - DNA, 14 bp, Homo sapiens
agtataaaagacaa

SEQ ID NO: 3938731 - DNA, 15 bp, Homo sapiens
agtatacaatatata

SEQ ID NO: 3938732 - DNA, 19 bp, Homo sapiens
agtatacaatatataaaaa

SEQ ID NO: 3938733 - DNA, 14 bp, Homo sapiens
agtataggatggat

SEQ ID NO: 3938734 - DNA, 15 bp, Homo sapiens
agtatatctggacaa

SEQ ID NO: 3938735 - DNA, 18 bp, Homo sapiens
agtatatctggacaagcc

SEQ ID NO: 3938736 - DNA, 16 bp, Homo sapiens
agtatatttatactct

SEQ ID NO: 3938737 - DNA, 14 bp, Homo sapiens
agtatatttatagt

SEQ ID NO: 3938738 - DNA, 18 bp, Homo sapiens
agtatatttatagtcaca

SEQ ID NO: 3938739 - DNA, 15 bp, Homo sapiens
agtatatttctgaaa

SEQ ID NO: 3938740 - DNA, 19 bp, Homo sapiens
agtatcaatccttgttcag

SEQ ID NO: 3938741 - DNA, 18 bp, Homo sapiens
agtatcaggtctcccacg

SEQ ID NO: 3938742 - DNA, 14 bp, Homo sapiens
agtatcatgcattc

SEQ ID NO: 3938743 - DNA, 14 bp, Homo sapiens
agtatccactttgc

SEQ ID NO: 3938744 - DNA, 19 bp, Homo sapiens
agtatcttacctgtaaagt

SEQ ID NO: 3938745 - DNA, 13 bp, Homo sapiens
agtatgaatgatg

SEQ ID NO: 3938746 - DNA, 14 bp, Homo sapiens
agtatgaatgatgt

SEQ ID NO: 3938747 - DNA, 15 bp, Homo sapiens
agtatgtaaagtatg

SEQ ID NO: 3938748 - DNA, 14 bp, Homo sapiens
agtatgtgatatct

SEQ ID NO: 3938749 - DNA, 18 bp, Homo sapiens
agtattaatactaaaata

SEQ ID NO: 3938750 - DNA, 18 bp, Homo sapiens
agtattcttgtcaaaaaa

SEQ ID NO: 3938751 - DNA, 22 bp, Homo sapiens
agtattgccacaatgcctctcc

SEQ ID NO: 3938752 - DNA, 15 bp, Homo sapiens
agtatttacagatgt

SEQ ID NO: 3938753 - DNA, 23 bp, Homo sapiens
agtatttgaaactgaatgtttat

SEQ ID NO: 3938754 - DNA, 19 bp, Homo sapiens
agtatttgtacaaatactg

SEQ ID NO: 3938755 - DNA, 21 bp, Homo sapiens
agtcaaaacagagatgtgata

SEQ ID NO: 3938756 - DNA, 13 bp, Homo sapiens
agtcaaaatttca

SEQ ID NO: 3938757 - DNA, 13 bp, Homo sapiens
agtcaaaccataa

SEQ ID NO: 3938758 - DNA, 15 bp, Homo sapiens
agtcaaactgtgcca

SEQ ID NO: 3938759 - DNA, 12 bp, Homo sapiens
agtcaaagtaaa

SEQ ID NO: 3938760 - DNA, 13 bp, Homo sapiens
agtcaacatcttc

SEQ ID NO: 3938761 - DNA, 12 bp, Homo sapiens
agtcaagaaaaa

SEQ ID NO: 3938762 - DNA, 15 bp, Homo sapiens
agtcaattagtacag

SEQ ID NO: 3938763 - DNA, 16 bp, Homo sapiens
agtcaattagtacagt

SEQ ID NO: 3938764 - DNA, 23 bp, Homo sapiens
agtcacaccatcttaaatgacag

SEQ ID NO: 3938765 - DNA, 21 bp, Homo sapiens
agtcacagctgcagctgggcc

SEQ ID NO: 3938766 - DNA, 18 bp, Homo sapiens
agtcaccactccattccc

SEQ ID NO: 3938767 - DNA, 20 bp, Homo sapiens
agtcaccctacctgtgcctg

SEQ ID NO: 3938768 - DNA, 14 bp, Homo sapiens
agtcacccttctgg

SEQ ID NO: 3938769 - DNA, 13 bp, Homo sapiens
agtcttccctgat

SEQ ID NO: 3938770 - DNA, 16 bp, Homo sapiens
agtcttggaatacttg

SEQ ID NO: 3938771 - DNA, 13 bp, Homo sapiens
agtctttgttgca

SEQ ID NO: 3938772 - DNA, 13 bp, Homo sapiens
agtcttttactcc

SEQ ID NO: 3938773 - DNA, 18 bp, Homo sapiens
agtgaaagagtagtgcat

SEQ ID NO: 3938774 - DNA, 22 bp, Homo sapiens
agtgaaataattaaaaaccact

SEQ ID NO: 3938775 - DNA, 20 bp, Homo sapiens
agtgaacacactcagcagcc

SEQ ID NO: 3938776 - DNA, 19 bp, Homo sapiens
agtgaagaaaagtgaatgc

SEQ ID NO: 3938777 - DNA, 22 bp, Homo sapiens
agtgaagaaaagtgaatgctca

SEQ ID NO: 3938778 - DNA, 16 bp, Homo sapiens
agtgaaggagaaagga

SEQ ID NO: 3938779 - DNA, 17 bp, Homo sapiens
agtgaagtgagaagttc

SEQ ID NO: 3938780 - DNA, 12 bp, Homo sapiens
agtgaataaact

SEQ ID NO: 3938781 - DNA, 16 bp, Homo sapiens
agtgaataaacttcag

SEQ ID NO: 3938782 - DNA, 18 bp, Homo sapiens
agtgaataaacttcagca

SEQ ID NO: 3938783 - DNA, 18 bp, Homo sapiens
agtgaatgctcaagtttt

SEQ ID NO: 3938784 - DNA, 21 bp, Homo sapiens
agtgaccataaaggcatggca

SEQ ID NO: 3938785 - DNA, 21 bp, Homo sapiens
agtgaccccagcctcctgcct

SEQ ID NO: 3938786 - DNA, 19 bp, Homo sapiens
agtgactcggtgtaaaacc

SEQ ID NO: 3938787 - DNA, 23 bp, Homo sapiens
agtgactcggtgtaaaaccatgt

SEQ ID NO: 3938788 - DNA, 22 bp, Homo sapiens
agtgactggcaggtgcagatgg

SEQ ID NO: 3938789 - DNA, 20 bp, Homo sapiens
agtgactgtcgtgtttacaa

SEQ ID NO: 3938790 - DNA, 15 bp, Homo sapiens
agtgacttcctggtg

SEQ ID NO: 3938791 - DNA, 16 bp, Homo sapiens
agtgacttcctggtga

SEQ ID NO: 3938792 - DNA, 16 bp, Homo sapiens
agtgactttttctgag

SEQ ID NO: 3938793 - DNA, 20 bp, Homo sapiens
agtgactttttctgagcttt

SEQ ID NO: 3938794 - DNA, 20 bp, Homo sapiens
agtgagaaaaagctcctgtc

SEQ ID NO: 3938795 - DNA, 12 bp, Homo sapiens
agtgagacacag

SEQ ID NO: 3938796 - DNA, 23 bp, Homo sapiens
agtgagacacagagtggagccct

SEQ ID NO: 3938797 - DNA, 13 bp, Homo sapiens
agtgagagggcat

SEQ ID NO: 3938798 - DNA, 14 bp, Homo sapiens
agtgagagggcatg

SEQ ID NO: 3938799 - DNA, 22 bp, Homo sapiens
agtgagagggcatgcgcacaag

SEQ ID NO: 3938800 - DNA, 20 bp, Homo sapiens
agtgagccgcatcttctcca

SEQ ID NO: 3938801 - DNA, 23 bp, Homo sapiens
agtgagctgagatcgtgccgtta

SEQ ID NO: 3938802 - DNA, 19 bp, Homo sapiens
agtgagctggaattctaaa

SEQ ID NO: 3938803 - DNA, 17 bp, Homo sapiens
agtgagctgtaggtgtg

SEQ ID NO: 3938804 - DNA, 16 bp, Homo sapiens
agtgaggcttccaggc

SEQ ID NO: 3938805 - DNA, 14 bp, Homo sapiens
agtgagggctgggc

SEQ ID NO: 3938806 - DNA, 14 bp, Homo sapiens
agtgagtctgtcag

SEQ ID NO: 3938807 - DNA, 23 bp, Homo sapiens
agtgatacaacttcaagtgcatg

SEQ ID NO: 3938808 - DNA, 15 bp, Homo sapiens
agtgatatatgtatt

SEQ ID NO: 3938809 - DNA, 16 bp, Homo sapiens
agtgatatatgtattt

SEQ ID NO: 3938810 - DNA, 21 bp, Homo sapiens
agtgatctgtcccctctcccc

SEQ ID NO: 3938811 - DNA, 21 bp, Homo sapiens
agtgatggcgcgggaggcacc

SEQ ID NO: 3938812 - DNA, 19 bp, Homo sapiens
agtgatggtctcacagagc

SEQ ID NO: 3938813 - DNA, 19 bp, Homo sapiens
agtgatgtcactagggcag

SEQ ID NO: 3938814 - DNA, 21 bp, Homo sapiens
agtgatgttgtttgggagagt

SEQ ID NO: 3938815 - DNA, 14 bp, Homo sapiens
agtgatgtttttat

SEQ ID NO: 3938816 - DNA, 24 bp, Homo sapiens
agtgattgtgtctgcattgttatt

SEQ ID NO: 3938817 - DNA, 23 bp, Homo sapiens
agtgcaaatactccaagcttcaa

SEQ ID NO: 3938818 - DNA, 11 bp, Homo sapiens
agtgcaacaag

SEQ ID NO: 3938819 - DNA, 19 bp, Homo sapiens
agtgcacacagaaatatat

SEQ ID NO: 3938820 - DNA, 22 bp, Homo sapiens
agtgcagtggtgcgatcttggc

SEQ ID NO: 3938821 - DNA, 16 bp, Homo sapiens
agtgcatctcagccca

SEQ ID NO: 3938822 - DNA, 15 bp, Homo sapiens
agtgcatgctctctg

SEQ ID NO: 3938823 - DNA, 17 bp, Homo sapiens
agtgcatgctctctgca

SEQ ID NO: 3938824 - DNA, 22 bp, Homo sapiens
agtgcatgctctctgcagccag

SEQ ID NO: 3938825 - DNA, 12 bp, Homo sapiens
agtgccacagag

SEQ ID NO: 3938826 - DNA, 13 bp, Homo sapiens
agtgccacagaga

SEQ ID NO: 3938827 - DNA, 19 bp, Homo sapiens
agtgccactcattcctgta

SEQ ID NO: 3938828 - DNA, 23 bp, Homo sapiens
agtgccacttgacattccttgtc

SEQ ID NO: 3938829 - DNA, 18 bp, Homo sapiens
agtgccatcccacattcg

SEQ ID NO: 3938830 - DNA, 19 bp, Homo sapiens
agtgcccaccaacatccca

SEQ ID NO: 3938831 - DNA, 20 bp, Homo sapiens
agtgcccaccaacatcccat

SEQ ID NO: 3938832 - DNA, 13 bp, Homo sapiens
agtgcctcctggc

SEQ ID NO: 3938833 - DNA, 19 bp, Homo sapiens
agtgcctcctgggaccatg

SEQ ID NO: 3938834 - DNA, 17 bp, Homo sapiens
agtgcctcgaggcaccg

SEQ ID NO: 3938835 - DNA, 12 bp, Homo sapiens
agtgcctgctga

SEQ ID NO: 3938836 - DNA, 22 bp, Homo sapiens
agtgccttacctcctgcccagg

SEQ ID NO: 3938837 - DNA, 23 bp, Homo sapiens
agtgcgctcattttaggcctcct

SEQ ID NO: 3938838 - DNA, 15 bp, Homo sapiens
agtgctatatatata

SEQ ID NO: 3938839 - DNA, 23 bp, Homo sapiens
agtgctatatatataaatatttg

SEQ ID NO: 3938840 - DNA, 16 bp, Homo sapiens
agtgctattctgtgtt

SEQ ID NO: 3938841 - DNA, 19 bp, Homo sapiens
agtgctattctgtgttgaa

SEQ ID NO: 3938842 - DNA, 14 bp, Homo sapiens
agtgctccccacac

SEQ ID NO: 3938843 - DNA, 16 bp, Homo sapiens
agtgctccccacacgt

SEQ ID NO: 3938844 - DNA, 23 bp, Homo sapiens
agtgctccccacacgtgctcgca

SEQ ID NO: 3938845 - DNA, 14 bp, Homo sapiens
agtgctgattcagc

SEQ ID NO: 3938846 - DNA, 12 bp, Homo sapiens
agtgctgccatg

SEQ ID NO: 3938847 - DNA, 17 bp, Homo sapiens
agtgctgccatgccact

SEQ ID NO: 3938848 - DNA, 21 bp, Homo sapiens
agtgctgccatgccactgcca

SEQ ID NO: 3938849 - DNA, 23 bp, Homo sapiens
agtgctgccatgccactgccagg

SEQ ID NO: 3938850 - DNA, 12 bp, Homo sapiens
agtgctgccctg

SEQ ID NO: 3938851 - DNA, 22 bp, Homo sapiens
agtgctgttttgtcctttgaga

SEQ ID NO: 3938852 - DNA, 14 bp, Homo sapiens
agtgcttagaaagt

SEQ ID NO: 3938853 - DNA, 19 bp, Homo sapiens
agtgcttgagtttggggaa

SEQ ID NO: 3938854 - DNA, 23 bp, Homo sapiens
agtgcttgggtggtgggtgctgg

SEQ ID NO: 3938855 - DNA, 16 bp, Homo sapiens
atagagtttaacacaa

SEQ ID NO: 3938856 - DNA, 21 bp, Homo sapiens
atagatctgatggtgagctgg

SEQ ID NO: 3938857 - DNA, 13 bp, Homo sapiens
atagatgggtctg

SEQ ID NO: 3938858 - DNA, 14 bp, Homo sapiens
atagatgtatcatt

SEQ ID NO: 3938859 - DNA, 18 bp, Homo sapiens
atagatttgtattttaaa

SEQ ID NO: 3938860 - DNA, 19 bp, Homo sapiens
atagcagcaaaaatataaa

SEQ ID NO: 3938861 - DNA, 20 bp, Homo sapiens
atagcagcaaaaatataaaa

SEQ ID NO: 3938862 - DNA, 15 bp, Homo sapiens
atagccagacacatg

SEQ ID NO: 3938863 - DNA, 13 bp, Homo sapiens
atagccagagagg

SEQ ID NO: 3938864 - DNA, 14 bp, Homo sapiens
atagccagagagga

SEQ ID NO: 3938865 - DNA, 18 bp, Homo sapiens
atagccgggcatggtggc

SEQ ID NO: 3938866 - DNA, 20 bp, Homo sapiens
atagcgggttactttcacat

SEQ ID NO: 3938867 - DNA, 18 bp, Homo sapiens
atagctattactgtctgg

SEQ ID NO: 3938868 - DNA, 22 bp, Homo sapiens
atagctattttcttacagtgga

SEQ ID NO: 3938869 - DNA, 22 bp, Homo sapiens
atagctcttctatttaaaaaat

SEQ ID NO: 3938870 - DNA, 18 bp, Homo sapiens
atagctgacatctcctct

SEQ ID NO: 3938871 - DNA, 15 bp, Homo sapiens
atagcttttattgta

SEQ ID NO: 3938872 - DNA, 19 bp, Homo sapiens
ataggatataaaacacatc

SEQ ID NO: 3938873 - DNA, 17 bp, Homo sapiens
ataggcggtcatgtgtg

SEQ ID NO: 3938874 - DNA, 19 bp, Homo sapiens
ataggcggtcatgtgtgca

SEQ ID NO: 3938875 - DNA, 20 bp, Homo sapiens
ataggcggtcatgtgtgcat

SEQ ID NO: 3938876 - DNA, 21 bp, Homo sapiens
ataggcggtcatgtgtgcatg

SEQ ID NO: 3938877 - DNA, 22 bp, Homo sapiens
ataggcggtcatgtgtgcatgt

SEQ ID NO: 3938878 - DNA, 16 bp, Homo sapiens
ataggctggagaagct

SEQ ID NO: 3938879 - DNA, 14 bp, Homo sapiens
ataggtgctacaaa

SEQ ID NO: 3938880 - DNA, 21 bp, Homo sapiens
ataggtgctacaaaaacacag

SEQ ID NO: 3938881 - DNA, 15 bp, Homo sapiens
atagtaagcctccct

SEQ ID NO: 3938882 - DNA, 18 bp, Homo sapiens
atagtagtcaattagtac

SEQ ID NO: 3938883 - DNA, 22 bp, Homo sapiens
atagtagtcaattagtacagta

SEQ ID NO: 3938884 - DNA, 16 bp, Homo sapiens
atagtatatttatact

SEQ ID NO: 3938885 - DNA, 22 bp, Homo sapiens
atagtcaaaccataaacttcat

SEQ ID NO: 3938886 - DNA, 21 bp, Homo sapiens
atagtccatggacaatataaa

SEQ ID NO: 3938887 - DNA, 15 bp, Homo sapiens
atagtgctatatata

SEQ ID NO: 3938888 - DNA, 19 bp, Homo sapiens
atagtgctatatatataaa

SEQ ID NO: 3938889 - DNA, 13 bp, Homo sapiens
atagtgtaaaata

SEQ ID NO: 3938890 - DNA, 17 bp, Homo sapiens
atagttatttacttgaa

SEQ ID NO: 3938891 - DNA, 21 bp, Homo sapiens
atagttctatcaggaaaacaa

SEQ ID NO: 3938892 - DNA, 22 bp, Homo sapiens
atagtttgctttgctttttaat

SEQ ID NO: 3938893 - DNA, 17 bp, Homo sapiens
atataaaaagaaaagat

SEQ ID NO: 3938894 - DNA, 12 bp, Homo sapiens
atataaatgcat

SEQ ID NO: 3938895 - DNA, 14 bp, Homo sapiens
atataaatgcatga

SEQ ID NO: 3938896 - DNA, 15 bp, Homo sapiens
atataaccattacat

SEQ ID NO: 3938897 - DNA, 16 bp, Homo sapiens
atataatactaaagtg

SEQ ID NO: 3938898 - DNA, 16 bp, Homo sapiens
atataatggaagagaa

SEQ ID NO: 3938899 - DNA, 15 bp, Homo sapiens
atatacaaacatgtg

SEQ ID NO: 3938900 - DNA, 22 bp, Homo sapiens
atatacacatacatacacatac

SEQ ID NO: 3938901 - DNA, 16 bp, Homo sapiens
atatacatattataaa

SEQ ID NO: 3938902 - DNA, 19 bp, Homo sapiens
atatacatattataaataa

SEQ ID NO: 3938903 - DNA, 20 bp, Homo sapiens
atatacatattataaataaa

SEQ ID NO: 3938904 - DNA, 15 bp, Homo sapiens
atatacatgtgtgta

SEQ ID NO: 3938905 - DNA, 11 bp, Homo sapiens
atatacatttc

SEQ ID NO: 3938906 - DNA, 22 bp, Homo sapiens
atatacatttcataaggcctgc

SEQ ID NO: 3938907 - DNA, 15 bp, Homo sapiens
atatacctataatgt

SEQ ID NO: 3938908 - DNA, 19 bp, Homo sapiens
atatacctataatgtgtgt

SEQ ID NO: 3938909 - DNA, 18 bp, Homo sapiens
atatagaaagctgtttat

SEQ ID NO: 3938910 - DNA, 23 bp, Homo sapiens
atatagatcagttataagtagca

SEQ ID NO: 3938911 - DNA, 20 bp, Homo sapiens
atatagcagcaaaaatataa

SEQ ID NO: 3938912 - DNA, 18 bp, Homo sapiens
atatagcgttcccaacaa

SEQ ID NO: 3938913 - DNA, 22 bp, Homo sapiens
atataggttgtgcaaattaaca

SEQ ID NO: 3938914 - DNA, 19 bp, Homo sapiens
atatagtatatttatactc

SEQ ID NO: 3938915 - DNA, 20 bp, Homo sapiens
atatagtatatttatactct

SEQ ID NO: 3938916 - DNA, 21 bp, Homo sapiens
atatagtatatttatactcta

SEQ ID NO: 3938917 - DNA, 18 bp, Homo sapiens
atatagtgctatatatat

SEQ ID NO: 3938918 - DNA, 12 bp, Homo sapiens
atatataaatat

SEQ ID NO: 3938919 - DNA, 14 bp, Homo sapiens
atatatacacatac

SEQ ID NO: 3938920 - DNA, 16 bp, Homo sapiens
atatatacacatacat

SEQ ID NO: 3938921 - DNA, 23 bp, Homo sapiens
atatatacacatacatacacata

SEQ ID NO: 3938922 - DNA, 11 bp, Homo sapiens
atatatacata

SEQ ID NO: 3938923 - DNA, 15 bp, Homo sapiens
atatatagtgctata

SEQ ID NO: 3938924 - DNA, 13 bp, Homo sapiens
atatatataaata

SEQ ID NO: 3938925 - DNA, 14 bp, Homo sapiens
atatatatacatat

SEQ ID NO: 3938926 - DNA, 16 bp, Homo sapiens
atatatatacatatgt

SEQ ID NO: 3938927 - DNA, 15 bp, Homo sapiens
atatatatatacaca

SEQ ID NO: 3938928 - DNA, 13 bp, Homo sapiens
atatatatatagt

SEQ ID NO: 3938929 - DNA, 16 bp, Homo sapiens
atatatatatgtatat

SEQ ID NO: 3938930 - DNA, 12 bp, Homo sapiens
atatatatattt

SEQ ID NO: 3938931 - DNA, 14 bp, Homo sapiens
atatatatatttaa

SEQ ID NO: 3938932 - DNA, 14 bp, Homo sapiens
atatatatctgata

SEQ ID NO: 3938933 - DNA, 14 bp, Homo sapiens
atatatatgtgtgt

SEQ ID NO: 3938934 - DNA, 16 bp, Homo sapiens
atatatcagaatctgt

SEQ ID NO: 3938935 - DNA, 15 bp, Homo sapiens
atatatcagttataa

SEQ ID NO: 3938936 - DNA, 16 bp, Homo sapiens
atatatcccagaaatt

SEQ ID NO: 3938937 - DNA, 20 bp, Homo sapiens
atatatctgataaaattgtg

SEQ ID NO: 3938938 - DNA, 17 bp, Homo sapiens
atatatctgcttcagtg

SEQ ID NO: 3938939 - DNA, 13 bp, Homo sapiens
atatatgaggact

SEQ ID NO: 3938940 - DNA, 21 bp, Homo sapiens
atatatggtctgtgtgtctga

SEQ ID NO: 3938941 - DNA, 17 bp, Homo sapiens
atatatgtatttattgt

SEQ ID NO: 3938942 - DNA, 20 bp, Homo sapiens
atccatgttagtttttactt

SEQ ID NO: 3938943 - DNA, 14 bp, Homo sapiens
atccattcctcagg

SEQ ID NO: 3938944 - DNA, 18 bp, Homo sapiens
atccattcctcagggaca

SEQ ID NO: 3938945 - DNA, 20 bp, Homo sapiens
atccatttggacaaaatgga

SEQ ID NO: 3938946 - DNA, 23 bp, Homo sapiens
atccatttggacaaaatggaagg

SEQ ID NO: 3938947 - DNA, 16 bp, Homo sapiens
atcccaaacttcggaa

SEQ ID NO: 3938948 - DNA, 16 bp, Homo sapiens
atcccaaaggacagcc

SEQ ID NO: 3938949 - DNA, 20 bp, Homo sapiens
atcccacattcggaccctgc

SEQ ID NO: 3938950 - DNA, 21 bp, Homo sapiens
atcccacattcggaccctgcc

SEQ ID NO: 3938951 - DNA, 15 bp, Homo sapiens
atcccaccaaccctc

SEQ ID NO: 3938952 - DNA, 12 bp, Homo sapiens
atcccacttcac

SEQ ID NO: 3938953 - DNA, 13 bp, Homo sapiens
atcccagaaatta

SEQ ID NO: 3938954 - DNA, 15 bp, Homo sapiens
atcccaggaggggcc

SEQ ID NO: 3938955 - DNA, 18 bp, Homo sapiens
atcccaggaggggcctct

SEQ ID NO: 3938956 - DNA, 19 bp, Homo sapiens
atcccaggcttcaccctga

SEQ ID NO: 3938957 - DNA, 20 bp, Homo sapiens
atcccaggggaccacacctc

SEQ ID NO: 3938958 - DNA, 23 bp, Homo sapiens
atcccaggggaccacacctccct

SEQ ID NO: 3938959 - DNA, 19 bp, Homo sapiens
atcccatctaagctgcagc

SEQ ID NO: 3938960 - DNA, 11 bp, Homo sapiens
atcccatctct

SEQ ID NO: 3938961 - DNA, 15 bp, Homo sapiens
atcccatgtatttat

SEQ ID NO: 3938962 - DNA, 17 bp, Homo sapiens
atcccatgtcacctcag

SEQ ID NO: 3938963 - DNA, 16 bp, Homo sapiens
atcccattgccctggt

SEQ ID NO: 3938964 - DNA, 17 bp, Homo sapiens
atcccattgccctggtt

SEQ ID NO: 3938965 - DNA, 16 bp, Homo sapiens
atccccaaactgtgcc

SEQ ID NO: 3938966 - DNA, 14 bp, Homo sapiens
atccccagtcccaa

SEQ ID NO: 3938967 - DNA, 21 bp, Homo sapiens
atccccggctgcttccttctg

SEQ ID NO: 3938968 - DNA, 20 bp, Homo sapiens
atcccctcgtcctgtcccag

SEQ ID NO: 3938969 - DNA, 16 bp, Homo sapiens
atcccctttcctcccc

SEQ ID NO: 3938970 - DNA, 20 bp, Homo sapiens
atcccctttcctccccacct

SEQ ID NO: 3938971 - DNA, 22 bp, Homo sapiens
atcccgcctcttcttcttcaga

SEQ ID NO: 3938972 - DNA, 15 bp, Homo sapiens
atcccggcctcttcc

SEQ ID NO: 3938973 - DNA, 18 bp, Homo sapiens
atcccggcctcttccacc

SEQ ID NO: 3938974 - DNA, 17 bp, Homo sapiens
atccctatgggattcag

SEQ ID NO: 3938975 - DNA, 13 bp, Homo sapiens
atccctatttaat

SEQ ID NO: 3938976 - DNA, 13 bp, Homo sapiens
atccctgggcccc

SEQ ID NO: 3938977 - DNA, 18 bp, Homo sapiens
atccctgggcctgctgct

SEQ ID NO: 3938978 - DNA, 21 bp, Homo sapiens
atccctgggcctgctgctgag

SEQ ID NO: 3938979 - DNA, 18 bp, Homo sapiens
atccctgttacccagaga

SEQ ID NO: 3938980 - DNA, 18 bp, Homo sapiens
atccctgtttaatattta

SEQ ID NO: 3938981 - DNA, 21 bp, Homo sapiens
atccctgtttaatatttaaac

SEQ ID NO: 3938982 - DNA, 16 bp, Homo sapiens
atcccttcctccccag

SEQ ID NO: 3938983 - DNA, 22 bp, Homo sapiens
atccgagtgtttgccaggctta

SEQ ID NO: 3938984 - DNA, 23 bp, Homo sapiens
atccgcctgcagaggacagagct

SEQ ID NO: 3938985 - DNA, 17 bp, Homo sapiens
atccgggacgcttccag

SEQ ID NO: 3938986 - DNA, 18 bp, Homo sapiens
atccgggacgcttccaga

SEQ ID NO: 3938987 - DNA, 22 bp, Homo sapiens
atccgggacgcttccagaccac

SEQ ID NO: 3938988 - DNA, 14 bp, Homo sapiens
atcctaactgagaa

SEQ ID NO: 3938989 - DNA, 23 bp, Homo sapiens
atcctaagtgggaagtgaagccc

SEQ ID NO: 3938990 - DNA, 17 bp, Homo sapiens
atcctaccaatgcatgc

SEQ ID NO: 3938991 - DNA, 20 bp, Homo sapiens
atcctagaaccaagcttcag

SEQ ID NO: 3938992 - DNA, 23 bp, Homo sapiens
atcctagaaccaagcttcagagc

SEQ ID NO: 3938993 - DNA, 16 bp, Homo sapiens
atcctaggtgctggat

SEQ ID NO: 3938994 - DNA, 20 bp, Homo sapiens
atcctattctcaccaggaag

SEQ ID NO: 3938995 - DNA, 18 bp, Homo sapiens
atcctcaaacatggaaga

SEQ ID NO: 3938996 - DNA, 14 bp, Homo sapiens
atcctcaacaacaa

SEQ ID NO: 3938997 - DNA, 22 bp, Homo sapiens
atcctcaggtagtactgggaat

SEQ ID NO: 3938998 - DNA, 23 bp, Homo sapiens
atcctccaacgttaaaagacagt

SEQ ID NO: 3938999 - DNA, 15 bp, Homo sapiens
atcctcccttcctcc

SEQ ID NO: 3939000 - DNA, 13 bp, Homo sapiens
atcctctggggtt

SEQ ID NO: 3939001 - DNA, 13 bp, Homo sapiens
atcctgaagaaac

SEQ ID NO: 3939002 - DNA, 12 bp, Homo sapiens
atcctgataaac

SEQ ID NO: 3939003 - DNA, 19 bp, Homo sapiens
atcctgataaacattaaac

SEQ ID NO: 3939004 - DNA, 22 bp, Homo sapiens
atcctgcccccagccatggtga

SEQ ID NO: 3939005 - DNA, 12 bp, Homo sapiens
atcctgcctctc

SEQ ID NO: 3939006 - DNA, 18 bp, Homo sapiens
atcctgctagctgtagaa

SEQ ID NO: 3939007 - DNA, 14 bp, Homo sapiens
atcctgctgctgtg

SEQ ID NO: 3939008 - DNA, 19 bp, Homo sapiens
atcctgctgtggcctcact

SEQ ID NO: 3939009 - DNA, 14 bp, Homo sapiens
atcctgcttcagtg

SEQ ID NO: 3939010 - DNA, 17 bp, Homo sapiens
atcctgctttccctccc

SEQ ID NO: 3939011 - DNA, 16 bp, Homo sapiens
atcctggattcactca

SEQ ID NO: 3939012 - DNA, 20 bp, Homo sapiens
atcctggattcactcactca

SEQ ID NO: 3939013 - DNA, 17 bp, Homo sapiens
atcctggccaacatggt

SEQ ID NO: 3939014 - DNA, 14 bp, Homo sapiens
atcctggcccctcc

SEQ ID NO: 3939015 - DNA, 11 bp, Homo sapiens
atcctggcctc

SEQ ID NO: 3939016 - DNA, 13 bp, Homo sapiens
atcctggcctcct

SEQ ID NO: 3939017 - DNA, 18 bp, Homo sapiens
atcctggcctccttttgc

SEQ ID NO: 3939018 - DNA, 21 bp, Homo sapiens
atcctgtatattatggtgtaa

SEQ ID NO: 3939019 - DNA, 15 bp, Homo sapiens
atcctgtgtggggag

SEQ ID NO: 3939020 - DNA, 16 bp, Homo sapiens
atcctgtgtggggagg

SEQ ID NO: 3939021 - DNA, 22 bp, Homo sapiens
atccttaggaaaatgcttctgt

SEQ ID NO: 3939022 - DNA, 23 bp, Homo sapiens
atccttaggaaaatgcttctgtt

SEQ ID NO: 3939023 - DNA, 20 bp, Homo sapiens
atccttcaccagcaactctg

SEQ ID NO: 3939024 - DNA, 17 bp, Homo sapiens
atccttccagtggctcg

SEQ ID NO: 3939025 - DNA, 15 bp, Homo sapiens
atccttggagagcag

SEQ ID NO: 3939026 - DNA, 13 bp, Homo sapiens
atccttttatgtt

SEQ ID NO: 3939027 - DNA, 18 bp, Homo sapiens
atccttttatgttattta

SEQ ID NO: 3939028 - DNA, 15 bp, Homo sapiens
atgatggagacttca

SEQ ID NO: 3939029 - DNA, 16 bp, Homo sapiens
atgatgtatttttgta

SEQ ID NO: 3939030 - DNA, 15 bp, Homo sapiens
atgatgtccagaaga

SEQ ID NO: 3939031 - DNA, 18 bp, Homo sapiens
atgatgtccagaagaata

SEQ ID NO: 3939032 - DNA, 19 bp, Homo sapiens
atgatgtccagaagaatat

SEQ ID NO: 3939033 - DNA, 16 bp, Homo sapiens
atgattaaacacctga

SEQ ID NO: 3939034 - DNA, 18 bp, Homo sapiens
atgattaaacacctgaca

SEQ ID NO: 3939035 - DNA, 16 bp, Homo sapiens
atgattatatgacaat

SEQ ID NO: 3939036 - DNA, 14 bp, Homo sapiens
atgattcataacaa

SEQ ID NO: 3939037 - DNA, 14 bp, Homo sapiens
atgattggattatt

SEQ ID NO: 3939038 - DNA, 15 bp, Homo sapiens
atgattggattattc

SEQ ID NO: 3939039 - DNA, 16 bp, Homo sapiens
atgattggattattca

SEQ ID NO: 3939040 - DNA, 14 bp, Homo sapiens
atgattgtaaaata

SEQ ID NO: 3939041 - DNA, 13 bp, Homo sapiens
atgatttatagtt

SEQ ID NO: 3939042 - DNA, 14 bp, Homo sapiens
atgatttatatatg

SEQ ID NO: 3939043 - DNA, 11 bp, Homo sapiens
atgattttaca

SEQ ID NO: 3939044 - DNA, 20 bp, Homo sapiens
atgattttacagagaatctg

SEQ ID NO: 3939045 - DNA, 13 bp, Homo sapiens
atgatttttagat

SEQ ID NO: 3939046 - DNA, 22 bp, Homo sapiens
atgatttttagatgagattgtt

SEQ ID NO: 3939047 - DNA, 19 bp, Homo sapiens
atgattttttaaaagaaat

SEQ ID NO: 3939048 - DNA, 12 bp, Homo sapiens
atgcaaaaagaa

SEQ ID NO: 3939049 - DNA, 21 bp, Homo sapiens
atgcaaaataatacctgtcca

SEQ ID NO: 3939050 - DNA, 12 bp, Homo sapiens
atgcaaagcact

SEQ ID NO: 3939051 - DNA, 14 bp, Homo sapiens
atgcaaagcactga

SEQ ID NO: 3939052 - DNA, 18 bp, Homo sapiens
atgcaagagtggactgaa

SEQ ID NO: 3939053 - DNA, 23 bp, Homo sapiens
atgcaagctagtggcttcaaaat

SEQ ID NO: 3939054 - DNA, 15 bp, Homo sapiens
atgcaatgaaacaga

SEQ ID NO: 3939055 - DNA, 17 bp, Homo sapiens
atgcaatttcctttttt

SEQ ID NO: 3939056 - DNA, 12 bp, Homo sapiens
atgcacaattta

SEQ ID NO: 3939057 - DNA, 16 bp, Homo sapiens
atgcacaatttagaaa

SEQ ID NO: 3939058 - DNA, 20 bp, Homo sapiens
atgcacacaaacacctccta

SEQ ID NO: 3939059 - DNA, 22 bp, Homo sapiens
atgcacacaaacacctcctagc

SEQ ID NO: 3939060 - DNA, 22 bp, Homo sapiens
atgcacactagcctctccagga

SEQ ID NO: 3939061 - DNA, 14 bp, Homo sapiens
atgcacagctgctt

SEQ ID NO: 3939062 - DNA, 13 bp, Homo sapiens
atgcacatttata

SEQ ID NO: 3939063 - DNA, 21 bp, Homo sapiens
atgcacatttatatatatatg

SEQ ID NO: 3939064 - DNA, 17 bp, Homo sapiens
atgcacgcacacatcag

SEQ ID NO: 3939065 - DNA, 17 bp, Homo sapiens
atgcactgacccttcca

SEQ ID NO: 3939066 - DNA, 14 bp, Homo sapiens
atgcactggccacc

SEQ ID NO: 3939067 - DNA, 20 bp, Homo sapiens
atgcagaatgtttttaaaat

SEQ ID NO: 3939068 - DNA, 20 bp, Homo sapiens
atgcagattcctgggcctgt

SEQ ID NO: 3939069 - DNA, 17 bp, Homo sapiens
atgcagcttcatcaatt

SEQ ID NO: 3939070 - DNA, 22 bp, Homo sapiens
atgcagcttcatcaatttttat

SEQ ID NO: 3939071 - DNA, 17 bp, Homo sapiens
atgcagggaagagggca

SEQ ID NO: 3939072 - DNA, 14 bp, Homo sapiens
atgcagtccagaat

SEQ ID NO: 3939073 - DNA, 20 bp, Homo sapiens
atgcatcagaaagggagggc

SEQ ID NO: 3939074 - DNA, 17 bp, Homo sapiens
atgcatccattcctcag

SEQ ID NO: 3939075 - DNA, 18 bp, Homo sapiens
atgcatccattcctcagg

SEQ ID NO: 3939076 - DNA, 22 bp, Homo sapiens
atgcatccattcctcagggaca

SEQ ID NO: 3939077 - DNA, 21 bp, Homo sapiens
atgcatgattttatacatagt

SEQ ID NO: 3939078 - DNA, 20 bp, Homo sapiens
atgcatgcagccactgtgct

SEQ ID NO: 3939079 - DNA, 16 bp, Homo sapiens
atgcatgcgcaggctc

SEQ ID NO: 3939080 - DNA, 12 bp, Homo sapiens
atgcatggaaac

SEQ ID NO: 3939081 - DNA, 20 bp, Homo sapiens
atgcatggaaacctgaaaaa

SEQ ID NO: 3939082 - DNA, 16 bp, Homo sapiens
atgcattgtcttgtgg

SEQ ID NO: 3939083 - DNA, 18 bp, Homo sapiens
atgcattgtcttgtggag

SEQ ID NO: 3939084 - DNA, 13 bp, Homo sapiens
atgcatttccaca

SEQ ID NO: 3939085 - DNA, 14 bp, Homo sapiens
atgcatttccacac

SEQ ID NO: 3939086 - DNA, 22 bp, Homo sapiens
atgccaattagcaattgactgt

SEQ ID NO: 3939087 - DNA, 11 bp, Homo sapiens
atgccacagcc

SEQ ID NO: 3939088 - DNA, 12 bp, Homo sapiens
atgccacagccc

SEQ ID NO: 3939089 - DNA, 15 bp, Homo sapiens
atgccacagccccac

SEQ ID NO: 3939090 - DNA, 17 bp, Homo sapiens
atgccaccctctccatg

SEQ ID NO: 3939091 - DNA, 21 bp, Homo sapiens
atgccaccctctccatgccca

SEQ ID NO: 3939092 - DNA, 15 bp, Homo sapiens
atgccactgccaggc

SEQ ID NO: 3939093 - DNA, 22 bp, Homo sapiens
atgccagcttcctgtgggccag

SEQ ID NO: 3939094 - DNA, 16 bp, Homo sapiens
atgccaggaccagtcc

SEQ ID NO: 3939095 - DNA, 19 bp, Homo sapiens
atgccaggctaatttttat

SEQ ID NO: 3939096 - DNA, 21 bp, Homo sapiens
atgccatttaaagcttattaa

SEQ ID NO: 3939097 - DNA, 15 bp, Homo sapiens
atgccccaaatatag

SEQ ID NO: 3939098 - DNA, 13 bp, Homo sapiens
atgccctccaatc

SEQ ID NO: 3939099 - DNA, 13 bp, Homo sapiens
atgccctgccatt

SEQ ID NO: 3939100 - DNA, 22 bp, Homo sapiens
atgccgtgtgtctcgtctcctg

SEQ ID NO: 3939101 - DNA, 20 bp, Homo sapiens
atgcctccaaaaattcacat

SEQ ID NO: 3939102 - DNA, 12 bp, Homo sapiens
atgcctccaccg

SEQ ID NO: 3939103 - DNA, 18 bp, Homo sapiens
atgcctctgaggccagcc

SEQ ID NO: 3939104 - DNA, 21 bp, Homo sapiens
atgcctctgatatgggactga

SEQ ID NO: 3939105 - DNA, 12 bp, Homo sapiens
atgcctgagggt

SEQ ID NO: 3939106 - DNA, 14 bp, Homo sapiens
atgcctgagggtgg

SEQ ID NO: 3939107 - DNA, 19 bp, Homo sapiens
atgcctggcccccctccag

SEQ ID NO: 3939108 - DNA, 12 bp, Homo sapiens
atgccttatgta

SEQ ID NO: 3939109 - DNA, 21 bp, Homo sapiens
atgccttccgggccgggcgga

SEQ ID NO: 3939110 - DNA, 14 bp, Homo sapiens
atgccttcctgtct

SEQ ID NO: 3939111 - DNA, 14 bp, Homo sapiens
atgcgaaaacttga

SEQ ID NO: 3939112 - DNA, 18 bp, Homo sapiens
atgcgaaaacttgaatct

SEQ ID NO: 3939113 - DNA, 19 bp, Homo sapiens
atgcggccgcattccctga

SEQ ID NO: 3939114 - DNA, 14 bp, Homo sapiens
atgcgtatatgtgc

SEQ ID NO: 3939115 - DNA, 24 bp, Homo sapiens
atggcatatttatattgtatattc

SEQ ID NO: 3939116 - DNA, 13 bp, Homo sapiens
atggccaagagca

SEQ ID NO: 3939117 - DNA, 16 bp, Homo sapiens
atggccaggtggccac

SEQ ID NO: 3939118 - DNA, 12 bp, Homo sapiens
atggccatggaa

SEQ ID NO: 3939119 - DNA, 14 bp, Homo sapiens
atggccccagggtt

SEQ ID NO: 3939120 - DNA, 17 bp, Homo sapiens
atggccccagggttgaa

SEQ ID NO: 3939121 - DNA, 19 bp, Homo sapiens
atggccctagaactgtgcc

SEQ ID NO: 3939122 - DNA, 21 bp, Homo sapiens
atggcctattatattaaaata

SEQ ID NO: 3939123 - DNA, 14 bp, Homo sapiens
atggcctctggcca

SEQ ID NO: 3939124 - DNA, 18 bp, Homo sapiens
atggcgtaatgggcctgc

SEQ ID NO: 3939125 - DNA, 17 bp, Homo sapiens
atggctaattcccagag

SEQ ID NO: 3939126 - DNA, 16 bp, Homo sapiens
atggctataggtgcta

SEQ ID NO: 3939127 - DNA, 23 bp, Homo sapiens
atggctataggtgctacaaaaac

SEQ ID NO: 3939128 - DNA, 14 bp, Homo sapiens
atggctgtgaggat

SEQ ID NO: 3939129 - DNA, 15 bp, Homo sapiens
atggctttaattata

SEQ ID NO: 3939130 - DNA, 20 bp, Homo sapiens
atgggaaagcattgtaaatg

SEQ ID NO: 3939131 - DNA, 23 bp, Homo sapiens
atgggaacctagtactctctgct

SEQ ID NO: 3939132 - DNA, 18 bp, Homo sapiens
atgggaagatggtagcag

SEQ ID NO: 3939133 - DNA, 21 bp, Homo sapiens
atgggaagatggtagcagata

SEQ ID NO: 3939134 - DNA, 18 bp, Homo sapiens
atgggactgtgcctttgg

SEQ ID NO: 3939135 - DNA, 16 bp, Homo sapiens
atgggagggggctcca

SEQ ID NO: 3939136 - DNA, 16 bp, Homo sapiens
atgggagtgagacaga

SEQ ID NO: 3939137 - DNA, 22 bp, Homo sapiens
atgggcaattctgacttctccc

SEQ ID NO: 3939138 - DNA, 22 bp, Homo sapiens
atgggcacatgaggagggtgcc

SEQ ID NO: 3939139 - DNA, 15 bp, Homo sapiens
atgggcagtgcctcc

SEQ ID NO: 3939140 - DNA, 16 bp, Homo sapiens
atgggcagtgcctcct

SEQ ID NO: 3939141 - DNA, 15 bp, Homo sapiens
atgggcattgggctg

SEQ ID NO: 3939142 - DNA, 23 bp, Homo sapiens
atgggccagggtttacccagtgg

SEQ ID NO: 3939143 - DNA, 21 bp, Homo sapiens
atgggcctgcccaatgctttg

SEQ ID NO: 3939144 - DNA, 13 bp, Homo sapiens
atgggcctgggcc

SEQ ID NO: 3939145 - DNA, 13 bp, Homo sapiens
atgggcttggact

SEQ ID NO: 3939146 - DNA, 18 bp, Homo sapiens
atgggcttggacttcctg

SEQ ID NO: 3939147 - DNA, 19 bp, Homo sapiens
atgggcttggacttcctgg

SEQ ID NO: 3939148 - DNA, 21 bp, Homo sapiens
atggggcgatcaagtccagag

SEQ ID NO: 3939149 - DNA, 15 bp, Homo sapiens
atggggcggcaattg

SEQ ID NO: 3939150 - DNA, 13 bp, Homo sapiens
atgggggactgag

SEQ ID NO: 3939151 - DNA, 22 bp, Homo sapiens
atgggtattaaacttgtcagaa

SEQ ID NO: 3939152 - DNA, 13 bp, Homo sapiens
atgggtgtgccct

SEQ ID NO: 3939153 - DNA, 23 bp, Homo sapiens
atggtaaaagttacttattctag

SEQ ID NO: 3939154 - DNA, 17 bp, Homo sapiens
atggtaagactgtaatt

SEQ ID NO: 3939155 - DNA, 17 bp, Homo sapiens
atggtcccacatccctg

SEQ ID NO: 3939156 - DNA, 19 bp, Homo sapiens
atggtcccacatccctggg

SEQ ID NO: 3939157 - DNA, 20 bp, Homo sapiens
atggtcccacatccctgggc

SEQ ID NO: 3939158 - DNA, 23 bp, Homo sapiens
atggtcccacatccctgggcctg

SEQ ID NO: 3939159 - DNA, 17 bp, Homo sapiens
atggtcccttcttccct

SEQ ID NO: 3939160 - DNA, 14 bp, Homo sapiens
atggtctcagaaac

SEQ ID NO: 3939161 - DNA, 21 bp, Homo sapiens
atggtctctcgggccccccac

SEQ ID NO: 3939162 - DNA, 14 bp, Homo sapiens
atggtgacacacag

SEQ ID NO: 3939163 - DNA, 20 bp, Homo sapiens
atggtgcagttgacagcagg

SEQ ID NO: 3939164 - DNA, 23 bp, Homo sapiens
atggtggtttgtcatatattcat

SEQ ID NO: 3939165 - DNA, 18 bp, Homo sapiens
atggtgtaatgcacaatt

SEQ ID NO: 3939166 - DNA, 22 bp, Homo sapiens
atggtgtaatgcacaatttaga

SEQ ID NO: 3939167 - DNA, 20 bp, Homo sapiens
atggttcccctgttcactct

SEQ ID NO: 3939168 - DNA, 18 bp, Homo sapiens
atggttccttccctggga

SEQ ID NO: 3939169 - DNA, 19 bp, Homo sapiens
atggttccttccctgggaa

SEQ ID NO: 3939170 - DNA, 20 bp, Homo sapiens
atggttccttccctgggaag

SEQ ID NO: 3939171 - DNA, 19 bp, Homo sapiens
atggtttctgcgtgcttta

SEQ ID NO: 3939172 - DNA, 20 bp, Homo sapiens
atggtttctgcgtgctttat

SEQ ID NO: 3939173 - DNA, 21 bp, Homo sapiens
atgtaaaaggtattaaattga

SEQ ID NO: 3939174 - DNA, 20 bp, Homo sapiens
atgtaaacagtgcctgctga

SEQ ID NO: 3939175 - DNA, 22 bp, Homo sapiens
atgtaaacagtgcctgctgaat

SEQ ID NO: 3939176 - DNA, 17 bp, Homo sapiens
atgtaaatagtgcagaa

SEQ ID NO: 3939177 - DNA, 20 bp, Homo sapiens
atgtaaattttgtatgaaaa

SEQ ID NO: 3939178 - DNA, 14 bp, Homo sapiens
atgtaacaaccaga

SEQ ID NO: 3939179 - DNA, 16 bp, Homo sapiens
atgtaagggaaactgc

SEQ ID NO: 3939180 - DNA, 19 bp, Homo sapiens
atgtaagggaaactgccag

SEQ ID NO: 3939181 - DNA, 19 bp, Homo sapiens
atgtaagggtctgttgtaa

SEQ ID NO: 3939182 - DNA, 16 bp, Homo sapiens
atgtacaagttttgta

SEQ ID NO: 3939183 - DNA, 21 bp, Homo sapiens
atgtacaagttttgtataaat

SEQ ID NO: 3939184 - DNA, 22 bp, Homo sapiens
atgtacacacacagatgcacac

SEQ ID NO: 3939185 - DNA, 16 bp, Homo sapiens
atgtacccaccgggcc

SEQ ID NO: 3939186 - DNA, 21 bp, Homo sapiens
atgtacccaccgggccactcc

SEQ ID NO: 3939187 - DNA, 19 bp, Homo sapiens
atgtacgaaactgtatgat

SEQ ID NO: 3939188 - DNA, 19 bp, Homo sapiens
atgtactctacgccaaagt

SEQ ID NO: 3939189 - DNA, 23 bp, Homo sapiens
atgtagaacttcaagaagtaaga

SEQ ID NO: 3939190 - DNA, 17 bp, Homo sapiens
atgtagcccggccaggg

SEQ ID NO: 3939191 - DNA, 21 bp, Homo sapiens
atgtagcccggccagggcctg

SEQ ID NO: 3939192 - DNA, 13 bp, Homo sapiens
atgtaggagggac

SEQ ID NO: 3939193 - DNA, 18 bp, Homo sapiens
atgtagggtaaggtgcct

SEQ ID NO: 3939194 - DNA, 21 bp, Homo sapiens
atgtaggtgtctgcacccagg

SEQ ID NO: 3939195 - DNA, 13 bp, Homo sapiens
atgtagttttaac

SEQ ID NO: 3939196 - DNA, 15 bp, Homo sapiens
atgtatatacacata

SEQ ID NO: 3939197 - DNA, 18 bp, Homo sapiens
atgtatatacacatatac

SEQ ID NO: 3939198 - DNA, 19 bp, Homo sapiens
atgtatatatatatagtaa

SEQ ID NO: 3939199 - DNA, 14 bp, Homo sapiens
atgtatatgtatat

SEQ ID NO: 3939200 - DNA, 15 bp, Homo sapiens
atgtatatgtatata

SEQ ID NO: 3939201 - DNA, 22 bp, Homo sapiens
attcagctagaactttgaagga

SEQ ID NO: 3939202 - DNA, 18 bp, Homo sapiens
attcaggaaaaggcctgg

SEQ ID NO: 3939203 - DNA, 20 bp, Homo sapiens
attcaggaaaaggcctgggg

SEQ ID NO: 3939204 - DNA, 14 bp, Homo sapiens
attcaggactggct

SEQ ID NO: 3939205 - DNA, 17 bp, Homo sapiens
attcagtgcttcttaaa

SEQ ID NO: 3939206 - DNA, 14 bp, Homo sapiens
attcataacaatgt

SEQ ID NO: 3939207 - DNA, 14 bp, Homo sapiens
attcataattagaa

SEQ ID NO: 3939208 - DNA, 19 bp, Homo sapiens
attcatctgggaggcagaa

SEQ ID NO: 3939209 - DNA, 20 bp, Homo sapiens
attcatctgtttttcttttt

SEQ ID NO: 3939210 - DNA, 17 bp, Homo sapiens
attcatgctttctcctt

SEQ ID NO: 3939211 - DNA, 18 bp, Homo sapiens
attcatgctttctccttt

SEQ ID NO: 3939212 - DNA, 12 bp, Homo sapiens
attcatgtaata

SEQ ID NO: 3939213 - DNA, 18 bp, Homo sapiens
attcatgtaataaatctg

SEQ ID NO: 3939214 - DNA, 14 bp, Homo sapiens
attcattcagtgag

SEQ ID NO: 3939215 - DNA, 22 bp, Homo sapiens
attcatttcacattaatggtct

SEQ ID NO: 3939216 - DNA, 17 bp, Homo sapiens
attccaaagaacagcct

SEQ ID NO: 3939217 - DNA, 23 bp, Homo sapiens
attccaacaatggggtgggccca

SEQ ID NO: 3939218 - DNA, 14 bp, Homo sapiens
attccaacagtgag

SEQ ID NO: 3939219 - DNA, 22 bp, Homo sapiens
attccaagggtatgggaagcca

SEQ ID NO: 3939220 - DNA, 16 bp, Homo sapiens
attccaccattcacat

SEQ ID NO: 3939221 - DNA, 17 bp, Homo sapiens
attccagagcactgctc

SEQ ID NO: 3939222 - DNA, 22 bp, Homo sapiens
attccagcatttgccattcctg

SEQ ID NO: 3939223 - DNA, 23 bp, Homo sapiens
attccataaccccaggcatccca

SEQ ID NO: 3939224 - DNA, 14 bp, Homo sapiens
attccatgatttta

SEQ ID NO: 3939225 - DNA, 16 bp, Homo sapiens
attccatgattttaca

SEQ ID NO: 3939226 - DNA, 22 bp, Homo sapiens
attccatgattttacagagaat

SEQ ID NO: 3939227 - DNA, 18 bp, Homo sapiens
attccatttaaaaaacaa

SEQ ID NO: 3939228 - DNA, 20 bp, Homo sapiens
attcccaactgctctgccca

SEQ ID NO: 3939229 - DNA, 15 bp, Homo sapiens
attcccaagaaatgc

SEQ ID NO: 3939230 - DNA, 16 bp, Homo sapiens
attcccaagaaatgct

SEQ ID NO: 3939231 - DNA, 19 bp, Homo sapiens
attcccactaagctttctc

SEQ ID NO: 3939232 - DNA, 20 bp, Homo sapiens
attcccactaagctttctcc

SEQ ID NO: 3939233 - DNA, 21 bp, Homo sapiens
attcccactaagctttctcct

SEQ ID NO: 3939234 - DNA, 22 bp, Homo sapiens
attcccactaagctttctcctt

SEQ ID NO: 3939235 - DNA, 12 bp, Homo sapiens
attcccagagac

SEQ ID NO: 3939236 - DNA, 23 bp, Homo sapiens
attcccagagacaggaaaatcct

SEQ ID NO: 3939237 - DNA, 15 bp, Homo sapiens
attcccagagtcaga

SEQ ID NO: 3939238 - DNA, 14 bp, Homo sapiens
attccccattcttc

SEQ ID NO: 3939239 - DNA, 13 bp, Homo sapiens
attcccccacttg

SEQ ID NO: 3939240 - DNA, 16 bp, Homo sapiens
attccctatcaaaaca

SEQ ID NO: 3939241 - DNA, 19 bp, Homo sapiens
attccctatcaaaacatat

SEQ ID NO: 3939242 - DNA, 14 bp, Homo sapiens
attccctcttgcta

SEQ ID NO: 3939243 - DNA, 20 bp, Homo sapiens
attccctgagtcaccaggaa

SEQ ID NO: 3939244 - DNA, 14 bp, Homo sapiens
attcctaagcagtg

SEQ ID NO: 3939245 - DNA, 20 bp, Homo sapiens
attcctaagcagtgcttgta

SEQ ID NO: 3939246 - DNA, 23 bp, Homo sapiens
attcctagagggtaaatatgact

SEQ ID NO: 3939247 - DNA, 17 bp, Homo sapiens
attcctatatagtttat

SEQ ID NO: 3939248 - DNA, 16 bp, Homo sapiens
attcctcagctgccaa

SEQ ID NO: 3939249 - DNA, 14 bp, Homo sapiens
attcctgaccctcc

SEQ ID NO: 3939250 - DNA, 16 bp, Homo sapiens
attcctgaccctccct

SEQ ID NO: 3939251 - DNA, 17 bp, Homo sapiens
attcctgaccctcccta

SEQ ID NO: 3939252 - DNA, 20 bp, Homo sapiens
attcctggcatgacactcta

SEQ ID NO: 3939253 - DNA, 12 bp, Homo sapiens
attcctggcccc

SEQ ID NO: 3939254 - DNA, 15 bp, Homo sapiens
attcctgggcaagaa

SEQ ID NO: 3939255 - DNA, 12 bp, Homo sapiens
attccttcccac

SEQ ID NO: 3939256 - DNA, 17 bp, Homo sapiens
attccttgtcaccagca

SEQ ID NO: 3939257 - DNA, 17 bp, Homo sapiens
attccttttgatgggga

SEQ ID NO: 3939258 - DNA, 21 bp, Homo sapiens
attccttttgatggggagaaa

SEQ ID NO: 3939259 - DNA, 22 bp, Homo sapiens
attccttttgatggggagaaag

SEQ ID NO: 3939260 - DNA, 21 bp, Homo sapiens
attcgcctgtgggaagagaag

SEQ ID NO: 3939261 - DNA, 13 bp, Homo sapiens
attcggaccctgc

SEQ ID NO: 3939262 - DNA, 19 bp, Homo sapiens
attcgtctgtcccagagct

SEQ ID NO: 3939263 - DNA, 16 bp, Homo sapiens
attctaaagctttctg

SEQ ID NO: 3939264 - DNA, 19 bp, Homo sapiens
attctaggaaacccaagga

SEQ ID NO: 3939265 - DNA, 21 bp, Homo sapiens
attctatggccattactaaca

SEQ ID NO: 3939266 - DNA, 20 bp, Homo sapiens
attctattgtgcctatgata

SEQ ID NO: 3939267 - DNA, 16 bp, Homo sapiens
attctcaccaggaagg

SEQ ID NO: 3939268 - DNA, 14 bp, Homo sapiens
attctcactccacc

SEQ ID NO: 3939269 - DNA, 15 bp, Homo sapiens
attctcactccacca

SEQ ID NO: 3939270 - DNA, 20 bp, Homo sapiens
attctcatatgtagccctca

SEQ ID NO: 3939271 - DNA, 15 bp, Homo sapiens
attctcatgtctcag

SEQ ID NO: 3939272 - DNA, 11 bp, Homo sapiens
attctcctcct

SEQ ID NO: 3939273 - DNA, 14 bp, Homo sapiens
attctcctgcctca

SEQ ID NO: 3939274 - DNA, 22 bp, Homo sapiens
attctcctgcctgtagcagtga

SEQ ID NO: 3939275 - DNA, 16 bp, Homo sapiens
attctcctgtgcccct

SEQ ID NO: 3939276 - DNA, 13 bp, Homo sapiens
attctcctgtgct

SEQ ID NO: 3939277 - DNA, 16 bp, Homo sapiens
attctcggggccctgt

SEQ ID NO: 3939278 - DNA, 19 bp, Homo sapiens
attctctcctcagactgct

SEQ ID NO: 3939279 - DNA, 10 bp, Homo sapiens
attctctctc

SEQ ID NO: 3939280 - DNA, 15 bp, Homo sapiens
attctctctcctgtc

SEQ ID NO: 3939281 - DNA, 17 bp, Homo sapiens
attctctctcctgtcca

SEQ ID NO: 3939282 - DNA, 16 bp, Homo sapiens
attctgaacaattctc

SEQ ID NO: 3939283 - DNA, 17 bp, Homo sapiens
attctgaagccattgtc

SEQ ID NO: 3939284 - DNA, 16 bp, Homo sapiens
attctgacttctccca

SEQ ID NO: 3939285 - DNA, 14 bp, Homo sapiens
attctgagccttga

SEQ ID NO: 3939286 - DNA, 23 bp, Homo sapiens
attctgggctcctggaaccaatc

SEQ ID NO: 3939287 - DNA, 12 bp, Homo sapiens
attctgtaagaa

SEQ ID NO: 3939288 - DNA, 13 bp, Homo sapiens
attttatatgaga

SEQ ID NO: 3939289 - DNA, 19 bp, Homo sapiens
attttatatgagagaatca

SEQ ID NO: 3939290 - DNA, 19 bp, Homo sapiens
attttattaaagcaacatt

SEQ ID NO: 3939291 - DNA, 22 bp, Homo sapiens
attttatttattagctgtaaat

SEQ ID NO: 3939292 - DNA, 15 bp, Homo sapiens
attttcaagagaaga

SEQ ID NO: 3939293 - DNA, 17 bp, Homo sapiens
attttcaagagaagaaa

SEQ ID NO: 3939294 - DNA, 22 bp, Homo sapiens
attttcacattcccatctgtca

SEQ ID NO: 3939295 - DNA, 23 bp, Homo sapiens
attttcagcccatatttcatcgt

SEQ ID NO: 3939296 - DNA, 23 bp, Homo sapiens
attttcaggtttcttaaaaacag

SEQ ID NO: 3939297 - DNA, 13 bp, Homo sapiens
attttcatgactt

SEQ ID NO: 3939298 - DNA, 17 bp, Homo sapiens
attttcattttaattta

SEQ ID NO: 3939299 - DNA, 20 bp, Homo sapiens
attttccacaagattcccag

SEQ ID NO: 3939300 - DNA, 20 bp, Homo sapiens
attttcctcgcctaggcctg

SEQ ID NO: 3939301 - DNA, 19 bp, Homo sapiens
attttctagactttctgtt

SEQ ID NO: 3939302 - DNA, 22 bp, Homo sapiens
attttctatagctcttctattt

SEQ ID NO: 3939303 - DNA, 17 bp, Homo sapiens
attttctcctaggagaa

SEQ ID NO: 3939304 - DNA, 12 bp, Homo sapiens
attttctgaatt

SEQ ID NO: 3939305 - DNA, 19 bp, Homo sapiens
attttcttatcttctgcaa

SEQ ID NO: 3939306 - DNA, 16 bp, Homo sapiens
attttctttctgtaac

SEQ ID NO: 3939307 - DNA, 23 bp, Homo sapiens
attttctttctttttctggaaat

SEQ ID NO: 3939308 - DNA, 19 bp, Homo sapiens
attttcttttgtaaatgtt

SEQ ID NO: 3939309 - DNA, 23 bp, Homo sapiens
attttgcattgtgtgagcttcta

SEQ ID NO: 3939310 - DNA, 14 bp, Homo sapiens
attttgcatttagt

SEQ ID NO: 3939311 - DNA, 15 bp, Homo sapiens
attttgcatttagtt

SEQ ID NO: 3939312 - DNA, 16 bp, Homo sapiens
attttgcatttgaata

SEQ ID NO: 3939313 - DNA, 14 bp, Homo sapiens
attttggagaaatt

SEQ ID NO: 3939314 - DNA, 21 bp, Homo sapiens
attttggagaaattatttaat

SEQ ID NO: 3939315 - DNA, 12 bp, Homo sapiens
attttggtttct

SEQ ID NO: 3939316 - DNA, 19 bp, Homo sapiens
attttgtaaactcaaaata

SEQ ID NO: 3939317 - DNA, 17 bp, Homo sapiens
attttgtaacaaatgaa

SEQ ID NO: 3939318 - DNA, 17 bp, Homo sapiens
attttgtacagaatttt

SEQ ID NO: 3939319 - DNA, 23 bp, Homo sapiens
attttgtacagaatttttaatga

SEQ ID NO: 3939320 - DNA, 14 bp, Homo sapiens
attttgtatattgt

SEQ ID NO: 3939321 - DNA, 10 bp, Homo sapiens
attttgtatt

SEQ ID NO: 3939322 - DNA, 24 bp, Homo sapiens
attttgtattacatctaatgcttc

SEQ ID NO: 3939323 - DNA, 18 bp, Homo sapiens
attttgtattttcaactt

SEQ ID NO: 3939324 - DNA, 20 bp, Homo sapiens
attttgtcaaatcatggcca

SEQ ID NO: 3939325 - DNA, 19 bp, Homo sapiens
attttgtccattttaaaaa

SEQ ID NO: 3939326 - DNA, 19 bp, Homo sapiens
attttgttgtgattttgta

SEQ ID NO: 3939327 - DNA, 17 bp, Homo sapiens
atttttaaagtatatat

SEQ ID NO: 3939328 - DNA, 13 bp, Homo sapiens
atttttaatgact

SEQ ID NO: 3939329 - DNA, 19 bp, Homo sapiens
atttttacaataaataatc

SEQ ID NO: 3939330 - DNA, 14 bp, Homo sapiens
atttttatacatat

SEQ ID NO: 3939331 - DNA, 20 bp, Homo sapiens
atttttatacatatcagaaa

SEQ ID NO: 3939332 - DNA, 18 bp, Homo sapiens
atttttatatcagcctga

SEQ ID NO: 3939333 - DNA, 15 bp, Homo sapiens
atttttatatttagt

SEQ ID NO: 3939334 - DNA, 14 bp, Homo sapiens
atttttatttttga

SEQ ID NO: 3939335 - DNA, 17 bp, Homo sapiens
atttttcaaccagcatt

SEQ ID NO: 3939336 - DNA, 20 bp, Homo sapiens
atttttcaaccagcatttta

SEQ ID NO: 3939337 - DNA, 23 bp, Homo sapiens
atttttcaaccagcattttacta

SEQ ID NO: 3939338 - DNA, 18 bp, Homo sapiens
atttttcagctctctgta

SEQ ID NO: 3939339 - DNA, 16 bp, Homo sapiens
atttttgaaacccatt

SEQ ID NO: 3939340 - DNA, 16 bp, Homo sapiens
atttttggtgtatttg

SEQ ID NO: 3939341 - DNA, 18 bp, Homo sapiens
atttttgtccctgctcct

SEQ ID NO: 3939342 - DNA, 14 bp, Homo sapiens
attttttaaaagaa

SEQ ID NO: 3939343 - DNA, 22 bp, Homo sapiens
attttttcagaaatatgtggtt

SEQ ID NO: 3939344 - DNA, 14 bp, Homo sapiens
atttttttaagtta

SEQ ID NO: 3939345 - DNA, 16 bp, Homo sapiens
atttttttattactga

SEQ ID NO: 3939346 - DNA, 22 bp, Homo sapiens
atttttttcactggagttacat

SEQ ID NO: 3939347 - DNA, 18 bp, Homo sapiens
attttttttaagtattta

SEQ ID NO: 3939348 - DNA, 23 bp, Homo sapiens
attttttttactgtgcatacatg

SEQ ID NO: 3939349 - DNA, 16 bp, Homo sapiens
attttttttgtaactt

SEQ ID NO: 3939350 - DNA, 18 bp, Homo sapiens
attttttttttaaaacta

SEQ ID NO: 3939351 - DNA, 13 bp, Homo sapiens
caaaaacagcctc

SEQ ID NO: 3939352 - DNA, 16 bp, Homo sapiens
caaaaacagcctcaca

SEQ ID NO: 3939353 - DNA, 22 bp, Homo sapiens
caaaaagctcttacactacatt

SEQ ID NO: 3939354 - DNA, 22 bp, Homo sapiens
caaaaaggctagtttattttgt

SEQ ID NO: 3939355 - DNA, 14 bp, Homo sapiens
caaaaataaactag

SEQ ID NO: 3939356 - DNA, 15 bp, Homo sapiens
caaaaataaactagt

SEQ ID NO: 3939357 - DNA, 15 bp, Homo sapiens
caaaacaaaacaaca

SEQ ID NO: 3939358 - DNA, 12 bp, Homo sapiens
caaaacaacaac

SEQ ID NO: 3939359 - DNA, 17 bp, Homo sapiens
caaaacaacaacaatac

SEQ ID NO: 3939360 - DNA, 19 bp, Homo sapiens
caaaacaaccatcctgctc

SEQ ID NO: 3939361 - DNA, 17 bp, Homo sapiens
caaaacatatcaattca

SEQ ID NO: 3939362 - DNA, 18 bp, Homo sapiens
caaaacatatcaattcaa

SEQ ID NO: 3939363 - DNA, 18 bp, Homo sapiens
caaaactgcactgtcaag

SEQ ID NO: 3939364 - DNA, 15 bp, Homo sapiens
caaaagaagtaaaag

SEQ ID NO: 3939365 - DNA, 21 bp, Homo sapiens
caaaagaagtaaaagctaatt

SEQ ID NO: 3939366 - DNA, 19 bp, Homo sapiens
caaaagaatcagaaacagg

SEQ ID NO: 3939367 - DNA, 16 bp, Homo sapiens
caaaagacatgttgta

SEQ ID NO: 3939368 - DNA, 15 bp, Homo sapiens
caaaagcaaatgaga

SEQ ID NO: 3939369 - DNA, 16 bp, Homo sapiens
caaaagcaagactgtt

SEQ ID NO: 3939370 - DNA, 21 bp, Homo sapiens
caaaagcacttgttccttctg

SEQ ID NO: 3939371 - DNA, 15 bp, Homo sapiens
caaaagccaaaaggt

SEQ ID NO: 3939372 - DNA, 11 bp, Homo sapiens
caaaagcctgg

SEQ ID NO: 3939373 - DNA, 11 bp, Homo sapiens
caaaagctgct

SEQ ID NO: 3939374 - DNA, 22 bp, Homo sapiens
caaccacatacaacacaaagag

SEQ ID NO: 3939375 - DNA, 13 bp, Homo sapiens
caaccagagcccc

SEQ ID NO: 3939376 - DNA, 19 bp, Homo sapiens
caaccagagccccccacaa

SEQ ID NO: 3939377 - DNA, 18 bp, Homo sapiens
caaccagcattttactac

SEQ ID NO: 3939378 - DNA, 16 bp, Homo sapiens
caaccattccagactg

SEQ ID NO: 3939379 - DNA, 12 bp, Homo sapiens
caaccccagctg

SEQ ID NO: 3939380 - DNA, 15 bp, Homo sapiens
caaccccagctggcc

SEQ ID NO: 3939381 - DNA, 17 bp, Homo sapiens
caaccccagctggcctc

SEQ ID NO: 3939382 - DNA, 17 bp, Homo sapiens
caaccccagttctgctc

SEQ ID NO: 3939383 - DNA, 14 bp, Homo sapiens
caaccccatcatat

SEQ ID NO: 3939384 - DNA, 20 bp, Homo sapiens
caaccccgcggtgctctggc

SEQ ID NO: 3939385 - DNA, 22 bp, Homo sapiens
caacccctgtacccagctcctt

SEQ ID NO: 3939386 - DNA, 16 bp, Homo sapiens
caacccgtgccaagtc

SEQ ID NO: 3939387 - DNA, 18 bp, Homo sapiens
caacccgtggaggctgct

SEQ ID NO: 3939388 - DNA, 18 bp, Homo sapiens
caaccctcagagccaccc

SEQ ID NO: 3939389 - DNA, 17 bp, Homo sapiens
caaccctgttttatact

SEQ ID NO: 3939390 - DNA, 19 bp, Homo sapiens
caaccgtggcccttcctgg

SEQ ID NO: 3939391 - DNA, 20 bp, Homo sapiens
caaccgtggcccttcctgga

SEQ ID NO: 3939392 - DNA, 23 bp, Homo sapiens
caaccgtggcccttcctggacag

SEQ ID NO: 3939393 - DNA, 18 bp, Homo sapiens
caacctaacccctttcct

SEQ ID NO: 3939394 - DNA, 20 bp, Homo sapiens
caacctaccaccccttcctg

SEQ ID NO: 3939395 - DNA, 22 bp, Homo sapiens
caacctaccaccccttcctgtc

SEQ ID NO: 3939396 - DNA, 17 bp, Homo sapiens
caacctcaatgccctgc

SEQ ID NO: 3939397 - DNA, 18 bp, Homo sapiens
caacctcaatgccctgcc

SEQ ID NO: 3939398 - DNA, 18 bp, Homo sapiens
caacctcatcctccttct

SEQ ID NO: 3939399 - DNA, 18 bp, Homo sapiens
caacctccgtgctgggct

SEQ ID NO: 3939400 - DNA, 16 bp, Homo sapiens
caacctcttcctcctg

SEQ ID NO: 3939401 - DNA, 17 bp, Homo sapiens
caacctcttcctcctgg

SEQ ID NO: 3939402 - DNA, 12 bp, Homo sapiens
caacctgcccct

SEQ ID NO: 3939403 - DNA, 17 bp, Homo sapiens
caacctgcccctcccca

SEQ ID NO: 3939404 - DNA, 16 bp, Homo sapiens
caacctgcctgtgcat

SEQ ID NO: 3939405 - DNA, 23 bp, Homo sapiens
caacctgctctcctcttgccact

SEQ ID NO: 3939406 - DNA, 17 bp, Homo sapiens
caaccttctgtggctca

SEQ ID NO: 3939407 - DNA, 19 bp, Homo sapiens
caaccttctgtggctcaca

SEQ ID NO: 3939408 - DNA, 15 bp, Homo sapiens
caacgcagccctgct

SEQ ID NO: 3939409 - DNA, 21 bp, Homo sapiens
caacgggaccccctggccctg

SEQ ID NO: 3939410 - DNA, 14 bp, Homo sapiens
caactaagccctcg

SEQ ID NO: 3939411 - DNA, 16 bp, Homo sapiens
caactaatcaagagtg

SEQ ID NO: 3939412 - DNA, 20 bp, Homo sapiens
caactactcagctctcctgc

SEQ ID NO: 3939413 - DNA, 22 bp, Homo sapiens
caactatgatatggtaaaagtt

SEQ ID NO: 3939414 - DNA, 14 bp, Homo sapiens
caactatttataaa

SEQ ID NO: 3939415 - DNA, 17 bp, Homo sapiens
caactcactcttatgaa

SEQ ID NO: 3939416 - DNA, 20 bp, Homo sapiens
caactcactcttatgaaatg

SEQ ID NO: 3939417 - DNA, 11 bp, Homo sapiens
caactccagaa

SEQ ID NO: 3939418 - DNA, 22 bp, Homo sapiens
caactccagaagtggggctctg

SEQ ID NO: 3939419 - DNA, 20 bp, Homo sapiens
caactccctgaacctcagtt

SEQ ID NO: 3939420 - DNA, 14 bp, Homo sapiens
caactcctggaagc

SEQ ID NO: 3939421 - DNA, 21 bp, Homo sapiens
caactcctggaagctgtgtcc

SEQ ID NO: 3939422 - DNA, 17 bp, Homo sapiens
caactctgcactccatg

SEQ ID NO: 3939423 - DNA, 14 bp, Homo sapiens
caactgacacagga

SEQ ID NO: 3939424 - DNA, 15 bp, Homo sapiens
caactgacacaggaa

SEQ ID NO: 3939425 - DNA, 16 bp, Homo sapiens
caactgacacaggaaa

SEQ ID NO: 3939426 - DNA, 19 bp, Homo sapiens
caactgaccagcctccatg

SEQ ID NO: 3939427 - DNA, 13 bp, Homo sapiens
caactggcttctg

SEQ ID NO: 3939428 - DNA, 19 bp, Homo sapiens
caactggcttctgtgcact

SEQ ID NO: 3939429 - DNA, 18 bp, Homo sapiens
caacttagatctccagga

SEQ ID NO: 3939430 - DNA, 22 bp, Homo sapiens
caacttcaagtgcatgctctct

SEQ ID NO: 3939431 - DNA, 19 bp, Homo sapiens
caacttggaaaaagaaaga

SEQ ID NO: 3939432 - DNA, 21 bp, Homo sapiens
caacttggaaaaagaaagaaa

SEQ ID NO: 3939433 - DNA, 19 bp, Homo sapiens
caactttagtatttttact

SEQ ID NO: 3939434 - DNA, 12 bp, Homo sapiens
caactttctgta

SEQ ID NO: 3939435 - DNA, 23 bp, Homo sapiens
caactttctgtaaactcaaaact

SEQ ID NO: 3939436 - DNA, 17 bp, Homo sapiens
caagaaaaaataaatgg

SEQ ID NO: 3939437 - DNA, 18 bp, Homo sapiens
caagaaaagaggaaaaaa

SEQ ID NO: 3939438 - DNA, 14 bp, Homo sapiens
caagaaacagaagt

SEQ ID NO: 3939439 - DNA, 16 bp, Homo sapiens
caagaaagctggtaaa

SEQ ID NO: 3939440 - DNA, 22 bp, Homo sapiens
caagaaatccagtttcccacca

SEQ ID NO: 3939441 - DNA, 17 bp, Homo sapiens
caagaaattgcctcctt

SEQ ID NO: 3939442 - DNA, 12 bp, Homo sapiens
caagaacaacaa

SEQ ID NO: 3939443 - DNA, 13 bp, Homo sapiens
caagaagaccaga

SEQ ID NO: 3939444 - DNA, 15 bp, Homo sapiens
caagaagctcccaga

SEQ ID NO: 3939445 - DNA, 14 bp, Homo sapiens
caagacagcagtct

SEQ ID NO: 3939446 - DNA, 14 bp, Homo sapiens
caagactgttgctc

SEQ ID NO: 3939447 - DNA, 18 bp, Homo sapiens
caagactgttgctcaaat

SEQ ID NO: 3939448 - DNA, 20 bp, Homo sapiens
caagacttggcaacagaagc

SEQ ID NO: 3939449 - DNA, 17 bp, Homo sapiens
caagagaagaaaaaatt

SEQ ID NO: 3939450 - DNA, 19 bp, Homo sapiens
caagagaagaaaaaattaa

SEQ ID NO: 3939451 - DNA, 14 bp, Homo sapiens
caagagacagagcc

SEQ ID NO: 3939452 - DNA, 12 bp, Homo sapiens
caagagactctg

SEQ ID NO: 3939453 - DNA, 19 bp, Homo sapiens
caagagagacattgcctcc

SEQ ID NO: 3939454 - DNA, 24 bp, Homo sapiens
caagagagggccatgcaattcatc

SEQ ID NO: 3939455 - DNA, 23 bp, Homo sapiens
caagagcatcatgcctctgaggc

SEQ ID NO: 3939456 - DNA, 22 bp, Homo sapiens
caagagcatcgtgacccttcag

SEQ ID NO: 3939457 - DNA, 15 bp, Homo sapiens
caagagctgctgtcc

SEQ ID NO: 3939458 - DNA, 15 bp, Homo sapiens
caagaggactgagac

SEQ ID NO: 3939459 - DNA, 12 bp, Homo sapiens
caagaggcccag

SEQ ID NO: 3939460 - DNA, 16 bp, Homo sapiens
caagaggctcctgtcc

SEQ ID NO: 3939461 - DNA, 15 bp, Homo sapiens
caatttgagcaattc

SEQ ID NO: 3939462 - DNA, 16 bp, Homo sapiens
caatttgagcaattca

SEQ ID NO: 3939463 - DNA, 17 bp, Homo sapiens
caatttgagcaattcat

SEQ ID NO: 3939464 - DNA, 22 bp, Homo sapiens
caatttgcactgttacttttta

SEQ ID NO: 3939465 - DNA, 19 bp, Homo sapiens
caattttctggaatacatg

SEQ ID NO: 3939466 - DNA, 11 bp, Homo sapiens
caattttgtaa

SEQ ID NO: 3939467 - DNA, 18 bp, Homo sapiens
caatttttatacatatca

SEQ ID NO: 3939468 - DNA, 22 bp, Homo sapiens
caatttttatacatatcagaaa

SEQ ID NO: 3939469 - DNA, 11 bp, Homo sapiens
caatttttcca

SEQ ID NO: 3939470 - DNA, 13 bp, Homo sapiens
cacaaaagccaaa

SEQ ID NO: 3939471 - DNA, 20 bp, Homo sapiens
cacaaagagaaaaagaaatg

SEQ ID NO: 3939472 - DNA, 15 bp, Homo sapiens
cacaaaggggagaag

SEQ ID NO: 3939473 - DNA, 16 bp, Homo sapiens
cacaaaggtataattt

SEQ ID NO: 3939474 - DNA, 21 bp, Homo sapiens
cacaaatatttattttctttc

SEQ ID NO: 3939475 - DNA, 23 bp, Homo sapiens
cacaaatatttattttctttctg

SEQ ID NO: 3939476 - DNA, 21 bp, Homo sapiens
cacaaatctatattaaagtgt

SEQ ID NO: 3939477 - DNA, 23 bp, Homo sapiens
cacaacataaggagaatgtatct

SEQ ID NO: 3939478 - DNA, 17 bp, Homo sapiens
cacaaccctgttttata

SEQ ID NO: 3939479 - DNA, 19 bp, Homo sapiens
cacaaccttctgtggctca

SEQ ID NO: 3939480 - DNA, 12 bp, Homo sapiens
cacaactgacac

SEQ ID NO: 3939481 - DNA, 14 bp, Homo sapiens
cacaagaaatttga

SEQ ID NO: 3939482 - DNA, 21 bp, Homo sapiens
cacaagagcccagcagggcct

SEQ ID NO: 3939483 - DNA, 22 bp, Homo sapiens
cacaagattcccagagacagga

SEQ ID NO: 3939484 - DNA, 22 bp, Homo sapiens
cacaagcaataattaggatcta

SEQ ID NO: 3939485 - DNA, 13 bp, Homo sapiens
cacaagcccaggc

SEQ ID NO: 3939486 - DNA, 12 bp, Homo sapiens
cacaagctggaa

SEQ ID NO: 3939487 - DNA, 13 bp, Homo sapiens
cacaagctggaag

SEQ ID NO: 3939488 - DNA, 15 bp, Homo sapiens
cacaagctggaagca

SEQ ID NO: 3939489 - DNA, 19 bp, Homo sapiens
cacaagcttgtatatacat

SEQ ID NO: 3939490 - DNA, 21 bp, Homo sapiens
cacaagcttgtatatacatat

SEQ ID NO: 3939491 - DNA, 16 bp, Homo sapiens
cacaaggcagcaaggc

SEQ ID NO: 3939492 - DNA, 21 bp, Homo sapiens
cacaaggctgaccaagagaga

SEQ ID NO: 3939493 - DNA, 24 bp, Homo sapiens
cacaaggctgggcacctctagtgc

SEQ ID NO: 3939494 - DNA, 17 bp, Homo sapiens
cacaagttccagctggt

SEQ ID NO: 3939495 - DNA, 19 bp, Homo sapiens
cacaagttccagctggtct

SEQ ID NO: 3939496 - DNA, 20 bp, Homo sapiens
cacaatctgggactttcact

SEQ ID NO: 3939497 - DNA, 22 bp, Homo sapiens
cacaatctttccttgtctctca

SEQ ID NO: 3939498 - DNA, 23 bp, Homo sapiens
cacaatgatgattaaacacctga

SEQ ID NO: 3939499 - DNA, 22 bp, Homo sapiens
cacaatggagtgggagatcagc

SEQ ID NO: 3939500 - DNA, 22 bp, Homo sapiens
cacaatttgagcaattcatttc

SEQ ID NO: 3939501 - DNA, 18 bp, Homo sapiens
cacacaaacacctcctag

SEQ ID NO: 3939502 - DNA, 20 bp, Homo sapiens
cacacaaacacctcctagca

SEQ ID NO: 3939503 - DNA, 13 bp, Homo sapiens
cacacaaaggtat

SEQ ID NO: 3939504 - DNA, 13 bp, Homo sapiens
cacacacacacac

SEQ ID NO: 3939505 - DNA, 15 bp, Homo sapiens
cacacacacacatac

SEQ ID NO: 3939506 - DNA, 15 bp, Homo sapiens
cacacacaggagcat

SEQ ID NO: 3939507 - DNA, 11 bp, Homo sapiens
cacacacatac

SEQ ID NO: 3939508 - DNA, 12 bp, Homo sapiens
cacacagaaata

SEQ ID NO: 3939509 - DNA, 12 bp, Homo sapiens
cacacagaggaa

SEQ ID NO: 3939510 - DNA, 20 bp, Homo sapiens
cacacagatatgcacacaca

SEQ ID NO: 3939511 - DNA, 12 bp, Homo sapiens
cacacagcagca

SEQ ID NO: 3939512 - DNA, 13 bp, Homo sapiens
cacacagcagccc

SEQ ID NO: 3939513 - DNA, 23 bp, Homo sapiens
cacacagggtctgcaaggtcttt

SEQ ID NO: 3939514 - DNA, 17 bp, Homo sapiens
cacacagtattaagtga

SEQ ID NO: 3939515 - DNA, 21 bp, Homo sapiens
cacacagtattaagtgacagt

SEQ ID NO: 3939516 - DNA, 22 bp, Homo sapiens
cacacatagattaatggcactg

SEQ ID NO: 3939517 - DNA, 18 bp, Homo sapiens
cacacatatacatatata

SEQ ID NO: 3939518 - DNA, 13 bp, Homo sapiens
cacacatatatat

SEQ ID NO: 3939519 - DNA, 15 bp, Homo sapiens
cacacatcagtgcac

SEQ ID NO: 3939520 - DNA, 16 bp, Homo sapiens
cacacatggacacaga

SEQ ID NO: 3939521 - DNA, 18 bp, Homo sapiens
cacaccactgccctgcct

SEQ ID NO: 3939522 - DNA, 17 bp, Homo sapiens
cacaccatcaccctctg

SEQ ID NO: 3939523 - DNA, 20 bp, Homo sapiens
cacaccatcttaaatgacag

SEQ ID NO: 3939524 - DNA, 12 bp, Homo sapiens
cacaccccaagg

SEQ ID NO: 3939525 - DNA, 14 bp, Homo sapiens
cacaccccaaggga

SEQ ID NO: 3939526 - DNA, 19 bp, Homo sapiens
cacaccccatctctcttcc

SEQ ID NO: 3939527 - DNA, 15 bp, Homo sapiens
cacaccgatgtgcgc

SEQ ID NO: 3939528 - DNA, 17 bp, Homo sapiens
cacaccggtcaccgaga

SEQ ID NO: 3939529 - DNA, 14 bp, Homo sapiens
cacacctccctgaa

SEQ ID NO: 3939530 - DNA, 16 bp, Homo sapiens
cacacctccctgaacc

SEQ ID NO: 3939531 - DNA, 14 bp, Homo sapiens
cacacctctgggct

SEQ ID NO: 3939532 - DNA, 16 bp, Homo sapiens
cacacctctgggcttc

SEQ ID NO: 3939533 - DNA, 17 bp, Homo sapiens
cacacctgagccagcct

SEQ ID NO: 3939534 - DNA, 20 bp, Homo sapiens
cacacggaggcatctgcacc

SEQ ID NO: 3939535 - DNA, 17 bp, Homo sapiens
cacactattaccatgag

SEQ ID NO: 3939536 - DNA, 15 bp, Homo sapiens
cacactcagcagccc

SEQ ID NO: 3939537 - DNA, 13 bp, Homo sapiens
cacactgtaaata

SEQ ID NO: 3939538 - DNA, 21 bp, Homo sapiens
cacactgtaaatatccacaga

SEQ ID NO: 3939539 - DNA, 20 bp, Homo sapiens
cacacttcaggctcttctcc

SEQ ID NO: 3939540 - DNA, 21 bp, Homo sapiens
cacacttcaggctcttctcct

SEQ ID NO: 3939541 - DNA, 23 bp, Homo sapiens
cacacttctcaggacacaggcct

SEQ ID NO: 3939542 - DNA, 21 bp, Homo sapiens
cacagaaacacaatattttgt

SEQ ID NO: 3939543 - DNA, 15 bp, Homo sapiens
cacagaaatatatat

SEQ ID NO: 3939544 - DNA, 21 bp, Homo sapiens
cacagaaatatatatacatat

SEQ ID NO: 3939545 - DNA, 23 bp, Homo sapiens
cacagaaatatatatacatatgt

SEQ ID NO: 3939546 - DNA, 13 bp, Homo sapiens
cacagaacccttg

SEQ ID NO: 3939547 - DNA, 14 bp, Homo sapiens
cacagacagatccc

SEQ ID NO: 3939548 - DNA, 21 bp, Homo sapiens
cacctcctagaggtgggcagc

SEQ ID NO: 3939549 - DNA, 22 bp, Homo sapiens
cacctcctagaggtgggcagct

SEQ ID NO: 3939550 - DNA, 13 bp, Homo sapiens
cacctcctccact

SEQ ID NO: 3939551 - DNA, 22 bp, Homo sapiens
cacctcctccactcactccagc

SEQ ID NO: 3939552 - DNA, 19 bp, Homo sapiens
cacctcctgagaaggcgag

SEQ ID NO: 3939553 - DNA, 23 bp, Homo sapiens
cacctctcaatattcaataaagc

SEQ ID NO: 3939554 - DNA, 13 bp, Homo sapiens
cacctctgcctca

SEQ ID NO: 3939555 - DNA, 17 bp, Homo sapiens
cacctctggctttgtct

SEQ ID NO: 3939556 - DNA, 13 bp, Homo sapiens
cacctctgggctt

SEQ ID NO: 3939557 - DNA, 14 bp, Homo sapiens
cacctctgggcttc

SEQ ID NO: 3939558 - DNA, 22 bp, Homo sapiens
cacctcttctcttcctgtaaca

SEQ ID NO: 3939559 - DNA, 23 bp, Homo sapiens
cacctgaaccccatgggcttgga

SEQ ID NO: 3939560 - DNA, 17 bp, Homo sapiens
cacctgacaatggcagc

SEQ ID NO: 3939561 - DNA, 19 bp, Homo sapiens
cacctgacaatggcagcta

SEQ ID NO: 3939562 - DNA, 21 bp, Homo sapiens
cacctgacaatggcagctaga

SEQ ID NO: 3939563 - DNA, 14 bp, Homo sapiens
cacctgcaagcccc

SEQ ID NO: 3939564 - DNA, 20 bp, Homo sapiens
cacctgcaagccccagggcc

SEQ ID NO: 3939565 - DNA, 21 bp, Homo sapiens
cacctgcaagccccagggcct

SEQ ID NO: 3939566 - DNA, 22 bp, Homo sapiens
cacctgcatccgtagttccctg

SEQ ID NO: 3939567 - DNA, 12 bp, Homo sapiens
cacctgccagcc

SEQ ID NO: 3939568 - DNA, 15 bp, Homo sapiens
cacctgccagccatc

SEQ ID NO: 3939569 - DNA, 14 bp, Homo sapiens
cacctgccccagcg

SEQ ID NO: 3939570 - DNA, 13 bp, Homo sapiens
cacctgccctgcc

SEQ ID NO: 3939571 - DNA, 16 bp, Homo sapiens
cacctgccctgccctg

SEQ ID NO: 3939572 - DNA, 21 bp, Homo sapiens
cacctgccctgccctgccacc

SEQ ID NO: 3939573 - DNA, 21 bp, Homo sapiens
cacctgccgacctcgtcctcc

SEQ ID NO: 3939574 - DNA, 23 bp, Homo sapiens
cacctgccgacctcgtcctcccc

SEQ ID NO: 3939575 - DNA, 22 bp, Homo sapiens
cacctgctggaaaccacacttc

SEQ ID NO: 3939576 - DNA, 11 bp, Homo sapiens
cacctggcccc

SEQ ID NO: 3939577 - DNA, 20 bp, Homo sapiens
cacctggccccatgtctctc

SEQ ID NO: 3939578 - DNA, 22 bp, Homo sapiens
cacctggccccatgtctctcag

SEQ ID NO: 3939579 - DNA, 15 bp, Homo sapiens
cacctggcctgctgg

SEQ ID NO: 3939580 - DNA, 19 bp, Homo sapiens
cacctggcctgctgggaac

SEQ ID NO: 3939581 - DNA, 21 bp, Homo sapiens
cacctgggaaaacagaggaat

SEQ ID NO: 3939582 - DNA, 14 bp, Homo sapiens
cacctgggccctgg

SEQ ID NO: 3939583 - DNA, 16 bp, Homo sapiens
cacctgtagtcccagc

SEQ ID NO: 3939584 - DNA, 12 bp, Homo sapiens
cacctgtctgtc

SEQ ID NO: 3939585 - DNA, 13 bp, Homo sapiens
cacctgtctgtct

SEQ ID NO: 3939586 - DNA, 22 bp, Homo sapiens
cacctgtctgtctgtctgtccc

SEQ ID NO: 3939587 - DNA, 17 bp, Homo sapiens
cacctgtggtgcctgcc

SEQ ID NO: 3939588 - DNA, 19 bp, Homo sapiens
cacctgttaaaatgtacac

SEQ ID NO: 3939589 - DNA, 20 bp, Homo sapiens
cacctgttaaaatgtacact

SEQ ID NO: 3939590 - DNA, 15 bp, Homo sapiens
cacctgttgcacctc

SEQ ID NO: 3939591 - DNA, 21 bp, Homo sapiens
cacctgttgcacctcaggcag

SEQ ID NO: 3939592 - DNA, 15 bp, Homo sapiens
caccttacattccta

SEQ ID NO: 3939593 - DNA, 19 bp, Homo sapiens
caccttcaccttcatccat

SEQ ID NO: 3939594 - DNA, 15 bp, Homo sapiens
caccttcccagctct

SEQ ID NO: 3939595 - DNA, 13 bp, Homo sapiens
caccttcccatgc

SEQ ID NO: 3939596 - DNA, 14 bp, Homo sapiens
caccttcccatgcc

SEQ ID NO: 3939597 - DNA, 14 bp, Homo sapiens
caccttccccagac

SEQ ID NO: 3939598 - DNA, 15 bp, Homo sapiens
caccttccccagact

SEQ ID NO: 3939599 - DNA, 20 bp, Homo sapiens
caccttccccagactcagct

SEQ ID NO: 3939600 - DNA, 18 bp, Homo sapiens
caccttcttggcttctgg

SEQ ID NO: 3939601 - DNA, 22 bp, Homo sapiens
caccttcttggcttctgggacc

SEQ ID NO: 3939602 - DNA, 17 bp, Homo sapiens
caccttgccgagagagg

SEQ ID NO: 3939603 - DNA, 18 bp, Homo sapiens
caccttgccgagagaggc

SEQ ID NO: 3939604 - DNA, 16 bp, Homo sapiens
caccttgctcttcttt

SEQ ID NO: 3939605 - DNA, 17 bp, Homo sapiens
caccttggactcctccc

SEQ ID NO: 3939606 - DNA, 17 bp, Homo sapiens
cacctttgggatcagcc

SEQ ID NO: 3939607 - DNA, 23 bp, Homo sapiens
cacctttgggatcagcctccgcc

SEQ ID NO: 3939608 - DNA, 22 bp, Homo sapiens
cacgaatttggtgtggctgtat

SEQ ID NO: 3939609 - DNA, 19 bp, Homo sapiens
cacgacctcggctcactgc

SEQ ID NO: 3939610 - DNA, 12 bp, Homo sapiens
cacgactcttcc

SEQ ID NO: 3939611 - DNA, 17 bp, Homo sapiens
cacgactcttcctgcaa

SEQ ID NO: 3939612 - DNA, 19 bp, Homo sapiens
cacgactcttcctgcaaag

SEQ ID NO: 3939613 - DNA, 19 bp, Homo sapiens
cacgagcaggctactgtca

SEQ ID NO: 3939614 - DNA, 22 bp, Homo sapiens
cacgagcaggctactgtcagct

SEQ ID NO: 3939615 - DNA, 21 bp, Homo sapiens
cacgagtaagatattatttaa

SEQ ID NO: 3939616 - DNA, 14 bp, Homo sapiens
cacgagtcacctgc

SEQ ID NO: 3939617 - DNA, 15 bp, Homo sapiens
cacgagtcacctgca

SEQ ID NO: 3939618 - DNA, 18 bp, Homo sapiens
cacgagtcacctgcaagc

SEQ ID NO: 3939619 - DNA, 23 bp, Homo sapiens
cacgagtcacctgcaagccccag

SEQ ID NO: 3939620 - DNA, 16 bp, Homo sapiens
cacgcaacccttgctg

SEQ ID NO: 3939621 - DNA, 23 bp, Homo sapiens
cacgcaagggcatcaggcactgg

SEQ ID NO: 3939622 - DNA, 13 bp, Homo sapiens
cacgcaggaactc

SEQ ID NO: 3939623 - DNA, 14 bp, Homo sapiens
cacgcctcctggcc

SEQ ID NO: 3939624 - DNA, 18 bp, Homo sapiens
cacgcctcctggccagac

SEQ ID NO: 3939625 - DNA, 21 bp, Homo sapiens
cacgcctgtaatcccagcact

SEQ ID NO: 3939626 - DNA, 21 bp, Homo sapiens
cacgcctgtaatcccagcagt

SEQ ID NO: 3939627 - DNA, 14 bp, Homo sapiens
cacgctctggacat

SEQ ID NO: 3939628 - DNA, 22 bp, Homo sapiens
cacgctgtcctctcgagcccag

SEQ ID NO: 3939629 - DNA, 20 bp, Homo sapiens
cacggcacctgggccctggg

SEQ ID NO: 3939630 - DNA, 12 bp, Homo sapiens
cacggccaccct

SEQ ID NO: 3939631 - DNA, 21 bp, Homo sapiens
cacgggaagcctccgtcagga

SEQ ID NO: 3939632 - DNA, 13 bp, Homo sapiens
cacgggcctcagt

SEQ ID NO: 3939633 - DNA, 15 bp, Homo sapiens
cacggtgaaatccag

SEQ ID NO: 3939634 - DNA, 21 bp, Homo sapiens
cagaatttttaatgacttttt

SEQ ID NO: 3939635 - DNA, 22 bp, Homo sapiens
cagaatttttaatgacttttta

SEQ ID NO: 3939636 - DNA, 20 bp, Homo sapiens
cagacaaaaacagcctcaca

SEQ ID NO: 3939637 - DNA, 15 bp, Homo sapiens
cagacaagagctgct

SEQ ID NO: 3939638 - DNA, 19 bp, Homo sapiens
cagacaagagctgctgtcc

SEQ ID NO: 3939639 - DNA, 19 bp, Homo sapiens
cagacaagcaacaggtttt

SEQ ID NO: 3939640 - DNA, 13 bp, Homo sapiens
cagacaatccact

SEQ ID NO: 3939641 - DNA, 15 bp, Homo sapiens
cagacaatccactct

SEQ ID NO: 3939642 - DNA, 21 bp, Homo sapiens
cagacaattcagaagcatcac

SEQ ID NO: 3939643 - DNA, 16 bp, Homo sapiens
cagacacattctcctg

SEQ ID NO: 3939644 - DNA, 11 bp, Homo sapiens
cagacactaag

SEQ ID NO: 3939645 - DNA, 20 bp, Homo sapiens
cagacagagaaatgtgaagg

SEQ ID NO: 3939646 - DNA, 13 bp, Homo sapiens
cagacagatccca

SEQ ID NO: 3939647 - DNA, 12 bp, Homo sapiens
cagaccacctgc

SEQ ID NO: 3939648 - DNA, 14 bp, Homo sapiens
cagaccacctgcca

SEQ ID NO: 3939649 - DNA, 18 bp, Homo sapiens
cagaccacctgccagcca

SEQ ID NO: 3939650 - DNA, 23 bp, Homo sapiens
cagaccacctgccagccatcaca

SEQ ID NO: 3939651 - DNA, 15 bp, Homo sapiens
cagaccatctccagc

SEQ ID NO: 3939652 - DNA, 21 bp, Homo sapiens
cagaccatctccagcatcctg

SEQ ID NO: 3939653 - DNA, 16 bp, Homo sapiens
cagaccattgtcttcc

SEQ ID NO: 3939654 - DNA, 18 bp, Homo sapiens
cagaccattgtcttccaa

SEQ ID NO: 3939655 - DNA, 22 bp, Homo sapiens
cagaccattgtcttccaacccc

SEQ ID NO: 3939656 - DNA, 15 bp, Homo sapiens
cagaccccagcggct

SEQ ID NO: 3939657 - DNA, 16 bp, Homo sapiens
cagacccccactctca

SEQ ID NO: 3939658 - DNA, 13 bp, Homo sapiens
cagacccctctca

SEQ ID NO: 3939659 - DNA, 13 bp, Homo sapiens
cagacccctggct

SEQ ID NO: 3939660 - DNA, 14 bp, Homo sapiens
cagacccctggctt

SEQ ID NO: 3939661 - DNA, 21 bp, Homo sapiens
cagacccctggcttttcactg

SEQ ID NO: 3939662 - DNA, 22 bp, Homo sapiens
cagacccctggcttttcactgc

SEQ ID NO: 3939663 - DNA, 13 bp, Homo sapiens
cagacccctgtgg

SEQ ID NO: 3939664 - DNA, 13 bp, Homo sapiens
cagaccccttggc

SEQ ID NO: 3939665 - DNA, 17 bp, Homo sapiens
cagaccctaccccacca

SEQ ID NO: 3939666 - DNA, 15 bp, Homo sapiens
cagaccctgcccttg

SEQ ID NO: 3939667 - DNA, 12 bp, Homo sapiens
cagaccctgcct

SEQ ID NO: 3939668 - DNA, 13 bp, Homo sapiens
cagaccctgcctg

SEQ ID NO: 3939669 - DNA, 15 bp, Homo sapiens
cagaccctgcctgag

SEQ ID NO: 3939670 - DNA, 16 bp, Homo sapiens
cagaccctgcctgagc

SEQ ID NO: 3939671 - DNA, 17 bp, Homo sapiens
cagaccctgcctgagcc

SEQ ID NO: 3939672 - DNA, 18 bp, Homo sapiens
cagaccctgcctgagccc

SEQ ID NO: 3939673 - DNA, 22 bp, Homo sapiens
cagaccgggggccagacacaga

SEQ ID NO: 3939674 - DNA, 15 bp, Homo sapiens
cagacctagacctgg

SEQ ID NO: 3939675 - DNA, 17 bp, Homo sapiens
cagacctagacctgggc

SEQ ID NO: 3939676 - DNA, 18 bp, Homo sapiens
cagacctagacctgggcc

SEQ ID NO: 3939677 - DNA, 20 bp, Homo sapiens
cagacctagacctgggccaa

SEQ ID NO: 3939678 - DNA, 23 bp, Homo sapiens
cagacctagacctgggccaaaag

SEQ ID NO: 3939679 - DNA, 13 bp, Homo sapiens
cagaccttttatc

SEQ ID NO: 3939680 - DNA, 17 bp, Homo sapiens
cagacgcagcagctggg

SEQ ID NO: 3939681 - DNA, 19 bp, Homo sapiens
cagactatttaacttgagg

SEQ ID NO: 3939682 - DNA, 17 bp, Homo sapiens
cagactcagctccagaa

SEQ ID NO: 3939683 - DNA, 18 bp, Homo sapiens
cagactccctcccctgcc

SEQ ID NO: 3939684 - DNA, 18 bp, Homo sapiens
cagactgcatgtagttgg

SEQ ID NO: 3939685 - DNA, 20 bp, Homo sapiens
cagactgcttccaattttct

SEQ ID NO: 3939686 - DNA, 17 bp, Homo sapiens
cagactggcacagtttt

SEQ ID NO: 3939687 - DNA, 22 bp, Homo sapiens
cagactggcacagttttctgag

SEQ ID NO: 3939688 - DNA, 23 bp, Homo sapiens
cagactggcacagttttctgaga

SEQ ID NO: 3939689 - DNA, 13 bp, Homo sapiens
cagacttctccag

SEQ ID NO: 3939690 - DNA, 14 bp, Homo sapiens
cagacttctccaga

SEQ ID NO: 3939691 - DNA, 22 bp, Homo sapiens
cagacttctggaaggctggctg

SEQ ID NO: 3939692 - DNA, 23 bp, Homo sapiens
cagacttctggaaggctggctga

SEQ ID NO: 3939693 - DNA, 20 bp, Homo sapiens
cagacttgccaggctccctt

SEQ ID NO: 3939694 - DNA, 20 bp, Homo sapiens
cagagaaagaagagacagga

SEQ ID NO: 3939695 - DNA, 21 bp, Homo sapiens
cagagaaagaagagacaggag

SEQ ID NO: 3939696 - DNA, 22 bp, Homo sapiens
cagagaaagaagagacaggagg

SEQ ID NO: 3939697 - DNA, 23 bp, Homo sapiens
cagagaaagaagagacaggaggg

SEQ ID NO: 3939698 - DNA, 18 bp, Homo sapiens
cagagaaatgtgaagggt

SEQ ID NO: 3939699 - DNA, 14 bp, Homo sapiens
cagagaaggcagga

SEQ ID NO: 3939700 - DNA, 13 bp, Homo sapiens
cagagaaggcctc

SEQ ID NO: 3939701 - DNA, 21 bp, Homo sapiens
cagagaaggcctcttgtgctc

SEQ ID NO: 3939702 - DNA, 11 bp, Homo sapiens
cagagaatata

SEQ ID NO: 3939703 - DNA, 17 bp, Homo sapiens
cagagaatcagggcagg

SEQ ID NO: 3939704 - DNA, 18 bp, Homo sapiens
cagagaatctgaagctat

SEQ ID NO: 3939705 - DNA, 14 bp, Homo sapiens
cagagaattcttag

SEQ ID NO: 3939706 - DNA, 16 bp, Homo sapiens
cagagaatttctacca

SEQ ID NO: 3939707 - DNA, 23 bp, Homo sapiens
cagagaatttctaccatttcaga

SEQ ID NO: 3939708 - DNA, 14 bp, Homo sapiens
cagagacacctgca

SEQ ID NO: 3939709 - DNA, 18 bp, Homo sapiens
cagagacacctgcacctc

SEQ ID NO: 3939710 - DNA, 22 bp, Homo sapiens
cagagacagaaacagagagaga

SEQ ID NO: 3939711 - DNA, 22 bp, Homo sapiens
cagagacaggaaaatcctctgg

SEQ ID NO: 3939712 - DNA, 16 bp, Homo sapiens
cagagacaggaaagaa

SEQ ID NO: 3939713 - DNA, 14 bp, Homo sapiens
cagagacaggccca

SEQ ID NO: 3939714 - DNA, 23 bp, Homo sapiens
cagagacaggcccaagagatgaa

SEQ ID NO: 3939715 - DNA, 16 bp, Homo sapiens
cagagaccccttcctt

SEQ ID NO: 3939716 - DNA, 17 bp, Homo sapiens
cagagacctgaggcaga

SEQ ID NO: 3939717 - DNA, 21 bp, Homo sapiens
cagagaccttttctctcccat

SEQ ID NO: 3939718 - DNA, 16 bp, Homo sapiens
cagagacgcaagggag

SEQ ID NO: 3939719 - DNA, 21 bp, Homo sapiens
cagagacgcaagggagaagaa

SEQ ID NO: 3939720 - DNA, 16 bp, Homo sapiens
cagcctgtcctggtac

SEQ ID NO: 3939721 - DNA, 22 bp, Homo sapiens
cagcctgtcctggtacagcagg

SEQ ID NO: 3939722 - DNA, 12 bp, Homo sapiens
cagcctgtggcg

SEQ ID NO: 3939723 - DNA, 21 bp, Homo sapiens
cagccttggataatgctgttg

SEQ ID NO: 3939724 - DNA, 21 bp, Homo sapiens
cagcgaaaggatgtaaacagt

SEQ ID NO: 3939725 - DNA, 23 bp, Homo sapiens
cagcgcagccgccgggcaggcct

SEQ ID NO: 3939726 - DNA, 21 bp, Homo sapiens
cagcgccctggagtcccctgg

SEQ ID NO: 3939727 - DNA, 19 bp, Homo sapiens
cagcgcggcttggccgcca

SEQ ID NO: 3939728 - DNA, 23 bp, Homo sapiens
cagcgcggcttggccgccatccg

SEQ ID NO: 3939729 - DNA, 16 bp, Homo sapiens
cagcgcgggcggaggc

SEQ ID NO: 3939730 - DNA, 15 bp, Homo sapiens
cagcggaggagctcc

SEQ ID NO: 3939731 - DNA, 14 bp, Homo sapiens
cagcggcccctgca

SEQ ID NO: 3939732 - DNA, 18 bp, Homo sapiens
cagcggggccccagggct

SEQ ID NO: 3939733 - DNA, 15 bp, Homo sapiens
cagcgtggccttgtt

SEQ ID NO: 3939734 - DNA, 18 bp, Homo sapiens
cagctaagctaggaatga

SEQ ID NO: 3939735 - DNA, 17 bp, Homo sapiens
cagctaatctgtagggc

SEQ ID NO: 3939736 - DNA, 21 bp, Homo sapiens
cagctaatctgtagggctgga

SEQ ID NO: 3939737 - DNA, 13 bp, Homo sapiens
cagctacattcct

SEQ ID NO: 3939738 - DNA, 14 bp, Homo sapiens
cagctacattcctc

SEQ ID NO: 3939739 - DNA, 17 bp, Homo sapiens
cagctacattcctcagc

SEQ ID NO: 3939740 - DNA, 19 bp, Homo sapiens
cagctacattcctcagctg

SEQ ID NO: 3939741 - DNA, 20 bp, Homo sapiens
cagctactctgtccaggcca

SEQ ID NO: 3939742 - DNA, 17 bp, Homo sapiens
cagctacttaagagaaa

SEQ ID NO: 3939743 - DNA, 20 bp, Homo sapiens
cagctacttaagagaaatgg

SEQ ID NO: 3939744 - DNA, 16 bp, Homo sapiens
cagctagactggagtg

SEQ ID NO: 3939745 - DNA, 13 bp, Homo sapiens
cagctagggctgg

SEQ ID NO: 3939746 - DNA, 15 bp, Homo sapiens
cagctagggctggac

SEQ ID NO: 3939747 - DNA, 15 bp, Homo sapiens
cagctagtgacccac

SEQ ID NO: 3939748 - DNA, 21 bp, Homo sapiens
cagctatgcgcaatgtggcat

SEQ ID NO: 3939749 - DNA, 16 bp, Homo sapiens
cagctcagagatgaaa

SEQ ID NO: 3939750 - DNA, 15 bp, Homo sapiens
cagctcccaccccac

SEQ ID NO: 3939751 - DNA, 22 bp, Homo sapiens
cagctcccaccccacccccttc

SEQ ID NO: 3939752 - DNA, 17 bp, Homo sapiens
cagctcccatagcgctg

SEQ ID NO: 3939753 - DNA, 20 bp, Homo sapiens
cagctcccctcggagaagag

SEQ ID NO: 3939754 - DNA, 22 bp, Homo sapiens
cagctcccctcggagaagagct

SEQ ID NO: 3939755 - DNA, 12 bp, Homo sapiens
cagctcctctgt

SEQ ID NO: 3939756 - DNA, 15 bp, Homo sapiens
cagctcctctgtctc

SEQ ID NO: 3939757 - DNA, 19 bp, Homo sapiens
cagctcctctgtctcgagc

SEQ ID NO: 3939758 - DNA, 20 bp, Homo sapiens
cagctccttttgtccccagg

SEQ ID NO: 3939759 - DNA, 20 bp, Homo sapiens
cagctctagttttcagcctt

SEQ ID NO: 3939760 - DNA, 16 bp, Homo sapiens
cagctctccctctggc

SEQ ID NO: 3939761 - DNA, 15 bp, Homo sapiens
cagctctctctaccc

SEQ ID NO: 3939762 - DNA, 18 bp, Homo sapiens
cagctctctgtataaaca

SEQ ID NO: 3939763 - DNA, 19 bp, Homo sapiens
cagctctgtggcctgtgtc

SEQ ID NO: 3939764 - DNA, 16 bp, Homo sapiens
cagctcttcactcagc

SEQ ID NO: 3939765 - DNA, 17 bp, Homo sapiens
cagctcttcactcagcc

SEQ ID NO: 3939766 - DNA, 16 bp, Homo sapiens
cagctctttcttcttt

SEQ ID NO: 3939767 - DNA, 21 bp, Homo sapiens
cagctgagagccctgctgtgg

SEQ ID NO: 3939768 - DNA, 13 bp, Homo sapiens
cagctgagtgaga

SEQ ID NO: 3939769 - DNA, 19 bp, Homo sapiens
cagctgattttgtcactgt

SEQ ID NO: 3939770 - DNA, 22 bp, Homo sapiens
cagctgattttgtcactgtctt

SEQ ID NO: 3939771 - DNA, 14 bp, Homo sapiens
cagctgcacattcc

SEQ ID NO: 3939772 - DNA, 19 bp, Homo sapiens
cagctgcagatgccacacc

SEQ ID NO: 3939773 - DNA, 17 bp, Homo sapiens
cagctgcagctgggccc

SEQ ID NO: 3939774 - DNA, 19 bp, Homo sapiens
cagctgcagctgggcccca

SEQ ID NO: 3939775 - DNA, 23 bp, Homo sapiens
cagctgcagctgggccccatgct

SEQ ID NO: 3939776 - DNA, 17 bp, Homo sapiens
cagctgccgaccagagc

SEQ ID NO: 3939777 - DNA, 12 bp, Homo sapiens
cagctgcctgca

SEQ ID NO: 3939778 - DNA, 14 bp, Homo sapiens
cagctgctctgccc

SEQ ID NO: 3939779 - DNA, 21 bp, Homo sapiens
cagctgctctgccccttgggc

SEQ ID NO: 3939780 - DNA, 16 bp, Homo sapiens
cagctgctcttagtgc

SEQ ID NO: 3939781 - DNA, 20 bp, Homo sapiens
cagctgctcttagtgcccgc

SEQ ID NO: 3939782 - DNA, 13 bp, Homo sapiens
cagctgctgaaga

SEQ ID NO: 3939783 - DNA, 21 bp, Homo sapiens
cagctgctgaagttctgagcc

SEQ ID NO: 3939784 - DNA, 10 bp, Homo sapiens
cagctgcttg

SEQ ID NO: 3939785 - DNA, 19 bp, Homo sapiens
cagctggcctctagaacac

SEQ ID NO: 3939786 - DNA, 20 bp, Homo sapiens
cagctggcctctagaacacc

SEQ ID NO: 3939787 - DNA, 18 bp, Homo sapiens
cagctgggacccctccca

SEQ ID NO: 3939788 - DNA, 15 bp, Homo sapiens
cagctgggccccatg

SEQ ID NO: 3939789 - DNA, 17 bp, Homo sapiens
cagctgggccccatgct

SEQ ID NO: 3939790 - DNA, 23 bp, Homo sapiens
cagctgggccccatgctctgccc

SEQ ID NO: 3939791 - DNA, 19 bp, Homo sapiens
cagctgggccggccagcct

SEQ ID NO: 3939792 - DNA, 18 bp, Homo sapiens
cagctggtcaacctgctc

SEQ ID NO: 3939793 - DNA, 13 bp, Homo sapiens
cagctggtgctgc

SEQ ID NO: 3939794 - DNA, 18 bp, Homo sapiens
cagctggtgctgcaagga

SEQ ID NO: 3939795 - DNA, 20 bp, Homo sapiens
cagctggtgctgcaaggaag

SEQ ID NO: 3939796 - DNA, 20 bp, Homo sapiens
cagctggtgggaagcgtctg

SEQ ID NO: 3939797 - DNA, 14 bp, Homo sapiens
cagctgtagccatg

SEQ ID NO: 3939798 - DNA, 16 bp, Homo sapiens
cagctgtagccatggc

SEQ ID NO: 3939799 - DNA, 18 bp, Homo sapiens
cagctgtagccatggctc

SEQ ID NO: 3939800 - DNA, 20 bp, Homo sapiens
cagctgtcatggaaaagccc

SEQ ID NO: 3939801 - DNA, 14 bp, Homo sapiens
cagctgtccctgtc

SEQ ID NO: 3939802 - DNA, 16 bp, Homo sapiens
cagctgtccctgtcac

SEQ ID NO: 3939803 - DNA, 20 bp, Homo sapiens
cagctgtctgtgtcagcctg

SEQ ID NO: 3939804 - DNA, 12 bp, Homo sapiens
cagctgtgcctc

SEQ ID NO: 3939805 - DNA, 14 bp, Homo sapiens
cagctgtgcctcgc

SEQ ID NO: 3939806 - DNA, 21 bp, Homo sapiens
cagtaaaaacttgtactatgt

SEQ ID NO: 3939807 - DNA, 17 bp, Homo sapiens
cagtaaataaattgttt

SEQ ID NO: 3939808 - DNA, 19 bp, Homo sapiens
cagtaaataaattgtttga

SEQ ID NO: 3939809 - DNA, 13 bp, Homo sapiens
cagtaaatccaca

SEQ ID NO: 3939810 - DNA, 18 bp, Homo sapiens
cagtaacacatctttaat

SEQ ID NO: 3939811 - DNA, 14 bp, Homo sapiens
cagtaagtcttttt

SEQ ID NO: 3939812 - DNA, 21 bp, Homo sapiens
cagtacagagaaattctgtgg

SEQ ID NO: 3939813 - DNA, 15 bp, Homo sapiens
cagtacatgggaaag

SEQ ID NO: 3939814 - DNA, 14 bp, Homo sapiens
cagtacctgggaaa

SEQ ID NO: 3939815 - DNA, 21 bp, Homo sapiens
cagtagcttaaataaattcaa

SEQ ID NO: 3939816 - DNA, 17 bp, Homo sapiens
cagtaggtccaagggcc

SEQ ID NO: 3939817 - DNA, 14 bp, Homo sapiens
cagtataaaagaca

SEQ ID NO: 3939818 - DNA, 15 bp, Homo sapiens
cagtataaaagacaa

SEQ ID NO: 3939819 - DNA, 14 bp, Homo sapiens
cagtatatttatag

SEQ ID NO: 3939820 - DNA, 15 bp, Homo sapiens
cagtatatttatagt

SEQ ID NO: 3939821 - DNA, 14 bp, Homo sapiens
cagtatatttctga

SEQ ID NO: 3939822 - DNA, 18 bp, Homo sapiens
cagtatatttgaaactgt

SEQ ID NO: 3939823 - DNA, 15 bp, Homo sapiens
cagtatgaatgatgt

SEQ ID NO: 3939824 - DNA, 17 bp, Homo sapiens
cagtattttattaaagc

SEQ ID NO: 3939825 - DNA, 14 bp, Homo sapiens
cagtattttggaga

SEQ ID NO: 3939826 - DNA, 20 bp, Homo sapiens
cagtattttggagaaattat

SEQ ID NO: 3939827 - DNA, 19 bp, Homo sapiens
cagtcaaaacagagatgtg

SEQ ID NO: 3939828 - DNA, 15 bp, Homo sapiens
cagtcacccttctgg

SEQ ID NO: 3939829 - DNA, 19 bp, Homo sapiens
cagtcacctcttctgccag

SEQ ID NO: 3939830 - DNA, 21 bp, Homo sapiens
cagtcagttcccggagcacag

SEQ ID NO: 3939831 - DNA, 23 bp, Homo sapiens
cagtcagttcccggagcacagcc

SEQ ID NO: 3939832 - DNA, 11 bp, Homo sapiens
cagtcatttaa

SEQ ID NO: 3939833 - DNA, 14 bp, Homo sapiens
cagtccagaataag

SEQ ID NO: 3939834 - DNA, 20 bp, Homo sapiens
cagtccagatgccttcctgt

SEQ ID NO: 3939835 - DNA, 15 bp, Homo sapiens
cagtcccagagcagg

SEQ ID NO: 3939836 - DNA, 14 bp, Homo sapiens
cagtccccagccct

SEQ ID NO: 3939837 - DNA, 15 bp, Homo sapiens
cagtccccagtcacc

SEQ ID NO: 3939838 - DNA, 17 bp, Homo sapiens
cagtccccctgccccag

SEQ ID NO: 3939839 - DNA, 23 bp, Homo sapiens
cagtccctgagaccatttaacat

SEQ ID NO: 3939840 - DNA, 12 bp, Homo sapiens
cagtccctgggg

SEQ ID NO: 3939841 - DNA, 20 bp, Homo sapiens
cagtccctgggggaagccct

SEQ ID NO: 3939842 - DNA, 16 bp, Homo sapiens
cagtcccttgctgaca

SEQ ID NO: 3939843 - DNA, 21 bp, Homo sapiens
cagtcccttgctgacatggct

SEQ ID NO: 3939844 - DNA, 17 bp, Homo sapiens
cagtccgtccaccacct

SEQ ID NO: 3939845 - DNA, 13 bp, Homo sapiens
cagtcctagagct

SEQ ID NO: 3939846 - DNA, 15 bp, Homo sapiens
cagtcctagagctcc

SEQ ID NO: 3939847 - DNA, 17 bp, Homo sapiens
cagtcctagagctcctg

SEQ ID NO: 3939848 - DNA, 21 bp, Homo sapiens
cagtcctagagctcctgtccc

SEQ ID NO: 3939849 - DNA, 20 bp, Homo sapiens
cagtcgcaggatccgctgcc

SEQ ID NO: 3939850 - DNA, 22 bp, Homo sapiens
cagtcgcaggatccgctgccac

SEQ ID NO: 3939851 - DNA, 20 bp, Homo sapiens
cagtctacgttctccagccc

SEQ ID NO: 3939852 - DNA, 23 bp, Homo sapiens
cagtctacgttctccagcccaca

SEQ ID NO: 3939853 - DNA, 19 bp, Homo sapiens
cagtctcaagcactaaaaa

SEQ ID NO: 3939854 - DNA, 11 bp, Homo sapiens
cagtctcagaa

SEQ ID NO: 3939855 - DNA, 14 bp, Homo sapiens
cagtctcctgacat

SEQ ID NO: 3939856 - DNA, 17 bp, Homo sapiens
cagtctcctgacattaa

SEQ ID NO: 3939857 - DNA, 15 bp, Homo sapiens
cagtctcgggtggct

SEQ ID NO: 3939858 - DNA, 19 bp, Homo sapiens
cagtctgaacccttgtgct

SEQ ID NO: 3939859 - DNA, 11 bp, Homo sapiens
cagtctgagct

SEQ ID NO: 3939860 - DNA, 20 bp, Homo sapiens
cagtctgtgtttgaccttca

SEQ ID NO: 3939861 - DNA, 23 bp, Homo sapiens
cagtcttatagcaagactgttag

SEQ ID NO: 3939862 - DNA, 17 bp, Homo sapiens
cagtcttcttcacccgc

SEQ ID NO: 3939863 - DNA, 19 bp, Homo sapiens
cagtcttcttcacccgctg

SEQ ID NO: 3939864 - DNA, 15 bp, Homo sapiens
cagtcttgcctaggc

SEQ ID NO: 3939865 - DNA, 18 bp, Homo sapiens
cagtgaaagagtagtgca

SEQ ID NO: 3939866 - DNA, 15 bp, Homo sapiens
cagtgacaagtggag

SEQ ID NO: 3939867 - DNA, 13 bp, Homo sapiens
cagtgacctgacc

SEQ ID NO: 3939868 - DNA, 20 bp, Homo sapiens
cagtgacctgaccggcacct

SEQ ID NO: 3939869 - DNA, 19 bp, Homo sapiens
cagtgacctgctgggtaaa

SEQ ID NO: 3939870 - DNA, 12 bp, Homo sapiens
cagtgactggca

SEQ ID NO: 3939871 - DNA, 14 bp, Homo sapiens
cagtgactggcagg

SEQ ID NO: 3939872 - DNA, 20 bp, Homo sapiens
cagtgactgtcgtgtttaca

SEQ ID NO: 3939873 - DNA, 20 bp, Homo sapiens
cagtgactttttctgagctt

SEQ ID NO: 3939874 - DNA, 22 bp, Homo sapiens
cagtgactttttctgagctttt

SEQ ID NO: 3939875 - DNA, 13 bp, Homo sapiens
cagtgagacacag

SEQ ID NO: 3939876 - DNA, 19 bp, Homo sapiens
cagtgagattacagaggaa

SEQ ID NO: 3939877 - DNA, 20 bp, Homo sapiens
cagtgagattacagaggaag

SEQ ID NO: 3939878 - DNA, 12 bp, Homo sapiens
cagtgagcctga

SEQ ID NO: 3939879 - DNA, 14 bp, Homo sapiens
cagtgaggagggtg

SEQ ID NO: 3939880 - DNA, 14 bp, Homo sapiens
cagtgagggctggg

SEQ ID NO: 3939881 - DNA, 15 bp, Homo sapiens
cagtgagggctgggc

SEQ ID NO: 3939882 - DNA, 18 bp, Homo sapiens
cagtgagttacagcgaga

SEQ ID NO: 3939883 - DNA, 18 bp, Homo sapiens
cagtgatacgtacagcca

SEQ ID NO: 3939884 - DNA, 23 bp, Homo sapiens
cagtgatggcgcgggaggcacca

SEQ ID NO: 3939885 - DNA, 20 bp, Homo sapiens
cagtgatgtgctggagctgg

SEQ ID NO: 3939886 - DNA, 11 bp, Homo sapiens
cagtgcaagag

SEQ ID NO: 3939887 - DNA, 21 bp, Homo sapiens
cagtgcaagagactctggcct

SEQ ID NO: 3939888 - DNA, 18 bp, Homo sapiens
cagtgcacacggatgcac

SEQ ID NO: 3939889 - DNA, 13 bp, Homo sapiens
cagtgccacagag

SEQ ID NO: 3939890 - DNA, 20 bp, Homo sapiens
cagtgccacttgacattcct

SEQ ID NO: 3939891 - DNA, 19 bp, Homo sapiens
cagtgccctcattttatgt

SEQ ID NO: 3939892 - DNA, 12 bp, Homo sapiens
cagtgcctcctg

SEQ ID NO: 3939893 - DNA, 22 bp, Homo sapiens
catctacacagcagtatgaatg

SEQ ID NO: 3939894 - DNA, 19 bp, Homo sapiens
catctatgtcccttgctgt

SEQ ID NO: 3939895 - DNA, 19 bp, Homo sapiens
catctattataaaaccatg

SEQ ID NO: 3939896 - DNA, 20 bp, Homo sapiens
catctattataaaaccatgt

SEQ ID NO: 3939897 - DNA, 18 bp, Homo sapiens
catctcaggcctccctca

SEQ ID NO: 3939898 - DNA, 15 bp, Homo sapiens
catctcaggtgccac

SEQ ID NO: 3939899 - DNA, 22 bp, Homo sapiens
catctcaggtgccactccctga

SEQ ID NO: 3939900 - DNA, 20 bp, Homo sapiens
catctcattgtagagcttgg

SEQ ID NO: 3939901 - DNA, 16 bp, Homo sapiens
catctccagcatcctg

SEQ ID NO: 3939902 - DNA, 22 bp, Homo sapiens
catctccagcatcctgcttcct

SEQ ID NO: 3939903 - DNA, 16 bp, Homo sapiens
catctccccaggcctc

SEQ ID NO: 3939904 - DNA, 21 bp, Homo sapiens
catctccccaggcctccagcc

SEQ ID NO: 3939905 - DNA, 20 bp, Homo sapiens
catctcctcccatggccttc

SEQ ID NO: 3939906 - DNA, 15 bp, Homo sapiens
catctcctgatttct

SEQ ID NO: 3939907 - DNA, 15 bp, Homo sapiens
catctcgagccccct

SEQ ID NO: 3939908 - DNA, 13 bp, Homo sapiens
catctctctgggg

SEQ ID NO: 3939909 - DNA, 21 bp, Homo sapiens
catctctctggggccctgggc

SEQ ID NO: 3939910 - DNA, 23 bp, Homo sapiens
catctcttcctacccaaccactc

SEQ ID NO: 3939911 - DNA, 12 bp, Homo sapiens
catctgaaagcc

SEQ ID NO: 3939912 - DNA, 11 bp, Homo sapiens
catctgaggag

SEQ ID NO: 3939913 - DNA, 22 bp, Homo sapiens
catctgcttggttggctggcag

SEQ ID NO: 3939914 - DNA, 22 bp, Homo sapiens
catctgttaaatgagagaatag

SEQ ID NO: 3939915 - DNA, 20 bp, Homo sapiens
catctgttgttttgttttaa

SEQ ID NO: 3939916 - DNA, 20 bp, Homo sapiens
catcttatgctaactgtaga

SEQ ID NO: 3939917 - DNA, 21 bp, Homo sapiens
catcttatgctaactgtagat

SEQ ID NO: 3939918 - DNA, 15 bp, Homo sapiens
catcttcagctccca

SEQ ID NO: 3939919 - DNA, 18 bp, Homo sapiens
catcttcagctcccatag

SEQ ID NO: 3939920 - DNA, 16 bp, Homo sapiens
catcttcctgctgctg

SEQ ID NO: 3939921 - DNA, 14 bp, Homo sapiens
catcttctccatct

SEQ ID NO: 3939922 - DNA, 13 bp, Homo sapiens
catcttctggagt

SEQ ID NO: 3939923 - DNA, 19 bp, Homo sapiens
catcttctggagtctccag

SEQ ID NO: 3939924 - DNA, 14 bp, Homo sapiens
catcttctggcttg

SEQ ID NO: 3939925 - DNA, 17 bp, Homo sapiens
catcttgacatgtaatg

SEQ ID NO: 3939926 - DNA, 16 bp, Homo sapiens
catctttcttctattt

SEQ ID NO: 3939927 - DNA, 16 bp, Homo sapiens
catctttgaaaagaaa

SEQ ID NO: 3939928 - DNA, 18 bp, Homo sapiens
catctttgaaaagaaaaa

SEQ ID NO: 3939929 - DNA, 20 bp, Homo sapiens
catcttttaatatgctgtgg

SEQ ID NO: 3939930 - DNA, 20 bp, Homo sapiens
catgaaaaacacggcagctg

SEQ ID NO: 3939931 - DNA, 22 bp, Homo sapiens
catgaaaaccattacctgactt

SEQ ID NO: 3939932 - DNA, 13 bp, Homo sapiens
catgaaaagtgct

SEQ ID NO: 3939933 - DNA, 13 bp, Homo sapiens
catgaaacagaaa

SEQ ID NO: 3939934 - DNA, 15 bp, Homo sapiens
catgaaacagaaaca

SEQ ID NO: 3939935 - DNA, 19 bp, Homo sapiens
catgaaacagaaacaaaaa

SEQ ID NO: 3939936 - DNA, 19 bp, Homo sapiens
catgaaagagaaagactga

SEQ ID NO: 3939937 - DNA, 22 bp, Homo sapiens
catgaaatatagatcagttata

SEQ ID NO: 3939938 - DNA, 14 bp, Homo sapiens
catgaacacacatg

SEQ ID NO: 3939939 - DNA, 13 bp, Homo sapiens
catgaagaccaca

SEQ ID NO: 3939940 - DNA, 14 bp, Homo sapiens
catgaagagactct

SEQ ID NO: 3939941 - DNA, 15 bp, Homo sapiens
catgacaatgcaatg

SEQ ID NO: 3939942 - DNA, 15 bp, Homo sapiens
catgacactgacctt

SEQ ID NO: 3939943 - DNA, 15 bp, Homo sapiens
catgaccagcaaata

SEQ ID NO: 3939944 - DNA, 19 bp, Homo sapiens
catgaccagttctggccag

SEQ ID NO: 3939945 - DNA, 15 bp, Homo sapiens
catgacctccagctt

SEQ ID NO: 3939946 - DNA, 20 bp, Homo sapiens
catgacctccagctttcctg

SEQ ID NO: 3939947 - DNA, 22 bp, Homo sapiens
catgacctccagctttcctgta

SEQ ID NO: 3939948 - DNA, 20 bp, Homo sapiens
catgactcgtatatgtctca

SEQ ID NO: 3939949 - DNA, 21 bp, Homo sapiens
catgacttttccatgtatcta

SEQ ID NO: 3939950 - DNA, 12 bp, Homo sapiens
catgagaatcta

SEQ ID NO: 3939951 - DNA, 23 bp, Homo sapiens
catgagagaattgtatcatttga

SEQ ID NO: 3939952 - DNA, 13 bp, Homo sapiens
catgaggagggtg

SEQ ID NO: 3939953 - DNA, 15 bp, Homo sapiens
catgaggagggtgcc

SEQ ID NO: 3939954 - DNA, 18 bp, Homo sapiens
catgagggatcacagggc

SEQ ID NO: 3939955 - DNA, 19 bp, Homo sapiens
catgagggatcacagggcc

SEQ ID NO: 3939956 - DNA, 16 bp, Homo sapiens
catgagtggatggatg

SEQ ID NO: 3939957 - DNA, 19 bp, Homo sapiens
catgagtggatggatggac

SEQ ID NO: 3939958 - DNA, 22 bp, Homo sapiens
catgagtggatggatggacaga

SEQ ID NO: 3939959 - DNA, 13 bp, Homo sapiens
catgatcctgagt

SEQ ID NO: 3939960 - DNA, 20 bp, Homo sapiens
catgatcgagccactgcact

SEQ ID NO: 3939961 - DNA, 16 bp, Homo sapiens
catgatctccctgccg

SEQ ID NO: 3939962 - DNA, 19 bp, Homo sapiens
catgatctccctgccgcct

SEQ ID NO: 3939963 - DNA, 12 bp, Homo sapiens
catgatctgtat

SEQ ID NO: 3939964 - DNA, 19 bp, Homo sapiens
catgatgttaaccagaata

SEQ ID NO: 3939965 - DNA, 16 bp, Homo sapiens
catgatttacagagaa

SEQ ID NO: 3939966 - DNA, 16 bp, Homo sapiens
catgattttacagaga

SEQ ID NO: 3939967 - DNA, 17 bp, Homo sapiens
catgcaataatgtgcaa

SEQ ID NO: 3939968 - DNA, 19 bp, Homo sapiens
catgcaataatgtgcaaat

SEQ ID NO: 3939969 - DNA, 17 bp, Homo sapiens
catgcaattcatcccag

SEQ ID NO: 3939970 - DNA, 19 bp, Homo sapiens
catgcacacaaacacctcc

SEQ ID NO: 3939971 - DNA, 21 bp, Homo sapiens
catgcacagctgcttgtcctg

SEQ ID NO: 3939972 - DNA, 15 bp, Homo sapiens
catgcacatttatat

SEQ ID NO: 3939973 - DNA, 17 bp, Homo sapiens
catgcacatttatatat

SEQ ID NO: 3939974 - DNA, 14 bp, Homo sapiens
catgcactgaccct

SEQ ID NO: 3939975 - DNA, 18 bp, Homo sapiens
catgcactgacccttcca

SEQ ID NO: 3939976 - DNA, 19 bp, Homo sapiens
catgcactgacccttccag

SEQ ID NO: 3939977 - DNA, 20 bp, Homo sapiens
catgcactgacccttccaga

SEQ ID NO: 3939978 - DNA, 17 bp, Homo sapiens
catgcagcttcatcaat

SEQ ID NO: 3939979 - DNA, 13 bp, Homo sapiens
catttctctgctt

SEQ ID NO: 3939980 - DNA, 14 bp, Homo sapiens
catttctctgctta

SEQ ID NO: 3939981 - DNA, 16 bp, Homo sapiens
catttcttatgatttt

SEQ ID NO: 3939982 - DNA, 13 bp, Homo sapiens
catttgagtgtct

SEQ ID NO: 3939983 - DNA, 22 bp, Homo sapiens
catttgagttattttaattatc

SEQ ID NO: 3939984 - DNA, 15 bp, Homo sapiens
catttgataaactaa

SEQ ID NO: 3939985 - DNA, 16 bp, Homo sapiens
catttgatgtacatgt

SEQ ID NO: 3939986 - DNA, 16 bp, Homo sapiens
catttgccattcctgg

SEQ ID NO: 3939987 - DNA, 19 bp, Homo sapiens
catttgcctaattcctggc

SEQ ID NO: 3939988 - DNA, 20 bp, Homo sapiens
catttggtgcacttttctgt

SEQ ID NO: 3939989 - DNA, 20 bp, Homo sapiens
catttggtgctggtctattt

SEQ ID NO: 3939990 - DNA, 16 bp, Homo sapiens
catttgtgaaatgatg

SEQ ID NO: 3939991 - DNA, 19 bp, Homo sapiens
catttgttcatgagtggat

SEQ ID NO: 3939992 - DNA, 16 bp, Homo sapiens
cattttaaaagcaatt

SEQ ID NO: 3939993 - DNA, 20 bp, Homo sapiens
cattttaaaagcaattatat

SEQ ID NO: 3939994 - DNA, 19 bp, Homo sapiens
cattttaaaatctgattta

SEQ ID NO: 3939995 - DNA, 21 bp, Homo sapiens
cattttaatttatatttgaaa

SEQ ID NO: 3939996 - DNA, 12 bp, Homo sapiens
cattttactact

SEQ ID NO: 3939997 - DNA, 16 bp, Homo sapiens
cattttactacttgtt

SEQ ID NO: 3939998 - DNA, 14 bp, Homo sapiens
cattttagtgactg

SEQ ID NO: 3939999 - DNA, 18 bp, Homo sapiens
cattttagttcctttatt

SEQ ID NO: 3940000 - DNA, 22 bp, Homo sapiens
cattttatctttgaatggtctt

SEQ ID NO: 3940001 - DNA, 11 bp, Homo sapiens
cattttattac

SEQ ID NO: 3940002 - DNA, 19 bp, Homo sapiens
cattttatttaagaataaa

SEQ ID NO: 3940003 - DNA, 19 bp, Homo sapiens
cattttctttctttttctg

SEQ ID NO: 3940004 - DNA, 23 bp, Homo sapiens
catttttggtaggcttatcaaaa

SEQ ID NO: 3940005 - DNA, 16 bp, Homo sapiens
ccaaaacctttcccca

SEQ ID NO: 3940006 - DNA, 21 bp, Homo sapiens
ccaaaacgtgggtatttcctg

SEQ ID NO: 3940007 - DNA, 22 bp, Homo sapiens
ccaaaacgtgggtatttcctgc

SEQ ID NO: 3940008 - DNA, 19 bp, Homo sapiens
ccaaaagggcagccagggg

SEQ ID NO: 3940009 - DNA, 21 bp, Homo sapiens
ccaaaagtcaaaaggtgcctg

SEQ ID NO: 3940010 - DNA, 16 bp, Homo sapiens
ccaaacacactgtaaa

SEQ ID NO: 3940011 - DNA, 17 bp, Homo sapiens
ccaaacacactgtaaat

SEQ ID NO: 3940012 - DNA, 21 bp, Homo sapiens
ccaaacacagagcgggagtga

SEQ ID NO: 3940013 - DNA, 18 bp, Homo sapiens
ccaaacaccatgaatctt

SEQ ID NO: 3940014 - DNA, 14 bp, Homo sapiens
ccaaacaccggcag

SEQ ID NO: 3940015 - DNA, 13 bp, Homo sapiens
ccaaacactccac

SEQ ID NO: 3940016 - DNA, 13 bp, Homo sapiens
ccaaactacagaa

SEQ ID NO: 3940017 - DNA, 13 bp, Homo sapiens
ccaaactcctgcc

SEQ ID NO: 3940018 - DNA, 16 bp, Homo sapiens
ccaaactcctgcctgt

SEQ ID NO: 3940019 - DNA, 19 bp, Homo sapiens
ccaaactgcacacacagct

SEQ ID NO: 3940020 - DNA, 14 bp, Homo sapiens
ccaaagaacagcct

SEQ ID NO: 3940021 - DNA, 21 bp, Homo sapiens
ccaaagagactggagcatctg

SEQ ID NO: 3940022 - DNA, 21 bp, Homo sapiens
ccaaagctgttggtctgtccc

SEQ ID NO: 3940023 - DNA, 21 bp, Homo sapiens
ccaaagggaaaactcttcatt

SEQ ID NO: 3940024 - DNA, 14 bp, Homo sapiens
ccaaaggggctgct

SEQ ID NO: 3940025 - DNA, 20 bp, Homo sapiens
ccaaaggggctgctggggca

SEQ ID NO: 3940026 - DNA, 14 bp, Homo sapiens
ccaaagtgcagccc

SEQ ID NO: 3940027 - DNA, 20 bp, Homo sapiens
ccaaataaatgtgtaaatgt

SEQ ID NO: 3940028 - DNA, 22 bp, Homo sapiens
ccaaataaatgtgtaaatgtgg

SEQ ID NO: 3940029 - DNA, 18 bp, Homo sapiens
ccaaatgcacaagctcag

SEQ ID NO: 3940030 - DNA, 11 bp, Homo sapiens
ccaaattattt

SEQ ID NO: 3940031 - DNA, 14 bp, Homo sapiens
ccaaattatttgtg

SEQ ID NO: 3940032 - DNA, 22 bp, Homo sapiens
ccaaattgctcctaagcttcaa

SEQ ID NO: 3940033 - DNA, 16 bp, Homo sapiens
ccaaattggtgtttct

SEQ ID NO: 3940034 - DNA, 23 bp, Homo sapiens
ccaaatttcatacctatcatctt

SEQ ID NO: 3940035 - DNA, 18 bp, Homo sapiens
ccaacaaacctgcttgtc

SEQ ID NO: 3940036 - DNA, 17 bp, Homo sapiens
ccaacaacatccatgtc

SEQ ID NO: 3940037 - DNA, 16 bp, Homo sapiens
ccaacaataaagagct

SEQ ID NO: 3940038 - DNA, 17 bp, Homo sapiens
ccaacacaatctttcct

SEQ ID NO: 3940039 - DNA, 17 bp, Homo sapiens
ccaacagctcagagatg

SEQ ID NO: 3940040 - DNA, 18 bp, Homo sapiens
ccaacaggtggcaggacc

SEQ ID NO: 3940041 - DNA, 20 bp, Homo sapiens
ccaacagtgagtctgtcagc

SEQ ID NO: 3940042 - DNA, 20 bp, Homo sapiens
ccaacatcccattgccctgg

SEQ ID NO: 3940043 - DNA, 16 bp, Homo sapiens
ccaacatctccctccc

SEQ ID NO: 3940044 - DNA, 23 bp, Homo sapiens
ccaacatggagaaaccctgtctc

SEQ ID NO: 3940045 - DNA, 15 bp, Homo sapiens
ccaacatggtgaaac

SEQ ID NO: 3940046 - DNA, 21 bp, Homo sapiens
ccaacccaattcaggactggc

SEQ ID NO: 3940047 - DNA, 12 bp, Homo sapiens
ccaacccatcag

SEQ ID NO: 3940048 - DNA, 12 bp, Homo sapiens
ccaaccccagct

SEQ ID NO: 3940049 - DNA, 13 bp, Homo sapiens
ccaaccccagctg

SEQ ID NO: 3940050 - DNA, 14 bp, Homo sapiens
ccaaccccagctgg

SEQ ID NO: 3940051 - DNA, 16 bp, Homo sapiens
ccaaccccagctggcc

SEQ ID NO: 3940052 - DNA, 17 bp, Homo sapiens
ccaaccccagctggcct

SEQ ID NO: 3940053 - DNA, 19 bp, Homo sapiens
ccaacccccgacttcatcc

SEQ ID NO: 3940054 - DNA, 21 bp, Homo sapiens
ccaaccccgcggtgctctggc

SEQ ID NO: 3940055 - DNA, 20 bp, Homo sapiens
ccaacccgtggaggctgctc

SEQ ID NO: 3940056 - DNA, 15 bp, Homo sapiens
ccaacctcaatgccc

SEQ ID NO: 3940057 - DNA, 16 bp, Homo sapiens
ccaacctcaatgccct

SEQ ID NO: 3940058 - DNA, 14 bp, Homo sapiens
ccaacctcctgacc

SEQ ID NO: 3940059 - DNA, 22 bp, Homo sapiens
ccaacctgaccaacatggagaa

SEQ ID NO: 3940060 - DNA, 14 bp, Homo sapiens
ccaactcacctgag

SEQ ID NO: 3940061 - DNA, 14 bp, Homo sapiens
ccaactcctccttg

SEQ ID NO: 3940062 - DNA, 12 bp, Homo sapiens
ccaactccttcc

SEQ ID NO: 3940063 - DNA, 18 bp, Homo sapiens
ccaactgtgttcattaga

SEQ ID NO: 3940064 - DNA, 14 bp, Homo sapiens
ccaacttggctttc

SEQ ID NO: 3940065 - DNA, 13 bp, Homo sapiens
ccaactttctgta

SEQ ID NO: 3940066 - DNA, 16 bp, Homo sapiens
cccatgttgcatgcct

SEQ ID NO: 3940067 - DNA, 24 bp, Homo sapiens
cccatgtttaaactttgtgccttt

SEQ ID NO: 3940068 - DNA, 18 bp, Homo sapiens
cccattaggcatgcctaa

SEQ ID NO: 3940069 - DNA, 19 bp, Homo sapiens
cccattcgtctgtcccaga

SEQ ID NO: 3940070 - DNA, 21 bp, Homo sapiens
cccattctgcctccattctga

SEQ ID NO: 3940071 - DNA, 12 bp, Homo sapiens
cccattcttcct

SEQ ID NO: 3940072 - DNA, 21 bp, Homo sapiens
cccattcttcctagttttctc

SEQ ID NO: 3940073 - DNA, 17 bp, Homo sapiens
cccattttgaggccaga

SEQ ID NO: 3940074 - DNA, 22 bp, Homo sapiens
ccccaaactgtgccctgccttc

SEQ ID NO: 3940075 - DNA, 22 bp, Homo sapiens
ccccaaagagcctggagaagct

SEQ ID NO: 3940076 - DNA, 14 bp, Homo sapiens
ccccaaaggcatcc

SEQ ID NO: 3940077 - DNA, 21 bp, Homo sapiens
ccccaaccccgcggtgctctg

SEQ ID NO: 3940078 - DNA, 20 bp, Homo sapiens
ccccaacccgtggaggctgc

SEQ ID NO: 3940079 - DNA, 13 bp, Homo sapiens
ccccaactcctgg

SEQ ID NO: 3940080 - DNA, 14 bp, Homo sapiens
ccccaactcctgga

SEQ ID NO: 3940081 - DNA, 15 bp, Homo sapiens
ccccaactcctggaa

SEQ ID NO: 3940082 - DNA, 19 bp, Homo sapiens
ccccaagcagccagccagt

SEQ ID NO: 3940083 - DNA, 21 bp, Homo sapiens
ccccaagcctctgccccaagg

SEQ ID NO: 3940084 - DNA, 20 bp, Homo sapiens
ccccaagggacaaccccatc

SEQ ID NO: 3940085 - DNA, 16 bp, Homo sapiens
ccccaaggggcccaca

SEQ ID NO: 3940086 - DNA, 20 bp, Homo sapiens
ccccaaggttttggagtcag

SEQ ID NO: 3940087 - DNA, 22 bp, Homo sapiens
ccccaagtccacctgcctatcc

SEQ ID NO: 3940088 - DNA, 17 bp, Homo sapiens
ccccacacctccctact

SEQ ID NO: 3940089 - DNA, 20 bp, Homo sapiens
ccccacacgtgctcgcagcc

SEQ ID NO: 3940090 - DNA, 13 bp, Homo sapiens
ccccacagcaccc

SEQ ID NO: 3940091 - DNA, 15 bp, Homo sapiens
ccccacagcacccag

SEQ ID NO: 3940092 - DNA, 12 bp, Homo sapiens
ccccaccaccta

SEQ ID NO: 3940093 - DNA, 23 bp, Homo sapiens
ccccaccccctccccaggggaga

SEQ ID NO: 3940094 - DNA, 21 bp, Homo sapiens
ccccaccctcgtggacacctg

SEQ ID NO: 3940095 - DNA, 19 bp, Homo sapiens
ccccaccttgccaagcttt

SEQ ID NO: 3940096 - DNA, 20 bp, Homo sapiens
ccccacgagtcacctgcaag

SEQ ID NO: 3940097 - DNA, 14 bp, Homo sapiens
ccccactccagccc

SEQ ID NO: 3940098 - DNA, 16 bp, Homo sapiens
ccccactccagccctg

SEQ ID NO: 3940099 - DNA, 21 bp, Homo sapiens
ccccactctaggggtcaggct

SEQ ID NO: 3940100 - DNA, 20 bp, Homo sapiens
ccccactctcattccccagg

SEQ ID NO: 3940101 - DNA, 16 bp, Homo sapiens
ccccactctgctctga

SEQ ID NO: 3940102 - DNA, 17 bp, Homo sapiens
ccccactctgctctgat

SEQ ID NO: 3940103 - DNA, 18 bp, Homo sapiens
ccccactgcaggccccgc

SEQ ID NO: 3940104 - DNA, 19 bp, Homo sapiens
ccccagactcagctccaga

SEQ ID NO: 3940105 - DNA, 20 bp, Homo sapiens
ccccagagaccttttctctc

SEQ ID NO: 3940106 - DNA, 23 bp, Homo sapiens
ccccagagaccttttctctccca

SEQ ID NO: 3940107 - DNA, 15 bp, Homo sapiens
ccccagagccccact

SEQ ID NO: 3940108 - DNA, 22 bp, Homo sapiens
ccccagagtgtgggaagggaga

SEQ ID NO: 3940109 - DNA, 18 bp, Homo sapiens
ccccagatcaccagcccg

SEQ ID NO: 3940110 - DNA, 17 bp, Homo sapiens
ccccagatctgcctggg

SEQ ID NO: 3940111 - DNA, 18 bp, Homo sapiens
ccccagatctgcctgggc

SEQ ID NO: 3940112 - DNA, 19 bp, Homo sapiens
ccccagatctgcctgggcc

SEQ ID NO: 3940113 - DNA, 21 bp, Homo sapiens
ccccagatctgcctgggcctg

SEQ ID NO: 3940114 - DNA, 19 bp, Homo sapiens
ccccagccctggctctgca

SEQ ID NO: 3940115 - DNA, 14 bp, Homo sapiens
ccccagcccttctg

SEQ ID NO: 3940116 - DNA, 17 bp, Homo sapiens
ccccagcccttctgcct

SEQ ID NO: 3940117 - DNA, 11 bp, Homo sapiens
ccccagcctgg

SEQ ID NO: 3940118 - DNA, 12 bp, Homo sapiens
ccccagcctggg

SEQ ID NO: 3940119 - DNA, 16 bp, Homo sapiens
ccccagcctgggccta

SEQ ID NO: 3940120 - DNA, 12 bp, Homo sapiens
ccccagctggcc

SEQ ID NO: 3940121 - DNA, 15 bp, Homo sapiens
ccccagctggcctct

SEQ ID NO: 3940122 - DNA, 19 bp, Homo sapiens
ccccaggcatcccatccct

SEQ ID NO: 3940123 - DNA, 15 bp, Homo sapiens
ccccaggccaatgca

SEQ ID NO: 3940124 - DNA, 22 bp, Homo sapiens
ccccaggccaggccaccaggat

SEQ ID NO: 3940125 - DNA, 14 bp, Homo sapiens
ccccaggccctccc

SEQ ID NO: 3940126 - DNA, 15 bp, Homo sapiens
ccccaggcctccagc

SEQ ID NO: 3940127 - DNA, 17 bp, Homo sapiens
ccccaggcctctgtgtc

SEQ ID NO: 3940128 - DNA, 14 bp, Homo sapiens
ccccagggcacagg

SEQ ID NO: 3940129 - DNA, 16 bp, Homo sapiens
ccccagggcacaggag

SEQ ID NO: 3940130 - DNA, 22 bp, Homo sapiens
ccccagggcacaggagctacct

SEQ ID NO: 3940131 - DNA, 23 bp, Homo sapiens
ccccagggcacaggagctacctg

SEQ ID NO: 3940132 - DNA, 11 bp, Homo sapiens
ccccagggccc

SEQ ID NO: 3940133 - DNA, 13 bp, Homo sapiens
ccccagggcccct

SEQ ID NO: 3940134 - DNA, 14 bp, Homo sapiens
ccccagggcctggg

SEQ ID NO: 3940135 - DNA, 16 bp, Homo sapiens
ccccaggggaaaatga

SEQ ID NO: 3940136 - DNA, 18 bp, Homo sapiens
ccccaggggaaaatgaag

SEQ ID NO: 3940137 - DNA, 23 bp, Homo sapiens
ccccagggggcggggtgcagaag

SEQ ID NO: 3940138 - DNA, 20 bp, Homo sapiens
ccccaggggtgcctgtgggg

SEQ ID NO: 3940139 - DNA, 23 bp, Homo sapiens
ccccaggtcatgctgctgttgct

SEQ ID NO: 3940140 - DNA, 19 bp, Homo sapiens
ccccaggtgccaccaataa

SEQ ID NO: 3940141 - DNA, 20 bp, Homo sapiens
ccccaggtgccaccaataaa

SEQ ID NO: 3940142 - DNA, 21 bp, Homo sapiens
ccccaggtggctgacccagtc

SEQ ID NO: 3940143 - DNA, 22 bp, Homo sapiens
ccccaggttcagactgagctcc

SEQ ID NO: 3940144 - DNA, 21 bp, Homo sapiens
ccccagttctgctcctctcca

SEQ ID NO: 3940145 - DNA, 22 bp, Homo sapiens
ccccataattttttttttcctt

SEQ ID NO: 3940146 - DNA, 15 bp, Homo sapiens
ccccatcccctttcc

SEQ ID NO: 3940147 - DNA, 19 bp, Homo sapiens
ccccatctccccaggcctc

SEQ ID NO: 3940148 - DNA, 20 bp, Homo sapiens
ccccatctcctcccatggcc

SEQ ID NO: 3940149 - DNA, 21 bp, Homo sapiens
ccccatctcctcccatggcct

SEQ ID NO: 3940150 - DNA, 14 bp, Homo sapiens
ccccatctgggtcc

SEQ ID NO: 3940151 - DNA, 13 bp, Homo sapiens
ccccatgacctcc

SEQ ID NO: 3940152 - DNA, 14 bp, Homo sapiens
cccttcaaccattc

SEQ ID NO: 3940153 - DNA, 16 bp, Homo sapiens
cccttcacagtgtttc

SEQ ID NO: 3940154 - DNA, 13 bp, Homo sapiens
cccttcagtgccc

SEQ ID NO: 3940155 - DNA, 17 bp, Homo sapiens
cccttcagtgcccacca

SEQ ID NO: 3940156 - DNA, 18 bp, Homo sapiens
cccttccacctcctagag

SEQ ID NO: 3940157 - DNA, 20 bp, Homo sapiens
cccttccatgtcgcctctgc

SEQ ID NO: 3940158 - DNA, 20 bp, Homo sapiens
cccttcccaatcagcactga

SEQ ID NO: 3940159 - DNA, 18 bp, Homo sapiens
cccttcccatctcttcct

SEQ ID NO: 3940160 - DNA, 22 bp, Homo sapiens
cccttccccaagaaggtgagtg

SEQ ID NO: 3940161 - DNA, 20 bp, Homo sapiens
cccttcctacagatagtcaa

SEQ ID NO: 3940162 - DNA, 21 bp, Homo sapiens
cccttcctcctgaagcctctg

SEQ ID NO: 3940163 - DNA, 21 bp, Homo sapiens
cccttcctctccactgccttc

SEQ ID NO: 3940164 - DNA, 11 bp, Homo sapiens
cccttcctgga

SEQ ID NO: 3940165 - DNA, 13 bp, Homo sapiens
cccttcctggaca

SEQ ID NO: 3940166 - DNA, 16 bp, Homo sapiens
cccttcctggacagct

SEQ ID NO: 3940167 - DNA, 18 bp, Homo sapiens
cccttcctggacagctgt

SEQ ID NO: 3940168 - DNA, 19 bp, Homo sapiens
cccttcctggacagctgtg

SEQ ID NO: 3940169 - DNA, 20 bp, Homo sapiens
cccttcctggacagctgtgc

SEQ ID NO: 3940170 - DNA, 21 bp, Homo sapiens
cccttcctggcctcactggct

SEQ ID NO: 3940171 - DNA, 14 bp, Homo sapiens
cccttcctttcctc

SEQ ID NO: 3940172 - DNA, 21 bp, Homo sapiens
cccttcgctgccaggacacct

SEQ ID NO: 3940173 - DNA, 17 bp, Homo sapiens
cccttctctccttccct

SEQ ID NO: 3940174 - DNA, 12 bp, Homo sapiens
cccttctgctgt

SEQ ID NO: 3940175 - DNA, 12 bp, Homo sapiens
cccttcttccct

SEQ ID NO: 3940176 - DNA, 13 bp, Homo sapiens
cccttctttcctc

SEQ ID NO: 3940177 - DNA, 11 bp, Homo sapiens
cccttcttttt

SEQ ID NO: 3940178 - DNA, 13 bp, Homo sapiens
cccttgagacctc

SEQ ID NO: 3940179 - DNA, 18 bp, Homo sapiens
cccttgagacctcagcca

SEQ ID NO: 3940180 - DNA, 18 bp, Homo sapiens
cccttgcccccatccctc

SEQ ID NO: 3940181 - DNA, 16 bp, Homo sapiens
cccttgccctgacctc

SEQ ID NO: 3940182 - DNA, 16 bp, Homo sapiens
cccttgcccttgccct

SEQ ID NO: 3940183 - DNA, 22 bp, Homo sapiens
cccttgctcagtgcctcctggc

SEQ ID NO: 3940184 - DNA, 16 bp, Homo sapiens
cccttggacttgagga

SEQ ID NO: 3940185 - DNA, 14 bp, Homo sapiens
cccttggggcctgg

SEQ ID NO: 3940186 - DNA, 16 bp, Homo sapiens
cccttggggcctggct

SEQ ID NO: 3940187 - DNA, 19 bp, Homo sapiens
cccttggggcctggcttgc

SEQ ID NO: 3940188 - DNA, 20 bp, Homo sapiens
cccttggggttcccccagac

SEQ ID NO: 3940189 - DNA, 13 bp, Homo sapiens
ccctttccagtta

SEQ ID NO: 3940190 - DNA, 21 bp, Homo sapiens
ccctttcccatgatccagaac

SEQ ID NO: 3940191 - DNA, 12 bp, Homo sapiens
ccctttcctccc

SEQ ID NO: 3940192 - DNA, 14 bp, Homo sapiens
ccctttctcttctt

SEQ ID NO: 3940193 - DNA, 18 bp, Homo sapiens
ccctttctggaccagatc

SEQ ID NO: 3940194 - DNA, 12 bp, Homo sapiens
ccctttctgtgt

SEQ ID NO: 3940195 - DNA, 20 bp, Homo sapiens
ccctttgcaggcccagcaga

SEQ ID NO: 3940196 - DNA, 17 bp, Homo sapiens
cccttttgcctggctgt

SEQ ID NO: 3940197 - DNA, 19 bp, Homo sapiens
cccttttgcctggctgtgg

SEQ ID NO: 3940198 - DNA, 23 bp, Homo sapiens
ccgaacatcaccgacgcgtctcc

SEQ ID NO: 3940199 - DNA, 11 bp, Homo sapiens
ccgaagcccag

SEQ ID NO: 3940200 - DNA, 12 bp, Homo sapiens
ccgaagcccagt

SEQ ID NO: 3940201 - DNA, 16 bp, Homo sapiens
ccgacactgctgcacc

SEQ ID NO: 3940202 - DNA, 12 bp, Homo sapiens
ccgacagagaga

SEQ ID NO: 3940203 - DNA, 13 bp, Homo sapiens
ccgacagagagat

SEQ ID NO: 3940204 - DNA, 19 bp, Homo sapiens
ccgacctcgtcctccccct

SEQ ID NO: 3940205 - DNA, 15 bp, Homo sapiens
ccgactagcaggcat

SEQ ID NO: 3940206 - DNA, 16 bp, Homo sapiens
ccgagagtagccgaga

SEQ ID NO: 3940207 - DNA, 22 bp, Homo sapiens
ccgagagtagccgagagcctgc

SEQ ID NO: 3940208 - DNA, 17 bp, Homo sapiens
ccgagattgcgccactg

SEQ ID NO: 3940209 - DNA, 14 bp, Homo sapiens
ccgagcaaccgtgg

SEQ ID NO: 3940210 - DNA, 23 bp, Homo sapiens
ccgagcaaccgtggcccttcctg

SEQ ID NO: 3940211 - DNA, 15 bp, Homo sapiens
ccgagcagctgagca

SEQ ID NO: 3940212 - DNA, 16 bp, Homo sapiens
ccgagcagctgagcag

SEQ ID NO: 3940213 - DNA, 17 bp, Homo sapiens
ccgagcagctgagcagg

SEQ ID NO: 3940214 - DNA, 18 bp, Homo sapiens
ccgagcccagctacattc

SEQ ID NO: 3940215 - DNA, 20 bp, Homo sapiens
ccgagcccagctacattcct

SEQ ID NO: 3940216 - DNA, 19 bp, Homo sapiens
ccgagccgggcctggggct

SEQ ID NO: 3940217 - DNA, 19 bp, Homo sapiens
ccgagcgctttctggaaaa

SEQ ID NO: 3940218 - DNA, 16 bp, Homo sapiens
ccgagctactctcttg

SEQ ID NO: 3940219 - DNA, 22 bp, Homo sapiens
ccgagctactctcttgccagca

SEQ ID NO: 3940220 - DNA, 15 bp, Homo sapiens
ccgagggcctgacag

SEQ ID NO: 3940221 - DNA, 14 bp, Homo sapiens
ccgagtctcttctc

SEQ ID NO: 3940222 - DNA, 18 bp, Homo sapiens
ccgagtctcttctccact

SEQ ID NO: 3940223 - DNA, 19 bp, Homo sapiens
ccgagtctcttctccactg

SEQ ID NO: 3940224 - DNA, 20 bp, Homo sapiens
ccgagtctcttctccactgg

SEQ ID NO: 3940225 - DNA, 16 bp, Homo sapiens
ccgattaatttatggt

SEQ ID NO: 3940226 - DNA, 15 bp, Homo sapiens
ccgcaagcgcaggga

SEQ ID NO: 3940227 - DNA, 15 bp, Homo sapiens
ccgcaccagctgctc

SEQ ID NO: 3940228 - DNA, 11 bp, Homo sapiens
ccgcaccccag

SEQ ID NO: 3940229 - DNA, 19 bp, Homo sapiens
ccgcaccgggccctccttg

SEQ ID NO: 3940230 - DNA, 15 bp, Homo sapiens
ccgcagaaggaaggc

SEQ ID NO: 3940231 - DNA, 18 bp, Homo sapiens
ccgcagaaggaaggcagg

SEQ ID NO: 3940232 - DNA, 15 bp, Homo sapiens
ccgcagagcccacgc

SEQ ID NO: 3940233 - DNA, 21 bp, Homo sapiens
ccgcagccagccggtgcctgg

SEQ ID NO: 3940234 - DNA, 22 bp, Homo sapiens
ccgcagcccgtgaagcagtgcc

SEQ ID NO: 3940235 - DNA, 13 bp, Homo sapiens
ccgcagtccccag

SEQ ID NO: 3940236 - DNA, 15 bp, Homo sapiens
ccgcatcttctccat

SEQ ID NO: 3940237 - DNA, 22 bp, Homo sapiens
ccgcatcttctccatctggcag

SEQ ID NO: 3940238 - DNA, 13 bp, Homo sapiens
ccgcattccctga

SEQ ID NO: 3940239 - DNA, 18 bp, Homo sapiens
cctcagcccttgccccca

SEQ ID NO: 3940240 - DNA, 23 bp, Homo sapiens
cctcagccgactgcacagcggcc

SEQ ID NO: 3940241 - DNA, 15 bp, Homo sapiens
cctcagcctcccaga

SEQ ID NO: 3940242 - DNA, 16 bp, Homo sapiens
cctcagcctcccagag

SEQ ID NO: 3940243 - DNA, 16 bp, Homo sapiens
cctcagctcagcctcc

SEQ ID NO: 3940244 - DNA, 17 bp, Homo sapiens
cctcagctcagcctccc

SEQ ID NO: 3940245 - DNA, 17 bp, Homo sapiens
cctcagctgccaagcac

SEQ ID NO: 3940246 - DNA, 11 bp, Homo sapiens
cctcagggaca

SEQ ID NO: 3940247 - DNA, 19 bp, Homo sapiens
cctcaggtagtactgggaa

SEQ ID NO: 3940248 - DNA, 15 bp, Homo sapiens
cctcagtgccacttg

SEQ ID NO: 3940249 - DNA, 22 bp, Homo sapiens
cctcagtgccacttgacattcc

SEQ ID NO: 3940250 - DNA, 16 bp, Homo sapiens
cctcagttcaacctgg

SEQ ID NO: 3940251 - DNA, 22 bp, Homo sapiens
cctcagtttttcggtgggacag

SEQ ID NO: 3940252 - DNA, 18 bp, Homo sapiens
cctcatccaccaatctct

SEQ ID NO: 3940253 - DNA, 18 bp, Homo sapiens
cctcatcccctcgtcctg

SEQ ID NO: 3940254 - DNA, 18 bp, Homo sapiens
cctcatcttgccccctca

SEQ ID NO: 3940255 - DNA, 17 bp, Homo sapiens
cctcatgccacaccttc

SEQ ID NO: 3940256 - DNA, 20 bp, Homo sapiens
cctcatgccacaccttcttc

SEQ ID NO: 3940257 - DNA, 15 bp, Homo sapiens
cctcatgcctggccc

SEQ ID NO: 3940258 - DNA, 17 bp, Homo sapiens
cctcatgcctggccccc

SEQ ID NO: 3940259 - DNA, 23 bp, Homo sapiens
cctcatgcctggcccccctccag

SEQ ID NO: 3940260 - DNA, 17 bp, Homo sapiens
cctcatgtgtgctgtgc

SEQ ID NO: 3940261 - DNA, 15 bp, Homo sapiens
cctcattacccaggt

SEQ ID NO: 3940262 - DNA, 22 bp, Homo sapiens
cctcattcaggaaaactgacag

SEQ ID NO: 3940263 - DNA, 14 bp, Homo sapiens
cctcattcccctcg

SEQ ID NO: 3940264 - DNA, 16 bp, Homo sapiens
cctcatttatccctca

SEQ ID NO: 3940265 - DNA, 18 bp, Homo sapiens
cctccaaactcctgcctg

SEQ ID NO: 3940266 - DNA, 14 bp, Homo sapiens
cctccaaagcccca

SEQ ID NO: 3940267 - DNA, 16 bp, Homo sapiens
cctccaaagccccacc

SEQ ID NO: 3940268 - DNA, 21 bp, Homo sapiens
cctccacattaagtggctttt

SEQ ID NO: 3940269 - DNA, 18 bp, Homo sapiens
cctccacccccgccacgg

SEQ ID NO: 3940270 - DNA, 20 bp, Homo sapiens
cctccacccccgccacggcc

SEQ ID NO: 3940271 - DNA, 18 bp, Homo sapiens
cctccaccgcagaaggaa

SEQ ID NO: 3940272 - DNA, 23 bp, Homo sapiens
cctccacctcttcaccccccact

SEQ ID NO: 3940273 - DNA, 20 bp, Homo sapiens
cctccacgcctcctggccag

SEQ ID NO: 3940274 - DNA, 20 bp, Homo sapiens
cctccactcccccacctgac

SEQ ID NO: 3940275 - DNA, 20 bp, Homo sapiens
cctccagacccctgtggcag

SEQ ID NO: 3940276 - DNA, 15 bp, Homo sapiens
cctccagaccctgcc

SEQ ID NO: 3940277 - DNA, 14 bp, Homo sapiens
cctccagagccagc

SEQ ID NO: 3940278 - DNA, 22 bp, Homo sapiens
cctccagagccagcctgggact

SEQ ID NO: 3940279 - DNA, 12 bp, Homo sapiens
cctccagcctct

SEQ ID NO: 3940280 - DNA, 13 bp, Homo sapiens
cctccagcctctc

SEQ ID NO: 3940281 - DNA, 16 bp, Homo sapiens
cctccagcctctcccg

SEQ ID NO: 3940282 - DNA, 17 bp, Homo sapiens
cctccagctttcctgta

SEQ ID NO: 3940283 - DNA, 14 bp, Homo sapiens
cctccagggccacg

SEQ ID NO: 3940284 - DNA, 17 bp, Homo sapiens
cctccagggccacgtgc

SEQ ID NO: 3940285 - DNA, 18 bp, Homo sapiens
cctccagggccacgtgcc

SEQ ID NO: 3940286 - DNA, 20 bp, Homo sapiens
cctccatccggctcctgtca

SEQ ID NO: 3940287 - DNA, 13 bp, Homo sapiens
cctccatgggcta

SEQ ID NO: 3940288 - DNA, 17 bp, Homo sapiens
cctccatttcaactcca

SEQ ID NO: 3940289 - DNA, 19 bp, Homo sapiens
cctccatttcaactccaga

SEQ ID NO: 3940290 - DNA, 21 bp, Homo sapiens
cctcccaacctcaatgccctg

SEQ ID NO: 3940291 - DNA, 16 bp, Homo sapiens
cctcccaataaagctg

SEQ ID NO: 3940292 - DNA, 17 bp, Homo sapiens
cctcccaataaagctgg

SEQ ID NO: 3940293 - DNA, 17 bp, Homo sapiens
cctcccaccccactcca

SEQ ID NO: 3940294 - DNA, 20 bp, Homo sapiens
cctcccaccccactccagcc

SEQ ID NO: 3940295 - DNA, 16 bp, Homo sapiens
cctcccagccccaggg

SEQ ID NO: 3940296 - DNA, 14 bp, Homo sapiens
cctcccagccctgc

SEQ ID NO: 3940297 - DNA, 20 bp, Homo sapiens
cctcccagccctgccaggag

SEQ ID NO: 3940298 - DNA, 12 bp, Homo sapiens
cctcccatggcc

SEQ ID NO: 3940299 - DNA, 19 bp, Homo sapiens
cctcccatggccttccctc

SEQ ID NO: 3940300 - DNA, 23 bp, Homo sapiens
cctccccaaacccatcagacagg

SEQ ID NO: 3940301 - DNA, 14 bp, Homo sapiens
cctccccaccttcc

SEQ ID NO: 3940302 - DNA, 15 bp, Homo sapiens
cctccccaccttccc

SEQ ID NO: 3940303 - DNA, 16 bp, Homo sapiens
cctccccaccttcccc

SEQ ID NO: 3940304 - DNA, 23 bp, Homo sapiens
cctccccagtctacgttctccag

SEQ ID NO: 3940305 - DNA, 14 bp, Homo sapiens
cctccccccactgc

SEQ ID NO: 3940306 - DNA, 17 bp, Homo sapiens
cctccccccactgcagg

SEQ ID NO: 3940307 - DNA, 17 bp, Homo sapiens
cctccccctcttggtcc

SEQ ID NO: 3940308 - DNA, 13 bp, Homo sapiens
cctccccctgcca

SEQ ID NO: 3940309 - DNA, 22 bp, Homo sapiens
cctcccctatccacccagccca

SEQ ID NO: 3940310 - DNA, 15 bp, Homo sapiens
cctcccgggagcaca

SEQ ID NO: 3940311 - DNA, 13 bp, Homo sapiens
cctcccggtgccc

SEQ ID NO: 3940312 - DNA, 13 bp, Homo sapiens
cctccctacctga

SEQ ID NO: 3940313 - DNA, 24 bp, Homo sapiens
cctccctacctgaggcctatctga

SEQ ID NO: 3940314 - DNA, 15 bp, Homo sapiens
cctccctctgcccca

SEQ ID NO: 3940315 - DNA, 20 bp, Homo sapiens
cctccctcttccttccccca

SEQ ID NO: 3940316 - DNA, 20 bp, Homo sapiens
cctccctgaaccatccctga

SEQ ID NO: 3940317 - DNA, 18 bp, Homo sapiens
cctccctgactccctgtg

SEQ ID NO: 3940318 - DNA, 13 bp, Homo sapiens
cctccctgcccct

SEQ ID NO: 3940319 - DNA, 24 bp, Homo sapiens
cctccctgcccctcccttcaacca

SEQ ID NO: 3940320 - DNA, 19 bp, Homo sapiens
cctccctggcatgtcagag

SEQ ID NO: 3940321 - DNA, 16 bp, Homo sapiens
cctccctgtcctcctc

SEQ ID NO: 3940322 - DNA, 12 bp, Homo sapiens
cctcccttgctc

SEQ ID NO: 3940323 - DNA, 14 bp, Homo sapiens
cctccctttctggg

SEQ ID NO: 3940324 - DNA, 19 bp, Homo sapiens
cctccgtccacccaggctg

SEQ ID NO: 3940325 - DNA, 20 bp, Homo sapiens
cctccgtccacccaggctgc

SEQ ID NO: 3940326 - DNA, 20 bp, Homo sapiens
cctggaggacctgagcctgc

SEQ ID NO: 3940327 - DNA, 18 bp, Homo sapiens
cctggaggatccctccat

SEQ ID NO: 3940328 - DNA, 21 bp, Homo sapiens
cctggagggaatgaacctgga

SEQ ID NO: 3940329 - DNA, 21 bp, Homo sapiens
cctggagggctagaacctaga

SEQ ID NO: 3940330 - DNA, 18 bp, Homo sapiens
cctggagggctagaactg

SEQ ID NO: 3940331 - DNA, 15 bp, Homo sapiens
cctggaggtgggaga

SEQ ID NO: 3940332 - DNA, 23 bp, Homo sapiens
cctggagtcccgtccctgcccag

SEQ ID NO: 3940333 - DNA, 14 bp, Homo sapiens
cctggagtgcagtt

SEQ ID NO: 3940334 - DNA, 17 bp, Homo sapiens
cctggatcagaacagga

SEQ ID NO: 3940335 - DNA, 14 bp, Homo sapiens
cctggatcagcgtg

SEQ ID NO: 3940336 - DNA, 16 bp, Homo sapiens
cctggatcagcgtggc

SEQ ID NO: 3940337 - DNA, 19 bp, Homo sapiens
cctggatcagcgtggcctt

SEQ ID NO: 3940338 - DNA, 20 bp, Homo sapiens
cctggatcagcgtggccttg

SEQ ID NO: 3940339 - DNA, 17 bp, Homo sapiens
cctggatgggcattggg

SEQ ID NO: 3940340 - DNA, 15 bp, Homo sapiens
cctggatgtcccctg

SEQ ID NO: 3940341 - DNA, 23 bp, Homo sapiens
cctggatgtcccctgtcccacca

SEQ ID NO: 3940342 - DNA, 17 bp, Homo sapiens
cctggatgtgtggggca

SEQ ID NO: 3940343 - DNA, 21 bp, Homo sapiens
cctggatgtgtggggcatggt

SEQ ID NO: 3940344 - DNA, 14 bp, Homo sapiens
cctggatgttgctg

SEQ ID NO: 3940345 - DNA, 23 bp, Homo sapiens
cctggcaagctagaacctggagg

SEQ ID NO: 3940346 - DNA, 15 bp, Homo sapiens
cctggcacaggactg

SEQ ID NO: 3940347 - DNA, 16 bp, Homo sapiens
cctggcacaggactga

SEQ ID NO: 3940348 - DNA, 12 bp, Homo sapiens
cctggcagccgt

SEQ ID NO: 3940349 - DNA, 14 bp, Homo sapiens
cctggcatgtcaga

SEQ ID NO: 3940350 - DNA, 16 bp, Homo sapiens
cctggcatgtcagagc

SEQ ID NO: 3940351 - DNA, 12 bp, Homo sapiens
cctggccaggca

SEQ ID NO: 3940352 - DNA, 21 bp, Homo sapiens
cctggccattttcttgcctga

SEQ ID NO: 3940353 - DNA, 19 bp, Homo sapiens
cctggcccagagctggaac

SEQ ID NO: 3940354 - DNA, 24 bp, Homo sapiens
cctggcccatagaaacatgacact

SEQ ID NO: 3940355 - DNA, 12 bp, Homo sapiens
cctggccccatg

SEQ ID NO: 3940356 - DNA, 14 bp, Homo sapiens
cctggccccatgtc

SEQ ID NO: 3940357 - DNA, 18 bp, Homo sapiens
cctggccccatgtctctc

SEQ ID NO: 3940358 - DNA, 18 bp, Homo sapiens
cctggcccccctccaggc

SEQ ID NO: 3940359 - DNA, 19 bp, Homo sapiens
cctggcccccctccaggca

SEQ ID NO: 3940360 - DNA, 19 bp, Homo sapiens
cctggccccgggctctggc

SEQ ID NO: 3940361 - DNA, 14 bp, Homo sapiens
cctggcccctccag

SEQ ID NO: 3940362 - DNA, 23 bp, Homo sapiens
cctggccggcaaccccagttctg

SEQ ID NO: 3940363 - DNA, 20 bp, Homo sapiens
cctggccggcccaggcctcc

SEQ ID NO: 3940364 - DNA, 20 bp, Homo sapiens
cctggccggggcccctcacc

SEQ ID NO: 3940365 - DNA, 16 bp, Homo sapiens
cctggcctcaagcaat

SEQ ID NO: 3940366 - DNA, 15 bp, Homo sapiens
cctggcctcactggc

SEQ ID NO: 3940367 - DNA, 16 bp, Homo sapiens
cctggcctcactggct

SEQ ID NO: 3940368 - DNA, 13 bp, Homo sapiens
cctggcctcctgc

SEQ ID NO: 3940369 - DNA, 16 bp, Homo sapiens
cctggcctcctgcctc

SEQ ID NO: 3940370 - DNA, 21 bp, Homo sapiens
cctggcctcctgcctctactg

SEQ ID NO: 3940371 - DNA, 22 bp, Homo sapiens
cctggcctgagctggggccaca

SEQ ID NO: 3940372 - DNA, 15 bp, Homo sapiens
cctggcctgctggga

SEQ ID NO: 3940373 - DNA, 11 bp, Homo sapiens
cctggccttca

SEQ ID NO: 3940374 - DNA, 22 bp, Homo sapiens
cctggccttgtcaggacccagg

SEQ ID NO: 3940375 - DNA, 19 bp, Homo sapiens
cctggcgcccctgcccccc

SEQ ID NO: 3940376 - DNA, 13 bp, Homo sapiens
cctggcggggcag

SEQ ID NO: 3940377 - DNA, 16 bp, Homo sapiens
cctggctccccacgag

SEQ ID NO: 3940378 - DNA, 18 bp, Homo sapiens
cctggctccccacgagtc

SEQ ID NO: 3940379 - DNA, 21 bp, Homo sapiens
cctggctccgtccaggagcct

SEQ ID NO: 3940380 - DNA, 23 bp, Homo sapiens
cctggctgaccccaaagagcctg

SEQ ID NO: 3940381 - DNA, 14 bp, Homo sapiens
cctggctgccaggc

SEQ ID NO: 3940382 - DNA, 17 bp, Homo sapiens
cctggctgctctcatgc

SEQ ID NO: 3940383 - DNA, 19 bp, Homo sapiens
cctggctgctctcatgcct

SEQ ID NO: 3940384 - DNA, 17 bp, Homo sapiens
cctggctgtggaggcct

SEQ ID NO: 3940385 - DNA, 23 bp, Homo sapiens
cctggctgtggaggcctgatgct

SEQ ID NO: 3940386 - DNA, 15 bp, Homo sapiens
cctggcttcccatcc

SEQ ID NO: 3940387 - DNA, 19 bp, Homo sapiens
cctggcttcccatccccag

SEQ ID NO: 3940388 - DNA, 21 bp, Homo sapiens
cctggcttcccatccccagcg

SEQ ID NO: 3940389 - DNA, 22 bp, Homo sapiens
cctggcttcccatccccagcga

SEQ ID NO: 3940390 - DNA, 14 bp, Homo sapiens
cctggcttgctcca

SEQ ID NO: 3940391 - DNA, 17 bp, Homo sapiens
cctggcttgctccaggg

SEQ ID NO: 3940392 - DNA, 19 bp, Homo sapiens
cctggcttgcttgccgagc

SEQ ID NO: 3940393 - DNA, 20 bp, Homo sapiens
cctggcttgtaactccacca

SEQ ID NO: 3940394 - DNA, 22 bp, Homo sapiens
cctggcttgtaactccaccaac

SEQ ID NO: 3940395 - DNA, 16 bp, Homo sapiens
cctggcttttcactgc

SEQ ID NO: 3940396 - DNA, 14 bp, Homo sapiens
cctgggaaaacaga

SEQ ID NO: 3940397 - DNA, 22 bp, Homo sapiens
cctgggaaaggaaaaccaggga

SEQ ID NO: 3940398 - DNA, 15 bp, Homo sapiens
cctgggaaaggaccc

SEQ ID NO: 3940399 - DNA, 16 bp, Homo sapiens
cctgggaaaggaccca

SEQ ID NO: 3940400 - DNA, 21 bp, Homo sapiens
cctgggaaaggacccacccat

SEQ ID NO: 3940401 - DNA, 12 bp, Homo sapiens
cctgggaagggg

SEQ ID NO: 3940402 - DNA, 23 bp, Homo sapiens
cctgggacccagctactctgtcc

SEQ ID NO: 3940403 - DNA, 23 bp, Homo sapiens
cctgggaccgctacaccactctg

SEQ ID NO: 3940404 - DNA, 15 bp, Homo sapiens
cctgggactcccagt

SEQ ID NO: 3940405 - DNA, 17 bp, Homo sapiens
cctgggactcccagtga

SEQ ID NO: 3940406 - DNA, 18 bp, Homo sapiens
cctgggactcccagtgaa

SEQ ID NO: 3940407 - DNA, 16 bp, Homo sapiens
cctgggaggcggagag

SEQ ID NO: 3940408 - DNA, 16 bp, Homo sapiens
cctgggatgggaccag

SEQ ID NO: 3940409 - DNA, 18 bp, Homo sapiens
cctgggatgggaccaggg

SEQ ID NO: 3940410 - DNA, 23 bp, Homo sapiens
cctgggattcaggaaaaggcctg

SEQ ID NO: 3940411 - DNA, 18 bp, Homo sapiens
cctgggcatcttctggct

SEQ ID NO: 3940412 - DNA, 19 bp, Homo sapiens
ccttgggcatccacccagt

SEQ ID NO: 3940413 - DNA, 22 bp, Homo sapiens
ccttgggcatccacccagtgct

SEQ ID NO: 3940414 - DNA, 14 bp, Homo sapiens
ccttgggctcctgg

SEQ ID NO: 3940415 - DNA, 19 bp, Homo sapiens
ccttgggctcctggctgcc

SEQ ID NO: 3940416 - DNA, 22 bp, Homo sapiens
ccttggggcctggcttgctcca

SEQ ID NO: 3940417 - DNA, 16 bp, Homo sapiens
ccttggtctgctggtg

SEQ ID NO: 3940418 - DNA, 15 bp, Homo sapiens
ccttggtgtccacct

SEQ ID NO: 3940419 - DNA, 20 bp, Homo sapiens
ccttggtgtccacctggccc

SEQ ID NO: 3940420 - DNA, 21 bp, Homo sapiens
ccttggtgtccacctggcccc

SEQ ID NO: 3940421 - DNA, 13 bp, Homo sapiens
ccttgtaccccat

SEQ ID NO: 3940422 - DNA, 14 bp, Homo sapiens
ccttgtaccccatc

SEQ ID NO: 3940423 - DNA, 16 bp, Homo sapiens
ccttgtaccccatccc

SEQ ID NO: 3940424 - DNA, 20 bp, Homo sapiens
ccttgtcaccagcaacatct

SEQ ID NO: 3940425 - DNA, 18 bp, Homo sapiens
ccttgtcaggacccaggc

SEQ ID NO: 3940426 - DNA, 19 bp, Homo sapiens
ccttgtcaggacccaggcc

SEQ ID NO: 3940427 - DNA, 20 bp, Homo sapiens
ccttgtcaggacccaggccg

SEQ ID NO: 3940428 - DNA, 15 bp, Homo sapiens
ccttgtcctgccagc

SEQ ID NO: 3940429 - DNA, 16 bp, Homo sapiens
ccttgtcctgccagct

SEQ ID NO: 3940430 - DNA, 21 bp, Homo sapiens
ccttgtgcttggtggggctcg

SEQ ID NO: 3940431 - DNA, 13 bp, Homo sapiens
ccttgtgtttctg

SEQ ID NO: 3940432 - DNA, 11 bp, Homo sapiens
ccttgttctgt

SEQ ID NO: 3940433 - DNA, 19 bp, Homo sapiens
ccttgtttggggcaggagt

SEQ ID NO: 3940434 - DNA, 15 bp, Homo sapiens
cctttaaagacttaa

SEQ ID NO: 3940435 - DNA, 15 bp, Homo sapiens
cctttaagtcctctc

SEQ ID NO: 3940436 - DNA, 17 bp, Homo sapiens
cctttaagtttagaaat

SEQ ID NO: 3940437 - DNA, 16 bp, Homo sapiens
cctttacctaccacct

SEQ ID NO: 3940438 - DNA, 17 bp, Homo sapiens
cctttacctaccacctt

SEQ ID NO: 3940439 - DNA, 18 bp, Homo sapiens
cctttaggcagcctgccg

SEQ ID NO: 3940440 - DNA, 16 bp, Homo sapiens
cctttaggtctggttg

SEQ ID NO: 3940441 - DNA, 21 bp, Homo sapiens
cctttcacaaaattttattcc

SEQ ID NO: 3940442 - DNA, 12 bp, Homo sapiens
cctttcagctgt

SEQ ID NO: 3940443 - DNA, 17 bp, Homo sapiens
cctttcatccccacctt

SEQ ID NO: 3940444 - DNA, 17 bp, Homo sapiens
cctttcccatgatccag

SEQ ID NO: 3940445 - DNA, 18 bp, Homo sapiens
cctttcccatgatccaga

SEQ ID NO: 3940446 - DNA, 20 bp, Homo sapiens
cctttcccatgatccagaac

SEQ ID NO: 3940447 - DNA, 14 bp, Homo sapiens
cctttcccatgctg

SEQ ID NO: 3940448 - DNA, 16 bp, Homo sapiens
cctttcccatgctgaa

SEQ ID NO: 3940449 - DNA, 17 bp, Homo sapiens
cctttcccatgctgaat

SEQ ID NO: 3940450 - DNA, 16 bp, Homo sapiens
cctttccccagacaca

SEQ ID NO: 3940451 - DNA, 12 bp, Homo sapiens
cctttcctctga

SEQ ID NO: 3940452 - DNA, 14 bp, Homo sapiens
cctttcctctgcag

SEQ ID NO: 3940453 - DNA, 21 bp, Homo sapiens
cctttcctctgcagcacttta

SEQ ID NO: 3940454 - DNA, 17 bp, Homo sapiens
cctttcctgtgccaacc

SEQ ID NO: 3940455 - DNA, 20 bp, Homo sapiens
cctttcctgtgccaacctga

SEQ ID NO: 3940456 - DNA, 22 bp, Homo sapiens
cctttctccagccagcaatgat

SEQ ID NO: 3940457 - DNA, 22 bp, Homo sapiens
cctttgaaattcccccacttgg

SEQ ID NO: 3940458 - DNA, 15 bp, Homo sapiens
cctttgagaaagaaa

SEQ ID NO: 3940459 - DNA, 16 bp, Homo sapiens
cctttgagaaagaaat

SEQ ID NO: 3940460 - DNA, 16 bp, Homo sapiens
cctttgcactgagggc

SEQ ID NO: 3940461 - DNA, 18 bp, Homo sapiens
cctttgcactgagggcca

SEQ ID NO: 3940462 - DNA, 19 bp, Homo sapiens
cctttgcactgagggccac

SEQ ID NO: 3940463 - DNA, 15 bp, Homo sapiens
cctttgccctgtcac

SEQ ID NO: 3940464 - DNA, 13 bp, Homo sapiens
cctttggaaaaat

SEQ ID NO: 3940465 - DNA, 18 bp, Homo sapiens
cctttggaaaaatcttgg

SEQ ID NO: 3940466 - DNA, 17 bp, Homo sapiens
cctttggaagaaacagg

SEQ ID NO: 3940467 - DNA, 16 bp, Homo sapiens
cctttggatgaccaga

SEQ ID NO: 3940468 - DNA, 15 bp, Homo sapiens
cctttgggtactact

SEQ ID NO: 3940469 - DNA, 23 bp, Homo sapiens
cctttgtcatcattgtatatatg

SEQ ID NO: 3940470 - DNA, 19 bp, Homo sapiens
cctttgttttgcactgaca

SEQ ID NO: 3940471 - DNA, 15 bp, Homo sapiens
ccttttcactacacc

SEQ ID NO: 3940472 - DNA, 15 bp, Homo sapiens
ccttttcttccttct

SEQ ID NO: 3940473 - DNA, 23 bp, Homo sapiens
ccttttgaagtagtttgtataac

SEQ ID NO: 3940474 - DNA, 17 bp, Homo sapiens
ccttttgatggggagaa

SEQ ID NO: 3940475 - DNA, 18 bp, Homo sapiens
ccttttgcataagattaa

SEQ ID NO: 3940476 - DNA, 15 bp, Homo sapiens
ccttttgtccccagg

SEQ ID NO: 3940477 - DNA, 21 bp, Homo sapiens
cctttttccccaaagtcttaa

SEQ ID NO: 3940478 - DNA, 14 bp, Homo sapiens
cctttttctacctt

SEQ ID NO: 3940479 - DNA, 20 bp, Homo sapiens
cctttttctttataaacttt

SEQ ID NO: 3940480 - DNA, 14 bp, Homo sapiens
cctttttgactttt

SEQ ID NO: 3940481 - DNA, 13 bp, Homo sapiens
ccttttttaaaag

SEQ ID NO: 3940482 - DNA, 15 bp, Homo sapiens
ccttttttcacagcc

SEQ ID NO: 3940483 - DNA, 10 bp, Homo sapiens
cgaaagctga

SEQ ID NO: 3940484 - DNA, 17 bp, Homo sapiens
cgaaccaaggcagcctc

SEQ ID NO: 3940485 - DNA, 22 bp, Homo sapiens
cgaaccaaggcagcctccagag

SEQ ID NO: 3940486 - DNA, 14 bp, Homo sapiens
cgaacccacctgct

SEQ ID NO: 3940487 - DNA, 16 bp, Homo sapiens
cgaacccacctgctga

SEQ ID NO: 3940488 - DNA, 23 bp, Homo sapiens
cgaacccacctgctgagagaccc

SEQ ID NO: 3940489 - DNA, 13 bp, Homo sapiens
cgaagacacagac

SEQ ID NO: 3940490 - DNA, 23 bp, Homo sapiens
cgaagagggaatggatggggaga

SEQ ID NO: 3940491 - DNA, 20 bp, Homo sapiens
cgaagccatctttctttgga

SEQ ID NO: 3940492 - DNA, 21 bp, Homo sapiens
cgaaggggccccggggctggc

SEQ ID NO: 3940493 - DNA, 12 bp, Homo sapiens
cgaataaatgtt

SEQ ID NO: 3940494 - DNA, 14 bp, Homo sapiens
cgaatcagactcat

SEQ ID NO: 3940495 - DNA, 23 bp, Homo sapiens
cgaatggggcgatcaagtccaga

SEQ ID NO: 3940496 - DNA, 16 bp, Homo sapiens
cgaattaatagctttt

SEQ ID NO: 3940497 - DNA, 16 bp, Homo sapiens
cgacactgctgcacca

SEQ ID NO: 3940498 - DNA, 21 bp, Homo sapiens
cgacactgctgcaccagagtg

SEQ ID NO: 3940499 - DNA, 12 bp, Homo sapiens
cgcattgtacac

SEQ ID NO: 3940500 - DNA, 14 bp, Homo sapiens
cgccaacagccccc

SEQ ID NO: 3940501 - DNA, 13 bp, Homo sapiens
cgccaccatcctg

SEQ ID NO: 3940502 - DNA, 13 bp, Homo sapiens
cgccacggccacc

SEQ ID NO: 3940503 - DNA, 14 bp, Homo sapiens
cgccacggccaccc

SEQ ID NO: 3940504 - DNA, 16 bp, Homo sapiens
cgccacggccaccctc

SEQ ID NO: 3940505 - DNA, 16 bp, Homo sapiens
cgccacggggaggggg

SEQ ID NO: 3940506 - DNA, 18 bp, Homo sapiens
cgccactgagacggcaga

SEQ ID NO: 3940507 - DNA, 20 bp, Homo sapiens
cgccactgcactccggcctg

SEQ ID NO: 3940508 - DNA, 18 bp, Homo sapiens
cgccaggaggtcctcctc

SEQ ID NO: 3940509 - DNA, 20 bp, Homo sapiens
cgccatccgggacgcttcca

SEQ ID NO: 3940510 - DNA, 22 bp, Homo sapiens
cgccatccgggacgcttccaga

SEQ ID NO: 3940511 - DNA, 13 bp, Homo sapiens
cgcccaaggctgc

SEQ ID NO: 3940512 - DNA, 15 bp, Homo sapiens
cgcccaaggctgcag

SEQ ID NO: 3940513 - DNA, 15 bp, Homo sapiens
cgcccacaaactgat

SEQ ID NO: 3940514 - DNA, 21 bp, Homo sapiens
cgcccacctagtgcttccact

SEQ ID NO: 3940515 - DNA, 21 bp, Homo sapiens
cgccccaacccgtggaggctg

SEQ ID NO: 3940516 - DNA, 22 bp, Homo sapiens
cgccccaacccgtggaggctgc

SEQ ID NO: 3940517 - DNA, 12 bp, Homo sapiens
cgccccccacct

SEQ ID NO: 3940518 - DNA, 17 bp, Homo sapiens
cgcccgactagcaggca

SEQ ID NO: 3940519 - DNA, 21 bp, Homo sapiens
cgcccgactagcaggcatgcc

SEQ ID NO: 3940520 - DNA, 12 bp, Homo sapiens
cgccctgcagac

SEQ ID NO: 3940521 - DNA, 15 bp, Homo sapiens
cgccctgcagaccct

SEQ ID NO: 3940522 - DNA, 12 bp, Homo sapiens
cgccctgggctg

SEQ ID NO: 3940523 - DNA, 18 bp, Homo sapiens
cgccctgggctgtctgtc

SEQ ID NO: 3940524 - DNA, 19 bp, Homo sapiens
cgccctgggctgtctgtca

SEQ ID NO: 3940525 - DNA, 22 bp, Homo sapiens
cgccgtgttactgttgcactga

SEQ ID NO: 3940526 - DNA, 15 bp, Homo sapiens
cgcctaggcctgtga

SEQ ID NO: 3940527 - DNA, 11 bp, Homo sapiens
cgcctcccagc

SEQ ID NO: 3940528 - DNA, 22 bp, Homo sapiens
cgcctcctggccagacgctgcc

SEQ ID NO: 3940529 - DNA, 13 bp, Homo sapiens
cgcctctgcattc

SEQ ID NO: 3940530 - DNA, 20 bp, Homo sapiens
cgcctctgcccgcagagccc

SEQ ID NO: 3940531 - DNA, 19 bp, Homo sapiens
cgcctcttcttcttcagaa

SEQ ID NO: 3940532 - DNA, 16 bp, Homo sapiens
cgcctgagcccaggga

SEQ ID NO: 3940533 - DNA, 18 bp, Homo sapiens
cgcctgagcccagggagg

SEQ ID NO: 3940534 - DNA, 14 bp, Homo sapiens
cgcctgggcccagg

SEQ ID NO: 3940535 - DNA, 15 bp, Homo sapiens
cgcctgggcccaggc

SEQ ID NO: 3940536 - DNA, 18 bp, Homo sapiens
cgcctgtaatcccagcag

SEQ ID NO: 3940537 - DNA, 15 bp, Homo sapiens
cgcctgtcctgcctc

SEQ ID NO: 3940538 - DNA, 18 bp, Homo sapiens
cgcctgtgctgaggactc

SEQ ID NO: 3940539 - DNA, 13 bp, Homo sapiens
cgccttcctcctc

SEQ ID NO: 3940540 - DNA, 17 bp, Homo sapiens
cgccttcctcctccaca

SEQ ID NO: 3940541 - DNA, 18 bp, Homo sapiens
cgccttcctcctccacag

SEQ ID NO: 3940542 - DNA, 12 bp, Homo sapiens
cgcgcatctctt

SEQ ID NO: 3940543 - DNA, 15 bp, Homo sapiens
cgcggcttggccgcc

SEQ ID NO: 3940544 - DNA, 14 bp, Homo sapiens
cgcggtgctctggc

SEQ ID NO: 3940545 - DNA, 16 bp, Homo sapiens
cgcggtggctcacacc

SEQ ID NO: 3940546 - DNA, 12 bp, Homo sapiens
cgcgtagagagc

SEQ ID NO: 3940547 - DNA, 16 bp, Homo sapiens
cgcgtctaccctggga

SEQ ID NO: 3940548 - DNA, 13 bp, Homo sapiens
cgcgtctgcccca

SEQ ID NO: 3940549 - DNA, 20 bp, Homo sapiens
cgctaggagagactgaaagc

SEQ ID NO: 3940550 - DNA, 13 bp, Homo sapiens
cgctcaggaccca

SEQ ID NO: 3940551 - DNA, 19 bp, Homo sapiens
cgctcaggacccaggccct

SEQ ID NO: 3940552 - DNA, 20 bp, Homo sapiens
cgctcaggacccaggccctc

SEQ ID NO: 3940553 - DNA, 13 bp, Homo sapiens
cgctcatctggct

SEQ ID NO: 3940554 - DNA, 18 bp, Homo sapiens
cgctcattttaggcctcc

SEQ ID NO: 3940555 - DNA, 22 bp, Homo sapiens
cgctcattttaggcctcctctc

SEQ ID NO: 3940556 - DNA, 22 bp, Homo sapiens
cgctcccccgcagtccccagcc

SEQ ID NO: 3940557 - DNA, 20 bp, Homo sapiens
cgctccctgtagctctgcct

SEQ ID NO: 3940558 - DNA, 14 bp, Homo sapiens
cgctctcttccaga

SEQ ID NO: 3940559 - DNA, 20 bp, Homo sapiens
cgctctgctggcctggccgg

SEQ ID NO: 3940560 - DNA, 21 bp, Homo sapiens
cgctcttggcaggtactcagc

SEQ ID NO: 3940561 - DNA, 22 bp, Homo sapiens
cgctgcaggtacttcctcctga

SEQ ID NO: 3940562 - DNA, 20 bp, Homo sapiens
cgctgccaccacgtctgcca

SEQ ID NO: 3940563 - DNA, 13 bp, Homo sapiens
cgctgccgcaccc

SEQ ID NO: 3940564 - DNA, 18 bp, Homo sapiens
cgctgccgcaccccagag

SEQ ID NO: 3940565 - DNA, 16 bp, Homo sapiens
cgctgccgctgcacca

SEQ ID NO: 3940566 - DNA, 16 bp, Homo sapiens
cgctgctagagaaggg

SEQ ID NO: 3940567 - DNA, 14 bp, Homo sapiens
cgctgctctagctg

SEQ ID NO: 3940568 - DNA, 17 bp, Homo sapiens
cgctgctctagctggca

SEQ ID NO: 3940569 - DNA, 21 bp, Homo sapiens
cgctggaatcaatttcccaga

SEQ ID NO: 3940570 - DNA, 17 bp, Homo sapiens
cgctggacaacccagaa

SEQ ID NO: 3940571 - DNA, 12 bp, Homo sapiens
cgctggctcagg

SEQ ID NO: 3940572 - DNA, 14 bp, Homo sapiens
cgctggctcaggaa

SEQ ID NO: 3940573 - DNA, 21 bp, Homo sapiens
cgctggggaacagagcgggcc

SEQ ID NO: 3940574 - DNA, 20 bp, Homo sapiens
cgctgtgaaaatgaggagga

SEQ ID NO: 3940575 - DNA, 21 bp, Homo sapiens
cgctgtgaaaatgaggaggat

SEQ ID NO: 3940576 - DNA, 19 bp, Homo sapiens
cgctgtgagcccctggtcc

SEQ ID NO: 3940577 - DNA, 14 bp, Homo sapiens
cgcttcacccctgc

SEQ ID NO: 3940578 - DNA, 16 bp, Homo sapiens
cgcttcacccctgcac

SEQ ID NO: 3940579 - DNA, 17 bp, Homo sapiens
cgcttcacccctgcact

SEQ ID NO: 3940580 - DNA, 16 bp, Homo sapiens
cgcttccagaccacct

SEQ ID NO: 3940581 - DNA, 13 bp, Homo sapiens
cgcttgagcccag

SEQ ID NO: 3940582 - DNA, 15 bp, Homo sapiens
cgcttgagcccagga

SEQ ID NO: 3940583 - DNA, 16 bp, Homo sapiens
cgcttgagcccaggag

SEQ ID NO: 3940584 - DNA, 22 bp, Homo sapiens
cgctttctggaaaagaggagtt

SEQ ID NO: 3940585 - DNA, 18 bp, Homo sapiens
cggaaaccttgcagcatt

SEQ ID NO: 3940586 - DNA, 20 bp, Homo sapiens
cgggaggctgagacaggaga

SEQ ID NO: 3940587 - DNA, 17 bp, Homo sapiens
cgggaggctgaggcagg

SEQ ID NO: 3940588 - DNA, 22 bp, Homo sapiens
cgggagtgacgggagcctcctc

SEQ ID NO: 3940589 - DNA, 18 bp, Homo sapiens
cgggccactccttcctgc

SEQ ID NO: 3940590 - DNA, 20 bp, Homo sapiens
cgggccactccttcctgccc

SEQ ID NO: 3940591 - DNA, 20 bp, Homo sapiens
cgggccatgctttccttttc

SEQ ID NO: 3940592 - DNA, 14 bp, Homo sapiens
cgggcctcagtttc

SEQ ID NO: 3940593 - DNA, 16 bp, Homo sapiens
cgggcctcttccctca

SEQ ID NO: 3940594 - DNA, 13 bp, Homo sapiens
cgggcggaggcgg

SEQ ID NO: 3940595 - DNA, 15 bp, Homo sapiens
cgggctctggccacc

SEQ ID NO: 3940596 - DNA, 17 bp, Homo sapiens
cgggctctggccaccct

SEQ ID NO: 3940597 - DNA, 18 bp, Homo sapiens
cgggctctggccaccctg

SEQ ID NO: 3940598 - DNA, 23 bp, Homo sapiens
cgggctctggccaccctggcccg

SEQ ID NO: 3940599 - DNA, 19 bp, Homo sapiens
cgggctgcccttcgctgcc

SEQ ID NO: 3940600 - DNA, 21 bp, Homo sapiens
cgggctgcccttcgctgccag

SEQ ID NO: 3940601 - DNA, 15 bp, Homo sapiens
cggggaaacctatca

SEQ ID NO: 3940602 - DNA, 14 bp, Homo sapiens
cggggaactcctgg

SEQ ID NO: 3940603 - DNA, 16 bp, Homo sapiens
cggggaactcctggaa

SEQ ID NO: 3940604 - DNA, 22 bp, Homo sapiens
cggggaactggccaagctgagg

SEQ ID NO: 3940605 - DNA, 16 bp, Homo sapiens
cggggcaaggtctcct

SEQ ID NO: 3940606 - DNA, 14 bp, Homo sapiens
cggggcaggaggcc

SEQ ID NO: 3940607 - DNA, 15 bp, Homo sapiens
cggggcaggaggcct

SEQ ID NO: 3940608 - DNA, 18 bp, Homo sapiens
cggggcaggaggcctggc

SEQ ID NO: 3940609 - DNA, 21 bp, Homo sapiens
cggggcaggaggcctggcctt

SEQ ID NO: 3940610 - DNA, 19 bp, Homo sapiens
cggggcccttggggcctgg

SEQ ID NO: 3940611 - DNA, 20 bp, Homo sapiens
cggggcccttggggcctggc

SEQ ID NO: 3940612 - DNA, 11 bp, Homo sapiens
cggggctggca

SEQ ID NO: 3940613 - DNA, 19 bp, Homo sapiens
cggggctggcaagcaggga

SEQ ID NO: 3940614 - DNA, 13 bp, Homo sapiens
cggggctgggaag

SEQ ID NO: 3940615 - DNA, 21 bp, Homo sapiens
cgggggccagacacagataca

SEQ ID NO: 3940616 - DNA, 19 bp, Homo sapiens
cgggggtggcaagggggcg

SEQ ID NO: 3940617 - DNA, 13 bp, Homo sapiens
cggggtctgtgct

SEQ ID NO: 3940618 - DNA, 19 bp, Homo sapiens
cggggtctgtgctgtgcct

SEQ ID NO: 3940619 - DNA, 20 bp, Homo sapiens
cggggtctgtgctgtgcctg

SEQ ID NO: 3940620 - DNA, 22 bp, Homo sapiens
cggggtctgtgctgtgcctgct

SEQ ID NO: 3940621 - DNA, 15 bp, Homo sapiens
cggggtgcacaggag

SEQ ID NO: 3940622 - DNA, 17 bp, Homo sapiens
cggggtgcacaggaggg

SEQ ID NO: 3940623 - DNA, 18 bp, Homo sapiens
cgggtgggcctggcctga

SEQ ID NO: 3940624 - DNA, 16 bp, Homo sapiens
cgggtgtggcctcagc

SEQ ID NO: 3940625 - DNA, 17 bp, Homo sapiens
cgggttgtgtgtctgtt

SEQ ID NO: 3940626 - DNA, 21 bp, Homo sapiens
cgggttttattgtttaaaatc

SEQ ID NO: 3940627 - DNA, 23 bp, Homo sapiens
cggtcaccgagacggctggacct

SEQ ID NO: 3940628 - DNA, 20 bp, Homo sapiens
cggtcagatttgctgttcac

SEQ ID NO: 3940629 - DNA, 14 bp, Homo sapiens
cggtcatgtgtgca

SEQ ID NO: 3940630 - DNA, 14 bp, Homo sapiens
cggtcccacactgg

SEQ ID NO: 3940631 - DNA, 21 bp, Homo sapiens
cggtcccttgagacctcagcc

SEQ ID NO: 3940632 - DNA, 23 bp, Homo sapiens
cggtcccttgagacctcagccat

SEQ ID NO: 3940633 - DNA, 17 bp, Homo sapiens
cggtcctttaggcagcc

SEQ ID NO: 3940634 - DNA, 20 bp, Homo sapiens
cggtcctttaggcagcctgc

SEQ ID NO: 3940635 - DNA, 22 bp, Homo sapiens
cggtcctttaggcagcctgccg

SEQ ID NO: 3940636 - DNA, 14 bp, Homo sapiens
cggtgaaatccagg

SEQ ID NO: 3940637 - DNA, 16 bp, Homo sapiens
cggtgaaatccaggtc

SEQ ID NO: 3940638 - DNA, 18 bp, Homo sapiens
cggtgcatccacgcacac

SEQ ID NO: 3940639 - DNA, 22 bp, Homo sapiens
cggtgcatccacgcacacatgg

SEQ ID NO: 3940640 - DNA, 11 bp, Homo sapiens
cggtgctctgg

SEQ ID NO: 3940641 - DNA, 15 bp, Homo sapiens
cggtgctctggcggc

SEQ ID NO: 3940642 - DNA, 20 bp, Homo sapiens
cggtggctcttgcctgtaat

SEQ ID NO: 3940643 - DNA, 16 bp, Homo sapiens
cggtgggacagcccca

SEQ ID NO: 3940644 - DNA, 18 bp, Homo sapiens
cggtgggacagccccagg

SEQ ID NO: 3940645 - DNA, 16 bp, Homo sapiens
cggtggtgccagaggt

SEQ ID NO: 3940646 - DNA, 13 bp, Homo sapiens
cggtgttgcagag

SEQ ID NO: 3940647 - DNA, 14 bp, Homo sapiens
cggtgttgcagaga

SEQ ID NO: 3940648 - DNA, 17 bp, Homo sapiens
cggttaacttgtatatt

SEQ ID NO: 3940649 - DNA, 18 bp, Homo sapiens
cggttccacgtccccctg

SEQ ID NO: 3940650 - DNA, 19 bp, Homo sapiens
cggttccacgtccccctgg

SEQ ID NO: 3940651 - DNA, 14 bp, Homo sapiens
cggttgcttcacct

SEQ ID NO: 3940652 - DNA, 19 bp, Homo sapiens
cggttgcttctggctcctc

SEQ ID NO: 3940653 - DNA, 19 bp, Homo sapiens
cggtttcaaaccaggattt

SEQ ID NO: 3940654 - DNA, 22 bp, Homo sapiens
cggtttggtttgttgtaaataa

SEQ ID NO: 3940655 - DNA, 13 bp, Homo sapiens
cgtaatgcttaga

SEQ ID NO: 3940656 - DNA, 21 bp, Homo sapiens
cgtaatgcttagagaatgttc

SEQ ID NO: 3940657 - DNA, 14 bp, Homo sapiens
cgtaatgggcctgc

SEQ ID NO: 3940658 - DNA, 16 bp, Homo sapiens
cgtaatgggcctgccc

SEQ ID NO: 3940659 - DNA, 19 bp, Homo sapiens
cgtataggatgtcagacaa

SEQ ID NO: 3940660 - DNA, 23 bp, Homo sapiens
cgtatgtcggcacgtcccatgtg

SEQ ID NO: 3940661 - DNA, 18 bp, Homo sapiens
cgtatttatatttggaaa

SEQ ID NO: 3940662 - DNA, 22 bp, Homo sapiens
cgtattttaaaagccacataga

SEQ ID NO: 3940663 - DNA, 18 bp, Homo sapiens
cgtcatcggaggctgggc

SEQ ID NO: 3940664 - DNA, 15 bp, Homo sapiens
cgtccacaggggcag

SEQ ID NO: 3940665 - DNA, 19 bp, Homo sapiens
cgtccacaggggcaggcct

SEQ ID NO: 3940666 - DNA, 20 bp, Homo sapiens
cgtccacaggggcaggcctg

SEQ ID NO: 3940667 - DNA, 15 bp, Homo sapiens
cgtccatggcaccag

SEQ ID NO: 3940668 - DNA, 21 bp, Homo sapiens
cgtcccttggaaagttcagcc

SEQ ID NO: 3940669 - DNA, 15 bp, Homo sapiens
cgtcctgcagaggac

SEQ ID NO: 3940670 - DNA, 21 bp, Homo sapiens
cgtcctgcagaggaccacagt

SEQ ID NO: 3940671 - DNA, 22 bp, Homo sapiens
cgtcctgctggcacctcagaca

SEQ ID NO: 3940672 - DNA, 15 bp, Homo sapiens
ctaaatagttctatc

SEQ ID NO: 3940673 - DNA, 12 bp, Homo sapiens
ctaaatatatgt

SEQ ID NO: 3940674 - DNA, 13 bp, Homo sapiens
ctaaatatatgtc

SEQ ID NO: 3940675 - DNA, 14 bp, Homo sapiens
ctaaatatatgtct

SEQ ID NO: 3940676 - DNA, 16 bp, Homo sapiens
ctaaatccaaatgagg

SEQ ID NO: 3940677 - DNA, 21 bp, Homo sapiens
ctaaatgcaaacactgtgtat

SEQ ID NO: 3940678 - DNA, 13 bp, Homo sapiens
ctaaatgctggtc

SEQ ID NO: 3940679 - DNA, 23 bp, Homo sapiens
ctaaatgctggtctaggagctgt

SEQ ID NO: 3940680 - DNA, 16 bp, Homo sapiens
ctaaatggctttaatt

SEQ ID NO: 3940681 - DNA, 17 bp, Homo sapiens
ctaacactcagaagcct

SEQ ID NO: 3940682 - DNA, 20 bp, Homo sapiens
ctaacactcagaagcctggg

SEQ ID NO: 3940683 - DNA, 21 bp, Homo sapiens
ctaacagggaaggcaggcagg

SEQ ID NO: 3940684 - DNA, 16 bp, Homo sapiens
ctaacataaaatctgt

SEQ ID NO: 3940685 - DNA, 18 bp, Homo sapiens
ctaacataaaatctgtga

SEQ ID NO: 3940686 - DNA, 13 bp, Homo sapiens
ctaacatatgtat

SEQ ID NO: 3940687 - DNA, 16 bp, Homo sapiens
ctaacatatgtattaa

SEQ ID NO: 3940688 - DNA, 18 bp, Homo sapiens
ctaaccccaacgcacagg

SEQ ID NO: 3940689 - DNA, 22 bp, Homo sapiens
ctaaccccaacgcacaggaaaa

SEQ ID NO: 3940690 - DNA, 16 bp, Homo sapiens
ctaacccccagtgcca

SEQ ID NO: 3940691 - DNA, 16 bp, Homo sapiens
ctaacccctttcctgc

SEQ ID NO: 3940692 - DNA, 14 bp, Homo sapiens
ctaacctaagcaaa

SEQ ID NO: 3940693 - DNA, 13 bp, Homo sapiens
ctaacctcagcca

SEQ ID NO: 3940694 - DNA, 22 bp, Homo sapiens
ctaacgcctgagcccagggagg

SEQ ID NO: 3940695 - DNA, 22 bp, Homo sapiens
ctaacgggggtgcggcaggagc

SEQ ID NO: 3940696 - DNA, 22 bp, Homo sapiens
ctaactgtaaatcacttgtaaa

SEQ ID NO: 3940697 - DNA, 14 bp, Homo sapiens
ctaactgtatgtgt

SEQ ID NO: 3940698 - DNA, 19 bp, Homo sapiens
ctaagagctagcgctgccg

SEQ ID NO: 3940699 - DNA, 20 bp, Homo sapiens
ctaagatgagatttgccagc

SEQ ID NO: 3940700 - DNA, 22 bp, Homo sapiens
ctaagatgagatttgccagcac

SEQ ID NO: 3940701 - DNA, 16 bp, Homo sapiens
ctaagcagctgggact

SEQ ID NO: 3940702 - DNA, 22 bp, Homo sapiens
ctaagcatcttgtcaagaaata

SEQ ID NO: 3940703 - DNA, 19 bp, Homo sapiens
ctaagccacagcttcttca

SEQ ID NO: 3940704 - DNA, 20 bp, Homo sapiens
ctaagccactcttccaaagg

SEQ ID NO: 3940705 - DNA, 18 bp, Homo sapiens
ctaagccctcgaaccaag

SEQ ID NO: 3940706 - DNA, 22 bp, Homo sapiens
ctaagccctcgaaccaaggcag

SEQ ID NO: 3940707 - DNA, 20 bp, Homo sapiens
ctaagccctgtcgagacact

SEQ ID NO: 3940708 - DNA, 14 bp, Homo sapiens
ctaagcctgttgct

SEQ ID NO: 3940709 - DNA, 14 bp, Homo sapiens
ctaagctaggaatg

SEQ ID NO: 3940710 - DNA, 12 bp, Homo sapiens
ctaagctgcagc

SEQ ID NO: 3940711 - DNA, 19 bp, Homo sapiens
ctaagctgcagcttcctgt

SEQ ID NO: 3940712 - DNA, 24 bp, Homo sapiens
ctaagctggagctcttggaagagc

SEQ ID NO: 3940713 - DNA, 22 bp, Homo sapiens
ctaagctggagtgcttatccct

SEQ ID NO: 3940714 - DNA, 15 bp, Homo sapiens
ctaagctttctcctt

SEQ ID NO: 3940715 - DNA, 19 bp, Homo sapiens
ctaaggtcccataataaaa

SEQ ID NO: 3940716 - DNA, 16 bp, Homo sapiens
ctaagttatagtatat

SEQ ID NO: 3940717 - DNA, 20 bp, Homo sapiens
ctaagttcatgtttgtaaat

SEQ ID NO: 3940718 - DNA, 22 bp, Homo sapiens
ctaataaatgccaactggtcac

SEQ ID NO: 3940719 - DNA, 18 bp, Homo sapiens
ctaatagactaaatgaaa

SEQ ID NO: 3940720 - DNA, 17 bp, Homo sapiens
ctaatagagacacagag

SEQ ID NO: 3940721 - DNA, 13 bp, Homo sapiens
ctaatagctgcta

SEQ ID NO: 3940722 - DNA, 17 bp, Homo sapiens
ctaatatacagggtagc

SEQ ID NO: 3940723 - DNA, 11 bp, Homo sapiens
ctaatatattt

SEQ ID NO: 3940724 - DNA, 12 bp, Homo sapiens
ctaatatatttt

SEQ ID NO: 3940725 - DNA, 15 bp, Homo sapiens
ctaatatatttttat

SEQ ID NO: 3940726 - DNA, 21 bp, Homo sapiens
ctaatatatttttatatttag

SEQ ID NO: 3940727 - DNA, 13 bp, Homo sapiens
ctaatatggcaaa

SEQ ID NO: 3940728 - DNA, 17 bp, Homo sapiens
ctaatcagcattctcac

SEQ ID NO: 3940729 - DNA, 18 bp, Homo sapiens
ctaatcagctcccttccc

SEQ ID NO: 3940730 - DNA, 13 bp, Homo sapiens
ctaatccaaccca

SEQ ID NO: 3940731 - DNA, 15 bp, Homo sapiens
ctaatccaacccatg

SEQ ID NO: 3940732 - DNA, 21 bp, Homo sapiens
ctaatctcatacctctgacca

SEQ ID NO: 3940733 - DNA, 13 bp, Homo sapiens
ctaatctgtaggg

SEQ ID NO: 3940734 - DNA, 14 bp, Homo sapiens
ctaatctgtagggc

SEQ ID NO: 3940735 - DNA, 16 bp, Homo sapiens
ctaatgaaattgagaa

SEQ ID NO: 3940736 - DNA, 18 bp, Homo sapiens
ctaatgacgatgccgtgt

SEQ ID NO: 3940737 - DNA, 14 bp, Homo sapiens
ctaatgctaagaaa

SEQ ID NO: 3940738 - DNA, 22 bp, Homo sapiens
ctaatgctaagaaatgctgaaa

SEQ ID NO: 3940739 - DNA, 17 bp, Homo sapiens
ctaatgtctcttcctct

SEQ ID NO: 3940740 - DNA, 19 bp, Homo sapiens
ctaattagggcatcctgcc

SEQ ID NO: 3940741 - DNA, 13 bp, Homo sapiens
ctaattcatttat

SEQ ID NO: 3940742 - DNA, 14 bp, Homo sapiens
ctaattcccagagt

SEQ ID NO: 3940743 - DNA, 17 bp, Homo sapiens
ctaatttaaaccagcag

SEQ ID NO: 3940744 - DNA, 22 bp, Homo sapiens
ctaatttaaaccagcagaaaag

SEQ ID NO: 3940745 - DNA, 16 bp, Homo sapiens
ctaatttatacaaaat

SEQ ID NO: 3940746 - DNA, 18 bp, Homo sapiens
ctaatttatacaaaataa

SEQ ID NO: 3940747 - DNA, 18 bp, Homo sapiens
ctacaaaaacacagcaag

SEQ ID NO: 3940748 - DNA, 11 bp, Homo sapiens
ctacaaaatgg

SEQ ID NO: 3940749 - DNA, 16 bp, Homo sapiens
ctacaaccagagcccc

SEQ ID NO: 3940750 - DNA, 15 bp, Homo sapiens
ctacaagcatttgcc

SEQ ID NO: 3940751 - DNA, 19 bp, Homo sapiens
ctacacagtgggaactctg

SEQ ID NO: 3940752 - DNA, 22 bp, Homo sapiens
ctacacagtgggaactctgaca

SEQ ID NO: 3940753 - DNA, 15 bp, Homo sapiens
ctacacatcagggct

SEQ ID NO: 3940754 - DNA, 14 bp, Homo sapiens
ctacaccactctgg

SEQ ID NO: 3940755 - DNA, 19 bp, Homo sapiens
ctacaccactctggcagcc

SEQ ID NO: 3940756 - DNA, 14 bp, Homo sapiens
ctacactaataaat

SEQ ID NO: 3940757 - DNA, 20 bp, Homo sapiens
ctacactattgcattgttca

SEQ ID NO: 3940758 - DNA, 22 bp, Homo sapiens
ctacagaaatactgctctgaat

SEQ ID NO: 3940759 - DNA, 14 bp, Homo sapiens
ctagaacttcaaaa

SEQ ID NO: 3940760 - DNA, 14 bp, Homo sapiens
ctagaaggccacat

SEQ ID NO: 3940761 - DNA, 21 bp, Homo sapiens
ctagaagtgggccaggacagg

SEQ ID NO: 3940762 - DNA, 17 bp, Homo sapiens
ctagaatggtagcacta

SEQ ID NO: 3940763 - DNA, 13 bp, Homo sapiens
ctagacactgcca

SEQ ID NO: 3940764 - DNA, 13 bp, Homo sapiens
ctagacattacca

SEQ ID NO: 3940765 - DNA, 19 bp, Homo sapiens
ctagacctgggccaaaagg

SEQ ID NO: 3940766 - DNA, 23 bp, Homo sapiens
ctagacctgggccaaaagggcag

SEQ ID NO: 3940767 - DNA, 14 bp, Homo sapiens
ctagactggagtga

SEQ ID NO: 3940768 - DNA, 24 bp, Homo sapiens
ctagactggagtgaggcttccagg

SEQ ID NO: 3940769 - DNA, 12 bp, Homo sapiens
ctagactttctg

SEQ ID NO: 3940770 - DNA, 19 bp, Homo sapiens
ctagagaagaggctggtgc

SEQ ID NO: 3940771 - DNA, 17 bp, Homo sapiens
ctagagagcagaaataa

SEQ ID NO: 3940772 - DNA, 14 bp, Homo sapiens
ctagagcaacccct

SEQ ID NO: 3940773 - DNA, 21 bp, Homo sapiens
ctagagcagcccaaatttttc

SEQ ID NO: 3940774 - DNA, 13 bp, Homo sapiens
ctagagctcctgt

SEQ ID NO: 3940775 - DNA, 13 bp, Homo sapiens
ctagagctgggaa

SEQ ID NO: 3940776 - DNA, 19 bp, Homo sapiens
ctagagctgggaaacaggg

SEQ ID NO: 3940777 - DNA, 13 bp, Homo sapiens
ctagatccacaca

SEQ ID NO: 3940778 - DNA, 17 bp, Homo sapiens
ctagatccacacacaga

SEQ ID NO: 3940779 - DNA, 18 bp, Homo sapiens
ctagatccacacacagag

SEQ ID NO: 3940780 - DNA, 19 bp, Homo sapiens
ctagatccacacacagagg

SEQ ID NO: 3940781 - DNA, 21 bp, Homo sapiens
ctagcagagtgaggatgtgtt

SEQ ID NO: 3940782 - DNA, 16 bp, Homo sapiens
ctagcatctcatgagt

SEQ ID NO: 3940783 - DNA, 15 bp, Homo sapiens
ctagcattttcttga

SEQ ID NO: 3940784 - DNA, 19 bp, Homo sapiens
ctagccaactcctccttgc

SEQ ID NO: 3940785 - DNA, 14 bp, Homo sapiens
ctagccaaggctag

SEQ ID NO: 3940786 - DNA, 20 bp, Homo sapiens
ctagccacctcccaccccac

SEQ ID NO: 3940787 - DNA, 23 bp, Homo sapiens
ctagccacctcccaccccactcc

SEQ ID NO: 3940788 - DNA, 13 bp, Homo sapiens
ctagccaggagtc

SEQ ID NO: 3940789 - DNA, 20 bp, Homo sapiens
ctagccaggagtctgtgctc

SEQ ID NO: 3940790 - DNA, 21 bp, Homo sapiens
ctagccaggagtctgtgctct

SEQ ID NO: 3940791 - DNA, 19 bp, Homo sapiens
ctagccctctcacatttat

SEQ ID NO: 3940792 - DNA, 18 bp, Homo sapiens
ctagccggccactttgga

SEQ ID NO: 3940793 - DNA, 12 bp, Homo sapiens
ctagcgctgccg

SEQ ID NO: 3940794 - DNA, 14 bp, Homo sapiens
ctagctagaaatat

SEQ ID NO: 3940795 - DNA, 16 bp, Homo sapiens
ctagctagaaatatga

SEQ ID NO: 3940796 - DNA, 20 bp, Homo sapiens
ctagctccaccctcaccagg

SEQ ID NO: 3940797 - DNA, 14 bp, Homo sapiens
ctagctggcaggac

SEQ ID NO: 3940798 - DNA, 22 bp, Homo sapiens
ctagctggcaggacacatcccg

SEQ ID NO: 3940799 - DNA, 20 bp, Homo sapiens
ctagctgggcaaacccttct

SEQ ID NO: 3940800 - DNA, 19 bp, Homo sapiens
ctagcttcatgcctcagtt

SEQ ID NO: 3940801 - DNA, 20 bp, Homo sapiens
ctagcttcatgcctcagttt

SEQ ID NO: 3940802 - DNA, 14 bp, Homo sapiens
ctaggaaacccaag

SEQ ID NO: 3940803 - DNA, 15 bp, Homo sapiens
ctaggaattcccagc

SEQ ID NO: 3940804 - DNA, 12 bp, Homo sapiens
ctaggactgagg

SEQ ID NO: 3940805 - DNA, 15 bp, Homo sapiens
ctaggactgaggagt

SEQ ID NO: 3940806 - DNA, 18 bp, Homo sapiens
ctaggactgaggagtggg

SEQ ID NO: 3940807 - DNA, 15 bp, Homo sapiens
ctaggagcaaagcct

SEQ ID NO: 3940808 - DNA, 17 bp, Homo sapiens
ctaggagcaaagcctgt

SEQ ID NO: 3940809 - DNA, 23 bp, Homo sapiens
ctaggagttgagtacagtgagga

SEQ ID NO: 3940810 - DNA, 15 bp, Homo sapiens
ctaggattcctcccc

SEQ ID NO: 3940811 - DNA, 23 bp, Homo sapiens
ctaggattcctcccccagagcca

SEQ ID NO: 3940812 - DNA, 19 bp, Homo sapiens
ctaggcatcccaggggacc

SEQ ID NO: 3940813 - DNA, 19 bp, Homo sapiens
ctaggccaaatgcacaagc

SEQ ID NO: 3940814 - DNA, 22 bp, Homo sapiens
ctaggccaaatgcacaagctca

SEQ ID NO: 3940815 - DNA, 14 bp, Homo sapiens
ctaggccactcctc

SEQ ID NO: 3940816 - DNA, 13 bp, Homo sapiens
ctaggccccagag

SEQ ID NO: 3940817 - DNA, 16 bp, Homo sapiens
ctaggcgagtgccagg

SEQ ID NO: 3940818 - DNA, 17 bp, Homo sapiens
ctaggcgagtgccagga

SEQ ID NO: 3940819 - DNA, 19 bp, Homo sapiens
ctaggcgagtgccaggact

SEQ ID NO: 3940820 - DNA, 13 bp, Homo sapiens
ctaggctgttttc

SEQ ID NO: 3940821 - DNA, 15 bp, Homo sapiens
ctagggagagaccct

SEQ ID NO: 3940822 - DNA, 16 bp, Homo sapiens
ctagggagtggtcttt

SEQ ID NO: 3940823 - DNA, 21 bp, Homo sapiens
ctaggggtccacgggaagcct

SEQ ID NO: 3940824 - DNA, 14 bp, Homo sapiens
ctaggtgctggatg

SEQ ID NO: 3940825 - DNA, 19 bp, Homo sapiens
ctagtaatgggccaattaa

SEQ ID NO: 3940826 - DNA, 19 bp, Homo sapiens
ctagtaccctatagagagg

SEQ ID NO: 3940827 - DNA, 16 bp, Homo sapiens
ctagtactctctgctc

SEQ ID NO: 3940828 - DNA, 19 bp, Homo sapiens
ctagtccttggtctgctgg

SEQ ID NO: 3940829 - DNA, 19 bp, Homo sapiens
ctagtctcctttgcactga

SEQ ID NO: 3940830 - DNA, 20 bp, Homo sapiens
ctagtctcctttgcactgag

SEQ ID NO: 3940831 - DNA, 18 bp, Homo sapiens
ctagtgaaagaggcagct

SEQ ID NO: 3940832 - DNA, 16 bp, Homo sapiens
ctagtgacccacatgc

SEQ ID NO: 3940833 - DNA, 19 bp, Homo sapiens
ctagtgacccacatgccat

SEQ ID NO: 3940834 - DNA, 14 bp, Homo sapiens
ctagtgacttcctg

SEQ ID NO: 3940835 - DNA, 18 bp, Homo sapiens
ctagtgacttcctggtga

SEQ ID NO: 3940836 - DNA, 19 bp, Homo sapiens
ctagtgatgtttttatgat

SEQ ID NO: 3940837 - DNA, 18 bp, Homo sapiens
ctagtgctattctgtgtt

SEQ ID NO: 3940838 - DNA, 22 bp, Homo sapiens
ctagtggcaataagttccatgt

SEQ ID NO: 3940839 - DNA, 18 bp, Homo sapiens
ctagtggggtctccctct

SEQ ID NO: 3940840 - DNA, 23 bp, Homo sapiens
ctagtggggtctccctctcctgc

SEQ ID NO: 3940841 - DNA, 17 bp, Homo sapiens
ctagtgtattcaacaga

SEQ ID NO: 3940842 - DNA, 16 bp, Homo sapiens
ctagtgtgagtggcag

SEQ ID NO: 3940843 - DNA, 18 bp, Homo sapiens
ctagtgtgagtggcagcc

SEQ ID NO: 3940844 - DNA, 19 bp, Homo sapiens
ctagtgtgagtggcagcca

SEQ ID NO: 3940845 - DNA, 20 bp, Homo sapiens
ctagtgtgagtggcagccat

SEQ ID NO: 3940846 - DNA, 23 bp, Homo sapiens
ctagtgtgagtggcagccatgcc

SEQ ID NO: 3940847 - DNA, 16 bp, Homo sapiens
ctagtttcagtaaata

SEQ ID NO: 3940848 - DNA, 21 bp, Homo sapiens
ctagtttcagtaaataatgaa

SEQ ID NO: 3940849 - DNA, 22 bp, Homo sapiens
ctagtttcagtaaataatgaaa

SEQ ID NO: 3940850 - DNA, 17 bp, Homo sapiens
ctagtttctttctgtta

SEQ ID NO: 3940851 - DNA, 18 bp, Homo sapiens
ctagtttctttctgttat

SEQ ID NO: 3940852 - DNA, 22 bp, Homo sapiens
ctagtttgacctcacagtgacc

SEQ ID NO: 3940853 - DNA, 19 bp, Homo sapiens
ctagttttcagccttggga

SEQ ID NO: 3940854 - DNA, 20 bp, Homo sapiens
ctagttttccttgaaaaaaa

SEQ ID NO: 3940855 - DNA, 17 bp, Homo sapiens
ctagttttctcctccca

SEQ ID NO: 3940856 - DNA, 16 bp, Homo sapiens
ctagttttttttgtaa

SEQ ID NO: 3940857 - DNA, 19 bp, Homo sapiens
ctagttttttttgtaaact

SEQ ID NO: 3940858 - DNA, 18 bp, Homo sapiens
ctataaacattaaaagaa

SEQ ID NO: 3940859 - DNA, 19 bp, Homo sapiens
ctataaactactgtaatta

SEQ ID NO: 3940860 - DNA, 22 bp, Homo sapiens
ctataaactactgtaattaagt

SEQ ID NO: 3940861 - DNA, 23 bp, Homo sapiens
ctataactgtcatctagcccctt

SEQ ID NO: 3940862 - DNA, 17 bp, Homo sapiens
ctataatggaaacattt

SEQ ID NO: 3940863 - DNA, 14 bp, Homo sapiens
ctatacaacaatgt

SEQ ID NO: 3940864 - DNA, 14 bp, Homo sapiens
ctatacccattctt

SEQ ID NO: 3940865 - DNA, 15 bp, Homo sapiens
ctatagagaaaaact

SEQ ID NO: 3940866 - DNA, 14 bp, Homo sapiens
ctatagagaggggg

SEQ ID NO: 3940867 - DNA, 17 bp, Homo sapiens
ctatagctcttctattt

SEQ ID NO: 3940868 - DNA, 19 bp, Homo sapiens
ctatagctcttctatttaa

SEQ ID NO: 3940869 - DNA, 16 bp, Homo sapiens
ctataggcagacgtgg

SEQ ID NO: 3940870 - DNA, 15 bp, Homo sapiens
ctataggctggagaa

SEQ ID NO: 3940871 - DNA, 16 bp, Homo sapiens
ctataggctggagaag

SEQ ID NO: 3940872 - DNA, 19 bp, Homo sapiens
ctatagtagtcaattagta

SEQ ID NO: 3940873 - DNA, 17 bp, Homo sapiens
ctatataaggaggaaaa

SEQ ID NO: 3940874 - DNA, 11 bp, Homo sapiens
ctatatacatg

SEQ ID NO: 3940875 - DNA, 13 bp, Homo sapiens
ctatatacatgtg

SEQ ID NO: 3940876 - DNA, 15 bp, Homo sapiens
ctatatatataaata

SEQ ID NO: 3940877 - DNA, 16 bp, Homo sapiens
ctatatgatttatagt

SEQ ID NO: 3940878 - DNA, 17 bp, Homo sapiens
ctatatgatttatagtt

SEQ ID NO: 3940879 - DNA, 18 bp, Homo sapiens
ctatatgatttatagttt

SEQ ID NO: 3940880 - DNA, 13 bp, Homo sapiens
ctatattaaagtg

SEQ ID NO: 3940881 - DNA, 19 bp, Homo sapiens
ctatattccgggtgccatt

SEQ ID NO: 3940882 - DNA, 18 bp, Homo sapiens
ctatcaaaacatatcaat

SEQ ID NO: 3940883 - DNA, 13 bp, Homo sapiens
ctatcaatattta

SEQ ID NO: 3940884 - DNA, 19 bp, Homo sapiens
ctatccaattaaaattaag

SEQ ID NO: 3940885 - DNA, 13 bp, Homo sapiens
ctatccacccagc

SEQ ID NO: 3940886 - DNA, 19 bp, Homo sapiens
ctatccacccagcccattc

SEQ ID NO: 3940887 - DNA, 22 bp, Homo sapiens
ctatccatcatgaccagcaaat

SEQ ID NO: 3940888 - DNA, 15 bp, Homo sapiens
ctatcctagagaggc

SEQ ID NO: 3940889 - DNA, 16 bp, Homo sapiens
ctatccttccagtggc

SEQ ID NO: 3940890 - DNA, 19 bp, Homo sapiens
ctatccttggagagcagct

SEQ ID NO: 3940891 - DNA, 13 bp, Homo sapiens
ctatcgactttat

SEQ ID NO: 3940892 - DNA, 17 bp, Homo sapiens
ctatctctgtgtgcaca

SEQ ID NO: 3940893 - DNA, 14 bp, Homo sapiens
ctatgaaaatcagt

SEQ ID NO: 3940894 - DNA, 17 bp, Homo sapiens
ctatgactgctccccag

SEQ ID NO: 3940895 - DNA, 23 bp, Homo sapiens
ctatgacttgggcacccccagcc

SEQ ID NO: 3940896 - DNA, 21 bp, Homo sapiens
ctatgagaacaagtcacagct

SEQ ID NO: 3940897 - DNA, 23 bp, Homo sapiens
ctatgagaacaagtcacagctgc

SEQ ID NO: 3940898 - DNA, 20 bp, Homo sapiens
ctatgatatggtaaaagtta

SEQ ID NO: 3940899 - DNA, 19 bp, Homo sapiens
ctatgcaatttttaaacta

SEQ ID NO: 3940900 - DNA, 18 bp, Homo sapiens
ctatgcagtattgccaca

SEQ ID NO: 3940901 - DNA, 13 bp, Homo sapiens
ctatgctatttct

SEQ ID NO: 3940902 - DNA, 17 bp, Homo sapiens
ctatgctatttctggcc

SEQ ID NO: 3940903 - DNA, 21 bp, Homo sapiens
ctatgctatttctggcctcag

SEQ ID NO: 3940904 - DNA, 15 bp, Homo sapiens
ctatggagagccctg

SEQ ID NO: 3940905 - DNA, 21 bp, Homo sapiens
ctatggagagccctgggaccg

SEQ ID NO: 3940906 - DNA, 24 bp, Homo sapiens
ctatggatgtggggtccccatcat

SEQ ID NO: 3940907 - DNA, 18 bp, Homo sapiens
ctatggccctgcaaaaat

SEQ ID NO: 3940908 - DNA, 17 bp, Homo sapiens
ctatggtatgctggcca

SEQ ID NO: 3940909 - DNA, 20 bp, Homo sapiens
ctatggtatgctggccagca

SEQ ID NO: 3940910 - DNA, 22 bp, Homo sapiens
ctatggtatgctggccagcacc

SEQ ID NO: 3940911 - DNA, 20 bp, Homo sapiens
ctatggttcccaataaaagt

SEQ ID NO: 3940912 - DNA, 22 bp, Homo sapiens
ctatggttcccaataaaagtga

SEQ ID NO: 3940913 - DNA, 17 bp, Homo sapiens
ctatgtcaatttgtata

SEQ ID NO: 3940914 - DNA, 13 bp, Homo sapiens
ctatgtcccttgc

SEQ ID NO: 3940915 - DNA, 16 bp, Homo sapiens
ctatgtcccttgctgt

SEQ ID NO: 3940916 - DNA, 13 bp, Homo sapiens
ctatgtgacagac

SEQ ID NO: 3940917 - DNA, 16 bp, Homo sapiens
ctatgttgtgatcctt

SEQ ID NO: 3940918 - DNA, 17 bp, Homo sapiens
ctattaagatttccaag

SEQ ID NO: 3940919 - DNA, 21 bp, Homo sapiens
ctattacttgaactttccaaa

SEQ ID NO: 3940920 - DNA, 13 bp, Homo sapiens
ctattagagaaac

SEQ ID NO: 3940921 - DNA, 15 bp, Homo sapiens
ctattataaaaccat

SEQ ID NO: 3940922 - DNA, 14 bp, Homo sapiens
ctattatagccaca

SEQ ID NO: 3940923 - DNA, 14 bp, Homo sapiens
ctattatattaaaa

SEQ ID NO: 3940924 - DNA, 20 bp, Homo sapiens
ctattatctgtgcttttgag

SEQ ID NO: 3940925 - DNA, 21 bp, Homo sapiens
ctattatctgtgcttttgagg

SEQ ID NO: 3940926 - DNA, 20 bp, Homo sapiens
ctattattttcactgtagaa

SEQ ID NO: 3940927 - DNA, 23 bp, Homo sapiens
ctattccctaactctcgggacct

SEQ ID NO: 3940928 - DNA, 15 bp, Homo sapiens
ctattcctgaccctc

SEQ ID NO: 3940929 - DNA, 16 bp, Homo sapiens
ctattctgagccttga

SEQ ID NO: 3940930 - DNA, 15 bp, Homo sapiens
ctattgaactgagcc

SEQ ID NO: 3940931 - DNA, 19 bp, Homo sapiens
ctattgatgtttccagaaa

SEQ ID NO: 3940932 - DNA, 12 bp, Homo sapiens
ctcactggctgg

SEQ ID NO: 3940933 - DNA, 15 bp, Homo sapiens
ctcactggctggggc

SEQ ID NO: 3940934 - DNA, 17 bp, Homo sapiens
ctcactggctggggcag

SEQ ID NO: 3940935 - DNA, 22 bp, Homo sapiens
ctcactggctggggcagagggg

SEQ ID NO: 3940936 - DNA, 16 bp, Homo sapiens
ctcacttccctgggaa

SEQ ID NO: 3940937 - DNA, 15 bp, Homo sapiens
ctcagaaagccttcc

SEQ ID NO: 3940938 - DNA, 16 bp, Homo sapiens
ctcagaagcctggggg

SEQ ID NO: 3940939 - DNA, 17 bp, Homo sapiens
ctcagaagcctgggggc

SEQ ID NO: 3940940 - DNA, 22 bp, Homo sapiens
ctcagaagcctgggggcctggc

SEQ ID NO: 3940941 - DNA, 16 bp, Homo sapiens
ctcagaaggtattcct

SEQ ID NO: 3940942 - DNA, 14 bp, Homo sapiens
ctcagacattccaa

SEQ ID NO: 3940943 - DNA, 14 bp, Homo sapiens
ctcagactccattt

SEQ ID NO: 3940944 - DNA, 13 bp, Homo sapiens
ctcagactgctca

SEQ ID NO: 3940945 - DNA, 13 bp, Homo sapiens
ctcagagaggcat

SEQ ID NO: 3940946 - DNA, 17 bp, Homo sapiens
ctcagagatgaaactat

SEQ ID NO: 3940947 - DNA, 13 bp, Homo sapiens
ctcagagcagagc

SEQ ID NO: 3940948 - DNA, 14 bp, Homo sapiens
ctcagagcagagca

SEQ ID NO: 3940949 - DNA, 15 bp, Homo sapiens
ctcagagcaggctca

SEQ ID NO: 3940950 - DNA, 16 bp, Homo sapiens
ctcagagcccctccct

SEQ ID NO: 3940951 - DNA, 10 bp, Homo sapiens
ctcagagctc

SEQ ID NO: 3940952 - DNA, 22 bp, Homo sapiens
ctcagaggctatagctgggaac

SEQ ID NO: 3940953 - DNA, 14 bp, Homo sapiens
ctcagatggagaca

SEQ ID NO: 3940954 - DNA, 21 bp, Homo sapiens
ctcagatggagacattggatg

SEQ ID NO: 3940955 - DNA, 11 bp, Homo sapiens
ctcagcagccc

SEQ ID NO: 3940956 - DNA, 13 bp, Homo sapiens
ctcagcagccccc

SEQ ID NO: 3940957 - DNA, 18 bp, Homo sapiens
ctcagcagccccctgccc

SEQ ID NO: 3940958 - DNA, 15 bp, Homo sapiens
ctcagcagccctcct

SEQ ID NO: 3940959 - DNA, 21 bp, Homo sapiens
ctcagcagccctcctcacccc

SEQ ID NO: 3940960 - DNA, 14 bp, Homo sapiens
ctcagccaaacaca

SEQ ID NO: 3940961 - DNA, 18 bp, Homo sapiens
ctcagccaaacacagagc

SEQ ID NO: 3940962 - DNA, 12 bp, Homo sapiens
ctcagccctcag

SEQ ID NO: 3940963 - DNA, 13 bp, Homo sapiens
ctcagccctcaga

SEQ ID NO: 3940964 - DNA, 20 bp, Homo sapiens
ctcagccctccctgcccctc

SEQ ID NO: 3940965 - DNA, 21 bp, Homo sapiens
ctcagccctccctgcccctcc

SEQ ID NO: 3940966 - DNA, 12 bp, Homo sapiens
ctcagccctggg

SEQ ID NO: 3940967 - DNA, 13 bp, Homo sapiens
ctcagccctgggc

SEQ ID NO: 3940968 - DNA, 14 bp, Homo sapiens
ctcagccctgggcc

SEQ ID NO: 3940969 - DNA, 15 bp, Homo sapiens
ctcagccctgggccc

SEQ ID NO: 3940970 - DNA, 15 bp, Homo sapiens
ctcagcctcccagag

SEQ ID NO: 3940971 - DNA, 17 bp, Homo sapiens
ctcagcctcccagagtg

SEQ ID NO: 3940972 - DNA, 18 bp, Homo sapiens
ctcagcctccccctgctg

SEQ ID NO: 3940973 - DNA, 21 bp, Homo sapiens
ctcagcctccccctgctgctc

SEQ ID NO: 3940974 - DNA, 15 bp, Homo sapiens
ctcagcctcctaagc

SEQ ID NO: 3940975 - DNA, 14 bp, Homo sapiens
ctcagctcagcctc

SEQ ID NO: 3940976 - DNA, 16 bp, Homo sapiens
ctcagctctcctgctg

SEQ ID NO: 3940977 - DNA, 15 bp, Homo sapiens
ctcagctgcacattc

SEQ ID NO: 3940978 - DNA, 17 bp, Homo sapiens
ctcagctgcacattcct

SEQ ID NO: 3940979 - DNA, 17 bp, Homo sapiens
ctcagctttttgtcttt

SEQ ID NO: 3940980 - DNA, 13 bp, Homo sapiens
ctcaggacacagg

SEQ ID NO: 3940981 - DNA, 14 bp, Homo sapiens
ctcaggacacaggc

SEQ ID NO: 3940982 - DNA, 15 bp, Homo sapiens
ctcaggacacaggcc

SEQ ID NO: 3940983 - DNA, 14 bp, Homo sapiens
ctcaggacccaggc

SEQ ID NO: 3940984 - DNA, 16 bp, Homo sapiens
ctcaggacccaggccc

SEQ ID NO: 3940985 - DNA, 12 bp, Homo sapiens
ctcaggagcaca

SEQ ID NO: 3940986 - DNA, 13 bp, Homo sapiens
ctcaggaggcgaa

SEQ ID NO: 3940987 - DNA, 18 bp, Homo sapiens
ctcaggaggcgaataaat

SEQ ID NO: 3940988 - DNA, 15 bp, Homo sapiens
ctcaggaggctgagg

SEQ ID NO: 3940989 - DNA, 14 bp, Homo sapiens
ctcaggcaagcccc

SEQ ID NO: 3940990 - DNA, 20 bp, Homo sapiens
ctcaggcaagcccctcagcc

SEQ ID NO: 3940991 - DNA, 21 bp, Homo sapiens
ctcaggcaagcccctcagccc

SEQ ID NO: 3940992 - DNA, 20 bp, Homo sapiens
ctcagggacagagacacctg

SEQ ID NO: 3940993 - DNA, 12 bp, Homo sapiens
ctcagggctgga

SEQ ID NO: 3940994 - DNA, 22 bp, Homo sapiens
ctcagggctggagtgcgctctt

SEQ ID NO: 3940995 - DNA, 22 bp, Homo sapiens
ctcaggggccagtgagggctgg

SEQ ID NO: 3940996 - DNA, 19 bp, Homo sapiens
ctcagggggtcagcagagt

SEQ ID NO: 3940997 - DNA, 16 bp, Homo sapiens
ctcaggtgactggagc

SEQ ID NO: 3940998 - DNA, 14 bp, Homo sapiens
ctcaggtgccactc

SEQ ID NO: 3940999 - DNA, 18 bp, Homo sapiens
ctcaggtgccactccctg

SEQ ID NO: 3941000 - DNA, 20 bp, Homo sapiens
ctcaggtgccactccctgag

SEQ ID NO: 3941001 - DNA, 16 bp, Homo sapiens
ctcaggttctttccat

SEQ ID NO: 3941002 - DNA, 22 bp, Homo sapiens
ctcaggttgtctgaagtcactg

SEQ ID NO: 3941003 - DNA, 20 bp, Homo sapiens
ctcagtaagtatctggagga

SEQ ID NO: 3941004 - DNA, 14 bp, Homo sapiens
ctcagtatagcatt

SEQ ID NO: 3941005 - DNA, 22 bp, Homo sapiens
ctcagtcagttcccggagcaca

SEQ ID NO: 3941006 - DNA, 20 bp, Homo sapiens
ctcagtccagatgccttcct

SEQ ID NO: 3941007 - DNA, 21 bp, Homo sapiens
ctcagtctagtgaagatgttg

SEQ ID NO: 3941008 - DNA, 22 bp, Homo sapiens
ctcagtgatacgtacagccaaa

SEQ ID NO: 3941009 - DNA, 12 bp, Homo sapiens
ctcagtgccact

SEQ ID NO: 3941010 - DNA, 12 bp, Homo sapiens
ctcagtgcctcc

SEQ ID NO: 3941011 - DNA, 20 bp, Homo sapiens
ctcagtgggacaaaccagag

SEQ ID NO: 3941012 - DNA, 23 bp, Homo sapiens
ctcagtgtagttaaagggcagaa

SEQ ID NO: 3941013 - DNA, 10 bp, Homo sapiens
ctcagtttcc

SEQ ID NO: 3941014 - DNA, 11 bp, Homo sapiens
ctcagtttccc

SEQ ID NO: 3941015 - DNA, 14 bp, Homo sapiens
ctcagtttcctcat

SEQ ID NO: 3941016 - DNA, 16 bp, Homo sapiens
ctcagtttctccatca

SEQ ID NO: 3941017 - DNA, 18 bp, Homo sapiens
ctcagtttctccatcagc

SEQ ID NO: 3941018 - DNA, 19 bp, Homo sapiens
ctcagtttctccatcagct

SEQ ID NO: 3941019 - DNA, 22 bp, Homo sapiens
ctcataacatctttgaaaagaa

SEQ ID NO: 3941020 - DNA, 21 bp, Homo sapiens
ctccagcctctcccggctgcc

SEQ ID NO: 3941021 - DNA, 22 bp, Homo sapiens
ctccagcctctcccggctgcct

SEQ ID NO: 3941022 - DNA, 23 bp, Homo sapiens
ctccagcctctcccggctgcctg

SEQ ID NO: 3941023 - DNA, 14 bp, Homo sapiens
ctccagcctgccct

SEQ ID NO: 3941024 - DNA, 13 bp, Homo sapiens
ctccagctccagt

SEQ ID NO: 3941025 - DNA, 14 bp, Homo sapiens
ctccagctccagtt

SEQ ID NO: 3941026 - DNA, 20 bp, Homo sapiens
ctccaggcacccttctttcc

SEQ ID NO: 3941027 - DNA, 17 bp, Homo sapiens
ctccaggcatgctggcc

SEQ ID NO: 3941028 - DNA, 23 bp, Homo sapiens
ctccagggccacgtgccaggccc

SEQ ID NO: 3941029 - DNA, 13 bp, Homo sapiens
ctccagggtcttg

SEQ ID NO: 3941030 - DNA, 17 bp, Homo sapiens
ctccagggtcttgggct

SEQ ID NO: 3941031 - DNA, 20 bp, Homo sapiens
ctccagggtcttgggctact

SEQ ID NO: 3941032 - DNA, 21 bp, Homo sapiens
ctccagggtcttgggctactg

SEQ ID NO: 3941033 - DNA, 23 bp, Homo sapiens
ctccagggtcttgggctactggc

SEQ ID NO: 3941034 - DNA, 14 bp, Homo sapiens
ctccagtattcttg

SEQ ID NO: 3941035 - DNA, 19 bp, Homo sapiens
ctccagtctgatctgtgaa

SEQ ID NO: 3941036 - DNA, 16 bp, Homo sapiens
ctccagtgagctggaa

SEQ ID NO: 3941037 - DNA, 15 bp, Homo sapiens
ctccagtggttgctg

SEQ ID NO: 3941038 - DNA, 15 bp, Homo sapiens
ctccataatgccact

SEQ ID NO: 3941039 - DNA, 16 bp, Homo sapiens
ctccatctggcagggt

SEQ ID NO: 3941040 - DNA, 21 bp, Homo sapiens
ctccatggaggaggtgtccca

SEQ ID NO: 3941041 - DNA, 13 bp, Homo sapiens
ctccatggccacc

SEQ ID NO: 3941042 - DNA, 22 bp, Homo sapiens
ctccatggggaagtgctcccca

SEQ ID NO: 3941043 - DNA, 16 bp, Homo sapiens
ctccatgtggccccag

SEQ ID NO: 3941044 - DNA, 15 bp, Homo sapiens
ctccattccagtctc

SEQ ID NO: 3941045 - DNA, 14 bp, Homo sapiens
ctccattctgacca

SEQ ID NO: 3941046 - DNA, 20 bp, Homo sapiens
ctccattctgaccatttcag

SEQ ID NO: 3941047 - DNA, 12 bp, Homo sapiens
ctccattgctgt

SEQ ID NO: 3941048 - DNA, 21 bp, Homo sapiens
ctccatttcaactccagaagt

SEQ ID NO: 3941049 - DNA, 13 bp, Homo sapiens
ctccatttcacac

SEQ ID NO: 3941050 - DNA, 13 bp, Homo sapiens
ctcccaaaatact

SEQ ID NO: 3941051 - DNA, 23 bp, Homo sapiens
ctcccaaagctcagacttgccag

SEQ ID NO: 3941052 - DNA, 21 bp, Homo sapiens
ctcccaacctcaatgccctgc

SEQ ID NO: 3941053 - DNA, 24 bp, Homo sapiens
ctcccaacctcaatgccctgccat

SEQ ID NO: 3941054 - DNA, 15 bp, Homo sapiens
ctcccaataaagctg

SEQ ID NO: 3941055 - DNA, 17 bp, Homo sapiens
ctcccaataaagctgga

SEQ ID NO: 3941056 - DNA, 18 bp, Homo sapiens
ctcccaataaagctggac

SEQ ID NO: 3941057 - DNA, 23 bp, Homo sapiens
ctcccaccccacccccttcagtg

SEQ ID NO: 3941058 - DNA, 14 bp, Homo sapiens
ctcccaccccactc

SEQ ID NO: 3941059 - DNA, 23 bp, Homo sapiens
ctcccaccccactccagccctgt

SEQ ID NO: 3941060 - DNA, 18 bp, Homo sapiens
ctcccaccccggcctcca

SEQ ID NO: 3941061 - DNA, 17 bp, Homo sapiens
ctcccaccctaccacag

SEQ ID NO: 3941062 - DNA, 14 bp, Homo sapiens
ctcccacgtgggag

SEQ ID NO: 3941063 - DNA, 15 bp, Homo sapiens
ctcccacgtgggaga

SEQ ID NO: 3941064 - DNA, 19 bp, Homo sapiens
ctcccactggaacagccca

SEQ ID NO: 3941065 - DNA, 15 bp, Homo sapiens
ctcccagatgctggg

SEQ ID NO: 3941066 - DNA, 17 bp, Homo sapiens
ctcccagatgctgggga

SEQ ID NO: 3941067 - DNA, 19 bp, Homo sapiens
ctcccaggagacagttcaa

SEQ ID NO: 3941068 - DNA, 17 bp, Homo sapiens
ctcccaggcgccccttc

SEQ ID NO: 3941069 - DNA, 22 bp, Homo sapiens
ctcccaggcgccccttccccct

SEQ ID NO: 3941070 - DNA, 17 bp, Homo sapiens
ctcccagtcatttaata

SEQ ID NO: 3941071 - DNA, 17 bp, Homo sapiens
ctcccataccatcactg

SEQ ID NO: 3941072 - DNA, 22 bp, Homo sapiens
ctcccatgcacacaaacacctc

SEQ ID NO: 3941073 - DNA, 17 bp, Homo sapiens
ctcccatggccttccct

SEQ ID NO: 3941074 - DNA, 20 bp, Homo sapiens
ctccccaaaacctttcccca

SEQ ID NO: 3941075 - DNA, 17 bp, Homo sapiens
ctccccaaacccatcag

SEQ ID NO: 3941076 - DNA, 18 bp, Homo sapiens
ctccccaaacccatcaga

SEQ ID NO: 3941077 - DNA, 14 bp, Homo sapiens
ctccccacagtcct

SEQ ID NO: 3941078 - DNA, 19 bp, Homo sapiens
ctccccacagtcctcacag

SEQ ID NO: 3941079 - DNA, 13 bp, Homo sapiens
ctccccacccccc

SEQ ID NO: 3941080 - DNA, 15 bp, Homo sapiens
ctccccaccttcccc

SEQ ID NO: 3941081 - DNA, 24 bp, Homo sapiens
ctccccacgagtcacctgcaagcc

SEQ ID NO: 3941082 - DNA, 12 bp, Homo sapiens
ctccccactcta

SEQ ID NO: 3941083 - DNA, 13 bp, Homo sapiens
ctccccactctag

SEQ ID NO: 3941084 - DNA, 16 bp, Homo sapiens
ctccccactctgctct

SEQ ID NO: 3941085 - DNA, 20 bp, Homo sapiens
ctccccactctgctctgatg

SEQ ID NO: 3941086 - DNA, 17 bp, Homo sapiens
ctccccaggccaggcca

SEQ ID NO: 3941087 - DNA, 12 bp, Homo sapiens
ctccccaggcct

SEQ ID NO: 3941088 - DNA, 13 bp, Homo sapiens
ctccccaggcctc

SEQ ID NO: 3941089 - DNA, 11 bp, Homo sapiens
ctccccagggg

SEQ ID NO: 3941090 - DNA, 19 bp, Homo sapiens
ctcccccaccccctcccca

SEQ ID NO: 3941091 - DNA, 15 bp, Homo sapiens
ctcccccgacactgc

SEQ ID NO: 3941092 - DNA, 16 bp, Homo sapiens
ctcccccgacactgct

SEQ ID NO: 3941093 - DNA, 14 bp, Homo sapiens
ctcccccgcccaag

SEQ ID NO: 3941094 - DNA, 18 bp, Homo sapiens
ctccccctgcctttgaaa

SEQ ID NO: 3941095 - DNA, 20 bp, Homo sapiens
ctccccgcctgtcctgcctc

SEQ ID NO: 3941096 - DNA, 17 bp, Homo sapiens
ctcccctatccacccag

SEQ ID NO: 3941097 - DNA, 18 bp, Homo sapiens
ctcccctatccacccagc

SEQ ID NO: 3941098 - DNA, 21 bp, Homo sapiens
ctcccctatccacccagccca

SEQ ID NO: 3941099 - DNA, 16 bp, Homo sapiens
ctcccctctgccctgt

SEQ ID NO: 3941100 - DNA, 12 bp, Homo sapiens
ctcccctgatcc

SEQ ID NO: 3941101 - DNA, 14 bp, Homo sapiens
ctcccctgccctgc

SEQ ID NO: 3941102 - DNA, 18 bp, Homo sapiens
ctcccgcgggcctggaca

SEQ ID NO: 3941103 - DNA, 15 bp, Homo sapiens
ctcccggctgcctgc

SEQ ID NO: 3941104 - DNA, 16 bp, Homo sapiens
ctccctaaaataaaaa

SEQ ID NO: 3941105 - DNA, 21 bp, Homo sapiens
ctccctaaaataaaaaccaga

SEQ ID NO: 3941106 - DNA, 17 bp, Homo sapiens
ctccctaaggaatctga

SEQ ID NO: 3941107 - DNA, 18 bp, Homo sapiens
ctcctggagatttcagtt

SEQ ID NO: 3941108 - DNA, 17 bp, Homo sapiens
ctcctggagcatcccag

SEQ ID NO: 3941109 - DNA, 20 bp, Homo sapiens
ctcctggccggggcccctca

SEQ ID NO: 3941110 - DNA, 12 bp, Homo sapiens
ctcctggctgcc

SEQ ID NO: 3941111 - DNA, 14 bp, Homo sapiens
ctcctggctgccag

SEQ ID NO: 3941112 - DNA, 16 bp, Homo sapiens
ctcctggctgccaggc

SEQ ID NO: 3941113 - DNA, 17 bp, Homo sapiens
ctcctggctgccaggcg

SEQ ID NO: 3941114 - DNA, 24 bp, Homo sapiens
ctcctgggggtggcaggcacacag

SEQ ID NO: 3941115 - DNA, 14 bp, Homo sapiens
ctcctgggggttct

SEQ ID NO: 3941116 - DNA, 21 bp, Homo sapiens
ctcctggtctgtgctgccctg

SEQ ID NO: 3941117 - DNA, 13 bp, Homo sapiens
ctcctgtccctac

SEQ ID NO: 3941118 - DNA, 14 bp, Homo sapiens
ctcctgtccctacc

SEQ ID NO: 3941119 - DNA, 16 bp, Homo sapiens
ctcctgtccctaccca

SEQ ID NO: 3941120 - DNA, 18 bp, Homo sapiens
ctcctgtccctacccact

SEQ ID NO: 3941121 - DNA, 24 bp, Homo sapiens
ctcctgtccctacccactctttgc

SEQ ID NO: 3941122 - DNA, 14 bp, Homo sapiens
ctcctgtctgtcct

SEQ ID NO: 3941123 - DNA, 19 bp, Homo sapiens
ctcctgtctgtcctggagg

SEQ ID NO: 3941124 - DNA, 21 bp, Homo sapiens
ctcctgtctgtcctggaggtg

SEQ ID NO: 3941125 - DNA, 14 bp, Homo sapiens
ctcctgtgcccaca

SEQ ID NO: 3941126 - DNA, 20 bp, Homo sapiens
ctcctgtgctactttgcctt

SEQ ID NO: 3941127 - DNA, 17 bp, Homo sapiens
ctccttactctgagccc

SEQ ID NO: 3941128 - DNA, 22 bp, Homo sapiens
ctccttactctgagcccaggcc

SEQ ID NO: 3941129 - DNA, 23 bp, Homo sapiens
ctccttactctgagcccaggccg

SEQ ID NO: 3941130 - DNA, 21 bp, Homo sapiens
ctccttatttatcaacatctt

SEQ ID NO: 3941131 - DNA, 23 bp, Homo sapiens
ctccttcccctacacctccctcc

SEQ ID NO: 3941132 - DNA, 23 bp, Homo sapiens
ctccttccctctttccccacctc

SEQ ID NO: 3941133 - DNA, 19 bp, Homo sapiens
ctccttcccttctctcctt

SEQ ID NO: 3941134 - DNA, 23 bp, Homo sapiens
ctccttcccttctctccttccct

SEQ ID NO: 3941135 - DNA, 15 bp, Homo sapiens
ctccttcctgcccca

SEQ ID NO: 3941136 - DNA, 14 bp, Homo sapiens
ctccttccttaccc

SEQ ID NO: 3941137 - DNA, 20 bp, Homo sapiens
ctccttcgtgtctctcccac

SEQ ID NO: 3941138 - DNA, 13 bp, Homo sapiens
ctccttcttgctt

SEQ ID NO: 3941139 - DNA, 14 bp, Homo sapiens
ctccttgctctgca

SEQ ID NO: 3941140 - DNA, 19 bp, Homo sapiens
ctccttgggctcctggctg

SEQ ID NO: 3941141 - DNA, 20 bp, Homo sapiens
ctccttgggctcctggctgc

SEQ ID NO: 3941142 - DNA, 22 bp, Homo sapiens
ctccttgggctcctggctgcca

SEQ ID NO: 3941143 - DNA, 15 bp, Homo sapiens
ctccttgggtcctgc

SEQ ID NO: 3941144 - DNA, 18 bp, Homo sapiens
ctccttgtggtttatgtc

SEQ ID NO: 3941145 - DNA, 15 bp, Homo sapiens
ctcctttacctacca

SEQ ID NO: 3941146 - DNA, 15 bp, Homo sapiens
ctcctttattgcagt

SEQ ID NO: 3941147 - DNA, 13 bp, Homo sapiens
ctcctttcacaac

SEQ ID NO: 3941148 - DNA, 16 bp, Homo sapiens
ctcctttcacaacctt

SEQ ID NO: 3941149 - DNA, 20 bp, Homo sapiens
ctcctttcacaaccttctgt

SEQ ID NO: 3941150 - DNA, 14 bp, Homo sapiens
ctcctttctccagc

SEQ ID NO: 3941151 - DNA, 18 bp, Homo sapiens
ctcctttctccagccagc

SEQ ID NO: 3941152 - DNA, 23 bp, Homo sapiens
ctcctttctctatcccaagccaa

SEQ ID NO: 3941153 - DNA, 17 bp, Homo sapiens
ctcctttggccattcca

SEQ ID NO: 3941154 - DNA, 16 bp, Homo sapiens
ctccttttgctgtctt

SEQ ID NO: 3941155 - DNA, 15 bp, Homo sapiens
ctccttttgtcccca

SEQ ID NO: 3941156 - DNA, 17 bp, Homo sapiens
ctccttttgtccccagg

SEQ ID NO: 3941157 - DNA, 17 bp, Homo sapiens
ctcctttttctaccttt

SEQ ID NO: 3941158 - DNA, 23 bp, Homo sapiens
ctcgaaccaaggcagcctccaga

SEQ ID NO: 3941159 - DNA, 20 bp, Homo sapiens
ctcgagaccatcctggcccc

SEQ ID NO: 3941160 - DNA, 21 bp, Homo sapiens
ctcgagaccatcctggcccct

SEQ ID NO: 3941161 - DNA, 17 bp, Homo sapiens
ctcgagcccagatggaa

SEQ ID NO: 3941162 - DNA, 16 bp, Homo sapiens
ctcgagccccctggat

SEQ ID NO: 3941163 - DNA, 17 bp, Homo sapiens
ctcgagcgccctgcaga

SEQ ID NO: 3941164 - DNA, 18 bp, Homo sapiens
ctcgagcgccctgcagac

SEQ ID NO: 3941165 - DNA, 23 bp, Homo sapiens
ctcgaggcaccggcgctgcaggt

SEQ ID NO: 3941166 - DNA, 12 bp, Homo sapiens
ctcgaggctctt

SEQ ID NO: 3941167 - DNA, 22 bp, Homo sapiens
ctcgcaacccgtgccaagtcca

SEQ ID NO: 3941168 - DNA, 23 bp, Homo sapiens
ctcgcaacccgtgccaagtccag

SEQ ID NO: 3941169 - DNA, 20 bp, Homo sapiens
ctcgcagcaggtgcaagaga

SEQ ID NO: 3941170 - DNA, 21 bp, Homo sapiens
ctcgcagcctggcggggcagg

SEQ ID NO: 3941171 - DNA, 18 bp, Homo sapiens
ctcgcagtcgcaggatcc

SEQ ID NO: 3941172 - DNA, 12 bp, Homo sapiens
ctcgccccaccc

SEQ ID NO: 3941173 - DNA, 13 bp, Homo sapiens
ctcgccctgggtc

SEQ ID NO: 3941174 - DNA, 15 bp, Homo sapiens
ctcgccctgggtcta

SEQ ID NO: 3941175 - DNA, 16 bp, Homo sapiens
ctcgccgtctgtgaat

SEQ ID NO: 3941176 - DNA, 16 bp, Homo sapiens
ctcgcctaggcctgtg

SEQ ID NO: 3941177 - DNA, 13 bp, Homo sapiens
ctcgcctctccca

SEQ ID NO: 3941178 - DNA, 11 bp, Homo sapiens
ctcgcctgggc

SEQ ID NO: 3941179 - DNA, 19 bp, Homo sapiens
ctcgcctgggcccaggctc

SEQ ID NO: 3941180 - DNA, 22 bp, Homo sapiens
ctcgcctgggcccaggctctgg

SEQ ID NO: 3941181 - DNA, 19 bp, Homo sapiens
ctcgccttttaggctcagg

SEQ ID NO: 3941182 - DNA, 15 bp, Homo sapiens
ctcgctgctgctact

SEQ ID NO: 3941183 - DNA, 16 bp, Homo sapiens
ctcgctgctgctacta

SEQ ID NO: 3941184 - DNA, 21 bp, Homo sapiens
ctcgctggaatcaatttccca

SEQ ID NO: 3941185 - DNA, 15 bp, Homo sapiens
ctcgcttctcctcca

SEQ ID NO: 3941186 - DNA, 16 bp, Homo sapiens
ctcgcttctcctccag

SEQ ID NO: 3941187 - DNA, 20 bp, Homo sapiens
ctcggagaagagctgttcac

SEQ ID NO: 3941188 - DNA, 20 bp, Homo sapiens
ctcggatcaccgagagtagc

SEQ ID NO: 3941189 - DNA, 21 bp, Homo sapiens
ctcggcacctccccggcctct

SEQ ID NO: 3941190 - DNA, 16 bp, Homo sapiens
ctcggccccctccatc

SEQ ID NO: 3941191 - DNA, 21 bp, Homo sapiens
ctcgggacctcgtttgggagt

SEQ ID NO: 3941192 - DNA, 22 bp, Homo sapiens
ctcggggcccttggggcctggc

SEQ ID NO: 3941193 - DNA, 13 bp, Homo sapiens
ctctccctctggc

SEQ ID NO: 3941194 - DNA, 18 bp, Homo sapiens
ctctccctctggccctgc

SEQ ID NO: 3941195 - DNA, 14 bp, Homo sapiens
ctctcctcagactg

SEQ ID NO: 3941196 - DNA, 14 bp, Homo sapiens
ctctcctcttgcca

SEQ ID NO: 3941197 - DNA, 12 bp, Homo sapiens
ctctcctgccta

SEQ ID NO: 3941198 - DNA, 13 bp, Homo sapiens
ctctcctgcctac

SEQ ID NO: 3941199 - DNA, 12 bp, Homo sapiens
ctctcctggctt

SEQ ID NO: 3941200 - DNA, 13 bp, Homo sapiens
ctctcctggcttc

SEQ ID NO: 3941201 - DNA, 17 bp, Homo sapiens
ctctcctggcttcccat

SEQ ID NO: 3941202 - DNA, 19 bp, Homo sapiens
ctctcctgggggtggcagg

SEQ ID NO: 3941203 - DNA, 23 bp, Homo sapiens
ctctcctgggggtggcaggcaca

SEQ ID NO: 3941204 - DNA, 12 bp, Homo sapiens
ctctccttcctt

SEQ ID NO: 3941205 - DNA, 16 bp, Homo sapiens
ctctccttcgtgtctc

SEQ ID NO: 3941206 - DNA, 13 bp, Homo sapiens
ctctccttgggct

SEQ ID NO: 3941207 - DNA, 17 bp, Homo sapiens
ctctccttgggctcctg

SEQ ID NO: 3941208 - DNA, 22 bp, Homo sapiens
ctctccttgggctcctggctgc

SEQ ID NO: 3941209 - DNA, 21 bp, Homo sapiens
ctctcggggcccttggggcct

SEQ ID NO: 3941210 - DNA, 16 bp, Homo sapiens
ctctcgtaactggttt

SEQ ID NO: 3941211 - DNA, 13 bp, Homo sapiens
ctctctaaaaata

SEQ ID NO: 3941212 - DNA, 24 bp, Homo sapiens
ctctctaaaaataaaatgatgtat

SEQ ID NO: 3941213 - DNA, 15 bp, Homo sapiens
ctctctaagccacag

SEQ ID NO: 3941214 - DNA, 17 bp, Homo sapiens
ctctctaagccacagct

SEQ ID NO: 3941215 - DNA, 23 bp, Homo sapiens
ctctctaagccacagcttcttca

SEQ ID NO: 3941216 - DNA, 18 bp, Homo sapiens
ctctctacccggcccaga

SEQ ID NO: 3941217 - DNA, 18 bp, Homo sapiens
ctctctgcagccagccca

SEQ ID NO: 3941218 - DNA, 14 bp, Homo sapiens
ctctctgctccaga

SEQ ID NO: 3941219 - DNA, 16 bp, Homo sapiens
ctctctgctctagcca

SEQ ID NO: 3941220 - DNA, 17 bp, Homo sapiens
ctctctgctctagccag

SEQ ID NO: 3941221 - DNA, 17 bp, Homo sapiens
ctctctggccttttcct

SEQ ID NO: 3941222 - DNA, 20 bp, Homo sapiens
ctctctggggccctgggcct

SEQ ID NO: 3941223 - DNA, 13 bp, Homo sapiens
ctctctgtataaa

SEQ ID NO: 3941224 - DNA, 15 bp, Homo sapiens
ctctctgtataaaca

SEQ ID NO: 3941225 - DNA, 20 bp, Homo sapiens
ctctctgtataaacattaaa

SEQ ID NO: 3941226 - DNA, 24 bp, Homo sapiens
ctctcttccagaagatgccctcca

SEQ ID NO: 3941227 - DNA, 23 bp, Homo sapiens
ctctcttctctattcctgaccct

SEQ ID NO: 3941228 - DNA, 18 bp, Homo sapiens
ctctcttgctttgttctt

SEQ ID NO: 3941229 - DNA, 22 bp, Homo sapiens
ctctgaaaagcaattgccctgt

SEQ ID NO: 3941230 - DNA, 18 bp, Homo sapiens
ctctgaatattttgtaat

SEQ ID NO: 3941231 - DNA, 18 bp, Homo sapiens
ctctgacaagggctgacc

SEQ ID NO: 3941232 - DNA, 20 bp, Homo sapiens
ctctgacaagggctgacctg

SEQ ID NO: 3941233 - DNA, 12 bp, Homo sapiens
ctctgagaacag

SEQ ID NO: 3941234 - DNA, 18 bp, Homo sapiens
ctctgagaattccaagga

SEQ ID NO: 3941235 - DNA, 18 bp, Homo sapiens
ctctgagaggccctggat

SEQ ID NO: 3941236 - DNA, 13 bp, Homo sapiens
ctctgagatgtgt

SEQ ID NO: 3941237 - DNA, 14 bp, Homo sapiens
ctctgagcccaggc

SEQ ID NO: 3941238 - DNA, 18 bp, Homo sapiens
ctctgaggccagcctggc

SEQ ID NO: 3941239 - DNA, 20 bp, Homo sapiens
ctctgaggccagcctggcct

SEQ ID NO: 3941240 - DNA, 15 bp, Homo sapiens
ctctgaggcttccag

SEQ ID NO: 3941241 - DNA, 19 bp, Homo sapiens
ctctgaggcttccagagag

SEQ ID NO: 3941242 - DNA, 13 bp, Homo sapiens
ctctgatatggga

SEQ ID NO: 3941243 - DNA, 14 bp, Homo sapiens
ctctgatatgggac

SEQ ID NO: 3941244 - DNA, 14 bp, Homo sapiens
ctctgattatcagg

SEQ ID NO: 3941245 - DNA, 18 bp, Homo sapiens
ctctgcaatgggcactgg

SEQ ID NO: 3941246 - DNA, 23 bp, Homo sapiens
ctctgcaatgggcactgggatga

SEQ ID NO: 3941247 - DNA, 21 bp, Homo sapiens
ctctgcactccatggccaccc

SEQ ID NO: 3941248 - DNA, 16 bp, Homo sapiens
ctctgcagccagccca

SEQ ID NO: 3941249 - DNA, 18 bp, Homo sapiens
ctctgcagccagcccagc

SEQ ID NO: 3941250 - DNA, 12 bp, Homo sapiens
ctctgccacctc

SEQ ID NO: 3941251 - DNA, 17 bp, Homo sapiens
ctctgccccaagcagcc

SEQ ID NO: 3941252 - DNA, 18 bp, Homo sapiens
ctctgccccaagcagcca

SEQ ID NO: 3941253 - DNA, 21 bp, Homo sapiens
ctctgccccaagcagccagcc

SEQ ID NO: 3941254 - DNA, 24 bp, Homo sapiens
ctctgccccaagcagccagccagt

SEQ ID NO: 3941255 - DNA, 16 bp, Homo sapiens
ctctgccccaagcccc

SEQ ID NO: 3941256 - DNA, 17 bp, Homo sapiens
ctctgccccaaggggcc

SEQ ID NO: 3941257 - DNA, 16 bp, Homo sapiens
ctctgccccagaggcc

SEQ ID NO: 3941258 - DNA, 20 bp, Homo sapiens
ctctgccccagaggcctctc

SEQ ID NO: 3941259 - DNA, 20 bp, Homo sapiens
ctctgccccttctgtttcca

SEQ ID NO: 3941260 - DNA, 20 bp, Homo sapiens
ctctgccccttgggcatcca

SEQ ID NO: 3941261 - DNA, 16 bp, Homo sapiens
ctctgcccgcagagcc

SEQ ID NO: 3941262 - DNA, 14 bp, Homo sapiens
ctctgccctgcctc

SEQ ID NO: 3941263 - DNA, 17 bp, Homo sapiens
ctctgccctgcctccct

SEQ ID NO: 3941264 - DNA, 17 bp, Homo sapiens
ctctgcctatttattgg

SEQ ID NO: 3941265 - DNA, 19 bp, Homo sapiens
ctctgcctatttattgggg

SEQ ID NO: 3941266 - DNA, 14 bp, Homo sapiens
ctctgcctccctct

SEQ ID NO: 3941267 - DNA, 17 bp, Homo sapiens
ctctgcctccctctcca

SEQ ID NO: 3941268 - DNA, 14 bp, Homo sapiens
ctctgcctcctctt

SEQ ID NO: 3941269 - DNA, 21 bp, Homo sapiens
ctctgcggtggtgccagaggt

SEQ ID NO: 3941270 - DNA, 12 bp, Homo sapiens
ctctgctccaga

SEQ ID NO: 3941271 - DNA, 16 bp, Homo sapiens
ctctgctctagccagg

SEQ ID NO: 3941272 - DNA, 18 bp, Homo sapiens
ctctgctctagccaggag

SEQ ID NO: 3941273 - DNA, 15 bp, Homo sapiens
ctctgctctgaggct

SEQ ID NO: 3941274 - DNA, 12 bp, Homo sapiens
ctctgctctgat

SEQ ID NO: 3941275 - DNA, 13 bp, Homo sapiens
ctctgctggcctg

SEQ ID NO: 3941276 - DNA, 22 bp, Homo sapiens
ctctgcttactaatgtgcccca

SEQ ID NO: 3941277 - DNA, 20 bp, Homo sapiens
ctctgcttgcatcacttggg

SEQ ID NO: 3941278 - DNA, 14 bp, Homo sapiens
ctctgctttaaagt

SEQ ID NO: 3941279 - DNA, 13 bp, Homo sapiens
ctctggaaagcaa

SEQ ID NO: 3941280 - DNA, 23 bp, Homo sapiens
ctctttctttttctgtctctctt

SEQ ID NO: 3941281 - DNA, 23 bp, Homo sapiens
ctctttgacgggaggcctcagtt

SEQ ID NO: 3941282 - DNA, 19 bp, Homo sapiens
ctctttggggtcagccagg

SEQ ID NO: 3941283 - DNA, 14 bp, Homo sapiens
ctcttttggccttg

SEQ ID NO: 3941284 - DNA, 18 bp, Homo sapiens
ctctttttagggccaggc

SEQ ID NO: 3941285 - DNA, 22 bp, Homo sapiens
ctctttttagggccaggcaggt

SEQ ID NO: 3941286 - DNA, 20 bp, Homo sapiens
ctcttttttcaactggctgg

SEQ ID NO: 3941287 - DNA, 15 bp, Homo sapiens
ctgaaaaaaagttta

SEQ ID NO: 3941288 - DNA, 18 bp, Homo sapiens
ctgaaaaaaagtttacaa

SEQ ID NO: 3941289 - DNA, 20 bp, Homo sapiens
ctgaaaaaaagtttacaagt

SEQ ID NO: 3941290 - DNA, 19 bp, Homo sapiens
ctgaaaaactgatcaaaaa

SEQ ID NO: 3941291 - DNA, 21 bp, Homo sapiens
ctgaaaaatggtaattgttgc

SEQ ID NO: 3941292 - DNA, 14 bp, Homo sapiens
ctgaaaacccagag

SEQ ID NO: 3941293 - DNA, 17 bp, Homo sapiens
ctgaaaacccagagagg

SEQ ID NO: 3941294 - DNA, 15 bp, Homo sapiens
ctgaaaacgaagggg

SEQ ID NO: 3941295 - DNA, 18 bp, Homo sapiens
ctgaaaagactcagtgtt

SEQ ID NO: 3941296 - DNA, 16 bp, Homo sapiens
ctgaaaatcaaagtaa

SEQ ID NO: 3941297 - DNA, 18 bp, Homo sapiens
ctgaaaatcaaagtaaaa

SEQ ID NO: 3941298 - DNA, 12 bp, Homo sapiens
ctgaaaatgttg

SEQ ID NO: 3941299 - DNA, 15 bp, Homo sapiens
ctgaaacaacaaata

SEQ ID NO: 3941300 - DNA, 20 bp, Homo sapiens
ctgaaacattcacacagggc

SEQ ID NO: 3941301 - DNA, 20 bp, Homo sapiens
ctgaaacattccgaagaggg

SEQ ID NO: 3941302 - DNA, 22 bp, Homo sapiens
ctgaaactcacacaactaggaa

SEQ ID NO: 3941303 - DNA, 17 bp, Homo sapiens
ctgaaagacagaatgtc

SEQ ID NO: 3941304 - DNA, 17 bp, Homo sapiens
ctgaaagcagcagctag

SEQ ID NO: 3941305 - DNA, 13 bp, Homo sapiens
ctgaaagtggctc

SEQ ID NO: 3941306 - DNA, 21 bp, Homo sapiens
ctgaaatgaggagagaaggac

SEQ ID NO: 3941307 - DNA, 20 bp, Homo sapiens
ctgaacaaacactgaatcat

SEQ ID NO: 3941308 - DNA, 12 bp, Homo sapiens
ctgaacaagaat

SEQ ID NO: 3941309 - DNA, 16 bp, Homo sapiens
ctgaacaattctctct

SEQ ID NO: 3941310 - DNA, 14 bp, Homo sapiens
ctgaaccatccctg

SEQ ID NO: 3941311 - DNA, 14 bp, Homo sapiens
ctgaaccattactg

SEQ ID NO: 3941312 - DNA, 15 bp, Homo sapiens
ctgaaccattactgt

SEQ ID NO: 3941313 - DNA, 15 bp, Homo sapiens
ctgaaccccatgggc

SEQ ID NO: 3941314 - DNA, 17 bp, Homo sapiens
ctgaaccccatgggctt

SEQ ID NO: 3941315 - DNA, 18 bp, Homo sapiens
ctgaaccccatgggcttg

SEQ ID NO: 3941316 - DNA, 20 bp, Homo sapiens
ctgaaccccatgggcttgga

SEQ ID NO: 3941317 - DNA, 20 bp, Homo sapiens
ctgaacccttgtgcttggtg

SEQ ID NO: 3941318 - DNA, 14 bp, Homo sapiens
ctgaacctcagttt

SEQ ID NO: 3941319 - DNA, 17 bp, Homo sapiens
ctgaacctcagtttcct

SEQ ID NO: 3941320 - DNA, 19 bp, Homo sapiens
ctgaacctcagtttcctca

SEQ ID NO: 3941321 - DNA, 17 bp, Homo sapiens
ctgaacggggagaaaag

SEQ ID NO: 3941322 - DNA, 16 bp, Homo sapiens
ctgaagccagatccac

SEQ ID NO: 3941323 - DNA, 17 bp, Homo sapiens
ctgaagcctatttattt

SEQ ID NO: 3941324 - DNA, 13 bp, Homo sapiens
ctgaagcctctgc

SEQ ID NO: 3941325 - DNA, 16 bp, Homo sapiens
ctgaaggaatagccag

SEQ ID NO: 3941326 - DNA, 17 bp, Homo sapiens
ctgaaggaatagccaga

SEQ ID NO: 3941327 - DNA, 18 bp, Homo sapiens
ctgaaggaatagccagag

SEQ ID NO: 3941328 - DNA, 20 bp, Homo sapiens
ctgaaggaatagccagagag

SEQ ID NO: 3941329 - DNA, 18 bp, Homo sapiens
ctgaaggagattttcctt

SEQ ID NO: 3941330 - DNA, 16 bp, Homo sapiens
ctgaagggtgacatcc

SEQ ID NO: 3941331 - DNA, 19 bp, Homo sapiens
ctgaagggtgacatcccag

SEQ ID NO: 3941332 - DNA, 20 bp, Homo sapiens
ctgaagggtgacatcccagg

SEQ ID NO: 3941333 - DNA, 22 bp, Homo sapiens
ctgaaggtggccactttaagag

SEQ ID NO: 3941334 - DNA, 13 bp, Homo sapiens
ctgaagtcactgc

SEQ ID NO: 3941335 - DNA, 16 bp, Homo sapiens
ctgaagtcactgcaca

SEQ ID NO: 3941336 - DNA, 14 bp, Homo sapiens
ctgaagtgaaggag

SEQ ID NO: 3941337 - DNA, 15 bp, Homo sapiens
ctgaagtgaaggaga

SEQ ID NO: 3941338 - DNA, 22 bp, Homo sapiens
ctgaagtgaaggagaaaggagc

SEQ ID NO: 3941339 - DNA, 19 bp, Homo sapiens
ctgaagttcagccaccctg

SEQ ID NO: 3941340 - DNA, 13 bp, Homo sapiens
ctgaagttctgag

SEQ ID NO: 3941341 - DNA, 15 bp, Homo sapiens
ctgaagttctgagcc

SEQ ID NO: 3941342 - DNA, 20 bp, Homo sapiens
ctgaagttctgagccgggca

SEQ ID NO: 3941343 - DNA, 15 bp, Homo sapiens
ctgaatattaatccc

SEQ ID NO: 3941344 - DNA, 16 bp, Homo sapiens
ctgaatcatgttaata

SEQ ID NO: 3941345 - DNA, 12 bp, Homo sapiens
ctgaatgctctg

SEQ ID NO: 3941346 - DNA, 16 bp, Homo sapiens
ctgaatgtttattcct

SEQ ID NO: 3941347 - DNA, 18 bp, Homo sapiens
ctgaatgtttattccttg

SEQ ID NO: 3941348 - DNA, 12 bp, Homo sapiens
ctgaattatttt

SEQ ID NO: 3941349 - DNA, 15 bp, Homo sapiens
ctgaattgtccccag

SEQ ID NO: 3941350 - DNA, 20 bp, Homo sapiens
ctgaatttcaggcattttgt

SEQ ID NO: 3941351 - DNA, 14 bp, Homo sapiens
ctgaatttgggcct

SEQ ID NO: 3941352 - DNA, 19 bp, Homo sapiens
ctgaatttgggcctcttgt

SEQ ID NO: 3941353 - DNA, 16 bp, Homo sapiens
ctgaattttaaatgtt

SEQ ID NO: 3941354 - DNA, 20 bp, Homo sapiens
ctgaattttaaatgttcaca

SEQ ID NO: 3941355 - DNA, 15 bp, Homo sapiens
ctgacaacctgtgca

SEQ ID NO: 3941356 - DNA, 14 bp, Homo sapiens
ctgacaagaagctc

SEQ ID NO: 3941357 - DNA, 19 bp, Homo sapiens
ctgacaagaagctcccaga

SEQ ID NO: 3941358 - DNA, 19 bp, Homo sapiens
ctgacaagggctgacctgc

SEQ ID NO: 3941359 - DNA, 22 bp, Homo sapiens
ctgacaatggcagctagactgg

SEQ ID NO: 3941360 - DNA, 10 bp, Homo sapiens
ctgacacagg

SEQ ID NO: 3941361 - DNA, 21 bp, Homo sapiens
ctgacacaggaaaccaacacc

SEQ ID NO: 3941362 - DNA, 15 bp, Homo sapiens
ctgacacccatgtaa

SEQ ID NO: 3941363 - DNA, 17 bp, Homo sapiens
ctgacacctaccatgct

SEQ ID NO: 3941364 - DNA, 13 bp, Homo sapiens
ctgacagatacat

SEQ ID NO: 3941365 - DNA, 23 bp, Homo sapiens
ctgacagatacatagatggacca

SEQ ID NO: 3941366 - DNA, 17 bp, Homo sapiens
ctgacaggttcccagca

SEQ ID NO: 3941367 - DNA, 22 bp, Homo sapiens
ctgagctctgagaggccctgga

SEQ ID NO: 3941368 - DNA, 23 bp, Homo sapiens
ctgagctctgagaggccctggat

SEQ ID NO: 3941369 - DNA, 23 bp, Homo sapiens
ctgagctggcattggtctgctga

SEQ ID NO: 3941370 - DNA, 12 bp, Homo sapiens
ctgagctggggc

SEQ ID NO: 3941371 - DNA, 21 bp, Homo sapiens
ctgagctggggcctggagagg

SEQ ID NO: 3941372 - DNA, 23 bp, Homo sapiens
ctgagcttagccttgtgccctgc

SEQ ID NO: 3941373 - DNA, 22 bp, Homo sapiens
ctgagcttcagtataaaagaca

SEQ ID NO: 3941374 - DNA, 17 bp, Homo sapiens
ctgagctttggggacag

SEQ ID NO: 3941375 - DNA, 21 bp, Homo sapiens
ctgagctttggggacagttgg

SEQ ID NO: 3941376 - DNA, 14 bp, Homo sapiens
ctgagcttttcatg

SEQ ID NO: 3941377 - DNA, 18 bp, Homo sapiens
ctgagcttttcatggaag

SEQ ID NO: 3941378 - DNA, 19 bp, Homo sapiens
ctgagcttttcatggaagt

SEQ ID NO: 3941379 - DNA, 19 bp, Homo sapiens
ctgaggacatggagagaga

SEQ ID NO: 3941380 - DNA, 14 bp, Homo sapiens
ctgaggaccagcca

SEQ ID NO: 3941381 - DNA, 11 bp, Homo sapiens
ctgaggagaaa

SEQ ID NO: 3941382 - DNA, 19 bp, Homo sapiens
ctgaggagtagctgagagg

SEQ ID NO: 3941383 - DNA, 20 bp, Homo sapiens
ctgaggagtagctgagagga

SEQ ID NO: 3941384 - DNA, 22 bp, Homo sapiens
ctgaggagtagctgagaggaag

SEQ ID NO: 3941385 - DNA, 16 bp, Homo sapiens
ctgaggagtctgaggt

SEQ ID NO: 3941386 - DNA, 14 bp, Homo sapiens
ctgaggatgacaga

SEQ ID NO: 3941387 - DNA, 11 bp, Homo sapiens
ctgaggcagga

SEQ ID NO: 3941388 - DNA, 13 bp, Homo sapiens
ctgaggccagcct

SEQ ID NO: 3941389 - DNA, 14 bp, Homo sapiens
ctgaggccagcctg

SEQ ID NO: 3941390 - DNA, 16 bp, Homo sapiens
ctgaggccagcctggc

SEQ ID NO: 3941391 - DNA, 18 bp, Homo sapiens
ctgaggccagcctggcct

SEQ ID NO: 3941392 - DNA, 19 bp, Homo sapiens
ctgaggcctaaaagtaaac

SEQ ID NO: 3941393 - DNA, 11 bp, Homo sapiens
ctgaggcctca

SEQ ID NO: 3941394 - DNA, 17 bp, Homo sapiens
ctgaggcctcatccctc

SEQ ID NO: 3941395 - DNA, 16 bp, Homo sapiens
ctgaggctcaagaggc

SEQ ID NO: 3941396 - DNA, 21 bp, Homo sapiens
ctgaggctcaagaggcccagg

SEQ ID NO: 3941397 - DNA, 22 bp, Homo sapiens
ctgaggctcaagaggcccaggg

SEQ ID NO: 3941398 - DNA, 12 bp, Homo sapiens
ctgagggcagtt

SEQ ID NO: 3941399 - DNA, 21 bp, Homo sapiens
ctgagggcagttcgcagccac

SEQ ID NO: 3941400 - DNA, 13 bp, Homo sapiens
ctgagggccacac

SEQ ID NO: 3941401 - DNA, 15 bp, Homo sapiens
ctgagggccacacta

SEQ ID NO: 3941402 - DNA, 21 bp, Homo sapiens
ctgagggtccccacctgggac

SEQ ID NO: 3941403 - DNA, 19 bp, Homo sapiens
ctgagggtggagactaagc

SEQ ID NO: 3941404 - DNA, 16 bp, Homo sapiens
ctgaggtcctgagcac

SEQ ID NO: 3941405 - DNA, 18 bp, Homo sapiens
ctgaggtcctgagcactg

SEQ ID NO: 3941406 - DNA, 17 bp, Homo sapiens
ctgaggtctagaaatag

SEQ ID NO: 3941407 - DNA, 13 bp, Homo sapiens
ctgaggtgcccag

SEQ ID NO: 3941408 - DNA, 17 bp, Homo sapiens
ctgaggtgcccaggaga

SEQ ID NO: 3941409 - DNA, 15 bp, Homo sapiens
ctgagtaccttctac

SEQ ID NO: 3941410 - DNA, 14 bp, Homo sapiens
ctgagtcaccagga

SEQ ID NO: 3941411 - DNA, 17 bp, Homo sapiens
ctgagtcaccaggaatg

SEQ ID NO: 3941412 - DNA, 14 bp, Homo sapiens
ctgagtcacctcct

SEQ ID NO: 3941413 - DNA, 23 bp, Homo sapiens
ctgagtcacctcctccactcact

SEQ ID NO: 3941414 - DNA, 20 bp, Homo sapiens
ctgagtcctgtctctgcctg

SEQ ID NO: 3941415 - DNA, 14 bp, Homo sapiens
ctgagtcggcccca

SEQ ID NO: 3941416 - DNA, 21 bp, Homo sapiens
ctgagtcggccccacatggga

SEQ ID NO: 3941417 - DNA, 14 bp, Homo sapiens
ctgagtctcctgtg

SEQ ID NO: 3941418 - DNA, 16 bp, Homo sapiens
ctgagtctgagtcctg

SEQ ID NO: 3941419 - DNA, 21 bp, Homo sapiens
ctgagtctgctatattttcat

SEQ ID NO: 3941420 - DNA, 13 bp, Homo sapiens
ctgagtgactgta

SEQ ID NO: 3941421 - DNA, 22 bp, Homo sapiens
ctgagtgactgtaggcagggaa

SEQ ID NO: 3941422 - DNA, 18 bp, Homo sapiens
ctgagtgctttaccttta

SEQ ID NO: 3941423 - DNA, 20 bp, Homo sapiens
ctgagtggaatgcagggaag

SEQ ID NO: 3941424 - DNA, 22 bp, Homo sapiens
ctgagtggcttgtgattctggg

SEQ ID NO: 3941425 - DNA, 20 bp, Homo sapiens
ctgagttacttgtctgaggc

SEQ ID NO: 3941426 - DNA, 13 bp, Homo sapiens
ctgataaaattgt

SEQ ID NO: 3941427 - DNA, 19 bp, Homo sapiens
ctgataaacacagaggttt

SEQ ID NO: 3941428 - DNA, 17 bp, Homo sapiens
ctgataaacattaaaca

SEQ ID NO: 3941429 - DNA, 14 bp, Homo sapiens
ctgataaagaaaga

SEQ ID NO: 3941430 - DNA, 17 bp, Homo sapiens
ctgataacaacctggag

SEQ ID NO: 3941431 - DNA, 22 bp, Homo sapiens
ctgataacaacctggagaccag

SEQ ID NO: 3941432 - DNA, 15 bp, Homo sapiens
ctgataggaaaagaa

SEQ ID NO: 3941433 - DNA, 13 bp, Homo sapiens
ctgatatgggact

SEQ ID NO: 3941434 - DNA, 19 bp, Homo sapiens
ctgatattatggcaagtga

SEQ ID NO: 3941435 - DNA, 19 bp, Homo sapiens
ctgatcaaaaataaactag

SEQ ID NO: 3941436 - DNA, 20 bp, Homo sapiens
ctgatcattacatggctgtg

SEQ ID NO: 3941437 - DNA, 22 bp, Homo sapiens
ctgatcattacatggctgtggt

SEQ ID NO: 3941438 - DNA, 21 bp, Homo sapiens
ctgatcctaactgaagagaca

SEQ ID NO: 3941439 - DNA, 24 bp, Homo sapiens
ctgatcgggataacaaaatcacaa

SEQ ID NO: 3941440 - DNA, 16 bp, Homo sapiens
ctgatgacagagcgag

SEQ ID NO: 3941441 - DNA, 17 bp, Homo sapiens
ctgatgacagagcgaga

SEQ ID NO: 3941442 - DNA, 21 bp, Homo sapiens
ctgatgatgtctcttgtagaa

SEQ ID NO: 3941443 - DNA, 22 bp, Homo sapiens
ctgatggaccgggtgggcctgg

SEQ ID NO: 3941444 - DNA, 15 bp, Homo sapiens
ctgatggccaagagc

SEQ ID NO: 3941445 - DNA, 20 bp, Homo sapiens
ctgatggccaagggggtgga

SEQ ID NO: 3941446 - DNA, 20 bp, Homo sapiens
ctgatgggtcccaaaagctt

SEQ ID NO: 3941447 - DNA, 14 bp, Homo sapiens
ctgatggtgagctg

SEQ ID NO: 3941448 - DNA, 16 bp, Homo sapiens
ctgatggtgagctggg

SEQ ID NO: 3941449 - DNA, 20 bp, Homo sapiens
ctgatgttacatcacagtgt

SEQ ID NO: 3941450 - DNA, 18 bp, Homo sapiens
ctgatgttcctagtgaaa

SEQ ID NO: 3941451 - DNA, 20 bp, Homo sapiens
ctgatgttcctagtgaaaga

SEQ ID NO: 3941452 - DNA, 21 bp, Homo sapiens
ctgatgttcctagtgaaagag

SEQ ID NO: 3941453 - DNA, 17 bp, Homo sapiens
ctgcatgctctggaagc

SEQ ID NO: 3941454 - DNA, 21 bp, Homo sapiens
ctgcatgctctggaagcctgg

SEQ ID NO: 3941455 - DNA, 21 bp, Homo sapiens
ctgcatggagtgagcagtaga

SEQ ID NO: 3941456 - DNA, 19 bp, Homo sapiens
ctgcatgtgttgtacaata

SEQ ID NO: 3941457 - DNA, 20 bp, Homo sapiens
ctgcattccccgctgcccaa

SEQ ID NO: 3941458 - DNA, 19 bp, Homo sapiens
ctgcattgttattgtggaa

SEQ ID NO: 3941459 - DNA, 20 bp, Homo sapiens
ctgcattgttattgtggaag

SEQ ID NO: 3941460 - DNA, 22 bp, Homo sapiens
ctgcattgttattgtggaagat

SEQ ID NO: 3941461 - DNA, 16 bp, Homo sapiens
ctgcatttataaatgt

SEQ ID NO: 3941462 - DNA, 19 bp, Homo sapiens
ctgcatttataaatgtgtg

SEQ ID NO: 3941463 - DNA, 21 bp, Homo sapiens
ctgcatttataaatgtgtggt

SEQ ID NO: 3941464 - DNA, 19 bp, Homo sapiens
ctgcattttattctggatg

SEQ ID NO: 3941465 - DNA, 20 bp, Homo sapiens
ctgcattttattctggatgg

SEQ ID NO: 3941466 - DNA, 24 bp, Homo sapiens
ctgccaagcactcgagaccatcct

SEQ ID NO: 3941467 - DNA, 15 bp, Homo sapiens
ctgccacacctgagc

SEQ ID NO: 3941468 - DNA, 16 bp, Homo sapiens
ctgccacacctgagcc

SEQ ID NO: 3941469 - DNA, 17 bp, Homo sapiens
ctgccacacttcaggct

SEQ ID NO: 3941470 - DNA, 13 bp, Homo sapiens
ctgccaccacccc

SEQ ID NO: 3941471 - DNA, 21 bp, Homo sapiens
ctgccaccacgtctgccaggc

SEQ ID NO: 3941472 - DNA, 14 bp, Homo sapiens
ctgccacccttgac

SEQ ID NO: 3941473 - DNA, 12 bp, Homo sapiens
ctgccacctccc

SEQ ID NO: 3941474 - DNA, 19 bp, Homo sapiens
ctgccactaacctgtagaa

SEQ ID NO: 3941475 - DNA, 20 bp, Homo sapiens
ctgccagagcccaagtgcca

SEQ ID NO: 3941476 - DNA, 21 bp, Homo sapiens
ctgccagagcccaagtgccat

SEQ ID NO: 3941477 - DNA, 13 bp, Homo sapiens
ctgccagctgcct

SEQ ID NO: 3941478 - DNA, 14 bp, Homo sapiens
ctgccagctgcctt

SEQ ID NO: 3941479 - DNA, 15 bp, Homo sapiens
ctgccagctgccttc

SEQ ID NO: 3941480 - DNA, 10 bp, Homo sapiens
ctgccaggac

SEQ ID NO: 3941481 - DNA, 16 bp, Homo sapiens
ctgccaggacacctgc

SEQ ID NO: 3941482 - DNA, 21 bp, Homo sapiens
ctgccaggacacctgccccag

SEQ ID NO: 3941483 - DNA, 22 bp, Homo sapiens
ctgccaggacacctgccccagc

SEQ ID NO: 3941484 - DNA, 23 bp, Homo sapiens
ctgccaggacacctgccccagcg

SEQ ID NO: 3941485 - DNA, 11 bp, Homo sapiens
ctgccaggagg

SEQ ID NO: 3941486 - DNA, 19 bp, Homo sapiens
ctgccaggaggctgcggcc

SEQ ID NO: 3941487 - DNA, 13 bp, Homo sapiens
ctgccaggaggga

SEQ ID NO: 3941488 - DNA, 20 bp, Homo sapiens
ctgccaggagggacaaagga

SEQ ID NO: 3941489 - DNA, 13 bp, Homo sapiens
ctgccaggcacct

SEQ ID NO: 3941490 - DNA, 15 bp, Homo sapiens
ctgccaggcacctgg

SEQ ID NO: 3941491 - DNA, 16 bp, Homo sapiens
ctgccaggcacctggc

SEQ ID NO: 3941492 - DNA, 13 bp, Homo sapiens
ctgccaggcccat

SEQ ID NO: 3941493 - DNA, 22 bp, Homo sapiens
ctgccaggcccatctcaggtgc

SEQ ID NO: 3941494 - DNA, 23 bp, Homo sapiens
ctgccaggcccatctcaggtgcc

SEQ ID NO: 3941495 - DNA, 14 bp, Homo sapiens
ctgccagtgcctta

SEQ ID NO: 3941496 - DNA, 20 bp, Homo sapiens
ctgccagtgccttacctcct

SEQ ID NO: 3941497 - DNA, 21 bp, Homo sapiens
ctgccagtgccttacctcctg

SEQ ID NO: 3941498 - DNA, 19 bp, Homo sapiens
ctgcccacttagccgtcca

SEQ ID NO: 3941499 - DNA, 18 bp, Homo sapiens
ctgcccacttcagcccag

SEQ ID NO: 3941500 - DNA, 20 bp, Homo sapiens
ctgcccagaattcccagctg

SEQ ID NO: 3941501 - DNA, 18 bp, Homo sapiens
ctgcccaggagagccagc

SEQ ID NO: 3941502 - DNA, 19 bp, Homo sapiens
ctgcccaggagagccagcc

SEQ ID NO: 3941503 - DNA, 21 bp, Homo sapiens
ctgcccaggagagccagccct

SEQ ID NO: 3941504 - DNA, 22 bp, Homo sapiens
ctgcccaggagagccagccctc

SEQ ID NO: 3941505 - DNA, 21 bp, Homo sapiens
ctgcccatacccctgcctggg

SEQ ID NO: 3941506 - DNA, 22 bp, Homo sapiens
ctgcccatacccctgcctgggt

SEQ ID NO: 3941507 - DNA, 14 bp, Homo sapiens
ctgccccaactcct

SEQ ID NO: 3941508 - DNA, 20 bp, Homo sapiens
ctgccccaactcctggaagc

SEQ ID NO: 3941509 - DNA, 15 bp, Homo sapiens
ctgccccaactcctt

SEQ ID NO: 3941510 - DNA, 20 bp, Homo sapiens
ctgccccaactccttccagc

SEQ ID NO: 3941511 - DNA, 22 bp, Homo sapiens
ctgccccaactccttccagcta

SEQ ID NO: 3941512 - DNA, 15 bp, Homo sapiens
ctgccccaagcagcc

SEQ ID NO: 3941513 - DNA, 13 bp, Homo sapiens
ctgccccaagccc

SEQ ID NO: 3941514 - DNA, 23 bp, Homo sapiens
ctgccccaagcccccaaccccgc

SEQ ID NO: 3941515 - DNA, 13 bp, Homo sapiens
ctgccccaagggg

SEQ ID NO: 3941516 - DNA, 11 bp, Homo sapiens
ctgccccaccc

SEQ ID NO: 3941517 - DNA, 15 bp, Homo sapiens
ctgccccagcgcggc

SEQ ID NO: 3941518 - DNA, 18 bp, Homo sapiens
ctgccccagtagtcagaa

SEQ ID NO: 3941519 - DNA, 13 bp, Homo sapiens
ctgcccccagcca

SEQ ID NO: 3941520 - DNA, 14 bp, Homo sapiens
ctgcccccatctcc

SEQ ID NO: 3941521 - DNA, 19 bp, Homo sapiens
ctgcccccatctccccagg

SEQ ID NO: 3941522 - DNA, 11 bp, Homo sapiens
ctgccccccgc

SEQ ID NO: 3941523 - DNA, 19 bp, Homo sapiens
ctgcccccgacagcccagc

SEQ ID NO: 3941524 - DNA, 17 bp, Homo sapiens
ctgccccgggtgcctca

SEQ ID NO: 3941525 - DNA, 15 bp, Homo sapiens
ctgccccgttccctg

SEQ ID NO: 3941526 - DNA, 17 bp, Homo sapiens
ctgcccctcccttcaac

SEQ ID NO: 3941527 - DNA, 13 bp, Homo sapiens
ctgccccttgggc

SEQ ID NO: 3941528 - DNA, 18 bp, Homo sapiens
ctgccccttgggcatcca

SEQ ID NO: 3941529 - DNA, 19 bp, Homo sapiens
ctgccccttgggcatccac

SEQ ID NO: 3941530 - DNA, 17 bp, Homo sapiens
ctgcccgactcaggtcc

SEQ ID NO: 3941531 - DNA, 16 bp, Homo sapiens
ctgccctcagcacaga

SEQ ID NO: 3941532 - DNA, 20 bp, Homo sapiens
ctgccctctctcagttattc

SEQ ID NO: 3941533 - DNA, 16 bp, Homo sapiens
ctgccctgccacctgt

SEQ ID NO: 3941534 - DNA, 12 bp, Homo sapiens
ctgccctgcctg

SEQ ID NO: 3941535 - DNA, 13 bp, Homo sapiens
ctgccctgcctgc

SEQ ID NO: 3941536 - DNA, 22 bp, Homo sapiens
ctgccctgcgaagtggctctca

SEQ ID NO: 3941537 - DNA, 21 bp, Homo sapiens
ctgccctgctgccgcctccca

SEQ ID NO: 3941538 - DNA, 16 bp, Homo sapiens
ctgccctggagggagg

SEQ ID NO: 3941539 - DNA, 14 bp, Homo sapiens
ctgctcccagcagc

SEQ ID NO: 3941540 - DNA, 15 bp, Homo sapiens
ctgctcccagcagcc

SEQ ID NO: 3941541 - DNA, 18 bp, Homo sapiens
ctgctcccatctgcacta

SEQ ID NO: 3941542 - DNA, 17 bp, Homo sapiens
ctgctccccagccctgg

SEQ ID NO: 3941543 - DNA, 19 bp, Homo sapiens
ctgctccccagccctggct

SEQ ID NO: 3941544 - DNA, 12 bp, Homo sapiens
ctgctcctccag

SEQ ID NO: 3941545 - DNA, 24 bp, Homo sapiens
ctgctcctccagggccacgtgcca

SEQ ID NO: 3941546 - DNA, 16 bp, Homo sapiens
ctgctcctctccaggc

SEQ ID NO: 3941547 - DNA, 21 bp, Homo sapiens
ctgctcggggtgcacaggagg

SEQ ID NO: 3941548 - DNA, 14 bp, Homo sapiens
ctgctctagccagg

SEQ ID NO: 3941549 - DNA, 16 bp, Homo sapiens
ctgctctagctggcag

SEQ ID NO: 3941550 - DNA, 17 bp, Homo sapiens
ctgctctagctggcagg

SEQ ID NO: 3941551 - DNA, 13 bp, Homo sapiens
ctgctctcatgcc

SEQ ID NO: 3941552 - DNA, 19 bp, Homo sapiens
ctgctctcttcaggaggcc

SEQ ID NO: 3941553 - DNA, 18 bp, Homo sapiens
ctgctctgaggcttccag

SEQ ID NO: 3941554 - DNA, 11 bp, Homo sapiens
ctgctctgcca

SEQ ID NO: 3941555 - DNA, 12 bp, Homo sapiens
ctgctctgcccc

SEQ ID NO: 3941556 - DNA, 23 bp, Homo sapiens
ctgctctgccccttgggcatcca

SEQ ID NO: 3941557 - DNA, 11 bp, Homo sapiens
ctgctctgcta

SEQ ID NO: 3941558 - DNA, 15 bp, Homo sapiens
ctgctcttagtgccc

SEQ ID NO: 3941559 - DNA, 17 bp, Homo sapiens
ctgctcttccaaagctc

SEQ ID NO: 3941560 - DNA, 13 bp, Homo sapiens
ctgctgaaacaac

SEQ ID NO: 3941561 - DNA, 16 bp, Homo sapiens
ctgctgaagttctgag

SEQ ID NO: 3941562 - DNA, 18 bp, Homo sapiens
ctgctgaagttctgagcc

SEQ ID NO: 3941563 - DNA, 22 bp, Homo sapiens
ctgctgaatgatttccaaagag

SEQ ID NO: 3941564 - DNA, 21 bp, Homo sapiens
ctgctgacctgatcacctctg

SEQ ID NO: 3941565 - DNA, 16 bp, Homo sapiens
ctgctgagctctgaga

SEQ ID NO: 3941566 - DNA, 19 bp, Homo sapiens
ctgctgagctctgagaggc

SEQ ID NO: 3941567 - DNA, 23 bp, Homo sapiens
ctgctgagctctgagaggccctg

SEQ ID NO: 3941568 - DNA, 14 bp, Homo sapiens
ctgctgcaaagtgc

SEQ ID NO: 3941569 - DNA, 16 bp, Homo sapiens
ctgctgcaaagtgcaa

SEQ ID NO: 3941570 - DNA, 17 bp, Homo sapiens
ctgctgcaccagagtga

SEQ ID NO: 3941571 - DNA, 22 bp, Homo sapiens
ctgctgcccagcctccaagctc

SEQ ID NO: 3941572 - DNA, 17 bp, Homo sapiens
ctgctgccgcctcccag

SEQ ID NO: 3941573 - DNA, 20 bp, Homo sapiens
ctgctgccgcctcccagcct

SEQ ID NO: 3941574 - DNA, 13 bp, Homo sapiens
ctgctgctgagaa

SEQ ID NO: 3941575 - DNA, 16 bp, Homo sapiens
ctgctgctgagaacct

SEQ ID NO: 3941576 - DNA, 17 bp, Homo sapiens
ctgctgctgagaacctg

SEQ ID NO: 3941577 - DNA, 23 bp, Homo sapiens
ctgctgctgagaacctggccttc

SEQ ID NO: 3941578 - DNA, 23 bp, Homo sapiens
ctgctgctgtaactgctgagcca

SEQ ID NO: 3941579 - DNA, 23 bp, Homo sapiens
ctgctggcacctcagacaatcca

SEQ ID NO: 3941580 - DNA, 11 bp, Homo sapiens
ctgctgggaac

SEQ ID NO: 3941581 - DNA, 17 bp, Homo sapiens
ctgctgggaaccccgca

SEQ ID NO: 3941582 - DNA, 19 bp, Homo sapiens
ctgctgggaaccccgcagc

SEQ ID NO: 3941583 - DNA, 15 bp, Homo sapiens
ctgctgggctctcca

SEQ ID NO: 3941584 - DNA, 23 bp, Homo sapiens
ctgctgggctctccacctcagcc

SEQ ID NO: 3941585 - DNA, 18 bp, Homo sapiens
ctgctggggcatgtgtgc

SEQ ID NO: 3941586 - DNA, 23 bp, Homo sapiens
ctgctggggcatgtgtgcctgtg

SEQ ID NO: 3941587 - DNA, 22 bp, Homo sapiens
ctgctggtaatttgtatctgaa

SEQ ID NO: 3941588 - DNA, 21 bp, Homo sapiens
ctgctggttttaacaactgtg

SEQ ID NO: 3941589 - DNA, 16 bp, Homo sapiens
ctgctgtaactgctga

SEQ ID NO: 3941590 - DNA, 23 bp, Homo sapiens
ctgctgtgaatttgtgtaaggat

SEQ ID NO: 3941591 - DNA, 12 bp, Homo sapiens
ctgctgtggcct

SEQ ID NO: 3941592 - DNA, 14 bp, Homo sapiens
ctgctgtgtgcctt

SEQ ID NO: 3941593 - DNA, 20 bp, Homo sapiens
ctgctgttgccatagcccca

SEQ ID NO: 3941594 - DNA, 22 bp, Homo sapiens
ctgctgttgctggactgaggac

SEQ ID NO: 3941595 - DNA, 14 bp, Homo sapiens
ctgcttacccttca

SEQ ID NO: 3941596 - DNA, 19 bp, Homo sapiens
ctgcttactaatgtgcccc

SEQ ID NO: 3941597 - DNA, 12 bp, Homo sapiens
ctgcttcagtgg

SEQ ID NO: 3941598 - DNA, 19 bp, Homo sapiens
ctgcttcagtgtatggaaa

SEQ ID NO: 3941599 - DNA, 15 bp, Homo sapiens
ctgcttctccctggc

SEQ ID NO: 3941600 - DNA, 22 bp, Homo sapiens
ctgcttcttcaagcacctgcag

SEQ ID NO: 3941601 - DNA, 23 bp, Homo sapiens
ctgcttcttcaagcacctgcaga

SEQ ID NO: 3941602 - DNA, 17 bp, Homo sapiens
ctgcttgactatcacat

SEQ ID NO: 3941603 - DNA, 18 bp, Homo sapiens
ctgcttgactatcacata

SEQ ID NO: 3941604 - DNA, 21 bp, Homo sapiens
ctgcttggggggtgatgaggg

SEQ ID NO: 3941605 - DNA, 23 bp, Homo sapiens
ctgcttgggttcctttttcaact

SEQ ID NO: 3941606 - DNA, 15 bp, Homo sapiens
ctgcttggtcaaatc

SEQ ID NO: 3941607 - DNA, 16 bp, Homo sapiens
ctgctttccctcccca

SEQ ID NO: 3941608 - DNA, 23 bp, Homo sapiens
ctgctttgggctgccctggtgct

SEQ ID NO: 3941609 - DNA, 22 bp, Homo sapiens
ctgcttttccaggatcctgcag

SEQ ID NO: 3941610 - DNA, 24 bp, Homo sapiens
ctgcttttccaggatcctgcagga

SEQ ID NO: 3941611 - DNA, 22 bp, Homo sapiens
ctgctttttccagattcttcca

SEQ ID NO: 3941612 - DNA, 20 bp, Homo sapiens
ctggaaaaaaaatatatata

SEQ ID NO: 3941613 - DNA, 15 bp, Homo sapiens
ctggaaaactcagga

SEQ ID NO: 3941614 - DNA, 20 bp, Homo sapiens
ctggaaaattcctattgatt

SEQ ID NO: 3941615 - DNA, 19 bp, Homo sapiens
ctggaaataaacctggaga

SEQ ID NO: 3941616 - DNA, 20 bp, Homo sapiens
ctggaaataaacctggagat

SEQ ID NO: 3941617 - DNA, 21 bp, Homo sapiens
ctggaaataaacctggagatg

SEQ ID NO: 3941618 - DNA, 23 bp, Homo sapiens
ctggaaataaacctggagatgat

SEQ ID NO: 3941619 - DNA, 16 bp, Homo sapiens
ctggaaattctggaac

SEQ ID NO: 3941620 - DNA, 16 bp, Homo sapiens
ctggaaattttgtcca

SEQ ID NO: 3941621 - DNA, 22 bp, Homo sapiens
ctggaaccaatcccgtgaaaga

SEQ ID NO: 3941622 - DNA, 14 bp, Homo sapiens
ctggaaccagggag

SEQ ID NO: 3941623 - DNA, 17 bp, Homo sapiens
ctggaaccagggaggag

SEQ ID NO: 3941624 - DNA, 17 bp, Homo sapiens
ctggaagacatgataca

SEQ ID NO: 3941625 - DNA, 19 bp, Homo sapiens
ctggcacttagcccaagag

SEQ ID NO: 3941626 - DNA, 21 bp, Homo sapiens
ctggcacttggagacttgtat

SEQ ID NO: 3941627 - DNA, 23 bp, Homo sapiens
ctggcagccacacttctcaggac

SEQ ID NO: 3941628 - DNA, 18 bp, Homo sapiens
ctggcagccgtgccttca

SEQ ID NO: 3941629 - DNA, 21 bp, Homo sapiens
ctggcagccgtgccttcagct

SEQ ID NO: 3941630 - DNA, 22 bp, Homo sapiens
ctggcagctcctctccttgggc

SEQ ID NO: 3941631 - DNA, 23 bp, Homo sapiens
ctggcagctcctctccttgggct

SEQ ID NO: 3941632 - DNA, 12 bp, Homo sapiens
ctggcagctgag

SEQ ID NO: 3941633 - DNA, 18 bp, Homo sapiens
ctggcagctgagagccct

SEQ ID NO: 3941634 - DNA, 19 bp, Homo sapiens
ctggcagctgagagccctg

SEQ ID NO: 3941635 - DNA, 14 bp, Homo sapiens
ctggcagctgtcat

SEQ ID NO: 3941636 - DNA, 23 bp, Homo sapiens
ctggcaggacacatcccggcctc

SEQ ID NO: 3941637 - DNA, 17 bp, Homo sapiens
ctggcatgacactctag

SEQ ID NO: 3941638 - DNA, 17 bp, Homo sapiens
ctggcattaattattaa

SEQ ID NO: 3941639 - DNA, 14 bp, Homo sapiens
ctggccaagctgag

SEQ ID NO: 3941640 - DNA, 17 bp, Homo sapiens
ctggccaagctgaggtg

SEQ ID NO: 3941641 - DNA, 23 bp, Homo sapiens
ctggccaagctgaggtgcccagg

SEQ ID NO: 3941642 - DNA, 14 bp, Homo sapiens
ctggccagacgctg

SEQ ID NO: 3941643 - DNA, 15 bp, Homo sapiens
ctggccagagagggc

SEQ ID NO: 3941644 - DNA, 19 bp, Homo sapiens
ctggccagagagggcccag

SEQ ID NO: 3941645 - DNA, 20 bp, Homo sapiens
ctggccagagagggcccagc

SEQ ID NO: 3941646 - DNA, 12 bp, Homo sapiens
ctggccagcacc

SEQ ID NO: 3941647 - DNA, 13 bp, Homo sapiens
ctggccagcaccc

SEQ ID NO: 3941648 - DNA, 14 bp, Homo sapiens
ctggccagcaccct

SEQ ID NO: 3941649 - DNA, 20 bp, Homo sapiens
ctggccagcaccctctcctg

SEQ ID NO: 3941650 - DNA, 16 bp, Homo sapiens
ctggccagtcctagag

SEQ ID NO: 3941651 - DNA, 19 bp, Homo sapiens
ctggccagtcctagagctc

SEQ ID NO: 3941652 - DNA, 21 bp, Homo sapiens
ctggccagtcctagagctcct

SEQ ID NO: 3941653 - DNA, 22 bp, Homo sapiens
ctggccattttcttgcctgagg

SEQ ID NO: 3941654 - DNA, 17 bp, Homo sapiens
ctggcccatagaaacat

SEQ ID NO: 3941655 - DNA, 23 bp, Homo sapiens
ctggcccatagaaacatgacact

SEQ ID NO: 3941656 - DNA, 16 bp, Homo sapiens
ctggccccatgtctct

SEQ ID NO: 3941657 - DNA, 16 bp, Homo sapiens
ctggcccccctccagg

SEQ ID NO: 3941658 - DNA, 23 bp, Homo sapiens
ctggccccgggctctggccaccc

SEQ ID NO: 3941659 - DNA, 23 bp, Homo sapiens
ctggcccgcccctcgctgctgct

SEQ ID NO: 3941660 - DNA, 18 bp, Homo sapiens
ctggcccgtcatgttcct

SEQ ID NO: 3941661 - DNA, 12 bp, Homo sapiens
ctggccctgcct

SEQ ID NO: 3941662 - DNA, 18 bp, Homo sapiens
ctggccggcaaccccagt

SEQ ID NO: 3941663 - DNA, 20 bp, Homo sapiens
ctggccggcccaggcctcca

SEQ ID NO: 3941664 - DNA, 15 bp, Homo sapiens
ctggcctcactggct

SEQ ID NO: 3941665 - DNA, 20 bp, Homo sapiens
ctggcctcactggctggggc

SEQ ID NO: 3941666 - DNA, 20 bp, Homo sapiens
ctggcctcagcaggaacctg

SEQ ID NO: 3941667 - DNA, 18 bp, Homo sapiens
ctggcctcccaataaagc

SEQ ID NO: 3941668 - DNA, 15 bp, Homo sapiens
ctggcctcctgcctc

SEQ ID NO: 3941669 - DNA, 15 bp, Homo sapiens
ctggcctgagctggg

SEQ ID NO: 3941670 - DNA, 17 bp, Homo sapiens
ctggcctgagctggggc

SEQ ID NO: 3941671 - DNA, 21 bp, Homo sapiens
ctggcctgagctggggccaca

SEQ ID NO: 3941672 - DNA, 12 bp, Homo sapiens
ctggcctgctgg

SEQ ID NO: 3941673 - DNA, 15 bp, Homo sapiens
ctggcctgctgggaa

SEQ ID NO: 3941674 - DNA, 17 bp, Homo sapiens
ctggcctgctgggaacc

SEQ ID NO: 3941675 - DNA, 19 bp, Homo sapiens
ctggcctgctgggctctcc

SEQ ID NO: 3941676 - DNA, 20 bp, Homo sapiens
ctggcctgctgggctctcca

SEQ ID NO: 3941677 - DNA, 18 bp, Homo sapiens
ctggccttgtcaggaccc

SEQ ID NO: 3941678 - DNA, 21 bp, Homo sapiens
ctggccttgtcaggacccagg

SEQ ID NO: 3941679 - DNA, 23 bp, Homo sapiens
ctggccttgtcaggacccaggcc

SEQ ID NO: 3941680 - DNA, 18 bp, Homo sapiens
ctggcgactgcagctgca

SEQ ID NO: 3941681 - DNA, 16 bp, Homo sapiens
ctggcggctactcagc

SEQ ID NO: 3941682 - DNA, 20 bp, Homo sapiens
ctggcggctactcagcagcc

SEQ ID NO: 3941683 - DNA, 13 bp, Homo sapiens
ctggcggcttcct

SEQ ID NO: 3941684 - DNA, 19 bp, Homo sapiens
ctggcggcttcctgtccac

SEQ ID NO: 3941685 - DNA, 20 bp, Homo sapiens
ctggcggcttcctgtccact

SEQ ID NO: 3941686 - DNA, 16 bp, Homo sapiens
ctggctaactggaagc

SEQ ID NO: 3941687 - DNA, 12 bp, Homo sapiens
ctggctccagaa

SEQ ID NO: 3941688 - DNA, 15 bp, Homo sapiens
ctggctcccacaggc

SEQ ID NO: 3941689 - DNA, 23 bp, Homo sapiens
ctggctccccacgagtcacctgc

SEQ ID NO: 3941690 - DNA, 20 bp, Homo sapiens
ctggctccgtccaggagcct

SEQ ID NO: 3941691 - DNA, 22 bp, Homo sapiens
ctggctgaccccaaagagcctg

SEQ ID NO: 3941692 - DNA, 13 bp, Homo sapiens
ctggctgagggca

SEQ ID NO: 3941693 - DNA, 14 bp, Homo sapiens
ctggctgcaagggc

SEQ ID NO: 3941694 - DNA, 22 bp, Homo sapiens
ctggctgccaggcgttggtgcc

SEQ ID NO: 3941695 - DNA, 23 bp, Homo sapiens
ctggctgccaggcgttggtgcca

SEQ ID NO: 3941696 - DNA, 20 bp, Homo sapiens
ctggctgctctcatgcctgc

SEQ ID NO: 3941697 - DNA, 11 bp, Homo sapiens
ctggctggctg

SEQ ID NO: 3941698 - DNA, 12 bp, Homo sapiens
ctggctgggaca

SEQ ID NO: 3941699 - DNA, 20 bp, Homo sapiens
ctggctgtcttcccccaccc

SEQ ID NO: 3941700 - DNA, 18 bp, Homo sapiens
ctggctgtggaggcctga

SEQ ID NO: 3941701 - DNA, 22 bp, Homo sapiens
ctggctgtggaggcctgatgct

SEQ ID NO: 3941702 - DNA, 20 bp, Homo sapiens
ctggcttcccatccccagcg

SEQ ID NO: 3941703 - DNA, 18 bp, Homo sapiens
ctggcttctgttgcgcca

SEQ ID NO: 3941704 - DNA, 13 bp, Homo sapiens
ctggcttgctcca

SEQ ID NO: 3941705 - DNA, 14 bp, Homo sapiens
ctggcttgctccag

SEQ ID NO: 3941706 - DNA, 15 bp, Homo sapiens
ctggctttctccgac

SEQ ID NO: 3941707 - DNA, 22 bp, Homo sapiens
ctggctttctccgactgctagg

SEQ ID NO: 3941708 - DNA, 15 bp, Homo sapiens
ctggcttttcactgc

SEQ ID NO: 3941709 - DNA, 16 bp, Homo sapiens
ctggcttttcactgct

SEQ ID NO: 3941710 - DNA, 16 bp, Homo sapiens
ctgggaaaacagagga

SEQ ID NO: 3941711 - DNA, 19 bp, Homo sapiens
ctggggagggagagcacct

SEQ ID NO: 3941712 - DNA, 22 bp, Homo sapiens
ctggggatgtgggagggagcag

SEQ ID NO: 3941713 - DNA, 19 bp, Homo sapiens
ctggggcatgtgtgcctgt

SEQ ID NO: 3941714 - DNA, 21 bp, Homo sapiens
ctggggcatgtgtgcctgtgg

SEQ ID NO: 3941715 - DNA, 21 bp, Homo sapiens
ctggggccagtgtaaggcata

SEQ ID NO: 3941716 - DNA, 13 bp, Homo sapiens
ctggggccctggg

SEQ ID NO: 3941717 - DNA, 16 bp, Homo sapiens
ctggggccctgggcct

SEQ ID NO: 3941718 - DNA, 17 bp, Homo sapiens
ctggggccctgggcctc

SEQ ID NO: 3941719 - DNA, 19 bp, Homo sapiens
ctggggccctgggcctcag

SEQ ID NO: 3941720 - DNA, 14 bp, Homo sapiens
ctggggcctggaga

SEQ ID NO: 3941721 - DNA, 19 bp, Homo sapiens
ctggggcctggagaggggc

SEQ ID NO: 3941722 - DNA, 14 bp, Homo sapiens
ctggggcctgtact

SEQ ID NO: 3941723 - DNA, 16 bp, Homo sapiens
ctggggcctgtactgc

SEQ ID NO: 3941724 - DNA, 19 bp, Homo sapiens
ctggggctcctttctccag

SEQ ID NO: 3941725 - DNA, 20 bp, Homo sapiens
ctggggctcctttctccagc

SEQ ID NO: 3941726 - DNA, 20 bp, Homo sapiens
ctggggctctaacgcctgag

SEQ ID NO: 3941727 - DNA, 21 bp, Homo sapiens
ctggggctctaacgcctgagc

SEQ ID NO: 3941728 - DNA, 23 bp, Homo sapiens
ctggggctctaacgcctgagccc

SEQ ID NO: 3941729 - DNA, 15 bp, Homo sapiens
ctggggcttctcctg

SEQ ID NO: 3941730 - DNA, 18 bp, Homo sapiens
ctggggcttgcaagagga

SEQ ID NO: 3941731 - DNA, 14 bp, Homo sapiens
ctgggggaagccct

SEQ ID NO: 3941732 - DNA, 13 bp, Homo sapiens
ctgggggcagtga

SEQ ID NO: 3941733 - DNA, 12 bp, Homo sapiens
ctgggggccagc

SEQ ID NO: 3941734 - DNA, 18 bp, Homo sapiens
ctgggggccagctggtgc

SEQ ID NO: 3941735 - DNA, 14 bp, Homo sapiens
ctgggggcctggct

SEQ ID NO: 3941736 - DNA, 17 bp, Homo sapiens
ctgggggcctggctggc

SEQ ID NO: 3941737 - DNA, 19 bp, Homo sapiens
ctgggggcgggggagccaa

SEQ ID NO: 3941738 - DNA, 21 bp, Homo sapiens
ctggggtgacccggcaccccc

SEQ ID NO: 3941739 - DNA, 13 bp, Homo sapiens
ctggggttcagcc

SEQ ID NO: 3941740 - DNA, 17 bp, Homo sapiens
ctggggttcagcccctc

SEQ ID NO: 3941741 - DNA, 20 bp, Homo sapiens
ctggggttcagcccctcctc

SEQ ID NO: 3941742 - DNA, 23 bp, Homo sapiens
ctggggttcagcccctcctctgc

SEQ ID NO: 3941743 - DNA, 18 bp, Homo sapiens
ctgggtccctcggagctg

SEQ ID NO: 3941744 - DNA, 18 bp, Homo sapiens
ctgggtccttgcacccct

SEQ ID NO: 3941745 - DNA, 16 bp, Homo sapiens
ctgggtgagaatcctg

SEQ ID NO: 3941746 - DNA, 15 bp, Homo sapiens
ctgggtgccattccc

SEQ ID NO: 3941747 - DNA, 16 bp, Homo sapiens
ctgggtggcctcggga

SEQ ID NO: 3941748 - DNA, 19 bp, Homo sapiens
ctgggtggcctcgggacac

SEQ ID NO: 3941749 - DNA, 19 bp, Homo sapiens
ctgggtggctactctgtgc

SEQ ID NO: 3941750 - DNA, 23 bp, Homo sapiens
ctgggttatttttgtccctgctc

SEQ ID NO: 3941751 - DNA, 17 bp, Homo sapiens
ctgggttcattccccgg

SEQ ID NO: 3941752 - DNA, 12 bp, Homo sapiens
ctgggttttcta

SEQ ID NO: 3941753 - DNA, 19 bp, Homo sapiens
ctgggttttctaactgtaa

SEQ ID NO: 3941754 - DNA, 21 bp, Homo sapiens
ctgggttttctaactgtaaat

SEQ ID NO: 3941755 - DNA, 21 bp, Homo sapiens
ctggtaatttgtatctgaagg

SEQ ID NO: 3941756 - DNA, 22 bp, Homo sapiens
ctggtaatttgtatctgaagga

SEQ ID NO: 3941757 - DNA, 15 bp, Homo sapiens
ctggtacaatccttt

SEQ ID NO: 3941758 - DNA, 17 bp, Homo sapiens
ctggtacagcagggtct

SEQ ID NO: 3941759 - DNA, 22 bp, Homo sapiens
ctggtatgaacttgaggacaca

SEQ ID NO: 3941760 - DNA, 18 bp, Homo sapiens
ctggtcacaggactctgc

SEQ ID NO: 3941761 - DNA, 19 bp, Homo sapiens
ctggtcacaggactctgcc

SEQ ID NO: 3941762 - DNA, 20 bp, Homo sapiens
ctggtcacaggactctgcct

SEQ ID NO: 3941763 - DNA, 21 bp, Homo sapiens
ctggtcacaggactctgcctc

SEQ ID NO: 3941764 - DNA, 23 bp, Homo sapiens
ctggtccctcgtccacaggggca

SEQ ID NO: 3941765 - DNA, 21 bp, Homo sapiens
ctggtcctgagggtccccacc

SEQ ID NO: 3941766 - DNA, 14 bp, Homo sapiens
ctggtcctgtgtgc

SEQ ID NO: 3941767 - DNA, 14 bp, Homo sapiens
ctggtctaggagct

SEQ ID NO: 3941768 - DNA, 20 bp, Homo sapiens
ctggtctgatgacttgctta

SEQ ID NO: 3941769 - DNA, 21 bp, Homo sapiens
ctggtctgtgctgccctgctc

SEQ ID NO: 3941770 - DNA, 16 bp, Homo sapiens
ctggtcttcactgcca

SEQ ID NO: 3941771 - DNA, 17 bp, Homo sapiens
ctggtcttttgggagtg

SEQ ID NO: 3941772 - DNA, 16 bp, Homo sapiens
ctggtgaggcccagcc

SEQ ID NO: 3941773 - DNA, 17 bp, Homo sapiens
ctggtgaggcccagcct

SEQ ID NO: 3941774 - DNA, 19 bp, Homo sapiens
ctggtgaggcccagcctgt

SEQ ID NO: 3941775 - DNA, 21 bp, Homo sapiens
ctggtgatcacgtggtcacgg

SEQ ID NO: 3941776 - DNA, 19 bp, Homo sapiens
ctggtgcactggccccacc

SEQ ID NO: 3941777 - DNA, 23 bp, Homo sapiens
ctggtgcctatttattcattcag

SEQ ID NO: 3941778 - DNA, 22 bp, Homo sapiens
ctggtgctataggctggagaag

SEQ ID NO: 3941779 - DNA, 23 bp, Homo sapiens
ctggtgctataggctggagaagc

SEQ ID NO: 3941780 - DNA, 20 bp, Homo sapiens
ctggtggcatcgtagaagag

SEQ ID NO: 3941781 - DNA, 15 bp, Homo sapiens
ctggtggggcagctc

SEQ ID NO: 3941782 - DNA, 14 bp, Homo sapiens
ctggtggtgctttt

SEQ ID NO: 3941783 - DNA, 20 bp, Homo sapiens
ctggtgtagctcctctgctg

SEQ ID NO: 3941784 - DNA, 20 bp, Homo sapiens
ctggtgtcattgctgtagga

SEQ ID NO: 3941785 - DNA, 15 bp, Homo sapiens
ctggtgtgaggctgg

SEQ ID NO: 3941786 - DNA, 23 bp, Homo sapiens
ctggtgtgaggctgggccagcct

SEQ ID NO: 3941787 - DNA, 22 bp, Homo sapiens
ctggttaattccataaccccag

SEQ ID NO: 3941788 - DNA, 14 bp, Homo sapiens
ctggttactctggt

SEQ ID NO: 3941789 - DNA, 16 bp, Homo sapiens
ctggttcaagcgattc

SEQ ID NO: 3941790 - DNA, 22 bp, Homo sapiens
ctggttgttgcaccatctgctt

SEQ ID NO: 3941791 - DNA, 23 bp, Homo sapiens
ctggtttcatttctactgtgact

SEQ ID NO: 3941792 - DNA, 14 bp, Homo sapiens
ctggtttctgttct

SEQ ID NO: 3941793 - DNA, 14 bp, Homo sapiens
ctgtaaactataaa

SEQ ID NO: 3941794 - DNA, 16 bp, Homo sapiens
ctgtaaatacatgtgt

SEQ ID NO: 3941795 - DNA, 17 bp, Homo sapiens
ctgtaaatacatgtgtg

SEQ ID NO: 3941796 - DNA, 21 bp, Homo sapiens
ctgtaaatatgtttgtgcctt

SEQ ID NO: 3941797 - DNA, 15 bp, Homo sapiens
ctgtcccacctcttc

SEQ ID NO: 3941798 - DNA, 23 bp, Homo sapiens
ctgtcccacctcttctcttcctg

SEQ ID NO: 3941799 - DNA, 11 bp, Homo sapiens
ctgtcccagag

SEQ ID NO: 3941800 - DNA, 13 bp, Homo sapiens
ctgtcccagaggt

SEQ ID NO: 3941801 - DNA, 22 bp, Homo sapiens
ctgtcccagaggttatctgcct

SEQ ID NO: 3941802 - DNA, 22 bp, Homo sapiens
ctgtccccctgagatcagagtc

SEQ ID NO: 3941803 - DNA, 14 bp, Homo sapiens
ctgtcccgccttcc

SEQ ID NO: 3941804 - DNA, 15 bp, Homo sapiens
ctgtcccgccttcct

SEQ ID NO: 3941805 - DNA, 21 bp, Homo sapiens
ctgtcccgccttcctcctcca

SEQ ID NO: 3941806 - DNA, 12 bp, Homo sapiens
ctgtccctaccc

SEQ ID NO: 3941807 - DNA, 14 bp, Homo sapiens
ctgtccctacccac

SEQ ID NO: 3941808 - DNA, 15 bp, Homo sapiens
ctgtccctacccact

SEQ ID NO: 3941809 - DNA, 16 bp, Homo sapiens
ctgtccctacccactc

SEQ ID NO: 3941810 - DNA, 18 bp, Homo sapiens
ctgtcctctcgagcccag

SEQ ID NO: 3941811 - DNA, 19 bp, Homo sapiens
ctgtcctctcgagcccaga

SEQ ID NO: 3941812 - DNA, 16 bp, Homo sapiens
ctgtcctggctgctct

SEQ ID NO: 3941813 - DNA, 14 bp, Homo sapiens
ctgtcctggtacag

SEQ ID NO: 3941814 - DNA, 19 bp, Homo sapiens
ctgtcctggtacagcaggg

SEQ ID NO: 3941815 - DNA, 14 bp, Homo sapiens
ctgtcgagacactt

SEQ ID NO: 3941816 - DNA, 15 bp, Homo sapiens
ctgtcgccccaggcc

SEQ ID NO: 3941817 - DNA, 16 bp, Homo sapiens
ctgtcgccccaggccc

SEQ ID NO: 3941818 - DNA, 17 bp, Homo sapiens
ctgtcgccccaggccct

SEQ ID NO: 3941819 - DNA, 20 bp, Homo sapiens
ctgtcgccccaggccctccc

SEQ ID NO: 3941820 - DNA, 13 bp, Homo sapiens
ctgtcgctgcttc

SEQ ID NO: 3941821 - DNA, 17 bp, Homo sapiens
ctgtcgctgcttcgtgg

SEQ ID NO: 3941822 - DNA, 21 bp, Homo sapiens
ctgtcgtgtttacaaaaggca

SEQ ID NO: 3941823 - DNA, 18 bp, Homo sapiens
ctgtctcaagagggcact

SEQ ID NO: 3941824 - DNA, 20 bp, Homo sapiens
ctgtctcaagagggcactgg

SEQ ID NO: 3941825 - DNA, 21 bp, Homo sapiens
ctgtctcaagagggcactggt

SEQ ID NO: 3941826 - DNA, 17 bp, Homo sapiens
ctgtctcgagcgccctg

SEQ ID NO: 3941827 - DNA, 20 bp, Homo sapiens
ctgtctcgagcgccctgcag

SEQ ID NO: 3941828 - DNA, 21 bp, Homo sapiens
ctgtctcgagcgccctgcaga

SEQ ID NO: 3941829 - DNA, 22 bp, Homo sapiens
ctgtctcgagcgccctgcagac

SEQ ID NO: 3941830 - DNA, 21 bp, Homo sapiens
ctgtctctcttgctttgttct

SEQ ID NO: 3941831 - DNA, 14 bp, Homo sapiens
ctgtctctgcctgc

SEQ ID NO: 3941832 - DNA, 23 bp, Homo sapiens
ctgtctggtgtagctcctctgct

SEQ ID NO: 3941833 - DNA, 17 bp, Homo sapiens
ctgtctggttttaacaa

SEQ ID NO: 3941834 - DNA, 14 bp, Homo sapiens
ctgtctgtacctaa

SEQ ID NO: 3941835 - DNA, 22 bp, Homo sapiens
ctgtctgtcaccagctatctgt

SEQ ID NO: 3941836 - DNA, 15 bp, Homo sapiens
ctgtctgtctgtccc

SEQ ID NO: 3941837 - DNA, 16 bp, Homo sapiens
ctgtctgtctgtccca

SEQ ID NO: 3941838 - DNA, 15 bp, Homo sapiens
ctgtctgtctgtctg

SEQ ID NO: 3941839 - DNA, 18 bp, Homo sapiens
ctgtcttcacaacagatt

SEQ ID NO: 3941840 - DNA, 13 bp, Homo sapiens
ctgtcttctctca

SEQ ID NO: 3941841 - DNA, 18 bp, Homo sapiens
ctgtgaaaatgaggagga

SEQ ID NO: 3941842 - DNA, 17 bp, Homo sapiens
ctgtgaaagtatgtgat

SEQ ID NO: 3941843 - DNA, 14 bp, Homo sapiens
ctgtgaacccagga

SEQ ID NO: 3941844 - DNA, 14 bp, Homo sapiens
ctgtgaacctggag

SEQ ID NO: 3941845 - DNA, 15 bp, Homo sapiens
ctgtgaattgagctg

SEQ ID NO: 3941846 - DNA, 19 bp, Homo sapiens
ctgtgaattgagctgcaga

SEQ ID NO: 3941847 - DNA, 21 bp, Homo sapiens
ctgtgaattgagctgcagaaa

SEQ ID NO: 3941848 - DNA, 17 bp, Homo sapiens
ctgtgaccccaccttga

SEQ ID NO: 3941849 - DNA, 18 bp, Homo sapiens
ctgtgacctgctgagctc

SEQ ID NO: 3941850 - DNA, 20 bp, Homo sapiens
ctgtgacctgctgagctctg

SEQ ID NO: 3941851 - DNA, 22 bp, Homo sapiens
ctgtgacctgctgagctctgag

SEQ ID NO: 3941852 - DNA, 22 bp, Homo sapiens
ctgtgacttcagctctgtttta

SEQ ID NO: 3941853 - DNA, 15 bp, Homo sapiens
ctgtgagcaagaagt

SEQ ID NO: 3941854 - DNA, 14 bp, Homo sapiens
ctgtgagcccctgg

SEQ ID NO: 3941855 - DNA, 20 bp, Homo sapiens
ctgtgaggaaagcacacagt

SEQ ID NO: 3941856 - DNA, 16 bp, Homo sapiens
ctgtgaggggaaggcc

SEQ ID NO: 3941857 - DNA, 13 bp, Homo sapiens
ctgtgattaactt

SEQ ID NO: 3941858 - DNA, 18 bp, Homo sapiens
ctgtgattaacttgctta

SEQ ID NO: 3941859 - DNA, 22 bp, Homo sapiens
ctgtgattgggcgtagaagtgg

SEQ ID NO: 3941860 - DNA, 19 bp, Homo sapiens
ctgtgcaccttacattcct

SEQ ID NO: 3941861 - DNA, 17 bp, Homo sapiens
ctgtgcacggccagctg

SEQ ID NO: 3941862 - DNA, 21 bp, Homo sapiens
ctgtgcacggccagctgcatc

SEQ ID NO: 3941863 - DNA, 15 bp, Homo sapiens
ctgtgcacggtggac

SEQ ID NO: 3941864 - DNA, 16 bp, Homo sapiens
ctgtgcactagcctgt

SEQ ID NO: 3941865 - DNA, 18 bp, Homo sapiens
ctgtgcagcagcccagct

SEQ ID NO: 3941866 - DNA, 19 bp, Homo sapiens
ctgtgcagtcccgtggagg

SEQ ID NO: 3941867 - DNA, 21 bp, Homo sapiens
ctgtgcagtcccgtggagggt

SEQ ID NO: 3941868 - DNA, 15 bp, Homo sapiens
ctgtgccagagcctg

SEQ ID NO: 3941869 - DNA, 19 bp, Homo sapiens
ctgtgccagagcctggggc

SEQ ID NO: 3941870 - DNA, 18 bp, Homo sapiens
ctgtgcccacatcccagg

SEQ ID NO: 3941871 - DNA, 22 bp, Homo sapiens
ctgtgcccacatcccaggcttc

SEQ ID NO: 3941872 - DNA, 23 bp, Homo sapiens
ctgtgcccacatcccaggcttca

SEQ ID NO: 3941873 - DNA, 15 bp, Homo sapiens
ctgtgccctgccttc

SEQ ID NO: 3941874 - DNA, 17 bp, Homo sapiens
ctgtgcctcgctcccca

SEQ ID NO: 3941875 - DNA, 23 bp, Homo sapiens
ctgtgcctcgctccccactctgc

SEQ ID NO: 3941876 - DNA, 18 bp, Homo sapiens
ctgtgcctgctagagcaa

SEQ ID NO: 3941877 - DNA, 21 bp, Homo sapiens
ctgtgcctgctagagcaaccc

SEQ ID NO: 3941878 - DNA, 12 bp, Homo sapiens
ctgtgcctttgg

SEQ ID NO: 3941879 - DNA, 24 bp, Homo sapiens
ctgtgctaaagaagccctgctggg

SEQ ID NO: 3941880 - DNA, 18 bp, Homo sapiens
ctgtgctactttgccttt

SEQ ID NO: 3941881 - DNA, 16 bp, Homo sapiens
ctgtgctctcaccagc

SEQ ID NO: 3941882 - DNA, 15 bp, Homo sapiens
ctgtgctgaggactc

SEQ ID NO: 3941883 - DNA, 21 bp, Homo sapiens
ctgttggcctcgcctgggccc

SEQ ID NO: 3941884 - DNA, 19 bp, Homo sapiens
ctgttgtaaatgaccaaga

SEQ ID NO: 3941885 - DNA, 21 bp, Homo sapiens
ctgttgtagaataataataaa

SEQ ID NO: 3941886 - DNA, 23 bp, Homo sapiens
ctgttgttgaggtggtggtagtg

SEQ ID NO: 3941887 - DNA, 16 bp, Homo sapiens
ctgtttaatatttaaa

SEQ ID NO: 3941888 - DNA, 15 bp, Homo sapiens
ctgtttatttattca

SEQ ID NO: 3941889 - DNA, 17 bp, Homo sapiens
ctgtttatttattcact

SEQ ID NO: 3941890 - DNA, 14 bp, Homo sapiens
ctgtttcaaactga

SEQ ID NO: 3941891 - DNA, 21 bp, Homo sapiens
ctgtttccataggaatcatgt

SEQ ID NO: 3941892 - DNA, 13 bp, Homo sapiens
ctgtttccatggg

SEQ ID NO: 3941893 - DNA, 14 bp, Homo sapiens
ctgttttatactgt

SEQ ID NO: 3941894 - DNA, 13 bp, Homo sapiens
ctgttttccacac

SEQ ID NO: 3941895 - DNA, 20 bp, Homo sapiens
ctgttttgtcctttgagaaa

SEQ ID NO: 3941896 - DNA, 21 bp, Homo sapiens
ctgtttttctgggtggcctcg

SEQ ID NO: 3941897 - DNA, 22 bp, Homo sapiens
cttaaaaggagagaagaaagtg

SEQ ID NO: 3941898 - DNA, 19 bp, Homo sapiens
cttaaaataacttatatca

SEQ ID NO: 3941899 - DNA, 20 bp, Homo sapiens
cttaaaatacggtacctggc

SEQ ID NO: 3941900 - DNA, 12 bp, Homo sapiens
cttaaagaaagt

SEQ ID NO: 3941901 - DNA, 13 bp, Homo sapiens
cttaaataaattc

SEQ ID NO: 3941902 - DNA, 14 bp, Homo sapiens
cttaaataaattca

SEQ ID NO: 3941903 - DNA, 16 bp, Homo sapiens
cttaaatgacagtgaa

SEQ ID NO: 3941904 - DNA, 16 bp, Homo sapiens
cttaaatttttgtcat

SEQ ID NO: 3941905 - DNA, 18 bp, Homo sapiens
cttaacctttccgctgtc

SEQ ID NO: 3941906 - DNA, 12 bp, Homo sapiens
cttaagagaaat

SEQ ID NO: 3941907 - DNA, 18 bp, Homo sapiens
cttaagatttctcctgac

SEQ ID NO: 3941908 - DNA, 17 bp, Homo sapiens
cttaataaattcagata

SEQ ID NO: 3941909 - DNA, 20 bp, Homo sapiens
cttaatcaggtcctcagaga

SEQ ID NO: 3941910 - DNA, 12 bp, Homo sapiens
cttaatgtttat

SEQ ID NO: 3941911 - DNA, 17 bp, Homo sapiens
cttaattaaaagaatat

SEQ ID NO: 3941912 - DNA, 18 bp, Homo sapiens
cttacaaattctacagca

SEQ ID NO: 3941913 - DNA, 23 bp, Homo sapiens
cttacacttggagcccgtgcagt

SEQ ID NO: 3941914 - DNA, 21 bp, Homo sapiens
cttacaggtatcaggcacagg

SEQ ID NO: 3941915 - DNA, 20 bp, Homo sapiens
cttacattagcagtttgctt

SEQ ID NO: 3941916 - DNA, 12 bp, Homo sapiens
cttacattccta

SEQ ID NO: 3941917 - DNA, 16 bp, Homo sapiens
cttaccgtagcctccg

SEQ ID NO: 3941918 - DNA, 15 bp, Homo sapiens
cttacctcctgccca

SEQ ID NO: 3941919 - DNA, 20 bp, Homo sapiens
cttacctcctgcccaggaga

SEQ ID NO: 3941920 - DNA, 12 bp, Homo sapiens
cttacctgacac

SEQ ID NO: 3941921 - DNA, 11 bp, Homo sapiens
cttacctgacg

SEQ ID NO: 3941922 - DNA, 17 bp, Homo sapiens
cttactaatgtgcccca

SEQ ID NO: 3941923 - DNA, 23 bp, Homo sapiens
cttactaatgtgccccatgtcca

SEQ ID NO: 3941924 - DNA, 16 bp, Homo sapiens
cttactacttcttgga

SEQ ID NO: 3941925 - DNA, 15 bp, Homo sapiens
cttactcccaggcac

SEQ ID NO: 3941926 - DNA, 16 bp, Homo sapiens
cttactcctgtgggag

SEQ ID NO: 3941927 - DNA, 13 bp, Homo sapiens
cttactctgagcc

SEQ ID NO: 3941928 - DNA, 22 bp, Homo sapiens
cttactctgagcccaggccgtt

SEQ ID NO: 3941929 - DNA, 23 bp, Homo sapiens
cttacttaaacccagctcccttc

SEQ ID NO: 3941930 - DNA, 14 bp, Homo sapiens
cttacttggaactg

SEQ ID NO: 3941931 - DNA, 23 bp, Homo sapiens
cttagaaatcattgtagaaacac

SEQ ID NO: 3941932 - DNA, 16 bp, Homo sapiens
cttagaaattgcattt

SEQ ID NO: 3941933 - DNA, 21 bp, Homo sapiens
cttagaagtggaccaggacag

SEQ ID NO: 3941934 - DNA, 16 bp, Homo sapiens
cttagaataaaattgt

SEQ ID NO: 3941935 - DNA, 17 bp, Homo sapiens
cttagaataaaattgta

SEQ ID NO: 3941936 - DNA, 20 bp, Homo sapiens
cttagacttcgactcaggat

SEQ ID NO: 3941937 - DNA, 20 bp, Homo sapiens
cttagattagctctggacca

SEQ ID NO: 3941938 - DNA, 15 bp, Homo sapiens
cttagcccaagaggt

SEQ ID NO: 3941939 - DNA, 17 bp, Homo sapiens
cttagcccaagaggtct

SEQ ID NO: 3941940 - DNA, 22 bp, Homo sapiens
cttagcctggagcacctttcct

SEQ ID NO: 3941941 - DNA, 17 bp, Homo sapiens
cttagccttgtgccctg

SEQ ID NO: 3941942 - DNA, 20 bp, Homo sapiens
cttagctgaacaatgaatgc

SEQ ID NO: 3941943 - DNA, 17 bp, Homo sapiens
cttagctgtctgctcag

SEQ ID NO: 3941944 - DNA, 19 bp, Homo sapiens
cttaggaaaatgcttctgt

SEQ ID NO: 3941945 - DNA, 18 bp, Homo sapiens
cttaggagcagagctctg

SEQ ID NO: 3941946 - DNA, 14 bp, Homo sapiens
cttaggtgccaggc

SEQ ID NO: 3941947 - DNA, 15 bp, Homo sapiens
cttaggtgccaggct

SEQ ID NO: 3941948 - DNA, 22 bp, Homo sapiens
cttagtccgcaagttcagggaa

SEQ ID NO: 3941949 - DNA, 13 bp, Homo sapiens
cttagtggctttt

SEQ ID NO: 3941950 - DNA, 23 bp, Homo sapiens
cttagttctcactgtctcctggt

SEQ ID NO: 3941951 - DNA, 12 bp, Homo sapiens
cttataaatgtg

SEQ ID NO: 3941952 - DNA, 13 bp, Homo sapiens
cttataccaaagg

SEQ ID NO: 3941953 - DNA, 12 bp, Homo sapiens
cttatccaggac

SEQ ID NO: 3941954 - DNA, 16 bp, Homo sapiens
cttatcccttcttttt

SEQ ID NO: 3941955 - DNA, 13 bp, Homo sapiens
cttatgagatggg

SEQ ID NO: 3941956 - DNA, 15 bp, Homo sapiens
cttatgtaattattt

SEQ ID NO: 3941957 - DNA, 21 bp, Homo sapiens
cttattcatgctttctccttt

SEQ ID NO: 3941958 - DNA, 23 bp, Homo sapiens
cttattcatgctttctccttttt

SEQ ID NO: 3941959 - DNA, 21 bp, Homo sapiens
cttattcccaaactacagaat

SEQ ID NO: 3941960 - DNA, 15 bp, Homo sapiens
cttattctcctccct

SEQ ID NO: 3941961 - DNA, 15 bp, Homo sapiens
cttatttcatttctt

SEQ ID NO: 3941962 - DNA, 14 bp, Homo sapiens
cttatttccctcat

SEQ ID NO: 3941963 - DNA, 17 bp, Homo sapiens
cttatttccctcatctt

SEQ ID NO: 3941964 - DNA, 12 bp, Homo sapiens
cttattttcaag

SEQ ID NO: 3941965 - DNA, 16 bp, Homo sapiens
cttcaaatatagagat

SEQ ID NO: 3941966 - DNA, 16 bp, Homo sapiens
cttcaaccattcccca

SEQ ID NO: 3941967 - DNA, 20 bp, Homo sapiens
cttcaaccattccccatggg

SEQ ID NO: 3941968 - DNA, 19 bp, Homo sapiens
cttcaagtgatatatgtat

SEQ ID NO: 3941969 - DNA, 20 bp, Homo sapiens
cttcaagtgatatatgtatt

SEQ ID NO: 3941970 - DNA, 17 bp, Homo sapiens
cttccccttttgcctgg

SEQ ID NO: 3941971 - DNA, 15 bp, Homo sapiens
cttcccgctcagccc

SEQ ID NO: 3941972 - DNA, 16 bp, Homo sapiens
cttcccgctcagccct

SEQ ID NO: 3941973 - DNA, 23 bp, Homo sapiens
cttcccgctcagccctccctgcc

SEQ ID NO: 3941974 - DNA, 16 bp, Homo sapiens
cttccctaggctgagc

SEQ ID NO: 3941975 - DNA, 11 bp, Homo sapiens
cttccctccaa

SEQ ID NO: 3941976 - DNA, 14 bp, Homo sapiens
cttccctctttccc

SEQ ID NO: 3941977 - DNA, 22 bp, Homo sapiens
cttccctctttccccacctctt

SEQ ID NO: 3941978 - DNA, 21 bp, Homo sapiens
cttccctgggaactcatcctg

SEQ ID NO: 3941979 - DNA, 22 bp, Homo sapiens
cttccctgggaactcatcctgt

SEQ ID NO: 3941980 - DNA, 15 bp, Homo sapiens
cttccctgggaaggc

SEQ ID NO: 3941981 - DNA, 22 bp, Homo sapiens
cttccctgtatgattccttgat

SEQ ID NO: 3941982 - DNA, 18 bp, Homo sapiens
cttccctgttttaaatta

SEQ ID NO: 3941983 - DNA, 16 bp, Homo sapiens
cttcccttctctcctt

SEQ ID NO: 3941984 - DNA, 18 bp, Homo sapiens
cttcccttctctccttcc

SEQ ID NO: 3941985 - DNA, 16 bp, Homo sapiens
cttccgctcctttacc

SEQ ID NO: 3941986 - DNA, 17 bp, Homo sapiens
cttcctagttttctcct

SEQ ID NO: 3941987 - DNA, 19 bp, Homo sapiens
cttcctccgtccacccagg

SEQ ID NO: 3941988 - DNA, 20 bp, Homo sapiens
cttcctccgtccacccaggc

SEQ ID NO: 3941989 - DNA, 21 bp, Homo sapiens
cttcctccgtccacccaggct

SEQ ID NO: 3941990 - DNA, 16 bp, Homo sapiens
cttcctcctccacagt

SEQ ID NO: 3941991 - DNA, 18 bp, Homo sapiens
cttcctcctccacagtgc

SEQ ID NO: 3941992 - DNA, 11 bp, Homo sapiens
cttcctcctga

SEQ ID NO: 3941993 - DNA, 14 bp, Homo sapiens
cttcctcctggttc

SEQ ID NO: 3941994 - DNA, 18 bp, Homo sapiens
cttcctgccaccagtcac

SEQ ID NO: 3941995 - DNA, 14 bp, Homo sapiens
cttcctggacagct

SEQ ID NO: 3941996 - DNA, 15 bp, Homo sapiens
cttcctggacagctg

SEQ ID NO: 3941997 - DNA, 14 bp, Homo sapiens
cttcctggcctcac

SEQ ID NO: 3941998 - DNA, 20 bp, Homo sapiens
cttcctggggcatctggcga

SEQ ID NO: 3941999 - DNA, 21 bp, Homo sapiens
cttcctggggccccgctggga

SEQ ID NO: 3942000 - DNA, 22 bp, Homo sapiens
cttcctggtgaggcccagcctg

SEQ ID NO: 3942001 - DNA, 16 bp, Homo sapiens
cttcctgtccactctc

SEQ ID NO: 3942002 - DNA, 16 bp, Homo sapiens
cttcctgtgacttcag

SEQ ID NO: 3942003 - DNA, 16 bp, Homo sapiens
cttcctgtgggagcag

SEQ ID NO: 3942004 - DNA, 20 bp, Homo sapiens
cttcctgtgggccaggagct

SEQ ID NO: 3942005 - DNA, 13 bp, Homo sapiens
cttccttccctgg

SEQ ID NO: 3942006 - DNA, 14 bp, Homo sapiens
cttccttctgcacc

SEQ ID NO: 3942007 - DNA, 18 bp, Homo sapiens
cttccttctttctcttcc

SEQ ID NO: 3942008 - DNA, 18 bp, Homo sapiens
cttcctttaggtctggtt

SEQ ID NO: 3942009 - DNA, 14 bp, Homo sapiens
cttcctttcctctg

SEQ ID NO: 3942010 - DNA, 17 bp, Homo sapiens
cttcctttcctctgcag

SEQ ID NO: 3942011 - DNA, 14 bp, Homo sapiens
cttcctttctaaat

SEQ ID NO: 3942012 - DNA, 18 bp, Homo sapiens
cttcgaccctttctctga

SEQ ID NO: 3942013 - DNA, 16 bp, Homo sapiens
cttcgactcaggatcc

SEQ ID NO: 3942014 - DNA, 13 bp, Homo sapiens
cttcgctgccagg

SEQ ID NO: 3942015 - DNA, 15 bp, Homo sapiens
cttcgctgccaggac

SEQ ID NO: 3942016 - DNA, 18 bp, Homo sapiens
cttcggggaactcctgga

SEQ ID NO: 3942017 - DNA, 21 bp, Homo sapiens
cttcggtgtttaaagtcaaca

SEQ ID NO: 3942018 - DNA, 22 bp, Homo sapiens
cttcgtgtctctcccaccccgg

SEQ ID NO: 3942019 - DNA, 20 bp, Homo sapiens
cttctaatatatttttatat

SEQ ID NO: 3942020 - DNA, 18 bp, Homo sapiens
cttctacaaccagagccc

SEQ ID NO: 3942021 - DNA, 17 bp, Homo sapiens
cttctagatctggaacc

SEQ ID NO: 3942022 - DNA, 15 bp, Homo sapiens
cttctatttaaaaaa

SEQ ID NO: 3942023 - DNA, 16 bp, Homo sapiens
cttctatttaaaaaat

SEQ ID NO: 3942024 - DNA, 19 bp, Homo sapiens
cttctatttaaaaaataaa

SEQ ID NO: 3942025 - DNA, 21 bp, Homo sapiens
cttctatttaaaaaataaaaa

SEQ ID NO: 3942026 - DNA, 22 bp, Homo sapiens
cttctatttaaaaaataaaaaa

SEQ ID NO: 3942027 - DNA, 21 bp, Homo sapiens
cttctcaaaagattgttttat

SEQ ID NO: 3942028 - DNA, 18 bp, Homo sapiens
cttctcaggacacaggcc

SEQ ID NO: 3942029 - DNA, 23 bp, Homo sapiens
cttctcaggacacaggcctgtgt

SEQ ID NO: 3942030 - DNA, 11 bp, Homo sapiens
cttctcagtgt

SEQ ID NO: 3942031 - DNA, 12 bp, Homo sapiens
cttctccaggct

SEQ ID NO: 3942032 - DNA, 13 bp, Homo sapiens
cttctccattcta

SEQ ID NO: 3942033 - DNA, 16 bp, Homo sapiens
cttctcctctcctagc

SEQ ID NO: 3942034 - DNA, 19 bp, Homo sapiens
cttctcctgacccagtccc

SEQ ID NO: 3942035 - DNA, 17 bp, Homo sapiens
cttctcctttcacaacc

SEQ ID NO: 3942036 - DNA, 22 bp, Homo sapiens
cttctcctttcacaaccttctg

SEQ ID NO: 3942037 - DNA, 11 bp, Homo sapiens
cttctctacag

SEQ ID NO: 3942038 - DNA, 13 bp, Homo sapiens
cttctctacagac

SEQ ID NO: 3942039 - DNA, 19 bp, Homo sapiens
cttctctattcctgaccct

SEQ ID NO: 3942040 - DNA, 14 bp, Homo sapiens
cttctcttcctgta

SEQ ID NO: 3942041 - DNA, 17 bp, Homo sapiens
cttctgaaacttcataa

SEQ ID NO: 3942042 - DNA, 19 bp, Homo sapiens
cttctgcaattgcttagga

SEQ ID NO: 3942043 - DNA, 14 bp, Homo sapiens
cttctgcacccaga

SEQ ID NO: 3942044 - DNA, 15 bp, Homo sapiens
cttctgcagcaactc

SEQ ID NO: 3942045 - DNA, 23 bp, Homo sapiens
cttctgcagcaactcccacgact

SEQ ID NO: 3942046 - DNA, 19 bp, Homo sapiens
cttctgccccagctttatc

SEQ ID NO: 3942047 - DNA, 13 bp, Homo sapiens
cttctgcttctcc

SEQ ID NO: 3942048 - DNA, 15 bp, Homo sapiens
cttctggaaggctgg

SEQ ID NO: 3942049 - DNA, 22 bp, Homo sapiens
cttctggaaggctggctgagtg

SEQ ID NO: 3942050 - DNA, 17 bp, Homo sapiens
cttctgggacctgtgtt

SEQ ID NO: 3942051 - DNA, 14 bp, Homo sapiens
cttctgtccaggac

SEQ ID NO: 3942052 - DNA, 23 bp, Homo sapiens
cttctgtccaggacatgatactg

SEQ ID NO: 3942053 - DNA, 18 bp, Homo sapiens
cttctgtcttcacaacag

SEQ ID NO: 3942054 - DNA, 18 bp, Homo sapiens
cttctgtgcactagcctg

SEQ ID NO: 3942055 - DNA, 22 bp, Homo sapiens
cttctgtggctcacagaaccct

SEQ ID NO: 3942056 - DNA, 13 bp, Homo sapiens
cttcttaaagagt

SEQ ID NO: 3942057 - DNA, 14 bp, Homo sapiens
cttgcctctctcag

SEQ ID NO: 3942058 - DNA, 17 bp, Homo sapiens
cttgcctctctcaggag

SEQ ID NO: 3942059 - DNA, 17 bp, Homo sapiens
cttgcctgaggctcaag

SEQ ID NO: 3942060 - DNA, 24 bp, Homo sapiens
cttgcctgaggctcaagaggccca

SEQ ID NO: 3942061 - DNA, 15 bp, Homo sapiens
cttgcctgcttttct

SEQ ID NO: 3942062 - DNA, 17 bp, Homo sapiens
cttgccttttaaaagaa

SEQ ID NO: 3942063 - DNA, 22 bp, Homo sapiens
cttgctcaccaagctgttccac

SEQ ID NO: 3942064 - DNA, 16 bp, Homo sapiens
cttgctcaggtgcaag

SEQ ID NO: 3942065 - DNA, 17 bp, Homo sapiens
cttgctcagtgcctcct

SEQ ID NO: 3942066 - DNA, 13 bp, Homo sapiens
cttgctccagggt

SEQ ID NO: 3942067 - DNA, 15 bp, Homo sapiens
cttgctcctccttct

SEQ ID NO: 3942068 - DNA, 15 bp, Homo sapiens
cttgctctctggcct

SEQ ID NO: 3942069 - DNA, 14 bp, Homo sapiens
cttgctctgcaggc

SEQ ID NO: 3942070 - DNA, 22 bp, Homo sapiens
cttgctggacggggactgggga

SEQ ID NO: 3942071 - DNA, 16 bp, Homo sapiens
cttgctggattaatgt

SEQ ID NO: 3942072 - DNA, 14 bp, Homo sapiens
cttgcttctgcagc

SEQ ID NO: 3942073 - DNA, 22 bp, Homo sapiens
cttgcttctgcagcaactccca

SEQ ID NO: 3942074 - DNA, 19 bp, Homo sapiens
cttgcttgccgagcctaat

SEQ ID NO: 3942075 - DNA, 13 bp, Homo sapiens
cttgctttgggct

SEQ ID NO: 3942076 - DNA, 23 bp, Homo sapiens
cttgctttgggctttgcaggctc

SEQ ID NO: 3942077 - DNA, 16 bp, Homo sapiens
cttggaaaaagaaaga

SEQ ID NO: 3942078 - DNA, 21 bp, Homo sapiens
cttggaaaaagaaagaaacac

SEQ ID NO: 3942079 - DNA, 18 bp, Homo sapiens
cttggaaagttcagccag

SEQ ID NO: 3942080 - DNA, 21 bp, Homo sapiens
cttggaagtcgtttcaggaca

SEQ ID NO: 3942081 - DNA, 15 bp, Homo sapiens
cttggacagtctgag

SEQ ID NO: 3942082 - DNA, 12 bp, Homo sapiens
cttggacctctg

SEQ ID NO: 3942083 - DNA, 19 bp, Homo sapiens
cttggacctctgctctgag

SEQ ID NO: 3942084 - DNA, 22 bp, Homo sapiens
cttggactattataatttaatg

SEQ ID NO: 3942085 - DNA, 15 bp, Homo sapiens
cttggactcctccca

SEQ ID NO: 3942086 - DNA, 16 bp, Homo sapiens
cttggactcctcccac

SEQ ID NO: 3942087 - DNA, 14 bp, Homo sapiens
cttggacttcctgg

SEQ ID NO: 3942088 - DNA, 17 bp, Homo sapiens
cttggacttcctggggc

SEQ ID NO: 3942089 - DNA, 23 bp, Homo sapiens
cttggacttcctggggccccgct

SEQ ID NO: 3942090 - DNA, 16 bp, Homo sapiens
cttggagagcagctgg

SEQ ID NO: 3942091 - DNA, 20 bp, Homo sapiens
cttggagagcagctggctct

SEQ ID NO: 3942092 - DNA, 20 bp, Homo sapiens
cttggagagggacgaagaaa

SEQ ID NO: 3942093 - DNA, 21 bp, Homo sapiens
cttggagagggacgaagaaag

SEQ ID NO: 3942094 - DNA, 15 bp, Homo sapiens
cttggagcccgtgca

SEQ ID NO: 3942095 - DNA, 22 bp, Homo sapiens
cttggataatgctgttgcctca

SEQ ID NO: 3942096 - DNA, 24 bp, Homo sapiens
cttggccgccatccgggacgcttc

SEQ ID NO: 3942097 - DNA, 11 bp, Homo sapiens
cttggccttgt

SEQ ID NO: 3942098 - DNA, 21 bp, Homo sapiens
cttggctgtgaggcccctgga

SEQ ID NO: 3942099 - DNA, 23 bp, Homo sapiens
cttggcttcctccgtccacccag

SEQ ID NO: 3942100 - DNA, 15 bp, Homo sapiens
cttggcttctgggac

SEQ ID NO: 3942101 - DNA, 18 bp, Homo sapiens
cttggcttctgggacctg

SEQ ID NO: 3942102 - DNA, 10 bp, Homo sapiens
cttgggaatg

SEQ ID NO: 3942103 - DNA, 17 bp, Homo sapiens
cttgggaggctgaggca

SEQ ID NO: 3942104 - DNA, 17 bp, Homo sapiens
cttgggcacccccagcc

SEQ ID NO: 3942105 - DNA, 17 bp, Homo sapiens
cttgggcatccacccag

SEQ ID NO: 3942106 - DNA, 17 bp, Homo sapiens
cttgggctactggcagc

SEQ ID NO: 3942107 - DNA, 18 bp, Homo sapiens
cttgggctactggcagct

SEQ ID NO: 3942108 - DNA, 19 bp, Homo sapiens
cttgggctactggcagctc

SEQ ID NO: 3942109 - DNA, 13 bp, Homo sapiens
cttgggctcctgg

SEQ ID NO: 3942110 - DNA, 21 bp, Homo sapiens
cttgggctcctggctgccagg

SEQ ID NO: 3942111 - DNA, 22 bp, Homo sapiens
cttgggctcctggctgccaggc

SEQ ID NO: 3942112 - DNA, 14 bp, Homo sapiens
cttggggagcagag

SEQ ID NO: 3942113 - DNA, 13 bp, Homo sapiens
cttggggcacagt

SEQ ID NO: 3942114 - DNA, 22 bp, Homo sapiens
cttggggggtgatgagggcagc

SEQ ID NO: 3942115 - DNA, 22 bp, Homo sapiens
cttggggggtttttactccagt

SEQ ID NO: 3942116 - DNA, 23 bp, Homo sapiens
cttggggggtttttactccagtg

SEQ ID NO: 3942117 - DNA, 23 bp, Homo sapiens
cttgggtcctgcaatctccaggg

SEQ ID NO: 3942118 - DNA, 16 bp, Homo sapiens
cttgggtcgccctacc

SEQ ID NO: 3942119 - DNA, 16 bp, Homo sapiens
cttggtaaattgtaaa

SEQ ID NO: 3942120 - DNA, 15 bp, Homo sapiens
cttggtcatgcttca

SEQ ID NO: 3942121 - DNA, 16 bp, Homo sapiens
cttggtccctggtccc

SEQ ID NO: 3942122 - DNA, 21 bp, Homo sapiens
cttggtggggctcgtggcctt

SEQ ID NO: 3942123 - DNA, 16 bp, Homo sapiens
cttggtgtccacctgg

SEQ ID NO: 3942124 - DNA, 16 bp, Homo sapiens
cttggttggctggcag

SEQ ID NO: 3942125 - DNA, 22 bp, Homo sapiens
cttggttggctggcagctgaga

SEQ ID NO: 3942126 - DNA, 17 bp, Homo sapiens
cttggtttggggagaaa

SEQ ID NO: 3942127 - DNA, 18 bp, Homo sapiens
cttggtttggggagaaat

SEQ ID NO: 3942128 - DNA, 18 bp, Homo sapiens
cttgtaaaaattaaaagt

SEQ ID NO: 3942129 - DNA, 13 bp, Homo sapiens
cttgtaaataaat

SEQ ID NO: 3942130 - DNA, 14 bp, Homo sapiens
cttgtaaataaata

SEQ ID NO: 3942131 - DNA, 13 bp, Homo sapiens
cttgtaaatacac

SEQ ID NO: 3942132 - DNA, 15 bp, Homo sapiens
cttgtaaatacacca

SEQ ID NO: 3942133 - DNA, 17 bp, Homo sapiens
cttgtaccccatccctt

SEQ ID NO: 3942134 - DNA, 16 bp, Homo sapiens
cttgtactatgttaat

SEQ ID NO: 3942135 - DNA, 13 bp, Homo sapiens
cttgtagccagcc

SEQ ID NO: 3942136 - DNA, 23 bp, Homo sapiens
cttgtataaatgtatatacacat

SEQ ID NO: 3942137 - DNA, 16 bp, Homo sapiens
cttgtatagtgtaaaa

SEQ ID NO: 3942138 - DNA, 17 bp, Homo sapiens
cttgtatagtgtaaaat

SEQ ID NO: 3942139 - DNA, 15 bp, Homo sapiens
cttgtatatacatat

SEQ ID NO: 3942140 - DNA, 13 bp, Homo sapiens
cttgtatattcca

SEQ ID NO: 3942141 - DNA, 23 bp, Homo sapiens
cttgtatattccaccattcacat

SEQ ID NO: 3942142 - DNA, 21 bp, Homo sapiens
cttgtatgaaagatggctgtg

SEQ ID NO: 3942143 - DNA, 22 bp, Homo sapiens
ctttccgtctccctaaaataaa

SEQ ID NO: 3942144 - DNA, 16 bp, Homo sapiens
ctttcctacaaaatgg

SEQ ID NO: 3942145 - DNA, 23 bp, Homo sapiens
ctttcctccaaactcctgcctgt

SEQ ID NO: 3942146 - DNA, 16 bp, Homo sapiens
ctttcctcgtgaagga

SEQ ID NO: 3942147 - DNA, 18 bp, Homo sapiens
ctttcctctccaattgta

SEQ ID NO: 3942148 - DNA, 22 bp, Homo sapiens
ctttcctctccaattgtaaaaa

SEQ ID NO: 3942149 - DNA, 13 bp, Homo sapiens
ctttcctcttccc

SEQ ID NO: 3942150 - DNA, 22 bp, Homo sapiens
ctttcctgatggtacaggaaag

SEQ ID NO: 3942151 - DNA, 16 bp, Homo sapiens
ctttccttccttccct

SEQ ID NO: 3942152 - DNA, 17 bp, Homo sapiens
ctttccttgtctctcat

SEQ ID NO: 3942153 - DNA, 17 bp, Homo sapiens
ctttctaatgtgtgaat

SEQ ID NO: 3942154 - DNA, 15 bp, Homo sapiens
ctttctattccaaag

SEQ ID NO: 3942155 - DNA, 16 bp, Homo sapiens
ctttctattgaaaaat

SEQ ID NO: 3942156 - DNA, 14 bp, Homo sapiens
ctttctccagccag

SEQ ID NO: 3942157 - DNA, 19 bp, Homo sapiens
ctttctcccccgacactgc

SEQ ID NO: 3942158 - DNA, 14 bp, Homo sapiens
ctttctccggggtc

SEQ ID NO: 3942159 - DNA, 17 bp, Homo sapiens
ctttctcgctggaatca

SEQ ID NO: 3942160 - DNA, 21 bp, Homo sapiens
ctttctcgtggtagaagccag

SEQ ID NO: 3942161 - DNA, 19 bp, Homo sapiens
ctttctctaaatatgatta

SEQ ID NO: 3942162 - DNA, 16 bp, Homo sapiens
ctttctctggctccag

SEQ ID NO: 3942163 - DNA, 17 bp, Homo sapiens
ctttctctggctccaga

SEQ ID NO: 3942164 - DNA, 19 bp, Homo sapiens
ctttctcttccctccttcc

SEQ ID NO: 3942165 - DNA, 22 bp, Homo sapiens
ctttctgacaagataaaggaag

SEQ ID NO: 3942166 - DNA, 22 bp, Homo sapiens
ctttctgagagttggctcaggc

SEQ ID NO: 3942167 - DNA, 16 bp, Homo sapiens
ctttctgttgccacaa

SEQ ID NO: 3942168 - DNA, 11 bp, Homo sapiens
ctttcttcctc

SEQ ID NO: 3942169 - DNA, 12 bp, Homo sapiens
ctttcttcctct

SEQ ID NO: 3942170 - DNA, 15 bp, Homo sapiens
ctttcttctatttta

SEQ ID NO: 3942171 - DNA, 18 bp, Homo sapiens
ctttcttttgattcttcc

SEQ ID NO: 3942172 - DNA, 16 bp, Homo sapiens
ctttctttttctggaa

SEQ ID NO: 3942173 - DNA, 17 bp, Homo sapiens
ctttctttttctgtctc

SEQ ID NO: 3942174 - DNA, 18 bp, Homo sapiens
ctttctttttctgtctct

SEQ ID NO: 3942175 - DNA, 19 bp, Homo sapiens
ctttctttttctgtctctc

SEQ ID NO: 3942176 - DNA, 23 bp, Homo sapiens
ctttgaatacccccagagacctt

SEQ ID NO: 3942177 - DNA, 23 bp, Homo sapiens
ctttgacatttccttctttgtct

SEQ ID NO: 3942178 - DNA, 19 bp, Homo sapiens
ctttgacgggaggcctcag

SEQ ID NO: 3942179 - DNA, 22 bp, Homo sapiens
ctttgacgggaggcctcagttc

SEQ ID NO: 3942180 - DNA, 14 bp, Homo sapiens
ctttgactcacctg

SEQ ID NO: 3942181 - DNA, 15 bp, Homo sapiens
ctttgagaaagaaat

SEQ ID NO: 3942182 - DNA, 21 bp, Homo sapiens
ctttgagaaaggattaagata

SEQ ID NO: 3942183 - DNA, 20 bp, Homo sapiens
ctttgagaatgtgattcctt

SEQ ID NO: 3942184 - DNA, 23 bp, Homo sapiens
ctttgagggacgatctttgaata

SEQ ID NO: 3942185 - DNA, 22 bp, Homo sapiens
ctttgatattttcaacgcagcc

SEQ ID NO: 3942186 - DNA, 19 bp, Homo sapiens
ctttgatgcatttccacac

SEQ ID NO: 3942187 - DNA, 14 bp, Homo sapiens
ctttgcactgaggg

SEQ ID NO: 3942188 - DNA, 16 bp, Homo sapiens
ctttgcactgagggcc

SEQ ID NO: 3942189 - DNA, 22 bp, Homo sapiens
ctttgcactgagggccacacta

SEQ ID NO: 3942190 - DNA, 22 bp, Homo sapiens
ctttgcagaccgcatagtcact

SEQ ID NO: 3942191 - DNA, 19 bp, Homo sapiens
ctttgcaggctctgggctc

SEQ ID NO: 3942192 - DNA, 23 bp, Homo sapiens
ctttgcaggctctgggctcaggg

SEQ ID NO: 3942193 - DNA, 11 bp, Homo sapiens
ctttgcctggt

SEQ ID NO: 3942194 - DNA, 14 bp, Homo sapiens
ctttgccttttgca

SEQ ID NO: 3942195 - DNA, 16 bp, Homo sapiens
ctttgctacaataaat

SEQ ID NO: 3942196 - DNA, 19 bp, Homo sapiens
ctttggaaaaatcttgggc

SEQ ID NO: 3942197 - DNA, 17 bp, Homo sapiens
ctttggaaacaggacca

SEQ ID NO: 3942198 - DNA, 11 bp, Homo sapiens
ctttggaagga

SEQ ID NO: 3942199 - DNA, 15 bp, Homo sapiens
ctttggaaggagtga

SEQ ID NO: 3942200 - DNA, 17 bp, Homo sapiens
ctttggaaggagtgaga

SEQ ID NO: 3942201 - DNA, 13 bp, Homo sapiens
ctttggaccctgt

SEQ ID NO: 3942202 - DNA, 15 bp, Homo sapiens
ctttgggaggccaag

SEQ ID NO: 3942203 - DNA, 18 bp, Homo sapiens
ctttgggaggccaaggca

SEQ ID NO: 3942204 - DNA, 19 bp, Homo sapiens
ctttgggaggccaaggcag

SEQ ID NO: 3942205 - DNA, 17 bp, Homo sapiens
ctttgggatcagcctcc

SEQ ID NO: 3942206 - DNA, 14 bp, Homo sapiens
ctttgggctgccct

SEQ ID NO: 3942207 - DNA, 23 bp, Homo sapiens
ctttggggagacggtgttgcaga

SEQ ID NO: 3942208 - DNA, 21 bp, Homo sapiens
ctttggggtcagccagggcca

SEQ ID NO: 3942209 - DNA, 21 bp, Homo sapiens
ctttgggtactactgctgcaa

SEQ ID NO: 3942210 - DNA, 16 bp, Homo sapiens
ctttgtaaaggtcaga

SEQ ID NO: 3942211 - DNA, 22 bp, Homo sapiens
ctttgtaatgtcaccaccttcc

SEQ ID NO: 3942212 - DNA, 18 bp, Homo sapiens
ctttgtcatctttcttct

SEQ ID NO: 3942213 - DNA, 23 bp, Homo sapiens
ctttgtgacaggaaagccctccc

SEQ ID NO: 3942214 - DNA, 19 bp, Homo sapiens
ctttgtgagagtgagctgt

SEQ ID NO: 3942215 - DNA, 18 bp, Homo sapiens
ctttgtgtagctttgctc

SEQ ID NO: 3942216 - DNA, 22 bp, Homo sapiens
ctttgtttgggccactgccagc

SEQ ID NO: 3942217 - DNA, 14 bp, Homo sapiens
ctttgttttgcact

SEQ ID NO: 3942218 - DNA, 14 bp, Homo sapiens
cttttaaaagaaaa

SEQ ID NO: 3942219 - DNA, 19 bp, Homo sapiens
cttttaaaagaaaaagtat

SEQ ID NO: 3942220 - DNA, 11 bp, Homo sapiens
cttttaaaatg

SEQ ID NO: 3942221 - DNA, 17 bp, Homo sapiens
cttttaaaatgaaatgt

SEQ ID NO: 3942222 - DNA, 13 bp, Homo sapiens
cttttaagaaaca

SEQ ID NO: 3942223 - DNA, 14 bp, Homo sapiens
cttttaataaaatt

SEQ ID NO: 3942224 - DNA, 14 bp, Homo sapiens
cttttaattcctag

SEQ ID NO: 3942225 - DNA, 14 bp, Homo sapiens
cttttactcctttg

SEQ ID NO: 3942226 - DNA, 21 bp, Homo sapiens
cttttagtaaagtcaaggaga

SEQ ID NO: 3942227 - DNA, 14 bp, Homo sapiens
cttttatagctatt

SEQ ID NO: 3942228 - DNA, 19 bp, Homo sapiens
cttttatagctattactgt

SEQ ID NO: 3942229 - DNA, 22 bp, Homo sapiens
gaaaagtagaattatatctaat

SEQ ID NO: 3942230 - DNA, 14 bp, Homo sapiens
gaaaagtgctgttt

SEQ ID NO: 3942231 - DNA, 18 bp, Homo sapiens
gaaaagtgcttagaaagt

SEQ ID NO: 3942232 - DNA, 20 bp, Homo sapiens
gaaaagtgcttagaaagtta

SEQ ID NO: 3942233 - DNA, 21 bp, Homo sapiens
gaaaagtgcttagaaagttat

SEQ ID NO: 3942234 - DNA, 19 bp, Homo sapiens
gaaaatataaatgcatgat

SEQ ID NO: 3942235 - DNA, 22 bp, Homo sapiens
gaaaatcagttatattctttaa

SEQ ID NO: 3942236 - DNA, 15 bp, Homo sapiens
gaaaatcctctggct

SEQ ID NO: 3942237 - DNA, 14 bp, Homo sapiens
gaaaatgaggagga

SEQ ID NO: 3942238 - DNA, 23 bp, Homo sapiens
gaaaatgagtttttatggggctg

SEQ ID NO: 3942239 - DNA, 16 bp, Homo sapiens
gaaaatgcaaaatgaa

SEQ ID NO: 3942240 - DNA, 14 bp, Homo sapiens
gaaaatgcttctgt

SEQ ID NO: 3942241 - DNA, 13 bp, Homo sapiens
gaaaatgtcctgt

SEQ ID NO: 3942242 - DNA, 23 bp, Homo sapiens
gaaaatgtctattcaaaatatca

SEQ ID NO: 3942243 - DNA, 14 bp, Homo sapiens
gaaaatgttcatca

SEQ ID NO: 3942244 - DNA, 17 bp, Homo sapiens
gaaaattattttaaaca

SEQ ID NO: 3942245 - DNA, 16 bp, Homo sapiens
gaaaattcatttcaca

SEQ ID NO: 3942246 - DNA, 22 bp, Homo sapiens
gaaacaagttattctcttcact

SEQ ID NO: 3942247 - DNA, 14 bp, Homo sapiens
gaaacagaaacaaa

SEQ ID NO: 3942248 - DNA, 16 bp, Homo sapiens
gaaacagagacaggcc

SEQ ID NO: 3942249 - DNA, 19 bp, Homo sapiens
gaaacagagacaggcccaa

SEQ ID NO: 3942250 - DNA, 15 bp, Homo sapiens
gaaacagagagagac

SEQ ID NO: 3942251 - DNA, 18 bp, Homo sapiens
gaaacagagagagacaga

SEQ ID NO: 3942252 - DNA, 14 bp, Homo sapiens
gaaacagataccat

SEQ ID NO: 3942253 - DNA, 22 bp, Homo sapiens
gaaacaggaccacaaaaatgaa

SEQ ID NO: 3942254 - DNA, 15 bp, Homo sapiens
gaaacagggcagtga

SEQ ID NO: 3942255 - DNA, 17 bp, Homo sapiens
gaaacagggcagtgaca

SEQ ID NO: 3942256 - DNA, 17 bp, Homo sapiens
gaaacaggggatcaaag

SEQ ID NO: 3942257 - DNA, 17 bp, Homo sapiens
gaaacatgacactgacc

SEQ ID NO: 3942258 - DNA, 14 bp, Homo sapiens
gaaaccagtatgga

SEQ ID NO: 3942259 - DNA, 15 bp, Homo sapiens
gaaaccagtatggaa

SEQ ID NO: 3942260 - DNA, 14 bp, Homo sapiens
gaaacccaaggaac

SEQ ID NO: 3942261 - DNA, 22 bp, Homo sapiens
gaaacccattaggcatgcctaa

SEQ ID NO: 3942262 - DNA, 13 bp, Homo sapiens
gaaaccttaatat

SEQ ID NO: 3942263 - DNA, 11 bp, Homo sapiens
gaaaccttgca

SEQ ID NO: 3942264 - DNA, 13 bp, Homo sapiens
gaaaccttgcagc

SEQ ID NO: 3942265 - DNA, 14 bp, Homo sapiens
gaaaccttgcagca

SEQ ID NO: 3942266 - DNA, 22 bp, Homo sapiens
gaaactcctgattttgtagtta

SEQ ID NO: 3942267 - DNA, 19 bp, Homo sapiens
gaaactccttttgctgtct

SEQ ID NO: 3942268 - DNA, 18 bp, Homo sapiens
gaaactgaaaactgtaaa

SEQ ID NO: 3942269 - DNA, 18 bp, Homo sapiens
gaaactgaggaattttct

SEQ ID NO: 3942270 - DNA, 22 bp, Homo sapiens
gaaactgaggaattttctttgt

SEQ ID NO: 3942271 - DNA, 24 bp, Homo sapiens
gaaactgaggagtagctgagagga

SEQ ID NO: 3942272 - DNA, 15 bp, Homo sapiens
gaaagaaataattgt

SEQ ID NO: 3942273 - DNA, 16 bp, Homo sapiens
gaaagaaataattgtt

SEQ ID NO: 3942274 - DNA, 15 bp, Homo sapiens
gaaagaagagacagg

SEQ ID NO: 3942275 - DNA, 21 bp, Homo sapiens
gaaagaattatttttgtgttt

SEQ ID NO: 3942276 - DNA, 17 bp, Homo sapiens
gaaagactattcaaaca

SEQ ID NO: 3942277 - DNA, 22 bp, Homo sapiens
gaaagactattcaaacagtctc

SEQ ID NO: 3942278 - DNA, 13 bp, Homo sapiens
gaaagagagtacc

SEQ ID NO: 3942279 - DNA, 23 bp, Homo sapiens
gaaagatggctgtgcctctgcct

SEQ ID NO: 3942280 - DNA, 14 bp, Homo sapiens
gaaagcaaagggct

SEQ ID NO: 3942281 - DNA, 16 bp, Homo sapiens
gaaagcacaggagaca

SEQ ID NO: 3942282 - DNA, 14 bp, Homo sapiens
gaaagcagcagcta

SEQ ID NO: 3942283 - DNA, 14 bp, Homo sapiens
gaaagccctccccc

SEQ ID NO: 3942284 - DNA, 15 bp, Homo sapiens
gaaagcctctggaaa

SEQ ID NO: 3942285 - DNA, 13 bp, Homo sapiens
gaaagctagagat

SEQ ID NO: 3942286 - DNA, 22 bp, Homo sapiens
gaaagctgatgatgtctcttgt

SEQ ID NO: 3942287 - DNA, 17 bp, Homo sapiens
gaaaggaaaaccaggga

SEQ ID NO: 3942288 - DNA, 18 bp, Homo sapiens
gaaaggaaaaccagggat

SEQ ID NO: 3942289 - DNA, 22 bp, Homo sapiens
gaaaggaagctccactgtcacc

SEQ ID NO: 3942290 - DNA, 22 bp, Homo sapiens
gaaaggagccggaccaagatgg

SEQ ID NO: 3942291 - DNA, 20 bp, Homo sapiens
gaaaggaggcatgcctctga

SEQ ID NO: 3942292 - DNA, 15 bp, Homo sapiens
gaaagggagggctct

SEQ ID NO: 3942293 - DNA, 16 bp, Homo sapiens
gaaagggagggctctg

SEQ ID NO: 3942294 - DNA, 18 bp, Homo sapiens
gaaagggagggctctgag

SEQ ID NO: 3942295 - DNA, 21 bp, Homo sapiens
gaaagggagggctctgaggcg

SEQ ID NO: 3942296 - DNA, 20 bp, Homo sapiens
gaaaggggcagtttaaagca

SEQ ID NO: 3942297 - DNA, 19 bp, Homo sapiens
gaaagtatgtgatatctga

SEQ ID NO: 3942298 - DNA, 19 bp, Homo sapiens
gaaagtcagctttcagagc

SEQ ID NO: 3942299 - DNA, 18 bp, Homo sapiens
gaaagtgaataaacttca

SEQ ID NO: 3942300 - DNA, 20 bp, Homo sapiens
gaaagtgaataaacttcagc

SEQ ID NO: 3942301 - DNA, 22 bp, Homo sapiens
gaaagtgcagaatcaacttgaa

SEQ ID NO: 3942302 - DNA, 23 bp, Homo sapiens
gaaagtggctcttctaacctcag

SEQ ID NO: 3942303 - DNA, 23 bp, Homo sapiens
gaaagtgggttcactagagctgg

SEQ ID NO: 3942304 - DNA, 24 bp, Homo sapiens
gaaagtgggttcactagagctggg

SEQ ID NO: 3942305 - DNA, 17 bp, Homo sapiens
gaaagtgtaaaatagaa

SEQ ID NO: 3942306 - DNA, 22 bp, Homo sapiens
gaaataaaaagcatgactattt

SEQ ID NO: 3942307 - DNA, 20 bp, Homo sapiens
gaaataaacctggagatgat

SEQ ID NO: 3942308 - DNA, 23 bp, Homo sapiens
gaaataaacctggagatgatgat

SEQ ID NO: 3942309 - DNA, 19 bp, Homo sapiens
gaaataattgttgattaat

SEQ ID NO: 3942310 - DNA, 15 bp, Homo sapiens
gaaatactgctctga

SEQ ID NO: 3942311 - DNA, 16 bp, Homo sapiens
gaaatactgctctgaa

SEQ ID NO: 3942312 - DNA, 18 bp, Homo sapiens
gaaatactttatctgtga

SEQ ID NO: 3942313 - DNA, 18 bp, Homo sapiens
gaaatagacagtatattt

SEQ ID NO: 3942314 - DNA, 18 bp, Homo sapiens
gaaatatatatacatatg

SEQ ID NO: 3942315 - DNA, 18 bp, Homo sapiens
gaactaagttttttactt

SEQ ID NO: 3942316 - DNA, 12 bp, Homo sapiens
gaactccactct

SEQ ID NO: 3942317 - DNA, 20 bp, Homo sapiens
gaactcctggaaatatcagt

SEQ ID NO: 3942318 - DNA, 20 bp, Homo sapiens
gaactccttattttgtatta

SEQ ID NO: 3942319 - DNA, 14 bp, Homo sapiens
gaactctgacaagg

SEQ ID NO: 3942320 - DNA, 17 bp, Homo sapiens
gaactctgacaagggct

SEQ ID NO: 3942321 - DNA, 14 bp, Homo sapiens
gaactgtgcctagt

SEQ ID NO: 3942322 - DNA, 17 bp, Homo sapiens
gaacttacacttggagc

SEQ ID NO: 3942323 - DNA, 18 bp, Homo sapiens
gaacttacacttggagcc

SEQ ID NO: 3942324 - DNA, 13 bp, Homo sapiens
gaacttctaatat

SEQ ID NO: 3942325 - DNA, 15 bp, Homo sapiens
gaacttctaatatat

SEQ ID NO: 3942326 - DNA, 13 bp, Homo sapiens
gaacttgaggaca

SEQ ID NO: 3942327 - DNA, 15 bp, Homo sapiens
gaacttgaggacaca

SEQ ID NO: 3942328 - DNA, 19 bp, Homo sapiens
gaacttgaggacacatgtc

SEQ ID NO: 3942329 - DNA, 17 bp, Homo sapiens
gaactttccaaaaccta

SEQ ID NO: 3942330 - DNA, 23 bp, Homo sapiens
gaactttctcttcatactttttt

SEQ ID NO: 3942331 - DNA, 14 bp, Homo sapiens
gaagaaaactatcc

SEQ ID NO: 3942332 - DNA, 23 bp, Homo sapiens
gaagaaacaggggatcaaagttc

SEQ ID NO: 3942333 - DNA, 19 bp, Homo sapiens
gaagaaaccccaagcagca

SEQ ID NO: 3942334 - DNA, 19 bp, Homo sapiens
gaagaaagaacggaagaag

SEQ ID NO: 3942335 - DNA, 17 bp, Homo sapiens
gaagaaagagaaggagc

SEQ ID NO: 3942336 - DNA, 17 bp, Homo sapiens
gaagaacatccaaggag

SEQ ID NO: 3942337 - DNA, 13 bp, Homo sapiens
gaagaagctgagg

SEQ ID NO: 3942338 - DNA, 13 bp, Homo sapiens
gaagaatattcta

SEQ ID NO: 3942339 - DNA, 18 bp, Homo sapiens
gaagaatcaagagggcag

SEQ ID NO: 3942340 - DNA, 18 bp, Homo sapiens
gaagaattgaacccagga

SEQ ID NO: 3942341 - DNA, 17 bp, Homo sapiens
gaagaattttcagaccc

SEQ ID NO: 3942342 - DNA, 20 bp, Homo sapiens
gaagaattttcagaccccag

SEQ ID NO: 3942343 - DNA, 16 bp, Homo sapiens
gaagacaaaccactgt

SEQ ID NO: 3942344 - DNA, 12 bp, Homo sapiens
gaagacacagac

SEQ ID NO: 3942345 - DNA, 21 bp, Homo sapiens
gaagacacagactgcgatttg

SEQ ID NO: 3942346 - DNA, 15 bp, Homo sapiens
gaagacatggagact

SEQ ID NO: 3942347 - DNA, 14 bp, Homo sapiens
gaagaccacatcca

SEQ ID NO: 3942348 - DNA, 20 bp, Homo sapiens
gaagaccacatccacacacg

SEQ ID NO: 3942349 - DNA, 22 bp, Homo sapiens
gaagaccacatccacacacgca

SEQ ID NO: 3942350 - DNA, 14 bp, Homo sapiens
gaagaccctccccg

SEQ ID NO: 3942351 - DNA, 15 bp, Homo sapiens
gaagagaagctgaga

SEQ ID NO: 3942352 - DNA, 16 bp, Homo sapiens
gaagagaagctgagaa

SEQ ID NO: 3942353 - DNA, 21 bp, Homo sapiens
gaagagaagctgagaagaagc

SEQ ID NO: 3942354 - DNA, 13 bp, Homo sapiens
gaagagaaggagc

SEQ ID NO: 3942355 - DNA, 18 bp, Homo sapiens
gaagagacaggagggcaa

SEQ ID NO: 3942356 - DNA, 18 bp, Homo sapiens
gaagagagagagagaggt

SEQ ID NO: 3942357 - DNA, 17 bp, Homo sapiens
gaagagaggcacctgct

SEQ ID NO: 3942358 - DNA, 23 bp, Homo sapiens
gaagagaggcacctgctggaaac

SEQ ID NO: 3942359 - DNA, 21 bp, Homo sapiens
gaagagctcttcggtttctga

SEQ ID NO: 3942360 - DNA, 20 bp, Homo sapiens
gaagaggaggagggattctg

SEQ ID NO: 3942361 - DNA, 16 bp, Homo sapiens
gaagaggctggtgctg

SEQ ID NO: 3942362 - DNA, 21 bp, Homo sapiens
gaagagggaatggatggggag

SEQ ID NO: 3942363 - DNA, 20 bp, Homo sapiens
gaagagggcctgtgggagcc

SEQ ID NO: 3942364 - DNA, 14 bp, Homo sapiens
gaagagtgagaggg

SEQ ID NO: 3942365 - DNA, 22 bp, Homo sapiens
gaagagtttaactttgggccca

SEQ ID NO: 3942366 - DNA, 17 bp, Homo sapiens
gaagatggtagcagata

SEQ ID NO: 3942367 - DNA, 15 bp, Homo sapiens
gaagatgtgatttat

SEQ ID NO: 3942368 - DNA, 17 bp, Homo sapiens
gaagcaggcagagcggg

SEQ ID NO: 3942369 - DNA, 20 bp, Homo sapiens
gaagcaggcagagcggggag

SEQ ID NO: 3942370 - DNA, 17 bp, Homo sapiens
gaagcaggttcttgatg

SEQ ID NO: 3942371 - DNA, 18 bp, Homo sapiens
gaagcagtgcctcgaggc

SEQ ID NO: 3942372 - DNA, 20 bp, Homo sapiens
gaagcagtgcctcgaggcac

SEQ ID NO: 3942373 - DNA, 15 bp, Homo sapiens
gaagccaacttggct

SEQ ID NO: 3942374 - DNA, 19 bp, Homo sapiens
gaagccacgctgtcctctc

SEQ ID NO: 3942375 - DNA, 15 bp, Homo sapiens
gaagccaggagcaaa

SEQ ID NO: 3942376 - DNA, 20 bp, Homo sapiens
gaagccatattcacacctca

SEQ ID NO: 3942377 - DNA, 14 bp, Homo sapiens
gaagcccaataaac

SEQ ID NO: 3942378 - DNA, 14 bp, Homo sapiens
gaagcccaggctga

SEQ ID NO: 3942379 - DNA, 20 bp, Homo sapiens
gaagccccccacctttctcg

SEQ ID NO: 3942380 - DNA, 11 bp, Homo sapiens
gaagccctcct

SEQ ID NO: 3942381 - DNA, 16 bp, Homo sapiens
gaagccctccttccac

SEQ ID NO: 3942382 - DNA, 19 bp, Homo sapiens
gaagccctccttccacgga

SEQ ID NO: 3942383 - DNA, 19 bp, Homo sapiens
gaagccctggatttcagaa

SEQ ID NO: 3942384 - DNA, 22 bp, Homo sapiens
gaagccctggatttcagaaaga

SEQ ID NO: 3942385 - DNA, 19 bp, Homo sapiens
gaagccgtctgactccaga

SEQ ID NO: 3942386 - DNA, 20 bp, Homo sapiens
gaagccgtctgactccagag

SEQ ID NO: 3942387 - DNA, 15 bp, Homo sapiens
gaagcctaaataaaa

SEQ ID NO: 3942388 - DNA, 13 bp, Homo sapiens
gaagcctgggggc

SEQ ID NO: 3942389 - DNA, 16 bp, Homo sapiens
gaagcctgggggcctg

SEQ ID NO: 3942390 - DNA, 18 bp, Homo sapiens
gaagcctgggggcctggc

SEQ ID NO: 3942391 - DNA, 21 bp, Homo sapiens
gaagcctgggggcctggctgg

SEQ ID NO: 3942392 - DNA, 19 bp, Homo sapiens
gaagcctgtaccaggtcat

SEQ ID NO: 3942393 - DNA, 18 bp, Homo sapiens
gaagcctttgggaagggg

SEQ ID NO: 3942394 - DNA, 14 bp, Homo sapiens
gaagctaacaggga

SEQ ID NO: 3942395 - DNA, 21 bp, Homo sapiens
gaagctaacagggaaggcagg

SEQ ID NO: 3942396 - DNA, 22 bp, Homo sapiens
gaagctaacagggaaggcaggc

SEQ ID NO: 3942397 - DNA, 13 bp, Homo sapiens
gaagctccactgt

SEQ ID NO: 3942398 - DNA, 15 bp, Homo sapiens
gaagctccactgtca

SEQ ID NO: 3942399 - DNA, 17 bp, Homo sapiens
gaagctcccagatgctg

SEQ ID NO: 3942400 - DNA, 17 bp, Homo sapiens
gaagctgagaagaagct

SEQ ID NO: 3942401 - DNA, 18 bp, Homo sapiens
gaagctgagcaggcccga

SEQ ID NO: 3942402 - DNA, 20 bp, Homo sapiens
gaatacagtgagtcctcctc

SEQ ID NO: 3942403 - DNA, 15 bp, Homo sapiens
gaatagatgctgact

SEQ ID NO: 3942404 - DNA, 15 bp, Homo sapiens
gaatagatgtgatca

SEQ ID NO: 3942405 - DNA, 19 bp, Homo sapiens
gaatagatgtgatcactga

SEQ ID NO: 3942406 - DNA, 13 bp, Homo sapiens
gaatagtgtctga

SEQ ID NO: 3942407 - DNA, 23 bp, Homo sapiens
gaatatatcagaatctgtgtgaa

SEQ ID NO: 3942408 - DNA, 17 bp, Homo sapiens
gaatatgtaagtcagga

SEQ ID NO: 3942409 - DNA, 15 bp, Homo sapiens
gaatatgttcaatgc

SEQ ID NO: 3942410 - DNA, 19 bp, Homo sapiens
gaatatttcaaatgaacac

SEQ ID NO: 3942411 - DNA, 16 bp, Homo sapiens
gaatattttaacttcc

SEQ ID NO: 3942412 - DNA, 20 bp, Homo sapiens
gaatattttcattaaaagct

SEQ ID NO: 3942413 - DNA, 13 bp, Homo sapiens
gaatcaaaactct

SEQ ID NO: 3942414 - DNA, 23 bp, Homo sapiens
gaatcaagagggcagcccccact

SEQ ID NO: 3942415 - DNA, 18 bp, Homo sapiens
gaatcaatttcccagaag

SEQ ID NO: 3942416 - DNA, 14 bp, Homo sapiens
gaatcacctggagg

SEQ ID NO: 3942417 - DNA, 19 bp, Homo sapiens
gaatcacctggagggcttg

SEQ ID NO: 3942418 - DNA, 20 bp, Homo sapiens
gaatcacctggagggcttgg

SEQ ID NO: 3942419 - DNA, 23 bp, Homo sapiens
gaatcactgtattttcattttaa

SEQ ID NO: 3942420 - DNA, 23 bp, Homo sapiens
gaatcagaccctaccccaccacg

SEQ ID NO: 3942421 - DNA, 19 bp, Homo sapiens
gaatcagacttcacactgc

SEQ ID NO: 3942422 - DNA, 20 bp, Homo sapiens
gaatcagtattgggagccgg

SEQ ID NO: 3942423 - DNA, 16 bp, Homo sapiens
gaatcataattttcaa

SEQ ID NO: 3942424 - DNA, 23 bp, Homo sapiens
gaatcataattttcaagagaaga

SEQ ID NO: 3942425 - DNA, 16 bp, Homo sapiens
gaatccaagcgaggtc

SEQ ID NO: 3942426 - DNA, 18 bp, Homo sapiens
gaatccgcctgcagagga

SEQ ID NO: 3942427 - DNA, 13 bp, Homo sapiens
gaatcctgcctct

SEQ ID NO: 3942428 - DNA, 18 bp, Homo sapiens
gaatcgatctgtactgta

SEQ ID NO: 3942429 - DNA, 20 bp, Homo sapiens
gaatcgtttcaaatggactc

SEQ ID NO: 3942430 - DNA, 13 bp, Homo sapiens
gaatctacagaac

SEQ ID NO: 3942431 - DNA, 18 bp, Homo sapiens
gaatctagggagggggaa

SEQ ID NO: 3942432 - DNA, 17 bp, Homo sapiens
gaatctgataggaaaag

SEQ ID NO: 3942433 - DNA, 18 bp, Homo sapiens
gaatctgataggaaaaga

SEQ ID NO: 3942434 - DNA, 19 bp, Homo sapiens
gaatctgcagggagcaact

SEQ ID NO: 3942435 - DNA, 21 bp, Homo sapiens
gaatctgcctgtggccttgcc

SEQ ID NO: 3942436 - DNA, 15 bp, Homo sapiens
gaatctgttactgaa

SEQ ID NO: 3942437 - DNA, 16 bp, Homo sapiens
gaatctgttactgaaa

SEQ ID NO: 3942438 - DNA, 16 bp, Homo sapiens
gaatgacaacagaagc

SEQ ID NO: 3942439 - DNA, 20 bp, Homo sapiens
gaatgaccacgggcctcagt

SEQ ID NO: 3942440 - DNA, 18 bp, Homo sapiens
gaatgaccttgttgcatg

SEQ ID NO: 3942441 - DNA, 14 bp, Homo sapiens
gaatgagagtgtga

SEQ ID NO: 3942442 - DNA, 16 bp, Homo sapiens
gaatgatttttagatg

SEQ ID NO: 3942443 - DNA, 12 bp, Homo sapiens
gaatgcaagagt

SEQ ID NO: 3942444 - DNA, 20 bp, Homo sapiens
gaatgcacactagcctctcc

SEQ ID NO: 3942445 - DNA, 16 bp, Homo sapiens
gaatgcagattcctgg

SEQ ID NO: 3942446 - DNA, 17 bp, Homo sapiens
gaatgcagggaagaggg

SEQ ID NO: 3942447 - DNA, 14 bp, Homo sapiens
gaatgcatgtaagg

SEQ ID NO: 3942448 - DNA, 13 bp, Homo sapiens
gaatgcctcctcc

SEQ ID NO: 3942449 - DNA, 18 bp, Homo sapiens
gaatgctttttgaatgtt

SEQ ID NO: 3942450 - DNA, 20 bp, Homo sapiens
gaatggatggggagaatggt

SEQ ID NO: 3942451 - DNA, 18 bp, Homo sapiens
gaatggccctagaactgt

SEQ ID NO: 3942452 - DNA, 15 bp, Homo sapiens
gaatggtccagggtt

SEQ ID NO: 3942453 - DNA, 22 bp, Homo sapiens
gaatggttccatgcctgagggt

SEQ ID NO: 3942454 - DNA, 17 bp, Homo sapiens
gaatgtcaccagtcctg

SEQ ID NO: 3942455 - DNA, 18 bp, Homo sapiens
gaatgtgtacaaagtgta

SEQ ID NO: 3942456 - DNA, 16 bp, Homo sapiens
gaatgttaaagtcagt

SEQ ID NO: 3942457 - DNA, 22 bp, Homo sapiens
gaatgttactttggaatgacta

SEQ ID NO: 3942458 - DNA, 14 bp, Homo sapiens
gaatgttccctgca

SEQ ID NO: 3942459 - DNA, 15 bp, Homo sapiens
gaatgttccctgcac

SEQ ID NO: 3942460 - DNA, 17 bp, Homo sapiens
gaatgtttatgttctca

SEQ ID NO: 3942461 - DNA, 12 bp, Homo sapiens
gaattaaataaa

SEQ ID NO: 3942462 - DNA, 17 bp, Homo sapiens
gaattaactccattcca

SEQ ID NO: 3942463 - DNA, 15 bp, Homo sapiens
gaattaatagctttt

SEQ ID NO: 3942464 - DNA, 17 bp, Homo sapiens
gaattatatctaattta

SEQ ID NO: 3942465 - DNA, 19 bp, Homo sapiens
gaattatatctaatttata

SEQ ID NO: 3942466 - DNA, 17 bp, Homo sapiens
gaattattatgtctcaa

SEQ ID NO: 3942467 - DNA, 19 bp, Homo sapiens
gaattattttgttgtgatt

SEQ ID NO: 3942468 - DNA, 14 bp, Homo sapiens
gaattatttttgtg

SEQ ID NO: 3942469 - DNA, 14 bp, Homo sapiens
gaattcacacctta

SEQ ID NO: 3942470 - DNA, 18 bp, Homo sapiens
gaattcagcaccctgggt

SEQ ID NO: 3942471 - DNA, 12 bp, Homo sapiens
gaattccaagga

SEQ ID NO: 3942472 - DNA, 16 bp, Homo sapiens
gaattccaaggagttc

SEQ ID NO: 3942473 - DNA, 18 bp, Homo sapiens
gaattcctgaagccagat

SEQ ID NO: 3942474 - DNA, 16 bp, Homo sapiens
gaattctagaaaattt

SEQ ID NO: 3942475 - DNA, 20 bp, Homo sapiens
gaattctctctaaaaataaa

SEQ ID NO: 3942476 - DNA, 15 bp, Homo sapiens
gaattgaacccagga

SEQ ID NO: 3942477 - DNA, 16 bp, Homo sapiens
gaattgcctgcagaga

SEQ ID NO: 3942478 - DNA, 17 bp, Homo sapiens
gaattggcctcagtgta

SEQ ID NO: 3942479 - DNA, 13 bp, Homo sapiens
gaattgggaagct

SEQ ID NO: 3942480 - DNA, 16 bp, Homo sapiens
gaattgggaagctggg

SEQ ID NO: 3942481 - DNA, 14 bp, Homo sapiens
gaattgtatcattt

SEQ ID NO: 3942482 - DNA, 22 bp, Homo sapiens
gaatttgtaagtttatgtctaa

SEQ ID NO: 3942483 - DNA, 14 bp, Homo sapiens
gaattttcagaccc

SEQ ID NO: 3942484 - DNA, 23 bp, Homo sapiens
gaattttcagaccccagcggctg

SEQ ID NO: 3942485 - DNA, 23 bp, Homo sapiens
gaattttctttgtgtagctttgc

SEQ ID NO: 3942486 - DNA, 19 bp, Homo sapiens
gacaaacacctcccaggag

SEQ ID NO: 3942487 - DNA, 16 bp, Homo sapiens
gacaaaccactgtaca

SEQ ID NO: 3942488 - DNA, 18 bp, Homo sapiens
gacaaaccactgtacata

SEQ ID NO: 3942489 - DNA, 20 bp, Homo sapiens
gacaggttcccagcagctgg

SEQ ID NO: 3942490 - DNA, 16 bp, Homo sapiens
gacagtatatttgaaa

SEQ ID NO: 3942491 - DNA, 23 bp, Homo sapiens
gacagtctcaagcactaaaaagt

SEQ ID NO: 3942492 - DNA, 14 bp, Homo sapiens
gacagtgcccatgc

SEQ ID NO: 3942493 - DNA, 23 bp, Homo sapiens
gacagttggcagagaaggcctct

SEQ ID NO: 3942494 - DNA, 12 bp, Homo sapiens
gacatacgaaac

SEQ ID NO: 3942495 - DNA, 16 bp, Homo sapiens
gacatcacttgtacaa

SEQ ID NO: 3942496 - DNA, 23 bp, Homo sapiens
gacatccatgtttgtaaaactac

SEQ ID NO: 3942497 - DNA, 23 bp, Homo sapiens
gacatgatactgatgccatgttt

SEQ ID NO: 3942498 - DNA, 21 bp, Homo sapiens
gacatgatttagggaagcagg

SEQ ID NO: 3942499 - DNA, 23 bp, Homo sapiens
gacatgatttagggaagcaggga

SEQ ID NO: 3942500 - DNA, 19 bp, Homo sapiens
gacatgccaccctctccat

SEQ ID NO: 3942501 - DNA, 17 bp, Homo sapiens
gacatggagactcctgc

SEQ ID NO: 3942502 - DNA, 20 bp, Homo sapiens
gacatggagactcctgccct

SEQ ID NO: 3942503 - DNA, 12 bp, Homo sapiens
gacatggctttg

SEQ ID NO: 3942504 - DNA, 15 bp, Homo sapiens
gacatggggcataga

SEQ ID NO: 3942505 - DNA, 16 bp, Homo sapiens
gacatggggcatagaa

SEQ ID NO: 3942506 - DNA, 17 bp, Homo sapiens
gacatggggcatagaaa

SEQ ID NO: 3942507 - DNA, 20 bp, Homo sapiens
gacatgtgctattgaactga

SEQ ID NO: 3942508 - DNA, 18 bp, Homo sapiens
gacatgttatatattttt

SEQ ID NO: 3942509 - DNA, 16 bp, Homo sapiens
gacattatgtgtgcat

SEQ ID NO: 3942510 - DNA, 22 bp, Homo sapiens
gacattatgtgtgcatgtgtgt

SEQ ID NO: 3942511 - DNA, 23 bp, Homo sapiens
gacattatgtgtgcatgtgtgta

SEQ ID NO: 3942512 - DNA, 17 bp, Homo sapiens
gacattccttgtcacca

SEQ ID NO: 3942513 - DNA, 14 bp, Homo sapiens
gacattttcaataa

SEQ ID NO: 3942514 - DNA, 17 bp, Homo sapiens
gaccaaccctgtttcct

SEQ ID NO: 3942515 - DNA, 14 bp, Homo sapiens
gaccaacctgacca

SEQ ID NO: 3942516 - DNA, 17 bp, Homo sapiens
gaccaactctctcctgt

SEQ ID NO: 3942517 - DNA, 13 bp, Homo sapiens
gaccaactggctt

SEQ ID NO: 3942518 - DNA, 19 bp, Homo sapiens
gaccaactggcttctgtgc

SEQ ID NO: 3942519 - DNA, 19 bp, Homo sapiens
gaccaagatgggcacatga

SEQ ID NO: 3942520 - DNA, 18 bp, Homo sapiens
gaccaaggttccagctca

SEQ ID NO: 3942521 - DNA, 23 bp, Homo sapiens
gaccacacgctgtctcttgagaa

SEQ ID NO: 3942522 - DNA, 15 bp, Homo sapiens
gaccacactttgaga

SEQ ID NO: 3942523 - DNA, 18 bp, Homo sapiens
gaccacactttgagaacc

SEQ ID NO: 3942524 - DNA, 19 bp, Homo sapiens
gaccacagtgggtggcacc

SEQ ID NO: 3942525 - DNA, 21 bp, Homo sapiens
gaccacagtgggtggcacctc

SEQ ID NO: 3942526 - DNA, 22 bp, Homo sapiens
gaccacagtgggtggcacctcc

SEQ ID NO: 3942527 - DNA, 16 bp, Homo sapiens
gaccacctctcaatat

SEQ ID NO: 3942528 - DNA, 14 bp, Homo sapiens
gaccacctgccagc

SEQ ID NO: 3942529 - DNA, 17 bp, Homo sapiens
gaccacctgccagccat

SEQ ID NO: 3942530 - DNA, 18 bp, Homo sapiens
gaccacctgccagccatc

SEQ ID NO: 3942531 - DNA, 19 bp, Homo sapiens
gaccacctgccagccatca

SEQ ID NO: 3942532 - DNA, 22 bp, Homo sapiens
gaccacggacgtttccatcagg

SEQ ID NO: 3942533 - DNA, 14 bp, Homo sapiens
gaccacgggcctca

SEQ ID NO: 3942534 - DNA, 21 bp, Homo sapiens
gaccacgggcctcagtttccc

SEQ ID NO: 3942535 - DNA, 11 bp, Homo sapiens
gaccagaatgc

SEQ ID NO: 3942536 - DNA, 18 bp, Homo sapiens
gaccagacctagacctgg

SEQ ID NO: 3942537 - DNA, 19 bp, Homo sapiens
gaccagacctagacctggg

SEQ ID NO: 3942538 - DNA, 13 bp, Homo sapiens
gaccagcaaatac

SEQ ID NO: 3942539 - DNA, 22 bp, Homo sapiens
gaccagcctccatgctgcctcc

SEQ ID NO: 3942540 - DNA, 14 bp, Homo sapiens
gaccagttgggagc

SEQ ID NO: 3942541 - DNA, 17 bp, Homo sapiens
gaccagttgggagcact

SEQ ID NO: 3942542 - DNA, 20 bp, Homo sapiens
gaccagttgggagcactgga

SEQ ID NO: 3942543 - DNA, 15 bp, Homo sapiens
gaccatcctggcccc

SEQ ID NO: 3942544 - DNA, 18 bp, Homo sapiens
gaccatcctggcccctcc

SEQ ID NO: 3942545 - DNA, 20 bp, Homo sapiens
gaccattgacctcagctgca

SEQ ID NO: 3942546 - DNA, 19 bp, Homo sapiens
gaccattgtcttccaaccc

SEQ ID NO: 3942547 - DNA, 13 bp, Homo sapiens
gaccatttaacat

SEQ ID NO: 3942548 - DNA, 17 bp, Homo sapiens
gaccatttaacatgcaa

SEQ ID NO: 3942549 - DNA, 15 bp, Homo sapiens
gaccatttcaggggt

SEQ ID NO: 3942550 - DNA, 13 bp, Homo sapiens
gacccaaggagga

SEQ ID NO: 3942551 - DNA, 18 bp, Homo sapiens
gacccacccatcttcctg

SEQ ID NO: 3942552 - DNA, 21 bp, Homo sapiens
gacccacccatcttcctgctg

SEQ ID NO: 3942553 - DNA, 19 bp, Homo sapiens
gacccagagtggagtctga

SEQ ID NO: 3942554 - DNA, 20 bp, Homo sapiens
gacccagatcctcacaacca

SEQ ID NO: 3942555 - DNA, 15 bp, Homo sapiens
gacccagctactctg

SEQ ID NO: 3942556 - DNA, 15 bp, Homo sapiens
gacccaggccctcca

SEQ ID NO: 3942557 - DNA, 22 bp, Homo sapiens
gacccaggccgcctgccatacc

SEQ ID NO: 3942558 - DNA, 22 bp, Homo sapiens
gacccagtgagattacagagga

SEQ ID NO: 3942559 - DNA, 20 bp, Homo sapiens
gaccccaaagagcctggaga

SEQ ID NO: 3942560 - DNA, 21 bp, Homo sapiens
gaccccaaagagcctggagaa

SEQ ID NO: 3942561 - DNA, 13 bp, Homo sapiens
gaccccagggcac

SEQ ID NO: 3942562 - DNA, 15 bp, Homo sapiens
gaccccagggcacag

SEQ ID NO: 3942563 - DNA, 21 bp, Homo sapiens
gacccccaaccaagtggctcc

SEQ ID NO: 3942564 - DNA, 12 bp, Homo sapiens
gacccctgtggc

SEQ ID NO: 3942565 - DNA, 16 bp, Homo sapiens
gaccccttcctttcct

SEQ ID NO: 3942566 - DNA, 13 bp, Homo sapiens
gacccgctctgga

SEQ ID NO: 3942567 - DNA, 20 bp, Homo sapiens
gacccggaggggcctggcag

SEQ ID NO: 3942568 - DNA, 18 bp, Homo sapiens
gaccctaagaccggcggc

SEQ ID NO: 3942569 - DNA, 14 bp, Homo sapiens
gaccctaccccacc

SEQ ID NO: 3942570 - DNA, 17 bp, Homo sapiens
gaccctacttcctgcac

SEQ ID NO: 3942571 - DNA, 21 bp, Homo sapiens
gaccctccaccgcagaaggaa

SEQ ID NO: 3942572 - DNA, 14 bp, Homo sapiens
gaccctccctacct

SEQ ID NO: 3942573 - DNA, 13 bp, Homo sapiens
gaccctcgcagca

SEQ ID NO: 3942574 - DNA, 14 bp, Homo sapiens
gaccctcgcagcag

SEQ ID NO: 3942575 - DNA, 19 bp, Homo sapiens
gaccctcgcagcaggtgca

SEQ ID NO: 3942576 - DNA, 13 bp, Homo sapiens
gaccctgagactc

SEQ ID NO: 3942577 - DNA, 21 bp, Homo sapiens
gaccctgcccatacccctgcc

SEQ ID NO: 3942578 - DNA, 23 bp, Homo sapiens
gaccctgcctgagcccaggagct

SEQ ID NO: 3942579 - DNA, 20 bp, Homo sapiens
gaccctggttactctggtgc

SEQ ID NO: 3942580 - DNA, 22 bp, Homo sapiens
gaccctggttactctggtgctg

SEQ ID NO: 3942581 - DNA, 16 bp, Homo sapiens
gaccctgttttccaca

SEQ ID NO: 3942582 - DNA, 18 bp, Homo sapiens
gaccctgttttccacacc

SEQ ID NO: 3942583 - DNA, 14 bp, Homo sapiens
gacccttcagggcc

SEQ ID NO: 3942584 - DNA, 17 bp, Homo sapiens
gacccttccagacatac

SEQ ID NO: 3942585 - DNA, 22 bp, Homo sapiens
gacccttcccaatcagcactga

SEQ ID NO: 3942586 - DNA, 20 bp, Homo sapiens
gaccctttccttccttccct

SEQ ID NO: 3942587 - DNA, 16 bp, Homo sapiens
gaccgcgtagagagcc

SEQ ID NO: 3942588 - DNA, 21 bp, Homo sapiens
gaccgctacaccactctggca

SEQ ID NO: 3942589 - DNA, 14 bp, Homo sapiens
gaccgcttcacccc

SEQ ID NO: 3942590 - DNA, 18 bp, Homo sapiens
gaccgcttcacccctgca

SEQ ID NO: 3942591 - DNA, 19 bp, Homo sapiens
gaccgcttcacccctgcac

SEQ ID NO: 3942592 - DNA, 14 bp, Homo sapiens
gaccgcttcccaga

SEQ ID NO: 3942593 - DNA, 15 bp, Homo sapiens
gaccgggggccagac

SEQ ID NO: 3942594 - DNA, 13 bp, Homo sapiens
gaccgtggccctg

SEQ ID NO: 3942595 - DNA, 21 bp, Homo sapiens
gacctaacctaagcaaaacca

SEQ ID NO: 3942596 - DNA, 20 bp, Homo sapiens
gacctcaagtgatccacctg

SEQ ID NO: 3942597 - DNA, 15 bp, Homo sapiens
gacctcagctgcaca

SEQ ID NO: 3942598 - DNA, 14 bp, Homo sapiens
gacctcccagccct

SEQ ID NO: 3942599 - DNA, 23 bp, Homo sapiens
gacctcccagccctatggatgtg

SEQ ID NO: 3942600 - DNA, 19 bp, Homo sapiens
gacctccggggagagcaga

SEQ ID NO: 3942601 - DNA, 13 bp, Homo sapiens
gacctctgatccc

SEQ ID NO: 3942602 - DNA, 16 bp, Homo sapiens
gacctctgctctgagg

SEQ ID NO: 3942603 - DNA, 22 bp, Homo sapiens
gacctgaagggtgacatcccag

SEQ ID NO: 3942604 - DNA, 13 bp, Homo sapiens
gacctgagcctgc

SEQ ID NO: 3942605 - DNA, 15 bp, Homo sapiens
gacctgagcctgccg

SEQ ID NO: 3942606 - DNA, 16 bp, Homo sapiens
gacctgagcctgccga

SEQ ID NO: 3942607 - DNA, 18 bp, Homo sapiens
gacctgagcctgccgagc

SEQ ID NO: 3942608 - DNA, 16 bp, Homo sapiens
gacctgagtcggcccc

SEQ ID NO: 3942609 - DNA, 20 bp, Homo sapiens
gacctgcacgccaccgctgc

SEQ ID NO: 3942610 - DNA, 22 bp, Homo sapiens
gacctgcctctcacacacatag

SEQ ID NO: 3942611 - DNA, 10 bp, Homo sapiens
gacctgctga

SEQ ID NO: 3942612 - DNA, 11 bp, Homo sapiens
gacctgctgag

SEQ ID NO: 3942613 - DNA, 13 bp, Homo sapiens
gacctgctgagct

SEQ ID NO: 3942614 - DNA, 14 bp, Homo sapiens
gacctgctgagctc

SEQ ID NO: 3942615 - DNA, 18 bp, Homo sapiens
gacctgtgttcttgctga

SEQ ID NO: 3942616 - DNA, 21 bp, Homo sapiens
gaccttagaaatcattgtaga

SEQ ID NO: 3942617 - DNA, 14 bp, Homo sapiens
gaccttcctgccac

SEQ ID NO: 3942618 - DNA, 16 bp, Homo sapiens
gaccttcctgccacca

SEQ ID NO: 3942619 - DNA, 19 bp, Homo sapiens
gaccttcctgccaccagtc

SEQ ID NO: 3942620 - DNA, 16 bp, Homo sapiens
gaccttggagagacac

SEQ ID NO: 3942621 - DNA, 22 bp, Homo sapiens
gaccttttgtctcacacagcag

SEQ ID NO: 3942622 - DNA, 15 bp, Homo sapiens
gacgaacggaagggt

SEQ ID NO: 3942623 - DNA, 16 bp, Homo sapiens
gacgcaagggagaaga

SEQ ID NO: 3942624 - DNA, 14 bp, Homo sapiens
gacgcagcagctgg

SEQ ID NO: 3942625 - DNA, 22 bp, Homo sapiens
gacgcagcagctgggacccctc

SEQ ID NO: 3942626 - DNA, 16 bp, Homo sapiens
gacgcagccctggggg

SEQ ID NO: 3942627 - DNA, 22 bp, Homo sapiens
gacgcgcacacacaccggtcac

SEQ ID NO: 3942628 - DNA, 15 bp, Homo sapiens
gacgcgtctcctgtt

SEQ ID NO: 3942629 - DNA, 19 bp, Homo sapiens
gacgcttaacctttccgct

SEQ ID NO: 3942630 - DNA, 14 bp, Homo sapiens
gacgcttccagacc

SEQ ID NO: 3942631 - DNA, 19 bp, Homo sapiens
gacgcttccagaccacctg

SEQ ID NO: 3942632 - DNA, 20 bp, Homo sapiens
gacgcttccagaccacctgc

SEQ ID NO: 3942633 - DNA, 21 bp, Homo sapiens
gacggcagagaccccaggatc

SEQ ID NO: 3942634 - DNA, 13 bp, Homo sapiens
gacggctggacct

SEQ ID NO: 3942635 - DNA, 16 bp, Homo sapiens
gacggctggacctgca

SEQ ID NO: 3942636 - DNA, 16 bp, Homo sapiens
gacgggaggcctcagt

SEQ ID NO: 3942637 - DNA, 16 bp, Homo sapiens
gacggggactggggat

SEQ ID NO: 3942638 - DNA, 16 bp, Homo sapiens
gacggtgttgcagaga

SEQ ID NO: 3942639 - DNA, 17 bp, Homo sapiens
gacggttaacttgtata

SEQ ID NO: 3942640 - DNA, 18 bp, Homo sapiens
gacggttaacttgtatat

SEQ ID NO: 3942641 - DNA, 20 bp, Homo sapiens
gacggttaacttgtatattc

SEQ ID NO: 3942642 - DNA, 14 bp, Homo sapiens
gacggttgtaagca

SEQ ID NO: 3942643 - DNA, 21 bp, Homo sapiens
gacgtcctgctggcacctcag

SEQ ID NO: 3942644 - DNA, 16 bp, Homo sapiens
gacgtctcaagactga

SEQ ID NO: 3942645 - DNA, 17 bp, Homo sapiens
gacgttggttctgcact

SEQ ID NO: 3942646 - DNA, 19 bp, Homo sapiens
gactaacactcagaagcct

SEQ ID NO: 3942647 - DNA, 20 bp, Homo sapiens
gactaacataaaatctgtga

SEQ ID NO: 3942648 - DNA, 19 bp, Homo sapiens
gactaaccccaacgcacag

SEQ ID NO: 3942649 - DNA, 22 bp, Homo sapiens
gactaaccccaacgcacaggaa

SEQ ID NO: 3942650 - DNA, 23 bp, Homo sapiens
gactaaccccaacgcacaggaaa

SEQ ID NO: 3942651 - DNA, 16 bp, Homo sapiens
gactaatagagacaca

SEQ ID NO: 3942652 - DNA, 21 bp, Homo sapiens
gactaattaaaatctggaaat

SEQ ID NO: 3942653 - DNA, 18 bp, Homo sapiens
gactagagctttctttca

SEQ ID NO: 3942654 - DNA, 15 bp, Homo sapiens
gactagaggcaggga

SEQ ID NO: 3942655 - DNA, 12 bp, Homo sapiens
gactagcaggca

SEQ ID NO: 3942656 - DNA, 16 bp, Homo sapiens
gactagcaggcatgcc

SEQ ID NO: 3942657 - DNA, 15 bp, Homo sapiens
gactataaacattaa

SEQ ID NO: 3942658 - DNA, 19 bp, Homo sapiens
gactataaagcagtagaca

SEQ ID NO: 3942659 - DNA, 12 bp, Homo sapiens
gactatatacat

SEQ ID NO: 3942660 - DNA, 16 bp, Homo sapiens
gactatatacatgtgt

SEQ ID NO: 3942661 - DNA, 21 bp, Homo sapiens
gactatatacatgtgtgtata

SEQ ID NO: 3942662 - DNA, 14 bp, Homo sapiens
gagaaaaagaaatg

SEQ ID NO: 3942663 - DNA, 14 bp, Homo sapiens
gagaaacagagaca

SEQ ID NO: 3942664 - DNA, 18 bp, Homo sapiens
gagaaacatgaattattt

SEQ ID NO: 3942665 - DNA, 18 bp, Homo sapiens
gagaaagaagtaggcatg

SEQ ID NO: 3942666 - DNA, 15 bp, Homo sapiens
gagaaagactattca

SEQ ID NO: 3942667 - DNA, 17 bp, Homo sapiens
gagaaagactattcaaa

SEQ ID NO: 3942668 - DNA, 15 bp, Homo sapiens
gagaaaggattaaga

SEQ ID NO: 3942669 - DNA, 17 bp, Homo sapiens
gagaaaggattaagata

SEQ ID NO: 3942670 - DNA, 19 bp, Homo sapiens
gagaaatgaatgctgagac

SEQ ID NO: 3942671 - DNA, 18 bp, Homo sapiens
gagaaatgtgaagggtgg

SEQ ID NO: 3942672 - DNA, 13 bp, Homo sapiens
gagaaatttttat

SEQ ID NO: 3942673 - DNA, 17 bp, Homo sapiens
gagaacaagtcacagct

SEQ ID NO: 3942674 - DNA, 22 bp, Homo sapiens
gagaacaagtcacagctgcagc

SEQ ID NO: 3942675 - DNA, 13 bp, Homo sapiens
gagaacctggcct

SEQ ID NO: 3942676 - DNA, 15 bp, Homo sapiens
gagaacctggccttc

SEQ ID NO: 3942677 - DNA, 19 bp, Homo sapiens
gagaactagaacctggagg

SEQ ID NO: 3942678 - DNA, 21 bp, Homo sapiens
gagaagaaagaacggaagaag

SEQ ID NO: 3942679 - DNA, 13 bp, Homo sapiens
gagaagagctgtt

SEQ ID NO: 3942680 - DNA, 16 bp, Homo sapiens
gagaagagggcctgtg

SEQ ID NO: 3942681 - DNA, 19 bp, Homo sapiens
gagaagagggcctgtggga

SEQ ID NO: 3942682 - DNA, 20 bp, Homo sapiens
gagaagccacgctgtcctct

SEQ ID NO: 3942683 - DNA, 23 bp, Homo sapiens
gagaagctgatgctttgcttcaa

SEQ ID NO: 3942684 - DNA, 14 bp, Homo sapiens
gagaaggaaggaga

SEQ ID NO: 3942685 - DNA, 21 bp, Homo sapiens
gagaaggaaggagactcacct

SEQ ID NO: 3942686 - DNA, 22 bp, Homo sapiens
gagaaggacccggaggggcctg

SEQ ID NO: 3942687 - DNA, 13 bp, Homo sapiens
gagaaggagcaga

SEQ ID NO: 3942688 - DNA, 23 bp, Homo sapiens
gagaaggcaggaatgtgtggcag

SEQ ID NO: 3942689 - DNA, 15 bp, Homo sapiens
gagaagggccagccc

SEQ ID NO: 3942690 - DNA, 16 bp, Homo sapiens
gagaagggccagccct

SEQ ID NO: 3942691 - DNA, 20 bp, Homo sapiens
gagaagggccagccctacat

SEQ ID NO: 3942692 - DNA, 21 bp, Homo sapiens
gagaagggggattggagggaa

SEQ ID NO: 3942693 - DNA, 19 bp, Homo sapiens
gagaagtgaataactgcaa

SEQ ID NO: 3942694 - DNA, 21 bp, Homo sapiens
gagaatcacacaagtttgtgc

SEQ ID NO: 3942695 - DNA, 17 bp, Homo sapiens
gagaatctggctcctgt

SEQ ID NO: 3942696 - DNA, 20 bp, Homo sapiens
gagaatggtgtgaacccggg

SEQ ID NO: 3942697 - DNA, 20 bp, Homo sapiens
gagaatgtgattccttttga

SEQ ID NO: 3942698 - DNA, 15 bp, Homo sapiens
gagaattgtatcatt

SEQ ID NO: 3942699 - DNA, 15 bp, Homo sapiens
gagaattttaaatta

SEQ ID NO: 3942700 - DNA, 16 bp, Homo sapiens
gagaattttaaattat

SEQ ID NO: 3942701 - DNA, 13 bp, Homo sapiens
gagacaagccctg

SEQ ID NO: 3942702 - DNA, 15 bp, Homo sapiens
gagacaagccctggc

SEQ ID NO: 3942703 - DNA, 17 bp, Homo sapiens
gagacaagccctggcaa

SEQ ID NO: 3942704 - DNA, 20 bp, Homo sapiens
gagacacattaaagggtagc

SEQ ID NO: 3942705 - DNA, 21 bp, Homo sapiens
gagacacctgcacctcccccc

SEQ ID NO: 3942706 - DNA, 20 bp, Homo sapiens
gagacactgtgctataaatc

SEQ ID NO: 3942707 - DNA, 17 bp, Homo sapiens
gagacacttgccttctt

SEQ ID NO: 3942708 - DNA, 22 bp, Homo sapiens
gagacagaccggggttcaagcc

SEQ ID NO: 3942709 - DNA, 22 bp, Homo sapiens
gagacagagcccccaagcctct

SEQ ID NO: 3942710 - DNA, 23 bp, Homo sapiens
gagacagagcccccaagcctctg

SEQ ID NO: 3942711 - DNA, 20 bp, Homo sapiens
gagacaggaaaatcctctgg

SEQ ID NO: 3942712 - DNA, 21 bp, Homo sapiens
gagacaggaaaatcctctggc

SEQ ID NO: 3942713 - DNA, 16 bp, Homo sapiens
gagacagtagaggcat

SEQ ID NO: 3942714 - DNA, 18 bp, Homo sapiens
gagacagttcaagaaagc

SEQ ID NO: 3942715 - DNA, 20 bp, Homo sapiens
gagacattgcctccacctct

SEQ ID NO: 3942716 - DNA, 14 bp, Homo sapiens
gagaccaacctgac

SEQ ID NO: 3942717 - DNA, 22 bp, Homo sapiens
gagaccaagactctgaaatctc

SEQ ID NO: 3942718 - DNA, 12 bp, Homo sapiens
gagaccacctct

SEQ ID NO: 3942719 - DNA, 20 bp, Homo sapiens
gagaccagttgggagcactg

SEQ ID NO: 3942720 - DNA, 22 bp, Homo sapiens
gagaccagttgggagcactgga

SEQ ID NO: 3942721 - DNA, 17 bp, Homo sapiens
gagaccatcctggcccc

SEQ ID NO: 3942722 - DNA, 17 bp, Homo sapiens
gagaccccttcctttcc

SEQ ID NO: 3942723 - DNA, 20 bp, Homo sapiens
gagaccccttcctttcctct

SEQ ID NO: 3942724 - DNA, 17 bp, Homo sapiens
gagaccctacaggagag

SEQ ID NO: 3942725 - DNA, 17 bp, Homo sapiens
gagaccgcttcacccct

SEQ ID NO: 3942726 - DNA, 19 bp, Homo sapiens
gagaccgcttcacccctgc

SEQ ID NO: 3942727 - DNA, 20 bp, Homo sapiens
gagaccgcttcacccctgca

SEQ ID NO: 3942728 - DNA, 11 bp, Homo sapiens
gagacctcagc

SEQ ID NO: 3942729 - DNA, 13 bp, Homo sapiens
gagacctcagcca

SEQ ID NO: 3942730 - DNA, 20 bp, Homo sapiens
gagacctctcaacagatctg

SEQ ID NO: 3942731 - DNA, 18 bp, Homo sapiens
gagacctgacaagcactg

SEQ ID NO: 3942732 - DNA, 16 bp, Homo sapiens
gagacctgaggcagat

SEQ ID NO: 3942733 - DNA, 18 bp, Homo sapiens
gagaccttttctctccca

SEQ ID NO: 3942734 - DNA, 22 bp, Homo sapiens
gagactaagccctgtcgagaca

SEQ ID NO: 3942735 - DNA, 21 bp, Homo sapiens
gagactaatagagacacagag

SEQ ID NO: 3942736 - DNA, 14 bp, Homo sapiens
gagactatggagcc

SEQ ID NO: 3942737 - DNA, 18 bp, Homo sapiens
gagactcaaagagactcc

SEQ ID NO: 3942738 - DNA, 16 bp, Homo sapiens
gagactcacctctgcc

SEQ ID NO: 3942739 - DNA, 19 bp, Homo sapiens
gagactccagaatctgctg

SEQ ID NO: 3942740 - DNA, 23 bp, Homo sapiens
gagactccagaatctgctgttgc

SEQ ID NO: 3942741 - DNA, 23 bp, Homo sapiens
gagactctggaagccccccacct

SEQ ID NO: 3942742 - DNA, 14 bp, Homo sapiens
gagactctggcctc

SEQ ID NO: 3942743 - DNA, 14 bp, Homo sapiens
gagactgagggaga

SEQ ID NO: 3942744 - DNA, 16 bp, Homo sapiens
gagactgagggagaga

SEQ ID NO: 3942745 - DNA, 16 bp, Homo sapiens
gagactggagcatctg

SEQ ID NO: 3942746 - DNA, 17 bp, Homo sapiens
gagactggcacttagcc

SEQ ID NO: 3942747 - DNA, 20 bp, Homo sapiens
gagactgggtgaaagtgact

SEQ ID NO: 3942748 - DNA, 14 bp, Homo sapiens
gagcactggccaga

SEQ ID NO: 3942749 - DNA, 15 bp, Homo sapiens
gagcactggccagag

SEQ ID NO: 3942750 - DNA, 24 bp, Homo sapiens
gagcactggccagagagggcccag

SEQ ID NO: 3942751 - DNA, 17 bp, Homo sapiens
gagcactgggttgactt

SEQ ID NO: 3942752 - DNA, 12 bp, Homo sapiens
gagcagaaataa

SEQ ID NO: 3942753 - DNA, 23 bp, Homo sapiens
gagcagaacggagccccaggcct

SEQ ID NO: 3942754 - DNA, 15 bp, Homo sapiens
gagcagacagagaaa

SEQ ID NO: 3942755 - DNA, 15 bp, Homo sapiens
gagcagacaggagga

SEQ ID NO: 3942756 - DNA, 12 bp, Homo sapiens
gagcagagagct

SEQ ID NO: 3942757 - DNA, 20 bp, Homo sapiens
gagcagagctgatggagaag

SEQ ID NO: 3942758 - DNA, 19 bp, Homo sapiens
gagcagagtataggatgga

SEQ ID NO: 3942759 - DNA, 20 bp, Homo sapiens
gagcagagtataggatggat

SEQ ID NO: 3942760 - DNA, 16 bp, Homo sapiens
gagcagcctgatggcc

SEQ ID NO: 3942761 - DNA, 19 bp, Homo sapiens
gagcagcctgatggccaag

SEQ ID NO: 3942762 - DNA, 19 bp, Homo sapiens
gagcagctgagcagggccg

SEQ ID NO: 3942763 - DNA, 11 bp, Homo sapiens
gagcagctggc

SEQ ID NO: 3942764 - DNA, 19 bp, Homo sapiens
gagcagctggctctccacc

SEQ ID NO: 3942765 - DNA, 16 bp, Homo sapiens
gagcaggaacagagac

SEQ ID NO: 3942766 - DNA, 18 bp, Homo sapiens
gagcaggaacagagactc

SEQ ID NO: 3942767 - DNA, 19 bp, Homo sapiens
gagcaggaacagagactct

SEQ ID NO: 3942768 - DNA, 21 bp, Homo sapiens
gagcaggaacagagactctgg

SEQ ID NO: 3942769 - DNA, 22 bp, Homo sapiens
gagcaggaacagagactctgga

SEQ ID NO: 3942770 - DNA, 21 bp, Homo sapiens
gagcaggctactgtcagctcc

SEQ ID NO: 3942771 - DNA, 15 bp, Homo sapiens
gagcaggctcagact

SEQ ID NO: 3942772 - DNA, 21 bp, Homo sapiens
gagcagggccggggaactggc

SEQ ID NO: 3942773 - DNA, 22 bp, Homo sapiens
gagcagggccggggaactggcc

SEQ ID NO: 3942774 - DNA, 16 bp, Homo sapiens
gagcagggtgctgtgg

SEQ ID NO: 3942775 - DNA, 17 bp, Homo sapiens
gagcagtcagggtggga

SEQ ID NO: 3942776 - DNA, 15 bp, Homo sapiens
gagcataatgctccc

SEQ ID NO: 3942777 - DNA, 18 bp, Homo sapiens
gagcatcatgcctctgag

SEQ ID NO: 3942778 - DNA, 19 bp, Homo sapiens
gagcatcatgcctctgagg

SEQ ID NO: 3942779 - DNA, 21 bp, Homo sapiens
gagcatcatgcctctgaggcc

SEQ ID NO: 3942780 - DNA, 15 bp, Homo sapiens
gagcatcgtgaccct

SEQ ID NO: 3942781 - DNA, 21 bp, Homo sapiens
gagcatcgtgacccttcaggg

SEQ ID NO: 3942782 - DNA, 13 bp, Homo sapiens
gagcatctgactc

SEQ ID NO: 3942783 - DNA, 15 bp, Homo sapiens
gagcatgcacagctg

SEQ ID NO: 3942784 - DNA, 18 bp, Homo sapiens
gagcatgcacagctgctt

SEQ ID NO: 3942785 - DNA, 20 bp, Homo sapiens
gagcatgcacagctgcttgt

SEQ ID NO: 3942786 - DNA, 14 bp, Homo sapiens
gagcatggctgtga

SEQ ID NO: 3942787 - DNA, 23 bp, Homo sapiens
gagccaaacacactgtaaatatc

SEQ ID NO: 3942788 - DNA, 23 bp, Homo sapiens
gagccactacctttgtccaggcc

SEQ ID NO: 3942789 - DNA, 19 bp, Homo sapiens
gagccagccctccctgtcc

SEQ ID NO: 3942790 - DNA, 12 bp, Homo sapiens
gagccagcctgg

SEQ ID NO: 3942791 - DNA, 12 bp, Homo sapiens
gagccaggctct

SEQ ID NO: 3942792 - DNA, 18 bp, Homo sapiens
gagccaggtaatgaggga

SEQ ID NO: 3942793 - DNA, 15 bp, Homo sapiens
gagccatgggcctgg

SEQ ID NO: 3942794 - DNA, 17 bp, Homo sapiens
gagccatgggcctgggc

SEQ ID NO: 3942795 - DNA, 19 bp, Homo sapiens
gagccatgggcctgggcct

SEQ ID NO: 3942796 - DNA, 11 bp, Homo sapiens
gagcccaggcc

SEQ ID NO: 3942797 - DNA, 14 bp, Homo sapiens
gagccccacacgga

SEQ ID NO: 3942798 - DNA, 16 bp, Homo sapiens
gagccccacacggagg

SEQ ID NO: 3942799 - DNA, 12 bp, Homo sapiens
gagcccccaagc

SEQ ID NO: 3942800 - DNA, 15 bp, Homo sapiens
gagcccccaagcctc

SEQ ID NO: 3942801 - DNA, 18 bp, Homo sapiens
gagcccccaagcctctgc

SEQ ID NO: 3942802 - DNA, 13 bp, Homo sapiens
gagcccctaggaa

SEQ ID NO: 3942803 - DNA, 13 bp, Homo sapiens
gagcccctggtcc

SEQ ID NO: 3942804 - DNA, 19 bp, Homo sapiens
gagcccgagggcctgacag

SEQ ID NO: 3942805 - DNA, 20 bp, Homo sapiens
gagcccgtgcagtacaggca

SEQ ID NO: 3942806 - DNA, 21 bp, Homo sapiens
gagcccgtgcagtacaggcaa

SEQ ID NO: 3942807 - DNA, 22 bp, Homo sapiens
gagccgagattgcgccactgca

SEQ ID NO: 3942808 - DNA, 21 bp, Homo sapiens
gagccgcatcttctccatctg

SEQ ID NO: 3942809 - DNA, 19 bp, Homo sapiens
gagccgctgtgagcccctg

SEQ ID NO: 3942810 - DNA, 20 bp, Homo sapiens
gagccgctgtgagcccctgg

SEQ ID NO: 3942811 - DNA, 22 bp, Homo sapiens
gagccggaccaagatgggcaca

SEQ ID NO: 3942812 - DNA, 23 bp, Homo sapiens
gagccggaccaagatgggcacat

SEQ ID NO: 3942813 - DNA, 15 bp, Homo sapiens
gagcctaaatctaat

SEQ ID NO: 3942814 - DNA, 19 bp, Homo sapiens
gagcctcgcaacccgtgcc

SEQ ID NO: 3942815 - DNA, 23 bp, Homo sapiens
gagcctcgcaacccgtgccaagt

SEQ ID NO: 3942816 - DNA, 19 bp, Homo sapiens
gagcctgaattttgttgct

SEQ ID NO: 3942817 - DNA, 13 bp, Homo sapiens
gagcctgctcccc

SEQ ID NO: 3942818 - DNA, 12 bp, Homo sapiens
gagcctggagaa

SEQ ID NO: 3942819 - DNA, 11 bp, Homo sapiens
gagcctggggc

SEQ ID NO: 3942820 - DNA, 18 bp, Homo sapiens
gagcctgtgaacccagga

SEQ ID NO: 3942821 - DNA, 21 bp, Homo sapiens
gagcctgtgaacccaggacaa

SEQ ID NO: 3942822 - DNA, 23 bp, Homo sapiens
gagcctgtgaacccaggacaagc

SEQ ID NO: 3942823 - DNA, 13 bp, Homo sapiens
gagcgaaactccg

SEQ ID NO: 3942824 - DNA, 19 bp, Homo sapiens
gagcgccctgcagaccctg

SEQ ID NO: 3942825 - DNA, 22 bp, Homo sapiens
gagcgccctgcagaccctgccc

SEQ ID NO: 3942826 - DNA, 18 bp, Homo sapiens
gagcgctttctggaaaag

SEQ ID NO: 3942827 - DNA, 18 bp, Homo sapiens
gagcgggcctcttccctc

SEQ ID NO: 3942828 - DNA, 20 bp, Homo sapiens
gagcgggcctcttccctcag

SEQ ID NO: 3942829 - DNA, 14 bp, Homo sapiens
gagctacctgtgtg

SEQ ID NO: 3942830 - DNA, 22 bp, Homo sapiens
gagctacctgtgtggacaggac

SEQ ID NO: 3942831 - DNA, 17 bp, Homo sapiens
gagctactctcttgcca

SEQ ID NO: 3942832 - DNA, 19 bp, Homo sapiens
gagctactctcttgccagc

SEQ ID NO: 3942833 - DNA, 20 bp, Homo sapiens
gagctactctcttgccagca

SEQ ID NO: 3942834 - DNA, 13 bp, Homo sapiens
gaggcaagagaca

SEQ ID NO: 3942835 - DNA, 16 bp, Homo sapiens
gaggcaccagctctgt

SEQ ID NO: 3942836 - DNA, 19 bp, Homo sapiens
gaggcaccagctctgtggc

SEQ ID NO: 3942837 - DNA, 17 bp, Homo sapiens
gaggcaccggcgctgca

SEQ ID NO: 3942838 - DNA, 20 bp, Homo sapiens
gaggcaccggcgctgcaggt

SEQ ID NO: 3942839 - DNA, 17 bp, Homo sapiens
gaggcagagaaagaaga

SEQ ID NO: 3942840 - DNA, 19 bp, Homo sapiens
gaggcagagaaagaagaga

SEQ ID NO: 3942841 - DNA, 21 bp, Homo sapiens
gaggcagagaaagaagagaca

SEQ ID NO: 3942842 - DNA, 21 bp, Homo sapiens
gaggcagcgtgaaagcagatg

SEQ ID NO: 3942843 - DNA, 21 bp, Homo sapiens
gaggcagctccaacagcttga

SEQ ID NO: 3942844 - DNA, 16 bp, Homo sapiens
gaggcagggaggggac

SEQ ID NO: 3942845 - DNA, 21 bp, Homo sapiens
gaggcagggccttgcccagag

SEQ ID NO: 3942846 - DNA, 15 bp, Homo sapiens
gaggcaggggcggag

SEQ ID NO: 3942847 - DNA, 14 bp, Homo sapiens
gaggcataaagact

SEQ ID NO: 3942848 - DNA, 17 bp, Homo sapiens
gaggcatggccctgggg

SEQ ID NO: 3942849 - DNA, 18 bp, Homo sapiens
gaggcatggccctggggt

SEQ ID NO: 3942850 - DNA, 15 bp, Homo sapiens
gaggccagcctggcc

SEQ ID NO: 3942851 - DNA, 16 bp, Homo sapiens
gaggccagcctggcct

SEQ ID NO: 3942852 - DNA, 17 bp, Homo sapiens
gaggccagcctggcctc

SEQ ID NO: 3942853 - DNA, 18 bp, Homo sapiens
gaggccagcctggcctcc

SEQ ID NO: 3942854 - DNA, 22 bp, Homo sapiens
gaggccagcctggcctcctgcc

SEQ ID NO: 3942855 - DNA, 21 bp, Homo sapiens
gaggcccagcctgtcctggta

SEQ ID NO: 3942856 - DNA, 16 bp, Homo sapiens
gaggccccaggcccta

SEQ ID NO: 3942857 - DNA, 13 bp, Homo sapiens
gaggcccctggac

SEQ ID NO: 3942858 - DNA, 14 bp, Homo sapiens
gaggccctggtgtc

SEQ ID NO: 3942859 - DNA, 19 bp, Homo sapiens
gaggcctaaaagtaaacat

SEQ ID NO: 3942860 - DNA, 12 bp, Homo sapiens
gaggcctcagtt

SEQ ID NO: 3942861 - DNA, 13 bp, Homo sapiens
gaggcctcagttc

SEQ ID NO: 3942862 - DNA, 19 bp, Homo sapiens
gaggcctcagtttctccat

SEQ ID NO: 3942863 - DNA, 23 bp, Homo sapiens
gaggcctcagtttctccatcagc

SEQ ID NO: 3942864 - DNA, 15 bp, Homo sapiens
gaggcctcatccctc

SEQ ID NO: 3942865 - DNA, 20 bp, Homo sapiens
gaggcctcgtaccagccagg

SEQ ID NO: 3942866 - DNA, 17 bp, Homo sapiens
gaggcctgatgctgccc

SEQ ID NO: 3942867 - DNA, 23 bp, Homo sapiens
gaggcctgccctcagggatcttg

SEQ ID NO: 3942868 - DNA, 13 bp, Homo sapiens
gaggcctggcctt

SEQ ID NO: 3942869 - DNA, 14 bp, Homo sapiens
gaggcgaataaatg

SEQ ID NO: 3942870 - DNA, 14 bp, Homo sapiens
gaggcgcgtctgcc

SEQ ID NO: 3942871 - DNA, 18 bp, Homo sapiens
gaggcggctccaggtccg

SEQ ID NO: 3942872 - DNA, 16 bp, Homo sapiens
gaggctatttaaaagt

SEQ ID NO: 3942873 - DNA, 16 bp, Homo sapiens
gaggctcaagaggccc

SEQ ID NO: 3942874 - DNA, 16 bp, Homo sapiens
gaggctgagacaggag

SEQ ID NO: 3942875 - DNA, 16 bp, Homo sapiens
gaggctgaggcagaag

SEQ ID NO: 3942876 - DNA, 18 bp, Homo sapiens
gaggctgaggcagaagaa

SEQ ID NO: 3942877 - DNA, 16 bp, Homo sapiens
gaggctgcatgctctg

SEQ ID NO: 3942878 - DNA, 13 bp, Homo sapiens
gaggctgctcggg

SEQ ID NO: 3942879 - DNA, 24 bp, Homo sapiens
gaggctgctcggggtgcacaggag

SEQ ID NO: 3942880 - DNA, 16 bp, Homo sapiens
gaggctggaggcaggg

SEQ ID NO: 3942881 - DNA, 18 bp, Homo sapiens
gaggctggaggcagggcc

SEQ ID NO: 3942882 - DNA, 14 bp, Homo sapiens
gaggctggcaagga

SEQ ID NO: 3942883 - DNA, 16 bp, Homo sapiens
gaggctgggccagcct

SEQ ID NO: 3942884 - DNA, 14 bp, Homo sapiens
gaggctgggcccct

SEQ ID NO: 3942885 - DNA, 20 bp, Homo sapiens
gaggctggtgctgtggccag

SEQ ID NO: 3942886 - DNA, 21 bp, Homo sapiens
gaggcttccagagagtcctct

SEQ ID NO: 3942887 - DNA, 22 bp, Homo sapiens
gaggcttccagagagtcctctg

SEQ ID NO: 3942888 - DNA, 23 bp, Homo sapiens
gaggcttccagagagtcctctgg

SEQ ID NO: 3942889 - DNA, 14 bp, Homo sapiens
gaggcttccaggct

SEQ ID NO: 3942890 - DNA, 16 bp, Homo sapiens
gaggcttccaggctct

SEQ ID NO: 3942891 - DNA, 19 bp, Homo sapiens
gaggcttccaggctcttcc

SEQ ID NO: 3942892 - DNA, 16 bp, Homo sapiens
gaggcttcttcagatc

SEQ ID NO: 3942893 - DNA, 19 bp, Homo sapiens
gagggaatgttccctgcac

SEQ ID NO: 3942894 - DNA, 19 bp, Homo sapiens
gagggacaaaggagcctgt

SEQ ID NO: 3942895 - DNA, 22 bp, Homo sapiens
gagggacaaaggagcctgtgaa

SEQ ID NO: 3942896 - DNA, 16 bp, Homo sapiens
gagggacgaagaaagg

SEQ ID NO: 3942897 - DNA, 18 bp, Homo sapiens
gagggagagactctgagg

SEQ ID NO: 3942898 - DNA, 20 bp, Homo sapiens
gagggagggggcgctcagga

SEQ ID NO: 3942899 - DNA, 14 bp, Homo sapiens
gagggatcacaggg

SEQ ID NO: 3942900 - DNA, 16 bp, Homo sapiens
gagggatgatgaagag

SEQ ID NO: 3942901 - DNA, 22 bp, Homo sapiens
gagggcaagggccatgctgaag

SEQ ID NO: 3942902 - DNA, 12 bp, Homo sapiens
gagggcactggt

SEQ ID NO: 3942903 - DNA, 22 bp, Homo sapiens
gagggcagagccatgggcctgg

SEQ ID NO: 3942904 - DNA, 15 bp, Homo sapiens
gagggcagcagccag

SEQ ID NO: 3942905 - DNA, 16 bp, Homo sapiens
gagggcagcagccagc

SEQ ID NO: 3942906 - DNA, 23 bp, Homo sapiens
gagggcagcagccagccctgcct

SEQ ID NO: 3942907 - DNA, 20 bp, Homo sapiens
gagggcagcccccactttcc

SEQ ID NO: 3942908 - DNA, 22 bp, Homo sapiens
gagggcatgcgcacaaggctga

SEQ ID NO: 3942909 - DNA, 17 bp, Homo sapiens
gagggcatgggagggag

SEQ ID NO: 3942910 - DNA, 18 bp, Homo sapiens
gagggcccagctgtagcc

SEQ ID NO: 3942911 - DNA, 20 bp, Homo sapiens
gagggcccagctgtagccat

SEQ ID NO: 3942912 - DNA, 23 bp, Homo sapiens
gagggcccagctgtagccatggc

SEQ ID NO: 3942913 - DNA, 18 bp, Homo sapiens
gagggcgcccattcgtct

SEQ ID NO: 3942914 - DNA, 20 bp, Homo sapiens
gagggctagaacctggaagg

SEQ ID NO: 3942915 - DNA, 11 bp, Homo sapiens
gagggctctga

SEQ ID NO: 3942916 - DNA, 13 bp, Homo sapiens
gagggctctgagg

SEQ ID NO: 3942917 - DNA, 15 bp, Homo sapiens
gagggctggaatctg

SEQ ID NO: 3942918 - DNA, 15 bp, Homo sapiens
gaggggaagggccag

SEQ ID NO: 3942919 - DNA, 13 bp, Homo sapiens
gaggggcagccgc

SEQ ID NO: 3942920 - DNA, 23 bp, Homo sapiens
gagggggtgtctggaagctgagc

SEQ ID NO: 3942921 - DNA, 20 bp, Homo sapiens
gagtgtgcgtgtgtgcatgt

SEQ ID NO: 3942922 - DNA, 18 bp, Homo sapiens
gagtgtgggaagggagag

SEQ ID NO: 3942923 - DNA, 17 bp, Homo sapiens
gagtgtgggtgatcaga

SEQ ID NO: 3942924 - DNA, 21 bp, Homo sapiens
gagtgttcattttagtgactg

SEQ ID NO: 3942925 - DNA, 22 bp, Homo sapiens
gagtgttcattttagtgactgt

SEQ ID NO: 3942926 - DNA, 13 bp, Homo sapiens
gagtgttcctgtt

SEQ ID NO: 3942927 - DNA, 23 bp, Homo sapiens
gagtgttctgtgggcttggcctt

SEQ ID NO: 3942928 - DNA, 19 bp, Homo sapiens
gagttacagcgagaggcag

SEQ ID NO: 3942929 - DNA, 18 bp, Homo sapiens
gagttacttgtctgaggc

SEQ ID NO: 3942930 - DNA, 15 bp, Homo sapiens
gagttcaagaccagc

SEQ ID NO: 3942931 - DNA, 17 bp, Homo sapiens
gagttcaagaccagcct

SEQ ID NO: 3942932 - DNA, 15 bp, Homo sapiens
gagttccatgaagac

SEQ ID NO: 3942933 - DNA, 16 bp, Homo sapiens
gagttctgacattcat

SEQ ID NO: 3942934 - DNA, 22 bp, Homo sapiens
gagttgaccgttttcatcctgg

SEQ ID NO: 3942935 - DNA, 15 bp, Homo sapiens
gagttgacgcatcct

SEQ ID NO: 3942936 - DNA, 19 bp, Homo sapiens
gagttgacgcatcctgcag

SEQ ID NO: 3942937 - DNA, 14 bp, Homo sapiens
gagttgctcactca

SEQ ID NO: 3942938 - DNA, 18 bp, Homo sapiens
gagttgctcactcaggac

SEQ ID NO: 3942939 - DNA, 16 bp, Homo sapiens
gagttggacacactgt

SEQ ID NO: 3942940 - DNA, 18 bp, Homo sapiens
gagttggctcaggcagac

SEQ ID NO: 3942941 - DNA, 15 bp, Homo sapiens
gagttgttgccctgg

SEQ ID NO: 3942942 - DNA, 22 bp, Homo sapiens
gagttgttttcagactcagact

SEQ ID NO: 3942943 - DNA, 21 bp, Homo sapiens
gagttgttttggtgcctgcct

SEQ ID NO: 3942944 - DNA, 15 bp, Homo sapiens
gagtttggtccctgg

SEQ ID NO: 3942945 - DNA, 14 bp, Homo sapiens
gagttttcaaagat

SEQ ID NO: 3942946 - DNA, 18 bp, Homo sapiens
gataaaattgtgatgttt

SEQ ID NO: 3942947 - DNA, 13 bp, Homo sapiens
gataaagacagct

SEQ ID NO: 3942948 - DNA, 19 bp, Homo sapiens
gataaagacagctgacaga

SEQ ID NO: 3942949 - DNA, 13 bp, Homo sapiens
gataaagatgatc

SEQ ID NO: 3942950 - DNA, 20 bp, Homo sapiens
gataaaggaagtcaccaaaa

SEQ ID NO: 3942951 - DNA, 17 bp, Homo sapiens
gataacaaaatcacaag

SEQ ID NO: 3942952 - DNA, 18 bp, Homo sapiens
gataacaaaatcacaagc

SEQ ID NO: 3942953 - DNA, 20 bp, Homo sapiens
gataacaaaatcacaagcaa

SEQ ID NO: 3942954 - DNA, 16 bp, Homo sapiens
gataacaacctggaga

SEQ ID NO: 3942955 - DNA, 15 bp, Homo sapiens
gataacaagatcttt

SEQ ID NO: 3942956 - DNA, 15 bp, Homo sapiens
gataaccagctgtaa

SEQ ID NO: 3942957 - DNA, 17 bp, Homo sapiens
gataacctatatgattt

SEQ ID NO: 3942958 - DNA, 23 bp, Homo sapiens
gataacctatatgatttatagtt

SEQ ID NO: 3942959 - DNA, 13 bp, Homo sapiens
gataagtggaaaa

SEQ ID NO: 3942960 - DNA, 13 bp, Homo sapiens
gataatatgtttg

SEQ ID NO: 3942961 - DNA, 15 bp, Homo sapiens
gataatcagcctctt

SEQ ID NO: 3942962 - DNA, 19 bp, Homo sapiens
gataatgctgttgcctcat

SEQ ID NO: 3942963 - DNA, 18 bp, Homo sapiens
gataattatgtcccaggg

SEQ ID NO: 3942964 - DNA, 14 bp, Homo sapiens
gatacaaggatcag

SEQ ID NO: 3942965 - DNA, 23 bp, Homo sapiens
gatacagccccaaaccagggtgc

SEQ ID NO: 3942966 - DNA, 14 bp, Homo sapiens
gatacatagatgga

SEQ ID NO: 3942967 - DNA, 13 bp, Homo sapiens
gatacatggggaa

SEQ ID NO: 3942968 - DNA, 13 bp, Homo sapiens
gatacccagtccc

SEQ ID NO: 3942969 - DNA, 13 bp, Homo sapiens
gatactctgtcag

SEQ ID NO: 3942970 - DNA, 17 bp, Homo sapiens
gatactctgtcagatgg

SEQ ID NO: 3942971 - DNA, 13 bp, Homo sapiens
gatacttcaggtg

SEQ ID NO: 3942972 - DNA, 20 bp, Homo sapiens
gatacttcaggtgcttttga

SEQ ID NO: 3942973 - DNA, 18 bp, Homo sapiens
gatactttgatattttca

SEQ ID NO: 3942974 - DNA, 22 bp, Homo sapiens
gatagacagtgctgccctgcga

SEQ ID NO: 3942975 - DNA, 13 bp, Homo sapiens
gatagcagggcat

SEQ ID NO: 3942976 - DNA, 22 bp, Homo sapiens
gatagcatttttgatttatgca

SEQ ID NO: 3942977 - DNA, 14 bp, Homo sapiens
gatagccagacaca

SEQ ID NO: 3942978 - DNA, 15 bp, Homo sapiens
gatagtatcttttaa

SEQ ID NO: 3942979 - DNA, 21 bp, Homo sapiens
gatagttaaaagactgcagct

SEQ ID NO: 3942980 - DNA, 15 bp, Homo sapiens
gatatagaaagctgt

SEQ ID NO: 3942981 - DNA, 12 bp, Homo sapiens
gatatatgtatt

SEQ ID NO: 3942982 - DNA, 12 bp, Homo sapiens
gatatattttga

SEQ ID NO: 3942983 - DNA, 17 bp, Homo sapiens
gatatatttttcacagt

SEQ ID NO: 3942984 - DNA, 12 bp, Homo sapiens
gatatcacctct

SEQ ID NO: 3942985 - DNA, 18 bp, Homo sapiens
gatatcagagctcttaat

SEQ ID NO: 3942986 - DNA, 15 bp, Homo sapiens
gatatgcaaaagctg

SEQ ID NO: 3942987 - DNA, 20 bp, Homo sapiens
gatattatttaaatgttgaa

SEQ ID NO: 3942988 - DNA, 14 bp, Homo sapiens
gatatttgaatctt

SEQ ID NO: 3942989 - DNA, 19 bp, Homo sapiens
gatattttcaacgcagccc

SEQ ID NO: 3942990 - DNA, 15 bp, Homo sapiens
gatcaaaaataaact

SEQ ID NO: 3942991 - DNA, 15 bp, Homo sapiens
gatcaagtccagagc

SEQ ID NO: 3942992 - DNA, 14 bp, Homo sapiens
gatcacctgaggtc

SEQ ID NO: 3942993 - DNA, 12 bp, Homo sapiens
gatcagaaggct

SEQ ID NO: 3942994 - DNA, 14 bp, Homo sapiens
gatcagaaggctgg

SEQ ID NO: 3942995 - DNA, 17 bp, Homo sapiens
gatcagcgtggccttgt

SEQ ID NO: 3942996 - DNA, 12 bp, Homo sapiens
gatcaggaagag

SEQ ID NO: 3942997 - DNA, 15 bp, Homo sapiens
gatcaggaagagaag

SEQ ID NO: 3942998 - DNA, 18 bp, Homo sapiens
gatcaggaagagaaggag

SEQ ID NO: 3942999 - DNA, 18 bp, Homo sapiens
gatcataggtatttcaaa

SEQ ID NO: 3943000 - DNA, 23 bp, Homo sapiens
gatcatcccatctaagctgcagc

SEQ ID NO: 3943001 - DNA, 18 bp, Homo sapiens
gatcattacatggctgtg

SEQ ID NO: 3943002 - DNA, 22 bp, Homo sapiens
gatcattacatggctgtggttc

SEQ ID NO: 3943003 - DNA, 18 bp, Homo sapiens
gatcatttgttggaatga

SEQ ID NO: 3943004 - DNA, 14 bp, Homo sapiens
gatccacacacaga

SEQ ID NO: 3943005 - DNA, 21 bp, Homo sapiens
gatccaccctcaaatgtcaga

SEQ ID NO: 3943006 - DNA, 23 bp, Homo sapiens
gatccagagacttggggaccaga

SEQ ID NO: 3943007 - DNA, 20 bp, Homo sapiens
gatcccagagcttcccagga

SEQ ID NO: 3943008 - DNA, 15 bp, Homo sapiens
gatggacccctccct

SEQ ID NO: 3943009 - DNA, 16 bp, Homo sapiens
gatggacccctccctt

SEQ ID NO: 3943010 - DNA, 15 bp, Homo sapiens
gatggaccctcgcag

SEQ ID NO: 3943011 - DNA, 18 bp, Homo sapiens
gatggaccgggtgggcct

SEQ ID NO: 3943012 - DNA, 13 bp, Homo sapiens
gatggagaaggaa

SEQ ID NO: 3943013 - DNA, 14 bp, Homo sapiens
gatggagaaggaag

SEQ ID NO: 3943014 - DNA, 23 bp, Homo sapiens
gatggagacttcaggttgttctg

SEQ ID NO: 3943015 - DNA, 15 bp, Homo sapiens
gatggagagagggga

SEQ ID NO: 3943016 - DNA, 14 bp, Homo sapiens
gatggaggagaaat

SEQ ID NO: 3943017 - DNA, 19 bp, Homo sapiens
gatggaggagaaataaact

SEQ ID NO: 3943018 - DNA, 21 bp, Homo sapiens
gatggagtgtgcgtgtgtgca

SEQ ID NO: 3943019 - DNA, 14 bp, Homo sapiens
gatggatgctgggg

SEQ ID NO: 3943020 - DNA, 17 bp, Homo sapiens
gatggatggacagaatg

SEQ ID NO: 3943021 - DNA, 15 bp, Homo sapiens
gatggatttgtatca

SEQ ID NO: 3943022 - DNA, 18 bp, Homo sapiens
gatggcaccaacgggacc

SEQ ID NO: 3943023 - DNA, 14 bp, Homo sapiens
gatggccaagagca

SEQ ID NO: 3943024 - DNA, 18 bp, Homo sapiens
gatggccaagggggtgga

SEQ ID NO: 3943025 - DNA, 20 bp, Homo sapiens
gatggcgcgggaggcaccag

SEQ ID NO: 3943026 - DNA, 18 bp, Homo sapiens
gatgggaagatggtagca

SEQ ID NO: 3943027 - DNA, 15 bp, Homo sapiens
gatgggagtgagaca

SEQ ID NO: 3943028 - DNA, 16 bp, Homo sapiens
gatgggcacatgagga

SEQ ID NO: 3943029 - DNA, 18 bp, Homo sapiens
gatgggcacatgaggagg

SEQ ID NO: 3943030 - DNA, 22 bp, Homo sapiens
gatgggcacatgaggagggtgc

SEQ ID NO: 3943031 - DNA, 21 bp, Homo sapiens
gatggggacactaatgaagat

SEQ ID NO: 3943032 - DNA, 21 bp, Homo sapiens
gatgggtctggctgagctgaa

SEQ ID NO: 3943033 - DNA, 13 bp, Homo sapiens
gatggtagcagat

SEQ ID NO: 3943034 - DNA, 14 bp, Homo sapiens
gatggtagcagata

SEQ ID NO: 3943035 - DNA, 13 bp, Homo sapiens
gatggtgagctgg

SEQ ID NO: 3943036 - DNA, 15 bp, Homo sapiens
gatggtgagctggga

SEQ ID NO: 3943037 - DNA, 16 bp, Homo sapiens
gatgtaactattgaat

SEQ ID NO: 3943038 - DNA, 15 bp, Homo sapiens
gatgtagtctgaggc

SEQ ID NO: 3943039 - DNA, 13 bp, Homo sapiens
gatgtattggaac

SEQ ID NO: 3943040 - DNA, 11 bp, Homo sapiens
gatgtcagcct

SEQ ID NO: 3943041 - DNA, 12 bp, Homo sapiens
gatgtcagcctt

SEQ ID NO: 3943042 - DNA, 15 bp, Homo sapiens
gatgtcagccttgca

SEQ ID NO: 3943043 - DNA, 13 bp, Homo sapiens
gatgtcatcccct

SEQ ID NO: 3943044 - DNA, 22 bp, Homo sapiens
gatgtcatgtacttcctgtgta

SEQ ID NO: 3943045 - DNA, 18 bp, Homo sapiens
gatgtcccaacttgtaaa

SEQ ID NO: 3943046 - DNA, 17 bp, Homo sapiens
gatgtcccctgtcccac

SEQ ID NO: 3943047 - DNA, 13 bp, Homo sapiens
gatgtctcttgta

SEQ ID NO: 3943048 - DNA, 16 bp, Homo sapiens
gatgtctcttgtagaa

SEQ ID NO: 3943049 - DNA, 21 bp, Homo sapiens
gatgtgaattgcctgcagaga

SEQ ID NO: 3943050 - DNA, 14 bp, Homo sapiens
gatgtggccctggc

SEQ ID NO: 3943051 - DNA, 20 bp, Homo sapiens
gatgtggccctggcctgctg

SEQ ID NO: 3943052 - DNA, 22 bp, Homo sapiens
gatgtgggagggagcagacagg

SEQ ID NO: 3943053 - DNA, 15 bp, Homo sapiens
gatgtgtggggcatg

SEQ ID NO: 3943054 - DNA, 14 bp, Homo sapiens
gatgttaactatta

SEQ ID NO: 3943055 - DNA, 23 bp, Homo sapiens
gatgttgaatgcccacaggcaaa

SEQ ID NO: 3943056 - DNA, 14 bp, Homo sapiens
gatgtttccagaaa

SEQ ID NO: 3943057 - DNA, 14 bp, Homo sapiens
gattaaacacctga

SEQ ID NO: 3943058 - DNA, 13 bp, Homo sapiens
gattaaaggaagg

SEQ ID NO: 3943059 - DNA, 14 bp, Homo sapiens
gattaaaggaagga

SEQ ID NO: 3943060 - DNA, 15 bp, Homo sapiens
gattaaaggaaggaa

SEQ ID NO: 3943061 - DNA, 16 bp, Homo sapiens
gattaaaggaaggaaa

SEQ ID NO: 3943062 - DNA, 16 bp, Homo sapiens
gattaatggcactgat

SEQ ID NO: 3943063 - DNA, 19 bp, Homo sapiens
gattaatttatggtttctg

SEQ ID NO: 3943064 - DNA, 22 bp, Homo sapiens
gattactgtttggctgacatga

SEQ ID NO: 3943065 - DNA, 14 bp, Homo sapiens
gattagaaggcaag

SEQ ID NO: 3943066 - DNA, 20 bp, Homo sapiens
gattattcatttaaaatgat

SEQ ID NO: 3943067 - DNA, 18 bp, Homo sapiens
gattcaggaaaaggcctg

SEQ ID NO: 3943068 - DNA, 20 bp, Homo sapiens
gattcaggaaaaggcctggg

SEQ ID NO: 3943069 - DNA, 19 bp, Homo sapiens
gattcccagagcaaaataa

SEQ ID NO: 3943070 - DNA, 19 bp, Homo sapiens
gattccctctcccaggccc

SEQ ID NO: 3943071 - DNA, 13 bp, Homo sapiens
gattcctgggcct

SEQ ID NO: 3943072 - DNA, 22 bp, Homo sapiens
gattccttttgatggggagaaa

SEQ ID NO: 3943073 - DNA, 15 bp, Homo sapiens
gattctcatgtctca

SEQ ID NO: 3943074 - DNA, 17 bp, Homo sapiens
gattctgggatgctcct

SEQ ID NO: 3943075 - DNA, 17 bp, Homo sapiens
gattgcttaaaatagca

SEQ ID NO: 3943076 - DNA, 15 bp, Homo sapiens
gattggattattcat

SEQ ID NO: 3943077 - DNA, 20 bp, Homo sapiens
gattggattattcatttaaa

SEQ ID NO: 3943078 - DNA, 18 bp, Homo sapiens
gattggctcacccaagca

SEQ ID NO: 3943079 - DNA, 22 bp, Homo sapiens
gattggctcacccaagcaaggc

SEQ ID NO: 3943080 - DNA, 16 bp, Homo sapiens
gattggctttaaacac

SEQ ID NO: 3943081 - DNA, 12 bp, Homo sapiens
gattgggtgcca

SEQ ID NO: 3943082 - DNA, 14 bp, Homo sapiens
gattgggtgccatg

SEQ ID NO: 3943083 - DNA, 23 bp, Homo sapiens
gattgtaaaatagcttgtatagt

SEQ ID NO: 3943084 - DNA, 14 bp, Homo sapiens
gattgttaaaataa

SEQ ID NO: 3943085 - DNA, 16 bp, Homo sapiens
gattgttacagaagct

SEQ ID NO: 3943086 - DNA, 22 bp, Homo sapiens
gatttaatgttttctgctgttt

SEQ ID NO: 3943087 - DNA, 17 bp, Homo sapiens
gatttaccttttctgtt

SEQ ID NO: 3943088 - DNA, 20 bp, Homo sapiens
gatttaccttttctgttgta

SEQ ID NO: 3943089 - DNA, 20 bp, Homo sapiens
gatttagtaatagtccaata

SEQ ID NO: 3943090 - DNA, 20 bp, Homo sapiens
gatttatagtttgtacatgc

SEQ ID NO: 3943091 - DNA, 17 bp, Homo sapiens
gatttcaacatatcatt

SEQ ID NO: 3943092 - DNA, 19 bp, Homo sapiens
gatttcaagaaaaaataaa

SEQ ID NO: 3943093 - DNA, 20 bp, Homo sapiens
gatttcaggatactctgtca

SEQ ID NO: 3943094 - DNA, 22 bp, Homo sapiens
gatttcaggatactctgtcaga

SEQ ID NO: 3943095 - DNA, 13 bp, Homo sapiens
gcaagggctccag

SEQ ID NO: 3943096 - DNA, 15 bp, Homo sapiens
gcaagggctccagca

SEQ ID NO: 3943097 - DNA, 17 bp, Homo sapiens
gcaagggctccagcatc

SEQ ID NO: 3943098 - DNA, 21 bp, Homo sapiens
gcaagggctccagcatccagc

SEQ ID NO: 3943099 - DNA, 13 bp, Homo sapiens
gcaagggggcggg

SEQ ID NO: 3943100 - DNA, 22 bp, Homo sapiens
gcaagggggtgtcatctgagga

SEQ ID NO: 3943101 - DNA, 22 bp, Homo sapiens
gcaaggtctccttactctgagc

SEQ ID NO: 3943102 - DNA, 22 bp, Homo sapiens
gcaaggtgaacaccactttgtc

SEQ ID NO: 3943103 - DNA, 15 bp, Homo sapiens
gcaaggtgtgaatga

SEQ ID NO: 3943104 - DNA, 23 bp, Homo sapiens
gcaagtcatacttaggaatttct

SEQ ID NO: 3943105 - DNA, 18 bp, Homo sapiens
gcaagtgacatgccatcc

SEQ ID NO: 3943106 - DNA, 16 bp, Homo sapiens
gcaagttcagggaagc

SEQ ID NO: 3943107 - DNA, 22 bp, Homo sapiens
gcaagttcagggaagcaggcag

SEQ ID NO: 3943108 - DNA, 24 bp, Homo sapiens
gcaagttcagggaagcaggcagag

SEQ ID NO: 3943109 - DNA, 17 bp, Homo sapiens
gcaagttctagagaaga

SEQ ID NO: 3943110 - DNA, 21 bp, Homo sapiens
gcaagttctagagaagaggct

SEQ ID NO: 3943111 - DNA, 17 bp, Homo sapiens
gcaataatgtgcaaatt

SEQ ID NO: 3943112 - DNA, 22 bp, Homo sapiens
gcaataattaggatctatgcaa

SEQ ID NO: 3943113 - DNA, 22 bp, Homo sapiens
gcaatatctttaataggttaat

SEQ ID NO: 3943114 - DNA, 14 bp, Homo sapiens
gcaatatgtaaata

SEQ ID NO: 3943115 - DNA, 20 bp, Homo sapiens
gcaatctccagggctgcccc

SEQ ID NO: 3943116 - DNA, 22 bp, Homo sapiens
gcaatgggagggggctccatgg

SEQ ID NO: 3943117 - DNA, 23 bp, Homo sapiens
gcaatgggagggggctccatgga

SEQ ID NO: 3943118 - DNA, 14 bp, Homo sapiens
gcaatgggcactgg

SEQ ID NO: 3943119 - DNA, 23 bp, Homo sapiens
gcaatggtgttgccctgagtgga

SEQ ID NO: 3943120 - DNA, 16 bp, Homo sapiens
gcaattatattgtcct

SEQ ID NO: 3943121 - DNA, 23 bp, Homo sapiens
gcaatttcaaattactctttctc

SEQ ID NO: 3943122 - DNA, 14 bp, Homo sapiens
gcaattttgtaacg

SEQ ID NO: 3943123 - DNA, 20 bp, Homo sapiens
gcaatttttaaactagtaat

SEQ ID NO: 3943124 - DNA, 15 bp, Homo sapiens
gcaatttttttatac

SEQ ID NO: 3943125 - DNA, 17 bp, Homo sapiens
gcaatttttttatacta

SEQ ID NO: 3943126 - DNA, 15 bp, Homo sapiens
gcacaaatatttatt

SEQ ID NO: 3943127 - DNA, 13 bp, Homo sapiens
gcacaagctcaga

SEQ ID NO: 3943128 - DNA, 22 bp, Homo sapiens
gcacaagctcagaatagatctg

SEQ ID NO: 3943129 - DNA, 17 bp, Homo sapiens
gcacaagcttgtatata

SEQ ID NO: 3943130 - DNA, 13 bp, Homo sapiens
gcacaatttagaa

SEQ ID NO: 3943131 - DNA, 18 bp, Homo sapiens
gcacaatttgagcaattc

SEQ ID NO: 3943132 - DNA, 22 bp, Homo sapiens
gcacacaatgctattgaaatta

SEQ ID NO: 3943133 - DNA, 22 bp, Homo sapiens
gcacacacacaccaatgcgcac

SEQ ID NO: 3943134 - DNA, 22 bp, Homo sapiens
gcacacacaccggtcaccgaga

SEQ ID NO: 3943135 - DNA, 15 bp, Homo sapiens
gcacacacagatgca

SEQ ID NO: 3943136 - DNA, 18 bp, Homo sapiens
gcacacacagatgcacac

SEQ ID NO: 3943137 - DNA, 15 bp, Homo sapiens
gcacacagaaatata

SEQ ID NO: 3943138 - DNA, 18 bp, Homo sapiens
gcacacagaaatatatat

SEQ ID NO: 3943139 - DNA, 14 bp, Homo sapiens
gcacacagcagccc

SEQ ID NO: 3943140 - DNA, 17 bp, Homo sapiens
gcacacatggacacaga

SEQ ID NO: 3943141 - DNA, 13 bp, Homo sapiens
gcacaccactgcc

SEQ ID NO: 3943142 - DNA, 16 bp, Homo sapiens
gcacaccactgccctg

SEQ ID NO: 3943143 - DNA, 19 bp, Homo sapiens
gcacaccactgccctgcct

SEQ ID NO: 3943144 - DNA, 21 bp, Homo sapiens
gcacaccactgccctgcctgc

SEQ ID NO: 3943145 - DNA, 22 bp, Homo sapiens
gcacaccactgccctgcctgcc

SEQ ID NO: 3943146 - DNA, 23 bp, Homo sapiens
gcacaccccaagggacaacccca

SEQ ID NO: 3943147 - DNA, 12 bp, Homo sapiens
gcacacctgtgg

SEQ ID NO: 3943148 - DNA, 17 bp, Homo sapiens
gcacacctgtggtgcct

SEQ ID NO: 3943149 - DNA, 14 bp, Homo sapiens
gcacagacttctgg

SEQ ID NO: 3943150 - DNA, 18 bp, Homo sapiens
gcacagacttctggaagg

SEQ ID NO: 3943151 - DNA, 22 bp, Homo sapiens
gcacagacttctggaaggctgg

SEQ ID NO: 3943152 - DNA, 17 bp, Homo sapiens
gcacagagggctaggga

SEQ ID NO: 3943153 - DNA, 13 bp, Homo sapiens
gcacagctgcttg

SEQ ID NO: 3943154 - DNA, 18 bp, Homo sapiens
gcacaggaaaaggtagct

SEQ ID NO: 3943155 - DNA, 21 bp, Homo sapiens
gcacaggactgattctgggat

SEQ ID NO: 3943156 - DNA, 12 bp, Homo sapiens
gcacaggcagct

SEQ ID NO: 3943157 - DNA, 16 bp, Homo sapiens
gcacaggcaggaagag

SEQ ID NO: 3943158 - DNA, 17 bp, Homo sapiens
gcacaggcaggaagaga

SEQ ID NO: 3943159 - DNA, 19 bp, Homo sapiens
gcacaggcaggaagagaga

SEQ ID NO: 3943160 - DNA, 15 bp, Homo sapiens
gcacaggggccccag

SEQ ID NO: 3943161 - DNA, 20 bp, Homo sapiens
gcacaggggccccagatctg

SEQ ID NO: 3943162 - DNA, 15 bp, Homo sapiens
gcacaggtgtaaata

SEQ ID NO: 3943163 - DNA, 16 bp, Homo sapiens
gcacaggtgtaaatat

SEQ ID NO: 3943164 - DNA, 13 bp, Homo sapiens
gcacagtgcatct

SEQ ID NO: 3943165 - DNA, 15 bp, Homo sapiens
gcacagtgcatctca

SEQ ID NO: 3943166 - DNA, 18 bp, Homo sapiens
gcacagtgcatctcagcc

SEQ ID NO: 3943167 - DNA, 21 bp, Homo sapiens
gcacagttgtctattctgagc

SEQ ID NO: 3943168 - DNA, 22 bp, Homo sapiens
gcacagttgtctattctgagcc

SEQ ID NO: 3943169 - DNA, 20 bp, Homo sapiens
gcacatagagatatgcacac

SEQ ID NO: 3943170 - DNA, 14 bp, Homo sapiens
gcacatattgagca

SEQ ID NO: 3943171 - DNA, 19 bp, Homo sapiens
gcaccaccatgccaggcta

SEQ ID NO: 3943172 - DNA, 21 bp, Homo sapiens
gcaccacggcgtttttttaca

SEQ ID NO: 3943173 - DNA, 21 bp, Homo sapiens
gcaccagaggctgcagaaggc

SEQ ID NO: 3943174 - DNA, 20 bp, Homo sapiens
gcaccagatgcaacctcact

SEQ ID NO: 3943175 - DNA, 15 bp, Homo sapiens
gcaccagccccctgg

SEQ ID NO: 3943176 - DNA, 15 bp, Homo sapiens
gcaccagcccttccc

SEQ ID NO: 3943177 - DNA, 13 bp, Homo sapiens
gcaccagctctgt

SEQ ID NO: 3943178 - DNA, 15 bp, Homo sapiens
gcaccagctgctctg

SEQ ID NO: 3943179 - DNA, 16 bp, Homo sapiens
gcaccagctgctctgc

SEQ ID NO: 3943180 - DNA, 17 bp, Homo sapiens
gcaccagcttctccagg

SEQ ID NO: 3943181 - DNA, 22 bp, Homo sapiens
gcagaaaatcttttactagtgt

SEQ ID NO: 3943182 - DNA, 21 bp, Homo sapiens
gcagaacatgtgggaggaaga

SEQ ID NO: 3943183 - DNA, 21 bp, Homo sapiens
gcagaagaattgaacccagga

SEQ ID NO: 3943184 - DNA, 12 bp, Homo sapiens
gcagaaggaagg

SEQ ID NO: 3943185 - DNA, 22 bp, Homo sapiens
gcagaaggaagggcatccttct

SEQ ID NO: 3943186 - DNA, 13 bp, Homo sapiens
gcagaagggagaa

SEQ ID NO: 3943187 - DNA, 15 bp, Homo sapiens
gcagaagggagaagg

SEQ ID NO: 3943188 - DNA, 23 bp, Homo sapiens
gcagaatcctaggctccacccca

SEQ ID NO: 3943189 - DNA, 13 bp, Homo sapiens
gcagaatgttttt

SEQ ID NO: 3943190 - DNA, 18 bp, Homo sapiens
gcagacaagagctgctgt

SEQ ID NO: 3943191 - DNA, 14 bp, Homo sapiens
gcagacaggaggaa

SEQ ID NO: 3943192 - DNA, 16 bp, Homo sapiens
gcagaccatctccagc

SEQ ID NO: 3943193 - DNA, 15 bp, Homo sapiens
gcagaccctgccctt

SEQ ID NO: 3943194 - DNA, 19 bp, Homo sapiens
gcagaccgggggccagaca

SEQ ID NO: 3943195 - DNA, 21 bp, Homo sapiens
gcagactcctcagatctgaac

SEQ ID NO: 3943196 - DNA, 22 bp, Homo sapiens
gcagacttgagtctgaggcccc

SEQ ID NO: 3943197 - DNA, 15 bp, Homo sapiens
gcagagaaggcctct

SEQ ID NO: 3943198 - DNA, 15 bp, Homo sapiens
gcagagaccccagga

SEQ ID NO: 3943199 - DNA, 16 bp, Homo sapiens
gcagagacgcaaggga

SEQ ID NO: 3943200 - DNA, 12 bp, Homo sapiens
gcagagagaagc

SEQ ID NO: 3943201 - DNA, 13 bp, Homo sapiens
gcagagagaagcc

SEQ ID NO: 3943202 - DNA, 16 bp, Homo sapiens
gcagagagaagcctgt

SEQ ID NO: 3943203 - DNA, 20 bp, Homo sapiens
gcagagaggaccccactgga

SEQ ID NO: 3943204 - DNA, 13 bp, Homo sapiens
gcagagcctgagt

SEQ ID NO: 3943205 - DNA, 18 bp, Homo sapiens
gcagagctgatggagaag

SEQ ID NO: 3943206 - DNA, 22 bp, Homo sapiens
gcagagctgatggagaaggaag

SEQ ID NO: 3943207 - DNA, 15 bp, Homo sapiens
gcagaggcagacagg

SEQ ID NO: 3943208 - DNA, 16 bp, Homo sapiens
gcagaggcggaaacct

SEQ ID NO: 3943209 - DNA, 17 bp, Homo sapiens
gcagaggcggaaacctt

SEQ ID NO: 3943210 - DNA, 18 bp, Homo sapiens
gcagaggcggaaaccttg

SEQ ID NO: 3943211 - DNA, 19 bp, Homo sapiens
gcagaggctggaggcaggg

SEQ ID NO: 3943212 - DNA, 21 bp, Homo sapiens
gcagaggctggaggcagggcc

SEQ ID NO: 3943213 - DNA, 22 bp, Homo sapiens
gcagaggctggaggcagggcct

SEQ ID NO: 3943214 - DNA, 17 bp, Homo sapiens
gcagagggaatgttccc

SEQ ID NO: 3943215 - DNA, 15 bp, Homo sapiens
gcagaggggcagccg

SEQ ID NO: 3943216 - DNA, 17 bp, Homo sapiens
gcagaggggcagccgct

SEQ ID NO: 3943217 - DNA, 21 bp, Homo sapiens
gcagaggtaaaagtgtgagca

SEQ ID NO: 3943218 - DNA, 16 bp, Homo sapiens
gcagaggtttcttgaa

SEQ ID NO: 3943219 - DNA, 19 bp, Homo sapiens
gcagagtgaggatgtgttt

SEQ ID NO: 3943220 - DNA, 18 bp, Homo sapiens
gcagataatcagcctctt

SEQ ID NO: 3943221 - DNA, 19 bp, Homo sapiens
gcagataatcagcctctta

SEQ ID NO: 3943222 - DNA, 19 bp, Homo sapiens
gcagatcatgtaaggaagg

SEQ ID NO: 3943223 - DNA, 23 bp, Homo sapiens
gcagatctgaaaggcacactttg

SEQ ID NO: 3943224 - DNA, 15 bp, Homo sapiens
gcagatggaaagaaa

SEQ ID NO: 3943225 - DNA, 13 bp, Homo sapiens
gcagatgtaggag

SEQ ID NO: 3943226 - DNA, 16 bp, Homo sapiens
gcagatgtaggaggga

SEQ ID NO: 3943227 - DNA, 17 bp, Homo sapiens
gcagattcctgggcctg

SEQ ID NO: 3943228 - DNA, 21 bp, Homo sapiens
gcagattcctgggcctgtccc

SEQ ID NO: 3943229 - DNA, 22 bp, Homo sapiens
gcagattcctgggcctgtcccc

SEQ ID NO: 3943230 - DNA, 16 bp, Homo sapiens
gcagcaaaaatataaa

SEQ ID NO: 3943231 - DNA, 13 bp, Homo sapiens
gcagcaactccca

SEQ ID NO: 3943232 - DNA, 15 bp, Homo sapiens
gcagcaactcccacg

SEQ ID NO: 3943233 - DNA, 16 bp, Homo sapiens
gcagcaactcccacga

SEQ ID NO: 3943234 - DNA, 21 bp, Homo sapiens
gcagcaaggcccgagcagctg

SEQ ID NO: 3943235 - DNA, 19 bp, Homo sapiens
gcagcaccctcccccgcag

SEQ ID NO: 3943236 - DNA, 18 bp, Homo sapiens
gcagcactttaaccctct

SEQ ID NO: 3943237 - DNA, 21 bp, Homo sapiens
gcagcactttaaccctctctt

SEQ ID NO: 3943238 - DNA, 12 bp, Homo sapiens
gcagcagccagc

SEQ ID NO: 3943239 - DNA, 13 bp, Homo sapiens
gcagcagccagcc

SEQ ID NO: 3943240 - DNA, 12 bp, Homo sapiens
gcagcagctagg

SEQ ID NO: 3943241 - DNA, 17 bp, Homo sapiens
gcagcaggtgcaagaga

SEQ ID NO: 3943242 - DNA, 19 bp, Homo sapiens
gcagcaggtgcaagagaca

SEQ ID NO: 3943243 - DNA, 13 bp, Homo sapiens
gcagcagtgagct

SEQ ID NO: 3943244 - DNA, 15 bp, Homo sapiens
gcagcatcttcaaac

SEQ ID NO: 3943245 - DNA, 21 bp, Homo sapiens
gcagcatcttcaaacatgtac

SEQ ID NO: 3943246 - DNA, 16 bp, Homo sapiens
gcagcattcagcacac

SEQ ID NO: 3943247 - DNA, 18 bp, Homo sapiens
gcagccacacttctcagg

SEQ ID NO: 3943248 - DNA, 20 bp, Homo sapiens
gcagccacacttctcaggac

SEQ ID NO: 3943249 - DNA, 22 bp, Homo sapiens
gcagccacacttctcaggacac

SEQ ID NO: 3943250 - DNA, 17 bp, Homo sapiens
gcagccaccctgaggag

SEQ ID NO: 3943251 - DNA, 14 bp, Homo sapiens
gcagccagccctgc

SEQ ID NO: 3943252 - DNA, 16 bp, Homo sapiens
gcagccagccctgcct

SEQ ID NO: 3943253 - DNA, 17 bp, Homo sapiens
gcagccagccctgcctg

SEQ ID NO: 3943254 - DNA, 20 bp, Homo sapiens
gcagccagccctgcctggag

SEQ ID NO: 3943255 - DNA, 22 bp, Homo sapiens
gcagccagccctgcctggagga

SEQ ID NO: 3943256 - DNA, 18 bp, Homo sapiens
gcagccagccggtgcctg

SEQ ID NO: 3943257 - DNA, 14 bp, Homo sapiens
gcagccaggggctg

SEQ ID NO: 3943258 - DNA, 18 bp, Homo sapiens
gcagccaggggctgctca

SEQ ID NO: 3943259 - DNA, 13 bp, Homo sapiens
gcagccatgcctc

SEQ ID NO: 3943260 - DNA, 16 bp, Homo sapiens
gcagccatgcctcatg

SEQ ID NO: 3943261 - DNA, 20 bp, Homo sapiens
gcagcccagcttcctggtgt

SEQ ID NO: 3943262 - DNA, 13 bp, Homo sapiens
gcagccctgcttt

SEQ ID NO: 3943263 - DNA, 14 bp, Homo sapiens
gcagccctgctttg

SEQ ID NO: 3943264 - DNA, 17 bp, Homo sapiens
gcagccctgggggccag

SEQ ID NO: 3943265 - DNA, 18 bp, Homo sapiens
gcagccctgggggccagc

SEQ ID NO: 3943266 - DNA, 20 bp, Homo sapiens
gcagccctgggggccagctg

SEQ ID NO: 3943267 - DNA, 13 bp, Homo sapiens
gcagccctttggg

SEQ ID NO: 3943268 - DNA, 16 bp, Homo sapiens
gcaggggtctgagcca

SEQ ID NO: 3943269 - DNA, 18 bp, Homo sapiens
gcaggggtgggagagcca

SEQ ID NO: 3943270 - DNA, 13 bp, Homo sapiens
gcaggggttccca

SEQ ID NO: 3943271 - DNA, 15 bp, Homo sapiens
gcagggtgggatgga

SEQ ID NO: 3943272 - DNA, 20 bp, Homo sapiens
gcagggtgggggagggaggt

SEQ ID NO: 3943273 - DNA, 15 bp, Homo sapiens
gcaggtctcagcccg

SEQ ID NO: 3943274 - DNA, 18 bp, Homo sapiens
gcaggtctcagcccggga

SEQ ID NO: 3943275 - DNA, 20 bp, Homo sapiens
gcaggtgcaagagacagagc

SEQ ID NO: 3943276 - DNA, 23 bp, Homo sapiens
gcaggtgcaagagacagagcccc

SEQ ID NO: 3943277 - DNA, 17 bp, Homo sapiens
gcaggtggcatctctaa

SEQ ID NO: 3943278 - DNA, 15 bp, Homo sapiens
gcaggtggtcctgag

SEQ ID NO: 3943279 - DNA, 13 bp, Homo sapiens
gcaggtgtggtgg

SEQ ID NO: 3943280 - DNA, 18 bp, Homo sapiens
gcaggtgtggtggctcat

SEQ ID NO: 3943281 - DNA, 21 bp, Homo sapiens
gcaggtgtggtggctcatggc

SEQ ID NO: 3943282 - DNA, 12 bp, Homo sapiens
gcaggttcttga

SEQ ID NO: 3943283 - DNA, 15 bp, Homo sapiens
gcaggttcttgatgt

SEQ ID NO: 3943284 - DNA, 16 bp, Homo sapiens
gcaggttcttgatgtc

SEQ ID NO: 3943285 - DNA, 13 bp, Homo sapiens
gcagtacatggga

SEQ ID NO: 3943286 - DNA, 16 bp, Homo sapiens
gcagtatctctctgcc

SEQ ID NO: 3943287 - DNA, 21 bp, Homo sapiens
gcagtattccatgggatgtta

SEQ ID NO: 3943288 - DNA, 13 bp, Homo sapiens
gcagtccagaata

SEQ ID NO: 3943289 - DNA, 17 bp, Homo sapiens
gcagtccccagcccttc

SEQ ID NO: 3943290 - DNA, 22 bp, Homo sapiens
gcagtccccagcccttctgcct

SEQ ID NO: 3943291 - DNA, 23 bp, Homo sapiens
gcagtccccagcccttctgcctt

SEQ ID NO: 3943292 - DNA, 21 bp, Homo sapiens
gcagtcccgtggagggtaggg

SEQ ID NO: 3943293 - DNA, 23 bp, Homo sapiens
gcagtccctgagaccatttaaca

SEQ ID NO: 3943294 - DNA, 17 bp, Homo sapiens
gcagtcctcccacccta

SEQ ID NO: 3943295 - DNA, 15 bp, Homo sapiens
gcagtcgcaggatcc

SEQ ID NO: 3943296 - DNA, 18 bp, Homo sapiens
gcagtctcgggtggctag

SEQ ID NO: 3943297 - DNA, 18 bp, Homo sapiens
gcagtctgaacccttgtg

SEQ ID NO: 3943298 - DNA, 16 bp, Homo sapiens
gcagtctggcctgggc

SEQ ID NO: 3943299 - DNA, 16 bp, Homo sapiens
gcagtgaaaaatatgt

SEQ ID NO: 3943300 - DNA, 21 bp, Homo sapiens
gcagtgaacacactcagcagc

SEQ ID NO: 3943301 - DNA, 14 bp, Homo sapiens
gcagtgaactattt

SEQ ID NO: 3943302 - DNA, 21 bp, Homo sapiens
gcagtgagccgcatcttctcc

SEQ ID NO: 3943303 - DNA, 15 bp, Homo sapiens
gcagtgatacatgta

SEQ ID NO: 3943304 - DNA, 13 bp, Homo sapiens
gcagtgatgtcac

SEQ ID NO: 3943305 - DNA, 23 bp, Homo sapiens
gcagtgcaagagactctggcctc

SEQ ID NO: 3943306 - DNA, 17 bp, Homo sapiens
gcagtgcctcctgggac

SEQ ID NO: 3943307 - DNA, 19 bp, Homo sapiens
gcagtgcctcgaggcaccg

SEQ ID NO: 3943308 - DNA, 13 bp, Homo sapiens
gcagtgtgtcctt

SEQ ID NO: 3943309 - DNA, 23 bp, Homo sapiens
gcagtgtgtccttggggcacagt

SEQ ID NO: 3943310 - DNA, 21 bp, Homo sapiens
gcagttaatggggtagaggag

SEQ ID NO: 3943311 - DNA, 19 bp, Homo sapiens
gcagttcaaatcctcacca

SEQ ID NO: 3943312 - DNA, 18 bp, Homo sapiens
gcagttcgcagccaccct

SEQ ID NO: 3943313 - DNA, 19 bp, Homo sapiens
gcagttcgcagccaccctg

SEQ ID NO: 3943314 - DNA, 20 bp, Homo sapiens
gcagttcgcagccaccctga

SEQ ID NO: 3943315 - DNA, 22 bp, Homo sapiens
gcagttcgcagccaccctgagg

SEQ ID NO: 3943316 - DNA, 23 bp, Homo sapiens
gcagttcgcagccaccctgagga

SEQ ID NO: 3943317 - DNA, 16 bp, Homo sapiens
gcagttgaaaagactc

SEQ ID NO: 3943318 - DNA, 19 bp, Homo sapiens
gcagttgaaaagactccaa

SEQ ID NO: 3943319 - DNA, 21 bp, Homo sapiens
gcagttgaaaagactccaaag

SEQ ID NO: 3943320 - DNA, 22 bp, Homo sapiens
gcagttgaaaagactccaaaga

SEQ ID NO: 3943321 - DNA, 15 bp, Homo sapiens
gcagttgacagcagg

SEQ ID NO: 3943322 - DNA, 17 bp, Homo sapiens
gcagttgacagcaggtg

SEQ ID NO: 3943323 - DNA, 14 bp, Homo sapiens
gcagtttgggaggt

SEQ ID NO: 3943324 - DNA, 18 bp, Homo sapiens
gcataaaccaatgagctg

SEQ ID NO: 3943325 - DNA, 13 bp, Homo sapiens
gcataagattaaa

SEQ ID NO: 3943326 - DNA, 22 bp, Homo sapiens
gcataatgctcccatctcctga

SEQ ID NO: 3943327 - DNA, 16 bp, Homo sapiens
gcatacctttattgtg

SEQ ID NO: 3943328 - DNA, 15 bp, Homo sapiens
gcatagaaactgagg

SEQ ID NO: 3943329 - DNA, 22 bp, Homo sapiens
gcatagaggtaccagcaatatg

SEQ ID NO: 3943330 - DNA, 15 bp, Homo sapiens
gcatagggaatatgt

SEQ ID NO: 3943331 - DNA, 17 bp, Homo sapiens
gcatagtcactgtctca

SEQ ID NO: 3943332 - DNA, 23 bp, Homo sapiens
gcatatttatattgtatattctg

SEQ ID NO: 3943333 - DNA, 16 bp, Homo sapiens
gcatcaccatgcatgg

SEQ ID NO: 3943334 - DNA, 12 bp, Homo sapiens
gcatcagctgct

SEQ ID NO: 3943335 - DNA, 23 bp, Homo sapiens
gcatcagctgctgaaacaacaaa

SEQ ID NO: 3943336 - DNA, 13 bp, Homo sapiens
gcatcaggcactg

SEQ ID NO: 3943337 - DNA, 15 bp, Homo sapiens
gcatcaggcactggt

SEQ ID NO: 3943338 - DNA, 21 bp, Homo sapiens
gcatcatgcctctgaggccag

SEQ ID NO: 3943339 - DNA, 15 bp, Homo sapiens
gcatccacccagtgc

SEQ ID NO: 3943340 - DNA, 13 bp, Homo sapiens
gcatccagcctgt

SEQ ID NO: 3943341 - DNA, 21 bp, Homo sapiens
gcatcccaggggaccacacct

SEQ ID NO: 3943342 - DNA, 16 bp, Homo sapiens
gcatcccctttattaa

SEQ ID NO: 3943343 - DNA, 18 bp, Homo sapiens
gcatccgtagttccctga

SEQ ID NO: 3943344 - DNA, 13 bp, Homo sapiens
gcatctcattgta

SEQ ID NO: 3943345 - DNA, 19 bp, Homo sapiens
gcatctcattgtagagctt

SEQ ID NO: 3943346 - DNA, 22 bp, Homo sapiens
gcatctcttcctgattccccac

SEQ ID NO: 3943347 - DNA, 19 bp, Homo sapiens
gcatctgactcacaagaag

SEQ ID NO: 3943348 - DNA, 12 bp, Homo sapiens
gcatctgcaccc

SEQ ID NO: 3943349 - DNA, 16 bp, Homo sapiens
gcatctgggattccca

SEQ ID NO: 3943350 - DNA, 13 bp, Homo sapiens
gcatcttctccat

SEQ ID NO: 3943351 - DNA, 14 bp, Homo sapiens
gcatcttctccatc

SEQ ID NO: 3943352 - DNA, 23 bp, Homo sapiens
gcatcttctggagtctccagtgg

SEQ ID NO: 3943353 - DNA, 15 bp, Homo sapiens
gcatcttctggcttg

SEQ ID NO: 3943354 - DNA, 23 bp, Homo sapiens
gccaattaaaatatatataaata

SEQ ID NO: 3943355 - DNA, 22 bp, Homo sapiens
gccacaaatcaaagcaagggct

SEQ ID NO: 3943356 - DNA, 21 bp, Homo sapiens
gccacaaccctgttttatact

SEQ ID NO: 3943357 - DNA, 23 bp, Homo sapiens
gccacaagaaatttgatttctat

SEQ ID NO: 3943358 - DNA, 19 bp, Homo sapiens
gccacaatgcctctcccac

SEQ ID NO: 3943359 - DNA, 11 bp, Homo sapiens
gccacagcccc

SEQ ID NO: 3943360 - DNA, 23 bp, Homo sapiens
gccacagccccacagcacccagg

SEQ ID NO: 3943361 - DNA, 22 bp, Homo sapiens
gccacagcttcttcatctttaa

SEQ ID NO: 3943362 - DNA, 13 bp, Homo sapiens
gccaccaataaaa

SEQ ID NO: 3943363 - DNA, 17 bp, Homo sapiens
gccaccacgtctgccag

SEQ ID NO: 3943364 - DNA, 16 bp, Homo sapiens
gccaccaggtcatctc

SEQ ID NO: 3943365 - DNA, 17 bp, Homo sapiens
gccaccatcctgcagcc

SEQ ID NO: 3943366 - DNA, 16 bp, Homo sapiens
gccacccaacagcacc

SEQ ID NO: 3943367 - DNA, 16 bp, Homo sapiens
gccacccagcaacaca

SEQ ID NO: 3943368 - DNA, 16 bp, Homo sapiens
gccaccccgtgccacc

SEQ ID NO: 3943369 - DNA, 22 bp, Homo sapiens
gccacccgtaggcagcctctct

SEQ ID NO: 3943370 - DNA, 18 bp, Homo sapiens
gccacccgttctgctggc

SEQ ID NO: 3943371 - DNA, 14 bp, Homo sapiens
gccaccctctccat

SEQ ID NO: 3943372 - DNA, 18 bp, Homo sapiens
gccaccctgaggcctctg

SEQ ID NO: 3943373 - DNA, 12 bp, Homo sapiens
gccacctcccac

SEQ ID NO: 3943374 - DNA, 11 bp, Homo sapiens
gccacctcccc

SEQ ID NO: 3943375 - DNA, 14 bp, Homo sapiens
gccacggccaccct

SEQ ID NO: 3943376 - DNA, 15 bp, Homo sapiens
gccacggccaccctc

SEQ ID NO: 3943377 - DNA, 16 bp, Homo sapiens
gccacgtgccaggccc

SEQ ID NO: 3943378 - DNA, 17 bp, Homo sapiens
gccacgtgccaggcccg

SEQ ID NO: 3943379 - DNA, 18 bp, Homo sapiens
gccacgtgccaggcccgg

SEQ ID NO: 3943380 - DNA, 23 bp, Homo sapiens
gccactaccttctgacctcccca

SEQ ID NO: 3943381 - DNA, 16 bp, Homo sapiens
gccactacctttgtcc

SEQ ID NO: 3943382 - DNA, 17 bp, Homo sapiens
gccactatgtccagcta

SEQ ID NO: 3943383 - DNA, 16 bp, Homo sapiens
gccactcattcctgta

SEQ ID NO: 3943384 - DNA, 16 bp, Homo sapiens
gccactccagacccct

SEQ ID NO: 3943385 - DNA, 18 bp, Homo sapiens
gccactccagacccctgg

SEQ ID NO: 3943386 - DNA, 19 bp, Homo sapiens
gccactcgcagtcgcagga

SEQ ID NO: 3943387 - DNA, 17 bp, Homo sapiens
gccactctcccctccct

SEQ ID NO: 3943388 - DNA, 22 bp, Homo sapiens
gccactctcccctccctcttcc

SEQ ID NO: 3943389 - DNA, 23 bp, Homo sapiens
gccactctcccctccctcttcct

SEQ ID NO: 3943390 - DNA, 18 bp, Homo sapiens
gccactgcactccagcct

SEQ ID NO: 3943391 - DNA, 13 bp, Homo sapiens
gccactgccaggc

SEQ ID NO: 3943392 - DNA, 17 bp, Homo sapiens
gccactgccaggcacct

SEQ ID NO: 3943393 - DNA, 20 bp, Homo sapiens
gccactgccaggcacctggc

SEQ ID NO: 3943394 - DNA, 13 bp, Homo sapiens
gccactgcctctt

SEQ ID NO: 3943395 - DNA, 18 bp, Homo sapiens
gccactgctttccagcct

SEQ ID NO: 3943396 - DNA, 15 bp, Homo sapiens
gccactgtggccaga

SEQ ID NO: 3943397 - DNA, 18 bp, Homo sapiens
gccactgtggccagagct

SEQ ID NO: 3943398 - DNA, 21 bp, Homo sapiens
gccacttcttaaaggcctgga

SEQ ID NO: 3943399 - DNA, 16 bp, Homo sapiens
gccacttgacattcct

SEQ ID NO: 3943400 - DNA, 23 bp, Homo sapiens
gccacttgacattccttgtcacc

SEQ ID NO: 3943401 - DNA, 15 bp, Homo sapiens
gccactttaagagag

SEQ ID NO: 3943402 - DNA, 14 bp, Homo sapiens
gccagaaggagggc

SEQ ID NO: 3943403 - DNA, 15 bp, Homo sapiens
gccagaaggagggca

SEQ ID NO: 3943404 - DNA, 16 bp, Homo sapiens
gccagaaggagggcag

SEQ ID NO: 3943405 - DNA, 22 bp, Homo sapiens
gccagaatcttcgtcctgcccc

SEQ ID NO: 3943406 - DNA, 12 bp, Homo sapiens
gccagacacatg

SEQ ID NO: 3943407 - DNA, 14 bp, Homo sapiens
gccagacacatggc

SEQ ID NO: 3943408 - DNA, 15 bp, Homo sapiens
gccagactggcacag

SEQ ID NO: 3943409 - DNA, 23 bp, Homo sapiens
gccagagaggagcacctgaaccc

SEQ ID NO: 3943410 - DNA, 24 bp, Homo sapiens
gccagagagggcccagctgtagcc

SEQ ID NO: 3943411 - DNA, 23 bp, Homo sapiens
gccagagcccaagtgccatccca

SEQ ID NO: 3943412 - DNA, 15 bp, Homo sapiens
gccagagctgggagg

SEQ ID NO: 3943413 - DNA, 13 bp, Homo sapiens
gccagatccaccc

SEQ ID NO: 3943414 - DNA, 17 bp, Homo sapiens
gccagcaaaccaggact

SEQ ID NO: 3943415 - DNA, 12 bp, Homo sapiens
gccagcaccctc

SEQ ID NO: 3943416 - DNA, 15 bp, Homo sapiens
gccagcaccctctcc

SEQ ID NO: 3943417 - DNA, 16 bp, Homo sapiens
gccagcaccctctcct

SEQ ID NO: 3943418 - DNA, 16 bp, Homo sapiens
gccagccatcacaagg

SEQ ID NO: 3943419 - DNA, 21 bp, Homo sapiens
gccagccatcacaaggggaac

SEQ ID NO: 3943420 - DNA, 13 bp, Homo sapiens
gccagcccagccc

SEQ ID NO: 3943421 - DNA, 20 bp, Homo sapiens
gccagccctacatcttcagc

SEQ ID NO: 3943422 - DNA, 13 bp, Homo sapiens
gccagccctccct

SEQ ID NO: 3943423 - DNA, 20 bp, Homo sapiens
gccagccctccctgtcctcc

SEQ ID NO: 3943424 - DNA, 10 bp, Homo sapiens
gccagccctg

SEQ ID NO: 3943425 - DNA, 14 bp, Homo sapiens
gccagccctgcctg

SEQ ID NO: 3943426 - DNA, 15 bp, Homo sapiens
gccagccctgcctgg

SEQ ID NO: 3943427 - DNA, 19 bp, Homo sapiens
gccagccctgcctggagga

SEQ ID NO: 3943428 - DNA, 20 bp, Homo sapiens
gccagccctgcctggaggac

SEQ ID NO: 3943429 - DNA, 18 bp, Homo sapiens
gccagccgccctgggctg

SEQ ID NO: 3943430 - DNA, 20 bp, Homo sapiens
gccagccgtgatgctcaggc

SEQ ID NO: 3943431 - DNA, 13 bp, Homo sapiens
gccagcctcagct

SEQ ID NO: 3943432 - DNA, 19 bp, Homo sapiens
gccagcctcagctcagcct

SEQ ID NO: 3943433 - DNA, 23 bp, Homo sapiens
gccagcctcagctcagcctcccc

SEQ ID NO: 3943434 - DNA, 14 bp, Homo sapiens
gccagcctcagtgc

SEQ ID NO: 3943435 - DNA, 18 bp, Homo sapiens
gccagcctcagtgccact

SEQ ID NO: 3943436 - DNA, 16 bp, Homo sapiens
gccagcctccccacat

SEQ ID NO: 3943437 - DNA, 21 bp, Homo sapiens
gccagcctccccacatatggc

SEQ ID NO: 3943438 - DNA, 12 bp, Homo sapiens
gccagcctggcc

SEQ ID NO: 3943439 - DNA, 20 bp, Homo sapiens
gccagcctggcctcctgcct

SEQ ID NO: 3943440 - DNA, 22 bp, Homo sapiens
gccagctcaggtgactggagcc

SEQ ID NO: 3943441 - DNA, 17 bp, Homo sapiens
gcccagctacattcctc

SEQ ID NO: 3943442 - DNA, 23 bp, Homo sapiens
gcccagctatggccccagggttg

SEQ ID NO: 3943443 - DNA, 16 bp, Homo sapiens
gcccagctgaggctgg

SEQ ID NO: 3943444 - DNA, 17 bp, Homo sapiens
gcccagctgtagccatg

SEQ ID NO: 3943445 - DNA, 21 bp, Homo sapiens
gcccagctgtagccatggctc

SEQ ID NO: 3943446 - DNA, 23 bp, Homo sapiens
gcccagctgtagccatggctcag

SEQ ID NO: 3943447 - DNA, 22 bp, Homo sapiens
gcccaggagctgagtcacctcc

SEQ ID NO: 3943448 - DNA, 15 bp, Homo sapiens
gcccaggcctccacg

SEQ ID NO: 3943449 - DNA, 14 bp, Homo sapiens
gcccaggctctggg

SEQ ID NO: 3943450 - DNA, 21 bp, Homo sapiens
gcccaggctctgggaaggggt

SEQ ID NO: 3943451 - DNA, 23 bp, Homo sapiens
gcccaggctctgggaaggggtgc

SEQ ID NO: 3943452 - DNA, 15 bp, Homo sapiens
gcccaggctgaagag

SEQ ID NO: 3943453 - DNA, 12 bp, Homo sapiens
gcccagggaggc

SEQ ID NO: 3943454 - DNA, 20 bp, Homo sapiens
gcccaggggcccacagggaa

SEQ ID NO: 3943455 - DNA, 12 bp, Homo sapiens
gcccaggtcctc

SEQ ID NO: 3943456 - DNA, 15 bp, Homo sapiens
gcccaggtcctctga

SEQ ID NO: 3943457 - DNA, 15 bp, Homo sapiens
gcccagtgacctgac

SEQ ID NO: 3943458 - DNA, 16 bp, Homo sapiens
gcccataccttctggt

SEQ ID NO: 3943459 - DNA, 23 bp, Homo sapiens
gcccatagaaacatgacactgac

SEQ ID NO: 3943460 - DNA, 19 bp, Homo sapiens
gcccatctcaggtgccact

SEQ ID NO: 3943461 - DNA, 20 bp, Homo sapiens
gcccatgggagctggttaga

SEQ ID NO: 3943462 - DNA, 19 bp, Homo sapiens
gcccatgtgtcccctcact

SEQ ID NO: 3943463 - DNA, 23 bp, Homo sapiens
gcccatgtgtcccctcactctgt

SEQ ID NO: 3943464 - DNA, 17 bp, Homo sapiens
gcccatgtgttccctct

SEQ ID NO: 3943465 - DNA, 20 bp, Homo sapiens
gcccattcgtctgtcccaga

SEQ ID NO: 3943466 - DNA, 23 bp, Homo sapiens
gcccattcgtctgtcccagagct

SEQ ID NO: 3943467 - DNA, 17 bp, Homo sapiens
gcccattctctctcctg

SEQ ID NO: 3943468 - DNA, 21 bp, Homo sapiens
gcccattctctctcctgtcca

SEQ ID NO: 3943469 - DNA, 18 bp, Homo sapiens
gcccatttcaattctcaa

SEQ ID NO: 3943470 - DNA, 19 bp, Homo sapiens
gcccatttcaattctcaaa

SEQ ID NO: 3943471 - DNA, 15 bp, Homo sapiens
gccccaaaccagggt

SEQ ID NO: 3943472 - DNA, 19 bp, Homo sapiens
gccccaacccgtggaggct

SEQ ID NO: 3943473 - DNA, 14 bp, Homo sapiens
gccccaactccttc

SEQ ID NO: 3943474 - DNA, 21 bp, Homo sapiens
gccccaactccttccagctag

SEQ ID NO: 3943475 - DNA, 15 bp, Homo sapiens
gccccaagcagccag

SEQ ID NO: 3943476 - DNA, 19 bp, Homo sapiens
gccccaagcagccagccag

SEQ ID NO: 3943477 - DNA, 22 bp, Homo sapiens
gccccaagcagccagccagtct

SEQ ID NO: 3943478 - DNA, 17 bp, Homo sapiens
gccccaaggggcccaca

SEQ ID NO: 3943479 - DNA, 18 bp, Homo sapiens
gccccaaggggcccacaa

SEQ ID NO: 3943480 - DNA, 13 bp, Homo sapiens
gccccaattttct

SEQ ID NO: 3943481 - DNA, 12 bp, Homo sapiens
gccccacagcac

SEQ ID NO: 3943482 - DNA, 15 bp, Homo sapiens
gccccacagcaccca

SEQ ID NO: 3943483 - DNA, 19 bp, Homo sapiens
gccccacagcacccaggct

SEQ ID NO: 3943484 - DNA, 11 bp, Homo sapiens
gccccaccacc

SEQ ID NO: 3943485 - DNA, 15 bp, Homo sapiens
gccccaccacctagg

SEQ ID NO: 3943486 - DNA, 20 bp, Homo sapiens
gccccaccacctaggccact

SEQ ID NO: 3943487 - DNA, 23 bp, Homo sapiens
gccccacccagggctccctcctg

SEQ ID NO: 3943488 - DNA, 20 bp, Homo sapiens
gccccaccctcgtggacacc

SEQ ID NO: 3943489 - DNA, 23 bp, Homo sapiens
gccccaccctcgtggacacctgc

SEQ ID NO: 3943490 - DNA, 17 bp, Homo sapiens
gccccacctacttgtga

SEQ ID NO: 3943491 - DNA, 23 bp, Homo sapiens
gccccacctacttgtgactgaag

SEQ ID NO: 3943492 - DNA, 15 bp, Homo sapiens
gccccagaggcctct

SEQ ID NO: 3943493 - DNA, 18 bp, Homo sapiens
gccccagatcaccagccc

SEQ ID NO: 3943494 - DNA, 16 bp, Homo sapiens
gccccagatctgcctg

SEQ ID NO: 3943495 - DNA, 18 bp, Homo sapiens
gccccagatctgcctggg

SEQ ID NO: 3943496 - DNA, 16 bp, Homo sapiens
gccccagcgcggcttg

SEQ ID NO: 3943497 - DNA, 22 bp, Homo sapiens
gccccagcgcggcttggccgcc

SEQ ID NO: 3943498 - DNA, 11 bp, Homo sapiens
gccccaggccc

SEQ ID NO: 3943499 - DNA, 14 bp, Homo sapiens
gccccaggccctcc

SEQ ID NO: 3943500 - DNA, 20 bp, Homo sapiens
gccccaggccctccctgact

SEQ ID NO: 3943501 - DNA, 12 bp, Homo sapiens
gccccagggcct

SEQ ID NO: 3943502 - DNA, 13 bp, Homo sapiens
gccccagggcctg

SEQ ID NO: 3943503 - DNA, 15 bp, Homo sapiens
gccccagggcctggg

SEQ ID NO: 3943504 - DNA, 19 bp, Homo sapiens
gccccaggggtgcctgtgg

SEQ ID NO: 3943505 - DNA, 14 bp, Homo sapiens
gccccaggtgccac

SEQ ID NO: 3943506 - DNA, 15 bp, Homo sapiens
gccccaggtgccacc

SEQ ID NO: 3943507 - DNA, 23 bp, Homo sapiens
gccccaggtgccaccaataaaaa

SEQ ID NO: 3943508 - DNA, 16 bp, Homo sapiens
gccccatctcctccca

SEQ ID NO: 3943509 - DNA, 15 bp, Homo sapiens
gccccatgacctcca

SEQ ID NO: 3943510 - DNA, 18 bp, Homo sapiens
gccccatgacctccagct

SEQ ID NO: 3943511 - DNA, 14 bp, Homo sapiens
gccccatgctctgc

SEQ ID NO: 3943512 - DNA, 22 bp, Homo sapiens
gccccatgctctgccccaagcc

SEQ ID NO: 3943513 - DNA, 20 bp, Homo sapiens
gcccccaaccccgcggtgct

SEQ ID NO: 3943514 - DNA, 22 bp, Homo sapiens
gcccccactttcaccagtttct

SEQ ID NO: 3943515 - DNA, 21 bp, Homo sapiens
gcccccatccctcggacccac

SEQ ID NO: 3943516 - DNA, 16 bp, Homo sapiens
gcccccatctccccag

SEQ ID NO: 3943517 - DNA, 18 bp, Homo sapiens
gcccccatctccccaggc

SEQ ID NO: 3943518 - DNA, 20 bp, Homo sapiens
gcccccatctccccaggcct

SEQ ID NO: 3943519 - DNA, 21 bp, Homo sapiens
gcccccatctccccaggcctc

SEQ ID NO: 3943520 - DNA, 19 bp, Homo sapiens
gccccccacacgcgtgtgt

SEQ ID NO: 3943521 - DNA, 12 bp, Homo sapiens
gccccccagcac

SEQ ID NO: 3943522 - DNA, 23 bp, Homo sapiens
gccccccccttgaatctgcaggg

SEQ ID NO: 3943523 - DNA, 16 bp, Homo sapiens
gccccccctcttttgg

SEQ ID NO: 3943524 - DNA, 16 bp, Homo sapiens
gcccccctccttgctc

SEQ ID NO: 3943525 - DNA, 20 bp, Homo sapiens
gcccccctccttgctctgca

SEQ ID NO: 3943526 - DNA, 17 bp, Homo sapiens
gcccccgacagcccagc

SEQ ID NO: 3943527 - DNA, 18 bp, Homo sapiens
gccctggatttcagaaag

SEQ ID NO: 3943528 - DNA, 10 bp, Homo sapiens
gccctggcaa

SEQ ID NO: 3943529 - DNA, 13 bp, Homo sapiens
gccctggcctgct

SEQ ID NO: 3943530 - DNA, 14 bp, Homo sapiens
gccctggcctgctg

SEQ ID NO: 3943531 - DNA, 16 bp, Homo sapiens
gccctggcctgctggg

SEQ ID NO: 3943532 - DNA, 22 bp, Homo sapiens
gccctgggcacccacctccacc

SEQ ID NO: 3943533 - DNA, 14 bp, Homo sapiens
gccctggggcctgt

SEQ ID NO: 3943534 - DNA, 15 bp, Homo sapiens
gccctggggcctgta

SEQ ID NO: 3943535 - DNA, 17 bp, Homo sapiens
gccctgggggccagctg

SEQ ID NO: 3943536 - DNA, 20 bp, Homo sapiens
gccctgggggccagctggtg

SEQ ID NO: 3943537 - DNA, 15 bp, Homo sapiens
gccctggtgctgcca

SEQ ID NO: 3943538 - DNA, 14 bp, Homo sapiens
gccctgtcccctga

SEQ ID NO: 3943539 - DNA, 16 bp, Homo sapiens
gccctgtcgagacact

SEQ ID NO: 3943540 - DNA, 14 bp, Homo sapiens
gccctgttaaaaga

SEQ ID NO: 3943541 - DNA, 17 bp, Homo sapiens
gcccttattttcaagaa

SEQ ID NO: 3943542 - DNA, 12 bp, Homo sapiens
gcccttccatgt

SEQ ID NO: 3943543 - DNA, 13 bp, Homo sapiens
gcccttccctgct

SEQ ID NO: 3943544 - DNA, 14 bp, Homo sapiens
gcccttccctgctt

SEQ ID NO: 3943545 - DNA, 16 bp, Homo sapiens
gcccttccctgctttg

SEQ ID NO: 3943546 - DNA, 15 bp, Homo sapiens
gcccttcctctccac

SEQ ID NO: 3943547 - DNA, 16 bp, Homo sapiens
gcccttcctctccact

SEQ ID NO: 3943548 - DNA, 20 bp, Homo sapiens
gcccttcctctccactgcct

SEQ ID NO: 3943549 - DNA, 21 bp, Homo sapiens
gcccttcctctccactgcctt

SEQ ID NO: 3943550 - DNA, 17 bp, Homo sapiens
gcccttcctggacagct

SEQ ID NO: 3943551 - DNA, 21 bp, Homo sapiens
gcccttcctggacagctgtgc

SEQ ID NO: 3943552 - DNA, 22 bp, Homo sapiens
gcccttcctggacagctgtgcc

SEQ ID NO: 3943553 - DNA, 20 bp, Homo sapiens
gcccttcgctgccaggacac

SEQ ID NO: 3943554 - DNA, 12 bp, Homo sapiens
gcccttctgcct

SEQ ID NO: 3943555 - DNA, 13 bp, Homo sapiens
gcccttgccccca

SEQ ID NO: 3943556 - DNA, 18 bp, Homo sapiens
gcccttgccctgacctcc

SEQ ID NO: 3943557 - DNA, 15 bp, Homo sapiens
gcccttggggcctgg

SEQ ID NO: 3943558 - DNA, 16 bp, Homo sapiens
gcccttggggcctggc

SEQ ID NO: 3943559 - DNA, 21 bp, Homo sapiens
gcccttggggtaagccagagc

SEQ ID NO: 3943560 - DNA, 18 bp, Homo sapiens
gcccttgtcctgccagct

SEQ ID NO: 3943561 - DNA, 22 bp, Homo sapiens
gcccttgtcctgccagctgcct

SEQ ID NO: 3943562 - DNA, 14 bp, Homo sapiens
gccctttctggacc

SEQ ID NO: 3943563 - DNA, 12 bp, Homo sapiens
gccctttctgtg

SEQ ID NO: 3943564 - DNA, 15 bp, Homo sapiens
gccctttgcaggccc

SEQ ID NO: 3943565 - DNA, 21 bp, Homo sapiens
gccctttgggtactactgctg

SEQ ID NO: 3943566 - DNA, 17 bp, Homo sapiens
gcccttttacagctctt

SEQ ID NO: 3943567 - DNA, 20 bp, Homo sapiens
gccgacctcgtcctccccct

SEQ ID NO: 3943568 - DNA, 22 bp, Homo sapiens
gccgactgcacagcggcccctg

SEQ ID NO: 3943569 - DNA, 12 bp, Homo sapiens
gccgagagcctg

SEQ ID NO: 3943570 - DNA, 19 bp, Homo sapiens
gccgagagcctgctccccc

SEQ ID NO: 3943571 - DNA, 22 bp, Homo sapiens
gccgagagcctgctcccccacc

SEQ ID NO: 3943572 - DNA, 19 bp, Homo sapiens
gccgagcaaccgtggccct

SEQ ID NO: 3943573 - DNA, 15 bp, Homo sapiens
gccgagccgggcctg

SEQ ID NO: 3943574 - DNA, 19 bp, Homo sapiens
gccgagccgggcctggggc

SEQ ID NO: 3943575 - DNA, 17 bp, Homo sapiens
gccgcaagtctgcagcc

SEQ ID NO: 3943576 - DNA, 16 bp, Homo sapiens
gccgccatcagcccaa

SEQ ID NO: 3943577 - DNA, 19 bp, Homo sapiens
gccgcccaccgtcttgggt

SEQ ID NO: 3943578 - DNA, 13 bp, Homo sapiens
gccgccctgggct

SEQ ID NO: 3943579 - DNA, 16 bp, Homo sapiens
gccgccgggcaggcct

SEQ ID NO: 3943580 - DNA, 17 bp, Homo sapiens
gccgccgggcaggcctg

SEQ ID NO: 3943581 - DNA, 13 bp, Homo sapiens
gccgcctcaatgt

SEQ ID NO: 3943582 - DNA, 16 bp, Homo sapiens
gccgcctcccagcctg

SEQ ID NO: 3943583 - DNA, 19 bp, Homo sapiens
gccgcctcccagcctgggg

SEQ ID NO: 3943584 - DNA, 20 bp, Homo sapiens
gccgcggtaggtaagggccg

SEQ ID NO: 3943585 - DNA, 21 bp, Homo sapiens
gccgcggtaggtaagggccgc

SEQ ID NO: 3943586 - DNA, 19 bp, Homo sapiens
gccgcgtggaatgtgagtg

SEQ ID NO: 3943587 - DNA, 18 bp, Homo sapiens
gccgctaggagagactga

SEQ ID NO: 3943588 - DNA, 14 bp, Homo sapiens
gccgctgcaccacg

SEQ ID NO: 3943589 - DNA, 16 bp, Homo sapiens
gccgctgccgctgcac

SEQ ID NO: 3943590 - DNA, 17 bp, Homo sapiens
gccgctgccgctgcacc

SEQ ID NO: 3943591 - DNA, 12 bp, Homo sapiens
gccgctgtgagc

SEQ ID NO: 3943592 - DNA, 17 bp, Homo sapiens
gccgctgtgagcccctg

SEQ ID NO: 3943593 - DNA, 23 bp, Homo sapiens
gccgctgtgagcccctggtcctg

SEQ ID NO: 3943594 - DNA, 16 bp, Homo sapiens
gccgctgttcacccac

SEQ ID NO: 3943595 - DNA, 15 bp, Homo sapiens
gccggaccaagatgg

SEQ ID NO: 3943596 - DNA, 11 bp, Homo sapiens
gccggcaaccc

SEQ ID NO: 3943597 - DNA, 13 bp, Homo sapiens
gccgggcaggcct

SEQ ID NO: 3943598 - DNA, 22 bp, Homo sapiens
gccgggcgtggtggcgggcacc

SEQ ID NO: 3943599 - DNA, 21 bp, Homo sapiens
gccgggctgcccttcgctgcc

SEQ ID NO: 3943600 - DNA, 22 bp, Homo sapiens
gccgggctgcccttcgctgcca

SEQ ID NO: 3943601 - DNA, 17 bp, Homo sapiens
gccggggcgagtggcac

SEQ ID NO: 3943602 - DNA, 15 bp, Homo sapiens
gccgtactgtctatg

SEQ ID NO: 3943603 - DNA, 18 bp, Homo sapiens
gccgtccatggcaccagc

SEQ ID NO: 3943604 - DNA, 19 bp, Homo sapiens
gccgtctgactccagagtc

SEQ ID NO: 3943605 - DNA, 23 bp, Homo sapiens
gccgtgaggacacgtggcctgca

SEQ ID NO: 3943606 - DNA, 17 bp, Homo sapiens
gccgtgatgctcaggct

SEQ ID NO: 3943607 - DNA, 12 bp, Homo sapiens
gccgtgcccagg

SEQ ID NO: 3943608 - DNA, 14 bp, Homo sapiens
gccgtgcccagggg

SEQ ID NO: 3943609 - DNA, 19 bp, Homo sapiens
gccgtgccttcagctctac

SEQ ID NO: 3943610 - DNA, 15 bp, Homo sapiens
gccgtggcttcccgc

SEQ ID NO: 3943611 - DNA, 19 bp, Homo sapiens
gccgtggcttcccgctcag

SEQ ID NO: 3943612 - DNA, 18 bp, Homo sapiens
gccgtgggggttgaggca

SEQ ID NO: 3943613 - DNA, 15 bp, Homo sapiens
gccgttccccttggc

SEQ ID NO: 3943614 - DNA, 16 bp, Homo sapiens
gcctctccaggcacca

SEQ ID NO: 3943615 - DNA, 23 bp, Homo sapiens
gcctctccaggcaccatctccct

SEQ ID NO: 3943616 - DNA, 14 bp, Homo sapiens
gcctctctcaggag

SEQ ID NO: 3943617 - DNA, 15 bp, Homo sapiens
gcctctctgctccag

SEQ ID NO: 3943618 - DNA, 16 bp, Homo sapiens
gcctctctgctccaga

SEQ ID NO: 3943619 - DNA, 16 bp, Homo sapiens
gcctctgaaatttccc

SEQ ID NO: 3943620 - DNA, 12 bp, Homo sapiens
gcctctgaggcc

SEQ ID NO: 3943621 - DNA, 13 bp, Homo sapiens
gcctctgaggcca

SEQ ID NO: 3943622 - DNA, 15 bp, Homo sapiens
gcctctgaggccagc

SEQ ID NO: 3943623 - DNA, 18 bp, Homo sapiens
gcctctgatatgggactg

SEQ ID NO: 3943624 - DNA, 21 bp, Homo sapiens
gcctctgccatgcccagagaa

SEQ ID NO: 3943625 - DNA, 13 bp, Homo sapiens
gcctctgccccaa

SEQ ID NO: 3943626 - DNA, 19 bp, Homo sapiens
gcctctgccccaaggggcc

SEQ ID NO: 3943627 - DNA, 12 bp, Homo sapiens
gcctctgccctg

SEQ ID NO: 3943628 - DNA, 17 bp, Homo sapiens
gcctctgccctgcctcc

SEQ ID NO: 3943629 - DNA, 15 bp, Homo sapiens
gcctctggaaagcaa

SEQ ID NO: 3943630 - DNA, 17 bp, Homo sapiens
gcctctggaaagcaaag

SEQ ID NO: 3943631 - DNA, 15 bp, Homo sapiens
gcctctgtgtccttc

SEQ ID NO: 3943632 - DNA, 21 bp, Homo sapiens
gcctctgtgtccttccctgca

SEQ ID NO: 3943633 - DNA, 19 bp, Homo sapiens
gcctcttaaagctgcctgt

SEQ ID NO: 3943634 - DNA, 22 bp, Homo sapiens
gcctcttaaagctgcctgtagt

SEQ ID NO: 3943635 - DNA, 23 bp, Homo sapiens
gcctcttaaagctgcctgtagtt

SEQ ID NO: 3943636 - DNA, 20 bp, Homo sapiens
gcctcttagtgattgtgtct

SEQ ID NO: 3943637 - DNA, 15 bp, Homo sapiens
gcctcttccctcagt

SEQ ID NO: 3943638 - DNA, 22 bp, Homo sapiens
gcctcttcctccctcattccac

SEQ ID NO: 3943639 - DNA, 18 bp, Homo sapiens
gcctcttggacctctgct

SEQ ID NO: 3943640 - DNA, 16 bp, Homo sapiens
gcctcttgtacagtta

SEQ ID NO: 3943641 - DNA, 16 bp, Homo sapiens
gcctcttgtgctcacg

SEQ ID NO: 3943642 - DNA, 22 bp, Homo sapiens
gcctcttgtgctcacgctcccc

SEQ ID NO: 3943643 - DNA, 18 bp, Homo sapiens
gcctcttttctctgtgct

SEQ ID NO: 3943644 - DNA, 21 bp, Homo sapiens
gcctgacaggttcccagcagc

SEQ ID NO: 3943645 - DNA, 23 bp, Homo sapiens
gcctgacaggttcccagcagctg

SEQ ID NO: 3943646 - DNA, 13 bp, Homo sapiens
gcctgagcccagg

SEQ ID NO: 3943647 - DNA, 14 bp, Homo sapiens
gcctgagcccaggg

SEQ ID NO: 3943648 - DNA, 15 bp, Homo sapiens
gcctgagcccaggga

SEQ ID NO: 3943649 - DNA, 18 bp, Homo sapiens
gcctgagcccagggaggc

SEQ ID NO: 3943650 - DNA, 17 bp, Homo sapiens
gcctgagctggggcctg

SEQ ID NO: 3943651 - DNA, 21 bp, Homo sapiens
gcctgagctggggcctggaga

SEQ ID NO: 3943652 - DNA, 13 bp, Homo sapiens
gcctgatgctgcc

SEQ ID NO: 3943653 - DNA, 17 bp, Homo sapiens
gcctgatgctgccccgt

SEQ ID NO: 3943654 - DNA, 13 bp, Homo sapiens
gcctgatggccaa

SEQ ID NO: 3943655 - DNA, 19 bp, Homo sapiens
gcctgatggccaagggggt

SEQ ID NO: 3943656 - DNA, 21 bp, Homo sapiens
gcctgcaaactcactgctcaa

SEQ ID NO: 3943657 - DNA, 11 bp, Homo sapiens
gcctgcagaga

SEQ ID NO: 3943658 - DNA, 14 bp, Homo sapiens
gcctgcagagagaa

SEQ ID NO: 3943659 - DNA, 19 bp, Homo sapiens
gcctgcagaggacagagct

SEQ ID NO: 3943660 - DNA, 15 bp, Homo sapiens
gcctgcagcctcccc

SEQ ID NO: 3943661 - DNA, 18 bp, Homo sapiens
gcctgcagcggcacaaat

SEQ ID NO: 3943662 - DNA, 17 bp, Homo sapiens
gcctgcccaatgctttg

SEQ ID NO: 3943663 - DNA, 14 bp, Homo sapiens
gcctgccctcaggg

SEQ ID NO: 3943664 - DNA, 12 bp, Homo sapiens
gcctgccctgga

SEQ ID NO: 3943665 - DNA, 16 bp, Homo sapiens
gcctgccgagcaaccg

SEQ ID NO: 3943666 - DNA, 19 bp, Homo sapiens
gcctgccgagcaaccgtgg

SEQ ID NO: 3943667 - DNA, 21 bp, Homo sapiens
gcctgccgccgtctctgtccc

SEQ ID NO: 3943668 - DNA, 17 bp, Homo sapiens
gcctgcctcccagccct

SEQ ID NO: 3943669 - DNA, 22 bp, Homo sapiens
gcctgcctcccagccctgccag

SEQ ID NO: 3943670 - DNA, 22 bp, Homo sapiens
gcctgcctctgccatgcccaga

SEQ ID NO: 3943671 - DNA, 20 bp, Homo sapiens
gcctgcctgataccctgctt

SEQ ID NO: 3943672 - DNA, 19 bp, Homo sapiens
gcctgcggccgggctgccc

SEQ ID NO: 3943673 - DNA, 15 bp, Homo sapiens
gcctgctaatagctg

SEQ ID NO: 3943674 - DNA, 22 bp, Homo sapiens
gcctgctcccagcagccctaag

SEQ ID NO: 3943675 - DNA, 11 bp, Homo sapiens
gcctgctcccc

SEQ ID NO: 3943676 - DNA, 15 bp, Homo sapiens
gcctgctcccccacc

SEQ ID NO: 3943677 - DNA, 16 bp, Homo sapiens
gcctgctcccccaccc

SEQ ID NO: 3943678 - DNA, 17 bp, Homo sapiens
gcctgctgcgtcagacc

SEQ ID NO: 3943679 - DNA, 20 bp, Homo sapiens
gcctgctgctgagaacctgg

SEQ ID NO: 3943680 - DNA, 22 bp, Homo sapiens
gcctgctgggctctccacctca

SEQ ID NO: 3943681 - DNA, 24 bp, Homo sapiens
gcctgctgggctctccacctcagc

SEQ ID NO: 3943682 - DNA, 16 bp, Homo sapiens
gcctgcttttccagga

SEQ ID NO: 3943683 - DNA, 15 bp, Homo sapiens
gcctggaaccaggga

SEQ ID NO: 3943684 - DNA, 17 bp, Homo sapiens
gcctggaaccagggagg

SEQ ID NO: 3943685 - DNA, 18 bp, Homo sapiens
gcctggaccgcttcccag

SEQ ID NO: 3943686 - DNA, 22 bp, Homo sapiens
gcctggactctaagctggagct

SEQ ID NO: 3943687 - DNA, 23 bp, Homo sapiens
gcctggactctaagctggagctc

SEQ ID NO: 3943688 - DNA, 12 bp, Homo sapiens
gcctggagaagc

SEQ ID NO: 3943689 - DNA, 12 bp, Homo sapiens
gcctggagaggg

SEQ ID NO: 3943690 - DNA, 14 bp, Homo sapiens
gcctggagaggggc

SEQ ID NO: 3943691 - DNA, 15 bp, Homo sapiens
gcctggagaggggcc

SEQ ID NO: 3943692 - DNA, 16 bp, Homo sapiens
gcctggagaggggcct

SEQ ID NO: 3943693 - DNA, 19 bp, Homo sapiens
gcctggagaggggcctggg

SEQ ID NO: 3943694 - DNA, 21 bp, Homo sapiens
gcctggagaggggcctgggaa

SEQ ID NO: 3943695 - DNA, 13 bp, Homo sapiens
gcctggaggacct

SEQ ID NO: 3943696 - DNA, 16 bp, Homo sapiens
gcctggaggacctgag

SEQ ID NO: 3943697 - DNA, 22 bp, Homo sapiens
gcctggaggacctgagcctgcc

SEQ ID NO: 3943698 - DNA, 21 bp, Homo sapiens
gcctggaggatccctccatcc

SEQ ID NO: 3943699 - DNA, 18 bp, Homo sapiens
gcctggcaagtgggtgaa

SEQ ID NO: 3943700 - DNA, 13 bp, Homo sapiens
gcctggcacagga

SEQ ID NO: 3943701 - DNA, 16 bp, Homo sapiens
gccttctccctgggaa

SEQ ID NO: 3943702 - DNA, 15 bp, Homo sapiens
gccttgcccagagat

SEQ ID NO: 3943703 - DNA, 22 bp, Homo sapiens
gccttgcccagagatgcctcca

SEQ ID NO: 3943704 - DNA, 21 bp, Homo sapiens
gccttggataatgctgttgcc

SEQ ID NO: 3943705 - DNA, 20 bp, Homo sapiens
gccttgtcaggacccaggcc

SEQ ID NO: 3943706 - DNA, 12 bp, Homo sapiens
gccttgtgccct

SEQ ID NO: 3943707 - DNA, 19 bp, Homo sapiens
gccttgtgccctgccccca

SEQ ID NO: 3943708 - DNA, 18 bp, Homo sapiens
gccttgtggataagggag

SEQ ID NO: 3943709 - DNA, 12 bp, Homo sapiens
gccttgttctgt

SEQ ID NO: 3943710 - DNA, 14 bp, Homo sapiens
gcctttcctgtgcc

SEQ ID NO: 3943711 - DNA, 15 bp, Homo sapiens
gcctttcctgtgcca

SEQ ID NO: 3943712 - DNA, 23 bp, Homo sapiens
gcctttctcgtggtagaagccag

SEQ ID NO: 3943713 - DNA, 15 bp, Homo sapiens
gcctttggaagaaac

SEQ ID NO: 3943714 - DNA, 20 bp, Homo sapiens
gcctttggatgaccagaaca

SEQ ID NO: 3943715 - DNA, 14 bp, Homo sapiens
gccttttatagcta

SEQ ID NO: 3943716 - DNA, 16 bp, Homo sapiens
gccttttttcacagcc

SEQ ID NO: 3943717 - DNA, 17 bp, Homo sapiens
gcgaataaatgttcaaa

SEQ ID NO: 3943718 - DNA, 18 bp, Homo sapiens
gcgacaggagtatttttt

SEQ ID NO: 3943719 - DNA, 16 bp, Homo sapiens
gcgagattgggcctcc

SEQ ID NO: 3943720 - DNA, 14 bp, Homo sapiens
gcgagctgctctgc

SEQ ID NO: 3943721 - DNA, 15 bp, Homo sapiens
gcgagctgctctgct

SEQ ID NO: 3943722 - DNA, 13 bp, Homo sapiens
gcgaggtgtaaag

SEQ ID NO: 3943723 - DNA, 15 bp, Homo sapiens
gcgagtgccaggact

SEQ ID NO: 3943724 - DNA, 22 bp, Homo sapiens
gcgagtgccaggactccccagg

SEQ ID NO: 3943725 - DNA, 17 bp, Homo sapiens
gcgatgaggtaattctc

SEQ ID NO: 3943726 - DNA, 14 bp, Homo sapiens
gcgattccctctcc

SEQ ID NO: 3943727 - DNA, 13 bp, Homo sapiens
gcgcaagcctgta

SEQ ID NO: 3943728 - DNA, 11 bp, Homo sapiens
gcgcacacaca

SEQ ID NO: 3943729 - DNA, 22 bp, Homo sapiens
gcgcagccgccgggcaggcctg

SEQ ID NO: 3943730 - DNA, 17 bp, Homo sapiens
gcgcagggaggatgcca

SEQ ID NO: 3943731 - DNA, 20 bp, Homo sapiens
gcgcagggaggatgccacag

SEQ ID NO: 3943732 - DNA, 18 bp, Homo sapiens
gcgcagtgcttctctaca

SEQ ID NO: 3943733 - DNA, 19 bp, Homo sapiens
gcgcccattcgtctgtccc

SEQ ID NO: 3943734 - DNA, 19 bp, Homo sapiens
gcgcgcagcgcgtgcacag

SEQ ID NO: 3943735 - DNA, 20 bp, Homo sapiens
gcgcggcttggccgccatcc

SEQ ID NO: 3943736 - DNA, 11 bp, Homo sapiens
gcgctcaggac

SEQ ID NO: 3943737 - DNA, 12 bp, Homo sapiens
gcgctcaggacc

SEQ ID NO: 3943738 - DNA, 13 bp, Homo sapiens
gcgctcaggaccc

SEQ ID NO: 3943739 - DNA, 17 bp, Homo sapiens
gcgctcaggacccaggc

SEQ ID NO: 3943740 - DNA, 18 bp, Homo sapiens
gcgctcaggacccaggcc

SEQ ID NO: 3943741 - DNA, 20 bp, Homo sapiens
gcgctcaggacccaggccct

SEQ ID NO: 3943742 - DNA, 18 bp, Homo sapiens
gcgctcttggtccctggt

SEQ ID NO: 3943743 - DNA, 20 bp, Homo sapiens
gcgctcttggtccctggtcc

SEQ ID NO: 3943744 - DNA, 22 bp, Homo sapiens
gcgctgcaggtacttcctcctg

SEQ ID NO: 3943745 - DNA, 19 bp, Homo sapiens
gcgctgccgcaccccagag

SEQ ID NO: 3943746 - DNA, 21 bp, Homo sapiens
gcgctgccgcaccccagagtg

SEQ ID NO: 3943747 - DNA, 14 bp, Homo sapiens
gcgctggctcagga

SEQ ID NO: 3943748 - DNA, 17 bp, Homo sapiens
gcgctggctcaggaaga

SEQ ID NO: 3943749 - DNA, 15 bp, Homo sapiens
gcgctttctggaaaa

SEQ ID NO: 3943750 - DNA, 12 bp, Homo sapiens
gcggaaaccttg

SEQ ID NO: 3943751 - DNA, 17 bp, Homo sapiens
gcggaaaccttgcagca

SEQ ID NO: 3943752 - DNA, 19 bp, Homo sapiens
gcggaaaccttgcagcatt

SEQ ID NO: 3943753 - DNA, 15 bp, Homo sapiens
gcggagagtacagtg

SEQ ID NO: 3943754 - DNA, 12 bp, Homo sapiens
gcggaggcggct

SEQ ID NO: 3943755 - DNA, 18 bp, Homo sapiens
gcggaggcggctccaggt

SEQ ID NO: 3943756 - DNA, 18 bp, Homo sapiens
gcggcacgccaacagccc

SEQ ID NO: 3943757 - DNA, 14 bp, Homo sapiens
gcggcaggagcagg

SEQ ID NO: 3943758 - DNA, 14 bp, Homo sapiens
gcggcagggtgggg

SEQ ID NO: 3943759 - DNA, 19 bp, Homo sapiens
gcggccgcattccctgagt

SEQ ID NO: 3943760 - DNA, 14 bp, Homo sapiens
gcggccgggctgcc

SEQ ID NO: 3943761 - DNA, 15 bp, Homo sapiens
gcggccgggctgccc

SEQ ID NO: 3943762 - DNA, 19 bp, Homo sapiens
gcggcctatgacttgggca

SEQ ID NO: 3943763 - DNA, 16 bp, Homo sapiens
gcggccttccaccggg

SEQ ID NO: 3943764 - DNA, 20 bp, Homo sapiens
gcggccttccaccgggcctg

SEQ ID NO: 3943765 - DNA, 13 bp, Homo sapiens
gcggcggccctca

SEQ ID NO: 3943766 - DNA, 13 bp, Homo sapiens
gcggctactcagc

SEQ ID NO: 3943767 - DNA, 19 bp, Homo sapiens
gcggctactcagcagccct

SEQ ID NO: 3943768 - DNA, 20 bp, Homo sapiens
gcggctactcagcagccctc

SEQ ID NO: 3943769 - DNA, 13 bp, Homo sapiens
gcggctccaggtc

SEQ ID NO: 3943770 - DNA, 19 bp, Homo sapiens
gcggcttcctgtccactct

SEQ ID NO: 3943771 - DNA, 17 bp, Homo sapiens
gcggcttggccgccatc

SEQ ID NO: 3943772 - DNA, 23 bp, Homo sapiens
gcgggacgagaccctacaggaga

SEQ ID NO: 3943773 - DNA, 17 bp, Homo sapiens
gcgggaggcaccagctc

SEQ ID NO: 3943774 - DNA, 23 bp, Homo sapiens
gcgggaggcaccagctctgtggc

SEQ ID NO: 3943775 - DNA, 15 bp, Homo sapiens
gcgggctgtgcctta

SEQ ID NO: 3943776 - DNA, 13 bp, Homo sapiens
gcggtcatgtgtg

SEQ ID NO: 3943777 - DNA, 22 bp, Homo sapiens
gcggtcatgtgtgcatgtgagc

SEQ ID NO: 3943778 - DNA, 13 bp, Homo sapiens
gcggtgctctggc

SEQ ID NO: 3943779 - DNA, 14 bp, Homo sapiens
gcggtgctctggcg

SEQ ID NO: 3943780 - DNA, 18 bp, Homo sapiens
gcggtggaaggcccgagg

SEQ ID NO: 3943781 - DNA, 15 bp, Homo sapiens
gcgtaatgggcctgc

SEQ ID NO: 3943782 - DNA, 14 bp, Homo sapiens
gcgtagagagccgg

SEQ ID NO: 3943783 - DNA, 19 bp, Homo sapiens
gcgtcccctgctactcctg

SEQ ID NO: 3943784 - DNA, 17 bp, Homo sapiens
gcgtcctgacgccctgc

SEQ ID NO: 3943785 - DNA, 18 bp, Homo sapiens
gcgtcctgcagaggacca

SEQ ID NO: 3943786 - DNA, 19 bp, Homo sapiens
gcgtcctgcagaggaccac

SEQ ID NO: 3943787 - DNA, 14 bp, Homo sapiens
gcgtctaccctggg

SEQ ID NO: 3943788 - DNA, 16 bp, Homo sapiens
gctataggctggagaa

SEQ ID NO: 3943789 - DNA, 18 bp, Homo sapiens
gctataggtgctacaaaa

SEQ ID NO: 3943790 - DNA, 14 bp, Homo sapiens
gctatattttcatg

SEQ ID NO: 3943791 - DNA, 23 bp, Homo sapiens
gctatattttcatgacttttcca

SEQ ID NO: 3943792 - DNA, 16 bp, Homo sapiens
gctatcctagagaggc

SEQ ID NO: 3943793 - DNA, 21 bp, Homo sapiens
gctatctgtcatctctctggg

SEQ ID NO: 3943794 - DNA, 18 bp, Homo sapiens
gctatgcgcaatgtggca

SEQ ID NO: 3943795 - DNA, 16 bp, Homo sapiens
gctatggccccagggt

SEQ ID NO: 3943796 - DNA, 22 bp, Homo sapiens
gctatgtatggaatacagtgtt

SEQ ID NO: 3943797 - DNA, 22 bp, Homo sapiens
gctattatgtaacatccagaag

SEQ ID NO: 3943798 - DNA, 13 bp, Homo sapiens
gctattgatgttt

SEQ ID NO: 3943799 - DNA, 20 bp, Homo sapiens
gctattgatgtttccagaaa

SEQ ID NO: 3943800 - DNA, 22 bp, Homo sapiens
gctattgatgtttccagaaaat

SEQ ID NO: 3943801 - DNA, 23 bp, Homo sapiens
gctattgatgtttccagaaaata

SEQ ID NO: 3943802 - DNA, 17 bp, Homo sapiens
gctattgcatgtaaaat

SEQ ID NO: 3943803 - DNA, 18 bp, Homo sapiens
gctattgttgtgggcttt

SEQ ID NO: 3943804 - DNA, 22 bp, Homo sapiens
gctattgtttctttaagaaagt

SEQ ID NO: 3943805 - DNA, 16 bp, Homo sapiens
gctatttaaaagtata

SEQ ID NO: 3943806 - DNA, 14 bp, Homo sapiens
gctatttgagcatg

SEQ ID NO: 3943807 - DNA, 17 bp, Homo sapiens
gctatttgttcagagag

SEQ ID NO: 3943808 - DNA, 18 bp, Homo sapiens
gctatttgttcagagagg

SEQ ID NO: 3943809 - DNA, 20 bp, Homo sapiens
gctatttgttgtttttaaca

SEQ ID NO: 3943810 - DNA, 22 bp, Homo sapiens
gctcaaatctattcagacaagc

SEQ ID NO: 3943811 - DNA, 23 bp, Homo sapiens
gctcaaatctattcagacaagca

SEQ ID NO: 3943812 - DNA, 17 bp, Homo sapiens
gctcaagaatcctctgg

SEQ ID NO: 3943813 - DNA, 14 bp, Homo sapiens
gctcaagaggccca

SEQ ID NO: 3943814 - DNA, 21 bp, Homo sapiens
gctcaatgcattgtcttgtgg

SEQ ID NO: 3943815 - DNA, 14 bp, Homo sapiens
gctcacaaaccatg

SEQ ID NO: 3943816 - DNA, 21 bp, Homo sapiens
gctcacagttcctcgccctgg

SEQ ID NO: 3943817 - DNA, 22 bp, Homo sapiens
gctcacagttcctcgccctggg

SEQ ID NO: 3943818 - DNA, 23 bp, Homo sapiens
gctcacagttcctcgccctgggt

SEQ ID NO: 3943819 - DNA, 18 bp, Homo sapiens
gctcaccaagctgttcca

SEQ ID NO: 3943820 - DNA, 19 bp, Homo sapiens
gctcacgactcttcctgca

SEQ ID NO: 3943821 - DNA, 15 bp, Homo sapiens
gctcagacccccact

SEQ ID NO: 3943822 - DNA, 19 bp, Homo sapiens
gctcagacccccactctca

SEQ ID NO: 3943823 - DNA, 23 bp, Homo sapiens
gctcagacccccactctcattcc

SEQ ID NO: 3943824 - DNA, 13 bp, Homo sapiens
gctcagactctgg

SEQ ID NO: 3943825 - DNA, 24 bp, Homo sapiens
gctcagactctgggtccctcggag

SEQ ID NO: 3943826 - DNA, 17 bp, Homo sapiens
gctcagacttgccaggc

SEQ ID NO: 3943827 - DNA, 16 bp, Homo sapiens
gctcagcaaggtgtga

SEQ ID NO: 3943828 - DNA, 20 bp, Homo sapiens
gctcagcaaggtgtgaatga

SEQ ID NO: 3943829 - DNA, 16 bp, Homo sapiens
gctcagccctccctgc

SEQ ID NO: 3943830 - DNA, 18 bp, Homo sapiens
gctcagccctccctgccc

SEQ ID NO: 3943831 - DNA, 21 bp, Homo sapiens
gctcagccctccctgcccctc

SEQ ID NO: 3943832 - DNA, 19 bp, Homo sapiens
gctcagccgtgcactccct

SEQ ID NO: 3943833 - DNA, 21 bp, Homo sapiens
gctcagcctccccctgctgct

SEQ ID NO: 3943834 - DNA, 20 bp, Homo sapiens
gctcaggaagaaaccccaag

SEQ ID NO: 3943835 - DNA, 12 bp, Homo sapiens
gctcaggaccca

SEQ ID NO: 3943836 - DNA, 21 bp, Homo sapiens
gctcaggaggcgaataaatgt

SEQ ID NO: 3943837 - DNA, 22 bp, Homo sapiens
gctcaggaggcgaataaatgtt

SEQ ID NO: 3943838 - DNA, 16 bp, Homo sapiens
gctcaggcaagcccct

SEQ ID NO: 3943839 - DNA, 17 bp, Homo sapiens
gctcaggcaagcccctc

SEQ ID NO: 3943840 - DNA, 22 bp, Homo sapiens
gctcaggcaagcccctcagccc

SEQ ID NO: 3943841 - DNA, 23 bp, Homo sapiens
gctcaggcaagcccctcagccct

SEQ ID NO: 3943842 - DNA, 14 bp, Homo sapiens
gctcagggctggag

SEQ ID NO: 3943843 - DNA, 15 bp, Homo sapiens
gctcagggctggagt

SEQ ID NO: 3943844 - DNA, 14 bp, Homo sapiens
gctcagtgcctcct

SEQ ID NO: 3943845 - DNA, 17 bp, Homo sapiens
gctcataacatctttga

SEQ ID NO: 3943846 - DNA, 19 bp, Homo sapiens
gctcataacatctttgaaa

SEQ ID NO: 3943847 - DNA, 14 bp, Homo sapiens
gctcatattttgta

SEQ ID NO: 3943848 - DNA, 14 bp, Homo sapiens
gctcatcacccagt

SEQ ID NO: 3943849 - DNA, 18 bp, Homo sapiens
gctcatcacccagtcctg

SEQ ID NO: 3943850 - DNA, 19 bp, Homo sapiens
gctcatcacccagtcctgg

SEQ ID NO: 3943851 - DNA, 18 bp, Homo sapiens
gctcatggcgtaatgggc

SEQ ID NO: 3943852 - DNA, 20 bp, Homo sapiens
gctcatggcgtaatgggcct

SEQ ID NO: 3943853 - DNA, 14 bp, Homo sapiens
gctccaacagcttg

SEQ ID NO: 3943854 - DNA, 21 bp, Homo sapiens
gctccaccctcaccaggatga

SEQ ID NO: 3943855 - DNA, 21 bp, Homo sapiens
gctccacggtgcgtggctgtg

SEQ ID NO: 3943856 - DNA, 12 bp, Homo sapiens
gctccactgtca

SEQ ID NO: 3943857 - DNA, 21 bp, Homo sapiens
gctccagagagaggatgcaga

SEQ ID NO: 3943858 - DNA, 14 bp, Homo sapiens
gctccagcatccag

SEQ ID NO: 3943859 - DNA, 16 bp, Homo sapiens
gctccagcatccagcc

SEQ ID NO: 3943860 - DNA, 19 bp, Homo sapiens
gctccagcatccagcctgt

SEQ ID NO: 3943861 - DNA, 17 bp, Homo sapiens
gctccagggtcttgggc

SEQ ID NO: 3943862 - DNA, 22 bp, Homo sapiens
gctccagggtcttgggctactg

SEQ ID NO: 3943863 - DNA, 19 bp, Homo sapiens
gctccaggtccggaggggt

SEQ ID NO: 3943864 - DNA, 20 bp, Homo sapiens
gctccaggtccggaggggtt

SEQ ID NO: 3943865 - DNA, 15 bp, Homo sapiens
gctccatggggaagt

SEQ ID NO: 3943866 - DNA, 16 bp, Homo sapiens
gctcccacaggccctt

SEQ ID NO: 3943867 - DNA, 20 bp, Homo sapiens
gctcccacaggcccttcctc

SEQ ID NO: 3943868 - DNA, 21 bp, Homo sapiens
gctcccacaggcccttcctct

SEQ ID NO: 3943869 - DNA, 21 bp, Homo sapiens
gctcccaccccacccccttca

SEQ ID NO: 3943870 - DNA, 14 bp, Homo sapiens
gctcccagatgctg

SEQ ID NO: 3943871 - DNA, 16 bp, Homo sapiens
gctcccagatgctggg

SEQ ID NO: 3943872 - DNA, 19 bp, Homo sapiens
gctcccagcagccctaagg

SEQ ID NO: 3943873 - DNA, 23 bp, Homo sapiens
gctcccagcagccctaaggatct

SEQ ID NO: 3943874 - DNA, 22 bp, Homo sapiens
gctgcatctgggattcccacca

SEQ ID NO: 3943875 - DNA, 18 bp, Homo sapiens
gctgccacacttcaggct

SEQ ID NO: 3943876 - DNA, 15 bp, Homo sapiens
gctgccaccacgtct

SEQ ID NO: 3943877 - DNA, 20 bp, Homo sapiens
gctgccaccacgtctgccag

SEQ ID NO: 3943878 - DNA, 19 bp, Homo sapiens
gctgccactaacctgtaga

SEQ ID NO: 3943879 - DNA, 14 bp, Homo sapiens
gctgccagccgggc

SEQ ID NO: 3943880 - DNA, 10 bp, Homo sapiens
gctgccagga

SEQ ID NO: 3943881 - DNA, 18 bp, Homo sapiens
gctgccaggacacctgcc

SEQ ID NO: 3943882 - DNA, 12 bp, Homo sapiens
gctgccatgcca

SEQ ID NO: 3943883 - DNA, 14 bp, Homo sapiens
gctgccatgccact

SEQ ID NO: 3943884 - DNA, 15 bp, Homo sapiens
gctgccatgccactg

SEQ ID NO: 3943885 - DNA, 17 bp, Homo sapiens
gctgccatgccactgcc

SEQ ID NO: 3943886 - DNA, 21 bp, Homo sapiens
gctgccatgccactgccaggc

SEQ ID NO: 3943887 - DNA, 20 bp, Homo sapiens
gctgccccgttccctgtcag

SEQ ID NO: 3943888 - DNA, 22 bp, Homo sapiens
gctgccccgttccctgtcagag

SEQ ID NO: 3943889 - DNA, 19 bp, Homo sapiens
gctgcccctgtaggttgct

SEQ ID NO: 3943890 - DNA, 18 bp, Homo sapiens
gctgccctgctctgggga

SEQ ID NO: 3943891 - DNA, 12 bp, Homo sapiens
gctgccctggtg

SEQ ID NO: 3943892 - DNA, 13 bp, Homo sapiens
gctgccctggtgc

SEQ ID NO: 3943893 - DNA, 18 bp, Homo sapiens
gctgccctggtgctgcca

SEQ ID NO: 3943894 - DNA, 19 bp, Homo sapiens
gctgccctggtgctgccac

SEQ ID NO: 3943895 - DNA, 20 bp, Homo sapiens
gctgccctggtgctgccaca

SEQ ID NO: 3943896 - DNA, 18 bp, Homo sapiens
gctgccctgtaccccagc

SEQ ID NO: 3943897 - DNA, 17 bp, Homo sapiens
gctgcccttcgctgcca

SEQ ID NO: 3943898 - DNA, 22 bp, Homo sapiens
gctgcccttcgctgccaggaca

SEQ ID NO: 3943899 - DNA, 16 bp, Homo sapiens
gctgccgcctcccagc

SEQ ID NO: 3943900 - DNA, 14 bp, Homo sapiens
gctgccgctgcacc

SEQ ID NO: 3943901 - DNA, 17 bp, Homo sapiens
gctgccgctgcaccacg

SEQ ID NO: 3943902 - DNA, 18 bp, Homo sapiens
gctgcctccctctgctgt

SEQ ID NO: 3943903 - DNA, 19 bp, Homo sapiens
gctgcctgtagttaggaaa

SEQ ID NO: 3943904 - DNA, 15 bp, Homo sapiens
gctgccttagaacct

SEQ ID NO: 3943905 - DNA, 20 bp, Homo sapiens
gctgccttagaacctttctt

SEQ ID NO: 3943906 - DNA, 17 bp, Homo sapiens
gctgccttttgctgctg

SEQ ID NO: 3943907 - DNA, 15 bp, Homo sapiens
gctgcgggtctgaag

SEQ ID NO: 3943908 - DNA, 22 bp, Homo sapiens
gctgctcatcacccagtcctgg

SEQ ID NO: 3943909 - DNA, 23 bp, Homo sapiens
gctgctcatcacccagtcctggc

SEQ ID NO: 3943910 - DNA, 22 bp, Homo sapiens
gctgctcatccagggtgttaca

SEQ ID NO: 3943911 - DNA, 23 bp, Homo sapiens
gctgctcctccagggccacgtgc

SEQ ID NO: 3943912 - DNA, 13 bp, Homo sapiens
gctgctcctggct

SEQ ID NO: 3943913 - DNA, 13 bp, Homo sapiens
gctgctctagctg

SEQ ID NO: 3943914 - DNA, 18 bp, Homo sapiens
gctgctctagctggcagg

SEQ ID NO: 3943915 - DNA, 22 bp, Homo sapiens
gctgctctagctggcaggacac

SEQ ID NO: 3943916 - DNA, 14 bp, Homo sapiens
gctgctctgcccct

SEQ ID NO: 3943917 - DNA, 12 bp, Homo sapiens
gctgctctggaa

SEQ ID NO: 3943918 - DNA, 18 bp, Homo sapiens
gctgctcttagtgcccgc

SEQ ID NO: 3943919 - DNA, 13 bp, Homo sapiens
gctgctgaaacaa

SEQ ID NO: 3943920 - DNA, 22 bp, Homo sapiens
gctgctgaagaggcaagagaca

SEQ ID NO: 3943921 - DNA, 13 bp, Homo sapiens
gctgctgagaacc

SEQ ID NO: 3943922 - DNA, 14 bp, Homo sapiens
gctgctgagaacct

SEQ ID NO: 3943923 - DNA, 16 bp, Homo sapiens
gctgctgagaacctgg

SEQ ID NO: 3943924 - DNA, 22 bp, Homo sapiens
gctgctggggcatgtgtgcctg

SEQ ID NO: 3943925 - DNA, 17 bp, Homo sapiens
gctgctgtaactgctga

SEQ ID NO: 3943926 - DNA, 19 bp, Homo sapiens
gctgctgtaactgctgagc

SEQ ID NO: 3943927 - DNA, 23 bp, Homo sapiens
gctgctgtaactgctgagccact

SEQ ID NO: 3943928 - DNA, 22 bp, Homo sapiens
gctgctgttgctggactgagga

SEQ ID NO: 3943929 - DNA, 14 bp, Homo sapiens
gctgcttgtcctgc

SEQ ID NO: 3943930 - DNA, 18 bp, Homo sapiens
gctgcttgtcctgctctc

SEQ ID NO: 3943931 - DNA, 15 bp, Homo sapiens
gctgcttgtgggccc

SEQ ID NO: 3943932 - DNA, 22 bp, Homo sapiens
gctggaaggcagggcagaggga

SEQ ID NO: 3943933 - DNA, 19 bp, Homo sapiens
gctggaatcaatttcccag

SEQ ID NO: 3943934 - DNA, 15 bp, Homo sapiens
gctggacaagaagct

SEQ ID NO: 3943935 - DNA, 16 bp, Homo sapiens
gctggacaagaagctg

SEQ ID NO: 3943936 - DNA, 17 bp, Homo sapiens
gctggacaagaagctgc

SEQ ID NO: 3943937 - DNA, 23 bp, Homo sapiens
gctggacctatgtcctaaggaca

SEQ ID NO: 3943938 - DNA, 19 bp, Homo sapiens
gctggacggggactgggga

SEQ ID NO: 3943939 - DNA, 12 bp, Homo sapiens
gctggagaagct

SEQ ID NO: 3943940 - DNA, 20 bp, Homo sapiens
gctggagagcatagggtctg

SEQ ID NO: 3943941 - DNA, 17 bp, Homo sapiens
gctggagctcttggaag

SEQ ID NO: 3943942 - DNA, 13 bp, Homo sapiens
gctggaggcaggg

SEQ ID NO: 3943943 - DNA, 21 bp, Homo sapiens
gctggaggcagggccttgccc

SEQ ID NO: 3943944 - DNA, 20 bp, Homo sapiens
gctggagtgcagtggtgcga

SEQ ID NO: 3943945 - DNA, 20 bp, Homo sapiens
gctggcaaaggtggctctcc

SEQ ID NO: 3943946 - DNA, 19 bp, Homo sapiens
gctggccagcaccctctcc

SEQ ID NO: 3943947 - DNA, 21 bp, Homo sapiens
gctggccagcaccctctcctg

SEQ ID NO: 3943948 - DNA, 21 bp, Homo sapiens
gctggcctcccaataaagctg

SEQ ID NO: 3943949 - DNA, 22 bp, Homo sapiens
gctggcctcccaataaagctgg

SEQ ID NO: 3943950 - DNA, 23 bp, Homo sapiens
gctggcctctagaacacccactg

SEQ ID NO: 3943951 - DNA, 15 bp, Homo sapiens
gctggcggcgcagag

SEQ ID NO: 3943952 - DNA, 17 bp, Homo sapiens
gctggcggcgcagaggg

SEQ ID NO: 3943953 - DNA, 21 bp, Homo sapiens
gctggcggctactcagcagcc

SEQ ID NO: 3943954 - DNA, 13 bp, Homo sapiens
gctggctcaggaa

SEQ ID NO: 3943955 - DNA, 13 bp, Homo sapiens
gctggctctccac

SEQ ID NO: 3943956 - DNA, 12 bp, Homo sapiens
gctggctgagtg

SEQ ID NO: 3943957 - DNA, 13 bp, Homo sapiens
gctggctgagtgg

SEQ ID NO: 3943958 - DNA, 21 bp, Homo sapiens
gctggctgagtggaatgcagg

SEQ ID NO: 3943959 - DNA, 10 bp, Homo sapiens
gctggctgtc

SEQ ID NO: 3943960 - DNA, 23 bp, Homo sapiens
gcttagcagggtgctaacgtatc

SEQ ID NO: 3943961 - DNA, 12 bp, Homo sapiens
gcttagccttgt

SEQ ID NO: 3943962 - DNA, 18 bp, Homo sapiens
gcttagccttgtgccctg

SEQ ID NO: 3943963 - DNA, 16 bp, Homo sapiens
gcttaggtgccaggct

SEQ ID NO: 3943964 - DNA, 20 bp, Homo sapiens
gcttattcatctgtttttct

SEQ ID NO: 3943965 - DNA, 22 bp, Homo sapiens
gcttattcccaactgctctgcc

SEQ ID NO: 3943966 - DNA, 14 bp, Homo sapiens
gcttattggccact

SEQ ID NO: 3943967 - DNA, 14 bp, Homo sapiens
gcttcacccctgca

SEQ ID NO: 3943968 - DNA, 15 bp, Homo sapiens
gcttcacccctgcac

SEQ ID NO: 3943969 - DNA, 22 bp, Homo sapiens
gcttcagacttttatcaaaatc

SEQ ID NO: 3943970 - DNA, 14 bp, Homo sapiens
gcttcagagcctag

SEQ ID NO: 3943971 - DNA, 20 bp, Homo sapiens
gcttcagagcctagccacct

SEQ ID NO: 3943972 - DNA, 19 bp, Homo sapiens
gcttcagcatatttatagc

SEQ ID NO: 3943973 - DNA, 20 bp, Homo sapiens
gcttcagggtatcccagacc

SEQ ID NO: 3943974 - DNA, 18 bp, Homo sapiens
gcttcatgctcagccctg

SEQ ID NO: 3943975 - DNA, 12 bp, Homo sapiens
gcttccaatttt

SEQ ID NO: 3943976 - DNA, 15 bp, Homo sapiens
gcttccagaccacct

SEQ ID NO: 3943977 - DNA, 16 bp, Homo sapiens
gcttccagaccacctg

SEQ ID NO: 3943978 - DNA, 19 bp, Homo sapiens
gcttccagaccacctgcca

SEQ ID NO: 3943979 - DNA, 20 bp, Homo sapiens
gcttccagaccacctgccag

SEQ ID NO: 3943980 - DNA, 11 bp, Homo sapiens
gcttccaggct

SEQ ID NO: 3943981 - DNA, 21 bp, Homo sapiens
gcttccaggctcttcctggac

SEQ ID NO: 3943982 - DNA, 19 bp, Homo sapiens
gcttccaggtatctccagg

SEQ ID NO: 3943983 - DNA, 22 bp, Homo sapiens
gcttccaggtatctccaggatt

SEQ ID NO: 3943984 - DNA, 13 bp, Homo sapiens
gcttcccatcccc

SEQ ID NO: 3943985 - DNA, 15 bp, Homo sapiens
gcttcccgctcagcc

SEQ ID NO: 3943986 - DNA, 16 bp, Homo sapiens
gcttcccgctcagccc

SEQ ID NO: 3943987 - DNA, 17 bp, Homo sapiens
gcttcccgctcagccct

SEQ ID NO: 3943988 - DNA, 18 bp, Homo sapiens
gcttcccgctcagccctc

SEQ ID NO: 3943989 - DNA, 18 bp, Homo sapiens
gcttccctaggctgagct

SEQ ID NO: 3943990 - DNA, 20 bp, Homo sapiens
gcttcctaggccccagagca

SEQ ID NO: 3943991 - DNA, 18 bp, Homo sapiens
gcttcctccgtccaccca

SEQ ID NO: 3943992 - DNA, 11 bp, Homo sapiens
gcttcctgggt

SEQ ID NO: 3943993 - DNA, 16 bp, Homo sapiens
gcttcctgggtcctgt

SEQ ID NO: 3943994 - DNA, 22 bp, Homo sapiens
gcttcctggtgtatttttcagg

SEQ ID NO: 3943995 - DNA, 14 bp, Homo sapiens
gcttcctgtccact

SEQ ID NO: 3943996 - DNA, 18 bp, Homo sapiens
gcttccttctgcacccag

SEQ ID NO: 3943997 - DNA, 12 bp, Homo sapiens
gcttcggacagt

SEQ ID NO: 3943998 - DNA, 20 bp, Homo sapiens
gcttctatcccaggaggtgg

SEQ ID NO: 3943999 - DNA, 13 bp, Homo sapiens
gcttctattaaat

SEQ ID NO: 3944000 - DNA, 12 bp, Homo sapiens
gcttctcctgac

SEQ ID NO: 3944001 - DNA, 14 bp, Homo sapiens
gcttctcctgtgac

SEQ ID NO: 3944002 - DNA, 12 bp, Homo sapiens
gcttctgcagca

SEQ ID NO: 3944003 - DNA, 15 bp, Homo sapiens
gcttcttaaagagtt

SEQ ID NO: 3944004 - DNA, 15 bp, Homo sapiens
gcttgagcccaggag

SEQ ID NO: 3944005 - DNA, 19 bp, Homo sapiens
gcttgagtttggggaatgc

SEQ ID NO: 3944006 - DNA, 21 bp, Homo sapiens
gcttgcaagaggaggtggttc

SEQ ID NO: 3944007 - DNA, 20 bp, Homo sapiens
gcttgccgagcctaatgaaa

SEQ ID NO: 3944008 - DNA, 14 bp, Homo sapiens
gcttgctccagggt

SEQ ID NO: 3944009 - DNA, 15 bp, Homo sapiens
gcttgctccagggtc

SEQ ID NO: 3944010 - DNA, 16 bp, Homo sapiens
gcttggacttcctggg

SEQ ID NO: 3944011 - DNA, 18 bp, Homo sapiens
gcttggacttcctggggc

SEQ ID NO: 3944012 - DNA, 22 bp, Homo sapiens
gcttggacttcctggggccccg

SEQ ID NO: 3944013 - DNA, 13 bp, Homo sapiens
gcttggcagagag

SEQ ID NO: 3944014 - DNA, 12 bp, Homo sapiens
gcttggccttgt

SEQ ID NO: 3944015 - DNA, 15 bp, Homo sapiens
gcttggccttgtgtc

SEQ ID NO: 3944016 - DNA, 14 bp, Homo sapiens
gcttggggagcaga

SEQ ID NO: 3944017 - DNA, 17 bp, Homo sapiens
gcttggggctggagagg

SEQ ID NO: 3944018 - DNA, 18 bp, Homo sapiens
gcttggtcaaatccccgg

SEQ ID NO: 3944019 - DNA, 20 bp, Homo sapiens
gcttggtggggctcgtggcc

SEQ ID NO: 3944020 - DNA, 13 bp, Homo sapiens
gcttggttggctg

SEQ ID NO: 3944021 - DNA, 15 bp, Homo sapiens
gcttggttggctggc

SEQ ID NO: 3944022 - DNA, 13 bp, Homo sapiens
gcttgtacatatt

SEQ ID NO: 3944023 - DNA, 14 bp, Homo sapiens
gcttgtagccagcc

SEQ ID NO: 3944024 - DNA, 15 bp, Homo sapiens
gcttgtagccagccg

SEQ ID NO: 3944025 - DNA, 16 bp, Homo sapiens
gcttgtagccagccgg

SEQ ID NO: 3944026 - DNA, 17 bp, Homo sapiens
gcttgtagccagccggg

SEQ ID NO: 3944027 - DNA, 14 bp, Homo sapiens
gcttgtatatacat

SEQ ID NO: 3944028 - DNA, 23 bp, Homo sapiens
gcttgtatatacatattataaat

SEQ ID NO: 3944029 - DNA, 16 bp, Homo sapiens
gcttgtccagcgccta

SEQ ID NO: 3944030 - DNA, 15 bp, Homo sapiens
gcttgtcctgctctc

SEQ ID NO: 3944031 - DNA, 20 bp, Homo sapiens
gctttaaactaccctccaga

SEQ ID NO: 3944032 - DNA, 14 bp, Homo sapiens
gctttaacaaaaca

SEQ ID NO: 3944033 - DNA, 12 bp, Homo sapiens
gctttacatgca

SEQ ID NO: 3944034 - DNA, 17 bp, Homo sapiens
gctttacatgctgtgct

SEQ ID NO: 3944035 - DNA, 20 bp, Homo sapiens
gctttacatgctgtgctctt

SEQ ID NO: 3944036 - DNA, 14 bp, Homo sapiens
gctttacattttat

SEQ ID NO: 3944037 - DNA, 22 bp, Homo sapiens
gctttaggactgacatttctat

SEQ ID NO: 3944038 - DNA, 17 bp, Homo sapiens
gctttatctgtcacaca

SEQ ID NO: 3944039 - DNA, 13 bp, Homo sapiens
gctttcagagcca

SEQ ID NO: 3944040 - DNA, 21 bp, Homo sapiens
gctttcagggcgataaaacta

SEQ ID NO: 3944041 - DNA, 17 bp, Homo sapiens
gctttcccttccagttc

SEQ ID NO: 3944042 - DNA, 23 bp, Homo sapiens
gctttcctaaagtctctgctgct

SEQ ID NO: 3944043 - DNA, 18 bp, Homo sapiens
gctttcttctacaaccag

SEQ ID NO: 3944044 - DNA, 21 bp, Homo sapiens
gctttcttctacaaccagagc

SEQ ID NO: 3944045 - DNA, 23 bp, Homo sapiens
gctttcttctacaaccagagccc

SEQ ID NO: 3944046 - DNA, 21 bp, Homo sapiens
gctttgacatgaaaagatagg

SEQ ID NO: 3944047 - DNA, 18 bp, Homo sapiens
ggaagccccccacctttc

SEQ ID NO: 3944048 - DNA, 12 bp, Homo sapiens
ggaagccctcct

SEQ ID NO: 3944049 - DNA, 18 bp, Homo sapiens
ggaagccgtctgactcca

SEQ ID NO: 3944050 - DNA, 15 bp, Homo sapiens
ggaagctgagcaggc

SEQ ID NO: 3944051 - DNA, 17 bp, Homo sapiens
ggaagctgtgtccttgc

SEQ ID NO: 3944052 - DNA, 23 bp, Homo sapiens
ggaagctgtgtccttgcacctgc

SEQ ID NO: 3944053 - DNA, 18 bp, Homo sapiens
ggaaggaactctggcttc

SEQ ID NO: 3944054 - DNA, 23 bp, Homo sapiens
ggaaggaactctggcttccaggt

SEQ ID NO: 3944055 - DNA, 21 bp, Homo sapiens
ggaaggagactcacctctgcc

SEQ ID NO: 3944056 - DNA, 23 bp, Homo sapiens
ggaaggcaaagcccctggaaatg

SEQ ID NO: 3944057 - DNA, 16 bp, Homo sapiens
ggaaggcagctgctct

SEQ ID NO: 3944058 - DNA, 15 bp, Homo sapiens
ggaaggcaggcaggg

SEQ ID NO: 3944059 - DNA, 19 bp, Homo sapiens
ggaaggcaggcagggctct

SEQ ID NO: 3944060 - DNA, 21 bp, Homo sapiens
ggaaggcaggcagggctctcc

SEQ ID NO: 3944061 - DNA, 22 bp, Homo sapiens
ggaaggcaggcagggctctcct

SEQ ID NO: 3944062 - DNA, 21 bp, Homo sapiens
ggaaggcagggaggaggcaga

SEQ ID NO: 3944063 - DNA, 19 bp, Homo sapiens
ggaaggctactggcattaa

SEQ ID NO: 3944064 - DNA, 19 bp, Homo sapiens
ggaaggctacttcggggct

SEQ ID NO: 3944065 - DNA, 15 bp, Homo sapiens
ggaaggctggctgag

SEQ ID NO: 3944066 - DNA, 14 bp, Homo sapiens
ggaagggccaggag

SEQ ID NO: 3944067 - DNA, 15 bp, Homo sapiens
ggaagggccaggaga

SEQ ID NO: 3944068 - DNA, 19 bp, Homo sapiens
ggaagggccaggagagaga

SEQ ID NO: 3944069 - DNA, 20 bp, Homo sapiens
ggaagggccaggagagagat

SEQ ID NO: 3944070 - DNA, 18 bp, Homo sapiens
ggaagggttggtgggctg

SEQ ID NO: 3944071 - DNA, 18 bp, Homo sapiens
ggaaggtttgtatattgt

SEQ ID NO: 3944072 - DNA, 14 bp, Homo sapiens
ggaagtatgtgtgg

SEQ ID NO: 3944073 - DNA, 21 bp, Homo sapiens
ggaagtcgtccttactcctgt

SEQ ID NO: 3944074 - DNA, 22 bp, Homo sapiens
ggaagtcgtccttactcctgtg

SEQ ID NO: 3944075 - DNA, 15 bp, Homo sapiens
ggaataatagaagaa

SEQ ID NO: 3944076 - DNA, 14 bp, Homo sapiens
ggaatagccagaga

SEQ ID NO: 3944077 - DNA, 16 bp, Homo sapiens
ggaatagccagagagg

SEQ ID NO: 3944078 - DNA, 20 bp, Homo sapiens
ggaatagccagagaggagca

SEQ ID NO: 3944079 - DNA, 21 bp, Homo sapiens
ggaatagccagagaggagcac

SEQ ID NO: 3944080 - DNA, 22 bp, Homo sapiens
ggaatatgttcaatgcaaagta

SEQ ID NO: 3944081 - DNA, 13 bp, Homo sapiens
ggaatcacctgga

SEQ ID NO: 3944082 - DNA, 17 bp, Homo sapiens
ggaatcacctggagggc

SEQ ID NO: 3944083 - DNA, 21 bp, Homo sapiens
ggaatcagacttcacactgca

SEQ ID NO: 3944084 - DNA, 21 bp, Homo sapiens
ggaatcatgtcaggcctgtgt

SEQ ID NO: 3944085 - DNA, 18 bp, Homo sapiens
ggaatcctttgagaatgt

SEQ ID NO: 3944086 - DNA, 13 bp, Homo sapiens
ggaatcgtttcaa

SEQ ID NO: 3944087 - DNA, 17 bp, Homo sapiens
ggaatctacctgtggtg

SEQ ID NO: 3944088 - DNA, 19 bp, Homo sapiens
ggaatgactataaacatta

SEQ ID NO: 3944089 - DNA, 18 bp, Homo sapiens
ggaatgcagggaagaggg

SEQ ID NO: 3944090 - DNA, 23 bp, Homo sapiens
ggaatgcggccgcattccctgag

SEQ ID NO: 3944091 - DNA, 19 bp, Homo sapiens
ggaatggaaggctttgcca

SEQ ID NO: 3944092 - DNA, 21 bp, Homo sapiens
ggaatggaaggctttgccatg

SEQ ID NO: 3944093 - DNA, 18 bp, Homo sapiens
ggaatgttccctgcaccc

SEQ ID NO: 3944094 - DNA, 16 bp, Homo sapiens
ggaattcagcaccctg

SEQ ID NO: 3944095 - DNA, 21 bp, Homo sapiens
ggaattcagcaccctgggtgc

SEQ ID NO: 3944096 - DNA, 22 bp, Homo sapiens
ggaattcagcaccctgggtgcc

SEQ ID NO: 3944097 - DNA, 14 bp, Homo sapiens
ggacaacccagaac

SEQ ID NO: 3944098 - DNA, 14 bp, Homo sapiens
ggacaacctgcccc

SEQ ID NO: 3944099 - DNA, 20 bp, Homo sapiens
ggacaaggaggtctgtgcca

SEQ ID NO: 3944100 - DNA, 16 bp, Homo sapiens
ggacaatgccttggga

SEQ ID NO: 3944101 - DNA, 11 bp, Homo sapiens
ggacacactgt

SEQ ID NO: 3944102 - DNA, 12 bp, Homo sapiens
ggacacactgta

SEQ ID NO: 3944103 - DNA, 15 bp, Homo sapiens
ggacacagacccaca

SEQ ID NO: 3944104 - DNA, 23 bp, Homo sapiens
ggacacaggcctgtgtagctgtg

SEQ ID NO: 3944105 - DNA, 12 bp, Homo sapiens
ggacacagtgtt

SEQ ID NO: 3944106 - DNA, 17 bp, Homo sapiens
ggacacatcccggcctc

SEQ ID NO: 3944107 - DNA, 21 bp, Homo sapiens
ggacacatcccggcctcttcc

SEQ ID NO: 3944108 - DNA, 16 bp, Homo sapiens
ggacacattttctcct

SEQ ID NO: 3944109 - DNA, 23 bp, Homo sapiens
ggacacattttctcctaggagaa

SEQ ID NO: 3944110 - DNA, 20 bp, Homo sapiens
ggacaccccttatccaggac

SEQ ID NO: 3944111 - DNA, 10 bp, Homo sapiens
ggacacctgc

SEQ ID NO: 3944112 - DNA, 14 bp, Homo sapiens
ggacacctgcccca

SEQ ID NO: 3944113 - DNA, 16 bp, Homo sapiens
ggacacctgccctgcc

SEQ ID NO: 3944114 - DNA, 19 bp, Homo sapiens
ggacagagacacctgcacc

SEQ ID NO: 3944115 - DNA, 21 bp, Homo sapiens
ggacagagacacctgcacctc

SEQ ID NO: 3944116 - DNA, 16 bp, Homo sapiens
ggacagaggggcaggg

SEQ ID NO: 3944117 - DNA, 19 bp, Homo sapiens
ggacagatagacagtgctg

SEQ ID NO: 3944118 - DNA, 12 bp, Homo sapiens
ggacagccccag

SEQ ID NO: 3944119 - DNA, 21 bp, Homo sapiens
ggacagcctgtggcggtgcct

SEQ ID NO: 3944120 - DNA, 22 bp, Homo sapiens
ggacagcctgtggcggtgcctg

SEQ ID NO: 3944121 - DNA, 23 bp, Homo sapiens
ggacagcctgtggcggtgcctgg

SEQ ID NO: 3944122 - DNA, 22 bp, Homo sapiens
ggacaggcccggcgcggtggct

SEQ ID NO: 3944123 - DNA, 20 bp, Homo sapiens
ggacagtattctcagtgctc

SEQ ID NO: 3944124 - DNA, 14 bp, Homo sapiens
ggacagttggcaga

SEQ ID NO: 3944125 - DNA, 18 bp, Homo sapiens
ggacagttggcagagaag

SEQ ID NO: 3944126 - DNA, 14 bp, Homo sapiens
ggacatcatgaagc

SEQ ID NO: 3944127 - DNA, 19 bp, Homo sapiens
ggacatggagagagactca

SEQ ID NO: 3944128 - DNA, 22 bp, Homo sapiens
ggacatgtgctattgaactgag

SEQ ID NO: 3944129 - DNA, 21 bp, Homo sapiens
ggacatgtttttgttttcttt

SEQ ID NO: 3944130 - DNA, 15 bp, Homo sapiens
ggacattatgtgtgc

SEQ ID NO: 3944131 - DNA, 18 bp, Homo sapiens
ggaccaaccctgtttcct

SEQ ID NO: 3944132 - DNA, 20 bp, Homo sapiens
ggaccaaccctgtttcctga

SEQ ID NO: 3944133 - DNA, 19 bp, Homo sapiens
ggagagctagaacctggag

SEQ ID NO: 3944134 - DNA, 22 bp, Homo sapiens
ggagagctaggagcaaagcctg

SEQ ID NO: 3944135 - DNA, 16 bp, Homo sapiens
ggagaggactctgcct

SEQ ID NO: 3944136 - DNA, 13 bp, Homo sapiens
ggagaggcggcct

SEQ ID NO: 3944137 - DNA, 14 bp, Homo sapiens
ggagaggcggcctc

SEQ ID NO: 3944138 - DNA, 17 bp, Homo sapiens
ggagagggagggagccg

SEQ ID NO: 3944139 - DNA, 13 bp, Homo sapiens
ggagaggggcctg

SEQ ID NO: 3944140 - DNA, 14 bp, Homo sapiens
ggagaggggcctgg

SEQ ID NO: 3944141 - DNA, 16 bp, Homo sapiens
ggagaggggcctggga

SEQ ID NO: 3944142 - DNA, 17 bp, Homo sapiens
ggagaggggcctgggaa

SEQ ID NO: 3944143 - DNA, 22 bp, Homo sapiens
ggagaggggcctgggaaaggaa

SEQ ID NO: 3944144 - DNA, 14 bp, Homo sapiens
ggagagggtctgga

SEQ ID NO: 3944145 - DNA, 21 bp, Homo sapiens
ggagaggtggggagggagaca

SEQ ID NO: 3944146 - DNA, 20 bp, Homo sapiens
ggagagtacagtgagccaag

SEQ ID NO: 3944147 - DNA, 14 bp, Homo sapiens
ggagagtgcttggg

SEQ ID NO: 3944148 - DNA, 21 bp, Homo sapiens
ggagagtggttgttgccaact

SEQ ID NO: 3944149 - DNA, 21 bp, Homo sapiens
ggagagttcaagcctgtggga

SEQ ID NO: 3944150 - DNA, 23 bp, Homo sapiens
ggagatatttatggggggagaac

SEQ ID NO: 3944151 - DNA, 19 bp, Homo sapiens
ggagatggacccctccctt

SEQ ID NO: 3944152 - DNA, 19 bp, Homo sapiens
ggagatggaggaaagtgat

SEQ ID NO: 3944153 - DNA, 17 bp, Homo sapiens
ggagattttccttccta

SEQ ID NO: 3944154 - DNA, 14 bp, Homo sapiens
ggagcaaagcctgt

SEQ ID NO: 3944155 - DNA, 18 bp, Homo sapiens
ggagcaaatgtttctgca

SEQ ID NO: 3944156 - DNA, 13 bp, Homo sapiens
ggagcaaggttta

SEQ ID NO: 3944157 - DNA, 14 bp, Homo sapiens
ggagcacagccctg

SEQ ID NO: 3944158 - DNA, 15 bp, Homo sapiens
ggagcacctgaaccc

SEQ ID NO: 3944159 - DNA, 19 bp, Homo sapiens
ggagcacttgcgtcctgca

SEQ ID NO: 3944160 - DNA, 22 bp, Homo sapiens
ggagcacttgcgtcctgcagag

SEQ ID NO: 3944161 - DNA, 23 bp, Homo sapiens
ggagcagaatcagtattgggagc

SEQ ID NO: 3944162 - DNA, 14 bp, Homo sapiens
ggagcagacagaga

SEQ ID NO: 3944163 - DNA, 15 bp, Homo sapiens
ggagcatcccaggcg

SEQ ID NO: 3944164 - DNA, 15 bp, Homo sapiens
ggagcatggctgtga

SEQ ID NO: 3944165 - DNA, 16 bp, Homo sapiens
ggagccactcctgtcc

SEQ ID NO: 3944166 - DNA, 12 bp, Homo sapiens
ggagccagctct

SEQ ID NO: 3944167 - DNA, 20 bp, Homo sapiens
ggagccccaggcctctgtgt

SEQ ID NO: 3944168 - DNA, 23 bp, Homo sapiens
ggagccccaggcctctgtgtcct

SEQ ID NO: 3944169 - DNA, 21 bp, Homo sapiens
ggagcccgagggcctgacagg

SEQ ID NO: 3944170 - DNA, 15 bp, Homo sapiens
ggagcccgtgcagta

SEQ ID NO: 3944171 - DNA, 23 bp, Homo sapiens
ggagccggaccaagatgggcaca

SEQ ID NO: 3944172 - DNA, 17 bp, Homo sapiens
ggagcctccccctcaga

SEQ ID NO: 3944173 - DNA, 22 bp, Homo sapiens
ggagcctcgcaacccgtgccaa

SEQ ID NO: 3944174 - DNA, 22 bp, Homo sapiens
ggagcctgcaaactcactgctc

SEQ ID NO: 3944175 - DNA, 12 bp, Homo sapiens
ggagctcttgga

SEQ ID NO: 3944176 - DNA, 20 bp, Homo sapiens
ggagctcttggaagagctct

SEQ ID NO: 3944177 - DNA, 18 bp, Homo sapiens
ggagctgatttccaggcc

SEQ ID NO: 3944178 - DNA, 19 bp, Homo sapiens
ggagctgatttccaggccc

SEQ ID NO: 3944179 - DNA, 22 bp, Homo sapiens
ggagctgatttccaggcccctg

SEQ ID NO: 3944180 - DNA, 21 bp, Homo sapiens
ggagctggaaataaacctgga

SEQ ID NO: 3944181 - DNA, 22 bp, Homo sapiens
ggagctggaggagcaggcagtg

SEQ ID NO: 3944182 - DNA, 14 bp, Homo sapiens
ggagctgggaggaa

SEQ ID NO: 3944183 - DNA, 12 bp, Homo sapiens
ggaggaaggcaa

SEQ ID NO: 3944184 - DNA, 14 bp, Homo sapiens
ggaggaaggcaaag

SEQ ID NO: 3944185 - DNA, 21 bp, Homo sapiens
ggaggaaggcaaagcccctgg

SEQ ID NO: 3944186 - DNA, 23 bp, Homo sapiens
ggaggaagggccaggagagagat

SEQ ID NO: 3944187 - DNA, 15 bp, Homo sapiens
ggaggacctgagcct

SEQ ID NO: 3944188 - DNA, 16 bp, Homo sapiens
ggaggacctgagcctg

SEQ ID NO: 3944189 - DNA, 22 bp, Homo sapiens
ggaggacctgagcctgccgagc

SEQ ID NO: 3944190 - DNA, 12 bp, Homo sapiens
ggaggagaaata

SEQ ID NO: 3944191 - DNA, 17 bp, Homo sapiens
ggaggagcttgggggat

SEQ ID NO: 3944192 - DNA, 16 bp, Homo sapiens
ggaggaggaggaaggc

SEQ ID NO: 3944193 - DNA, 16 bp, Homo sapiens
ggaggaggaggaggaa

SEQ ID NO: 3944194 - DNA, 17 bp, Homo sapiens
ggaggaggcagagaaga

SEQ ID NO: 3944195 - DNA, 18 bp, Homo sapiens
ggaggaggcagagaagaa

SEQ ID NO: 3944196 - DNA, 15 bp, Homo sapiens
ggaggatgccacagc

SEQ ID NO: 3944197 - DNA, 16 bp, Homo sapiens
ggaggcaccagctctg

SEQ ID NO: 3944198 - DNA, 15 bp, Homo sapiens
ggaggcagagaagaa

SEQ ID NO: 3944199 - DNA, 18 bp, Homo sapiens
ggaggcagggccttgccc

SEQ ID NO: 3944200 - DNA, 21 bp, Homo sapiens
ggaggcagggccttgcccaga

SEQ ID NO: 3944201 - DNA, 15 bp, Homo sapiens
ggaggcatggccctg

SEQ ID NO: 3944202 - DNA, 13 bp, Homo sapiens
ggaggccaaggca

SEQ ID NO: 3944203 - DNA, 21 bp, Homo sapiens
ggaggccctggtgtcaggcag

SEQ ID NO: 3944204 - DNA, 12 bp, Homo sapiens
ggaggccgaagc

SEQ ID NO: 3944205 - DNA, 12 bp, Homo sapiens
ggaggcctcagt

SEQ ID NO: 3944206 - DNA, 14 bp, Homo sapiens
ggaggcctgggggc

SEQ ID NO: 3944207 - DNA, 17 bp, Homo sapiens
ggaggcgaataaatgtt

SEQ ID NO: 3944208 - DNA, 23 bp, Homo sapiens
ggaggcgcagcccgaagcccagt

SEQ ID NO: 3944209 - DNA, 14 bp, Homo sapiens
ggaggcggctccag

SEQ ID NO: 3944210 - DNA, 14 bp, Homo sapiens
ggaggctgagacag

SEQ ID NO: 3944211 - DNA, 18 bp, Homo sapiens
ggaggctgagacaggaga

SEQ ID NO: 3944212 - DNA, 15 bp, Homo sapiens
ggaggctgaggcaga

SEQ ID NO: 3944213 - DNA, 16 bp, Homo sapiens
ggaggctgaggcagaa

SEQ ID NO: 3944214 - DNA, 22 bp, Homo sapiens
ggaggctgcatgctctggaagc

SEQ ID NO: 3944215 - DNA, 14 bp, Homo sapiens
ggaggctgctcggg

SEQ ID NO: 3944216 - DNA, 22 bp, Homo sapiens
ggaggctgctcggggtgcacag

SEQ ID NO: 3944217 - DNA, 23 bp, Homo sapiens
ggaggctgctcggggtgcacagg

SEQ ID NO: 3944218 - DNA, 13 bp, Homo sapiens
ggaggctgggccc

SEQ ID NO: 3944219 - DNA, 21 bp, Homo sapiens
ggagggacaaaggagcctgtg

SEQ ID NO: 3944220 - DNA, 16 bp, Homo sapiens
ggatgctccagggcag

SEQ ID NO: 3944221 - DNA, 14 bp, Homo sapiens
ggatggaggagaag

SEQ ID NO: 3944222 - DNA, 16 bp, Homo sapiens
ggatggattgcagtcc

SEQ ID NO: 3944223 - DNA, 21 bp, Homo sapiens
ggatggattgcagtccccagt

SEQ ID NO: 3944224 - DNA, 22 bp, Homo sapiens
ggatggcccttcccactggagg

SEQ ID NO: 3944225 - DNA, 15 bp, Homo sapiens
ggatgggagtgagac

SEQ ID NO: 3944226 - DNA, 17 bp, Homo sapiens
ggatgggcattgggctg

SEQ ID NO: 3944227 - DNA, 12 bp, Homo sapiens
ggatggggacac

SEQ ID NO: 3944228 - DNA, 19 bp, Homo sapiens
ggatggggagaatggtcaa

SEQ ID NO: 3944229 - DNA, 21 bp, Homo sapiens
ggatgggggatgggccagggt

SEQ ID NO: 3944230 - DNA, 16 bp, Homo sapiens
ggatgtaaacagtgcc

SEQ ID NO: 3944231 - DNA, 20 bp, Homo sapiens
ggatgtaaacagtgcctgct

SEQ ID NO: 3944232 - DNA, 21 bp, Homo sapiens
ggatgtaaacagtgcctgctg

SEQ ID NO: 3944233 - DNA, 16 bp, Homo sapiens
ggatgtcccctgtccc

SEQ ID NO: 3944234 - DNA, 15 bp, Homo sapiens
ggatgtgtaaatgga

SEQ ID NO: 3944235 - DNA, 18 bp, Homo sapiens
ggatgtgtgtctcacccc

SEQ ID NO: 3944236 - DNA, 18 bp, Homo sapiens
ggatgtttttcatgaaaa

SEQ ID NO: 3944237 - DNA, 19 bp, Homo sapiens
ggattaagatacactcctg

SEQ ID NO: 3944238 - DNA, 15 bp, Homo sapiens
ggattattcatttaa

SEQ ID NO: 3944239 - DNA, 18 bp, Homo sapiens
ggattccagcatttgcca

SEQ ID NO: 3944240 - DNA, 23 bp, Homo sapiens
ggattcccaccaaggtcttcagc

SEQ ID NO: 3944241 - DNA, 15 bp, Homo sapiens
ggattgttgacatga

SEQ ID NO: 3944242 - DNA, 19 bp, Homo sapiens
ggatttatatctatagtag

SEQ ID NO: 3944243 - DNA, 19 bp, Homo sapiens
ggatttcctattttaaaac

SEQ ID NO: 3944244 - DNA, 19 bp, Homo sapiens
ggatttcttcgctgctcta

SEQ ID NO: 3944245 - DNA, 21 bp, Homo sapiens
ggatttgaggagcagcttcag

SEQ ID NO: 3944246 - DNA, 22 bp, Homo sapiens
ggatttgccccttcccatctct

SEQ ID NO: 3944247 - DNA, 16 bp, Homo sapiens
ggcaaacccttctctt

SEQ ID NO: 3944248 - DNA, 20 bp, Homo sapiens
ggcaaagaactgccccatct

SEQ ID NO: 3944249 - DNA, 21 bp, Homo sapiens
ggcaaagtgctgtacccttcc

SEQ ID NO: 3944250 - DNA, 16 bp, Homo sapiens
ggcaaccccagttctg

SEQ ID NO: 3944251 - DNA, 18 bp, Homo sapiens
ggcaaccccagttctgct

SEQ ID NO: 3944252 - DNA, 17 bp, Homo sapiens
ggcaacgacggtttcaa

SEQ ID NO: 3944253 - DNA, 16 bp, Homo sapiens
ggcaagagaaaataaa

SEQ ID NO: 3944254 - DNA, 13 bp, Homo sapiens
ggcaagcagggaa

SEQ ID NO: 3944255 - DNA, 15 bp, Homo sapiens
ggcaagcccctcagc

SEQ ID NO: 3944256 - DNA, 17 bp, Homo sapiens
ggcaagcccctcagccc

SEQ ID NO: 3944257 - DNA, 20 bp, Homo sapiens
ggcaagcccctcagcccttg

SEQ ID NO: 3944258 - DNA, 18 bp, Homo sapiens
ggcaagctagaacctgga

SEQ ID NO: 3944259 - DNA, 21 bp, Homo sapiens
ggcaagggccatgctgaaggg

SEQ ID NO: 3944260 - DNA, 15 bp, Homo sapiens
ggcaagggggcgggg

SEQ ID NO: 3944261 - DNA, 15 bp, Homo sapiens
ggcaaggggtttcca

SEQ ID NO: 3944262 - DNA, 23 bp, Homo sapiens
ggcaaggtctccttactctgagc

SEQ ID NO: 3944263 - DNA, 22 bp, Homo sapiens
ggcaagtcgagagggctgttgg

SEQ ID NO: 3944264 - DNA, 20 bp, Homo sapiens
ggcacaatggctaattccca

SEQ ID NO: 3944265 - DNA, 22 bp, Homo sapiens
ggcacaatggctaattcccaga

SEQ ID NO: 3944266 - DNA, 18 bp, Homo sapiens
ggcacacagcagcccccc

SEQ ID NO: 3944267 - DNA, 22 bp, Homo sapiens
ggcacacagcagccccccagca

SEQ ID NO: 3944268 - DNA, 19 bp, Homo sapiens
ggcacagacttctggaagg

SEQ ID NO: 3944269 - DNA, 22 bp, Homo sapiens
ggcacagacttctggaaggctg

SEQ ID NO: 3944270 - DNA, 13 bp, Homo sapiens
ggcacaggcagga

SEQ ID NO: 3944271 - DNA, 16 bp, Homo sapiens
ggcacaggcaggaaga

SEQ ID NO: 3944272 - DNA, 16 bp, Homo sapiens
ggcacagggcagtggg

SEQ ID NO: 3944273 - DNA, 16 bp, Homo sapiens
ggcacaggtgtaaata

SEQ ID NO: 3944274 - DNA, 21 bp, Homo sapiens
ggcacatgaggagggtgccct

SEQ ID NO: 3944275 - DNA, 23 bp, Homo sapiens
ggcaccactagggtcctggccct

SEQ ID NO: 3944276 - DNA, 22 bp, Homo sapiens
ggcaccagaggctgcagaaggc

SEQ ID NO: 3944277 - DNA, 13 bp, Homo sapiens
ggcaccagctctg

SEQ ID NO: 3944278 - DNA, 14 bp, Homo sapiens
ggcaccagctctgt

SEQ ID NO: 3944279 - DNA, 20 bp, Homo sapiens
ggcaccagctctgtggcctg

SEQ ID NO: 3944280 - DNA, 22 bp, Homo sapiens
ggcaccagctctgtggcctgtg

SEQ ID NO: 3944281 - DNA, 20 bp, Homo sapiens
ggcacccccagcctgggcct

SEQ ID NO: 3944282 - DNA, 13 bp, Homo sapiens
ggcaccccctgca

SEQ ID NO: 3944283 - DNA, 14 bp, Homo sapiens
ggcaccccctggag

SEQ ID NO: 3944284 - DNA, 15 bp, Homo sapiens
ggcaccccctggaga

SEQ ID NO: 3944285 - DNA, 18 bp, Homo sapiens
ggcaccccctggagagaa

SEQ ID NO: 3944286 - DNA, 21 bp, Homo sapiens
ggcaccccggatcgaggacaa

SEQ ID NO: 3944287 - DNA, 12 bp, Homo sapiens
ggcacccttctt

SEQ ID NO: 3944288 - DNA, 17 bp, Homo sapiens
ggcacccttctttcctc

SEQ ID NO: 3944289 - DNA, 16 bp, Homo sapiens
ggcaccggcgctgcag

SEQ ID NO: 3944290 - DNA, 17 bp, Homo sapiens
ggcacctcagacaatcc

SEQ ID NO: 3944291 - DNA, 18 bp, Homo sapiens
ggcacctgaccagaatgc

SEQ ID NO: 3944292 - DNA, 16 bp, Homo sapiens
ggcacctggcctgctg

SEQ ID NO: 3944293 - DNA, 17 bp, Homo sapiens
ggcacctggcctgctgg

SEQ ID NO: 3944294 - DNA, 18 bp, Homo sapiens
ggcacctggcctgctggg

SEQ ID NO: 3944295 - DNA, 20 bp, Homo sapiens
ggcacctgggaaaacagagg

SEQ ID NO: 3944296 - DNA, 17 bp, Homo sapiens
ggcacctgggccctggg

SEQ ID NO: 3944297 - DNA, 22 bp, Homo sapiens
ggcacctgggccctggggcctg

SEQ ID NO: 3944298 - DNA, 23 bp, Homo sapiens
ggcacctgggccctggggcctgt

SEQ ID NO: 3944299 - DNA, 19 bp, Homo sapiens
ggcacgaacccacctgctg

SEQ ID NO: 3944300 - DNA, 20 bp, Homo sapiens
ggcacgaacccacctgctga

SEQ ID NO: 3944301 - DNA, 19 bp, Homo sapiens
ggcacgccaacagcccccc

SEQ ID NO: 3944302 - DNA, 15 bp, Homo sapiens
ggcacgtcccatgtg

SEQ ID NO: 3944303 - DNA, 22 bp, Homo sapiens
ggcactgattgttttagagact

SEQ ID NO: 3944304 - DNA, 17 bp, Homo sapiens
ggcacttagcccaagag

SEQ ID NO: 3944305 - DNA, 23 bp, Homo sapiens
ggcagaaaacggagagtgcttgg

SEQ ID NO: 3944306 - DNA, 17 bp, Homo sapiens
ggcagtgactggcaggt

SEQ ID NO: 3944307 - DNA, 20 bp, Homo sapiens
ggcagtgactggcaggtgca

SEQ ID NO: 3944308 - DNA, 16 bp, Homo sapiens
ggcagtgcctcctggg

SEQ ID NO: 3944309 - DNA, 18 bp, Homo sapiens
ggcagtgcctcctgggac

SEQ ID NO: 3944310 - DNA, 15 bp, Homo sapiens
ggcagttcgcagcca

SEQ ID NO: 3944311 - DNA, 19 bp, Homo sapiens
ggcagttcgcagccaccct

SEQ ID NO: 3944312 - DNA, 20 bp, Homo sapiens
ggcagttcgcagccaccctg

SEQ ID NO: 3944313 - DNA, 18 bp, Homo sapiens
ggcatcaggcactggtgg

SEQ ID NO: 3944314 - DNA, 13 bp, Homo sapiens
ggcatccacccag

SEQ ID NO: 3944315 - DNA, 18 bp, Homo sapiens
ggcatccacccagtgctg

SEQ ID NO: 3944316 - DNA, 23 bp, Homo sapiens
ggcatccacccagtgctgccatg

SEQ ID NO: 3944317 - DNA, 17 bp, Homo sapiens
ggcatccgcagcccagg

SEQ ID NO: 3944318 - DNA, 22 bp, Homo sapiens
ggcatcgtagaagagatgtggc

SEQ ID NO: 3944319 - DNA, 22 bp, Homo sapiens
ggcatctgcaccctcgatgaag

SEQ ID NO: 3944320 - DNA, 14 bp, Homo sapiens
ggcatgagggatca

SEQ ID NO: 3944321 - DNA, 17 bp, Homo sapiens
ggcatgatttatatatg

SEQ ID NO: 3944322 - DNA, 23 bp, Homo sapiens
ggcatgcctctgatatgggactg

SEQ ID NO: 3944323 - DNA, 19 bp, Homo sapiens
ggcatgcgcacaaggctga

SEQ ID NO: 3944324 - DNA, 13 bp, Homo sapiens
ggcatgctggcct

SEQ ID NO: 3944325 - DNA, 13 bp, Homo sapiens
ggcatggccctgg

SEQ ID NO: 3944326 - DNA, 17 bp, Homo sapiens
ggcatggcgaggctgag

SEQ ID NO: 3944327 - DNA, 22 bp, Homo sapiens
ggcatggtggcgcaagcctgta

SEQ ID NO: 3944328 - DNA, 20 bp, Homo sapiens
ggcatggttccttccctggg

SEQ ID NO: 3944329 - DNA, 20 bp, Homo sapiens
ggcatgtattatcacatcaa

SEQ ID NO: 3944330 - DNA, 12 bp, Homo sapiens
ggcatgtggaga

SEQ ID NO: 3944331 - DNA, 17 bp, Homo sapiens
ggcatgtgtgcctgtgg

SEQ ID NO: 3944332 - DNA, 19 bp, Homo sapiens
ggcatgtgtgcctgtggca

SEQ ID NO: 3944333 - DNA, 13 bp, Homo sapiens
ggcattgggctga

SEQ ID NO: 3944334 - DNA, 17 bp, Homo sapiens
ggcattgggctgacacc

SEQ ID NO: 3944335 - DNA, 13 bp, Homo sapiens
ggcattgggttct

SEQ ID NO: 3944336 - DNA, 15 bp, Homo sapiens
ggcatttcctgggtg

SEQ ID NO: 3944337 - DNA, 16 bp, Homo sapiens
ggcatttcctgggtgg

SEQ ID NO: 3944338 - DNA, 13 bp, Homo sapiens
ggccaagctgaag

SEQ ID NO: 3944339 - DNA, 21 bp, Homo sapiens
ggccaagctgaagtgaaggag

SEQ ID NO: 3944340 - DNA, 22 bp, Homo sapiens
ggccaagctgaagtgaaggaga

SEQ ID NO: 3944341 - DNA, 23 bp, Homo sapiens
ggccaagctgaagtgaaggagaa

SEQ ID NO: 3944342 - DNA, 15 bp, Homo sapiens
ggccaagctgaggtg

SEQ ID NO: 3944343 - DNA, 17 bp, Homo sapiens
ggccaattaaaatatat

SEQ ID NO: 3944344 - DNA, 14 bp, Homo sapiens
ggccaccaggatgg

SEQ ID NO: 3944345 - DNA, 15 bp, Homo sapiens
ggccaccccgtgcca

SEQ ID NO: 3944346 - DNA, 20 bp, Homo sapiens
ggccaccccgtgccacccgt

SEQ ID NO: 3944347 - DNA, 19 bp, Homo sapiens
ggccaccctccttcccgcc

SEQ ID NO: 3944348 - DNA, 16 bp, Homo sapiens
ggccacgtgccaggcc

SEQ ID NO: 3944349 - DNA, 18 bp, Homo sapiens
ggccacgtgccaggcccg

SEQ ID NO: 3944350 - DNA, 17 bp, Homo sapiens
ggccactccagacccct

SEQ ID NO: 3944351 - DNA, 12 bp, Homo sapiens
ggccactcctcc

SEQ ID NO: 3944352 - DNA, 19 bp, Homo sapiens
ggccactccttcctgcccc

SEQ ID NO: 3944353 - DNA, 19 bp, Homo sapiens
ggccactctcccctccctc

SEQ ID NO: 3944354 - DNA, 22 bp, Homo sapiens
ggccactctcccctccctcttc

SEQ ID NO: 3944355 - DNA, 20 bp, Homo sapiens
ggccactgtggccagagctg

SEQ ID NO: 3944356 - DNA, 21 bp, Homo sapiens
ggccactttaagagagaaatc

SEQ ID NO: 3944357 - DNA, 13 bp, Homo sapiens
ggccagaaggagg

SEQ ID NO: 3944358 - DNA, 21 bp, Homo sapiens
ggccagaaggagggcagagcc

SEQ ID NO: 3944359 - DNA, 17 bp, Homo sapiens
ggccagagagggcccag

SEQ ID NO: 3944360 - DNA, 19 bp, Homo sapiens
ggccagagagggcccagct

SEQ ID NO: 3944361 - DNA, 21 bp, Homo sapiens
ggccagagagggcccagctgt

SEQ ID NO: 3944362 - DNA, 23 bp, Homo sapiens
ggccagagagggcccagctgtag

SEQ ID NO: 3944363 - DNA, 13 bp, Homo sapiens
ggccagagctgga

SEQ ID NO: 3944364 - DNA, 19 bp, Homo sapiens
ggccagagctggaaggcag

SEQ ID NO: 3944365 - DNA, 14 bp, Homo sapiens
ggccagagctggga

SEQ ID NO: 3944366 - DNA, 17 bp, Homo sapiens
ggccagagctgggaggc

SEQ ID NO: 3944367 - DNA, 21 bp, Homo sapiens
ggccagccctacatcttcagc

SEQ ID NO: 3944368 - DNA, 23 bp, Homo sapiens
ggccagcctcagctcagcctccc

SEQ ID NO: 3944369 - DNA, 11 bp, Homo sapiens
ggccagcctgg

SEQ ID NO: 3944370 - DNA, 15 bp, Homo sapiens
ggccagcctggcctc

SEQ ID NO: 3944371 - DNA, 20 bp, Homo sapiens
ggccagcctggcctcctgcc

SEQ ID NO: 3944372 - DNA, 22 bp, Homo sapiens
ggccagcctggcctcctgcctc

SEQ ID NO: 3944373 - DNA, 20 bp, Homo sapiens
ggccagctgcatctactcag

SEQ ID NO: 3944374 - DNA, 13 bp, Homo sapiens
ggccagctggtgc

SEQ ID NO: 3944375 - DNA, 20 bp, Homo sapiens
ggccagctggtgctgcaagg

SEQ ID NO: 3944376 - DNA, 21 bp, Homo sapiens
ggccagctgtcgcatctcagc

SEQ ID NO: 3944377 - DNA, 14 bp, Homo sapiens
ggccaggagagaga

SEQ ID NO: 3944378 - DNA, 15 bp, Homo sapiens
ggccaggagagagat

SEQ ID NO: 3944379 - DNA, 12 bp, Homo sapiens
ggccaggcaggt

SEQ ID NO: 3944380 - DNA, 17 bp, Homo sapiens
ggccaggccaccaggat

SEQ ID NO: 3944381 - DNA, 12 bp, Homo sapiens
ggccaggctggt

SEQ ID NO: 3944382 - DNA, 16 bp, Homo sapiens
ggccagggtgagagct

SEQ ID NO: 3944383 - DNA, 17 bp, Homo sapiens
ggccagtcctagagctc

SEQ ID NO: 3944384 - DNA, 24 bp, Homo sapiens
ggccagtcctagagctcctgtccc

SEQ ID NO: 3944385 - DNA, 16 bp, Homo sapiens
ggccagtgagggctgg

SEQ ID NO: 3944386 - DNA, 18 bp, Homo sapiens
ggccagtgtaaggcatag

SEQ ID NO: 3944387 - DNA, 13 bp, Homo sapiens
ggccatccctggg

SEQ ID NO: 3944388 - DNA, 14 bp, Homo sapiens
ggccatccctgggc

SEQ ID NO: 3944389 - DNA, 17 bp, Homo sapiens
ggccatccctgggcccc

SEQ ID NO: 3944390 - DNA, 20 bp, Homo sapiens
ggccatccctgggcccctcc

SEQ ID NO: 3944391 - DNA, 17 bp, Homo sapiens
ggccattttcttgcctg

SEQ ID NO: 3944392 - DNA, 16 bp, Homo sapiens
ggccgccatccgggac

SEQ ID NO: 3944393 - DNA, 15 bp, Homo sapiens
ggccgggcaggtcct

SEQ ID NO: 3944394 - DNA, 20 bp, Homo sapiens
ggccgggcaggtcctgccca

SEQ ID NO: 3944395 - DNA, 22 bp, Homo sapiens
ggccgtggccatcagggtgggc

SEQ ID NO: 3944396 - DNA, 18 bp, Homo sapiens
ggccgtgtctctgaggac

SEQ ID NO: 3944397 - DNA, 16 bp, Homo sapiens
ggccgttccccttggc

SEQ ID NO: 3944398 - DNA, 17 bp, Homo sapiens
ggcctaaaagtaaacat

SEQ ID NO: 3944399 - DNA, 23 bp, Homo sapiens
ggcctaatctcatacctctgacc

SEQ ID NO: 3944400 - DNA, 17 bp, Homo sapiens
ggcctagatccacacac

SEQ ID NO: 3944401 - DNA, 18 bp, Homo sapiens
ggcctatgacttgggcac

SEQ ID NO: 3944402 - DNA, 16 bp, Homo sapiens
ggcctatggagagccc

SEQ ID NO: 3944403 - DNA, 19 bp, Homo sapiens
ggcctatggagagccctgg

SEQ ID NO: 3944404 - DNA, 16 bp, Homo sapiens
ggcctcacttccctgg

SEQ ID NO: 3944405 - DNA, 17 bp, Homo sapiens
ggcctcacttccctggg

SEQ ID NO: 3944406 - DNA, 18 bp, Homo sapiens
ggcctcacttccctggga

SEQ ID NO: 3944407 - DNA, 18 bp, Homo sapiens
ggcctcagcaggaacctg

SEQ ID NO: 3944408 - DNA, 14 bp, Homo sapiens
ggcctcagccctca

SEQ ID NO: 3944409 - DNA, 13 bp, Homo sapiens
ggcctcagtttcc

SEQ ID NO: 3944410 - DNA, 20 bp, Homo sapiens
ggcctcagtttctccatcag

SEQ ID NO: 3944411 - DNA, 14 bp, Homo sapiens
ggcctcatccctcg

SEQ ID NO: 3944412 - DNA, 12 bp, Homo sapiens
ggcctccactcc

SEQ ID NO: 3944413 - DNA, 20 bp, Homo sapiens
ggcctcccaaggtgctagga

SEQ ID NO: 3944414 - DNA, 18 bp, Homo sapiens
ggcctcccaataaagctg

SEQ ID NO: 3944415 - DNA, 22 bp, Homo sapiens
ggcctccgtcatgaatgccttc

SEQ ID NO: 3944416 - DNA, 14 bp, Homo sapiens
ggcctcctgcctct

SEQ ID NO: 3944417 - DNA, 13 bp, Homo sapiens
ggcctcgcctggg

SEQ ID NO: 3944418 - DNA, 14 bp, Homo sapiens
ggcctcgcctgggc

SEQ ID NO: 3944419 - DNA, 15 bp, Homo sapiens
ggcctcgcctgggcc

SEQ ID NO: 3944420 - DNA, 18 bp, Homo sapiens
ggcctcgcctgggcccag

SEQ ID NO: 3944421 - DNA, 20 bp, Homo sapiens
ggcctcgcctgggcccaggc

SEQ ID NO: 3944422 - DNA, 16 bp, Homo sapiens
ggcctcgggacacctg

SEQ ID NO: 3944423 - DNA, 15 bp, Homo sapiens
ggcctcgtaccagcc

SEQ ID NO: 3944424 - DNA, 22 bp, Homo sapiens
ggcctctagaacacccactggc

SEQ ID NO: 3944425 - DNA, 22 bp, Homo sapiens
ggcctctgaaatttcccacacc

SEQ ID NO: 3944426 - DNA, 21 bp, Homo sapiens
ggcctctggaaagcaaagggc

SEQ ID NO: 3944427 - DNA, 20 bp, Homo sapiens
ggcctctgtgtccttccctg

SEQ ID NO: 3944428 - DNA, 19 bp, Homo sapiens
ggcctcttccgtgacgtca

SEQ ID NO: 3944429 - DNA, 19 bp, Homo sapiens
ggcctgacaggttcccagc

SEQ ID NO: 3944430 - DNA, 21 bp, Homo sapiens
ggcctgacaggttcccagcag

SEQ ID NO: 3944431 - DNA, 17 bp, Homo sapiens
ggcctgagctggggcca

SEQ ID NO: 3944432 - DNA, 15 bp, Homo sapiens
ggcctgcccaatgct

SEQ ID NO: 3944433 - DNA, 17 bp, Homo sapiens
ggcctgccctcagggat

SEQ ID NO: 3944434 - DNA, 12 bp, Homo sapiens
ggcctgcggccg

SEQ ID NO: 3944435 - DNA, 19 bp, Homo sapiens
ggcctgcggccgggctgcc

SEQ ID NO: 3944436 - DNA, 23 bp, Homo sapiens
ggcctgcggccgggctgcccttc

SEQ ID NO: 3944437 - DNA, 18 bp, Homo sapiens
ggcctgctcccagcagcc

SEQ ID NO: 3944438 - DNA, 11 bp, Homo sapiens
ggcctgctgcg

SEQ ID NO: 3944439 - DNA, 18 bp, Homo sapiens
ggcctgctgcgtcagacc

SEQ ID NO: 3944440 - DNA, 13 bp, Homo sapiens
ggcctgctgctga

SEQ ID NO: 3944441 - DNA, 14 bp, Homo sapiens
ggcctgctgctgag

SEQ ID NO: 3944442 - DNA, 15 bp, Homo sapiens
ggcctgctgctgaga

SEQ ID NO: 3944443 - DNA, 19 bp, Homo sapiens
ggcctgctgctgagaacct

SEQ ID NO: 3944444 - DNA, 12 bp, Homo sapiens
ggcctgctggga

SEQ ID NO: 3944445 - DNA, 22 bp, Homo sapiens
ggcctgctgggaaccccgcagc

SEQ ID NO: 3944446 - DNA, 17 bp, Homo sapiens
ggcctgctgggctctcc

SEQ ID NO: 3944447 - DNA, 20 bp, Homo sapiens
ggcctgctgggctctccacc

SEQ ID NO: 3944448 - DNA, 16 bp, Homo sapiens
ggcctgcttttccagg

SEQ ID NO: 3944449 - DNA, 21 bp, Homo sapiens
ggcctgcttttccaggatcct

SEQ ID NO: 3944450 - DNA, 24 bp, Homo sapiens
ggcctgcttttccaggatcctgca

SEQ ID NO: 3944451 - DNA, 24 bp, Homo sapiens
ggcctggaaccagggaggagagga

SEQ ID NO: 3944452 - DNA, 14 bp, Homo sapiens
ggcctggacactta

SEQ ID NO: 3944453 - DNA, 21 bp, Homo sapiens
ggcctggaccgcttcccagag

SEQ ID NO: 3944454 - DNA, 22 bp, Homo sapiens
ggcctggaccgcttcccagagg

SEQ ID NO: 3944455 - DNA, 23 bp, Homo sapiens
ggcctggaccgcttcccagaggc

SEQ ID NO: 3944456 - DNA, 17 bp, Homo sapiens
ggcctggagaggggcct

SEQ ID NO: 3944457 - DNA, 14 bp, Homo sapiens
ggcctggcagccgt

SEQ ID NO: 3944458 - DNA, 13 bp, Homo sapiens
ggcctggccaggc

SEQ ID NO: 3944459 - DNA, 14 bp, Homo sapiens
ggcctggcctgagc

SEQ ID NO: 3944460 - DNA, 17 bp, Homo sapiens
ggcctggctggctgagg

SEQ ID NO: 3944461 - DNA, 17 bp, Homo sapiens
ggcctggcttgctccag

SEQ ID NO: 3944462 - DNA, 19 bp, Homo sapiens
ggcctggcttgctccaggg

SEQ ID NO: 3944463 - DNA, 15 bp, Homo sapiens
ggcctgggaaaggaa

SEQ ID NO: 3944464 - DNA, 20 bp, Homo sapiens
ggcctgggacccagctactc

SEQ ID NO: 3944465 - DNA, 15 bp, Homo sapiens
ggcctgggcctgctt

SEQ ID NO: 3944466 - DNA, 18 bp, Homo sapiens
ggcctggggctcctttct

SEQ ID NO: 3944467 - DNA, 19 bp, Homo sapiens
ggcctgggggcagtgactg

SEQ ID NO: 3944468 - DNA, 19 bp, Homo sapiens
ggcctggtgtgaggctggg

SEQ ID NO: 3944469 - DNA, 16 bp, Homo sapiens
ggcctgtactgcctgc

SEQ ID NO: 3944470 - DNA, 17 bp, Homo sapiens
ggcctgtactgcctgct

SEQ ID NO: 3944471 - DNA, 13 bp, Homo sapiens
ggcctgtccccca

SEQ ID NO: 3944472 - DNA, 17 bp, Homo sapiens
ggcctgtcccccaaggt

SEQ ID NO: 3944473 - DNA, 13 bp, Homo sapiens
ggcctgtgcagca

SEQ ID NO: 3944474 - DNA, 15 bp, Homo sapiens
ggcctgtgcagcagc

SEQ ID NO: 3944475 - DNA, 18 bp, Homo sapiens
ggcctgtgcagcagccca

SEQ ID NO: 3944476 - DNA, 21 bp, Homo sapiens
ggcctgtgcagcagcccagct

SEQ ID NO: 3944477 - DNA, 20 bp, Homo sapiens
ggcctgtgggagcctgcaaa

SEQ ID NO: 3944478 - DNA, 20 bp, Homo sapiens
ggctctgcaatgggcactgg

SEQ ID NO: 3944479 - DNA, 16 bp, Homo sapiens
ggctctgccccagagg

SEQ ID NO: 3944480 - DNA, 16 bp, Homo sapiens
ggctctggagccagag

SEQ ID NO: 3944481 - DNA, 17 bp, Homo sapiens
ggctctggagccagaga

SEQ ID NO: 3944482 - DNA, 23 bp, Homo sapiens
ggctctgggaaggggtgccctct

SEQ ID NO: 3944483 - DNA, 12 bp, Homo sapiens
ggctctgggctc

SEQ ID NO: 3944484 - DNA, 16 bp, Homo sapiens
ggctctgggctcaggg

SEQ ID NO: 3944485 - DNA, 20 bp, Homo sapiens
ggctctgggctcagggctgg

SEQ ID NO: 3944486 - DNA, 15 bp, Homo sapiens
ggctcttcctggacc

SEQ ID NO: 3944487 - DNA, 16 bp, Homo sapiens
ggctcttcctggacct

SEQ ID NO: 3944488 - DNA, 12 bp, Homo sapiens
ggctcttctcct

SEQ ID NO: 3944489 - DNA, 13 bp, Homo sapiens
ggctctttcagag

SEQ ID NO: 3944490 - DNA, 21 bp, Homo sapiens
ggctgaatccgtggtggcacc

SEQ ID NO: 3944491 - DNA, 17 bp, Homo sapiens
ggctgacacctaccatg

SEQ ID NO: 3944492 - DNA, 19 bp, Homo sapiens
ggctgacccagtccctggg

SEQ ID NO: 3944493 - DNA, 19 bp, Homo sapiens
ggctgaccccaaagagcct

SEQ ID NO: 3944494 - DNA, 17 bp, Homo sapiens
ggctgacctgcctctca

SEQ ID NO: 3944495 - DNA, 21 bp, Homo sapiens
ggctgagggcagttcgcagcc

SEQ ID NO: 3944496 - DNA, 22 bp, Homo sapiens
ggctgagtcatgatctccctgc

SEQ ID NO: 3944497 - DNA, 22 bp, Homo sapiens
ggctgcaaaagaagtttctgga

SEQ ID NO: 3944498 - DNA, 23 bp, Homo sapiens
ggctgcatctgggattcccacca

SEQ ID NO: 3944499 - DNA, 20 bp, Homo sapiens
ggctgccactaacctgtaga

SEQ ID NO: 3944500 - DNA, 21 bp, Homo sapiens
ggctgccactaacctgtagaa

SEQ ID NO: 3944501 - DNA, 10 bp, Homo sapiens
ggctgccagg

SEQ ID NO: 3944502 - DNA, 16 bp, Homo sapiens
ggctgccctggtgctg

SEQ ID NO: 3944503 - DNA, 22 bp, Homo sapiens
ggctgccctggtgctgccacac

SEQ ID NO: 3944504 - DNA, 20 bp, Homo sapiens
ggctgcccttcgctgccagg

SEQ ID NO: 3944505 - DNA, 21 bp, Homo sapiens
ggctgcccttcgctgccagga

SEQ ID NO: 3944506 - DNA, 10 bp, Homo sapiens
ggctgcctgc

SEQ ID NO: 3944507 - DNA, 11 bp, Homo sapiens
ggctgcctgcc

SEQ ID NO: 3944508 - DNA, 20 bp, Homo sapiens
ggctgcgtcgaactgtcctg

SEQ ID NO: 3944509 - DNA, 21 bp, Homo sapiens
ggctgcgtcgaactgtcctgg

SEQ ID NO: 3944510 - DNA, 18 bp, Homo sapiens
ggctgctcatcacccagt

SEQ ID NO: 3944511 - DNA, 18 bp, Homo sapiens
ggctgctcctccagggcc

SEQ ID NO: 3944512 - DNA, 19 bp, Homo sapiens
ggctgctcctccagggcca

SEQ ID NO: 3944513 - DNA, 23 bp, Homo sapiens
ggctgctcctccagggccacgtg

SEQ ID NO: 3944514 - DNA, 13 bp, Homo sapiens
ggctgctggggca

SEQ ID NO: 3944515 - DNA, 22 bp, Homo sapiens
ggctgctggggcatgtgtgcct

SEQ ID NO: 3944516 - DNA, 18 bp, Homo sapiens
ggctgcttattggaccag

SEQ ID NO: 3944517 - DNA, 16 bp, Homo sapiens
ggctggaatctggaga

SEQ ID NO: 3944518 - DNA, 19 bp, Homo sapiens
ggctggaatctggagagct

SEQ ID NO: 3944519 - DNA, 20 bp, Homo sapiens
ggctggaatctggagagcta

SEQ ID NO: 3944520 - DNA, 22 bp, Homo sapiens
ggctggacctatgtcctaagga

SEQ ID NO: 3944521 - DNA, 13 bp, Homo sapiens
ggctggaggcagg

SEQ ID NO: 3944522 - DNA, 15 bp, Homo sapiens
ggctggatgaaattt

SEQ ID NO: 3944523 - DNA, 12 bp, Homo sapiens
ggctggctgagg

SEQ ID NO: 3944524 - DNA, 22 bp, Homo sapiens
ggctgggcccacagagatgcat

SEQ ID NO: 3944525 - DNA, 13 bp, Homo sapiens
ggctgggcccctg

SEQ ID NO: 3944526 - DNA, 15 bp, Homo sapiens
ggctgggcccctggg

SEQ ID NO: 3944527 - DNA, 12 bp, Homo sapiens
ggctggggcaga

SEQ ID NO: 3944528 - DNA, 22 bp, Homo sapiens
ggctggggcagaggggcagccg

SEQ ID NO: 3944529 - DNA, 21 bp, Homo sapiens
ggctgggggcgggggagccaa

SEQ ID NO: 3944530 - DNA, 23 bp, Homo sapiens
ggctgggttcattccccggccct

SEQ ID NO: 3944531 - DNA, 22 bp, Homo sapiens
ggctgtaaactataaactactg

SEQ ID NO: 3944532 - DNA, 14 bp, Homo sapiens
ggctgtctgtcacc

SEQ ID NO: 3944533 - DNA, 14 bp, Homo sapiens
ggctgtggaggcct

SEQ ID NO: 3944534 - DNA, 12 bp, Homo sapiens
ggctgtggttcc

SEQ ID NO: 3944535 - DNA, 17 bp, Homo sapiens
ggctgttggacagctgc

SEQ ID NO: 3944536 - DNA, 12 bp, Homo sapiens
ggcttaatgttt

SEQ ID NO: 3944537 - DNA, 22 bp, Homo sapiens
ggcttcaaccactcgccgagga

SEQ ID NO: 3944538 - DNA, 20 bp, Homo sapiens
ggcttcagcatatttatagc

SEQ ID NO: 3944539 - DNA, 14 bp, Homo sapiens
ggcttccagagagt

SEQ ID NO: 3944540 - DNA, 12 bp, Homo sapiens
ggcttccaggct

SEQ ID NO: 3944541 - DNA, 13 bp, Homo sapiens
ggcttccaggctc

SEQ ID NO: 3944542 - DNA, 19 bp, Homo sapiens
ggcttcccgctcagccctc

SEQ ID NO: 3944543 - DNA, 21 bp, Homo sapiens
ggcttcctcagttcctgccct

SEQ ID NO: 3944544 - DNA, 22 bp, Homo sapiens
ggcttcctccgtccacccaggc

SEQ ID NO: 3944545 - DNA, 11 bp, Homo sapiens
ggcttcctggg

SEQ ID NO: 3944546 - DNA, 12 bp, Homo sapiens
ggcttcctgtcc

SEQ ID NO: 3944547 - DNA, 16 bp, Homo sapiens
ggcttctcctgaccca

SEQ ID NO: 3944548 - DNA, 17 bp, Homo sapiens
ggcttgcttgccgagcc

SEQ ID NO: 3944549 - DNA, 17 bp, Homo sapiens
ggcttggacttcctggg

SEQ ID NO: 3944550 - DNA, 14 bp, Homo sapiens
ggcttggccttgtg

SEQ ID NO: 3944551 - DNA, 14 bp, Homo sapiens
ggcttggggagcag

SEQ ID NO: 3944552 - DNA, 16 bp, Homo sapiens
ggcttggggagcagag

SEQ ID NO: 3944553 - DNA, 17 bp, Homo sapiens
ggcttggggagcagagt

SEQ ID NO: 3944554 - DNA, 17 bp, Homo sapiens
ggcttgggggaaaagag

SEQ ID NO: 3944555 - DNA, 17 bp, Homo sapiens
ggcttgtaactccacca

SEQ ID NO: 3944556 - DNA, 17 bp, Homo sapiens
ggcttgtgattctggga

SEQ ID NO: 3944557 - DNA, 23 bp, Homo sapiens
ggctttaaactaccctccagagt

SEQ ID NO: 3944558 - DNA, 13 bp, Homo sapiens
ggctttgcaggct

SEQ ID NO: 3944559 - DNA, 14 bp, Homo sapiens
ggctttgcaggctc

SEQ ID NO: 3944560 - DNA, 20 bp, Homo sapiens
ggctttgcaggctctgggct

SEQ ID NO: 3944561 - DNA, 22 bp, Homo sapiens
ggctttgccatgggcctgctgc

SEQ ID NO: 3944562 - DNA, 20 bp, Homo sapiens
ggctttgtctctagccgggc

SEQ ID NO: 3944563 - DNA, 17 bp, Homo sapiens
ggcttttcactgctggc

SEQ ID NO: 3944564 - DNA, 21 bp, Homo sapiens
ggcttttcgcttgcttctgca

SEQ ID NO: 3944565 - DNA, 16 bp, Homo sapiens
gggaggaaaagaaaag

SEQ ID NO: 3944566 - DNA, 15 bp, Homo sapiens
gggaggacatcataa

SEQ ID NO: 3944567 - DNA, 16 bp, Homo sapiens
gggaggatgccacagc

SEQ ID NO: 3944568 - DNA, 15 bp, Homo sapiens
gggaggcaccagctc

SEQ ID NO: 3944569 - DNA, 14 bp, Homo sapiens
gggaggcagctcca

SEQ ID NO: 3944570 - DNA, 20 bp, Homo sapiens
gggaggctggaagctgggag

SEQ ID NO: 3944571 - DNA, 14 bp, Homo sapiens
gggagggccaggat

SEQ ID NO: 3944572 - DNA, 12 bp, Homo sapiens
gggagggctctg

SEQ ID NO: 3944573 - DNA, 16 bp, Homo sapiens
gggagggctctgaggc

SEQ ID NO: 3944574 - DNA, 19 bp, Homo sapiens
gggagggctctgaggcgcc

SEQ ID NO: 3944575 - DNA, 16 bp, Homo sapiens
gggagggggctccatg

SEQ ID NO: 3944576 - DNA, 24 bp, Homo sapiens
gggaggtctccactgaggatgtga

SEQ ID NO: 3944577 - DNA, 19 bp, Homo sapiens
gggaggttcctcgcaggtc

SEQ ID NO: 3944578 - DNA, 21 bp, Homo sapiens
gggaggttttattctgacttc

SEQ ID NO: 3944579 - DNA, 23 bp, Homo sapiens
gggaggttttattctgacttcct

SEQ ID NO: 3944580 - DNA, 18 bp, Homo sapiens
gggagtgttctgtgggct

SEQ ID NO: 3944581 - DNA, 14 bp, Homo sapiens
gggatcacagggcc

SEQ ID NO: 3944582 - DNA, 23 bp, Homo sapiens
gggatcagcctccgccattccaa

SEQ ID NO: 3944583 - DNA, 19 bp, Homo sapiens
gggatgactaaaatattta

SEQ ID NO: 3944584 - DNA, 15 bp, Homo sapiens
gggatgactgtgatt

SEQ ID NO: 3944585 - DNA, 14 bp, Homo sapiens
gggatgagagtggc

SEQ ID NO: 3944586 - DNA, 21 bp, Homo sapiens
gggatgccaacaccttcttgg

SEQ ID NO: 3944587 - DNA, 12 bp, Homo sapiens
gggatggaccct

SEQ ID NO: 3944588 - DNA, 19 bp, Homo sapiens
gggatggagaggcggcctc

SEQ ID NO: 3944589 - DNA, 14 bp, Homo sapiens
gggatgggccaggg

SEQ ID NO: 3944590 - DNA, 12 bp, Homo sapiens
gggatgtagaac

SEQ ID NO: 3944591 - DNA, 22 bp, Homo sapiens
gggatgtgaattgcctgcagag

SEQ ID NO: 3944592 - DNA, 14 bp, Homo sapiens
gggatgtgggaggg

SEQ ID NO: 3944593 - DNA, 15 bp, Homo sapiens
gggattcccaccaag

SEQ ID NO: 3944594 - DNA, 19 bp, Homo sapiens
gggattctggtcttcactg

SEQ ID NO: 3944595 - DNA, 22 bp, Homo sapiens
gggcaaatgacatgcactgacc

SEQ ID NO: 3944596 - DNA, 21 bp, Homo sapiens
gggcaagaacctaaagtagca

SEQ ID NO: 3944597 - DNA, 13 bp, Homo sapiens
gggcaagggccat

SEQ ID NO: 3944598 - DNA, 18 bp, Homo sapiens
gggcacaccactgccctg

SEQ ID NO: 3944599 - DNA, 17 bp, Homo sapiens
gggcacaggagctacct

SEQ ID NO: 3944600 - DNA, 21 bp, Homo sapiens
gggcacaggagctacctgtgt

SEQ ID NO: 3944601 - DNA, 14 bp, Homo sapiens
gggcacccccagcc

SEQ ID NO: 3944602 - DNA, 17 bp, Homo sapiens
gggcacccccagcctgg

SEQ ID NO: 3944603 - DNA, 12 bp, Homo sapiens
gggcacctggga

SEQ ID NO: 3944604 - DNA, 13 bp, Homo sapiens
gggcacctgggaa

SEQ ID NO: 3944605 - DNA, 15 bp, Homo sapiens
gggcagagccatggg

SEQ ID NO: 3944606 - DNA, 16 bp, Homo sapiens
gggcagagccatgggc

SEQ ID NO: 3944607 - DNA, 14 bp, Homo sapiens
gggcagagggcaga

SEQ ID NO: 3944608 - DNA, 16 bp, Homo sapiens
gggcagcagatcttct

SEQ ID NO: 3944609 - DNA, 15 bp, Homo sapiens
gggcagcagccagcc

SEQ ID NO: 3944610 - DNA, 17 bp, Homo sapiens
gggcagcagccagccct

SEQ ID NO: 3944611 - DNA, 20 bp, Homo sapiens
gggcagcagccagccctgcc

SEQ ID NO: 3944612 - DNA, 22 bp, Homo sapiens
gggcagcagccagccctgcctg

SEQ ID NO: 3944613 - DNA, 17 bp, Homo sapiens
gggcagccgctaggaga

SEQ ID NO: 3944614 - DNA, 12 bp, Homo sapiens
gggcagctcctc

SEQ ID NO: 3944615 - DNA, 22 bp, Homo sapiens
gggcagctcctctgtctcgagc

SEQ ID NO: 3944616 - DNA, 14 bp, Homo sapiens
gggcagctgggccc

SEQ ID NO: 3944617 - DNA, 12 bp, Homo sapiens
gggcaggaggcc

SEQ ID NO: 3944618 - DNA, 11 bp, Homo sapiens
gggcaggcctg

SEQ ID NO: 3944619 - DNA, 13 bp, Homo sapiens
gggcaggcctggg

SEQ ID NO: 3944620 - DNA, 14 bp, Homo sapiens
gggcaggcctggga

SEQ ID NO: 3944621 - DNA, 19 bp, Homo sapiens
gggcaggcctgggacccag

SEQ ID NO: 3944622 - DNA, 21 bp, Homo sapiens
gggcaggcctgggacccagct

SEQ ID NO: 3944623 - DNA, 23 bp, Homo sapiens
gggcaggcctgggacccagctac

SEQ ID NO: 3944624 - DNA, 16 bp, Homo sapiens
gggcaggtcctgccca

SEQ ID NO: 3944625 - DNA, 18 bp, Homo sapiens
gggcaggtcctgcccatg

SEQ ID NO: 3944626 - DNA, 20 bp, Homo sapiens
gggcagtgacaagtggaggg

SEQ ID NO: 3944627 - DNA, 17 bp, Homo sapiens
gggcagtgactggcagg

SEQ ID NO: 3944628 - DNA, 14 bp, Homo sapiens
gggcagtgcctcct

SEQ ID NO: 3944629 - DNA, 15 bp, Homo sapiens
gggcagtggggagca

SEQ ID NO: 3944630 - DNA, 16 bp, Homo sapiens
gggcagttcgcagcca

SEQ ID NO: 3944631 - DNA, 17 bp, Homo sapiens
gggcagttcgcagccac

SEQ ID NO: 3944632 - DNA, 20 bp, Homo sapiens
gggcagttcgcagccaccct

SEQ ID NO: 3944633 - DNA, 22 bp, Homo sapiens
gggcagttcgcagccaccctga

SEQ ID NO: 3944634 - DNA, 23 bp, Homo sapiens
gggcagttcgcagccaccctgag

SEQ ID NO: 3944635 - DNA, 22 bp, Homo sapiens
gggcatagaaactgaggagtag

SEQ ID NO: 3944636 - DNA, 13 bp, Homo sapiens
gggcatcaggcac

SEQ ID NO: 3944637 - DNA, 17 bp, Homo sapiens
gggcatcaggcactggt

SEQ ID NO: 3944638 - DNA, 21 bp, Homo sapiens
gggcatcaggcactggtggca

SEQ ID NO: 3944639 - DNA, 19 bp, Homo sapiens
gggcatccacccagtgctg

SEQ ID NO: 3944640 - DNA, 18 bp, Homo sapiens
gggcatccgcagcccagg

SEQ ID NO: 3944641 - DNA, 16 bp, Homo sapiens
gggcatgggagggagg

SEQ ID NO: 3944642 - DNA, 16 bp, Homo sapiens
gggcatgtgtgcctgt

SEQ ID NO: 3944643 - DNA, 22 bp, Homo sapiens
gggcatgtgtgcctgtggcaga

SEQ ID NO: 3944644 - DNA, 15 bp, Homo sapiens
gggcattaaaaatag

SEQ ID NO: 3944645 - DNA, 16 bp, Homo sapiens
gggccaaaagggcagc

SEQ ID NO: 3944646 - DNA, 20 bp, Homo sapiens
gggccaaaagggcagccagg

SEQ ID NO: 3944647 - DNA, 15 bp, Homo sapiens
gggccaagagagaca

SEQ ID NO: 3944648 - DNA, 13 bp, Homo sapiens
gggccaattaaaa

SEQ ID NO: 3944649 - DNA, 12 bp, Homo sapiens
gggccactcctt

SEQ ID NO: 3944650 - DNA, 16 bp, Homo sapiens
gggccactccttcctg

SEQ ID NO: 3944651 - DNA, 20 bp, Homo sapiens
gggccactccttcctgcccc

SEQ ID NO: 3944652 - DNA, 15 bp, Homo sapiens
gggctccctcctgga

SEQ ID NO: 3944653 - DNA, 14 bp, Homo sapiens
gggctcctggaacc

SEQ ID NO: 3944654 - DNA, 15 bp, Homo sapiens
gggctcctggctgcc

SEQ ID NO: 3944655 - DNA, 16 bp, Homo sapiens
gggctcctggctgcca

SEQ ID NO: 3944656 - DNA, 21 bp, Homo sapiens
gggctcctttctccagccagc

SEQ ID NO: 3944657 - DNA, 22 bp, Homo sapiens
gggctcctttctccagccagca

SEQ ID NO: 3944658 - DNA, 19 bp, Homo sapiens
gggctctaacgcctgagcc

SEQ ID NO: 3944659 - DNA, 20 bp, Homo sapiens
gggctctaacgcctgagccc

SEQ ID NO: 3944660 - DNA, 21 bp, Homo sapiens
gggctctccacctcagccttg

SEQ ID NO: 3944661 - DNA, 12 bp, Homo sapiens
gggctctcctgg

SEQ ID NO: 3944662 - DNA, 22 bp, Homo sapiens
gggctctcctggcttcccatcc

SEQ ID NO: 3944663 - DNA, 12 bp, Homo sapiens
gggctctgaggc

SEQ ID NO: 3944664 - DNA, 17 bp, Homo sapiens
gggctctggccaccctg

SEQ ID NO: 3944665 - DNA, 19 bp, Homo sapiens
gggctctggccaccctggc

SEQ ID NO: 3944666 - DNA, 15 bp, Homo sapiens
gggctgacacctacc

SEQ ID NO: 3944667 - DNA, 22 bp, Homo sapiens
gggctgacacctaccatgctgc

SEQ ID NO: 3944668 - DNA, 23 bp, Homo sapiens
gggctgacacctaccatgctgct

SEQ ID NO: 3944669 - DNA, 21 bp, Homo sapiens
gggctgcccctgtaggttgct

SEQ ID NO: 3944670 - DNA, 13 bp, Homo sapiens
gggctgccctggt

SEQ ID NO: 3944671 - DNA, 19 bp, Homo sapiens
gggctgcccttcgctgcca

SEQ ID NO: 3944672 - DNA, 20 bp, Homo sapiens
gggctgcccttcgctgccag

SEQ ID NO: 3944673 - DNA, 23 bp, Homo sapiens
gggctgcccttcgctgccaggac

SEQ ID NO: 3944674 - DNA, 19 bp, Homo sapiens
gggctgctcatcacccagt

SEQ ID NO: 3944675 - DNA, 15 bp, Homo sapiens
gggctgctcctccag

SEQ ID NO: 3944676 - DNA, 16 bp, Homo sapiens
gggctgctcctccagg

SEQ ID NO: 3944677 - DNA, 19 bp, Homo sapiens
gggctgctcctccagggcc

SEQ ID NO: 3944678 - DNA, 17 bp, Homo sapiens
gggctggcaagcaggga

SEQ ID NO: 3944679 - DNA, 19 bp, Homo sapiens
gggctggcccagccaactg

SEQ ID NO: 3944680 - DNA, 18 bp, Homo sapiens
gggctgggagctctgcag

SEQ ID NO: 3944681 - DNA, 11 bp, Homo sapiens
gggctggggtt

SEQ ID NO: 3944682 - DNA, 19 bp, Homo sapiens
gggctgttggacagctgct

SEQ ID NO: 3944683 - DNA, 21 bp, Homo sapiens
gggcttggacttcctggggcc

SEQ ID NO: 3944684 - DNA, 23 bp, Homo sapiens
gggctttaacaaaacaagaaaga

SEQ ID NO: 3944685 - DNA, 18 bp, Homo sapiens
gggctttgcaggctctgg

SEQ ID NO: 3944686 - DNA, 22 bp, Homo sapiens
gggctttgtttgggccactgcc

SEQ ID NO: 3944687 - DNA, 20 bp, Homo sapiens
ggggaacagagcgggcctct

SEQ ID NO: 3944688 - DNA, 18 bp, Homo sapiens
ggggaacccagccctggg

SEQ ID NO: 3944689 - DNA, 13 bp, Homo sapiens
ggggaactcctgg

SEQ ID NO: 3944690 - DNA, 23 bp, Homo sapiens
ggggaactgcatatcggaggtgg

SEQ ID NO: 3944691 - DNA, 14 bp, Homo sapiens
ggggaagccctgga

SEQ ID NO: 3944692 - DNA, 22 bp, Homo sapiens
ggggaagggccagtctgggctg

SEQ ID NO: 3944693 - DNA, 16 bp, Homo sapiens
ggggaagtgctcccca

SEQ ID NO: 3944694 - DNA, 18 bp, Homo sapiens
ggggacagttggcagaga

SEQ ID NO: 3944695 - DNA, 10 bp, Homo sapiens
ggggagaaag

SEQ ID NO: 3944696 - DNA, 19 bp, Homo sapiens
ggggagacggtgttgcaga

SEQ ID NO: 3944697 - DNA, 14 bp, Homo sapiens
ggggagctggaaat

SEQ ID NO: 3944698 - DNA, 13 bp, Homo sapiens
ggggaggcagctc

SEQ ID NO: 3944699 - DNA, 11 bp, Homo sapiens
ggggaggggga

SEQ ID NO: 3944700 - DNA, 19 bp, Homo sapiens
ggggaggtgcctgagctgg

SEQ ID NO: 3944701 - DNA, 13 bp, Homo sapiens
ggggatgggccag

SEQ ID NO: 3944702 - DNA, 14 bp, Homo sapiens
ggggatgggccagg

SEQ ID NO: 3944703 - DNA, 18 bp, Homo sapiens
ggggattggagggaagac

SEQ ID NO: 3944704 - DNA, 15 bp, Homo sapiens
ggggcaaggtctcct

SEQ ID NO: 3944705 - DNA, 16 bp, Homo sapiens
ggggcacaccactgcc

SEQ ID NO: 3944706 - DNA, 20 bp, Homo sapiens
ggggcacaccactgccctgc

SEQ ID NO: 3944707 - DNA, 16 bp, Homo sapiens
ggggcagaggggcagc

SEQ ID NO: 3944708 - DNA, 11 bp, Homo sapiens
ggggcaggagg

SEQ ID NO: 3944709 - DNA, 14 bp, Homo sapiens
ggggcaggaggcct

SEQ ID NO: 3944710 - DNA, 18 bp, Homo sapiens
ggggcaggaggcctggcc

SEQ ID NO: 3944711 - DNA, 11 bp, Homo sapiens
ggggcaggcct

SEQ ID NO: 3944712 - DNA, 15 bp, Homo sapiens
ggggcatagaaactg

SEQ ID NO: 3944713 - DNA, 19 bp, Homo sapiens
ggggcatagaaactgagga

SEQ ID NO: 3944714 - DNA, 22 bp, Homo sapiens
ggggcatagaaactgaggagta

SEQ ID NO: 3944715 - DNA, 23 bp, Homo sapiens
ggggcatagaaactgaggagtag

SEQ ID NO: 3944716 - DNA, 23 bp, Homo sapiens
ggggccaggcaggggtgggagag

SEQ ID NO: 3944717 - DNA, 11 bp, Homo sapiens
ggggcccacaa

SEQ ID NO: 3944718 - DNA, 22 bp, Homo sapiens
ggggcccacagacagatcccat

SEQ ID NO: 3944719 - DNA, 15 bp, Homo sapiens
ggggccccagatctg

SEQ ID NO: 3944720 - DNA, 20 bp, Homo sapiens
ggggccccagatctgcctgg

SEQ ID NO: 3944721 - DNA, 18 bp, Homo sapiens
ggggccccggggctggca

SEQ ID NO: 3944722 - DNA, 21 bp, Homo sapiens
ggggcccttggggcctggctt

SEQ ID NO: 3944723 - DNA, 12 bp, Homo sapiens
ggggcctggaga

SEQ ID NO: 3944724 - DNA, 13 bp, Homo sapiens
ggggcctggagag

SEQ ID NO: 3944725 - DNA, 15 bp, Homo sapiens
ggggcctggagaggg

SEQ ID NO: 3944726 - DNA, 21 bp, Homo sapiens
ggggcctggagaggggcctgg

SEQ ID NO: 3944727 - DNA, 14 bp, Homo sapiens
ggggcctggcttgc

SEQ ID NO: 3944728 - DNA, 19 bp, Homo sapiens
ggggcctggcttgctccag

SEQ ID NO: 3944729 - DNA, 18 bp, Homo sapiens
ggggcctgtactgcctgc

SEQ ID NO: 3944730 - DNA, 24 bp, Homo sapiens
ggggcgctcaggacccaggccctc

SEQ ID NO: 3944731 - DNA, 14 bp, Homo sapiens
ggggctagaaccta

SEQ ID NO: 3944732 - DNA, 17 bp, Homo sapiens
ggggctaggggctggtc

SEQ ID NO: 3944733 - DNA, 15 bp, Homo sapiens
ggggctcgccccacc

SEQ ID NO: 3944734 - DNA, 18 bp, Homo sapiens
ggggctctaacgcctgag

SEQ ID NO: 3944735 - DNA, 20 bp, Homo sapiens
ggggctctaacgcctgagcc

SEQ ID NO: 3944736 - DNA, 22 bp, Homo sapiens
ggggctctaacgcctgagccca

SEQ ID NO: 3944737 - DNA, 18 bp, Homo sapiens
ggggctctccaaaggggc

SEQ ID NO: 3944738 - DNA, 15 bp, Homo sapiens
gggttgtactattgt

SEQ ID NO: 3944739 - DNA, 18 bp, Homo sapiens
gggttgtactattgttta

SEQ ID NO: 3944740 - DNA, 21 bp, Homo sapiens
gggttgtgaggcctggccagg

SEQ ID NO: 3944741 - DNA, 23 bp, Homo sapiens
gggttgtgaggcctggccaggca

SEQ ID NO: 3944742 - DNA, 22 bp, Homo sapiens
gggtttctgacccaagaggtgg

SEQ ID NO: 3944743 - DNA, 23 bp, Homo sapiens
gggttttattgtccttcagagct

SEQ ID NO: 3944744 - DNA, 20 bp, Homo sapiens
gggttttctaactgtaaatc

SEQ ID NO: 3944745 - DNA, 18 bp, Homo sapiens
ggtaaaaaggatgaaagt

SEQ ID NO: 3944746 - DNA, 20 bp, Homo sapiens
ggtaagccagagcctggggt

SEQ ID NO: 3944747 - DNA, 22 bp, Homo sapiens
ggtaattgttgctaatcttctt

SEQ ID NO: 3944748 - DNA, 21 bp, Homo sapiens
ggtacagcagggtcttgctgt

SEQ ID NO: 3944749 - DNA, 18 bp, Homo sapiens
ggtacatttctctgagca

SEQ ID NO: 3944750 - DNA, 14 bp, Homo sapiens
ggtacggtggcacg

SEQ ID NO: 3944751 - DNA, 18 bp, Homo sapiens
ggtactggggctgagggc

SEQ ID NO: 3944752 - DNA, 21 bp, Homo sapiens
ggtacttcctcctgatggcca

SEQ ID NO: 3944753 - DNA, 12 bp, Homo sapiens
ggtagaagccag

SEQ ID NO: 3944754 - DNA, 16 bp, Homo sapiens
ggtagaattgggaagc

SEQ ID NO: 3944755 - DNA, 18 bp, Homo sapiens
ggtagaattgggaagctg

SEQ ID NO: 3944756 - DNA, 11 bp, Homo sapiens
ggtagagatgt

SEQ ID NO: 3944757 - DNA, 13 bp, Homo sapiens
ggtagagatgtgt

SEQ ID NO: 3944758 - DNA, 14 bp, Homo sapiens
ggtagagatgtgtg

SEQ ID NO: 3944759 - DNA, 14 bp, Homo sapiens
ggtagaggagggca

SEQ ID NO: 3944760 - DNA, 18 bp, Homo sapiens
ggtagatcgcttgagccc

SEQ ID NO: 3944761 - DNA, 20 bp, Homo sapiens
ggtagatcgcttgagcccag

SEQ ID NO: 3944762 - DNA, 19 bp, Homo sapiens
ggtagcagataaagacagc

SEQ ID NO: 3944763 - DNA, 21 bp, Homo sapiens
ggtagcagataaagacagctg

SEQ ID NO: 3944764 - DNA, 22 bp, Homo sapiens
ggtagcagataaagacagctga

SEQ ID NO: 3944765 - DNA, 16 bp, Homo sapiens
ggtagcgagctgctct

SEQ ID NO: 3944766 - DNA, 18 bp, Homo sapiens
ggtagcttacctgacaca

SEQ ID NO: 3944767 - DNA, 14 bp, Homo sapiens
ggtagcttttccct

SEQ ID NO: 3944768 - DNA, 16 bp, Homo sapiens
ggtaggcccttgtcct

SEQ ID NO: 3944769 - DNA, 19 bp, Homo sapiens
ggtaggcccttgtcctgcc

SEQ ID NO: 3944770 - DNA, 13 bp, Homo sapiens
ggtagggcagcag

SEQ ID NO: 3944771 - DNA, 17 bp, Homo sapiens
ggtataatggttgactg

SEQ ID NO: 3944772 - DNA, 17 bp, Homo sapiens
ggtatatttgtgtatgt

SEQ ID NO: 3944773 - DNA, 13 bp, Homo sapiens
ggtatcaggcaca

SEQ ID NO: 3944774 - DNA, 15 bp, Homo sapiens
ggtatcaggcacagg

SEQ ID NO: 3944775 - DNA, 17 bp, Homo sapiens
ggtatcaggcacaggca

SEQ ID NO: 3944776 - DNA, 18 bp, Homo sapiens
ggtatcaggcacaggcag

SEQ ID NO: 3944777 - DNA, 20 bp, Homo sapiens
ggtatcaggcacaggcagga

SEQ ID NO: 3944778 - DNA, 13 bp, Homo sapiens
ggtatctccagga

SEQ ID NO: 3944779 - DNA, 16 bp, Homo sapiens
ggtatctccaggattg

SEQ ID NO: 3944780 - DNA, 23 bp, Homo sapiens
ggtatctccaggattgaagagca

SEQ ID NO: 3944781 - DNA, 20 bp, Homo sapiens
ggtatgaacttgaggacaca

SEQ ID NO: 3944782 - DNA, 13 bp, Homo sapiens
ggtatgctggcca

SEQ ID NO: 3944783 - DNA, 20 bp, Homo sapiens
ggtatgctggccagcaccct

SEQ ID NO: 3944784 - DNA, 21 bp, Homo sapiens
ggtatgctggccagcaccctc

SEQ ID NO: 3944785 - DNA, 16 bp, Homo sapiens
ggtatgtagcccggcc

SEQ ID NO: 3944786 - DNA, 19 bp, Homo sapiens
ggtattccttttgtgtaca

SEQ ID NO: 3944787 - DNA, 18 bp, Homo sapiens
ggtattgcgaaacaactt

SEQ ID NO: 3944788 - DNA, 22 bp, Homo sapiens
ggtcaaaccgcactcacccatg

SEQ ID NO: 3944789 - DNA, 14 bp, Homo sapiens
ggtcaaaggaagac

SEQ ID NO: 3944790 - DNA, 20 bp, Homo sapiens
ggtcaacagagaaggcagga

SEQ ID NO: 3944791 - DNA, 13 bp, Homo sapiens
ggtcaatcccaaa

SEQ ID NO: 3944792 - DNA, 17 bp, Homo sapiens
ggtcacattcaggaaga

SEQ ID NO: 3944793 - DNA, 15 bp, Homo sapiens
ggtcaccatgaaact

SEQ ID NO: 3944794 - DNA, 13 bp, Homo sapiens
ggtcagccagggc

SEQ ID NO: 3944795 - DNA, 13 bp, Homo sapiens
ggtcaggctccat

SEQ ID NO: 3944796 - DNA, 14 bp, Homo sapiens
ggtcagtgtggaga

SEQ ID NO: 3944797 - DNA, 22 bp, Homo sapiens
ggtcatgcttttgccactttgg

SEQ ID NO: 3944798 - DNA, 15 bp, Homo sapiens
ggtcatgtaacaggt

SEQ ID NO: 3944799 - DNA, 14 bp, Homo sapiens
ggtcatgtgtgcat

SEQ ID NO: 3944800 - DNA, 16 bp, Homo sapiens
ggtccacccagcaaag

SEQ ID NO: 3944801 - DNA, 18 bp, Homo sapiens
ggtccagcttgctcttca

SEQ ID NO: 3944802 - DNA, 22 bp, Homo sapiens
ggtccaggaaggcagctgctct

SEQ ID NO: 3944803 - DNA, 13 bp, Homo sapiens
ggtcccacactgg

SEQ ID NO: 3944804 - DNA, 16 bp, Homo sapiens
ggtcccacatccctgg

SEQ ID NO: 3944805 - DNA, 19 bp, Homo sapiens
ggtcccacatccctgggcc

SEQ ID NO: 3944806 - DNA, 20 bp, Homo sapiens
ggtcccacatccctgggcct

SEQ ID NO: 3944807 - DNA, 22 bp, Homo sapiens
ggtcccacgaatttgctgggga

SEQ ID NO: 3944808 - DNA, 20 bp, Homo sapiens
ggtccctcctttggaccctg

SEQ ID NO: 3944809 - DNA, 22 bp, Homo sapiens
ggtccctcgtccacaggggcag

SEQ ID NO: 3944810 - DNA, 23 bp, Homo sapiens
ggtccctgataacaacctggaga

SEQ ID NO: 3944811 - DNA, 19 bp, Homo sapiens
ggtccctggtccctcgtcc

SEQ ID NO: 3944812 - DNA, 20 bp, Homo sapiens
ggtcccttgagacctcagcc

SEQ ID NO: 3944813 - DNA, 18 bp, Homo sapiens
ggtccgcaccagctgctc

SEQ ID NO: 3944814 - DNA, 19 bp, Homo sapiens
ggtccgcaccagctgctct

SEQ ID NO: 3944815 - DNA, 23 bp, Homo sapiens
ggtccgcaccagctgctctgccc

SEQ ID NO: 3944816 - DNA, 14 bp, Homo sapiens
ggtcctcagagaat

SEQ ID NO: 3944817 - DNA, 23 bp, Homo sapiens
ggtcctgaaagtctgtgtccaat

SEQ ID NO: 3944818 - DNA, 22 bp, Homo sapiens
ggtcctgagcactgccaggagg

SEQ ID NO: 3944819 - DNA, 20 bp, Homo sapiens
ggtcctgcccatgtgtcccc

SEQ ID NO: 3944820 - DNA, 17 bp, Homo sapiens
ggtcctggtggggcagc

SEQ ID NO: 3944821 - DNA, 18 bp, Homo sapiens
ggtcctggtggggcagct

SEQ ID NO: 3944822 - DNA, 20 bp, Homo sapiens
ggtcgaccccaaagcccctt

SEQ ID NO: 3944823 - DNA, 14 bp, Homo sapiens
ggtcgtggagagct

SEQ ID NO: 3944824 - DNA, 13 bp, Homo sapiens
ggtggctgaccca

SEQ ID NO: 3944825 - DNA, 21 bp, Homo sapiens
ggtggctgacccagtccctgg

SEQ ID NO: 3944826 - DNA, 13 bp, Homo sapiens
ggtgggacagccc

SEQ ID NO: 3944827 - DNA, 15 bp, Homo sapiens
ggtgggacagcccca

SEQ ID NO: 3944828 - DNA, 13 bp, Homo sapiens
ggtgggagagcca

SEQ ID NO: 3944829 - DNA, 16 bp, Homo sapiens
ggtgggatggaggaga

SEQ ID NO: 3944830 - DNA, 17 bp, Homo sapiens
ggtgggatggaggagaa

SEQ ID NO: 3944831 - DNA, 16 bp, Homo sapiens
ggtgggcagaggctgg

SEQ ID NO: 3944832 - DNA, 13 bp, Homo sapiens
ggtgggcagctgg

SEQ ID NO: 3944833 - DNA, 14 bp, Homo sapiens
ggtgggcctggcct

SEQ ID NO: 3944834 - DNA, 13 bp, Homo sapiens
ggtggggaatgtt

SEQ ID NO: 3944835 - DNA, 10 bp, Homo sapiens
ggtggggcag

SEQ ID NO: 3944836 - DNA, 15 bp, Homo sapiens
ggtggggcagctcct

SEQ ID NO: 3944837 - DNA, 12 bp, Homo sapiens
ggtggggctcgt

SEQ ID NO: 3944838 - DNA, 14 bp, Homo sapiens
ggtggtggatctgt

SEQ ID NO: 3944839 - DNA, 18 bp, Homo sapiens
ggtgtaaaatatctacct

SEQ ID NO: 3944840 - DNA, 22 bp, Homo sapiens
ggtgtaaaatatctacctgccc

SEQ ID NO: 3944841 - DNA, 10 bp, Homo sapiens
ggtgtaaata

SEQ ID NO: 3944842 - DNA, 15 bp, Homo sapiens
ggtgtaatgcacaat

SEQ ID NO: 3944843 - DNA, 17 bp, Homo sapiens
ggtgtagattacctgcc

SEQ ID NO: 3944844 - DNA, 15 bp, Homo sapiens
ggtgtaggtaaatct

SEQ ID NO: 3944845 - DNA, 18 bp, Homo sapiens
ggtgtaggtaaatctagt

SEQ ID NO: 3944846 - DNA, 13 bp, Homo sapiens
ggtgtcaccctgc

SEQ ID NO: 3944847 - DNA, 17 bp, Homo sapiens
ggtgtcaccctgcagag

SEQ ID NO: 3944848 - DNA, 21 bp, Homo sapiens
ggtgtcgctctgctggcctgg

SEQ ID NO: 3944849 - DNA, 16 bp, Homo sapiens
ggtgtctgcacccagg

SEQ ID NO: 3944850 - DNA, 16 bp, Homo sapiens
ggtgtctggaagctga

SEQ ID NO: 3944851 - DNA, 20 bp, Homo sapiens
ggtgtctggaagctgagcag

SEQ ID NO: 3944852 - DNA, 21 bp, Homo sapiens
ggtgtcttttccactcctatg

SEQ ID NO: 3944853 - DNA, 22 bp, Homo sapiens
ggtgtcttttccactcctatgg

SEQ ID NO: 3944854 - DNA, 15 bp, Homo sapiens
ggtgtgcgtgcgtgt

SEQ ID NO: 3944855 - DNA, 20 bp, Homo sapiens
ggtgtgcgtgcgtgtgcgtg

SEQ ID NO: 3944856 - DNA, 12 bp, Homo sapiens
ggtgtggcctca

SEQ ID NO: 3944857 - DNA, 19 bp, Homo sapiens
ggtgtggcctcagccctca

SEQ ID NO: 3944858 - DNA, 18 bp, Homo sapiens
ggtgtgtggagatgcaga

SEQ ID NO: 3944859 - DNA, 17 bp, Homo sapiens
ggtgttggtgtatttgc

SEQ ID NO: 3944860 - DNA, 18 bp, Homo sapiens
ggttaaaatataaattaa

SEQ ID NO: 3944861 - DNA, 13 bp, Homo sapiens
ggttaattccata

SEQ ID NO: 3944862 - DNA, 13 bp, Homo sapiens
ggttatctgcctg

SEQ ID NO: 3944863 - DNA, 20 bp, Homo sapiens
ggttattgaaaatatgatgt

SEQ ID NO: 3944864 - DNA, 17 bp, Homo sapiens
ggttatttttgtccctg

SEQ ID NO: 3944865 - DNA, 18 bp, Homo sapiens
ggttatttttgtccctgc

SEQ ID NO: 3944866 - DNA, 19 bp, Homo sapiens
ggttatttttgtccctgct

SEQ ID NO: 3944867 - DNA, 22 bp, Homo sapiens
ggttatttttgtccctgctcct

SEQ ID NO: 3944868 - DNA, 13 bp, Homo sapiens
ggttcaccttgcc

SEQ ID NO: 3944869 - DNA, 22 bp, Homo sapiens
ggttcaccttgccgagagaggc

SEQ ID NO: 3944870 - DNA, 18 bp, Homo sapiens
ggttcactagagctggga

SEQ ID NO: 3944871 - DNA, 18 bp, Homo sapiens
ggttcagcccctcctctg

SEQ ID NO: 3944872 - DNA, 19 bp, Homo sapiens
ggttcattccccggccctc

SEQ ID NO: 3944873 - DNA, 23 bp, Homo sapiens
ggttccaagaaagatccaccctc

SEQ ID NO: 3944874 - DNA, 15 bp, Homo sapiens
ggttcccagcagctg

SEQ ID NO: 3944875 - DNA, 17 bp, Homo sapiens
ggttcccccagacagag

SEQ ID NO: 3944876 - DNA, 22 bp, Homo sapiens
ggttcctcgcaggtctcagccc

SEQ ID NO: 3944877 - DNA, 15 bp, Homo sapiens
ggttccttccctggg

SEQ ID NO: 3944878 - DNA, 14 bp, Homo sapiens
ggttctggggagga

SEQ ID NO: 3944879 - DNA, 16 bp, Homo sapiens
ggttcttgatgtcatg

SEQ ID NO: 3944880 - DNA, 21 bp, Homo sapiens
ggttgaaggcagtctgaaccc

SEQ ID NO: 3944881 - DNA, 16 bp, Homo sapiens
ggttgactttcaggta

SEQ ID NO: 3944882 - DNA, 16 bp, Homo sapiens
ggttgcaaggccgctg

SEQ ID NO: 3944883 - DNA, 22 bp, Homo sapiens
ggttgcgggggagctggaaata

SEQ ID NO: 3944884 - DNA, 19 bp, Homo sapiens
ggttgcttctggctcctcc

SEQ ID NO: 3944885 - DNA, 11 bp, Homo sapiens
ggttggatggg

SEQ ID NO: 3944886 - DNA, 18 bp, Homo sapiens
ggttggatgggaagatgg

SEQ ID NO: 3944887 - DNA, 17 bp, Homo sapiens
ggttgtactattgttta

SEQ ID NO: 3944888 - DNA, 16 bp, Homo sapiens
ggttgtgaggcctggc

SEQ ID NO: 3944889 - DNA, 22 bp, Homo sapiens
ggttgtgaggcctggccaggca

SEQ ID NO: 3944890 - DNA, 19 bp, Homo sapiens
ggttgttaatgttgggatt

SEQ ID NO: 3944891 - DNA, 14 bp, Homo sapiens
ggtttacccagtgg

SEQ ID NO: 3944892 - DNA, 18 bp, Homo sapiens
ggtttctgcgtgctttat

SEQ ID NO: 3944893 - DNA, 15 bp, Homo sapiens
ggtttctgttctgtt

SEQ ID NO: 3944894 - DNA, 22 bp, Homo sapiens
ggtttcttggggtcccagggaa

SEQ ID NO: 3944895 - DNA, 13 bp, Homo sapiens
ggtttgccagtga

SEQ ID NO: 3944896 - DNA, 13 bp, Homo sapiens
ggtttgccctgcc

SEQ ID NO: 3944897 - DNA, 15 bp, Homo sapiens
ggtttgtattttaaa

SEQ ID NO: 3944898 - DNA, 15 bp, Homo sapiens
ggttttggagtcagt

SEQ ID NO: 3944899 - DNA, 15 bp, Homo sapiens
ggttttgtattcttt

SEQ ID NO: 3944900 - DNA, 21 bp, Homo sapiens
ggtttttaatctttgtgacag

SEQ ID NO: 3944901 - DNA, 16 bp, Homo sapiens
ggtttttatttctcgg

SEQ ID NO: 3944902 - DNA, 16 bp, Homo sapiens
gtaaaaccacagcagt

SEQ ID NO: 3944903 - DNA, 17 bp, Homo sapiens
gtaaaaccatgtagttt

SEQ ID NO: 3944904 - DNA, 21 bp, Homo sapiens
gtaaaactacacatccctaat

SEQ ID NO: 3944905 - DNA, 18 bp, Homo sapiens
gtaaaagaacagtaaaca

SEQ ID NO: 3944906 - DNA, 17 bp, Homo sapiens
gtaaaagataacaagat

SEQ ID NO: 3944907 - DNA, 13 bp, Homo sapiens
gtaaaagctaatt

SEQ ID NO: 3944908 - DNA, 17 bp, Homo sapiens
gtaaaaggtattaaatt

SEQ ID NO: 3944909 - DNA, 14 bp, Homo sapiens
gtaaaataaaatta

SEQ ID NO: 3944910 - DNA, 15 bp, Homo sapiens
gtaaacagtgcctgc

SEQ ID NO: 3944911 - DNA, 16 bp, Homo sapiens
gtaccaggtcattctt

SEQ ID NO: 3944912 - DNA, 14 bp, Homo sapiens
gtaccccatccctt

SEQ ID NO: 3944913 - DNA, 15 bp, Homo sapiens
gtaccccatcccttc

SEQ ID NO: 3944914 - DNA, 17 bp, Homo sapiens
gtaccccatcccttcct

SEQ ID NO: 3944915 - DNA, 20 bp, Homo sapiens
gtacccttccacctcctaga

SEQ ID NO: 3944916 - DNA, 18 bp, Homo sapiens
gtaccgcgtctaccctgg

SEQ ID NO: 3944917 - DNA, 20 bp, Homo sapiens
gtaccgcgtctaccctggga

SEQ ID NO: 3944918 - DNA, 16 bp, Homo sapiens
gtacgttatatattgt

SEQ ID NO: 3944919 - DNA, 22 bp, Homo sapiens
gtactactgctgcaaagtgcaa

SEQ ID NO: 3944920 - DNA, 19 bp, Homo sapiens
gtactagaatttgtatttt

SEQ ID NO: 3944921 - DNA, 16 bp, Homo sapiens
gtactatgttaataac

SEQ ID NO: 3944922 - DNA, 13 bp, Homo sapiens
gtactcagagcag

SEQ ID NO: 3944923 - DNA, 15 bp, Homo sapiens
gtactcagagcagag

SEQ ID NO: 3944924 - DNA, 21 bp, Homo sapiens
gtactcagtatagcattgaac

SEQ ID NO: 3944925 - DNA, 22 bp, Homo sapiens
gtactctctgctctagccagga

SEQ ID NO: 3944926 - DNA, 11 bp, Homo sapiens
gtactgcctgc

SEQ ID NO: 3944927 - DNA, 13 bp, Homo sapiens
gtactgcctgctt

SEQ ID NO: 3944928 - DNA, 23 bp, Homo sapiens
gtactgggaatggaaggctttgc

SEQ ID NO: 3944929 - DNA, 14 bp, Homo sapiens
gtacttcctcctga

SEQ ID NO: 3944930 - DNA, 13 bp, Homo sapiens
gtacttcctgtgt

SEQ ID NO: 3944931 - DNA, 12 bp, Homo sapiens
gtacttctaaga

SEQ ID NO: 3944932 - DNA, 19 bp, Homo sapiens
gtactttatttgtatttgc

SEQ ID NO: 3944933 - DNA, 18 bp, Homo sapiens
gtagaaattgttcctgat

SEQ ID NO: 3944934 - DNA, 14 bp, Homo sapiens
gtagaacctcacct

SEQ ID NO: 3944935 - DNA, 11 bp, Homo sapiens
gtagaagccag

SEQ ID NO: 3944936 - DNA, 17 bp, Homo sapiens
gtagaattatatctaat

SEQ ID NO: 3944937 - DNA, 18 bp, Homo sapiens
gtagaattgggaagctgg

SEQ ID NO: 3944938 - DNA, 15 bp, Homo sapiens
gtagacaactggtcc

SEQ ID NO: 3944939 - DNA, 15 bp, Homo sapiens
gtagaccaaaataaa

SEQ ID NO: 3944940 - DNA, 16 bp, Homo sapiens
gtagactatatacatg

SEQ ID NO: 3944941 - DNA, 19 bp, Homo sapiens
gtagatcgcttgagcccag

SEQ ID NO: 3944942 - DNA, 15 bp, Homo sapiens
gtagatctgcttctt

SEQ ID NO: 3944943 - DNA, 16 bp, Homo sapiens
gtagcacatgtatgct

SEQ ID NO: 3944944 - DNA, 18 bp, Homo sapiens
gtagcaggtaccactgat

SEQ ID NO: 3944945 - DNA, 14 bp, Homo sapiens
gtagccaaaggttc

SEQ ID NO: 3944946 - DNA, 15 bp, Homo sapiens
gtagccatggctcag

SEQ ID NO: 3944947 - DNA, 17 bp, Homo sapiens
gtagccatggctcaggc

SEQ ID NO: 3944948 - DNA, 20 bp, Homo sapiens
gtagccatggctcaggcaag

SEQ ID NO: 3944949 - DNA, 21 bp, Homo sapiens
gtagccatggctcaggcaagc

SEQ ID NO: 3944950 - DNA, 13 bp, Homo sapiens
gtagcccggccag

SEQ ID NO: 3944951 - DNA, 23 bp, Homo sapiens
gtagcctccgtttatgggccttg

SEQ ID NO: 3944952 - DNA, 22 bp, Homo sapiens
gtagccttgccttttaaaagaa

SEQ ID NO: 3944953 - DNA, 22 bp, Homo sapiens
gtagctatttgtttacatgcag

SEQ ID NO: 3944954 - DNA, 12 bp, Homo sapiens
gtagctctgcct

SEQ ID NO: 3944955 - DNA, 14 bp, Homo sapiens
gtagctctgcctcc

SEQ ID NO: 3944956 - DNA, 11 bp, Homo sapiens
gtagctgagct

SEQ ID NO: 3944957 - DNA, 22 bp, Homo sapiens
gtagctgagctcacaaggcagc

SEQ ID NO: 3944958 - DNA, 14 bp, Homo sapiens
gtagctgtgacctg

SEQ ID NO: 3944959 - DNA, 15 bp, Homo sapiens
gtagctgtgacctgc

SEQ ID NO: 3944960 - DNA, 16 bp, Homo sapiens
gtagctgtgacctgct

SEQ ID NO: 3944961 - DNA, 17 bp, Homo sapiens
gtagctgtgacctgctg

SEQ ID NO: 3944962 - DNA, 13 bp, Homo sapiens
gtagcttaaataa

SEQ ID NO: 3944963 - DNA, 18 bp, Homo sapiens
gtagcttacctgacacaa

SEQ ID NO: 3944964 - DNA, 22 bp, Homo sapiens
gtagcttacctgacacaagagg

SEQ ID NO: 3944965 - DNA, 16 bp, Homo sapiens
gtagctttatccttag

SEQ ID NO: 3944966 - DNA, 12 bp, Homo sapiens
gtagctttgctc

SEQ ID NO: 3944967 - DNA, 15 bp, Homo sapiens
gtaggaatcctttga

SEQ ID NO: 3944968 - DNA, 17 bp, Homo sapiens
gtaggaatcctttgaga

SEQ ID NO: 3944969 - DNA, 16 bp, Homo sapiens
gtaggaccaatgttgt

SEQ ID NO: 3944970 - DNA, 21 bp, Homo sapiens
gtaggagggactgtcgctgct

SEQ ID NO: 3944971 - DNA, 13 bp, Homo sapiens
gtaggcagagcct

SEQ ID NO: 3944972 - DNA, 20 bp, Homo sapiens
gtaggcatgagggatcacag

SEQ ID NO: 3944973 - DNA, 16 bp, Homo sapiens
gtaggccaagctgaag

SEQ ID NO: 3944974 - DNA, 17 bp, Homo sapiens
gtaggcccttgtcctgc

SEQ ID NO: 3944975 - DNA, 18 bp, Homo sapiens
gtaggcccttgtcctgcc

SEQ ID NO: 3944976 - DNA, 20 bp, Homo sapiens
gtaggcccttgtcctgccag

SEQ ID NO: 3944977 - DNA, 22 bp, Homo sapiens
gtaggcccttgtcctgccagct

SEQ ID NO: 3944978 - DNA, 23 bp, Homo sapiens
gtaggcccttgtcctgccagctg

SEQ ID NO: 3944979 - DNA, 20 bp, Homo sapiens
gtagggagctcactcccact

SEQ ID NO: 3944980 - DNA, 20 bp, Homo sapiens
gtaggggtcaaagaaatgct

SEQ ID NO: 3944981 - DNA, 20 bp, Homo sapiens
gtaggtattaaagatgtgtt

SEQ ID NO: 3944982 - DNA, 14 bp, Homo sapiens
gtaggtccaagggc

SEQ ID NO: 3944983 - DNA, 16 bp, Homo sapiens
gtaggtccaagggcca

SEQ ID NO: 3944984 - DNA, 12 bp, Homo sapiens
gtagtcccagcc

SEQ ID NO: 3944985 - DNA, 13 bp, Homo sapiens
gtagtggaagagc

SEQ ID NO: 3944986 - DNA, 16 bp, Homo sapiens
gtagtggaagagcagc

SEQ ID NO: 3944987 - DNA, 20 bp, Homo sapiens
gtagtggaagagcagcctga

SEQ ID NO: 3944988 - DNA, 13 bp, Homo sapiens
gtagttccctgaa

SEQ ID NO: 3944989 - DNA, 12 bp, Homo sapiens
gtataaaaacaa

SEQ ID NO: 3944990 - DNA, 18 bp, Homo sapiens
gtataaaatgcaaaataa

SEQ ID NO: 3944991 - DNA, 19 bp, Homo sapiens
gtataaaatgcaaaataaa

SEQ ID NO: 3944992 - DNA, 17 bp, Homo sapiens
gtataaactatcagttt

SEQ ID NO: 3944993 - DNA, 11 bp, Homo sapiens
gtataaatgta

SEQ ID NO: 3944994 - DNA, 17 bp, Homo sapiens
gtataaatgtatataca

SEQ ID NO: 3944995 - DNA, 20 bp, Homo sapiens
gtataacttcttaaaagttg

SEQ ID NO: 3944996 - DNA, 14 bp, Homo sapiens
gtataatctattta

SEQ ID NO: 3944997 - DNA, 23 bp, Homo sapiens
gtataatggttgactgggtttct

SEQ ID NO: 3944998 - DNA, 12 bp, Homo sapiens
gtcacagctgca

SEQ ID NO: 3944999 - DNA, 14 bp, Homo sapiens
gtcacagctgcagc

SEQ ID NO: 3945000 - DNA, 15 bp, Homo sapiens
gtcacagctgcagct

SEQ ID NO: 3945001 - DNA, 22 bp, Homo sapiens
gtcacagttcttggtgactgtc

SEQ ID NO: 3945002 - DNA, 17 bp, Homo sapiens
gtcaccaccttcccagc

SEQ ID NO: 3945003 - DNA, 20 bp, Homo sapiens
gtcaccaccttcccagctct

SEQ ID NO: 3945004 - DNA, 22 bp, Homo sapiens
gtcaccaccttcccagctctcc

SEQ ID NO: 3945005 - DNA, 23 bp, Homo sapiens
gtcaccaggaatgttaaagtcag

SEQ ID NO: 3945006 - DNA, 20 bp, Homo sapiens
gtcacccaggctggagtaca

SEQ ID NO: 3945007 - DNA, 13 bp, Homo sapiens
gtcaccctgcaga

SEQ ID NO: 3945008 - DNA, 15 bp, Homo sapiens
gtcaccctgcagagc

SEQ ID NO: 3945009 - DNA, 15 bp, Homo sapiens
gtcacccttctgggc

SEQ ID NO: 3945010 - DNA, 18 bp, Homo sapiens
gtcaccgtggaccttcct

SEQ ID NO: 3945011 - DNA, 19 bp, Homo sapiens
gtcaccgtggaccttcctg

SEQ ID NO: 3945012 - DNA, 18 bp, Homo sapiens
gtcacctgcaagccccag

SEQ ID NO: 3945013 - DNA, 16 bp, Homo sapiens
gtcacgcagccaccag

SEQ ID NO: 3945014 - DNA, 16 bp, Homo sapiens
gtcacgtgaaatattt

SEQ ID NO: 3945015 - DNA, 24 bp, Homo sapiens
gtcactatgctatttctggcctca

SEQ ID NO: 3945016 - DNA, 20 bp, Homo sapiens
gtcactcttcctgcaaggac

SEQ ID NO: 3945017 - DNA, 13 bp, Homo sapiens
gtcactgggttct

SEQ ID NO: 3945018 - DNA, 17 bp, Homo sapiens
gtcactgtccctcaaat

SEQ ID NO: 3945019 - DNA, 22 bp, Homo sapiens
gtcactgtctcaactactcagc

SEQ ID NO: 3945020 - DNA, 13 bp, Homo sapiens
gtcagaaactgtt

SEQ ID NO: 3945021 - DNA, 20 bp, Homo sapiens
gtcagacatccatgtttgta

SEQ ID NO: 3945022 - DNA, 18 bp, Homo sapiens
gtcagagccaggctctgc

SEQ ID NO: 3945023 - DNA, 10 bp, Homo sapiens
gtcagagcta

SEQ ID NO: 3945024 - DNA, 14 bp, Homo sapiens
gtcagccagggcca

SEQ ID NO: 3945025 - DNA, 15 bp, Homo sapiens
gtcagccagggccag

SEQ ID NO: 3945026 - DNA, 21 bp, Homo sapiens
gtcagcgcaggtttagtttac

SEQ ID NO: 3945027 - DNA, 19 bp, Homo sapiens
gtcagctcccctcggagaa

SEQ ID NO: 3945028 - DNA, 23 bp, Homo sapiens
gtcagctcccctcggagaagagc

SEQ ID NO: 3945029 - DNA, 13 bp, Homo sapiens
gtcaggacccagg

SEQ ID NO: 3945030 - DNA, 20 bp, Homo sapiens
gtcaggacctccggggagag

SEQ ID NO: 3945031 - DNA, 21 bp, Homo sapiens
gtcaggcaggtttgccagtga

SEQ ID NO: 3945032 - DNA, 21 bp, Homo sapiens
gtcaggcccttattttcaaga

SEQ ID NO: 3945033 - DNA, 12 bp, Homo sapiens
gtcagggcagta

SEQ ID NO: 3945034 - DNA, 15 bp, Homo sapiens
gtcagggtgggaaga

SEQ ID NO: 3945035 - DNA, 15 bp, Homo sapiens
gtcagtgtggagagg

SEQ ID NO: 3945036 - DNA, 17 bp, Homo sapiens
gtcagttcccggagcac

SEQ ID NO: 3945037 - DNA, 19 bp, Homo sapiens
gtcagttcccggagcacag

SEQ ID NO: 3945038 - DNA, 22 bp, Homo sapiens
gtcatagaaattacacccaaag

SEQ ID NO: 3945039 - DNA, 21 bp, Homo sapiens
gtcatatattcatgtaataaa

SEQ ID NO: 3945040 - DNA, 18 bp, Homo sapiens
gtcatatgtaggtgtctg

SEQ ID NO: 3945041 - DNA, 15 bp, Homo sapiens
gtcatctagcccctt

SEQ ID NO: 3945042 - DNA, 15 bp, Homo sapiens
gtcatctctctgggg

SEQ ID NO: 3945043 - DNA, 17 bp, Homo sapiens
gtcatctctctggggcc

SEQ ID NO: 3945044 - DNA, 20 bp, Homo sapiens
gtcatgaattcttatgctta

SEQ ID NO: 3945045 - DNA, 20 bp, Homo sapiens
gtcatgatctccctgccgcc

SEQ ID NO: 3945046 - DNA, 22 bp, Homo sapiens
gtcatgatctccctgccgcctc

SEQ ID NO: 3945047 - DNA, 17 bp, Homo sapiens
gtcatgcttcagttgta

SEQ ID NO: 3945048 - DNA, 18 bp, Homo sapiens
gtcatggaaaagcccagt

SEQ ID NO: 3945049 - DNA, 19 bp, Homo sapiens
gtcatggaaaagcccagtg

SEQ ID NO: 3945050 - DNA, 15 bp, Homo sapiens
gtcatggcttaatgt

SEQ ID NO: 3945051 - DNA, 20 bp, Homo sapiens
gtcatggcttaatgtttatt

SEQ ID NO: 3945052 - DNA, 18 bp, Homo sapiens
gtcatgtacttcctgtgt

SEQ ID NO: 3945053 - DNA, 15 bp, Homo sapiens
gtcatgtgtgcatgt

SEQ ID NO: 3945054 - DNA, 16 bp, Homo sapiens
gtcatgtgtgcatgtg

SEQ ID NO: 3945055 - DNA, 23 bp, Homo sapiens
gtcattcttaagatttctcctga

SEQ ID NO: 3945056 - DNA, 16 bp, Homo sapiens
gtcatttattttaaaa

SEQ ID NO: 3945057 - DNA, 15 bp, Homo sapiens
gtcatttgcaagctg

SEQ ID NO: 3945058 - DNA, 15 bp, Homo sapiens
gtccaacctgcctgt

SEQ ID NO: 3945059 - DNA, 20 bp, Homo sapiens
gtccaatggctgtaaactat

SEQ ID NO: 3945060 - DNA, 22 bp, Homo sapiens
gtccacaggggcaggcctggga

SEQ ID NO: 3945061 - DNA, 22 bp, Homo sapiens
gtccacagtctcccattctcat

SEQ ID NO: 3945062 - DNA, 19 bp, Homo sapiens
gtccacatcttctcagtgt

SEQ ID NO: 3945063 - DNA, 13 bp, Homo sapiens
gtccacccaggct

SEQ ID NO: 3945064 - DNA, 14 bp, Homo sapiens
gtccacccaggctg

SEQ ID NO: 3945065 - DNA, 16 bp, Homo sapiens
gtccacccaggctgca

SEQ ID NO: 3945066 - DNA, 21 bp, Homo sapiens
gtccacccaggctgcactgca

SEQ ID NO: 3945067 - DNA, 21 bp, Homo sapiens
gtccacctggccccatgtctc

SEQ ID NO: 3945068 - DNA, 19 bp, Homo sapiens
gtccactcagggctgccac

SEQ ID NO: 3945069 - DNA, 18 bp, Homo sapiens
gtccactctcggggccct

SEQ ID NO: 3945070 - DNA, 19 bp, Homo sapiens
gtccagaataagtgctgtt

SEQ ID NO: 3945071 - DNA, 19 bp, Homo sapiens
gtccagaccattgtcttcc

SEQ ID NO: 3945072 - DNA, 22 bp, Homo sapiens
gtccagacgtcaaccaggaaca

SEQ ID NO: 3945073 - DNA, 15 bp, Homo sapiens
gtccagatgccttcc

SEQ ID NO: 3945074 - DNA, 12 bp, Homo sapiens
gtccagcagctg

SEQ ID NO: 3945075 - DNA, 13 bp, Homo sapiens
gtccagcagctgc

SEQ ID NO: 3945076 - DNA, 22 bp, Homo sapiens
gtccagctagccaactcctcct

SEQ ID NO: 3945077 - DNA, 23 bp, Homo sapiens
gtccagctagccaactcctcctt

SEQ ID NO: 3945078 - DNA, 17 bp, Homo sapiens
gtccagcttgctcttca

SEQ ID NO: 3945079 - DNA, 20 bp, Homo sapiens
gtccaggaaggcagctgctc

SEQ ID NO: 3945080 - DNA, 21 bp, Homo sapiens
gtccaggaaggcagctgctct

SEQ ID NO: 3945081 - DNA, 17 bp, Homo sapiens
gtccagggcgggagtgg

SEQ ID NO: 3945082 - DNA, 19 bp, Homo sapiens
gtccagggcgggagtgggg

SEQ ID NO: 3945083 - DNA, 21 bp, Homo sapiens
gtccaggtcctggtggggcag

SEQ ID NO: 3945084 - DNA, 16 bp, Homo sapiens
gtccttgcacccctca

SEQ ID NO: 3945085 - DNA, 18 bp, Homo sapiens
gtccttgcacccctcact

SEQ ID NO: 3945086 - DNA, 17 bp, Homo sapiens
gtccttggaagtttcat

SEQ ID NO: 3945087 - DNA, 14 bp, Homo sapiens
gtccttggtgtgac

SEQ ID NO: 3945088 - DNA, 14 bp, Homo sapiens
gtcctttaggcagc

SEQ ID NO: 3945089 - DNA, 16 bp, Homo sapiens
gtcgccccaggccctc

SEQ ID NO: 3945090 - DNA, 18 bp, Homo sapiens
gtcgccccaggccctccc

SEQ ID NO: 3945091 - DNA, 18 bp, Homo sapiens
gtcgctctgctggcctgg

SEQ ID NO: 3945092 - DNA, 18 bp, Homo sapiens
gtcgggagttcgagacca

SEQ ID NO: 3945093 - DNA, 13 bp, Homo sapiens
gtcgggggtggca

SEQ ID NO: 3945094 - DNA, 18 bp, Homo sapiens
gtcgtggagagctaggag

SEQ ID NO: 3945095 - DNA, 21 bp, Homo sapiens
gtcgtggagagctaggagcaa

SEQ ID NO: 3945096 - DNA, 23 bp, Homo sapiens
gtcgtggcagataatcagcctct

SEQ ID NO: 3945097 - DNA, 18 bp, Homo sapiens
gtctacgttctccagccc

SEQ ID NO: 3945098 - DNA, 15 bp, Homo sapiens
gtctaggagctgtct

SEQ ID NO: 3945099 - DNA, 18 bp, Homo sapiens
gtctatagagaaaaactt

SEQ ID NO: 3945100 - DNA, 15 bp, Homo sapiens
gtctattctgagcct

SEQ ID NO: 3945101 - DNA, 16 bp, Homo sapiens
gtctattctgagcctt

SEQ ID NO: 3945102 - DNA, 12 bp, Homo sapiens
gtctatttaagc

SEQ ID NO: 3945103 - DNA, 13 bp, Homo sapiens
gtctcaaacaagg

SEQ ID NO: 3945104 - DNA, 17 bp, Homo sapiens
gtctcaagagggcactg

SEQ ID NO: 3945105 - DNA, 22 bp, Homo sapiens
gtctcaagagggcactggtggc

SEQ ID NO: 3945106 - DNA, 14 bp, Homo sapiens
gtctcactcctgag

SEQ ID NO: 3945107 - DNA, 16 bp, Homo sapiens
gtctcacttataccaa

SEQ ID NO: 3945108 - DNA, 11 bp, Homo sapiens
gtctcattctg

SEQ ID NO: 3945109 - DNA, 15 bp, Homo sapiens
gtctccactgaggat

SEQ ID NO: 3945110 - DNA, 18 bp, Homo sapiens
gtctccagtggttgctgt

SEQ ID NO: 3945111 - DNA, 19 bp, Homo sapiens
gtctccagtggttgctgtt

SEQ ID NO: 3945112 - DNA, 20 bp, Homo sapiens
gtctccagtggttgctgttg

SEQ ID NO: 3945113 - DNA, 16 bp, Homo sapiens
gtctccataatgccac

SEQ ID NO: 3945114 - DNA, 16 bp, Homo sapiens
gtctccctaaaataaa

SEQ ID NO: 3945115 - DNA, 23 bp, Homo sapiens
gtctccctaaaataaaaaccaga

SEQ ID NO: 3945116 - DNA, 21 bp, Homo sapiens
gtctcctacctgctgctgcta

SEQ ID NO: 3945117 - DNA, 19 bp, Homo sapiens
gtctccttactctgagccc

SEQ ID NO: 3945118 - DNA, 20 bp, Homo sapiens
gtctccttactctgagccca

SEQ ID NO: 3945119 - DNA, 21 bp, Homo sapiens
gtctcctttctcagccacaaa

SEQ ID NO: 3945120 - DNA, 16 bp, Homo sapiens
gtctcctttgcactga

SEQ ID NO: 3945121 - DNA, 20 bp, Homo sapiens
gtctcctttgcactgagggc

SEQ ID NO: 3945122 - DNA, 22 bp, Homo sapiens
gtctcgggtccgattaatttat

SEQ ID NO: 3945123 - DNA, 14 bp, Homo sapiens
gtctctagccactt

SEQ ID NO: 3945124 - DNA, 16 bp, Homo sapiens
gtctctatttcatttt

SEQ ID NO: 3945125 - DNA, 19 bp, Homo sapiens
gtctctctctctctacaaa

SEQ ID NO: 3945126 - DNA, 17 bp, Homo sapiens
gtctctctttctccctc

SEQ ID NO: 3945127 - DNA, 19 bp, Homo sapiens
gtctctctttctccctcac

SEQ ID NO: 3945128 - DNA, 20 bp, Homo sapiens
gtctctgtataatctattta

SEQ ID NO: 3945129 - DNA, 13 bp, Homo sapiens
gtctcttcctctg

SEQ ID NO: 3945130 - DNA, 14 bp, Homo sapiens
gtctcttcctctgt

SEQ ID NO: 3945131 - DNA, 14 bp, Homo sapiens
gtctcttgtagaag

SEQ ID NO: 3945132 - DNA, 20 bp, Homo sapiens
gtctcttgtagaagatggac

SEQ ID NO: 3945133 - DNA, 22 bp, Homo sapiens
gtctcttttgttcctggctttg

SEQ ID NO: 3945134 - DNA, 18 bp, Homo sapiens
gtctgaacccttgtgctt

SEQ ID NO: 3945135 - DNA, 16 bp, Homo sapiens
gtctgaagtggttgtt

SEQ ID NO: 3945136 - DNA, 14 bp, Homo sapiens
gtctgactccagag

SEQ ID NO: 3945137 - DNA, 20 bp, Homo sapiens
gtctgactccagagtctgag

SEQ ID NO: 3945138 - DNA, 22 bp, Homo sapiens
gtctgactccagagtctgagcc

SEQ ID NO: 3945139 - DNA, 23 bp, Homo sapiens
gtctgactccagagtctgagccc

SEQ ID NO: 3945140 - DNA, 23 bp, Homo sapiens
gtctgagactctcttaggagcag

SEQ ID NO: 3945141 - DNA, 22 bp, Homo sapiens
gtctgagcaccccctcattccc

SEQ ID NO: 3945142 - DNA, 14 bp, Homo sapiens
gtctgaggcctcat

SEQ ID NO: 3945143 - DNA, 22 bp, Homo sapiens
gtctgaggggcaactgagtctg

SEQ ID NO: 3945144 - DNA, 16 bp, Homo sapiens
gtctgaggtcctgagc

SEQ ID NO: 3945145 - DNA, 21 bp, Homo sapiens
gtctgaggtcctgagcactgc

SEQ ID NO: 3945146 - DNA, 18 bp, Homo sapiens
gtctgagtctgagtcctg

SEQ ID NO: 3945147 - DNA, 14 bp, Homo sapiens
gtctgatgtttgtt

SEQ ID NO: 3945148 - DNA, 15 bp, Homo sapiens
gtctgcacccagggg

SEQ ID NO: 3945149 - DNA, 17 bp, Homo sapiens
gtctgcacccaggggtg

SEQ ID NO: 3945150 - DNA, 18 bp, Homo sapiens
gtctgcagcccggcgcca

SEQ ID NO: 3945151 - DNA, 18 bp, Homo sapiens
gtctgcattgttattgtg

SEQ ID NO: 3945152 - DNA, 12 bp, Homo sapiens
gtctgccaggcc

SEQ ID NO: 3945153 - DNA, 17 bp, Homo sapiens
gtctgccaggcccatct

SEQ ID NO: 3945154 - DNA, 22 bp, Homo sapiens
gtctgccaggcccatctcaggt

SEQ ID NO: 3945155 - DNA, 19 bp, Homo sapiens
gtctgcttctgtccaggac

SEQ ID NO: 3945156 - DNA, 23 bp, Homo sapiens
gtctgcttctgtccaggacatga

SEQ ID NO: 3945157 - DNA, 19 bp, Homo sapiens
gtctgcttttgctggggta

SEQ ID NO: 3945158 - DNA, 19 bp, Homo sapiens
gtctggaagctgagcaggc

SEQ ID NO: 3945159 - DNA, 20 bp, Homo sapiens
gtctggaagctgagcaggcc

SEQ ID NO: 3945160 - DNA, 15 bp, Homo sapiens
gtctggctgagctga

SEQ ID NO: 3945161 - DNA, 16 bp, Homo sapiens
gtctgggatgtagaac

SEQ ID NO: 3945162 - DNA, 22 bp, Homo sapiens
gtctgggcaatgaaaccaaagc

SEQ ID NO: 3945163 - DNA, 15 bp, Homo sapiens
gtctgggcccccact

SEQ ID NO: 3945164 - DNA, 11 bp, Homo sapiens
gtctggtgtag

SEQ ID NO: 3945165 - DNA, 12 bp, Homo sapiens
gtctgtgctctt

SEQ ID NO: 3945166 - DNA, 14 bp, Homo sapiens
gtctgtgtgtgtgt

SEQ ID NO: 3945167 - DNA, 15 bp, Homo sapiens
gtcttaaaataactt

SEQ ID NO: 3945168 - DNA, 23 bp, Homo sapiens
gtcttaagccttttgctcacaaa

SEQ ID NO: 3945169 - DNA, 19 bp, Homo sapiens
gtcttaattaaaagaatat

SEQ ID NO: 3945170 - DNA, 19 bp, Homo sapiens
gtgatccttttatgttatt

SEQ ID NO: 3945171 - DNA, 14 bp, Homo sapiens
gtgatggagtgtgc

SEQ ID NO: 3945172 - DNA, 22 bp, Homo sapiens
gtgatggagtgtgcgtgtgtgc

SEQ ID NO: 3945173 - DNA, 17 bp, Homo sapiens
gtgatgggaaagcattg

SEQ ID NO: 3945174 - DNA, 22 bp, Homo sapiens
gtgatggttcccctgttcactc

SEQ ID NO: 3945175 - DNA, 14 bp, Homo sapiens
gtgattaacttgct

SEQ ID NO: 3945176 - DNA, 23 bp, Homo sapiens
gtgatttagaactgtatgtcaga

SEQ ID NO: 3945177 - DNA, 19 bp, Homo sapiens
gtgatttcagagagggcag

SEQ ID NO: 3945178 - DNA, 20 bp, Homo sapiens
gtgatttggaagagaggcac

SEQ ID NO: 3945179 - DNA, 23 bp, Homo sapiens
gtgatttggaagagaggcacctg

SEQ ID NO: 3945180 - DNA, 21 bp, Homo sapiens
gtgattttgtacagaattttt

SEQ ID NO: 3945181 - DNA, 14 bp, Homo sapiens
gtgatttttttgtc

SEQ ID NO: 3945182 - DNA, 15 bp, Homo sapiens
gtgcaaagtgccctc

SEQ ID NO: 3945183 - DNA, 20 bp, Homo sapiens
gtgcaaattttgcatttagt

SEQ ID NO: 3945184 - DNA, 20 bp, Homo sapiens
gtgcaacaagagcaaaatga

SEQ ID NO: 3945185 - DNA, 14 bp, Homo sapiens
gtgcaagagacaga

SEQ ID NO: 3945186 - DNA, 21 bp, Homo sapiens
gtgcaagagacagagccccca

SEQ ID NO: 3945187 - DNA, 18 bp, Homo sapiens
gtgcaagagactctggcc

SEQ ID NO: 3945188 - DNA, 19 bp, Homo sapiens
gtgcaagagactctggcct

SEQ ID NO: 3945189 - DNA, 20 bp, Homo sapiens
gtgcaagagactctggcctc

SEQ ID NO: 3945190 - DNA, 16 bp, Homo sapiens
gtgcaatttcccctct

SEQ ID NO: 3945191 - DNA, 22 bp, Homo sapiens
gtgcaatttcccctctgtgtcc

SEQ ID NO: 3945192 - DNA, 23 bp, Homo sapiens
gtgcacacagaaatatatataca

SEQ ID NO: 3945193 - DNA, 21 bp, Homo sapiens
gtgcaccaccatgccaggcta

SEQ ID NO: 3945194 - DNA, 17 bp, Homo sapiens
gtgcacccactcaccag

SEQ ID NO: 3945195 - DNA, 18 bp, Homo sapiens
gtgcacccactcaccagg

SEQ ID NO: 3945196 - DNA, 17 bp, Homo sapiens
gtgcaccttacattcct

SEQ ID NO: 3945197 - DNA, 20 bp, Homo sapiens
gtgcaccttaccaactttct

SEQ ID NO: 3945198 - DNA, 15 bp, Homo sapiens
gtgcacttttctgtg

SEQ ID NO: 3945199 - DNA, 17 bp, Homo sapiens
gtgcagaggtgagcaga

SEQ ID NO: 3945200 - DNA, 20 bp, Homo sapiens
gtgcagaggtgagcagagga

SEQ ID NO: 3945201 - DNA, 21 bp, Homo sapiens
gtgcagaggtgagcagaggag

SEQ ID NO: 3945202 - DNA, 14 bp, Homo sapiens
gtgcagcagcccag

SEQ ID NO: 3945203 - DNA, 16 bp, Homo sapiens
gtgcagcagcccagct

SEQ ID NO: 3945204 - DNA, 18 bp, Homo sapiens
gtgcagcagcccagcttc

SEQ ID NO: 3945205 - DNA, 14 bp, Homo sapiens
gtgcagcccttcct

SEQ ID NO: 3945206 - DNA, 17 bp, Homo sapiens
gtgcagcttctgtcctg

SEQ ID NO: 3945207 - DNA, 19 bp, Homo sapiens
gtgcagtgatacatgtact

SEQ ID NO: 3945208 - DNA, 15 bp, Homo sapiens
gtgcagttttccagg

SEQ ID NO: 3945209 - DNA, 14 bp, Homo sapiens
gtgcatctcagccc

SEQ ID NO: 3945210 - DNA, 16 bp, Homo sapiens
gtgcatgctctctgca

SEQ ID NO: 3945211 - DNA, 18 bp, Homo sapiens
gtgcatggcttggggagc

SEQ ID NO: 3945212 - DNA, 20 bp, Homo sapiens
gtgcatggcttggggagcag

SEQ ID NO: 3945213 - DNA, 21 bp, Homo sapiens
gtgcatggcttggggagcaga

SEQ ID NO: 3945214 - DNA, 22 bp, Homo sapiens
gtgcatggcttggggagcagag

SEQ ID NO: 3945215 - DNA, 22 bp, Homo sapiens
gtgcatgtatgtgtgtgtgtat

SEQ ID NO: 3945216 - DNA, 19 bp, Homo sapiens
gtgcatgtgagcacatgcg

SEQ ID NO: 3945217 - DNA, 14 bp, Homo sapiens
gtgcatgtgtgtat

SEQ ID NO: 3945218 - DNA, 18 bp, Homo sapiens
gtgcatgtgtgtgtctgt

SEQ ID NO: 3945219 - DNA, 22 bp, Homo sapiens
gtgcatttgagagaagccacgc

SEQ ID NO: 3945220 - DNA, 24 bp, Homo sapiens
gtgcatttgagagaagccacgctg

SEQ ID NO: 3945221 - DNA, 22 bp, Homo sapiens
gtgccaagtccaggtcctggtg

SEQ ID NO: 3945222 - DNA, 12 bp, Homo sapiens
gtgccacagaga

SEQ ID NO: 3945223 - DNA, 20 bp, Homo sapiens
gtgccacccgtaggcagcct

SEQ ID NO: 3945224 - DNA, 15 bp, Homo sapiens
gtgccactccctgag

SEQ ID NO: 3945225 - DNA, 16 bp, Homo sapiens
gtgccactccctgagc

SEQ ID NO: 3945226 - DNA, 22 bp, Homo sapiens
gtgccacttcttaaaggcctgg

SEQ ID NO: 3945227 - DNA, 19 bp, Homo sapiens
gtgccacttgacattcctt

SEQ ID NO: 3945228 - DNA, 17 bp, Homo sapiens
gtgccagagcctggggc

SEQ ID NO: 3945229 - DNA, 18 bp, Homo sapiens
gtgccagagcctggggct

SEQ ID NO: 3945230 - DNA, 23 bp, Homo sapiens
gtgccaggactccccaggccagg

SEQ ID NO: 3945231 - DNA, 14 bp, Homo sapiens
gtgccatcccacat

SEQ ID NO: 3945232 - DNA, 16 bp, Homo sapiens
gtgccatgtggagtgg

SEQ ID NO: 3945233 - DNA, 23 bp, Homo sapiens
gtgcccaagaatagatgctgact

SEQ ID NO: 3945234 - DNA, 19 bp, Homo sapiens
gtgcccaggggcccacagg

SEQ ID NO: 3945235 - DNA, 18 bp, Homo sapiens
gtgccctctggatcctgc

SEQ ID NO: 3945236 - DNA, 14 bp, Homo sapiens
gtgccctgccccca

SEQ ID NO: 3945237 - DNA, 15 bp, Homo sapiens
gtgccgttactctcc

SEQ ID NO: 3945238 - DNA, 22 bp, Homo sapiens
gtgccgttactctccaacctgg

SEQ ID NO: 3945239 - DNA, 16 bp, Homo sapiens
gtgcctaatggagaag

SEQ ID NO: 3945240 - DNA, 20 bp, Homo sapiens
gtgcctatttattcattcag

SEQ ID NO: 3945241 - DNA, 20 bp, Homo sapiens
gtgcctcagagcaggctcag

SEQ ID NO: 3945242 - DNA, 13 bp, Homo sapiens
gtgcctcctggga

SEQ ID NO: 3945243 - DNA, 22 bp, Homo sapiens
gtgcctcctgggaccatggaca

SEQ ID NO: 3945244 - DNA, 21 bp, Homo sapiens
gtgcctcgctccccactctgc

SEQ ID NO: 3945245 - DNA, 13 bp, Homo sapiens
gtgcctgagctgg

SEQ ID NO: 3945246 - DNA, 14 bp, Homo sapiens
gtgcctgagctggg

SEQ ID NO: 3945247 - DNA, 17 bp, Homo sapiens
gtgcctgagctggggcc

SEQ ID NO: 3945248 - DNA, 18 bp, Homo sapiens
gtgcctgccctggaggga

SEQ ID NO: 3945249 - DNA, 17 bp, Homo sapiens
gtgcctgctagagcaac

SEQ ID NO: 3945250 - DNA, 23 bp, Homo sapiens
gtgcctgctagagcaacccctgt

SEQ ID NO: 3945251 - DNA, 14 bp, Homo sapiens
gtgcctggcaaggc

SEQ ID NO: 3945252 - DNA, 17 bp, Homo sapiens
gtgcctgggtggggctg

SEQ ID NO: 3945253 - DNA, 18 bp, Homo sapiens
gtgcctgggtggggctgc

SEQ ID NO: 3945254 - DNA, 21 bp, Homo sapiens
gtgcctgggtggggctgctcc

SEQ ID NO: 3945255 - DNA, 22 bp, Homo sapiens
gtgcctgggtggggctgctcct

SEQ ID NO: 3945256 - DNA, 20 bp, Homo sapiens
gtggcacctcctgagaaggc

SEQ ID NO: 3945257 - DNA, 19 bp, Homo sapiens
gtggcagaaaagaggagac

SEQ ID NO: 3945258 - DNA, 20 bp, Homo sapiens
gtggcagaaaagaggagacc

SEQ ID NO: 3945259 - DNA, 24 bp, Homo sapiens
gtggcagaaaagaggagaccctgg

SEQ ID NO: 3945260 - DNA, 13 bp, Homo sapiens
gtggcagaccggg

SEQ ID NO: 3945261 - DNA, 19 bp, Homo sapiens
gtggcagaccgggggccag

SEQ ID NO: 3945262 - DNA, 20 bp, Homo sapiens
gtggcagaccgggggccaga

SEQ ID NO: 3945263 - DNA, 16 bp, Homo sapiens
gtggcagccatgcctc

SEQ ID NO: 3945264 - DNA, 14 bp, Homo sapiens
gtggcagctgtccc

SEQ ID NO: 3945265 - DNA, 15 bp, Homo sapiens
gtggcaggaccagga

SEQ ID NO: 3945266 - DNA, 17 bp, Homo sapiens
gtggcaggaccaggact

SEQ ID NO: 3945267 - DNA, 19 bp, Homo sapiens
gtggcaggcacacagcagc

SEQ ID NO: 3945268 - DNA, 18 bp, Homo sapiens
gtggcagttacagggccc

SEQ ID NO: 3945269 - DNA, 11 bp, Homo sapiens
gtggccagagc

SEQ ID NO: 3945270 - DNA, 18 bp, Homo sapiens
gtggccagagctggaagg

SEQ ID NO: 3945271 - DNA, 22 bp, Homo sapiens
gtggccagagctggaaggcagg

SEQ ID NO: 3945272 - DNA, 23 bp, Homo sapiens
gtggccagagctgggaggcatgg

SEQ ID NO: 3945273 - DNA, 13 bp, Homo sapiens
gtggccagggtga

SEQ ID NO: 3945274 - DNA, 14 bp, Homo sapiens
gtggccatccctgg

SEQ ID NO: 3945275 - DNA, 17 bp, Homo sapiens
gtggccatccctgggcc

SEQ ID NO: 3945276 - DNA, 16 bp, Homo sapiens
gtggccccctgtgcca

SEQ ID NO: 3945277 - DNA, 19 bp, Homo sapiens
gtggccccctgtgccagct

SEQ ID NO: 3945278 - DNA, 16 bp, Homo sapiens
gtggcccgacagcctg

SEQ ID NO: 3945279 - DNA, 17 bp, Homo sapiens
gtggcccgacagcctgg

SEQ ID NO: 3945280 - DNA, 18 bp, Homo sapiens
gtggcccgacagcctggc

SEQ ID NO: 3945281 - DNA, 17 bp, Homo sapiens
gtggccctgccctctcc

SEQ ID NO: 3945282 - DNA, 22 bp, Homo sapiens
gtggccgacggcggcggccctc

SEQ ID NO: 3945283 - DNA, 18 bp, Homo sapiens
gtggcctcagccctcaga

SEQ ID NO: 3945284 - DNA, 23 bp, Homo sapiens
gtggcctgtgtccagcagctgcg

SEQ ID NO: 3945285 - DNA, 17 bp, Homo sapiens
gtggcgagaggagagga

SEQ ID NO: 3945286 - DNA, 13 bp, Homo sapiens
gtggcggtgcctg

SEQ ID NO: 3945287 - DNA, 22 bp, Homo sapiens
gtggctcatggcgtaatgggcc

SEQ ID NO: 3945288 - DNA, 20 bp, Homo sapiens
gtggctcctcccggtgccca

SEQ ID NO: 3945289 - DNA, 20 bp, Homo sapiens
gtggctcttctaacctcagc

SEQ ID NO: 3945290 - DNA, 15 bp, Homo sapiens
gtggctgacccagtc

SEQ ID NO: 3945291 - DNA, 16 bp, Homo sapiens
gtggctgagcttggcc

SEQ ID NO: 3945292 - DNA, 15 bp, Homo sapiens
gtggcttacaaattc

SEQ ID NO: 3945293 - DNA, 18 bp, Homo sapiens
gtggcttcccgctcagcc

SEQ ID NO: 3945294 - DNA, 20 bp, Homo sapiens
gtggcttcccgctcagccct

SEQ ID NO: 3945295 - DNA, 21 bp, Homo sapiens
gtggcttcccgctcagccctc

SEQ ID NO: 3945296 - DNA, 20 bp, Homo sapiens
gtggcttgtgattctgggat

SEQ ID NO: 3945297 - DNA, 20 bp, Homo sapiens
gtggcttttttcctcctgtg

SEQ ID NO: 3945298 - DNA, 14 bp, Homo sapiens
gtgggaaccctccc

SEQ ID NO: 3945299 - DNA, 17 bp, Homo sapiens
gtgggaaccctccccaa

SEQ ID NO: 3945300 - DNA, 17 bp, Homo sapiens
gtgggaacgactgggca

SEQ ID NO: 3945301 - DNA, 14 bp, Homo sapiens
gtgggaagaaagaa

SEQ ID NO: 3945302 - DNA, 14 bp, Homo sapiens
gtgggaagagaagg

SEQ ID NO: 3945303 - DNA, 13 bp, Homo sapiens
gtgggaagggaga

SEQ ID NO: 3945304 - DNA, 17 bp, Homo sapiens
gtgggacagaggagcaa

SEQ ID NO: 3945305 - DNA, 18 bp, Homo sapiens
gtgggacagccccagggc

SEQ ID NO: 3945306 - DNA, 21 bp, Homo sapiens
gtgggagagacactcccaggg

SEQ ID NO: 3945307 - DNA, 13 bp, Homo sapiens
gtgggagggagca

SEQ ID NO: 3945308 - DNA, 15 bp, Homo sapiens
gtgggagggagcaga

SEQ ID NO: 3945309 - DNA, 14 bp, Homo sapiens
gtgggcagaggctg

SEQ ID NO: 3945310 - DNA, 15 bp, Homo sapiens
gtgggcagcaccctc

SEQ ID NO: 3945311 - DNA, 19 bp, Homo sapiens
gtgggccaggagctcagcc

SEQ ID NO: 3945312 - DNA, 23 bp, Homo sapiens
gtgggcccataatagttagccct

SEQ ID NO: 3945313 - DNA, 23 bp, Homo sapiens
gtgggcccggagtaatcaggcag

SEQ ID NO: 3945314 - DNA, 16 bp, Homo sapiens
gtgggcctggcctgag

SEQ ID NO: 3945315 - DNA, 22 bp, Homo sapiens
gtgggcctggcctgagctgggg

SEQ ID NO: 3945316 - DNA, 15 bp, Homo sapiens
gtgggctgcatctgg

SEQ ID NO: 3945317 - DNA, 14 bp, Homo sapiens
gtgggcttggcctt

SEQ ID NO: 3945318 - DNA, 21 bp, Homo sapiens
gtgggctttctccggggtctg

SEQ ID NO: 3945319 - DNA, 13 bp, Homo sapiens
gtggggaggcagc

SEQ ID NO: 3945320 - DNA, 15 bp, Homo sapiens
gtggggaggcagctc

SEQ ID NO: 3945321 - DNA, 22 bp, Homo sapiens
gtggggaggcagctccaacagc

SEQ ID NO: 3945322 - DNA, 12 bp, Homo sapiens
gtggggctgctc

SEQ ID NO: 3945323 - DNA, 18 bp, Homo sapiens
gtggggctgctcctccag

SEQ ID NO: 3945324 - DNA, 21 bp, Homo sapiens
gtgggggtggccatccctggg

SEQ ID NO: 3945325 - DNA, 18 bp, Homo sapiens
gtggggtacatttctctg

SEQ ID NO: 3945326 - DNA, 17 bp, Homo sapiens
gtggggtctccctctcc

SEQ ID NO: 3945327 - DNA, 22 bp, Homo sapiens
gtggggtctccctctcctgcct

SEQ ID NO: 3945328 - DNA, 16 bp, Homo sapiens
gtgggtccaggaaggc

SEQ ID NO: 3945329 - DNA, 19 bp, Homo sapiens
gtgggtccaggaaggcagc

SEQ ID NO: 3945330 - DNA, 17 bp, Homo sapiens
gtgggtgatcagaaggc

SEQ ID NO: 3945331 - DNA, 17 bp, Homo sapiens
gtgggtggatcacctga

SEQ ID NO: 3945332 - DNA, 12 bp, Homo sapiens
gtgggtggtgga

SEQ ID NO: 3945333 - DNA, 16 bp, Homo sapiens
gtgggtggtggatctg

SEQ ID NO: 3945334 - DNA, 17 bp, Homo sapiens
gtgggttatcagttaac

SEQ ID NO: 3945335 - DNA, 22 bp, Homo sapiens
gtgggttttattgtccttcaga

SEQ ID NO: 3945336 - DNA, 16 bp, Homo sapiens
gtgggttttcttccca

SEQ ID NO: 3945337 - DNA, 16 bp, Homo sapiens
gtggtaagctctggct

SEQ ID NO: 3945338 - DNA, 22 bp, Homo sapiens
gtggtcaaaccgcactcaccca

SEQ ID NO: 3945339 - DNA, 15 bp, Homo sapiens
gtggtcctgagacct

SEQ ID NO: 3945340 - DNA, 14 bp, Homo sapiens
gtggtggaggagga

SEQ ID NO: 3945341 - DNA, 22 bp, Homo sapiens
gtggtgggttctttggaaggag

SEQ ID NO: 3945342 - DNA, 23 bp, Homo sapiens
gttaactttaagactgagcacct

SEQ ID NO: 3945343 - DNA, 20 bp, Homo sapiens
gttaagcaaaggaaaccaaa

SEQ ID NO: 3945344 - DNA, 12 bp, Homo sapiens
gttaaggacttc

SEQ ID NO: 3945345 - DNA, 13 bp, Homo sapiens
gttaagggaagga

SEQ ID NO: 3945346 - DNA, 14 bp, Homo sapiens
gttaagggaaggaa

SEQ ID NO: 3945347 - DNA, 14 bp, Homo sapiens
gttaatagacagta

SEQ ID NO: 3945348 - DNA, 13 bp, Homo sapiens
gttaatgctttct

SEQ ID NO: 3945349 - DNA, 17 bp, Homo sapiens
gttaatttgttatgtat

SEQ ID NO: 3945350 - DNA, 16 bp, Homo sapiens
gttacacaattaattg

SEQ ID NO: 3945351 - DNA, 19 bp, Homo sapiens
gttacagcgagaggcagag

SEQ ID NO: 3945352 - DNA, 14 bp, Homo sapiens
gttacagggcccag

SEQ ID NO: 3945353 - DNA, 13 bp, Homo sapiens
gttacattaatgt

SEQ ID NO: 3945354 - DNA, 12 bp, Homo sapiens
gttactcagccc

SEQ ID NO: 3945355 - DNA, 14 bp, Homo sapiens
gttactcagccctg

SEQ ID NO: 3945356 - DNA, 15 bp, Homo sapiens
gttactcagccctgg

SEQ ID NO: 3945357 - DNA, 16 bp, Homo sapiens
gttactcagccctggg

SEQ ID NO: 3945358 - DNA, 17 bp, Homo sapiens
gttactgattctcctgt

SEQ ID NO: 3945359 - DNA, 17 bp, Homo sapiens
gttacttgtctgaggcc

SEQ ID NO: 3945360 - DNA, 13 bp, Homo sapiens
gttactttttagt

SEQ ID NO: 3945361 - DNA, 20 bp, Homo sapiens
gttagagaatatatttttga

SEQ ID NO: 3945362 - DNA, 22 bp, Homo sapiens
gttagagaggtagcgagctgct

SEQ ID NO: 3945363 - DNA, 13 bp, Homo sapiens
gttagccctcagt

SEQ ID NO: 3945364 - DNA, 15 bp, Homo sapiens
gttagccctcagtca

SEQ ID NO: 3945365 - DNA, 20 bp, Homo sapiens
gttagctggacatgctttgg

SEQ ID NO: 3945366 - DNA, 14 bp, Homo sapiens
gttaggaaataaaa

SEQ ID NO: 3945367 - DNA, 17 bp, Homo sapiens
gttaggaaataaaacct

SEQ ID NO: 3945368 - DNA, 23 bp, Homo sapiens
gttaggaaataaaacctttcaaa

SEQ ID NO: 3945369 - DNA, 15 bp, Homo sapiens
gttaggaggctgcat

SEQ ID NO: 3945370 - DNA, 15 bp, Homo sapiens
gttagtgtgtgtgca

SEQ ID NO: 3945371 - DNA, 19 bp, Homo sapiens
gttagtgtgtgtgcatgtg

SEQ ID NO: 3945372 - DNA, 21 bp, Homo sapiens
gttagtgtgtgtgcatgtgtg

SEQ ID NO: 3945373 - DNA, 23 bp, Homo sapiens
gttagttattttaggagacagtc

SEQ ID NO: 3945374 - DNA, 23 bp, Homo sapiens
gttatagaatacttttttctagt

SEQ ID NO: 3945375 - DNA, 16 bp, Homo sapiens
gttatagtatatctgg

SEQ ID NO: 3945376 - DNA, 19 bp, Homo sapiens
gttatagtatatctggaca

SEQ ID NO: 3945377 - DNA, 13 bp, Homo sapiens
gttatatattgta

SEQ ID NO: 3945378 - DNA, 16 bp, Homo sapiens
gttatcacttatatat

SEQ ID NO: 3945379 - DNA, 16 bp, Homo sapiens
gttatcagttaacatt

SEQ ID NO: 3945380 - DNA, 15 bp, Homo sapiens
gttatctgcctggcc

SEQ ID NO: 3945381 - DNA, 21 bp, Homo sapiens
gttatctgcctggcctggctc

SEQ ID NO: 3945382 - DNA, 21 bp, Homo sapiens
gttattaacgggcatgtatta

SEQ ID NO: 3945383 - DNA, 17 bp, Homo sapiens
gttattgtacagctgtt

SEQ ID NO: 3945384 - DNA, 12 bp, Homo sapiens
gttattgtggaa

SEQ ID NO: 3945385 - DNA, 15 bp, Homo sapiens
gttatttacttgaaa

SEQ ID NO: 3945386 - DNA, 19 bp, Homo sapiens
gttatttatagtcatttat

SEQ ID NO: 3945387 - DNA, 13 bp, Homo sapiens
gttatttgtacag

SEQ ID NO: 3945388 - DNA, 14 bp, Homo sapiens
gttatttgtacagt

SEQ ID NO: 3945389 - DNA, 18 bp, Homo sapiens
gttattttaggagacagt

SEQ ID NO: 3945390 - DNA, 15 bp, Homo sapiens
gttattttcagtatt

SEQ ID NO: 3945391 - DNA, 23 bp, Homo sapiens
gttattttctttgaaattgttta

SEQ ID NO: 3945392 - DNA, 23 bp, Homo sapiens
gttatttttatatcagcctgagt

SEQ ID NO: 3945393 - DNA, 18 bp, Homo sapiens
gttatttttgtccctgct

SEQ ID NO: 3945394 - DNA, 22 bp, Homo sapiens
gttcaaatgcattttgggggtt

SEQ ID NO: 3945395 - DNA, 13 bp, Homo sapiens
gttcaagccatgg

SEQ ID NO: 3945396 - DNA, 20 bp, Homo sapiens
gttcaagcctgtgggagtag

SEQ ID NO: 3945397 - DNA, 18 bp, Homo sapiens
gttcaaggaccacatgtg

SEQ ID NO: 3945398 - DNA, 18 bp, Homo sapiens
gttcaatgcaaagtaaaa

SEQ ID NO: 3945399 - DNA, 16 bp, Homo sapiens
gttcacccacagggct

SEQ ID NO: 3945400 - DNA, 18 bp, Homo sapiens
gttcaccttatgtattat

SEQ ID NO: 3945401 - DNA, 21 bp, Homo sapiens
gttcaccttatgtattatttt

SEQ ID NO: 3945402 - DNA, 15 bp, Homo sapiens
gttcactagagctgg

SEQ ID NO: 3945403 - DNA, 16 bp, Homo sapiens
gttcactagagctggg

SEQ ID NO: 3945404 - DNA, 19 bp, Homo sapiens
gttcagcccctcctctgcc

SEQ ID NO: 3945405 - DNA, 21 bp, Homo sapiens
gttcagcccctcctctgccac

SEQ ID NO: 3945406 - DNA, 18 bp, Homo sapiens
gttcagggaagcaggcag

SEQ ID NO: 3945407 - DNA, 16 bp, Homo sapiens
gttcatcccagcccca

SEQ ID NO: 3945408 - DNA, 12 bp, Homo sapiens
gttcatgagaat

SEQ ID NO: 3945409 - DNA, 14 bp, Homo sapiens
gttcatgagaatct

SEQ ID NO: 3945410 - DNA, 17 bp, Homo sapiens
gttcatgagtggatgga

SEQ ID NO: 3945411 - DNA, 19 bp, Homo sapiens
gttcatgagtggatggatg

SEQ ID NO: 3945412 - DNA, 18 bp, Homo sapiens
gttcatgtttgtaaatta

SEQ ID NO: 3945413 - DNA, 22 bp, Homo sapiens
gttcattcttaccgagaaaagg

SEQ ID NO: 3945414 - DNA, 12 bp, Homo sapiens
gttcattttagt

SEQ ID NO: 3945415 - DNA, 17 bp, Homo sapiens
gttcattttagtgactg

SEQ ID NO: 3945416 - DNA, 18 bp, Homo sapiens
gttcattttagtgactgt

SEQ ID NO: 3945417 - DNA, 15 bp, Homo sapiens
gttccacttctctag

SEQ ID NO: 3945418 - DNA, 12 bp, Homo sapiens
gttccagctggt

SEQ ID NO: 3945419 - DNA, 23 bp, Homo sapiens
gttccatgaagaccacatccaca

SEQ ID NO: 3945420 - DNA, 14 bp, Homo sapiens
gttccatgcctgag

SEQ ID NO: 3945421 - DNA, 18 bp, Homo sapiens
gttcccaataaaagtgac

SEQ ID NO: 3945422 - DNA, 19 bp, Homo sapiens
gttccccatctgggtcctt

SEQ ID NO: 3945423 - DNA, 15 bp, Homo sapiens
gttcccctgttcact

SEQ ID NO: 3945424 - DNA, 17 bp, Homo sapiens
gttcccctgttcactct

SEQ ID NO: 3945425 - DNA, 13 bp, Homo sapiens
gttccccttggct

SEQ ID NO: 3945426 - DNA, 22 bp, Homo sapiens
gttccctctgagaattccaagg

SEQ ID NO: 3945427 - DNA, 17 bp, Homo sapiens
gttccctgaaaacccag

SEQ ID NO: 3945428 - DNA, 18 bp, Homo sapiens
gttccctgaaaacccaga

SEQ ID NO: 3945429 - DNA, 23 bp, Homo sapiens
gttgtcaatattaaatacagaca

SEQ ID NO: 3945430 - DNA, 18 bp, Homo sapiens
gttgtctattctgagcct

SEQ ID NO: 3945431 - DNA, 22 bp, Homo sapiens
gttgtctgaagtcactgcacag

SEQ ID NO: 3945432 - DNA, 13 bp, Homo sapiens
gttgtgaggcctg

SEQ ID NO: 3945433 - DNA, 17 bp, Homo sapiens
gttgtgcaaattaacag

SEQ ID NO: 3945434 - DNA, 13 bp, Homo sapiens
gttgttaatgttg

SEQ ID NO: 3945435 - DNA, 14 bp, Homo sapiens
gttgttaatgttgg

SEQ ID NO: 3945436 - DNA, 13 bp, Homo sapiens
gttgttatgctat

SEQ ID NO: 3945437 - DNA, 21 bp, Homo sapiens
gttgttctcctccattgctgt

SEQ ID NO: 3945438 - DNA, 16 bp, Homo sapiens
gttgttcttgatgaca

SEQ ID NO: 3945439 - DNA, 22 bp, Homo sapiens
gttgttgccaactaagccctcg

SEQ ID NO: 3945440 - DNA, 12 bp, Homo sapiens
gttgttgttctc

SEQ ID NO: 3945441 - DNA, 18 bp, Homo sapiens
gttgttttggtgcctgcc

SEQ ID NO: 3945442 - DNA, 14 bp, Homo sapiens
gtttaaaaaataca

SEQ ID NO: 3945443 - DNA, 15 bp, Homo sapiens
gtttaaaaaatacac

SEQ ID NO: 3945444 - DNA, 14 bp, Homo sapiens
gtttaaaaacagga

SEQ ID NO: 3945445 - DNA, 20 bp, Homo sapiens
gtttaaaaacaggaaaaaaa

SEQ ID NO: 3945446 - DNA, 15 bp, Homo sapiens
gtttaaataaagtat

SEQ ID NO: 3945447 - DNA, 17 bp, Homo sapiens
gtttaaataaagtatca

SEQ ID NO: 3945448 - DNA, 19 bp, Homo sapiens
gtttaaataaagtatcatg

SEQ ID NO: 3945449 - DNA, 23 bp, Homo sapiens
gtttaaataaagtatcatgcatt

SEQ ID NO: 3945450 - DNA, 15 bp, Homo sapiens
gtttaatatttaaac

SEQ ID NO: 3945451 - DNA, 17 bp, Homo sapiens
gtttaatatttaaacag

SEQ ID NO: 3945452 - DNA, 20 bp, Homo sapiens
gtttacaaaaggcagccctt

SEQ ID NO: 3945453 - DNA, 16 bp, Homo sapiens
gtttacaagtgtatat

SEQ ID NO: 3945454 - DNA, 15 bp, Homo sapiens
gtttacagtaaataa

SEQ ID NO: 3945455 - DNA, 15 bp, Homo sapiens
gtttacatgaacaca

SEQ ID NO: 3945456 - DNA, 23 bp, Homo sapiens
gtttagatcccatgtcacctcag

SEQ ID NO: 3945457 - DNA, 12 bp, Homo sapiens
gtttagcctgga

SEQ ID NO: 3945458 - DNA, 19 bp, Homo sapiens
gtttaggggaagtatgtgt

SEQ ID NO: 3945459 - DNA, 19 bp, Homo sapiens
gtttagtttctagaggcct

SEQ ID NO: 3945460 - DNA, 23 bp, Homo sapiens
gtttattaacaaattatgttaca

SEQ ID NO: 3945461 - DNA, 22 bp, Homo sapiens
gtttatttaacttttagtaaag

SEQ ID NO: 3945462 - DNA, 12 bp, Homo sapiens
gtttcaaaagtg

SEQ ID NO: 3945463 - DNA, 12 bp, Homo sapiens
gtttcaccattt

SEQ ID NO: 3945464 - DNA, 23 bp, Homo sapiens
gtttcactgtgttggccaggctg

SEQ ID NO: 3945465 - DNA, 17 bp, Homo sapiens
gtttcagatatatatca

SEQ ID NO: 3945466 - DNA, 16 bp, Homo sapiens
gtttcattctcctgcc

SEQ ID NO: 3945467 - DNA, 13 bp, Homo sapiens
gtttccagaaaat

SEQ ID NO: 3945468 - DNA, 14 bp, Homo sapiens
gtttccagaaaata

SEQ ID NO: 3945469 - DNA, 17 bp, Homo sapiens
gtttccagaaaatataa

SEQ ID NO: 3945470 - DNA, 20 bp, Homo sapiens
gtttccagaaaatataaatg

SEQ ID NO: 3945471 - DNA, 22 bp, Homo sapiens
gtttccagaaaatataaatgca

SEQ ID NO: 3945472 - DNA, 23 bp, Homo sapiens
gtttccagaaaatataaatgcat

SEQ ID NO: 3945473 - DNA, 16 bp, Homo sapiens
gtttcccaaattccct

SEQ ID NO: 3945474 - DNA, 20 bp, Homo sapiens
gtttcccaaattccctggac

SEQ ID NO: 3945475 - DNA, 17 bp, Homo sapiens
gtttcctcatctgcaga

SEQ ID NO: 3945476 - DNA, 18 bp, Homo sapiens
gtttctgaatgacatcaa

SEQ ID NO: 3945477 - DNA, 20 bp, Homo sapiens
gtttctgacccaagaggtgg

SEQ ID NO: 3945478 - DNA, 21 bp, Homo sapiens
gtttctgacccaagaggtggg

SEQ ID NO: 3945479 - DNA, 14 bp, Homo sapiens
gtttctgagaaaag

SEQ ID NO: 3945480 - DNA, 14 bp, Homo sapiens
gtttctgcgtgctt

SEQ ID NO: 3945481 - DNA, 22 bp, Homo sapiens
gtttgagacaagccctggcaac

SEQ ID NO: 3945482 - DNA, 13 bp, Homo sapiens
gtttgatttagta

SEQ ID NO: 3945483 - DNA, 21 bp, Homo sapiens
gtttgattttagctgcagaac

SEQ ID NO: 3945484 - DNA, 19 bp, Homo sapiens
gtttgcagaaaagcacctg

SEQ ID NO: 3945485 - DNA, 21 bp, Homo sapiens
gtttgcagaaaagcacctgcc

SEQ ID NO: 3945486 - DNA, 22 bp, Homo sapiens
gtttgcagaaaagcacctgccg

SEQ ID NO: 3945487 - DNA, 19 bp, Homo sapiens
gtttgctctagtcttgctt

SEQ ID NO: 3945488 - DNA, 16 bp, Homo sapiens
gtttggcttcctcctg

SEQ ID NO: 3945489 - DNA, 21 bp, Homo sapiens
gtttgggcagaagggagaagg

SEQ ID NO: 3945490 - DNA, 12 bp, Homo sapiens
gtttggggagaa

SEQ ID NO: 3945491 - DNA, 21 bp, Homo sapiens
gtttggggcaggagtagctga

SEQ ID NO: 3945492 - DNA, 15 bp, Homo sapiens
gtttgtataacttct

SEQ ID NO: 3945493 - DNA, 16 bp, Homo sapiens
gtttgtataacttctt

SEQ ID NO: 3945494 - DNA, 14 bp, Homo sapiens
gtttgtattttaaa

SEQ ID NO: 3945495 - DNA, 17 bp, Homo sapiens
gtttgtcccccggggca

SEQ ID NO: 3945496 - DNA, 22 bp, Homo sapiens
gtttgtgccttaaaaggagaga

SEQ ID NO: 3945497 - DNA, 12 bp, Homo sapiens
gtttgttctccg

SEQ ID NO: 3945498 - DNA, 23 bp, Homo sapiens
gtttgttctccgggtgtggcctc

SEQ ID NO: 3945499 - DNA, 16 bp, Homo sapiens
gtttgttgattttcta

SEQ ID NO: 3945500 - DNA, 22 bp, Homo sapiens
gttttaaatacgcactacatgt

SEQ ID NO: 3945501 - DNA, 19 bp, Homo sapiens
gttttaacagaaccagagg

SEQ ID NO: 3945502 - DNA, 17 bp, Homo sapiens
gttttaaggacattaaa

SEQ ID NO: 3945503 - DNA, 20 bp, Homo sapiens
gttttacaagaattgtccat

SEQ ID NO: 3945504 - DNA, 23 bp, Homo sapiens
gttttatactgtacttaataaat

SEQ ID NO: 3945505 - DNA, 14 bp, Homo sapiens
gttttcagactcag

SEQ ID NO: 3945506 - DNA, 18 bp, Homo sapiens
gttttcatcctggcctcc

SEQ ID NO: 3945507 - DNA, 16 bp, Homo sapiens
gttttcatgagctgag

SEQ ID NO: 3945508 - DNA, 16 bp, Homo sapiens
gttttcattatctcaa

SEQ ID NO: 3945509 - DNA, 14 bp, Homo sapiens
gttttctaactgta

SEQ ID NO: 3945510 - DNA, 16 bp, Homo sapiens
gttttctaactgtaaa

SEQ ID NO: 3945511 - DNA, 18 bp, Homo sapiens
gttttctaactgtaaatc

SEQ ID NO: 3945512 - DNA, 22 bp, Homo sapiens
gttttctaactgtaaatcactt

SEQ ID NO: 3945513 - DNA, 24 bp, Homo sapiens
gttttctaactgtaaatcacttgt

SEQ ID NO: 3945514 - DNA, 19 bp, Homo sapiens
gttttctcagaacagctga

SEQ ID NO: 3945515 - DNA, 13 bp, Homo sapiens
taaacagcagtgt

SEQ ID NO: 3945516 - DNA, 17 bp, Homo sapiens
taaacagcagtgttccc

SEQ ID NO: 3945517 - DNA, 18 bp, Homo sapiens
taaacagctaataatgaa

SEQ ID NO: 3945518 - DNA, 13 bp, Homo sapiens
taaacagtgcctg

SEQ ID NO: 3945519 - DNA, 15 bp, Homo sapiens
taaacataattcttg

SEQ ID NO: 3945520 - DNA, 17 bp, Homo sapiens
taaacattaaacactgt

SEQ ID NO: 3945521 - DNA, 20 bp, Homo sapiens
taaacattaaacactgtaat

SEQ ID NO: 3945522 - DNA, 22 bp, Homo sapiens
taaacattaatcaatcatctgt

SEQ ID NO: 3945523 - DNA, 20 bp, Homo sapiens
taaacattggtatatttcca

SEQ ID NO: 3945524 - DNA, 14 bp, Homo sapiens
taaaccaaaggaca

SEQ ID NO: 3945525 - DNA, 19 bp, Homo sapiens
taaaccaaaggacattatg

SEQ ID NO: 3945526 - DNA, 20 bp, Homo sapiens
taaaccaaaggacattatgt

SEQ ID NO: 3945527 - DNA, 20 bp, Homo sapiens
taaaccagcagaaaagtgct

SEQ ID NO: 3945528 - DNA, 17 bp, Homo sapiens
taaacccaaataaatgt

SEQ ID NO: 3945529 - DNA, 19 bp, Homo sapiens
taaacgactccgagaacaa

SEQ ID NO: 3945530 - DNA, 18 bp, Homo sapiens
taaactaccctccagagt

SEQ ID NO: 3945531 - DNA, 14 bp, Homo sapiens
taaactactgtaat

SEQ ID NO: 3945532 - DNA, 16 bp, Homo sapiens
taaactactgtaatta

SEQ ID NO: 3945533 - DNA, 23 bp, Homo sapiens
taaactactgtaattaagtgcaa

SEQ ID NO: 3945534 - DNA, 22 bp, Homo sapiens
taaactagtaatgggccaatta

SEQ ID NO: 3945535 - DNA, 15 bp, Homo sapiens
taaactagtttccag

SEQ ID NO: 3945536 - DNA, 17 bp, Homo sapiens
taaactatcagtttgtc

SEQ ID NO: 3945537 - DNA, 22 bp, Homo sapiens
taaactatcttggtgaattttt

SEQ ID NO: 3945538 - DNA, 15 bp, Homo sapiens
taaactcaaaactta

SEQ ID NO: 3945539 - DNA, 19 bp, Homo sapiens
taaactcaaaacttaacat

SEQ ID NO: 3945540 - DNA, 19 bp, Homo sapiens
taaactcaaaatatttgta

SEQ ID NO: 3945541 - DNA, 16 bp, Homo sapiens
taaactgcattagaaa

SEQ ID NO: 3945542 - DNA, 22 bp, Homo sapiens
taaactgtatcaaatctgtata

SEQ ID NO: 3945543 - DNA, 14 bp, Homo sapiens
taaacttcagcacc

SEQ ID NO: 3945544 - DNA, 16 bp, Homo sapiens
taaacttcagcaccat

SEQ ID NO: 3945545 - DNA, 20 bp, Homo sapiens
taaacttcatggtcatgggt

SEQ ID NO: 3945546 - DNA, 14 bp, Homo sapiens
taaacttgtcagaa

SEQ ID NO: 3945547 - DNA, 13 bp, Homo sapiens
taaacttgtgtat

SEQ ID NO: 3945548 - DNA, 12 bp, Homo sapiens
taaactttctct

SEQ ID NO: 3945549 - DNA, 17 bp, Homo sapiens
taaactttgtgcctttg

SEQ ID NO: 3945550 - DNA, 21 bp, Homo sapiens
taaagaaagtcgaattaatag

SEQ ID NO: 3945551 - DNA, 17 bp, Homo sapiens
taaagaagtaaatttgt

SEQ ID NO: 3945552 - DNA, 18 bp, Homo sapiens
taaagaagtaaatttgtc

SEQ ID NO: 3945553 - DNA, 21 bp, Homo sapiens
taaagaagtaaatttgtccaa

SEQ ID NO: 3945554 - DNA, 13 bp, Homo sapiens
taaagaataaatg

SEQ ID NO: 3945555 - DNA, 16 bp, Homo sapiens
taaagacagctgacag

SEQ ID NO: 3945556 - DNA, 13 bp, Homo sapiens
taaagatgatcta

SEQ ID NO: 3945557 - DNA, 17 bp, Homo sapiens
taaagcaacattttatt

SEQ ID NO: 3945558 - DNA, 18 bp, Homo sapiens
taaagctgcctgtagtta

SEQ ID NO: 3945559 - DNA, 22 bp, Homo sapiens
taaagctggacaagaagctgct

SEQ ID NO: 3945560 - DNA, 14 bp, Homo sapiens
taaaggaaggaaaa

SEQ ID NO: 3945561 - DNA, 15 bp, Homo sapiens
taaaggattgatcac

SEQ ID NO: 3945562 - DNA, 22 bp, Homo sapiens
taaaggattgatcactttgtta

SEQ ID NO: 3945563 - DNA, 19 bp, Homo sapiens
taaaggcctcatctccttt

SEQ ID NO: 3945564 - DNA, 20 bp, Homo sapiens
taaaggcctcatctccttta

SEQ ID NO: 3945565 - DNA, 21 bp, Homo sapiens
taaagggaaaggattcatgtg

SEQ ID NO: 3945566 - DNA, 18 bp, Homo sapiens
taaaggtagagatgtgtg

SEQ ID NO: 3945567 - DNA, 14 bp, Homo sapiens
taaagtacctgtag

SEQ ID NO: 3945568 - DNA, 22 bp, Homo sapiens
taaagtacctgtagtgagaaac

SEQ ID NO: 3945569 - DNA, 14 bp, Homo sapiens
taaagtatatattt

SEQ ID NO: 3945570 - DNA, 14 bp, Homo sapiens
taaagtatcatgca

SEQ ID NO: 3945571 - DNA, 17 bp, Homo sapiens
taaagtatcatgcattc

SEQ ID NO: 3945572 - DNA, 13 bp, Homo sapiens
taaagtatgtaaa

SEQ ID NO: 3945573 - DNA, 19 bp, Homo sapiens
taaagtcaacaaccatgcc

SEQ ID NO: 3945574 - DNA, 16 bp, Homo sapiens
taaagtgtaaatcctt

SEQ ID NO: 3945575 - DNA, 18 bp, Homo sapiens
taaagtgtaataatatga

SEQ ID NO: 3945576 - DNA, 15 bp, Homo sapiens
taaagtttaaaaaat

SEQ ID NO: 3945577 - DNA, 18 bp, Homo sapiens
taaagtttaaaaaataca

SEQ ID NO: 3945578 - DNA, 13 bp, Homo sapiens
taaagtttacagt

SEQ ID NO: 3945579 - DNA, 16 bp, Homo sapiens
taaagtttacagtaaa

SEQ ID NO: 3945580 - DNA, 23 bp, Homo sapiens
taaagtttacagtaaataaattg

SEQ ID NO: 3945581 - DNA, 16 bp, Homo sapiens
taaataaatcattaat

SEQ ID NO: 3945582 - DNA, 19 bp, Homo sapiens
taaataaatgccaacatac

SEQ ID NO: 3945583 - DNA, 13 bp, Homo sapiens
taaataaattcaa

SEQ ID NO: 3945584 - DNA, 14 bp, Homo sapiens
taaataaattcaaa

SEQ ID NO: 3945585 - DNA, 15 bp, Homo sapiens
taaataaattgtttg

SEQ ID NO: 3945586 - DNA, 12 bp, Homo sapiens
taaataatgaaa

SEQ ID NO: 3945587 - DNA, 16 bp, Homo sapiens
taaatacagacactaa

SEQ ID NO: 3945588 - DNA, 18 bp, Homo sapiens
taaatacagacactaagt

SEQ ID NO: 3945589 - DNA, 21 bp, Homo sapiens
taaatagtaggaccaatgttg

SEQ ID NO: 3945590 - DNA, 13 bp, Homo sapiens
taaatagttctat

SEQ ID NO: 3945591 - DNA, 14 bp, Homo sapiens
taaatatataaaaa

SEQ ID NO: 3945592 - DNA, 21 bp, Homo sapiens
taaatatatatttttcaacca

SEQ ID NO: 3945593 - DNA, 14 bp, Homo sapiens
taaatattctgcat

SEQ ID NO: 3945594 - DNA, 10 bp, Homo sapiens
taaatattta

SEQ ID NO: 3945595 - DNA, 16 bp, Homo sapiens
taaatatttatgctta

SEQ ID NO: 3945596 - DNA, 17 bp, Homo sapiens
taaatcacttgtaaata

SEQ ID NO: 3945597 - DNA, 22 bp, Homo sapiens
taaatcacttgtaaataaatag

SEQ ID NO: 3945598 - DNA, 23 bp, Homo sapiens
taaatcacttgtaaataaataga

SEQ ID NO: 3945599 - DNA, 14 bp, Homo sapiens
taaatccaaagtaa

SEQ ID NO: 3945600 - DNA, 22 bp, Homo sapiens
taaatccacagccaacaaacat

SEQ ID NO: 3945601 - DNA, 12 bp, Homo sapiens
taaatcctccag

SEQ ID NO: 3945602 - DNA, 16 bp, Homo sapiens
taactgtatgtgtctt

SEQ ID NO: 3945603 - DNA, 16 bp, Homo sapiens
taactgtgtgaagaaa

SEQ ID NO: 3945604 - DNA, 17 bp, Homo sapiens
taactgtgtgaagaaat

SEQ ID NO: 3945605 - DNA, 20 bp, Homo sapiens
taactgtgtgaagaaatgga

SEQ ID NO: 3945606 - DNA, 18 bp, Homo sapiens
taacttaaaaaaatgaca

SEQ ID NO: 3945607 - DNA, 16 bp, Homo sapiens
taacttaaaatatttt

SEQ ID NO: 3945608 - DNA, 23 bp, Homo sapiens
taacttatatcatcagcatacct

SEQ ID NO: 3945609 - DNA, 18 bp, Homo sapiens
taacttcttaaaagttgt

SEQ ID NO: 3945610 - DNA, 16 bp, Homo sapiens
taagaaaacatcactg

SEQ ID NO: 3945611 - DNA, 21 bp, Homo sapiens
taagaaacacagggttttgta

SEQ ID NO: 3945612 - DNA, 18 bp, Homo sapiens
taagaaagtataaagtca

SEQ ID NO: 3945613 - DNA, 15 bp, Homo sapiens
taagaaagtgcagaa

SEQ ID NO: 3945614 - DNA, 19 bp, Homo sapiens
taagaaagtgcagaatcaa

SEQ ID NO: 3945615 - DNA, 22 bp, Homo sapiens
taagaacaaagagaaaaaatac

SEQ ID NO: 3945616 - DNA, 14 bp, Homo sapiens
taagaagacatgac

SEQ ID NO: 3945617 - DNA, 15 bp, Homo sapiens
taagaagacatgaca

SEQ ID NO: 3945618 - DNA, 17 bp, Homo sapiens
taagaatctagcaagaa

SEQ ID NO: 3945619 - DNA, 21 bp, Homo sapiens
taagaatctagcaagaattga

SEQ ID NO: 3945620 - DNA, 22 bp, Homo sapiens
taagaatgcagattcctgggcc

SEQ ID NO: 3945621 - DNA, 21 bp, Homo sapiens
taagaccgtgtcccaaggagc

SEQ ID NO: 3945622 - DNA, 22 bp, Homo sapiens
taagaccgtgtcccaaggagct

SEQ ID NO: 3945623 - DNA, 21 bp, Homo sapiens
taagagatctggtcaaagcaa

SEQ ID NO: 3945624 - DNA, 22 bp, Homo sapiens
taagaggctatttaaaagtata

SEQ ID NO: 3945625 - DNA, 23 bp, Homo sapiens
taagagggattagggagagaaga

SEQ ID NO: 3945626 - DNA, 17 bp, Homo sapiens
taagatacactcctgct

SEQ ID NO: 3945627 - DNA, 17 bp, Homo sapiens
taagatgagatttgcca

SEQ ID NO: 3945628 - DNA, 20 bp, Homo sapiens
taagattaaattatatctga

SEQ ID NO: 3945629 - DNA, 18 bp, Homo sapiens
taagattagaatgaaaat

SEQ ID NO: 3945630 - DNA, 16 bp, Homo sapiens
taagatttctcctgac

SEQ ID NO: 3945631 - DNA, 16 bp, Homo sapiens
taagcaaaggaaacca

SEQ ID NO: 3945632 - DNA, 16 bp, Homo sapiens
taagcagtgcttgtaa

SEQ ID NO: 3945633 - DNA, 16 bp, Homo sapiens
taagcattctgagctg

SEQ ID NO: 3945634 - DNA, 22 bp, Homo sapiens
taagctcccagggcctgtctca

SEQ ID NO: 3945635 - DNA, 12 bp, Homo sapiens
taagctgcagct

SEQ ID NO: 3945636 - DNA, 14 bp, Homo sapiens
taagctgcagcttc

SEQ ID NO: 3945637 - DNA, 16 bp, Homo sapiens
taagctgcagcttcct

SEQ ID NO: 3945638 - DNA, 12 bp, Homo sapiens
taagctgtaaaa

SEQ ID NO: 3945639 - DNA, 16 bp, Homo sapiens
taagctttctcctttg

SEQ ID NO: 3945640 - DNA, 23 bp, Homo sapiens
taaggaccgtggccctgccctct

SEQ ID NO: 3945641 - DNA, 20 bp, Homo sapiens
taaggagaggagaaactgag

SEQ ID NO: 3945642 - DNA, 16 bp, Homo sapiens
taaggcatatacaaat

SEQ ID NO: 3945643 - DNA, 16 bp, Homo sapiens
taaggcctgccctccc

SEQ ID NO: 3945644 - DNA, 20 bp, Homo sapiens
taaggtcttcttgtgtcctg

SEQ ID NO: 3945645 - DNA, 16 bp, Homo sapiens
taaggtgggtccagga

SEQ ID NO: 3945646 - DNA, 19 bp, Homo sapiens
taagtaaaaccacagcagt

SEQ ID NO: 3945647 - DNA, 18 bp, Homo sapiens
taagtaattgcatttctg

SEQ ID NO: 3945648 - DNA, 20 bp, Homo sapiens
taagtatttaggtttttgtt

SEQ ID NO: 3945649 - DNA, 17 bp, Homo sapiens
taagtatttgaaactga

SEQ ID NO: 3945650 - DNA, 17 bp, Homo sapiens
taagtcctctcttctct

SEQ ID NO: 3945651 - DNA, 14 bp, Homo sapiens
taagtgaataataa

SEQ ID NO: 3945652 - DNA, 17 bp, Homo sapiens
taagtgcacacagaaat

SEQ ID NO: 3945653 - DNA, 22 bp, Homo sapiens
taagtgctgtttgagatgtgat

SEQ ID NO: 3945654 - DNA, 12 bp, Homo sapiens
taagtggaaaaa

SEQ ID NO: 3945655 - DNA, 13 bp, Homo sapiens
taagtggaaaaaa

SEQ ID NO: 3945656 - DNA, 17 bp, Homo sapiens
taagtggaaaaaagaga

SEQ ID NO: 3945657 - DNA, 19 bp, Homo sapiens
taagtgggaagtgaagccc

SEQ ID NO: 3945658 - DNA, 18 bp, Homo sapiens
taagttctaagttcatgt

SEQ ID NO: 3945659 - DNA, 17 bp, Homo sapiens
taagtttattttttcta

SEQ ID NO: 3945660 - DNA, 20 bp, Homo sapiens
taataaaaaatggaaagaat

SEQ ID NO: 3945661 - DNA, 21 bp, Homo sapiens
taataaaaaatggaaagaatc

SEQ ID NO: 3945662 - DNA, 19 bp, Homo sapiens
taataaaggctatttcctg

SEQ ID NO: 3945663 - DNA, 19 bp, Homo sapiens
taataaattttaacatttt

SEQ ID NO: 3945664 - DNA, 17 bp, Homo sapiens
taataagaaggaaaaat

SEQ ID NO: 3945665 - DNA, 22 bp, Homo sapiens
taatacaacatgtagctgagtt

SEQ ID NO: 3945666 - DNA, 13 bp, Homo sapiens
taatactaaaata

SEQ ID NO: 3945667 - DNA, 17 bp, Homo sapiens
taatactaaaatatgtc

SEQ ID NO: 3945668 - DNA, 15 bp, Homo sapiens
taatagaaaactgaa

SEQ ID NO: 3945669 - DNA, 19 bp, Homo sapiens
taatagaaaactgaaaatc

SEQ ID NO: 3945670 - DNA, 12 bp, Homo sapiens
taatagaagaac

SEQ ID NO: 3945671 - DNA, 21 bp, Homo sapiens
taatagaagaacatccaagga

SEQ ID NO: 3945672 - DNA, 19 bp, Homo sapiens
taatagcgggttactttca

SEQ ID NO: 3945673 - DNA, 18 bp, Homo sapiens
taatagcttttattgtat

SEQ ID NO: 3945674 - DNA, 12 bp, Homo sapiens
taatatattgct

SEQ ID NO: 3945675 - DNA, 14 bp, Homo sapiens
taatatattgctgc

SEQ ID NO: 3945676 - DNA, 22 bp, Homo sapiens
taatatatttttatatttagtt

SEQ ID NO: 3945677 - DNA, 15 bp, Homo sapiens
taatatcaatgaaga

SEQ ID NO: 3945678 - DNA, 23 bp, Homo sapiens
taatatgattttttaaaagaaat

SEQ ID NO: 3945679 - DNA, 18 bp, Homo sapiens
taatatggaaccttccct

SEQ ID NO: 3945680 - DNA, 16 bp, Homo sapiens
taatatggcaaaaatg

SEQ ID NO: 3945681 - DNA, 14 bp, Homo sapiens
taatatgtctgcca

SEQ ID NO: 3945682 - DNA, 14 bp, Homo sapiens
taatattaaaaata

SEQ ID NO: 3945683 - DNA, 15 bp, Homo sapiens
taatattattggggt

SEQ ID NO: 3945684 - DNA, 13 bp, Homo sapiens
taatatttaaaca

SEQ ID NO: 3945685 - DNA, 23 bp, Homo sapiens
taatatttttagctctgttcttt

SEQ ID NO: 3945686 - DNA, 21 bp, Homo sapiens
taatcaagaatattcaaatgt

SEQ ID NO: 3945687 - DNA, 11 bp, Homo sapiens
taatcagcctc

SEQ ID NO: 3945688 - DNA, 19 bp, Homo sapiens
tacaataattaatgtgtgt

SEQ ID NO: 3945689 - DNA, 12 bp, Homo sapiens
tacaataccaga

SEQ ID NO: 3945690 - DNA, 13 bp, Homo sapiens
tacaatatataaa

SEQ ID NO: 3945691 - DNA, 14 bp, Homo sapiens
tacaatatataaaa

SEQ ID NO: 3945692 - DNA, 17 bp, Homo sapiens
tacaatatataaaaata

SEQ ID NO: 3945693 - DNA, 13 bp, Homo sapiens
tacaatggccatg

SEQ ID NO: 3945694 - DNA, 19 bp, Homo sapiens
tacaatttgcactgttact

SEQ ID NO: 3945695 - DNA, 16 bp, Homo sapiens
tacacacacagatgtg

SEQ ID NO: 3945696 - DNA, 14 bp, Homo sapiens
tacacacatataca

SEQ ID NO: 3945697 - DNA, 15 bp, Homo sapiens
tacacagtaaaaact

SEQ ID NO: 3945698 - DNA, 23 bp, Homo sapiens
tacacataagaccgtgtcccaag

SEQ ID NO: 3945699 - DNA, 17 bp, Homo sapiens
tacacatacatacacat

SEQ ID NO: 3945700 - DNA, 15 bp, Homo sapiens
tacacatacatacat

SEQ ID NO: 3945701 - DNA, 14 bp, Homo sapiens
tacacccttggact

SEQ ID NO: 3945702 - DNA, 17 bp, Homo sapiens
tacaccgggcctggaga

SEQ ID NO: 3945703 - DNA, 19 bp, Homo sapiens
tacactaacatatttagaa

SEQ ID NO: 3945704 - DNA, 17 bp, Homo sapiens
tacactattgcattgtt

SEQ ID NO: 3945705 - DNA, 12 bp, Homo sapiens
tacactcctgct

SEQ ID NO: 3945706 - DNA, 15 bp, Homo sapiens
tacactcctgctgtg

SEQ ID NO: 3945707 - DNA, 20 bp, Homo sapiens
tacactgaagttaacagaga

SEQ ID NO: 3945708 - DNA, 11 bp, Homo sapiens
tacactgtgta

SEQ ID NO: 3945709 - DNA, 14 bp, Homo sapiens
tacacttggagccc

SEQ ID NO: 3945710 - DNA, 19 bp, Homo sapiens
tacacttgtataaatgtat

SEQ ID NO: 3945711 - DNA, 21 bp, Homo sapiens
tacagaaagatggatgtgctt

SEQ ID NO: 3945712 - DNA, 14 bp, Homo sapiens
tacagaacaaagaa

SEQ ID NO: 3945713 - DNA, 18 bp, Homo sapiens
tacagaataatgtgttaa

SEQ ID NO: 3945714 - DNA, 13 bp, Homo sapiens
tacagaatgaatc

SEQ ID NO: 3945715 - DNA, 11 bp, Homo sapiens
tacagaatttt

SEQ ID NO: 3945716 - DNA, 13 bp, Homo sapiens
tacagacactaag

SEQ ID NO: 3945717 - DNA, 18 bp, Homo sapiens
tacagacactaagttata

SEQ ID NO: 3945718 - DNA, 19 bp, Homo sapiens
tacagacactaagttatag

SEQ ID NO: 3945719 - DNA, 18 bp, Homo sapiens
tacagagaaattctgtgg

SEQ ID NO: 3945720 - DNA, 20 bp, Homo sapiens
tacagagaaattctgtggtg

SEQ ID NO: 3945721 - DNA, 16 bp, Homo sapiens
tacagagtggcccctc

SEQ ID NO: 3945722 - DNA, 13 bp, Homo sapiens
tacagattttaga

SEQ ID NO: 3945723 - DNA, 14 bp, Homo sapiens
tacagctcttggca

SEQ ID NO: 3945724 - DNA, 21 bp, Homo sapiens
tacagctcttggcattttcct

SEQ ID NO: 3945725 - DNA, 14 bp, Homo sapiens
tacagctgcctgca

SEQ ID NO: 3945726 - DNA, 14 bp, Homo sapiens
tacagctgtttaag

SEQ ID NO: 3945727 - DNA, 16 bp, Homo sapiens
tacagctgtttaagat

SEQ ID NO: 3945728 - DNA, 22 bp, Homo sapiens
tacagggtagcaggtaccactg

SEQ ID NO: 3945729 - DNA, 19 bp, Homo sapiens
tacaggtatcaggcacagg

SEQ ID NO: 3945730 - DNA, 16 bp, Homo sapiens
tacagtaaagtttaaa

SEQ ID NO: 3945731 - DNA, 17 bp, Homo sapiens
tacagtaaagtttaaaa

SEQ ID NO: 3945732 - DNA, 17 bp, Homo sapiens
tacagtaaataaattgt

SEQ ID NO: 3945733 - DNA, 16 bp, Homo sapiens
tacagtagcttaaata

SEQ ID NO: 3945734 - DNA, 19 bp, Homo sapiens
tacagtgttattttctttg

SEQ ID NO: 3945735 - DNA, 20 bp, Homo sapiens
tacagttgttttttgaaaac

SEQ ID NO: 3945736 - DNA, 13 bp, Homo sapiens
tacatacatacat

SEQ ID NO: 3945737 - DNA, 16 bp, Homo sapiens
tacatacatacatata

SEQ ID NO: 3945738 - DNA, 18 bp, Homo sapiens
tacatacatacatatata

SEQ ID NO: 3945739 - DNA, 14 bp, Homo sapiens
tacatacatatata

SEQ ID NO: 3945740 - DNA, 20 bp, Homo sapiens
tacatagatgtatcattaat

SEQ ID NO: 3945741 - DNA, 18 bp, Homo sapiens
tacatagtcacaaaaatg

SEQ ID NO: 3945742 - DNA, 20 bp, Homo sapiens
tacatagtcacaaaaatggt

SEQ ID NO: 3945743 - DNA, 20 bp, Homo sapiens
tacatatatatatacacata

SEQ ID NO: 3945744 - DNA, 22 bp, Homo sapiens
tacatatatatatacacataca

SEQ ID NO: 3945745 - DNA, 14 bp, Homo sapiens
tacatatcagaaaa

SEQ ID NO: 3945746 - DNA, 21 bp, Homo sapiens
tacatatcagaaaagtagaat

SEQ ID NO: 3945747 - DNA, 22 bp, Homo sapiens
tacatatgtagactatatacat

SEQ ID NO: 3945748 - DNA, 16 bp, Homo sapiens
tacatattataaataa

SEQ ID NO: 3945749 - DNA, 21 bp, Homo sapiens
tacatattataaataaatgcc

SEQ ID NO: 3945750 - DNA, 15 bp, Homo sapiens
tacatcatcctcctt

SEQ ID NO: 3945751 - DNA, 16 bp, Homo sapiens
tacatcatcctcctta

SEQ ID NO: 3945752 - DNA, 13 bp, Homo sapiens
tacatcttcagct

SEQ ID NO: 3945753 - DNA, 16 bp, Homo sapiens
tacatcttcagctccc

SEQ ID NO: 3945754 - DNA, 20 bp, Homo sapiens
tacatcttttcaacaagtaa

SEQ ID NO: 3945755 - DNA, 12 bp, Homo sapiens
tacatgaaacag

SEQ ID NO: 3945756 - DNA, 14 bp, Homo sapiens
tacatgaaacagaa

SEQ ID NO: 3945757 - DNA, 21 bp, Homo sapiens
tacatgaaacagaaacaaaaa

SEQ ID NO: 3945758 - DNA, 11 bp, Homo sapiens
tacatgaacac

SEQ ID NO: 3945759 - DNA, 13 bp, Homo sapiens
tacatgaacacag

SEQ ID NO: 3945760 - DNA, 22 bp, Homo sapiens
tacatgaccagaaaacaaatct

SEQ ID NO: 3945761 - DNA, 19 bp, Homo sapiens
tacatgcaatttattaaaa

SEQ ID NO: 3945762 - DNA, 12 bp, Homo sapiens
tacatgctgcta

SEQ ID NO: 3945763 - DNA, 17 bp, Homo sapiens
tacatgtactccagagg

SEQ ID NO: 3945764 - DNA, 12 bp, Homo sapiens
tacatgtgtgga

SEQ ID NO: 3945765 - DNA, 15 bp, Homo sapiens
tacatgtttaaattg

SEQ ID NO: 3945766 - DNA, 22 bp, Homo sapiens
tacatgtttaaattgtaaattt

SEQ ID NO: 3945767 - DNA, 15 bp, Homo sapiens
tacattaatgttaat

SEQ ID NO: 3945768 - DNA, 23 bp, Homo sapiens
tacattaattattattgctgttg

SEQ ID NO: 3945769 - DNA, 16 bp, Homo sapiens
tacattccctatcaaa

SEQ ID NO: 3945770 - DNA, 17 bp, Homo sapiens
tacattccctatcaaaa

SEQ ID NO: 3945771 - DNA, 19 bp, Homo sapiens
tacattcctcagctgccaa

SEQ ID NO: 3945772 - DNA, 23 bp, Homo sapiens
tacattcctcagctgccaagcac

SEQ ID NO: 3945773 - DNA, 13 bp, Homo sapiens
tacatttaataca

SEQ ID NO: 3945774 - DNA, 16 bp, Homo sapiens
tacatttccaaatgaa

SEQ ID NO: 3945775 - DNA, 20 bp, Homo sapiens
tactcagcagccctcctcac

SEQ ID NO: 3945776 - DNA, 12 bp, Homo sapiens
tactcagccctg

SEQ ID NO: 3945777 - DNA, 16 bp, Homo sapiens
tactcagccctgggcc

SEQ ID NO: 3945778 - DNA, 23 bp, Homo sapiens
tactcagccctgggccccaccac

SEQ ID NO: 3945779 - DNA, 15 bp, Homo sapiens
tactcaggaggctga

SEQ ID NO: 3945780 - DNA, 22 bp, Homo sapiens
tactcaggaggctgaggcagaa

SEQ ID NO: 3945781 - DNA, 19 bp, Homo sapiens
tactccaagcttcaagtga

SEQ ID NO: 3945782 - DNA, 18 bp, Homo sapiens
tactcccttcctggcctc

SEQ ID NO: 3945783 - DNA, 12 bp, Homo sapiens
tactcctcccag

SEQ ID NO: 3945784 - DNA, 19 bp, Homo sapiens
tactcctgtgctctggagg

SEQ ID NO: 3945785 - DNA, 16 bp, Homo sapiens
tactctacgccaaagt

SEQ ID NO: 3945786 - DNA, 21 bp, Homo sapiens
tactctagaacatgcacattt

SEQ ID NO: 3945787 - DNA, 18 bp, Homo sapiens
tactctagcctgggccag

SEQ ID NO: 3945788 - DNA, 22 bp, Homo sapiens
tactctagcctgggccagagaa

SEQ ID NO: 3945789 - DNA, 19 bp, Homo sapiens
tactctcctcggccccctc

SEQ ID NO: 3945790 - DNA, 12 bp, Homo sapiens
tactctgagccc

SEQ ID NO: 3945791 - DNA, 14 bp, Homo sapiens
tactctgagcccag

SEQ ID NO: 3945792 - DNA, 17 bp, Homo sapiens
tactctgagcccaggcc

SEQ ID NO: 3945793 - DNA, 15 bp, Homo sapiens
tactctgtcagatgg

SEQ ID NO: 3945794 - DNA, 13 bp, Homo sapiens
tactctgtccagg

SEQ ID NO: 3945795 - DNA, 16 bp, Homo sapiens
tactctgtccaggcca

SEQ ID NO: 3945796 - DNA, 20 bp, Homo sapiens
tactctgtgccagagcctgg

SEQ ID NO: 3945797 - DNA, 21 bp, Homo sapiens
tactctgtgccagagcctggg

SEQ ID NO: 3945798 - DNA, 13 bp, Homo sapiens
tactcttcctttc

SEQ ID NO: 3945799 - DNA, 18 bp, Homo sapiens
tactgaaaacaaaatatc

SEQ ID NO: 3945800 - DNA, 19 bp, Homo sapiens
tactgaaaacaaaatatct

SEQ ID NO: 3945801 - DNA, 20 bp, Homo sapiens
tactgaaaacaaaatatctg

SEQ ID NO: 3945802 - DNA, 23 bp, Homo sapiens
tactgatgttcctagtgaaagag

SEQ ID NO: 3945803 - DNA, 18 bp, Homo sapiens
tactgatgttcctttgga

SEQ ID NO: 3945804 - DNA, 13 bp, Homo sapiens
tactgatttttgt

SEQ ID NO: 3945805 - DNA, 22 bp, Homo sapiens
tactgcagctttacatgcaatt

SEQ ID NO: 3945806 - DNA, 10 bp, Homo sapiens
tactgcctgc

SEQ ID NO: 3945807 - DNA, 11 bp, Homo sapiens
tactgcctgct

SEQ ID NO: 3945808 - DNA, 16 bp, Homo sapiens
tactgcctgcttgggg

SEQ ID NO: 3945809 - DNA, 13 bp, Homo sapiens
tactgcctttgga

SEQ ID NO: 3945810 - DNA, 19 bp, Homo sapiens
tactgctgcaaagtgcaaa

SEQ ID NO: 3945811 - DNA, 19 bp, Homo sapiens
tactggaccccgcctccca

SEQ ID NO: 3945812 - DNA, 14 bp, Homo sapiens
tactggcagctcct

SEQ ID NO: 3945813 - DNA, 17 bp, Homo sapiens
tactgggaaggctactt

SEQ ID NO: 3945814 - DNA, 16 bp, Homo sapiens
tactgggttatttttg

SEQ ID NO: 3945815 - DNA, 15 bp, Homo sapiens
tactgtaattaagtg

SEQ ID NO: 3945816 - DNA, 19 bp, Homo sapiens
tactgtaattttgtttgta

SEQ ID NO: 3945817 - DNA, 11 bp, Homo sapiens
tactgtacata

SEQ ID NO: 3945818 - DNA, 23 bp, Homo sapiens
tactgtcagctcccctcggagaa

SEQ ID NO: 3945819 - DNA, 19 bp, Homo sapiens
tactgtctggttttaacaa

SEQ ID NO: 3945820 - DNA, 12 bp, Homo sapiens
tacttaactgtg

SEQ ID NO: 3945821 - DNA, 15 bp, Homo sapiens
tacttaagagaaatg

SEQ ID NO: 3945822 - DNA, 18 bp, Homo sapiens
tacttaagagaaatggca

SEQ ID NO: 3945823 - DNA, 19 bp, Homo sapiens
tacttaagagaaatggcaa

SEQ ID NO: 3945824 - DNA, 13 bp, Homo sapiens
tacttaataaatt

SEQ ID NO: 3945825 - DNA, 13 bp, Homo sapiens
tacttatcctcat

SEQ ID NO: 3945826 - DNA, 15 bp, Homo sapiens
tacttcactttaatt

SEQ ID NO: 3945827 - DNA, 16 bp, Homo sapiens
tacttcactttaattc

SEQ ID NO: 3945828 - DNA, 19 bp, Homo sapiens
tacttcaggtgcttttgat

SEQ ID NO: 3945829 - DNA, 16 bp, Homo sapiens
tacttcctcctgatgg

SEQ ID NO: 3945830 - DNA, 18 bp, Homo sapiens
tacttcctcctgatggcc

SEQ ID NO: 3945831 - DNA, 21 bp, Homo sapiens
tacttctgagaccttgtttca

SEQ ID NO: 3945832 - DNA, 22 bp, Homo sapiens
tacttgaactttccaaaaccta

SEQ ID NO: 3945833 - DNA, 14 bp, Homo sapiens
tacttgacctccta

SEQ ID NO: 3945834 - DNA, 16 bp, Homo sapiens
tacttgagctgtatat

SEQ ID NO: 3945835 - DNA, 12 bp, Homo sapiens
tacttgcacaag

SEQ ID NO: 3945836 - DNA, 15 bp, Homo sapiens
tacttgtagaaatct

SEQ ID NO: 3945837 - DNA, 16 bp, Homo sapiens
tacttgtagaaatctg

SEQ ID NO: 3945838 - DNA, 15 bp, Homo sapiens
tacttgtctgaggcc

SEQ ID NO: 3945839 - DNA, 20 bp, Homo sapiens
tacttgttacctttcccatg

SEQ ID NO: 3945840 - DNA, 22 bp, Homo sapiens
tactttgccttttgcaaacttt

SEQ ID NO: 3945841 - DNA, 21 bp, Homo sapiens
tacttttaaacagtgagcctg

SEQ ID NO: 3945842 - DNA, 17 bp, Homo sapiens
tacttttgtcttcctca

SEQ ID NO: 3945843 - DNA, 20 bp, Homo sapiens
tacttttgttctgtattttc

SEQ ID NO: 3945844 - DNA, 14 bp, Homo sapiens
tacttttgtttcag

SEQ ID NO: 3945845 - DNA, 17 bp, Homo sapiens
tactttttatactccat

SEQ ID NO: 3945846 - DNA, 20 bp, Homo sapiens
tactttttatactccataca

SEQ ID NO: 3945847 - DNA, 15 bp, Homo sapiens
tagaaaactgaaaat

SEQ ID NO: 3945848 - DNA, 20 bp, Homo sapiens
tagaaaactgaaaatctaat

SEQ ID NO: 3945849 - DNA, 21 bp, Homo sapiens
tagaaaactgaaaatctaata

SEQ ID NO: 3945850 - DNA, 22 bp, Homo sapiens
tagaaaactgaaaatctaatat

SEQ ID NO: 3945851 - DNA, 21 bp, Homo sapiens
tagaaaaggctaggtacacag

SEQ ID NO: 3945852 - DNA, 13 bp, Homo sapiens
tagaaacatgaca

SEQ ID NO: 3945853 - DNA, 19 bp, Homo sapiens
tagaaacatgacactgacc

SEQ ID NO: 3945854 - DNA, 19 bp, Homo sapiens
tagaaactcaccatgtaaa

SEQ ID NO: 3945855 - DNA, 20 bp, Homo sapiens
tagaaagaaaagaccctgag

SEQ ID NO: 3945856 - DNA, 15 bp, Homo sapiens
tagaaagtgggttca

SEQ ID NO: 3945857 - DNA, 15 bp, Homo sapiens
tagaaagttattgtg

SEQ ID NO: 3945858 - DNA, 21 bp, Homo sapiens
tagaaatagctccgtggagca

SEQ ID NO: 3945859 - DNA, 22 bp, Homo sapiens
tagaaatagctccgtggagcag

SEQ ID NO: 3945860 - DNA, 14 bp, Homo sapiens
tagaaatcattgta

SEQ ID NO: 3945861 - DNA, 19 bp, Homo sapiens
tagaaattacacccaaaga

SEQ ID NO: 3945862 - DNA, 20 bp, Homo sapiens
tagccaggagtctgtgctct

SEQ ID NO: 3945863 - DNA, 18 bp, Homo sapiens
tagccatggctcaggcaa

SEQ ID NO: 3945864 - DNA, 22 bp, Homo sapiens
tagccatgtactataatgtgat

SEQ ID NO: 3945865 - DNA, 17 bp, Homo sapiens
tagcccaagaggtctga

SEQ ID NO: 3945866 - DNA, 13 bp, Homo sapiens
tagccccataatt

SEQ ID NO: 3945867 - DNA, 23 bp, Homo sapiens
tagcccgacagttctgaactgga

SEQ ID NO: 3945868 - DNA, 13 bp, Homo sapiens
tagccctccctgg

SEQ ID NO: 3945869 - DNA, 22 bp, Homo sapiens
tagccctccctggcatgtcaga

SEQ ID NO: 3945870 - DNA, 15 bp, Homo sapiens
tagccctttctgtgt

SEQ ID NO: 3945871 - DNA, 14 bp, Homo sapiens
tagccgagagcctg

SEQ ID NO: 3945872 - DNA, 19 bp, Homo sapiens
tagccgggcatggtggcgc

SEQ ID NO: 3945873 - DNA, 18 bp, Homo sapiens
tagccgtccatggcacca

SEQ ID NO: 3945874 - DNA, 19 bp, Homo sapiens
tagccgtccatggcaccag

SEQ ID NO: 3945875 - DNA, 20 bp, Homo sapiens
tagcctaatacaacatgtag

SEQ ID NO: 3945876 - DNA, 13 bp, Homo sapiens
tagcctgggccag

SEQ ID NO: 3945877 - DNA, 22 bp, Homo sapiens
tagccttgccttttaaaagaaa

SEQ ID NO: 3945878 - DNA, 18 bp, Homo sapiens
tagccttgctcaggtgca

SEQ ID NO: 3945879 - DNA, 16 bp, Homo sapiens
tagccttgtgccctgc

SEQ ID NO: 3945880 - DNA, 19 bp, Homo sapiens
tagccttgtgccctgcccc

SEQ ID NO: 3945881 - DNA, 22 bp, Homo sapiens
tagccttgtgccctgcccccat

SEQ ID NO: 3945882 - DNA, 14 bp, Homo sapiens
tagcgagctgctct

SEQ ID NO: 3945883 - DNA, 18 bp, Homo sapiens
tagcgagctgctctgcta

SEQ ID NO: 3945884 - DNA, 13 bp, Homo sapiens
tagcgttcccaac

SEQ ID NO: 3945885 - DNA, 15 bp, Homo sapiens
tagctaatgaaattg

SEQ ID NO: 3945886 - DNA, 21 bp, Homo sapiens
tagctacccaaaagagaaaaa

SEQ ID NO: 3945887 - DNA, 19 bp, Homo sapiens
tagctagaaatatgatttt

SEQ ID NO: 3945888 - DNA, 15 bp, Homo sapiens
tagctatcagaagac

SEQ ID NO: 3945889 - DNA, 16 bp, Homo sapiens
tagctatcagaagacc

SEQ ID NO: 3945890 - DNA, 14 bp, Homo sapiens
tagctattactgtc

SEQ ID NO: 3945891 - DNA, 15 bp, Homo sapiens
tagctattactgtct

SEQ ID NO: 3945892 - DNA, 14 bp, Homo sapiens
tagctattgcatgt

SEQ ID NO: 3945893 - DNA, 16 bp, Homo sapiens
tagctattgcatgtaa

SEQ ID NO: 3945894 - DNA, 18 bp, Homo sapiens
tagctattgcatgtaaaa

SEQ ID NO: 3945895 - DNA, 18 bp, Homo sapiens
tagctattttcttacagt

SEQ ID NO: 3945896 - DNA, 23 bp, Homo sapiens
tagctcccgagctactctcttgc

SEQ ID NO: 3945897 - DNA, 15 bp, Homo sapiens
tagctcctctgctgc

SEQ ID NO: 3945898 - DNA, 16 bp, Homo sapiens
tagctcctctgctgct

SEQ ID NO: 3945899 - DNA, 17 bp, Homo sapiens
tagctctgcctccctct

SEQ ID NO: 3945900 - DNA, 14 bp, Homo sapiens
tagctctgttcttt

SEQ ID NO: 3945901 - DNA, 17 bp, Homo sapiens
tagctgaacaatgaatg

SEQ ID NO: 3945902 - DNA, 16 bp, Homo sapiens
tagctgagaggaagat

SEQ ID NO: 3945903 - DNA, 23 bp, Homo sapiens
tagctgagaggaagatgaagaga

SEQ ID NO: 3945904 - DNA, 17 bp, Homo sapiens
tagctgagcgtggtggc

SEQ ID NO: 3945905 - DNA, 11 bp, Homo sapiens
tagctgagctc

SEQ ID NO: 3945906 - DNA, 12 bp, Homo sapiens
tagctgagctca

SEQ ID NO: 3945907 - DNA, 11 bp, Homo sapiens
tagctgtaaat

SEQ ID NO: 3945908 - DNA, 15 bp, Homo sapiens
tagctgtgacctgct

SEQ ID NO: 3945909 - DNA, 17 bp, Homo sapiens
tagctgtgacctgctga

SEQ ID NO: 3945910 - DNA, 24 bp, Homo sapiens
tagctgtgacctgctgagctctga

SEQ ID NO: 3945911 - DNA, 14 bp, Homo sapiens
tagctgtgtgaaat

SEQ ID NO: 3945912 - DNA, 14 bp, Homo sapiens
tagcttaaataaat

SEQ ID NO: 3945913 - DNA, 16 bp, Homo sapiens
tagcttacctgacaca

SEQ ID NO: 3945914 - DNA, 15 bp, Homo sapiens
tagcttcatgcctca

SEQ ID NO: 3945915 - DNA, 16 bp, Homo sapiens
tagcttcatgcctcag

SEQ ID NO: 3945916 - DNA, 17 bp, Homo sapiens
tagcttgtatagtgtaa

SEQ ID NO: 3945917 - DNA, 11 bp, Homo sapiens
tagctttgctc

SEQ ID NO: 3945918 - DNA, 15 bp, Homo sapiens
tagctttgctctttg

SEQ ID NO: 3945919 - DNA, 13 bp, Homo sapiens
tagcttttcaaac

SEQ ID NO: 3945920 - DNA, 24 bp, Homo sapiens
taggaaacccaaggaacaagagaa

SEQ ID NO: 3945921 - DNA, 17 bp, Homo sapiens
taggaagaaaaatgttt

SEQ ID NO: 3945922 - DNA, 20 bp, Homo sapiens
taggaaggctactggcatta

SEQ ID NO: 3945923 - DNA, 22 bp, Homo sapiens
taggaatcctttgagaatgtga

SEQ ID NO: 3945924 - DNA, 22 bp, Homo sapiens
taggagagactgaaagcagcag

SEQ ID NO: 3945925 - DNA, 14 bp, Homo sapiens
taggagctgggagg

SEQ ID NO: 3945926 - DNA, 21 bp, Homo sapiens
taggaggctgcatgctctgga

SEQ ID NO: 3945927 - DNA, 14 bp, Homo sapiens
taggagggactgtc

SEQ ID NO: 3945928 - DNA, 18 bp, Homo sapiens
taggatctatgcaatttt

SEQ ID NO: 3945929 - DNA, 21 bp, Homo sapiens
taggatttaacagtcatttaa

SEQ ID NO: 3945930 - DNA, 22 bp, Homo sapiens
taggatttaacagtcatttaaa

SEQ ID NO: 3945931 - DNA, 12 bp, Homo sapiens
taggcaagagaa

SEQ ID NO: 3945932 - DNA, 12 bp, Homo sapiens
taggcagcctgc

SEQ ID NO: 3945933 - DNA, 14 bp, Homo sapiens
taggcagcctgccg

SEQ ID NO: 3945934 - DNA, 19 bp, Homo sapiens
taggcagggatttgaggag

SEQ ID NO: 3945935 - DNA, 16 bp, Homo sapiens
taggcattatttaatg

SEQ ID NO: 3945936 - DNA, 20 bp, Homo sapiens
taggcattatttaatgtttg

SEQ ID NO: 3945937 - DNA, 14 bp, Homo sapiens
taggccaagctgaa

SEQ ID NO: 3945938 - DNA, 13 bp, Homo sapiens
taggccactcctc

SEQ ID NO: 3945939 - DNA, 18 bp, Homo sapiens
taggcccttgtcctgcca

SEQ ID NO: 3945940 - DNA, 19 bp, Homo sapiens
taggcccttgtcctgccag

SEQ ID NO: 3945941 - DNA, 22 bp, Homo sapiens
taggcctgtgaggtaactggga

SEQ ID NO: 3945942 - DNA, 14 bp, Homo sapiens
taggcgagtgccag

SEQ ID NO: 3945943 - DNA, 15 bp, Homo sapiens
taggcggtcatgtgt

SEQ ID NO: 3945944 - DNA, 18 bp, Homo sapiens
taggcggtcatgtgtgca

SEQ ID NO: 3945945 - DNA, 14 bp, Homo sapiens
taggctggagaagc

SEQ ID NO: 3945946 - DNA, 17 bp, Homo sapiens
taggctggagaagctca

SEQ ID NO: 3945947 - DNA, 21 bp, Homo sapiens
taggctggagaagctcaccca

SEQ ID NO: 3945948 - DNA, 18 bp, Homo sapiens
taggcttttaagaaacac

SEQ ID NO: 3945949 - DNA, 14 bp, Homo sapiens
tataactagtcctt

SEQ ID NO: 3945950 - DNA, 19 bp, Homo sapiens
tataacttaaaaaaatgac

SEQ ID NO: 3945951 - DNA, 16 bp, Homo sapiens
tataacttcttaaaag

SEQ ID NO: 3945952 - DNA, 21 bp, Homo sapiens
tataactttagaaataagaag

SEQ ID NO: 3945953 - DNA, 15 bp, Homo sapiens
tataagcaaatttca

SEQ ID NO: 3945954 - DNA, 23 bp, Homo sapiens
tataagcaaatttcaaaagacat

SEQ ID NO: 3945955 - DNA, 18 bp, Homo sapiens
tataatactaaagtgtct

SEQ ID NO: 3945956 - DNA, 15 bp, Homo sapiens
tataatatcctttgt

SEQ ID NO: 3945957 - DNA, 14 bp, Homo sapiens
tataatatggaacc

SEQ ID NO: 3945958 - DNA, 18 bp, Homo sapiens
tataatgtggatttccta

SEQ ID NO: 3945959 - DNA, 19 bp, Homo sapiens
tataatgtggatttcctat

SEQ ID NO: 3945960 - DNA, 22 bp, Homo sapiens
tataatgtgtgtatgtgtattt

SEQ ID NO: 3945961 - DNA, 22 bp, Homo sapiens
tataattttatgaatgtctttg

SEQ ID NO: 3945962 - DNA, 20 bp, Homo sapiens
tataatttttttattactga

SEQ ID NO: 3945963 - DNA, 18 bp, Homo sapiens
tatacaaaagcaagactt

SEQ ID NO: 3945964 - DNA, 13 bp, Homo sapiens
tatacaaaataat

SEQ ID NO: 3945965 - DNA, 17 bp, Homo sapiens
tatacaaaataatttaa

SEQ ID NO: 3945966 - DNA, 23 bp, Homo sapiens
tatacaaaataatttaactaatt

SEQ ID NO: 3945967 - DNA, 15 bp, Homo sapiens
tatacaaacatgtgg

SEQ ID NO: 3945968 - DNA, 18 bp, Homo sapiens
tatacaatatataaaaat

SEQ ID NO: 3945969 - DNA, 15 bp, Homo sapiens
tatacacaacattta

SEQ ID NO: 3945970 - DNA, 18 bp, Homo sapiens
tatacacacatatacata

SEQ ID NO: 3945971 - DNA, 21 bp, Homo sapiens
tatacacacatatacatatat

SEQ ID NO: 3945972 - DNA, 14 bp, Homo sapiens
tatacacatacata

SEQ ID NO: 3945973 - DNA, 15 bp, Homo sapiens
tatacacatacatac

SEQ ID NO: 3945974 - DNA, 16 bp, Homo sapiens
tatacacatacataca

SEQ ID NO: 3945975 - DNA, 17 bp, Homo sapiens
tatacacatatacctat

SEQ ID NO: 3945976 - DNA, 12 bp, Homo sapiens
tatacagaactg

SEQ ID NO: 3945977 - DNA, 23 bp, Homo sapiens
tatacagaactgaattaagttat

SEQ ID NO: 3945978 - DNA, 15 bp, Homo sapiens
tatacatacacttgt

SEQ ID NO: 3945979 - DNA, 16 bp, Homo sapiens
tatacatatgtagact

SEQ ID NO: 3945980 - DNA, 11 bp, Homo sapiens
tatacatatta

SEQ ID NO: 3945981 - DNA, 18 bp, Homo sapiens
tatacatattataaataa

SEQ ID NO: 3945982 - DNA, 21 bp, Homo sapiens
tatacatattataaataaatg

SEQ ID NO: 3945983 - DNA, 23 bp, Homo sapiens
tatacatattataaataaatgcc

SEQ ID NO: 3945984 - DNA, 22 bp, Homo sapiens
tatacatcacctttttgacttt

SEQ ID NO: 3945985 - DNA, 12 bp, Homo sapiens
tatacatgtgtg

SEQ ID NO: 3945986 - DNA, 14 bp, Homo sapiens
tatacatgtgtgta

SEQ ID NO: 3945987 - DNA, 16 bp, Homo sapiens
tatacatgtgtgtata

SEQ ID NO: 3945988 - DNA, 17 bp, Homo sapiens
tatacatgtgtgtatat

SEQ ID NO: 3945989 - DNA, 18 bp, Homo sapiens
tatacatgtgtgtatata

SEQ ID NO: 3945990 - DNA, 19 bp, Homo sapiens
tatacatgtgtgtatatat

SEQ ID NO: 3945991 - DNA, 16 bp, Homo sapiens
tatacattctttatct

SEQ ID NO: 3945992 - DNA, 22 bp, Homo sapiens
tatacattctttatcttgacat

SEQ ID NO: 3945993 - DNA, 13 bp, Homo sapiens
tatacatttctgt

SEQ ID NO: 3945994 - DNA, 13 bp, Homo sapiens
tataccatatgtc

SEQ ID NO: 3945995 - DNA, 17 bp, Homo sapiens
tataccatatgtctgct

SEQ ID NO: 3945996 - DNA, 15 bp, Homo sapiens
tatacctataatgtg

SEQ ID NO: 3945997 - DNA, 13 bp, Homo sapiens
tataccttctcaa

SEQ ID NO: 3945998 - DNA, 22 bp, Homo sapiens
tatactaaaaaatgtctataga

SEQ ID NO: 3945999 - DNA, 17 bp, Homo sapiens
tatactatacaacaatg

SEQ ID NO: 3946000 - DNA, 16 bp, Homo sapiens
tatactgtacttaata

SEQ ID NO: 3946001 - DNA, 19 bp, Homo sapiens
tatagaaagctgtttattt

SEQ ID NO: 3946002 - DNA, 20 bp, Homo sapiens
tatagaatacttttttctag

SEQ ID NO: 3946003 - DNA, 17 bp, Homo sapiens
tatagagatatgcagaa

SEQ ID NO: 3946004 - DNA, 17 bp, Homo sapiens
tatagatttgtatttta

SEQ ID NO: 3946005 - DNA, 23 bp, Homo sapiens
tatagcaatccatgttagttttt

SEQ ID NO: 3946006 - DNA, 17 bp, Homo sapiens
tatagcattgaacattt

SEQ ID NO: 3946007 - DNA, 14 bp, Homo sapiens
tatagctattactg

SEQ ID NO: 3946008 - DNA, 22 bp, Homo sapiens
tatagctcttctatttaaaaaa

SEQ ID NO: 3946009 - DNA, 16 bp, Homo sapiens
tataggtgctacaaaa

SEQ ID NO: 3946010 - DNA, 17 bp, Homo sapiens
tataggttactcataag

SEQ ID NO: 3946011 - DNA, 19 bp, Homo sapiens
tatagtagtcaattagtac

SEQ ID NO: 3946012 - DNA, 16 bp, Homo sapiens
tatagtataccataca

SEQ ID NO: 3946013 - DNA, 17 bp, Homo sapiens
tatagtatatttatact

SEQ ID NO: 3946014 - DNA, 13 bp, Homo sapiens
tatagtcatttat

SEQ ID NO: 3946015 - DNA, 18 bp, Homo sapiens
tatagtgtaaaataagaa

SEQ ID NO: 3946016 - DNA, 17 bp, Homo sapiens
tatagttaggatagcat

SEQ ID NO: 3946017 - DNA, 19 bp, Homo sapiens
tatagtttattgacaataa

SEQ ID NO: 3946018 - DNA, 15 bp, Homo sapiens
tatagtttgtacatg

SEQ ID NO: 3946019 - DNA, 23 bp, Homo sapiens
tatataaaaagaaaagataaaga

SEQ ID NO: 3946020 - DNA, 18 bp, Homo sapiens
tatataaaaatatatata

SEQ ID NO: 3946021 - DNA, 18 bp, Homo sapiens
tatataactttagaaata

SEQ ID NO: 3946022 - DNA, 16 bp, Homo sapiens
tatataatactaaagt

SEQ ID NO: 3946023 - DNA, 19 bp, Homo sapiens
tatataatactaaagtgtc

SEQ ID NO: 3946024 - DNA, 17 bp, Homo sapiens
tatatacaataacataa

SEQ ID NO: 3946025 - DNA, 13 bp, Homo sapiens
tatatacacatac

SEQ ID NO: 3946026 - DNA, 22 bp, Homo sapiens
tatatacacatacatacacata

SEQ ID NO: 3946027 - DNA, 18 bp, Homo sapiens
tatatacacatataccta

SEQ ID NO: 3946028 - DNA, 13 bp, Homo sapiens
tatatacatatgt

SEQ ID NO: 3946029 - DNA, 14 bp, Homo sapiens
tatatacatatgta

SEQ ID NO: 3946030 - DNA, 17 bp, Homo sapiens
tatatacatatgtagac

SEQ ID NO: 3946031 - DNA, 17 bp, Homo sapiens
tatatacatgtgtgtat

SEQ ID NO: 3946032 - DNA, 16 bp, Homo sapiens
tatatagatgtgcaag

SEQ ID NO: 3946033 - DNA, 11 bp, Homo sapiens
tatatagtata

SEQ ID NO: 3946034 - DNA, 14 bp, Homo sapiens
tatatagtatattt

SEQ ID NO: 3946035 - DNA, 19 bp, Homo sapiens
tatatagtatatttatact

SEQ ID NO: 3946036 - DNA, 15 bp, Homo sapiens
tatcagttaacatta

SEQ ID NO: 3946037 - DNA, 15 bp, Homo sapiens
tatcagttactcagc

SEQ ID NO: 3946038 - DNA, 16 bp, Homo sapiens
tatcagttactcagcc

SEQ ID NO: 3946039 - DNA, 23 bp, Homo sapiens
tatcatagaaatgtaacttttgt

SEQ ID NO: 3946040 - DNA, 13 bp, Homo sapiens
tatcatgacatgt

SEQ ID NO: 3946041 - DNA, 22 bp, Homo sapiens
tatccacagactccctcccctg

SEQ ID NO: 3946042 - DNA, 14 bp, Homo sapiens
tatccacccagccc

SEQ ID NO: 3946043 - DNA, 15 bp, Homo sapiens
tatccactttgcaca

SEQ ID NO: 3946044 - DNA, 15 bp, Homo sapiens
tatcccaagccaacc

SEQ ID NO: 3946045 - DNA, 14 bp, Homo sapiens
tatcccagaaatta

SEQ ID NO: 3946046 - DNA, 19 bp, Homo sapiens
tatcccccccctgtatagt

SEQ ID NO: 3946047 - DNA, 19 bp, Homo sapiens
tatcctacaacaagagttt

SEQ ID NO: 3946048 - DNA, 16 bp, Homo sapiens
tatcctataggcagac

SEQ ID NO: 3946049 - DNA, 11 bp, Homo sapiens
tatcctcaggg

SEQ ID NO: 3946050 - DNA, 16 bp, Homo sapiens
tatcctgaaatttcag

SEQ ID NO: 3946051 - DNA, 14 bp, Homo sapiens
tatcctgataaaca

SEQ ID NO: 3946052 - DNA, 20 bp, Homo sapiens
tatcctgctagctgtagaaa

SEQ ID NO: 3946053 - DNA, 19 bp, Homo sapiens
tatccttggagagcagctg

SEQ ID NO: 3946054 - DNA, 12 bp, Homo sapiens
tatcgactttat

SEQ ID NO: 3946055 - DNA, 14 bp, Homo sapiens
tatctaatttatac

SEQ ID NO: 3946056 - DNA, 19 bp, Homo sapiens
tatctaatttatacaaaat

SEQ ID NO: 3946057 - DNA, 20 bp, Homo sapiens
tatctacctgccctctctca

SEQ ID NO: 3946058 - DNA, 17 bp, Homo sapiens
tatctagaaagaaaaga

SEQ ID NO: 3946059 - DNA, 19 bp, Homo sapiens
tatctatggccctgcaaaa

SEQ ID NO: 3946060 - DNA, 17 bp, Homo sapiens
tatctcaaaactgcact

SEQ ID NO: 3946061 - DNA, 23 bp, Homo sapiens
tatctccaggattgaagagcatt

SEQ ID NO: 3946062 - DNA, 17 bp, Homo sapiens
tatctctaggctgtttt

SEQ ID NO: 3946063 - DNA, 16 bp, Homo sapiens
tatctctatttaatat

SEQ ID NO: 3946064 - DNA, 18 bp, Homo sapiens
tatctctgtgtgcacaaa

SEQ ID NO: 3946065 - DNA, 23 bp, Homo sapiens
tatctctgtgtgcacaaatattt

SEQ ID NO: 3946066 - DNA, 13 bp, Homo sapiens
tatctgaacacat

SEQ ID NO: 3946067 - DNA, 14 bp, Homo sapiens
tatctgaacacata

SEQ ID NO: 3946068 - DNA, 23 bp, Homo sapiens
tatctgataaaattgtgatgttt

SEQ ID NO: 3946069 - DNA, 21 bp, Homo sapiens
tatctgatcgggataacaaaa

SEQ ID NO: 3946070 - DNA, 20 bp, Homo sapiens
tatctgcatttataaatgtg

SEQ ID NO: 3946071 - DNA, 12 bp, Homo sapiens
tatctgcctggc

SEQ ID NO: 3946072 - DNA, 15 bp, Homo sapiens
tatctgcctggcctg

SEQ ID NO: 3946073 - DNA, 19 bp, Homo sapiens
tatctgcctggcctggctc

SEQ ID NO: 3946074 - DNA, 20 bp, Homo sapiens
tatctgcttcagtggagaat

SEQ ID NO: 3946075 - DNA, 20 bp, Homo sapiens
tatctgtaattaatattcct

SEQ ID NO: 3946076 - DNA, 20 bp, Homo sapiens
tatctgtcacacaaggctgg

SEQ ID NO: 3946077 - DNA, 14 bp, Homo sapiens
tatcttatgttaaa

SEQ ID NO: 3946078 - DNA, 19 bp, Homo sapiens
tatcttctgcagacactgt

SEQ ID NO: 3946079 - DNA, 20 bp, Homo sapiens
tatctttgaagccagtattt

SEQ ID NO: 3946080 - DNA, 21 bp, Homo sapiens
tatgaaatgataaagatgtca

SEQ ID NO: 3946081 - DNA, 21 bp, Homo sapiens
tatgaacttgaggacacatgt

SEQ ID NO: 3946082 - DNA, 18 bp, Homo sapiens
tatgacaatcctgaagaa

SEQ ID NO: 3946083 - DNA, 16 bp, Homo sapiens
tatgacagctgtccct

SEQ ID NO: 3946084 - DNA, 20 bp, Homo sapiens
tatgacagctgtccctgtca

SEQ ID NO: 3946085 - DNA, 21 bp, Homo sapiens
tatgatattttgtctcctacc

SEQ ID NO: 3946086 - DNA, 13 bp, Homo sapiens
tatgatctaatac

SEQ ID NO: 3946087 - DNA, 17 bp, Homo sapiens
tatgatttttacaataa

SEQ ID NO: 3946088 - DNA, 16 bp, Homo sapiens
tatgattttttaaaag

SEQ ID NO: 3946089 - DNA, 18 bp, Homo sapiens
tatgattttttaaaagaa

SEQ ID NO: 3946090 - DNA, 20 bp, Homo sapiens
tatgattttttaaaagaaat

SEQ ID NO: 3946091 - DNA, 21 bp, Homo sapiens
tatgattttttaaaagaaatt

SEQ ID NO: 3946092 - DNA, 15 bp, Homo sapiens
tatgcacacacatgg

SEQ ID NO: 3946093 - DNA, 15 bp, Homo sapiens
tatgcacgaccttgg

SEQ ID NO: 3946094 - DNA, 17 bp, Homo sapiens
tatgcacgaccttggga

SEQ ID NO: 3946095 - DNA, 13 bp, Homo sapiens
tatgcactggcca

SEQ ID NO: 3946096 - DNA, 17 bp, Homo sapiens
tatgcactggccaccca

SEQ ID NO: 3946097 - DNA, 13 bp, Homo sapiens
tatgcagctgagg

SEQ ID NO: 3946098 - DNA, 18 bp, Homo sapiens
tatgccttatgtaattat

SEQ ID NO: 3946099 - DNA, 19 bp, Homo sapiens
tatgctatttctggcctca

SEQ ID NO: 3946100 - DNA, 12 bp, Homo sapiens
tatgctggccag

SEQ ID NO: 3946101 - DNA, 13 bp, Homo sapiens
tatgctgtgttta

SEQ ID NO: 3946102 - DNA, 15 bp, Homo sapiens
tatgctgtgtttatg

SEQ ID NO: 3946103 - DNA, 13 bp, Homo sapiens
tatgcttaaaata

SEQ ID NO: 3946104 - DNA, 23 bp, Homo sapiens
tatggaaaagggtcttcttggca

SEQ ID NO: 3946105 - DNA, 17 bp, Homo sapiens
tatggaaataaatgtat

SEQ ID NO: 3946106 - DNA, 13 bp, Homo sapiens
tatggaacttcta

SEQ ID NO: 3946107 - DNA, 17 bp, Homo sapiens
tatggaatacagtgtta

SEQ ID NO: 3946108 - DNA, 14 bp, Homo sapiens
tatggcaaaaatgg

SEQ ID NO: 3946109 - DNA, 14 bp, Homo sapiens
tatggcagcgaaag

SEQ ID NO: 3946110 - DNA, 16 bp, Homo sapiens
tatggcatgatttata

SEQ ID NO: 3946111 - DNA, 20 bp, Homo sapiens
tatggccctgcaaaaatata

SEQ ID NO: 3946112 - DNA, 17 bp, Homo sapiens
tatggctataggtgcta

SEQ ID NO: 3946113 - DNA, 17 bp, Homo sapiens
tatggcttataaatgtg

SEQ ID NO: 3946114 - DNA, 13 bp, Homo sapiens
tatggtataatgg

SEQ ID NO: 3946115 - DNA, 16 bp, Homo sapiens
tatggtgtaatgcaca

SEQ ID NO: 3946116 - DNA, 18 bp, Homo sapiens
tatggtgtaatgcacaat

SEQ ID NO: 3946117 - DNA, 20 bp, Homo sapiens
tatggtgtaatgcacaattt

SEQ ID NO: 3946118 - DNA, 21 bp, Homo sapiens
tatggttcccaataaaagtga

SEQ ID NO: 3946119 - DNA, 23 bp, Homo sapiens
tatggttctcagatcttgacagt

SEQ ID NO: 3946120 - DNA, 14 bp, Homo sapiens
tatggtttctgcgt

SEQ ID NO: 3946121 - DNA, 12 bp, Homo sapiens
tatgtaaaataa

SEQ ID NO: 3946122 - DNA, 17 bp, Homo sapiens
tatgtaaagtatgtaaa

SEQ ID NO: 3946123 - DNA, 16 bp, Homo sapiens
tattctgacttcctct

SEQ ID NO: 3946124 - DNA, 19 bp, Homo sapiens
tattctggaaaaaaaatat

SEQ ID NO: 3946125 - DNA, 23 bp, Homo sapiens
tattctggaaaaaaaatatatat

SEQ ID NO: 3946126 - DNA, 18 bp, Homo sapiens
tattctgtgttgaacaca

SEQ ID NO: 3946127 - DNA, 16 bp, Homo sapiens
tattcttatgcagggt

SEQ ID NO: 3946128 - DNA, 16 bp, Homo sapiens
tattgaaattactgaa

SEQ ID NO: 3946129 - DNA, 17 bp, Homo sapiens
tattgaagaaaagcact

SEQ ID NO: 3946130 - DNA, 18 bp, Homo sapiens
tattgaagaaaagcactt

SEQ ID NO: 3946131 - DNA, 20 bp, Homo sapiens
tattgaagaaaagcactttt

SEQ ID NO: 3946132 - DNA, 22 bp, Homo sapiens
tattgaagaaacagataccata

SEQ ID NO: 3946133 - DNA, 12 bp, Homo sapiens
tattgaatgttt

SEQ ID NO: 3946134 - DNA, 21 bp, Homo sapiens
tattgatgtttccagaaaata

SEQ ID NO: 3946135 - DNA, 20 bp, Homo sapiens
tattgcatgtaaaatgcagt

SEQ ID NO: 3946136 - DNA, 18 bp, Homo sapiens
tattggaagtgttcaaga

SEQ ID NO: 3946137 - DNA, 11 bp, Homo sapiens
tattggccact

SEQ ID NO: 3946138 - DNA, 22 bp, Homo sapiens
tattggtaacatcctttctatt

SEQ ID NO: 3946139 - DNA, 16 bp, Homo sapiens
tattgtataaactatc

SEQ ID NO: 3946140 - DNA, 21 bp, Homo sapiens
tattgtataaactatcagttt

SEQ ID NO: 3946141 - DNA, 14 bp, Homo sapiens
tattgtatattctg

SEQ ID NO: 3946142 - DNA, 18 bp, Homo sapiens
tattgtatattctggaaa

SEQ ID NO: 3946143 - DNA, 21 bp, Homo sapiens
tattgtgatctatcaatagtc

SEQ ID NO: 3946144 - DNA, 21 bp, Homo sapiens
tattgtttaaaaacaggaaaa

SEQ ID NO: 3946145 - DNA, 15 bp, Homo sapiens
tattgtttaaaatca

SEQ ID NO: 3946146 - DNA, 18 bp, Homo sapiens
tattgttttatgttctag

SEQ ID NO: 3946147 - DNA, 15 bp, Homo sapiens
tatttaacaagatct

SEQ ID NO: 3946148 - DNA, 18 bp, Homo sapiens
tatttaagcctcatattt

SEQ ID NO: 3946149 - DNA, 17 bp, Homo sapiens
tatttaagtatatagta

SEQ ID NO: 3946150 - DNA, 19 bp, Homo sapiens
tatttaagtatatagtata

SEQ ID NO: 3946151 - DNA, 22 bp, Homo sapiens
tatttaagtatatagtatattt

SEQ ID NO: 3946152 - DNA, 15 bp, Homo sapiens
tatttaatacctttg

SEQ ID NO: 3946153 - DNA, 17 bp, Homo sapiens
tatttaattttcctgga

SEQ ID NO: 3946154 - DNA, 17 bp, Homo sapiens
tatttaatttttacatg

SEQ ID NO: 3946155 - DNA, 21 bp, Homo sapiens
tatttaatttttacatgacca

SEQ ID NO: 3946156 - DNA, 15 bp, Homo sapiens
tatttactaaaagaa

SEQ ID NO: 3946157 - DNA, 17 bp, Homo sapiens
tatttacttgaaagatg

SEQ ID NO: 3946158 - DNA, 16 bp, Homo sapiens
tatttagaccctgttt

SEQ ID NO: 3946159 - DNA, 17 bp, Homo sapiens
tatttagattgttaaaa

SEQ ID NO: 3946160 - DNA, 20 bp, Homo sapiens
tatttatatattggtaacat

SEQ ID NO: 3946161 - DNA, 14 bp, Homo sapiens
tatttatatatttg

SEQ ID NO: 3946162 - DNA, 13 bp, Homo sapiens
tatttatatttgg

SEQ ID NO: 3946163 - DNA, 16 bp, Homo sapiens
tatttatctctattta

SEQ ID NO: 3946164 - DNA, 17 bp, Homo sapiens
tatttatctctatttaa

SEQ ID NO: 3946165 - DNA, 20 bp, Homo sapiens
tatttatgaaaaccatatga

SEQ ID NO: 3946166 - DNA, 20 bp, Homo sapiens
tatttatgcctctgtattta

SEQ ID NO: 3946167 - DNA, 12 bp, Homo sapiens
tatttatggctt

SEQ ID NO: 3946168 - DNA, 20 bp, Homo sapiens
tatttatggcttataaatgt

SEQ ID NO: 3946169 - DNA, 21 bp, Homo sapiens
tatttatgtctatttaagcct

SEQ ID NO: 3946170 - DNA, 21 bp, Homo sapiens
tatttattgaagaaacagata

SEQ ID NO: 3946171 - DNA, 17 bp, Homo sapiens
tatttattgtcattact

SEQ ID NO: 3946172 - DNA, 16 bp, Homo sapiens
tatttatttgaaagtc

SEQ ID NO: 3946173 - DNA, 23 bp, Homo sapiens
tatttccaccatcaaatgctgta

SEQ ID NO: 3946174 - DNA, 13 bp, Homo sapiens
tatttctctcccc

SEQ ID NO: 3946175 - DNA, 19 bp, Homo sapiens
tatttctttgtgataacaa

SEQ ID NO: 3946176 - DNA, 12 bp, Homo sapiens
tatttgaaattt

SEQ ID NO: 3946177 - DNA, 12 bp, Homo sapiens
tatttggaaaga

SEQ ID NO: 3946178 - DNA, 16 bp, Homo sapiens
tatttggaaagagacc

SEQ ID NO: 3946179 - DNA, 23 bp, Homo sapiens
tatttgtaaaagaacagtaaaca

SEQ ID NO: 3946180 - DNA, 19 bp, Homo sapiens
tatttgtacagttcagttc

SEQ ID NO: 3946181 - DNA, 15 bp, Homo sapiens
tatttgtattcatga

SEQ ID NO: 3946182 - DNA, 15 bp, Homo sapiens
tatttgtctttcagg

SEQ ID NO: 3946183 - DNA, 14 bp, Homo sapiens
tatttgtgtatgtg

SEQ ID NO: 3946184 - DNA, 16 bp, Homo sapiens
tatttgtgtatgtgta

SEQ ID NO: 3946185 - DNA, 17 bp, Homo sapiens
tatttgttattttcagt

SEQ ID NO: 3946186 - DNA, 14 bp, Homo sapiens
tatttgttcagaga

SEQ ID NO: 3946187 - DNA, 17 bp, Homo sapiens
tatttgttcccaagagc

SEQ ID NO: 3946188 - DNA, 23 bp, Homo sapiens
tattttaaaagccacatagagtg

SEQ ID NO: 3946189 - DNA, 17 bp, Homo sapiens
tattttaagacgtgaat

SEQ ID NO: 3946190 - DNA, 16 bp, Homo sapiens
tattttaggagacagt

SEQ ID NO: 3946191 - DNA, 15 bp, Homo sapiens
tattttatctgtgtt

SEQ ID NO: 3946192 - DNA, 19 bp, Homo sapiens
tattttcaacgcagccctg

SEQ ID NO: 3946193 - DNA, 17 bp, Homo sapiens
tattttcagtattttgg

SEQ ID NO: 3946194 - DNA, 21 bp, Homo sapiens
tattttcatgacttttccatg

SEQ ID NO: 3946195 - DNA, 18 bp, Homo sapiens
tattttcattttaattta

SEQ ID NO: 3946196 - DNA, 14 bp, Homo sapiens
tattttctttgaaa

SEQ ID NO: 3946197 - DNA, 16 bp, Homo sapiens
tattttggagaaatta

SEQ ID NO: 3946198 - DNA, 13 bp, Homo sapiens
tattttgtaaact

SEQ ID NO: 3946199 - DNA, 18 bp, Homo sapiens
tatttttcaaccagcatt

SEQ ID NO: 3946200 - DNA, 22 bp, Homo sapiens
tatttttgaaaggcatgttcct

SEQ ID NO: 3946201 - DNA, 20 bp, Homo sapiens
tatttttgaacccctgtgtc

SEQ ID NO: 3946202 - DNA, 16 bp, Homo sapiens
tatttttgtgtttcta

SEQ ID NO: 3946203 - DNA, 13 bp, Homo sapiens
tattttttattgt

SEQ ID NO: 3946204 - DNA, 18 bp, Homo sapiens
tattttttctacacagta

SEQ ID NO: 3946205 - DNA, 19 bp, Homo sapiens
tatttttttaagctgtaaa

SEQ ID NO: 3946206 - DNA, 20 bp, Homo sapiens
tatttttttaagctgtaaaa

SEQ ID NO: 3946207 - DNA, 21 bp, Homo sapiens
tcaaaacacatctttcctgtc

SEQ ID NO: 3946208 - DNA, 15 bp, Homo sapiens
tcaaaacagagatgt

SEQ ID NO: 3946209 - DNA, 16 bp, Homo sapiens
tcaaggtgtaaaatat

SEQ ID NO: 3946210 - DNA, 22 bp, Homo sapiens
tcaagtatttattattgaagat

SEQ ID NO: 3946211 - DNA, 13 bp, Homo sapiens
tcaagtccagagc

SEQ ID NO: 3946212 - DNA, 15 bp, Homo sapiens
tcaagtgatatatgt

SEQ ID NO: 3946213 - DNA, 17 bp, Homo sapiens
tcaagtgatccacctgc

SEQ ID NO: 3946214 - DNA, 21 bp, Homo sapiens
tcaagtgcatgctctctgcag

SEQ ID NO: 3946215 - DNA, 22 bp, Homo sapiens
tcaagtgcatgctctctgcagc

SEQ ID NO: 3946216 - DNA, 22 bp, Homo sapiens
tcaagtgcctcttgttgcagag

SEQ ID NO: 3946217 - DNA, 15 bp, Homo sapiens
tcaagtgtcatatgt

SEQ ID NO: 3946218 - DNA, 17 bp, Homo sapiens
tcaagttattgtacagc

SEQ ID NO: 3946219 - DNA, 16 bp, Homo sapiens
tcaagtttttcagaaa

SEQ ID NO: 3946220 - DNA, 21 bp, Homo sapiens
tcaataccccaagtccacctg

SEQ ID NO: 3946221 - DNA, 16 bp, Homo sapiens
tcaatacccctgttaa

SEQ ID NO: 3946222 - DNA, 16 bp, Homo sapiens
tcaatatgtgattttt

SEQ ID NO: 3946223 - DNA, 16 bp, Homo sapiens
tcaatattcaataaag

SEQ ID NO: 3946224 - DNA, 17 bp, Homo sapiens
tcaatattcaataaagc

SEQ ID NO: 3946225 - DNA, 20 bp, Homo sapiens
tcaatattgcctttgcctct

SEQ ID NO: 3946226 - DNA, 15 bp, Homo sapiens
tcaatgacctgtatt

SEQ ID NO: 3946227 - DNA, 21 bp, Homo sapiens
tcaatgcattgtcttgtggag

SEQ ID NO: 3946228 - DNA, 15 bp, Homo sapiens
tcaatgccctgccat

SEQ ID NO: 3946229 - DNA, 15 bp, Homo sapiens
tcaatggaaacaggg

SEQ ID NO: 3946230 - DNA, 15 bp, Homo sapiens
tcaatgtgaatcaga

SEQ ID NO: 3946231 - DNA, 13 bp, Homo sapiens
tcaattaattctt

SEQ ID NO: 3946232 - DNA, 15 bp, Homo sapiens
tcaattcaacacatt

SEQ ID NO: 3946233 - DNA, 12 bp, Homo sapiens
tcaattctcaaa

SEQ ID NO: 3946234 - DNA, 18 bp, Homo sapiens
tcaatttccctgactcct

SEQ ID NO: 3946235 - DNA, 20 bp, Homo sapiens
tcaatttgtaattgcttaca

SEQ ID NO: 3946236 - DNA, 15 bp, Homo sapiens
tcaatttttatacat

SEQ ID NO: 3946237 - DNA, 22 bp, Homo sapiens
tcaatttttatacatatcagaa

SEQ ID NO: 3946238 - DNA, 20 bp, Homo sapiens
tcaatttttcttatttcatt

SEQ ID NO: 3946239 - DNA, 13 bp, Homo sapiens
tcacaaaatgcaa

SEQ ID NO: 3946240 - DNA, 19 bp, Homo sapiens
tcacaagcaataattagga

SEQ ID NO: 3946241 - DNA, 22 bp, Homo sapiens
tcacaaggcagcaaggcccgag

SEQ ID NO: 3946242 - DNA, 23 bp, Homo sapiens
tcacaaggcagcaaggcccgagc

SEQ ID NO: 3946243 - DNA, 16 bp, Homo sapiens
tcacaaggtcaggagt

SEQ ID NO: 3946244 - DNA, 14 bp, Homo sapiens
tcacaatagaaact

SEQ ID NO: 3946245 - DNA, 16 bp, Homo sapiens
tcacacaaggctgggc

SEQ ID NO: 3946246 - DNA, 19 bp, Homo sapiens
tcacacaggcatttcctgg

SEQ ID NO: 3946247 - DNA, 23 bp, Homo sapiens
tcacacaggcatttcctgggtgg

SEQ ID NO: 3946248 - DNA, 23 bp, Homo sapiens
tcacacagggctctttgatggac

SEQ ID NO: 3946249 - DNA, 20 bp, Homo sapiens
tcacaccatcttaaatgaca

SEQ ID NO: 3946250 - DNA, 21 bp, Homo sapiens
tcacactgcaagagccttggt

SEQ ID NO: 3946251 - DNA, 17 bp, Homo sapiens
tcacagaggcttcttca

SEQ ID NO: 3946252 - DNA, 20 bp, Homo sapiens
tcacagatgggtattaaact

SEQ ID NO: 3946253 - DNA, 22 bp, Homo sapiens
tcacagatgggtattaaacttg

SEQ ID NO: 3946254 - DNA, 23 bp, Homo sapiens
tcacagccagactggcacagttt

SEQ ID NO: 3946255 - DNA, 22 bp, Homo sapiens
tcacagcccgggtgtgcctgcc

SEQ ID NO: 3946256 - DNA, 23 bp, Homo sapiens
tcacagcccgggtgtgcctgccc

SEQ ID NO: 3946257 - DNA, 11 bp, Homo sapiens
tcacagctgca

SEQ ID NO: 3946258 - DNA, 14 bp, Homo sapiens
tcacagctgcagct

SEQ ID NO: 3946259 - DNA, 19 bp, Homo sapiens
tcacagctgcagctgggcc

SEQ ID NO: 3946260 - DNA, 19 bp, Homo sapiens
tcacaggactctgcctcct

SEQ ID NO: 3946261 - DNA, 13 bp, Homo sapiens
tcacaggagcaga

SEQ ID NO: 3946262 - DNA, 18 bp, Homo sapiens
tcacaggagcagacagag

SEQ ID NO: 3946263 - DNA, 22 bp, Homo sapiens
tcacaggagcagacagagaaat

SEQ ID NO: 3946264 - DNA, 23 bp, Homo sapiens
tcacagggccccagaaggcaggg

SEQ ID NO: 3946265 - DNA, 18 bp, Homo sapiens
tcacaggtgtggtgtaat

SEQ ID NO: 3946266 - DNA, 19 bp, Homo sapiens
tcacaggtgtggtgtaatt

SEQ ID NO: 3946267 - DNA, 21 bp, Homo sapiens
tcacaggtgtggtgtaattta

SEQ ID NO: 3946268 - DNA, 17 bp, Homo sapiens
tcacagttcctcgccct

SEQ ID NO: 3946269 - DNA, 17 bp, Homo sapiens
tcacataaaacctcatt

SEQ ID NO: 3946270 - DNA, 12 bp, Homo sapiens
tcacatacaatt

SEQ ID NO: 3946271 - DNA, 13 bp, Homo sapiens
tcacatacaattt

SEQ ID NO: 3946272 - DNA, 15 bp, Homo sapiens
tcacatacaatttgc

SEQ ID NO: 3946273 - DNA, 16 bp, Homo sapiens
tcacatacaatttgca

SEQ ID NO: 3946274 - DNA, 14 bp, Homo sapiens
tcacataccctccc

SEQ ID NO: 3946275 - DNA, 17 bp, Homo sapiens
tcacatagctacccaaa

SEQ ID NO: 3946276 - DNA, 19 bp, Homo sapiens
tcacatcaagcatgcaata

SEQ ID NO: 3946277 - DNA, 19 bp, Homo sapiens
tcacattaatggtctaaaa

SEQ ID NO: 3946278 - DNA, 21 bp, Homo sapiens
tcacattacatcatcctcctt

SEQ ID NO: 3946279 - DNA, 23 bp, Homo sapiens
tcacattgtaactgaacttcagg

SEQ ID NO: 3946280 - DNA, 15 bp, Homo sapiens
tcacatttgatgtac

SEQ ID NO: 3946281 - DNA, 17 bp, Homo sapiens
tcacatttgatgtacat

SEQ ID NO: 3946282 - DNA, 18 bp, Homo sapiens
tcacatttgatgtacatg

SEQ ID NO: 3946283 - DNA, 19 bp, Homo sapiens
tcacatttgatgtacatgt

SEQ ID NO: 3946284 - DNA, 17 bp, Homo sapiens
tcacattttgcctttct

SEQ ID NO: 3946285 - DNA, 19 bp, Homo sapiens
tcacattttgcctttctcg

SEQ ID NO: 3946286 - DNA, 18 bp, Homo sapiens
tcaccaaagtattaatgt

SEQ ID NO: 3946287 - DNA, 16 bp, Homo sapiens
tcaccaagctcacagt

SEQ ID NO: 3946288 - DNA, 20 bp, Homo sapiens
tcaccaagctcacagttcct

SEQ ID NO: 3946289 - DNA, 15 bp, Homo sapiens
tcaccaccctcccct

SEQ ID NO: 3946290 - DNA, 14 bp, Homo sapiens
tcaccaccttccca

SEQ ID NO: 3946291 - DNA, 16 bp, Homo sapiens
tcaccaccttcccagc

SEQ ID NO: 3946292 - DNA, 21 bp, Homo sapiens
tcaccagcaacatctcgagcc

SEQ ID NO: 3946293 - DNA, 16 bp, Homo sapiens
tcaccaggatgaaggc

SEQ ID NO: 3946294 - DNA, 22 bp, Homo sapiens
tcaccagggtccgcaccagctg

SEQ ID NO: 3946295 - DNA, 14 bp, Homo sapiens
tcagaattttgtat

SEQ ID NO: 3946296 - DNA, 13 bp, Homo sapiens
tcagacaatccac

SEQ ID NO: 3946297 - DNA, 22 bp, Homo sapiens
tcagacatccatgtttgtaaaa

SEQ ID NO: 3946298 - DNA, 15 bp, Homo sapiens
tcagacattccaagg

SEQ ID NO: 3946299 - DNA, 18 bp, Homo sapiens
tcagacccccactctcat

SEQ ID NO: 3946300 - DNA, 22 bp, Homo sapiens
tcagacccccactctcattccc

SEQ ID NO: 3946301 - DNA, 13 bp, Homo sapiens
tcagaccctaccc

SEQ ID NO: 3946302 - DNA, 17 bp, Homo sapiens
tcagacctctgatccct

SEQ ID NO: 3946303 - DNA, 22 bp, Homo sapiens
tcagacctgacaccgtccctca

SEQ ID NO: 3946304 - DNA, 13 bp, Homo sapiens
tcagagaatttct

SEQ ID NO: 3946305 - DNA, 14 bp, Homo sapiens
tcagagagagtgtt

SEQ ID NO: 3946306 - DNA, 22 bp, Homo sapiens
tcagagaggcatgtgatgtgca

SEQ ID NO: 3946307 - DNA, 17 bp, Homo sapiens
tcagagaggtctcaggt

SEQ ID NO: 3946308 - DNA, 23 bp, Homo sapiens
tcagagatggtaatctacagctc

SEQ ID NO: 3946309 - DNA, 21 bp, Homo sapiens
tcagagccacccctaaagaga

SEQ ID NO: 3946310 - DNA, 17 bp, Homo sapiens
tcagagccaggctctgc

SEQ ID NO: 3946311 - DNA, 19 bp, Homo sapiens
tcagagccaggctctgcct

SEQ ID NO: 3946312 - DNA, 15 bp, Homo sapiens
tcagagccagtgaag

SEQ ID NO: 3946313 - DNA, 13 bp, Homo sapiens
tcagagcctagcc

SEQ ID NO: 3946314 - DNA, 22 bp, Homo sapiens
tcagagcctagccacctcccac

SEQ ID NO: 3946315 - DNA, 9 bp, Homo sapiens
tcagagctc

SEQ ID NO: 3946316 - DNA, 21 bp, Homo sapiens
tcagagctcttcaagctgtcc

SEQ ID NO: 3946317 - DNA, 13 bp, Homo sapiens
tcagaggagaaga

SEQ ID NO: 3946318 - DNA, 21 bp, Homo sapiens
tcagagtgacatccaggagga

SEQ ID NO: 3946319 - DNA, 21 bp, Homo sapiens
tcagatattttttcagaaata

SEQ ID NO: 3946320 - DNA, 14 bp, Homo sapiens
tcagatctgaacac

SEQ ID NO: 3946321 - DNA, 15 bp, Homo sapiens
tcagatgggaagaca

SEQ ID NO: 3946322 - DNA, 19 bp, Homo sapiens
tcagattcccagagcaaaa

SEQ ID NO: 3946323 - DNA, 21 bp, Homo sapiens
tcagattcccagagcaaaata

SEQ ID NO: 3946324 - DNA, 16 bp, Homo sapiens
tcagattgacaaggta

SEQ ID NO: 3946325 - DNA, 16 bp, Homo sapiens
tcagatttgctgttca

SEQ ID NO: 3946326 - DNA, 18 bp, Homo sapiens
tcagcaatagggtgcagt

SEQ ID NO: 3946327 - DNA, 14 bp, Homo sapiens
tcagcacaccccaa

SEQ ID NO: 3946328 - DNA, 17 bp, Homo sapiens
tcagcacccctgtctct

SEQ ID NO: 3946329 - DNA, 15 bp, Homo sapiens
tcagcaccctgggtg

SEQ ID NO: 3946330 - DNA, 17 bp, Homo sapiens
tcagcaccctgggtgcc

SEQ ID NO: 3946331 - DNA, 16 bp, Homo sapiens
tcagcactcagaaaag

SEQ ID NO: 3946332 - DNA, 14 bp, Homo sapiens
tcagcactgaaaat

SEQ ID NO: 3946333 - DNA, 12 bp, Homo sapiens
tcagcagccctc

SEQ ID NO: 3946334 - DNA, 16 bp, Homo sapiens
tcagcagccctcctca

SEQ ID NO: 3946335 - DNA, 17 bp, Homo sapiens
tcagcagccctcctcac

SEQ ID NO: 3946336 - DNA, 13 bp, Homo sapiens
tcagcaggcccta

SEQ ID NO: 3946337 - DNA, 18 bp, Homo sapiens
tcagcattaggcttttaa

SEQ ID NO: 3946338 - DNA, 18 bp, Homo sapiens
tcagcattattcttcaga

SEQ ID NO: 3946339 - DNA, 20 bp, Homo sapiens
tcagcattctcactcctacc

SEQ ID NO: 3946340 - DNA, 19 bp, Homo sapiens
tcagccagccgccctgggc

SEQ ID NO: 3946341 - DNA, 18 bp, Homo sapiens
tcagccagggccaggggt

SEQ ID NO: 3946342 - DNA, 13 bp, Homo sapiens
tcagcccctcctc

SEQ ID NO: 3946343 - DNA, 16 bp, Homo sapiens
tcagcccctcctctgc

SEQ ID NO: 3946344 - DNA, 19 bp, Homo sapiens
tcagcccctcctctgccac

SEQ ID NO: 3946345 - DNA, 20 bp, Homo sapiens
tcagcccctcctctgccacc

SEQ ID NO: 3946346 - DNA, 23 bp, Homo sapiens
tcagcccctcctctgccacctcc

SEQ ID NO: 3946347 - DNA, 13 bp, Homo sapiens
tcagcccgggaca

SEQ ID NO: 3946348 - DNA, 12 bp, Homo sapiens
tcagccctgggc

SEQ ID NO: 3946349 - DNA, 21 bp, Homo sapiens
tcagccctgggccccaccacc

SEQ ID NO: 3946350 - DNA, 22 bp, Homo sapiens
tcagccgagccgggcctggggc

SEQ ID NO: 3946351 - DNA, 20 bp, Homo sapiens
tcagcctcccgagtagctgg

SEQ ID NO: 3946352 - DNA, 22 bp, Homo sapiens
tcagcctcctaagcagctggga

SEQ ID NO: 3946353 - DNA, 23 bp, Homo sapiens
tcagcctcctaagcagctgggac

SEQ ID NO: 3946354 - DNA, 10 bp, Homo sapiens
tcagcctgag

SEQ ID NO: 3946355 - DNA, 15 bp, Homo sapiens
tcagcctgagtctcc

SEQ ID NO: 3946356 - DNA, 18 bp, Homo sapiens
tcagcctggccatcccca

SEQ ID NO: 3946357 - DNA, 14 bp, Homo sapiens
tcagcgagaccctt

SEQ ID NO: 3946358 - DNA, 14 bp, Homo sapiens
tcagcgtcccctgc

SEQ ID NO: 3946359 - DNA, 16 bp, Homo sapiens
tcagcgtgcttagcct

SEQ ID NO: 3946360 - DNA, 19 bp, Homo sapiens
tcagctacttaagagaaat

SEQ ID NO: 3946361 - DNA, 12 bp, Homo sapiens
tcagctcacacc

SEQ ID NO: 3946362 - DNA, 15 bp, Homo sapiens
tcagctcagcctccc

SEQ ID NO: 3946363 - DNA, 17 bp, Homo sapiens
tcagctcccctcggaga

SEQ ID NO: 3946364 - DNA, 21 bp, Homo sapiens
tcagctcccctcggagaagag

SEQ ID NO: 3946365 - DNA, 19 bp, Homo sapiens
tcagctcccttcccctgcc

SEQ ID NO: 3946366 - DNA, 15 bp, Homo sapiens
tcagctctcctgctg

SEQ ID NO: 3946367 - DNA, 14 bp, Homo sapiens
tcagctctctgtat

SEQ ID NO: 3946368 - DNA, 20 bp, Homo sapiens
tcagctctctgtataaacat

SEQ ID NO: 3946369 - DNA, 15 bp, Homo sapiens
tcagctgcacattcc

SEQ ID NO: 3946370 - DNA, 17 bp, Homo sapiens
tcagctgcacattcctg

SEQ ID NO: 3946371 - DNA, 16 bp, Homo sapiens
tcagctgccaagcact

SEQ ID NO: 3946372 - DNA, 22 bp, Homo sapiens
tcagcttatgggatccttgtct

SEQ ID NO: 3946373 - DNA, 17 bp, Homo sapiens
tcagcttcagactttta

SEQ ID NO: 3946374 - DNA, 14 bp, Homo sapiens
tcagctttcagagc

SEQ ID NO: 3946375 - DNA, 17 bp, Homo sapiens
tcagctttcagagccag

SEQ ID NO: 3946376 - DNA, 20 bp, Homo sapiens
tcagctttcagagccagtga

SEQ ID NO: 3946377 - DNA, 17 bp, Homo sapiens
tcagcttttaataaaat

SEQ ID NO: 3946378 - DNA, 18 bp, Homo sapiens
tcaggaaaaggcctgggg

SEQ ID NO: 3946379 - DNA, 15 bp, Homo sapiens
tcaggacatggggca

SEQ ID NO: 3946380 - DNA, 15 bp, Homo sapiens
tcaggacccaggccc

SEQ ID NO: 3946381 - DNA, 16 bp, Homo sapiens
tcaggacccaggccct

SEQ ID NO: 3946382 - DNA, 14 bp, Homo sapiens
tcatacctctgacc

SEQ ID NO: 3946383 - DNA, 20 bp, Homo sapiens
tcataggcggtcatgtgtgc

SEQ ID NO: 3946384 - DNA, 16 bp, Homo sapiens
tcataggtatttcaaa

SEQ ID NO: 3946385 - DNA, 13 bp, Homo sapiens
tcatatattcatg

SEQ ID NO: 3946386 - DNA, 15 bp, Homo sapiens
tcatatattcatgta

SEQ ID NO: 3946387 - DNA, 11 bp, Homo sapiens
tcatatgaaaa

SEQ ID NO: 3946388 - DNA, 21 bp, Homo sapiens
tcatatgaaaaaaatgcattt

SEQ ID NO: 3946389 - DNA, 19 bp, Homo sapiens
tcatatgacatgccaccct

SEQ ID NO: 3946390 - DNA, 19 bp, Homo sapiens
tcatatttaaagacaggga

SEQ ID NO: 3946391 - DNA, 12 bp, Homo sapiens
tcatcaattccc

SEQ ID NO: 3946392 - DNA, 21 bp, Homo sapiens
tcatcaatttaaaatcattca

SEQ ID NO: 3946393 - DNA, 19 bp, Homo sapiens
tcatcaatttttatacata

SEQ ID NO: 3946394 - DNA, 22 bp, Homo sapiens
tcatcaatttttatacatatca

SEQ ID NO: 3946395 - DNA, 12 bp, Homo sapiens
tcatcacccagt

SEQ ID NO: 3946396 - DNA, 15 bp, Homo sapiens
tcatcacccagtcct

SEQ ID NO: 3946397 - DNA, 16 bp, Homo sapiens
tcatcacccagtcctg

SEQ ID NO: 3946398 - DNA, 17 bp, Homo sapiens
tcatcacccagtcctgg

SEQ ID NO: 3946399 - DNA, 14 bp, Homo sapiens
tcatcactccctgg

SEQ ID NO: 3946400 - DNA, 15 bp, Homo sapiens
tcatcactggatgaa

SEQ ID NO: 3946401 - DNA, 17 bp, Homo sapiens
tcatcacttttcagtga

SEQ ID NO: 3946402 - DNA, 15 bp, Homo sapiens
tcatcagaagataac

SEQ ID NO: 3946403 - DNA, 14 bp, Homo sapiens
tcatcagcatacct

SEQ ID NO: 3946404 - DNA, 21 bp, Homo sapiens
tcatcagcatacctttattgt

SEQ ID NO: 3946405 - DNA, 17 bp, Homo sapiens
tcatcattccttgagaa

SEQ ID NO: 3946406 - DNA, 21 bp, Homo sapiens
tcatccagttgcaataaaata

SEQ ID NO: 3946407 - DNA, 22 bp, Homo sapiens
tcatccagtttgttctccgggt

SEQ ID NO: 3946408 - DNA, 21 bp, Homo sapiens
tcatcccatctaagctgcagc

SEQ ID NO: 3946409 - DNA, 18 bp, Homo sapiens
tcatcccctcgtcctgtc

SEQ ID NO: 3946410 - DNA, 14 bp, Homo sapiens
tcatccctttccag

SEQ ID NO: 3946411 - DNA, 16 bp, Homo sapiens
tcatccgtttcagctg

SEQ ID NO: 3946412 - DNA, 22 bp, Homo sapiens
tcatcctccttataagcccagc

SEQ ID NO: 3946413 - DNA, 12 bp, Homo sapiens
tcatcctggcct

SEQ ID NO: 3946414 - DNA, 13 bp, Homo sapiens
tcatcctggcctc

SEQ ID NO: 3946415 - DNA, 17 bp, Homo sapiens
tcatcctgtgtggggag

SEQ ID NO: 3946416 - DNA, 22 bp, Homo sapiens
tcatcctgtgtggggaggcagc

SEQ ID NO: 3946417 - DNA, 19 bp, Homo sapiens
tcatcgaaaattcatttca

SEQ ID NO: 3946418 - DNA, 21 bp, Homo sapiens
tcatcgaaaattcatttcaca

SEQ ID NO: 3946419 - DNA, 18 bp, Homo sapiens
tcatcgaacaaactgatg

SEQ ID NO: 3946420 - DNA, 20 bp, Homo sapiens
tcatctaaaatttttctaga

SEQ ID NO: 3946421 - DNA, 14 bp, Homo sapiens
tcatctagcccctt

SEQ ID NO: 3946422 - DNA, 15 bp, Homo sapiens
tcatctagccccttc

SEQ ID NO: 3946423 - DNA, 20 bp, Homo sapiens
tcatctcatttaatcctccc

SEQ ID NO: 3946424 - DNA, 21 bp, Homo sapiens
tcatctcatttaatcctccct

SEQ ID NO: 3946425 - DNA, 13 bp, Homo sapiens
tcatctccagtgt

SEQ ID NO: 3946426 - DNA, 16 bp, Homo sapiens
tcatctctctggggcc

SEQ ID NO: 3946427 - DNA, 22 bp, Homo sapiens
tcatctctctggggccctgggc

SEQ ID NO: 3946428 - DNA, 11 bp, Homo sapiens
tcatctgagga

SEQ ID NO: 3946429 - DNA, 14 bp, Homo sapiens
tcatctgtgtgaaa

SEQ ID NO: 3946430 - DNA, 18 bp, Homo sapiens
tcatcttgacatgtaatg

SEQ ID NO: 3946431 - DNA, 13 bp, Homo sapiens
tcatgaaaagtgc

SEQ ID NO: 3946432 - DNA, 16 bp, Homo sapiens
tcatgaacttggctgt

SEQ ID NO: 3946433 - DNA, 18 bp, Homo sapiens
tcatgaacttggctgtaa

SEQ ID NO: 3946434 - DNA, 20 bp, Homo sapiens
tcatgaattcttatgcttat

SEQ ID NO: 3946435 - DNA, 14 bp, Homo sapiens
tcatgacatgttat

SEQ ID NO: 3946436 - DNA, 17 bp, Homo sapiens
tcatgacatgttatata

SEQ ID NO: 3946437 - DNA, 17 bp, Homo sapiens
tcatgagtcagacattt

SEQ ID NO: 3946438 - DNA, 22 bp, Homo sapiens
tcatgagtggatggatggacag

SEQ ID NO: 3946439 - DNA, 15 bp, Homo sapiens
tcatgatctccctgc

SEQ ID NO: 3946440 - DNA, 17 bp, Homo sapiens
tcatgatctccctgccg

SEQ ID NO: 3946441 - DNA, 11 bp, Homo sapiens
tcatgattttt

SEQ ID NO: 3946442 - DNA, 19 bp, Homo sapiens
tcatgccatctgttttcaa

SEQ ID NO: 3946443 - DNA, 13 bp, Homo sapiens
tcatgcctcagtt

SEQ ID NO: 3946444 - DNA, 14 bp, Homo sapiens
tcatgcctcagttt

SEQ ID NO: 3946445 - DNA, 17 bp, Homo sapiens
tcatgcctcagtttccc

SEQ ID NO: 3946446 - DNA, 18 bp, Homo sapiens
tcatgcctcagtttcccc

SEQ ID NO: 3946447 - DNA, 22 bp, Homo sapiens
tcatgcctctgaggccagcctg

SEQ ID NO: 3946448 - DNA, 14 bp, Homo sapiens
tcatgcctggcccc

SEQ ID NO: 3946449 - DNA, 21 bp, Homo sapiens
tcatgcctggcccccctccag

SEQ ID NO: 3946450 - DNA, 22 bp, Homo sapiens
tcatgcctggcccccctccagg

SEQ ID NO: 3946451 - DNA, 20 bp, Homo sapiens
tcatgctttaaagtgtaata

SEQ ID NO: 3946452 - DNA, 14 bp, Homo sapiens
tcatggagctgagg

SEQ ID NO: 3946453 - DNA, 18 bp, Homo sapiens
tcatggcagatgtaggag

SEQ ID NO: 3946454 - DNA, 20 bp, Homo sapiens
tcatggcctattatattaaa

SEQ ID NO: 3946455 - DNA, 22 bp, Homo sapiens
tcatggcgtaatgggcctgccc

SEQ ID NO: 3946456 - DNA, 18 bp, Homo sapiens
tcatggcttaatgtttat

SEQ ID NO: 3946457 - DNA, 12 bp, Homo sapiens
tcatggtcagct

SEQ ID NO: 3946458 - DNA, 15 bp, Homo sapiens
tcatggtcagctcac

SEQ ID NO: 3946459 - DNA, 15 bp, Homo sapiens
tcatgtaataaatct

SEQ ID NO: 3946460 - DNA, 15 bp, Homo sapiens
tcatgtacttcctgt

SEQ ID NO: 3946461 - DNA, 17 bp, Homo sapiens
tcatgtacttcctgtgt

SEQ ID NO: 3946462 - DNA, 18 bp, Homo sapiens
tcatgtacttcctgtgta

SEQ ID NO: 3946463 - DNA, 13 bp, Homo sapiens
tcatgtgtgcatg

SEQ ID NO: 3946464 - DNA, 13 bp, Homo sapiens
tcatgtttgtaaa

SEQ ID NO: 3946465 - DNA, 16 bp, Homo sapiens
tcattactgcctttgg

SEQ ID NO: 3946466 - DNA, 13 bp, Homo sapiens
tcattatctcaaa

SEQ ID NO: 3946467 - DNA, 17 bp, Homo sapiens
tcattcaagcctgtgaa

SEQ ID NO: 3946468 - DNA, 22 bp, Homo sapiens
tcattcaccaaatgatgccact

SEQ ID NO: 3946469 - DNA, 21 bp, Homo sapiens
tccacggtgcgtggctgtggc

SEQ ID NO: 3946470 - DNA, 22 bp, Homo sapiens
tccacggtgcgtggctgtggca

SEQ ID NO: 3946471 - DNA, 16 bp, Homo sapiens
tccacgtccccctggg

SEQ ID NO: 3946472 - DNA, 18 bp, Homo sapiens
tccacgtccccctggggc

SEQ ID NO: 3946473 - DNA, 18 bp, Homo sapiens
tccactactgtgtagact

SEQ ID NO: 3946474 - DNA, 14 bp, Homo sapiens
tccactcactccag

SEQ ID NO: 3946475 - DNA, 15 bp, Homo sapiens
tccactcactccagc

SEQ ID NO: 3946476 - DNA, 19 bp, Homo sapiens
tccactcccccacctgaca

SEQ ID NO: 3946477 - DNA, 12 bp, Homo sapiens
tccactctcagg

SEQ ID NO: 3946478 - DNA, 16 bp, Homo sapiens
tccactggctccacat

SEQ ID NO: 3946479 - DNA, 19 bp, Homo sapiens
tccactgtcaccctccacc

SEQ ID NO: 3946480 - DNA, 23 bp, Homo sapiens
tccacttagaaattgcatttcct

SEQ ID NO: 3946481 - DNA, 14 bp, Homo sapiens
tccacttctctaga

SEQ ID NO: 3946482 - DNA, 13 bp, Homo sapiens
tccagaaaatata

SEQ ID NO: 3946483 - DNA, 14 bp, Homo sapiens
tccagaaaatataa

SEQ ID NO: 3946484 - DNA, 16 bp, Homo sapiens
tccagaaaatataaat

SEQ ID NO: 3946485 - DNA, 20 bp, Homo sapiens
tccagaaaatataaatgcat

SEQ ID NO: 3946486 - DNA, 22 bp, Homo sapiens
tccagaagaatattcaggactt

SEQ ID NO: 3946487 - DNA, 22 bp, Homo sapiens
tccagaataaaacgcaaagggc

SEQ ID NO: 3946488 - DNA, 17 bp, Homo sapiens
tccagaataagtgctgt

SEQ ID NO: 3946489 - DNA, 15 bp, Homo sapiens
tccagaatctgctgt

SEQ ID NO: 3946490 - DNA, 18 bp, Homo sapiens
tccagaatctgctgttgc

SEQ ID NO: 3946491 - DNA, 19 bp, Homo sapiens
tccagaatctgctgttgcc

SEQ ID NO: 3946492 - DNA, 18 bp, Homo sapiens
tccagaatggtctttcta

SEQ ID NO: 3946493 - DNA, 13 bp, Homo sapiens
tccagaccacctg

SEQ ID NO: 3946494 - DNA, 16 bp, Homo sapiens
tccagaccacctgcca

SEQ ID NO: 3946495 - DNA, 17 bp, Homo sapiens
tccagaccacctgccag

SEQ ID NO: 3946496 - DNA, 20 bp, Homo sapiens
tccagaccacctgccagcca

SEQ ID NO: 3946497 - DNA, 21 bp, Homo sapiens
tccagaccacctgccagccat

SEQ ID NO: 3946498 - DNA, 23 bp, Homo sapiens
tccagaccacctgccagccatca

SEQ ID NO: 3946499 - DNA, 22 bp, Homo sapiens
tccagaccattgtcttccaacc

SEQ ID NO: 3946500 - DNA, 16 bp, Homo sapiens
tccagacccctggctt

SEQ ID NO: 3946501 - DNA, 20 bp, Homo sapiens
tccagacccctgtggcagac

SEQ ID NO: 3946502 - DNA, 21 bp, Homo sapiens
tccagacccctgtggcagacc

SEQ ID NO: 3946503 - DNA, 17 bp, Homo sapiens
tccagaccctgcctgag

SEQ ID NO: 3946504 - DNA, 16 bp, Homo sapiens
tccagagagaggatgc

SEQ ID NO: 3946505 - DNA, 21 bp, Homo sapiens
tccagagagaggatgcagagg

SEQ ID NO: 3946506 - DNA, 15 bp, Homo sapiens
tccagagagtcctct

SEQ ID NO: 3946507 - DNA, 18 bp, Homo sapiens
tccagagagtcctctgga

SEQ ID NO: 3946508 - DNA, 15 bp, Homo sapiens
tccagagagtggctc

SEQ ID NO: 3946509 - DNA, 17 bp, Homo sapiens
tccagagagtggctcct

SEQ ID NO: 3946510 - DNA, 22 bp, Homo sapiens
tccagagagtggctcctcccgg

SEQ ID NO: 3946511 - DNA, 13 bp, Homo sapiens
tccagagccagcc

SEQ ID NO: 3946512 - DNA, 15 bp, Homo sapiens
tccagagccagcctg

SEQ ID NO: 3946513 - DNA, 17 bp, Homo sapiens
tccagagccagcctggg

SEQ ID NO: 3946514 - DNA, 20 bp, Homo sapiens
tccagagccagcctgggact

SEQ ID NO: 3946515 - DNA, 20 bp, Homo sapiens
tccagaggctattattttca

SEQ ID NO: 3946516 - DNA, 16 bp, Homo sapiens
tccagagggacagggt

SEQ ID NO: 3946517 - DNA, 14 bp, Homo sapiens
tccagagtctgagc

SEQ ID NO: 3946518 - DNA, 22 bp, Homo sapiens
tccagagtctgagcccccggct

SEQ ID NO: 3946519 - DNA, 18 bp, Homo sapiens
tccagagtgtgcagactg

SEQ ID NO: 3946520 - DNA, 19 bp, Homo sapiens
tccagagtgtgcagactga

SEQ ID NO: 3946521 - DNA, 15 bp, Homo sapiens
tccagatgccttcct

SEQ ID NO: 3946522 - DNA, 19 bp, Homo sapiens
tccagatgccttcctgtct

SEQ ID NO: 3946523 - DNA, 22 bp, Homo sapiens
tccagattttttacagctgcct

SEQ ID NO: 3946524 - DNA, 17 bp, Homo sapiens
tccagcatccagcctgt

SEQ ID NO: 3946525 - DNA, 13 bp, Homo sapiens
tccagcatcctgc

SEQ ID NO: 3946526 - DNA, 12 bp, Homo sapiens
tccagcccacac

SEQ ID NO: 3946527 - DNA, 13 bp, Homo sapiens
tccagcccacacc

SEQ ID NO: 3946528 - DNA, 14 bp, Homo sapiens
tccagcccacaccc

SEQ ID NO: 3946529 - DNA, 16 bp, Homo sapiens
tccagcccacacccct

SEQ ID NO: 3946530 - DNA, 18 bp, Homo sapiens
tccagcccacacccctcc

SEQ ID NO: 3946531 - DNA, 18 bp, Homo sapiens
tccagccctgtcccctga

SEQ ID NO: 3946532 - DNA, 15 bp, Homo sapiens
tccagcctctcccgg

SEQ ID NO: 3946533 - DNA, 22 bp, Homo sapiens
tccagcgcctgccctccctggg

SEQ ID NO: 3946534 - DNA, 17 bp, Homo sapiens
tccagctagccaactcc

SEQ ID NO: 3946535 - DNA, 13 bp, Homo sapiens
tccagctccagtt

SEQ ID NO: 3946536 - DNA, 13 bp, Homo sapiens
tccaggaaggcag

SEQ ID NO: 3946537 - DNA, 19 bp, Homo sapiens
tccaggaaggcagctgctc

SEQ ID NO: 3946538 - DNA, 23 bp, Homo sapiens
tccaggaaggcagctgctcttag

SEQ ID NO: 3946539 - DNA, 22 bp, Homo sapiens
tccaggaatgcctcctccctgg

SEQ ID NO: 3946540 - DNA, 18 bp, Homo sapiens
tccaggacatgatactga

SEQ ID NO: 3946541 - DNA, 13 bp, Homo sapiens
tccaggagcctgg

SEQ ID NO: 3946542 - DNA, 14 bp, Homo sapiens
tccaggatcctgca

SEQ ID NO: 3946543 - DNA, 15 bp, Homo sapiens
tccaggcaccatctc

SEQ ID NO: 3946544 - DNA, 21 bp, Homo sapiens
tccaggcacccttctttcctc

SEQ ID NO: 3946545 - DNA, 23 bp, Homo sapiens
tccaggcacccttctttcctctt

SEQ ID NO: 3946546 - DNA, 18 bp, Homo sapiens
tccaggcatgctggcctc

SEQ ID NO: 3946547 - DNA, 21 bp, Homo sapiens
tccaggccactgtggccagag

SEQ ID NO: 3946548 - DNA, 20 bp, Homo sapiens
tccaggcccctgaggactgg

SEQ ID NO: 3946549 - DNA, 21 bp, Homo sapiens
tccaggcccctgaggactgga

SEQ ID NO: 3946550 - DNA, 19 bp, Homo sapiens
tccaggctcttcctggacc

SEQ ID NO: 3946551 - DNA, 23 bp, Homo sapiens
tccaggctctttggggtcagcca

SEQ ID NO: 3946552 - DNA, 22 bp, Homo sapiens
tccagggcagcctccaccttgc

SEQ ID NO: 3946553 - DNA, 21 bp, Homo sapiens
tccagggcatccgcagcccag

SEQ ID NO: 3946554 - DNA, 17 bp, Homo sapiens
tccagggccacgtgcca

SEQ ID NO: 3946555 - DNA, 19 bp, Homo sapiens
tcccagagtcagaggagaa

SEQ ID NO: 3946556 - DNA, 21 bp, Homo sapiens
tcccagagtcagaggagaaga

SEQ ID NO: 3946557 - DNA, 22 bp, Homo sapiens
tcccagagtcagaggagaagag

SEQ ID NO: 3946558 - DNA, 16 bp, Homo sapiens
tcccagagtgctagga

SEQ ID NO: 3946559 - DNA, 21 bp, Homo sapiens
tcccagcagctgggccggcca

SEQ ID NO: 3946560 - DNA, 22 bp, Homo sapiens
tcccagcagctgggccggccag

SEQ ID NO: 3946561 - DNA, 23 bp, Homo sapiens
tcccagcagctgggccggccagc

SEQ ID NO: 3946562 - DNA, 22 bp, Homo sapiens
tcccagccactcgggaggctga

SEQ ID NO: 3946563 - DNA, 15 bp, Homo sapiens
tcccagccctatgga

SEQ ID NO: 3946564 - DNA, 17 bp, Homo sapiens
tcccagccctatggatg

SEQ ID NO: 3946565 - DNA, 14 bp, Homo sapiens
tcccagccctgcca

SEQ ID NO: 3946566 - DNA, 17 bp, Homo sapiens
tcccagccctgccagga

SEQ ID NO: 3946567 - DNA, 10 bp, Homo sapiens
tcccagcctg

SEQ ID NO: 3946568 - DNA, 21 bp, Homo sapiens
tcccagctctccctctggccc

SEQ ID NO: 3946569 - DNA, 22 bp, Homo sapiens
tcccagctgtctgtgtcagcct

SEQ ID NO: 3946570 - DNA, 16 bp, Homo sapiens
tcccaggaactgggcc

SEQ ID NO: 3946571 - DNA, 15 bp, Homo sapiens
tcccaggaggggcct

SEQ ID NO: 3946572 - DNA, 21 bp, Homo sapiens
tcccaggaggggcctctgaaa

SEQ ID NO: 3946573 - DNA, 11 bp, Homo sapiens
tcccaggcccc

SEQ ID NO: 3946574 - DNA, 16 bp, Homo sapiens
tcccagggcctgtctc

SEQ ID NO: 3946575 - DNA, 12 bp, Homo sapiens
tcccaggggacc

SEQ ID NO: 3946576 - DNA, 17 bp, Homo sapiens
tcccaggggaccacacc

SEQ ID NO: 3946577 - DNA, 14 bp, Homo sapiens
tcccataagctaag

SEQ ID NO: 3946578 - DNA, 14 bp, Homo sapiens
tcccatagcgctgg

SEQ ID NO: 3946579 - DNA, 22 bp, Homo sapiens
tcccatcactggagcaccaggc

SEQ ID NO: 3946580 - DNA, 18 bp, Homo sapiens
tcccatctaagctgcagc

SEQ ID NO: 3946581 - DNA, 17 bp, Homo sapiens
tcccatgatccagaact

SEQ ID NO: 3946582 - DNA, 21 bp, Homo sapiens
tcccatgcacacaaacacctc

SEQ ID NO: 3946583 - DNA, 23 bp, Homo sapiens
tcccatgcacacaaacacctcct

SEQ ID NO: 3946584 - DNA, 12 bp, Homo sapiens
tcccatgccctg

SEQ ID NO: 3946585 - DNA, 15 bp, Homo sapiens
tcccatgctgaatta

SEQ ID NO: 3946586 - DNA, 16 bp, Homo sapiens
tcccatgctgaattat

SEQ ID NO: 3946587 - DNA, 17 bp, Homo sapiens
tcccatgctgaattatt

SEQ ID NO: 3946588 - DNA, 13 bp, Homo sapiens
tcccatggccttc

SEQ ID NO: 3946589 - DNA, 21 bp, Homo sapiens
tcccatgtgtgactccagcct

SEQ ID NO: 3946590 - DNA, 21 bp, Homo sapiens
tccccaaaacctttccccaga

SEQ ID NO: 3946591 - DNA, 22 bp, Homo sapiens
tccccaaaacctttccccagac

SEQ ID NO: 3946592 - DNA, 17 bp, Homo sapiens
tccccaaacccatcaga

SEQ ID NO: 3946593 - DNA, 18 bp, Homo sapiens
tccccaaacccatcagac

SEQ ID NO: 3946594 - DNA, 15 bp, Homo sapiens
tccccaaactgtgcc

SEQ ID NO: 3946595 - DNA, 22 bp, Homo sapiens
tccccaaactgtgccctgcctt

SEQ ID NO: 3946596 - DNA, 14 bp, Homo sapiens
tccccaaaggcatc

SEQ ID NO: 3946597 - DNA, 13 bp, Homo sapiens
tccccaccccact

SEQ ID NO: 3946598 - DNA, 17 bp, Homo sapiens
tccccacccccgctggg

SEQ ID NO: 3946599 - DNA, 18 bp, Homo sapiens
tccccacctcttccttcc

SEQ ID NO: 3946600 - DNA, 16 bp, Homo sapiens
tccccaccttccccag

SEQ ID NO: 3946601 - DNA, 18 bp, Homo sapiens
tccccacgagtcacctgc

SEQ ID NO: 3946602 - DNA, 22 bp, Homo sapiens
tccccacgagtcacctgcaagc

SEQ ID NO: 3946603 - DNA, 23 bp, Homo sapiens
tccccacgagtcacctgcaagcc

SEQ ID NO: 3946604 - DNA, 16 bp, Homo sapiens
tccccactctgctctg

SEQ ID NO: 3946605 - DNA, 17 bp, Homo sapiens
tccccactctgctctga

SEQ ID NO: 3946606 - DNA, 12 bp, Homo sapiens
tccccagacaca

SEQ ID NO: 3946607 - DNA, 23 bp, Homo sapiens
tccccagacacattctcctgtgc

SEQ ID NO: 3946608 - DNA, 12 bp, Homo sapiens
tccccagactca

SEQ ID NO: 3946609 - DNA, 17 bp, Homo sapiens
tccccagactcagctcc

SEQ ID NO: 3946610 - DNA, 13 bp, Homo sapiens
tccccagccctgg

SEQ ID NO: 3946611 - DNA, 22 bp, Homo sapiens
tccccagcccttctgcctttct

SEQ ID NO: 3946612 - DNA, 12 bp, Homo sapiens
tccccagctggt

SEQ ID NO: 3946613 - DNA, 14 bp, Homo sapiens
tccccaggccaggc

SEQ ID NO: 3946614 - DNA, 19 bp, Homo sapiens
tccccaggccaggccacca

SEQ ID NO: 3946615 - DNA, 22 bp, Homo sapiens
tccccaggcctccagcctctcc

SEQ ID NO: 3946616 - DNA, 12 bp, Homo sapiens
tccccagggccc

SEQ ID NO: 3946617 - DNA, 14 bp, Homo sapiens
tccccagggcccct

SEQ ID NO: 3946618 - DNA, 22 bp, Homo sapiens
tccccagggcccctccctctgc

SEQ ID NO: 3946619 - DNA, 14 bp, Homo sapiens
tccccaggggagag

SEQ ID NO: 3946620 - DNA, 22 bp, Homo sapiens
tccccaggtggctgacccagtc

SEQ ID NO: 3946621 - DNA, 17 bp, Homo sapiens
tccccagtttgcagaaa

SEQ ID NO: 3946622 - DNA, 19 bp, Homo sapiens
tccccatcatcccagctgc

SEQ ID NO: 3946623 - DNA, 14 bp, Homo sapiens
tccccatctgggtc

SEQ ID NO: 3946624 - DNA, 19 bp, Homo sapiens
tcccccacagtttgatgtc

SEQ ID NO: 3946625 - DNA, 18 bp, Homo sapiens
tcccccaccccctcccca

SEQ ID NO: 3946626 - DNA, 14 bp, Homo sapiens
tcccccacttggga

SEQ ID NO: 3946627 - DNA, 13 bp, Homo sapiens
tcccccagacaga

SEQ ID NO: 3946628 - DNA, 18 bp, Homo sapiens
tcccccatcccctttcct

SEQ ID NO: 3946629 - DNA, 14 bp, Homo sapiens
tcccccatgtggct

SEQ ID NO: 3946630 - DNA, 23 bp, Homo sapiens
tccccccactgcaggccccgctt

SEQ ID NO: 3946631 - DNA, 20 bp, Homo sapiens
tcccccgacactgctgcacc

SEQ ID NO: 3946632 - DNA, 17 bp, Homo sapiens
tcccccgcagtccccag

SEQ ID NO: 3946633 - DNA, 21 bp, Homo sapiens
tcccccgcagtccccagccct

SEQ ID NO: 3946634 - DNA, 22 bp, Homo sapiens
tccccctcagatgatctctcca

SEQ ID NO: 3946635 - DNA, 13 bp, Homo sapiens
tccccctgcccca

SEQ ID NO: 3946636 - DNA, 20 bp, Homo sapiens
tccccctggggcttctcctg

SEQ ID NO: 3946637 - DNA, 16 bp, Homo sapiens
tccccctttcaaggaa

SEQ ID NO: 3946638 - DNA, 24 bp, Homo sapiens
tccccgaaacaggctactctcctc

SEQ ID NO: 3946639 - DNA, 11 bp, Homo sapiens
tccccgcctgt

SEQ ID NO: 3946640 - DNA, 18 bp, Homo sapiens
tccccgcctgtcctgcct

SEQ ID NO: 3946641 - DNA, 20 bp, Homo sapiens
tccctggctctcagaaggta

SEQ ID NO: 3946642 - DNA, 19 bp, Homo sapiens
tccctggcttgtaactcca

SEQ ID NO: 3946643 - DNA, 19 bp, Homo sapiens
tccctgggaactcatcctg

SEQ ID NO: 3946644 - DNA, 16 bp, Homo sapiens
tccctgggcagaaagt

SEQ ID NO: 3946645 - DNA, 18 bp, Homo sapiens
tccctgggcccctccacg

SEQ ID NO: 3946646 - DNA, 21 bp, Homo sapiens
tccctgggcctgctgctgaga

SEQ ID NO: 3946647 - DNA, 18 bp, Homo sapiens
tccctgggggaagccctg

SEQ ID NO: 3946648 - DNA, 20 bp, Homo sapiens
tccctgggggaagccctgga

SEQ ID NO: 3946649 - DNA, 17 bp, Homo sapiens
tccctggtccctcgtcc

SEQ ID NO: 3946650 - DNA, 14 bp, Homo sapiens
tccctggtcccttg

SEQ ID NO: 3946651 - DNA, 15 bp, Homo sapiens
tccctgtcaccaagc

SEQ ID NO: 3946652 - DNA, 22 bp, Homo sapiens
tccctgtcaccaagctcacagt

SEQ ID NO: 3946653 - DNA, 15 bp, Homo sapiens
tccctgtcctcctcg

SEQ ID NO: 3946654 - DNA, 11 bp, Homo sapiens
tccctgtgggg

SEQ ID NO: 3946655 - DNA, 12 bp, Homo sapiens
tccctgtggggg

SEQ ID NO: 3946656 - DNA, 19 bp, Homo sapiens
tccctgtgggggtggccat

SEQ ID NO: 3946657 - DNA, 23 bp, Homo sapiens
tccctgtgggggtggccatccct

SEQ ID NO: 3946658 - DNA, 11 bp, Homo sapiens
tccctgtttaa

SEQ ID NO: 3946659 - DNA, 14 bp, Homo sapiens
tccctgtttaatat

SEQ ID NO: 3946660 - DNA, 22 bp, Homo sapiens
tcccttagtaatcccccttgcc

SEQ ID NO: 3946661 - DNA, 16 bp, Homo sapiens
tcccttcctggcctca

SEQ ID NO: 3946662 - DNA, 17 bp, Homo sapiens
tcccttctctccttccc

SEQ ID NO: 3946663 - DNA, 16 bp, Homo sapiens
tcccttgagacctcag

SEQ ID NO: 3946664 - DNA, 19 bp, Homo sapiens
tcccttgagacctcagcca

SEQ ID NO: 3946665 - DNA, 17 bp, Homo sapiens
tcccttgctcagtgcct

SEQ ID NO: 3946666 - DNA, 19 bp, Homo sapiens
tcccttgctcagtgcctcc

SEQ ID NO: 3946667 - DNA, 23 bp, Homo sapiens
tcccttgctgacatggctttgct

SEQ ID NO: 3946668 - DNA, 21 bp, Homo sapiens
tcccttggaaagttcagccag

SEQ ID NO: 3946669 - DNA, 21 bp, Homo sapiens
tccctttcacaaaattttatt

SEQ ID NO: 3946670 - DNA, 20 bp, Homo sapiens
tccctttcccatgatccaga

SEQ ID NO: 3946671 - DNA, 15 bp, Homo sapiens
tccctttctgggagg

SEQ ID NO: 3946672 - DNA, 20 bp, Homo sapiens
tcccttttgcataagattaa

SEQ ID NO: 3946673 - DNA, 12 bp, Homo sapiens
tccgagaacaac

SEQ ID NO: 3946674 - DNA, 19 bp, Homo sapiens
tccgattaatttatggttt

SEQ ID NO: 3946675 - DNA, 21 bp, Homo sapiens
tccgcaccagctgctctgccc

SEQ ID NO: 3946676 - DNA, 13 bp, Homo sapiens
tccgcagcccagg

SEQ ID NO: 3946677 - DNA, 15 bp, Homo sapiens
tccgcctgcagagga

SEQ ID NO: 3946678 - DNA, 16 bp, Homo sapiens
tccgctaagacctccc

SEQ ID NO: 3946679 - DNA, 20 bp, Homo sapiens
tccgctaagacctccccacc

SEQ ID NO: 3946680 - DNA, 22 bp, Homo sapiens
tccgctaagacctccccacccc

SEQ ID NO: 3946681 - DNA, 13 bp, Homo sapiens
tccgctgccacca

SEQ ID NO: 3946682 - DNA, 16 bp, Homo sapiens
tccgctgtcgccccag

SEQ ID NO: 3946683 - DNA, 18 bp, Homo sapiens
tccgctgtcgccccaggc

SEQ ID NO: 3946684 - DNA, 14 bp, Homo sapiens
tccggaatgaccag

SEQ ID NO: 3946685 - DNA, 21 bp, Homo sapiens
tccggcctgatgacagagcga

SEQ ID NO: 3946686 - DNA, 23 bp, Homo sapiens
tccgggaccattgacctcagctg

SEQ ID NO: 3946687 - DNA, 20 bp, Homo sapiens
tccgggacgcttccagacca

SEQ ID NO: 3946688 - DNA, 19 bp, Homo sapiens
tccgggagagcggctgccc

SEQ ID NO: 3946689 - DNA, 24 bp, Homo sapiens
tccgggatccccagcctactgcct

SEQ ID NO: 3946690 - DNA, 14 bp, Homo sapiens
tccggggtctgtgc

SEQ ID NO: 3946691 - DNA, 21 bp, Homo sapiens
tccggggtctgtgctgtgcct

SEQ ID NO: 3946692 - DNA, 18 bp, Homo sapiens
tccgggtgtggcctcagc

SEQ ID NO: 3946693 - DNA, 16 bp, Homo sapiens
tccgtccacccaggct

SEQ ID NO: 3946694 - DNA, 17 bp, Homo sapiens
tccgtccacccaggctg

SEQ ID NO: 3946695 - DNA, 21 bp, Homo sapiens
tccgtccacccaggctgcact

SEQ ID NO: 3946696 - DNA, 19 bp, Homo sapiens
tccgtcccaaacagagggc

SEQ ID NO: 3946697 - DNA, 19 bp, Homo sapiens
tccgtctccctaaaataaa

SEQ ID NO: 3946698 - DNA, 18 bp, Homo sapiens
tccgtttatgggccttgc

SEQ ID NO: 3946699 - DNA, 20 bp, Homo sapiens
tcctaaacccccgctccaga

SEQ ID NO: 3946700 - DNA, 23 bp, Homo sapiens
tcctaaacccccgctccagatct

SEQ ID NO: 3946701 - DNA, 15 bp, Homo sapiens
tcctaaatttcagta

SEQ ID NO: 3946702 - DNA, 17 bp, Homo sapiens
tcctaactgaagagaca

SEQ ID NO: 3946703 - DNA, 17 bp, Homo sapiens
tcctaaggacacactaa

SEQ ID NO: 3946704 - DNA, 20 bp, Homo sapiens
tcctacagaaatactgctct

SEQ ID NO: 3946705 - DNA, 23 bp, Homo sapiens
tcctacagaaatactgctctgaa

SEQ ID NO: 3946706 - DNA, 20 bp, Homo sapiens
tcctacgtcaaacatgaagt

SEQ ID NO: 3946707 - DNA, 19 bp, Homo sapiens
tcctactactttgtgtttt

SEQ ID NO: 3946708 - DNA, 18 bp, Homo sapiens
tcctagaaccaagcttca

SEQ ID NO: 3946709 - DNA, 21 bp, Homo sapiens
tcctagaaccaagcttcagag

SEQ ID NO: 3946710 - DNA, 19 bp, Homo sapiens
tcctagagagcagaaataa

SEQ ID NO: 3946711 - DNA, 21 bp, Homo sapiens
tcctagagagcagaaataaaa

SEQ ID NO: 3946712 - DNA, 21 bp, Homo sapiens
tcctagagaggctggcaagga

SEQ ID NO: 3946713 - DNA, 19 bp, Homo sapiens
tcctagagctcctgtccct

SEQ ID NO: 3946714 - DNA, 21 bp, Homo sapiens
tcctagagctcctgtccctac

SEQ ID NO: 3946715 - DNA, 15 bp, Homo sapiens
tcctagaggacctga

SEQ ID NO: 3946716 - DNA, 18 bp, Homo sapiens
tcctagaggtgggcagct

SEQ ID NO: 3946717 - DNA, 22 bp, Homo sapiens
tcctagaggtgggcagctgggc

SEQ ID NO: 3946718 - DNA, 22 bp, Homo sapiens
tcctaggctccaccccatccag

SEQ ID NO: 3946719 - DNA, 13 bp, Homo sapiens
tcctaggtgctgg

SEQ ID NO: 3946720 - DNA, 14 bp, Homo sapiens
tcctagtgaaagag

SEQ ID NO: 3946721 - DNA, 15 bp, Homo sapiens
tcctagtttgacctc

SEQ ID NO: 3946722 - DNA, 16 bp, Homo sapiens
tcctagtttgacctca

SEQ ID NO: 3946723 - DNA, 20 bp, Homo sapiens
tcctagttttctcctcccag

SEQ ID NO: 3946724 - DNA, 19 bp, Homo sapiens
tcctataccatatgtctgc

SEQ ID NO: 3946725 - DNA, 15 bp, Homo sapiens
tcctatatagtttat

SEQ ID NO: 3946726 - DNA, 17 bp, Homo sapiens
tcctatcagaagtttct

SEQ ID NO: 3946727 - DNA, 20 bp, Homo sapiens
tcctgcagaggaccacagtg

SEQ ID NO: 3946728 - DNA, 12 bp, Homo sapiens
tcctgcagcctc

SEQ ID NO: 3946729 - DNA, 18 bp, Homo sapiens
tcctgcagcctcctcctg

SEQ ID NO: 3946730 - DNA, 22 bp, Homo sapiens
tcctgcagcctcctcctgacca

SEQ ID NO: 3946731 - DNA, 16 bp, Homo sapiens
tcctgccaccagtcac

SEQ ID NO: 3946732 - DNA, 13 bp, Homo sapiens
tcctgcccaggag

SEQ ID NO: 3946733 - DNA, 19 bp, Homo sapiens
tcctgcccaggagagccag

SEQ ID NO: 3946734 - DNA, 19 bp, Homo sapiens
tcctgcccatgtgtcccct

SEQ ID NO: 3946735 - DNA, 21 bp, Homo sapiens
tcctgccccaactccttccag

SEQ ID NO: 3946736 - DNA, 11 bp, Homo sapiens
tcctgcctctc

SEQ ID NO: 3946737 - DNA, 15 bp, Homo sapiens
tcctgcctctctgct

SEQ ID NO: 3946738 - DNA, 23 bp, Homo sapiens
tcctgcgggcttttccccggtcc

SEQ ID NO: 3946739 - DNA, 17 bp, Homo sapiens
tcctgctacacaaaagc

SEQ ID NO: 3946740 - DNA, 17 bp, Homo sapiens
tcctgctagctgtagaa

SEQ ID NO: 3946741 - DNA, 17 bp, Homo sapiens
tcctgctctcttcagga

SEQ ID NO: 3946742 - DNA, 16 bp, Homo sapiens
tcctgctggatgcgtg

SEQ ID NO: 3946743 - DNA, 15 bp, Homo sapiens
tcctgctggcacctc

SEQ ID NO: 3946744 - DNA, 17 bp, Homo sapiens
tcctgctggcacctcag

SEQ ID NO: 3946745 - DNA, 13 bp, Homo sapiens
tcctgctgtggcc

SEQ ID NO: 3946746 - DNA, 21 bp, Homo sapiens
tcctgcttcctaggccccaga

SEQ ID NO: 3946747 - DNA, 14 bp, Homo sapiens
tcctggaaccaatc

SEQ ID NO: 3946748 - DNA, 11 bp, Homo sapiens
tcctggacagc

SEQ ID NO: 3946749 - DNA, 14 bp, Homo sapiens
tcctggacagctgt

SEQ ID NO: 3946750 - DNA, 22 bp, Homo sapiens
tcctggacagctgtgcctcgct

SEQ ID NO: 3946751 - DNA, 14 bp, Homo sapiens
tcctggacctgagt

SEQ ID NO: 3946752 - DNA, 22 bp, Homo sapiens
tcctggacctgagtcggcccca

SEQ ID NO: 3946753 - DNA, 18 bp, Homo sapiens
tcctggagcatcccaggc

SEQ ID NO: 3946754 - DNA, 16 bp, Homo sapiens
tcctggcatgacactc

SEQ ID NO: 3946755 - DNA, 18 bp, Homo sapiens
tcctggccagacgctgcc

SEQ ID NO: 3946756 - DNA, 19 bp, Homo sapiens
tcctggccattttcttgcc

SEQ ID NO: 3946757 - DNA, 21 bp, Homo sapiens
tcctggccccgggctctggcc

SEQ ID NO: 3946758 - DNA, 22 bp, Homo sapiens
tcctggccccgggctctggcca

SEQ ID NO: 3946759 - DNA, 18 bp, Homo sapiens
tcctggcccctccagacc

SEQ ID NO: 3946760 - DNA, 12 bp, Homo sapiens
tcctggccctct

SEQ ID NO: 3946761 - DNA, 18 bp, Homo sapiens
tcctggcctcactggctg

SEQ ID NO: 3946762 - DNA, 19 bp, Homo sapiens
tcctggcctcactggctgg

SEQ ID NO: 3946763 - DNA, 13 bp, Homo sapiens
tcctggctgccag

SEQ ID NO: 3946764 - DNA, 15 bp, Homo sapiens
tcctggctgccaggc

SEQ ID NO: 3946765 - DNA, 14 bp, Homo sapiens
tcctggctgctctc

SEQ ID NO: 3946766 - DNA, 11 bp, Homo sapiens
tcctggcttct

SEQ ID NO: 3946767 - DNA, 20 bp, Homo sapiens
tcctggcttctagatctgga

SEQ ID NO: 3946768 - DNA, 23 bp, Homo sapiens
tcctggcttctagatctggaacc

SEQ ID NO: 3946769 - DNA, 17 bp, Homo sapiens
tcctggctttgacatga

SEQ ID NO: 3946770 - DNA, 20 bp, Homo sapiens
tcctgggaccatggacacat

SEQ ID NO: 3946771 - DNA, 10 bp, Homo sapiens
tcctgggcct

SEQ ID NO: 3946772 - DNA, 16 bp, Homo sapiens
tcctgggcctgtcccc

SEQ ID NO: 3946773 - DNA, 17 bp, Homo sapiens
tcctggggccccgctgg

SEQ ID NO: 3946774 - DNA, 18 bp, Homo sapiens
tcctgggggtggcaggca

SEQ ID NO: 3946775 - DNA, 17 bp, Homo sapiens
tcctgggtggctactct

SEQ ID NO: 3946776 - DNA, 22 bp, Homo sapiens
tcctgggtggctactctgtgcc

SEQ ID NO: 3946777 - DNA, 23 bp, Homo sapiens
tcctgggtggctactctgtgcca

SEQ ID NO: 3946778 - DNA, 23 bp, Homo sapiens
tcctggtacagcagggtcttgct

SEQ ID NO: 3946779 - DNA, 13 bp, Homo sapiens
tcctggtctgtgc

SEQ ID NO: 3946780 - DNA, 20 bp, Homo sapiens
tcctggtctgtgctgccctg

SEQ ID NO: 3946781 - DNA, 13 bp, Homo sapiens
tcctggtggggca

SEQ ID NO: 3946782 - DNA, 20 bp, Homo sapiens
tcctgtaacacaagccacag

SEQ ID NO: 3946783 - DNA, 19 bp, Homo sapiens
tcctgtagcatcttctgga

SEQ ID NO: 3946784 - DNA, 16 bp, Homo sapiens
tcctgtataatttaac

SEQ ID NO: 3946785 - DNA, 23 bp, Homo sapiens
tcctgtatattatggtgtaatgc

SEQ ID NO: 3946786 - DNA, 20 bp, Homo sapiens
tcctgtccaacctaacccct

SEQ ID NO: 3946787 - DNA, 22 bp, Homo sapiens
tcctgtccactctcggggccct

SEQ ID NO: 3946788 - DNA, 13 bp, Homo sapiens
tcctgtcccagag

SEQ ID NO: 3946789 - DNA, 16 bp, Homo sapiens
tcctgtccctacccac

SEQ ID NO: 3946790 - DNA, 23 bp, Homo sapiens
tcctgtccctacccactctttgc

SEQ ID NO: 3946791 - DNA, 15 bp, Homo sapiens
tcctgtgaccccacc

SEQ ID NO: 3946792 - DNA, 19 bp, Homo sapiens
tcctgtgaccccaccttga

SEQ ID NO: 3946793 - DNA, 23 bp, Homo sapiens
tcctgtgcccctcagagaggcat

SEQ ID NO: 3946794 - DNA, 13 bp, Homo sapiens
tcctgtgctctgg

SEQ ID NO: 3946795 - DNA, 13 bp, Homo sapiens
tcctgtggccagg

SEQ ID NO: 3946796 - DNA, 16 bp, Homo sapiens
tcctgtgggagcctcg

SEQ ID NO: 3946797 - DNA, 18 bp, Homo sapiens
tcctgtgggagcctcgca

SEQ ID NO: 3946798 - DNA, 15 bp, Homo sapiens
tcctgtgtgcagtga

SEQ ID NO: 3946799 - DNA, 19 bp, Homo sapiens
tcctgtgtggggaggcagc

SEQ ID NO: 3946800 - DNA, 18 bp, Homo sapiens
tcctgttacttacctaaa

SEQ ID NO: 3946801 - DNA, 16 bp, Homo sapiens
tcctgttcaccttatg

SEQ ID NO: 3946802 - DNA, 19 bp, Homo sapiens
tcctgttcaccttatgtat

SEQ ID NO: 3946803 - DNA, 16 bp, Homo sapiens
tcctgtttttctgggt

SEQ ID NO: 3946804 - DNA, 20 bp, Homo sapiens
tcctgtttttctgggtggcc

SEQ ID NO: 3946805 - DNA, 18 bp, Homo sapiens
tccttactctgagcccag

SEQ ID NO: 3946806 - DNA, 19 bp, Homo sapiens
tccttactctgagcccagg

SEQ ID NO: 3946807 - DNA, 19 bp, Homo sapiens
tccttaggaaaatgcttct

SEQ ID NO: 3946808 - DNA, 16 bp, Homo sapiens
tccttcactcatccag

SEQ ID NO: 3946809 - DNA, 12 bp, Homo sapiens
tccttcagagct

SEQ ID NO: 3946810 - DNA, 12 bp, Homo sapiens
tccttcagtgca

SEQ ID NO: 3946811 - DNA, 13 bp, Homo sapiens
tccttccagtggc

SEQ ID NO: 3946812 - DNA, 18 bp, Homo sapiens
tccttccctgggaaggct

SEQ ID NO: 3946813 - DNA, 15 bp, Homo sapiens
tccttccgctccttt

SEQ ID NO: 3946814 - DNA, 19 bp, Homo sapiens
tcgctgctctagctggcag

SEQ ID NO: 3946815 - DNA, 21 bp, Homo sapiens
tcgctgctctagctggcagga

SEQ ID NO: 3946816 - DNA, 17 bp, Homo sapiens
tcgctggacaacccaga

SEQ ID NO: 3946817 - DNA, 18 bp, Homo sapiens
tcgctggacaacccagaa

SEQ ID NO: 3946818 - DNA, 22 bp, Homo sapiens
tcgctgtgaaaatgaggaggat

SEQ ID NO: 3946819 - DNA, 16 bp, Homo sapiens
tcgctgtggttgtttt

SEQ ID NO: 3946820 - DNA, 16 bp, Homo sapiens
tcgcttgcttctgcag

SEQ ID NO: 3946821 - DNA, 16 bp, Homo sapiens
tcggaagggaaaacag

SEQ ID NO: 3946822 - DNA, 12 bp, Homo sapiens
tcggagaagagc

SEQ ID NO: 3946823 - DNA, 15 bp, Homo sapiens
tcggagctgccagcc

SEQ ID NO: 3946824 - DNA, 15 bp, Homo sapiens
tcggaggtggtggag

SEQ ID NO: 3946825 - DNA, 12 bp, Homo sapiens
tcggcccacagc

SEQ ID NO: 3946826 - DNA, 16 bp, Homo sapiens
tcggcccacagctccc

SEQ ID NO: 3946827 - DNA, 23 bp, Homo sapiens
tcggcccacagctcccaccccac

SEQ ID NO: 3946828 - DNA, 16 bp, Homo sapiens
tcggccccacatggga

SEQ ID NO: 3946829 - DNA, 16 bp, Homo sapiens
tcgggacacctgccct

SEQ ID NO: 3946830 - DNA, 13 bp, Homo sapiens
tcgggacagagag

SEQ ID NO: 3946831 - DNA, 16 bp, Homo sapiens
tcggggctgggaagtc

SEQ ID NO: 3946832 - DNA, 14 bp, Homo sapiens
tcggggtgcacagg

SEQ ID NO: 3946833 - DNA, 17 bp, Homo sapiens
tcggggtgcacaggagg

SEQ ID NO: 3946834 - DNA, 21 bp, Homo sapiens
tcggtgggacagccccagggc

SEQ ID NO: 3946835 - DNA, 15 bp, Homo sapiens
tcgtaccagccagga

SEQ ID NO: 3946836 - DNA, 23 bp, Homo sapiens
tcgtccacaggggcaggcctggg

SEQ ID NO: 3946837 - DNA, 14 bp, Homo sapiens
tcgtcctccccctg

SEQ ID NO: 3946838 - DNA, 14 bp, Homo sapiens
tcgtcctgtcccag

SEQ ID NO: 3946839 - DNA, 17 bp, Homo sapiens
tcgtgccatgatctgta

SEQ ID NO: 3946840 - DNA, 20 bp, Homo sapiens
tcgtgccgttactctccaac

SEQ ID NO: 3946841 - DNA, 23 bp, Homo sapiens
tcgtgccgttactctccaacctg

SEQ ID NO: 3946842 - DNA, 16 bp, Homo sapiens
tcgtgcctataaatag

SEQ ID NO: 3946843 - DNA, 17 bp, Homo sapiens
tcgtgcctataaatagt

SEQ ID NO: 3946844 - DNA, 19 bp, Homo sapiens
tcgtgcgcaacaacaagga

SEQ ID NO: 3946845 - DNA, 20 bp, Homo sapiens
tcgtggcagataatcagcct

SEQ ID NO: 3946846 - DNA, 21 bp, Homo sapiens
tcgtggcagataatcagcctc

SEQ ID NO: 3946847 - DNA, 22 bp, Homo sapiens
tcgtggcagataatcagcctct

SEQ ID NO: 3946848 - DNA, 11 bp, Homo sapiens
tcgtggccttc

SEQ ID NO: 3946849 - DNA, 22 bp, Homo sapiens
tcgtgtagtggaagagcagcct

SEQ ID NO: 3946850 - DNA, 13 bp, Homo sapiens
tcgtgtttacaaa

SEQ ID NO: 3946851 - DNA, 15 bp, Homo sapiens
tcgtgtttacaaaag

SEQ ID NO: 3946852 - DNA, 21 bp, Homo sapiens
tcgttcctatacatttctgtt

SEQ ID NO: 3946853 - DNA, 12 bp, Homo sapiens
tctaaaaataaa

SEQ ID NO: 3946854 - DNA, 19 bp, Homo sapiens
tctaaaactatggttccca

SEQ ID NO: 3946855 - DNA, 20 bp, Homo sapiens
tctaaacccaaataaatgtg

SEQ ID NO: 3946856 - DNA, 23 bp, Homo sapiens
tctaaacccaaataaatgtgtaa

SEQ ID NO: 3946857 - DNA, 17 bp, Homo sapiens
tctaaatcaagtattta

SEQ ID NO: 3946858 - DNA, 17 bp, Homo sapiens
tctaaattctttatttc

SEQ ID NO: 3946859 - DNA, 13 bp, Homo sapiens
tctaacatatgta

SEQ ID NO: 3946860 - DNA, 16 bp, Homo sapiens
tctaacatatgtatta

SEQ ID NO: 3946861 - DNA, 17 bp, Homo sapiens
tctaactacaaggacaa

SEQ ID NO: 3946862 - DNA, 14 bp, Homo sapiens
tctaactgtaaatc

SEQ ID NO: 3946863 - DNA, 16 bp, Homo sapiens
tctaactgtaaatcac

SEQ ID NO: 3946864 - DNA, 17 bp, Homo sapiens
tctaactgtaaatcact

SEQ ID NO: 3946865 - DNA, 19 bp, Homo sapiens
tctaactgtaaatcacttg

SEQ ID NO: 3946866 - DNA, 17 bp, Homo sapiens
tctaagctgcagcttcc

SEQ ID NO: 3946867 - DNA, 23 bp, Homo sapiens
tctaagtaaaaccacagcagttg

SEQ ID NO: 3946868 - DNA, 16 bp, Homo sapiens
tctaagtatttgaaac

SEQ ID NO: 3946869 - DNA, 22 bp, Homo sapiens
tctaagtctccaagaatacaga

SEQ ID NO: 3946870 - DNA, 24 bp, Homo sapiens
tctaagtttggttagccttagttt

SEQ ID NO: 3946871 - DNA, 21 bp, Homo sapiens
tctaatagcgggttactttca

SEQ ID NO: 3946872 - DNA, 15 bp, Homo sapiens
tctaatatattttta

SEQ ID NO: 3946873 - DNA, 17 bp, Homo sapiens
tctaatattaaaaatat

SEQ ID NO: 3946874 - DNA, 17 bp, Homo sapiens
tctaatgtaagaaaatt

SEQ ID NO: 3946875 - DNA, 22 bp, Homo sapiens
tctaatgtaagaaaatttgaag

SEQ ID NO: 3946876 - DNA, 16 bp, Homo sapiens
tctaatgtctcttcct

SEQ ID NO: 3946877 - DNA, 17 bp, Homo sapiens
tctaatttatacaaaat

SEQ ID NO: 3946878 - DNA, 17 bp, Homo sapiens
tctacaagcatatttga

SEQ ID NO: 3946879 - DNA, 18 bp, Homo sapiens
tctacacagtaaaaactt

SEQ ID NO: 3946880 - DNA, 18 bp, Homo sapiens
tctacacagtgggaactc

SEQ ID NO: 3946881 - DNA, 15 bp, Homo sapiens
tctacagaacaaaga

SEQ ID NO: 3946882 - DNA, 16 bp, Homo sapiens
tctacatattctttaa

SEQ ID NO: 3946883 - DNA, 11 bp, Homo sapiens
tctacctgtgg

SEQ ID NO: 3946884 - DNA, 20 bp, Homo sapiens
tctactacttttactacagt

SEQ ID NO: 3946885 - DNA, 15 bp, Homo sapiens
tctagaacacaggca

SEQ ID NO: 3946886 - DNA, 16 bp, Homo sapiens
tctagaacacaggcaa

SEQ ID NO: 3946887 - DNA, 17 bp, Homo sapiens
tctagaacacaggcaaa

SEQ ID NO: 3946888 - DNA, 16 bp, Homo sapiens
tctagaacacccactg

SEQ ID NO: 3946889 - DNA, 20 bp, Homo sapiens
tctagaatgtgttttctgaa

SEQ ID NO: 3946890 - DNA, 14 bp, Homo sapiens
tctagacactgcca

SEQ ID NO: 3946891 - DNA, 13 bp, Homo sapiens
tctagactttctg

SEQ ID NO: 3946892 - DNA, 15 bp, Homo sapiens
tctagactttctgtt

SEQ ID NO: 3946893 - DNA, 14 bp, Homo sapiens
tctagaggcctcag

SEQ ID NO: 3946894 - DNA, 15 bp, Homo sapiens
tctagaggcctcagt

SEQ ID NO: 3946895 - DNA, 22 bp, Homo sapiens
tctagaggtgagaccaaaggat

SEQ ID NO: 3946896 - DNA, 23 bp, Homo sapiens
tctagagtgagaatctggctcct

SEQ ID NO: 3946897 - DNA, 20 bp, Homo sapiens
tctagatcaattaattctta

SEQ ID NO: 3946898 - DNA, 19 bp, Homo sapiens
tctagccgggccatgcttt

SEQ ID NO: 3946899 - DNA, 20 bp, Homo sapiens
tctagccgggccatgctttc

SEQ ID NO: 3946900 - DNA, 20 bp, Homo sapiens
tctagcctgggccagagaag

SEQ ID NO: 3946901 - DNA, 12 bp, Homo sapiens
tctccactccat

SEQ ID NO: 3946902 - DNA, 18 bp, Homo sapiens
tctccagcatcctgcttc

SEQ ID NO: 3946903 - DNA, 13 bp, Homo sapiens
tctccagccagca

SEQ ID NO: 3946904 - DNA, 15 bp, Homo sapiens
tctccagccagcaat

SEQ ID NO: 3946905 - DNA, 16 bp, Homo sapiens
tctccagcccacaccc

SEQ ID NO: 3946906 - DNA, 19 bp, Homo sapiens
tctccagcccacacccctc

SEQ ID NO: 3946907 - DNA, 17 bp, Homo sapiens
tctccagggctgcccct

SEQ ID NO: 3946908 - DNA, 14 bp, Homo sapiens
tctcccacgtggga

SEQ ID NO: 3946909 - DNA, 16 bp, Homo sapiens
tctcccacgtgggaga

SEQ ID NO: 3946910 - DNA, 13 bp, Homo sapiens
tctcccaggcccc

SEQ ID NO: 3946911 - DNA, 23 bp, Homo sapiens
tctcccaggccccatgacctcca

SEQ ID NO: 3946912 - DNA, 15 bp, Homo sapiens
tctcccagtcattta

SEQ ID NO: 3946913 - DNA, 12 bp, Homo sapiens
tctccccaggcc

SEQ ID NO: 3946914 - DNA, 19 bp, Homo sapiens
tctccccaggcctccagcc

SEQ ID NO: 3946915 - DNA, 18 bp, Homo sapiens
tctcccccgacactgctg

SEQ ID NO: 3946916 - DNA, 17 bp, Homo sapiens
tctcccctccctcttcc

SEQ ID NO: 3946917 - DNA, 17 bp, Homo sapiens
tctcccctctgccctgt

SEQ ID NO: 3946918 - DNA, 15 bp, Homo sapiens
tctcccctgccctgc

SEQ ID NO: 3946919 - DNA, 19 bp, Homo sapiens
tctcccgcgggcctggaca

SEQ ID NO: 3946920 - DNA, 12 bp, Homo sapiens
tctccctcaccc

SEQ ID NO: 3946921 - DNA, 13 bp, Homo sapiens
tctccctccaggg

SEQ ID NO: 3946922 - DNA, 16 bp, Homo sapiens
tctccctctcctgcct

SEQ ID NO: 3946923 - DNA, 18 bp, Homo sapiens
tctccctctcctgcctac

SEQ ID NO: 3946924 - DNA, 12 bp, Homo sapiens
tctccctctggc

SEQ ID NO: 3946925 - DNA, 18 bp, Homo sapiens
tctccctctggccctgcc

SEQ ID NO: 3946926 - DNA, 16 bp, Homo sapiens
tctccggggtctgtgc

SEQ ID NO: 3946927 - DNA, 20 bp, Homo sapiens
tctccggggtctgtgctgtg

SEQ ID NO: 3946928 - DNA, 15 bp, Homo sapiens
tctccgggtgtggcc

SEQ ID NO: 3946929 - DNA, 19 bp, Homo sapiens
tctccgggtgtggcctcag

SEQ ID NO: 3946930 - DNA, 19 bp, Homo sapiens
tctcctaccccacctcatg

SEQ ID NO: 3946931 - DNA, 22 bp, Homo sapiens
tctcctaccccacctcatgcct

SEQ ID NO: 3946932 - DNA, 23 bp, Homo sapiens
tctcctaccccacctcatgcctg

SEQ ID NO: 3946933 - DNA, 12 bp, Homo sapiens
tctcctcccagg

SEQ ID NO: 3946934 - DNA, 23 bp, Homo sapiens
tctcctccctgttatctgctaga

SEQ ID NO: 3946935 - DNA, 14 bp, Homo sapiens
tctcctcggccccc

SEQ ID NO: 3946936 - DNA, 17 bp, Homo sapiens
tctcctgaagttcagcc

SEQ ID NO: 3946937 - DNA, 16 bp, Homo sapiens
tctcctgacccagtcc

SEQ ID NO: 3946938 - DNA, 13 bp, Homo sapiens
tctcctgcctgta

SEQ ID NO: 3946939 - DNA, 20 bp, Homo sapiens
tctcctgcctgtagcagtga

SEQ ID NO: 3946940 - DNA, 18 bp, Homo sapiens
tctcctggcttcccatcc

SEQ ID NO: 3946941 - DNA, 22 bp, Homo sapiens
tctcctggcttcccatccccag

SEQ ID NO: 3946942 - DNA, 19 bp, Homo sapiens
tctcctgggggtggcaggc

SEQ ID NO: 3946943 - DNA, 18 bp, Homo sapiens
tctcctgtgcccctcaga

SEQ ID NO: 3946944 - DNA, 14 bp, Homo sapiens
tctcctgtttttct

SEQ ID NO: 3946945 - DNA, 18 bp, Homo sapiens
tctccttactctgagccc

SEQ ID NO: 3946946 - DNA, 19 bp, Homo sapiens
tctccttactctgagccca

SEQ ID NO: 3946947 - DNA, 20 bp, Homo sapiens
tctccttcgtgtctctccca

SEQ ID NO: 3946948 - DNA, 14 bp, Homo sapiens
tctccttgggctcc

SEQ ID NO: 3946949 - DNA, 19 bp, Homo sapiens
tctccttgggctcctggct

SEQ ID NO: 3946950 - DNA, 15 bp, Homo sapiens
tctcctttctttcta

SEQ ID NO: 3946951 - DNA, 19 bp, Homo sapiens
tctcctttgcactgagggc

SEQ ID NO: 3946952 - DNA, 23 bp, Homo sapiens
tctcctttgcactgagggccaca

SEQ ID NO: 3946953 - DNA, 18 bp, Homo sapiens
tctcgagcccagatggaa

SEQ ID NO: 3946954 - DNA, 15 bp, Homo sapiens
tctcgagccccctgg

SEQ ID NO: 3946955 - DNA, 23 bp, Homo sapiens
tctcgagccccctggatgtcccc

SEQ ID NO: 3946956 - DNA, 16 bp, Homo sapiens
tctcgagcgccctgca

SEQ ID NO: 3946957 - DNA, 18 bp, Homo sapiens
tctcgagcgccctgcaga

SEQ ID NO: 3946958 - DNA, 17 bp, Homo sapiens
tctcggttccacgtccc

SEQ ID NO: 3946959 - DNA, 20 bp, Homo sapiens
tctcgtggtagaagccagta

SEQ ID NO: 3946960 - DNA, 17 bp, Homo sapiens
tctctaaaaataaaatg

SEQ ID NO: 3946961 - DNA, 18 bp, Homo sapiens
tctctaaaaataaaatga

SEQ ID NO: 3946962 - DNA, 11 bp, Homo sapiens
tctctaatatg

SEQ ID NO: 3946963 - DNA, 22 bp, Homo sapiens
tctctagctttaggggaccatg

SEQ ID NO: 3946964 - DNA, 14 bp, Homo sapiens
tctctatttaatat

SEQ ID NO: 3946965 - DNA, 15 bp, Homo sapiens
tctctatttaatatt

SEQ ID NO: 3946966 - DNA, 13 bp, Homo sapiens
tctctcaggagca

SEQ ID NO: 3946967 - DNA, 18 bp, Homo sapiens
tctctcaggagcacaggc

SEQ ID NO: 3946968 - DNA, 19 bp, Homo sapiens
tctctcaggagcacaggca

SEQ ID NO: 3946969 - DNA, 13 bp, Homo sapiens
tctctccttccct

SEQ ID NO: 3946970 - DNA, 15 bp, Homo sapiens
tctctcgggcccccc

SEQ ID NO: 3946971 - DNA, 20 bp, Homo sapiens
tctctctaaaaataaaatga

SEQ ID NO: 3946972 - DNA, 21 bp, Homo sapiens
tctctctaagtttagaagcgc

SEQ ID NO: 3946973 - DNA, 22 bp, Homo sapiens
tctctctcccttttaaatggtg

SEQ ID NO: 3946974 - DNA, 13 bp, Homo sapiens
tctctctctacaa

SEQ ID NO: 3946975 - DNA, 21 bp, Homo sapiens
tctctctggggccctgggcct

SEQ ID NO: 3946976 - DNA, 18 bp, Homo sapiens
tctctcttgctttgttct

SEQ ID NO: 3946977 - DNA, 17 bp, Homo sapiens
tctctgagatgcccctc

SEQ ID NO: 3946978 - DNA, 19 bp, Homo sapiens
tctctgattttcaaagctt

SEQ ID NO: 3946979 - DNA, 20 bp, Homo sapiens
tctctgattttcaaagcttt

SEQ ID NO: 3946980 - DNA, 16 bp, Homo sapiens
tctctgcagccagccc

SEQ ID NO: 3946981 - DNA, 16 bp, Homo sapiens
tctctgctccagagag

SEQ ID NO: 3946982 - DNA, 15 bp, Homo sapiens
tctctgctctagcca

SEQ ID NO: 3946983 - DNA, 18 bp, Homo sapiens
tctctgcttacccttcac

SEQ ID NO: 3946984 - DNA, 22 bp, Homo sapiens
tctctgcttactaatgtgcccc

SEQ ID NO: 3946985 - DNA, 19 bp, Homo sapiens
tctctggcccttcttgcct

SEQ ID NO: 3946986 - DNA, 17 bp, Homo sapiens
tctctggccttttccta

SEQ ID NO: 3946987 - DNA, 15 bp, Homo sapiens
tctctggctccagaa

SEQ ID NO: 3946988 - DNA, 16 bp, Homo sapiens
tctgcagcaactccca

SEQ ID NO: 3946989 - DNA, 23 bp, Homo sapiens
tctgcagcactttaaccctctct

SEQ ID NO: 3946990 - DNA, 15 bp, Homo sapiens
tctgcagccagccca

SEQ ID NO: 3946991 - DNA, 19 bp, Homo sapiens
tctgcagtagtctctgtgc

SEQ ID NO: 3946992 - DNA, 19 bp, Homo sapiens
tctgcatcagctgctgaaa

SEQ ID NO: 3946993 - DNA, 16 bp, Homo sapiens
tctgcatctcattgta

SEQ ID NO: 3946994 - DNA, 12 bp, Homo sapiens
tctgcatggaaa

SEQ ID NO: 3946995 - DNA, 20 bp, Homo sapiens
tctgcattgttattgtggaa

SEQ ID NO: 3946996 - DNA, 21 bp, Homo sapiens
tctgcattgttattgtggaag

SEQ ID NO: 3946997 - DNA, 17 bp, Homo sapiens
tctgcatttataaatgt

SEQ ID NO: 3946998 - DNA, 20 bp, Homo sapiens
tctgcatttataaatgtgtg

SEQ ID NO: 3946999 - DNA, 14 bp, Homo sapiens
tctgccacagagag

SEQ ID NO: 3947000 - DNA, 16 bp, Homo sapiens
tctgccacagagagtc

SEQ ID NO: 3947001 - DNA, 14 bp, Homo sapiens
tctgccacctcccc

SEQ ID NO: 3947002 - DNA, 15 bp, Homo sapiens
tctgccacctcccct

SEQ ID NO: 3947003 - DNA, 20 bp, Homo sapiens
tctgccacctcccctatcca

SEQ ID NO: 3947004 - DNA, 13 bp, Homo sapiens
tctgccaggccca

SEQ ID NO: 3947005 - DNA, 14 bp, Homo sapiens
tctgccaggcccat

SEQ ID NO: 3947006 - DNA, 16 bp, Homo sapiens
tctgccatgcccagag

SEQ ID NO: 3947007 - DNA, 17 bp, Homo sapiens
tctgccatgcccagaga

SEQ ID NO: 3947008 - DNA, 12 bp, Homo sapiens
tctgccccaagc

SEQ ID NO: 3947009 - DNA, 13 bp, Homo sapiens
tctgccccaagca

SEQ ID NO: 3947010 - DNA, 22 bp, Homo sapiens
tctgccccaagcagccagccag

SEQ ID NO: 3947011 - DNA, 14 bp, Homo sapiens
tctgccccaagccc

SEQ ID NO: 3947012 - DNA, 15 bp, Homo sapiens
tctgccccaagcccc

SEQ ID NO: 3947013 - DNA, 12 bp, Homo sapiens
tctgccccaccc

SEQ ID NO: 3947014 - DNA, 15 bp, Homo sapiens
tctgccccagaggcc

SEQ ID NO: 3947015 - DNA, 13 bp, Homo sapiens
tctgccctgcctc

SEQ ID NO: 3947016 - DNA, 19 bp, Homo sapiens
tctgccctgcctccctttc

SEQ ID NO: 3947017 - DNA, 21 bp, Homo sapiens
tctgcctcaatgtgaatcaga

SEQ ID NO: 3947018 - DNA, 15 bp, Homo sapiens
tctgcctgcggccca

SEQ ID NO: 3947019 - DNA, 16 bp, Homo sapiens
tctgcctgggcctgtg

SEQ ID NO: 3947020 - DNA, 18 bp, Homo sapiens
tctgcctgtggccttgcc

SEQ ID NO: 3947021 - DNA, 18 bp, Homo sapiens
tctgctcagcaggcccta

SEQ ID NO: 3947022 - DNA, 17 bp, Homo sapiens
tctgctcctctccaggc

SEQ ID NO: 3947023 - DNA, 15 bp, Homo sapiens
tctgctctagccagg

SEQ ID NO: 3947024 - DNA, 16 bp, Homo sapiens
tctgctctagccagga

SEQ ID NO: 3947025 - DNA, 18 bp, Homo sapiens
tctgctggcctggatctc

SEQ ID NO: 3947026 - DNA, 13 bp, Homo sapiens
tctgctggtcact

SEQ ID NO: 3947027 - DNA, 18 bp, Homo sapiens
tctgctgttgccatagcc

SEQ ID NO: 3947028 - DNA, 16 bp, Homo sapiens
tctgcttacccttcac

SEQ ID NO: 3947029 - DNA, 15 bp, Homo sapiens
tctgcttctccctgg

SEQ ID NO: 3947030 - DNA, 17 bp, Homo sapiens
tctgcttctccctggct

SEQ ID NO: 3947031 - DNA, 18 bp, Homo sapiens
tctgcttcttcatcttga

SEQ ID NO: 3947032 - DNA, 17 bp, Homo sapiens
tctgcttttgctggggt

SEQ ID NO: 3947033 - DNA, 21 bp, Homo sapiens
tctggaaaaaaaatatatata

SEQ ID NO: 3947034 - DNA, 15 bp, Homo sapiens
tctggaaaactcagg

SEQ ID NO: 3947035 - DNA, 19 bp, Homo sapiens
tctggaaaactcaggattc

SEQ ID NO: 3947036 - DNA, 12 bp, Homo sapiens
tctggaaatctg

SEQ ID NO: 3947037 - DNA, 10 bp, Homo sapiens
tctggaaatt

SEQ ID NO: 3947038 - DNA, 12 bp, Homo sapiens
tctggaaatttt

SEQ ID NO: 3947039 - DNA, 17 bp, Homo sapiens
tctggaaattttgtcca

SEQ ID NO: 3947040 - DNA, 20 bp, Homo sapiens
tctggaagagaggaatgcct

SEQ ID NO: 3947041 - DNA, 20 bp, Homo sapiens
tctggaaggcccctcccagc

SEQ ID NO: 3947042 - DNA, 15 bp, Homo sapiens
tctggaaggctggct

SEQ ID NO: 3947043 - DNA, 16 bp, Homo sapiens
tctggaaggctggctg

SEQ ID NO: 3947044 - DNA, 12 bp, Homo sapiens
tctggacaagcc

SEQ ID NO: 3947045 - DNA, 23 bp, Homo sapiens
tctggacaagccaacttgtaaat

SEQ ID NO: 3947046 - DNA, 22 bp, Homo sapiens
tctggagaagcagtgagccgca

SEQ ID NO: 3947047 - DNA, 20 bp, Homo sapiens
tctggagagctagaacctgg

SEQ ID NO: 3947048 - DNA, 22 bp, Homo sapiens
tctggagagctagaacctggag

SEQ ID NO: 3947049 - DNA, 17 bp, Homo sapiens
tctggagcaagagagag

SEQ ID NO: 3947050 - DNA, 21 bp, Homo sapiens
tctggaggacacacagtctca

SEQ ID NO: 3947051 - DNA, 24 bp, Homo sapiens
tctggatcctgctgtggcctcact

SEQ ID NO: 3947052 - DNA, 14 bp, Homo sapiens
tctggatctgggac

SEQ ID NO: 3947053 - DNA, 14 bp, Homo sapiens
tctggattccagag

SEQ ID NO: 3947054 - DNA, 20 bp, Homo sapiens
tctggcaccactagggtcct

SEQ ID NO: 3947055 - DNA, 18 bp, Homo sapiens
tctggcagccacacttct

SEQ ID NO: 3947056 - DNA, 23 bp, Homo sapiens
tctggcagccacacttctcagga

SEQ ID NO: 3947057 - DNA, 15 bp, Homo sapiens
tctggccaccctggc

SEQ ID NO: 3947058 - DNA, 17 bp, Homo sapiens
tctggccaccctggccc

SEQ ID NO: 3947059 - DNA, 14 bp, Homo sapiens
tctggccaggcatg

SEQ ID NO: 3947060 - DNA, 18 bp, Homo sapiens
tctggccctttctggacc

SEQ ID NO: 3947061 - DNA, 15 bp, Homo sapiens
tctggcctcagacca

SEQ ID NO: 3947062 - DNA, 17 bp, Homo sapiens
tctggcctcagcaggaa

SEQ ID NO: 3947063 - DNA, 18 bp, Homo sapiens
tctggcctcagcaggaac

SEQ ID NO: 3947064 - DNA, 11 bp, Homo sapiens
tctggcctcca

SEQ ID NO: 3947065 - DNA, 21 bp, Homo sapiens
tctggcggcttcctgtccact

SEQ ID NO: 3947066 - DNA, 13 bp, Homo sapiens
tctggctcctcct

SEQ ID NO: 3947067 - DNA, 15 bp, Homo sapiens
tctggctcctccttc

SEQ ID NO: 3947068 - DNA, 15 bp, Homo sapiens
tctggctgagctgaa

SEQ ID NO: 3947069 - DNA, 21 bp, Homo sapiens
tctggctggctaactggaagc

SEQ ID NO: 3947070 - DNA, 13 bp, Homo sapiens
tctggcttccagg

SEQ ID NO: 3947071 - DNA, 15 bp, Homo sapiens
tctggcttccaggta

SEQ ID NO: 3947072 - DNA, 23 bp, Homo sapiens
tctggcttttcgcttgcttctgc

SEQ ID NO: 3947073 - DNA, 18 bp, Homo sapiens
tctgggaaataagagaga

SEQ ID NO: 3947074 - DNA, 15 bp, Homo sapiens
tctgggaccctttcc

SEQ ID NO: 3947075 - DNA, 21 bp, Homo sapiens
tcttatttacttgtagaaatc

SEQ ID NO: 3947076 - DNA, 19 bp, Homo sapiens
tcttcaactgaccagcctc

SEQ ID NO: 3947077 - DNA, 20 bp, Homo sapiens
tcttcaagcacctgcagatt

SEQ ID NO: 3947078 - DNA, 15 bp, Homo sapiens
tcttcaagctgtccc

SEQ ID NO: 3947079 - DNA, 13 bp, Homo sapiens
tcttcacaacctc

SEQ ID NO: 3947080 - DNA, 19 bp, Homo sapiens
tcttcacccagctaatctg

SEQ ID NO: 3947081 - DNA, 20 bp, Homo sapiens
tcttcacccagctaatctgt

SEQ ID NO: 3947082 - DNA, 16 bp, Homo sapiens
tcttcacccgctgcag

SEQ ID NO: 3947083 - DNA, 14 bp, Homo sapiens
tcttcactcagcca

SEQ ID NO: 3947084 - DNA, 19 bp, Homo sapiens
tcttcactgccatgcctca

SEQ ID NO: 3947085 - DNA, 18 bp, Homo sapiens
tcttcagaagacactgca

SEQ ID NO: 3947086 - DNA, 15 bp, Homo sapiens
tcttcagcgagaccc

SEQ ID NO: 3947087 - DNA, 17 bp, Homo sapiens
tcttcagggtgagtgaa

SEQ ID NO: 3947088 - DNA, 23 bp, Homo sapiens
tcttcaggtggaaaaacatctga

SEQ ID NO: 3947089 - DNA, 13 bp, Homo sapiens
tcttcagtgccta

SEQ ID NO: 3947090 - DNA, 22 bp, Homo sapiens
tcttcatactttttttcacagt

SEQ ID NO: 3947091 - DNA, 13 bp, Homo sapiens
tcttccaaagctc

SEQ ID NO: 3947092 - DNA, 15 bp, Homo sapiens
tcttccaaaggcata

SEQ ID NO: 3947093 - DNA, 12 bp, Homo sapiens
tcttccaacccc

SEQ ID NO: 3947094 - DNA, 14 bp, Homo sapiens
tcttccactgcaaa

SEQ ID NO: 3947095 - DNA, 18 bp, Homo sapiens
tcttccagtgcaacaaaa

SEQ ID NO: 3947096 - DNA, 20 bp, Homo sapiens
tcttcccccacccctaacct

SEQ ID NO: 3947097 - DNA, 22 bp, Homo sapiens
tcttcccccacccctaacctgg

SEQ ID NO: 3947098 - DNA, 23 bp, Homo sapiens
tcttccccttgcccttgccctga

SEQ ID NO: 3947099 - DNA, 16 bp, Homo sapiens
tcttccctccttccct

SEQ ID NO: 3947100 - DNA, 17 bp, Homo sapiens
tcttcctaccaaatata

SEQ ID NO: 3947101 - DNA, 21 bp, Homo sapiens
tcttcctagttttctcctccc

SEQ ID NO: 3947102 - DNA, 15 bp, Homo sapiens
tcttcctctgttcta

SEQ ID NO: 3947103 - DNA, 22 bp, Homo sapiens
tcttcctgtaacacaagccaca

SEQ ID NO: 3947104 - DNA, 13 bp, Homo sapiens
tcttccttccccc

SEQ ID NO: 3947105 - DNA, 15 bp, Homo sapiens
tcttccttcccccat

SEQ ID NO: 3947106 - DNA, 13 bp, Homo sapiens
tcttccttctttc

SEQ ID NO: 3947107 - DNA, 14 bp, Homo sapiens
tcttccttctttct

SEQ ID NO: 3947108 - DNA, 15 bp, Homo sapiens
tcttccttctttctc

SEQ ID NO: 3947109 - DNA, 13 bp, Homo sapiens
tcttcgaggtgga

SEQ ID NO: 3947110 - DNA, 19 bp, Homo sapiens
tcttcgctgctagagaagg

SEQ ID NO: 3947111 - DNA, 20 bp, Homo sapiens
tcttcgctgctagagaaggg

SEQ ID NO: 3947112 - DNA, 13 bp, Homo sapiens
tcttcgctgctct

SEQ ID NO: 3947113 - DNA, 22 bp, Homo sapiens
tcttcgctgctctagctggcag

SEQ ID NO: 3947114 - DNA, 17 bp, Homo sapiens
tcttcggggtgtgatga

SEQ ID NO: 3947115 - DNA, 18 bp, Homo sapiens
tcttcggtgtttaaagtc

SEQ ID NO: 3947116 - DNA, 14 bp, Homo sapiens
tcttcggtttctga

SEQ ID NO: 3947117 - DNA, 15 bp, Homo sapiens
tcttcggtttctgag

SEQ ID NO: 3947118 - DNA, 16 bp, Homo sapiens
tcttctaacctcagcc

SEQ ID NO: 3947119 - DNA, 18 bp, Homo sapiens
tcttctacgtataaatat

SEQ ID NO: 3947120 - DNA, 15 bp, Homo sapiens
tcttctatttaaaaa

SEQ ID NO: 3947121 - DNA, 16 bp, Homo sapiens
tcttctattttattcc

SEQ ID NO: 3947122 - DNA, 21 bp, Homo sapiens
tcttctccattctagatgctt

SEQ ID NO: 3947123 - DNA, 13 bp, Homo sapiens
tcttctcctttca

SEQ ID NO: 3947124 - DNA, 14 bp, Homo sapiens
tcttctcctttcac

SEQ ID NO: 3947125 - DNA, 14 bp, Homo sapiens
tcttctcttcctgt

SEQ ID NO: 3947126 - DNA, 13 bp, Homo sapiens
tcttctgccaaga

SEQ ID NO: 3947127 - DNA, 15 bp, Homo sapiens
tcttctgccagccca

SEQ ID NO: 3947128 - DNA, 19 bp, Homo sapiens
tcttctgttgtagaataat

SEQ ID NO: 3947129 - DNA, 21 bp, Homo sapiens
tcttcttattcatgctttctc

SEQ ID NO: 3947130 - DNA, 20 bp, Homo sapiens
tcttcttgagcagaccgtga

SEQ ID NO: 3947131 - DNA, 16 bp, Homo sapiens
tcttcttgtgtcctga

SEQ ID NO: 3947132 - DNA, 16 bp, Homo sapiens
tcttctttttttgtga

SEQ ID NO: 3947133 - DNA, 16 bp, Homo sapiens
tcttgaaacagcctgg

SEQ ID NO: 3947134 - DNA, 13 bp, Homo sapiens
tcttgaatcccat

SEQ ID NO: 3947135 - DNA, 23 bp, Homo sapiens
tcttgacagtatatttgaaactg

SEQ ID NO: 3947136 - DNA, 19 bp, Homo sapiens
tcttgacattcaaggcatt

SEQ ID NO: 3947137 - DNA, 16 bp, Homo sapiens
tcttgccactgcctct

SEQ ID NO: 3947138 - DNA, 13 bp, Homo sapiens
tcttgcctgaggc

SEQ ID NO: 3947139 - DNA, 18 bp, Homo sapiens
tcttgctggattaatgtt

SEQ ID NO: 3947140 - DNA, 22 bp, Homo sapiens
tcttggacccctgaattcaatg

SEQ ID NO: 3947141 - DNA, 14 bp, Homo sapiens
tcttggacctctgc

SEQ ID NO: 3947142 - DNA, 18 bp, Homo sapiens
tcttggacctctgctctg

SEQ ID NO: 3947143 - DNA, 20 bp, Homo sapiens
tcttggcattttcctcgcct

SEQ ID NO: 3947144 - DNA, 13 bp, Homo sapiens
tcttggcttctgg

SEQ ID NO: 3947145 - DNA, 14 bp, Homo sapiens
tcttgggctactgg

SEQ ID NO: 3947146 - DNA, 18 bp, Homo sapiens
tcttgggctactggcagc

SEQ ID NO: 3947147 - DNA, 22 bp, Homo sapiens
tcttgggctactggcagctcct

SEQ ID NO: 3947148 - DNA, 20 bp, Homo sapiens
tcttggggctcgccccaccc

SEQ ID NO: 3947149 - DNA, 19 bp, Homo sapiens
tcttggtgatggagtgtgc

SEQ ID NO: 3947150 - DNA, 14 bp, Homo sapiens
tcttggtttgggga

SEQ ID NO: 3947151 - DNA, 17 bp, Homo sapiens
tcttggtttggggagaa

SEQ ID NO: 3947152 - DNA, 20 bp, Homo sapiens
tcttggtttggggagaaata

SEQ ID NO: 3947153 - DNA, 21 bp, Homo sapiens
tcttgtatttgggccaaggtg

SEQ ID NO: 3947154 - DNA, 20 bp, Homo sapiens
tcttgtccacagtctcccat

SEQ ID NO: 3947155 - DNA, 18 bp, Homo sapiens
tcttgtgaaaccacaggc

SEQ ID NO: 3947156 - DNA, 12 bp, Homo sapiens
tcttgtgcctca

SEQ ID NO: 3947157 - DNA, 15 bp, Homo sapiens
tcttgtgctcacgct

SEQ ID NO: 3947158 - DNA, 13 bp, Homo sapiens
tcttgtgtcctga

SEQ ID NO: 3947159 - DNA, 21 bp, Homo sapiens
tcttgttttttttttccactt

SEQ ID NO: 3947160 - DNA, 13 bp, Homo sapiens
tctttaaatcaaa

SEQ ID NO: 3947161 - DNA, 22 bp, Homo sapiens
tctttaaatttttatcttactt

SEQ ID NO: 3947162 - DNA, 18 bp, Homo sapiens
tgaacacaattgatactt

SEQ ID NO: 3947163 - DNA, 19 bp, Homo sapiens
tgaacacacatggatgcac

SEQ ID NO: 3947164 - DNA, 16 bp, Homo sapiens
tgaacacactcagcag

SEQ ID NO: 3947165 - DNA, 14 bp, Homo sapiens
tgaacccaggaggt

SEQ ID NO: 3947166 - DNA, 19 bp, Homo sapiens
tgaacccaggaggtggagg

SEQ ID NO: 3947167 - DNA, 21 bp, Homo sapiens
tgaaccccatgggcttggact

SEQ ID NO: 3947168 - DNA, 13 bp, Homo sapiens
tgaacccctgtgt

SEQ ID NO: 3947169 - DNA, 14 bp, Homo sapiens
tgaacccctgtgtc

SEQ ID NO: 3947170 - DNA, 13 bp, Homo sapiens
tgaacctcagttt

SEQ ID NO: 3947171 - DNA, 19 bp, Homo sapiens
tgaacctcagtttcctcat

SEQ ID NO: 3947172 - DNA, 19 bp, Homo sapiens
tgaacctttaaagtaaagg

SEQ ID NO: 3947173 - DNA, 20 bp, Homo sapiens
tgaacgatatgtagcagaaa

SEQ ID NO: 3947174 - DNA, 21 bp, Homo sapiens
tgaacgatatgtagcagaaag

SEQ ID NO: 3947175 - DNA, 21 bp, Homo sapiens
tgaactacgcttgctcatttt

SEQ ID NO: 3947176 - DNA, 18 bp, Homo sapiens
tgaacttgaggacacatg

SEQ ID NO: 3947177 - DNA, 19 bp, Homo sapiens
tgaacttgaggacacatgt

SEQ ID NO: 3947178 - DNA, 20 bp, Homo sapiens
tgaacttgaggacacatgtc

SEQ ID NO: 3947179 - DNA, 14 bp, Homo sapiens
tgaactttccaaaa

SEQ ID NO: 3947180 - DNA, 21 bp, Homo sapiens
tgaactttctcttcatacttt

SEQ ID NO: 3947181 - DNA, 19 bp, Homo sapiens
tgaagacccagtgtaaaga

SEQ ID NO: 3947182 - DNA, 24 bp, Homo sapiens
tgaagacctccacattaagtggct

SEQ ID NO: 3947183 - DNA, 15 bp, Homo sapiens
tgaagacttcttggg

SEQ ID NO: 3947184 - DNA, 19 bp, Homo sapiens
tgaagagaagctgagaaga

SEQ ID NO: 3947185 - DNA, 22 bp, Homo sapiens
tgaagagaagctgagaagaagc

SEQ ID NO: 3947186 - DNA, 17 bp, Homo sapiens
tgaagagacagttattt

SEQ ID NO: 3947187 - DNA, 23 bp, Homo sapiens
tgaagagacagttatttatagtc

SEQ ID NO: 3947188 - DNA, 19 bp, Homo sapiens
tgaagaggcaagagacaga

SEQ ID NO: 3947189 - DNA, 13 bp, Homo sapiens
tgaagagtagttt

SEQ ID NO: 3947190 - DNA, 17 bp, Homo sapiens
tgaagagtgagagggca

SEQ ID NO: 3947191 - DNA, 23 bp, Homo sapiens
tgaagagtttaactttgggccca

SEQ ID NO: 3947192 - DNA, 22 bp, Homo sapiens
tgaagatttttaattacaataa

SEQ ID NO: 3947193 - DNA, 18 bp, Homo sapiens
tgaagcagtgcctcgagg

SEQ ID NO: 3947194 - DNA, 11 bp, Homo sapiens
tgaagccagat

SEQ ID NO: 3947195 - DNA, 16 bp, Homo sapiens
tgaagccagatccacc

SEQ ID NO: 3947196 - DNA, 19 bp, Homo sapiens
tgaagccagatccacccta

SEQ ID NO: 3947197 - DNA, 21 bp, Homo sapiens
tgaagcctctgccctgcctcc

SEQ ID NO: 3947198 - DNA, 22 bp, Homo sapiens
tgaagcctctgccctgcctccc

SEQ ID NO: 3947199 - DNA, 13 bp, Homo sapiens
tgaagctgacagc

SEQ ID NO: 3947200 - DNA, 13 bp, Homo sapiens
tgaagctttacca

SEQ ID NO: 3947201 - DNA, 20 bp, Homo sapiens
tgaaggaataaattgctcct

SEQ ID NO: 3947202 - DNA, 18 bp, Homo sapiens
tgaaggagaaaggagccg

SEQ ID NO: 3947203 - DNA, 19 bp, Homo sapiens
tgaaggcagtctgaaccct

SEQ ID NO: 3947204 - DNA, 18 bp, Homo sapiens
tgaagggaaaggatattt

SEQ ID NO: 3947205 - DNA, 21 bp, Homo sapiens
tgaagggaaaggatattttct

SEQ ID NO: 3947206 - DNA, 18 bp, Homo sapiens
tgaagggggcggcctatg

SEQ ID NO: 3947207 - DNA, 23 bp, Homo sapiens
tgaagggtgacatcccaggaggg

SEQ ID NO: 3947208 - DNA, 11 bp, Homo sapiens
tgaagtaacct

SEQ ID NO: 3947209 - DNA, 15 bp, Homo sapiens
tgaagtagtttgtat

SEQ ID NO: 3947210 - DNA, 15 bp, Homo sapiens
tgaagtcactgcaca

SEQ ID NO: 3947211 - DNA, 16 bp, Homo sapiens
tgaagtcactgcacag

SEQ ID NO: 3947212 - DNA, 21 bp, Homo sapiens
tgaagtcattgtcgctcagca

SEQ ID NO: 3947213 - DNA, 16 bp, Homo sapiens
tgaagtcgttgtgagg

SEQ ID NO: 3947214 - DNA, 21 bp, Homo sapiens
tgaagtgaaggagaaaggagc

SEQ ID NO: 3947215 - DNA, 19 bp, Homo sapiens
tgaagttcatggtgatcag

SEQ ID NO: 3947216 - DNA, 15 bp, Homo sapiens
tgaataaacttcagc

SEQ ID NO: 3947217 - DNA, 17 bp, Homo sapiens
tgaataaacttcagcac

SEQ ID NO: 3947218 - DNA, 19 bp, Homo sapiens
aaaaattaagagatacatt

SEQ ID NO: 3947219 - DNA, 14 bp, Homo sapiens
aaaaattgcacaat

SEQ ID NO: 3947220 - DNA, 17 bp, Homo sapiens
aaaaattgcacaatttg

SEQ ID NO: 3947221 - DNA, 14 bp, Homo sapiens
aaaacaaaaagaca

SEQ ID NO: 3947222 - DNA, 14 bp, Homo sapiens
aaaacaaaaataaa

SEQ ID NO: 3947223 - DNA, 12 bp, Homo sapiens
aaaacaaaacaa

SEQ ID NO: 3947224 - DNA, 16 bp, Homo sapiens
aaaacaaaagagagaa

SEQ ID NO: 3947225 - DNA, 14 bp, Homo sapiens
aaaacaaatcttca

SEQ ID NO: 3947226 - DNA, 16 bp, Homo sapiens
aaaacaatcacactca

SEQ ID NO: 3947227 - DNA, 19 bp, Homo sapiens
aaaacaatcatttgctttt

SEQ ID NO: 3947228 - DNA, 21 bp, Homo sapiens
aaaacactaaaaataaaaatg

SEQ ID NO: 3947229 - DNA, 17 bp, Homo sapiens
aaaacagcccaggtcct

SEQ ID NO: 3947230 - DNA, 13 bp, Homo sapiens
aaaacaggaaaaa

SEQ ID NO: 3947231 - DNA, 18 bp, Homo sapiens
aaaacaggtggagaaatt

SEQ ID NO: 3947232 - DNA, 17 bp, Homo sapiens
aaaacatacccagtgtt

SEQ ID NO: 3947233 - DNA, 11 bp, Homo sapiens
aaaacatatca

SEQ ID NO: 3947234 - DNA, 13 bp, Homo sapiens
aaaacatatcaat

SEQ ID NO: 3947235 - DNA, 22 bp, Homo sapiens
aaaacatatcaattcaacacat

SEQ ID NO: 3947236 - DNA, 11 bp, Homo sapiens
aaaacatgaaa

SEQ ID NO: 3947237 - DNA, 14 bp, Homo sapiens
aaaacatggtagaa

SEQ ID NO: 3947238 - DNA, 16 bp, Homo sapiens
aaaacatggtagaatt

SEQ ID NO: 3947239 - DNA, 14 bp, Homo sapiens
aaaacattcatcca

SEQ ID NO: 3947240 - DNA, 17 bp, Homo sapiens
aaaacatttactgacca

SEQ ID NO: 3947241 - DNA, 23 bp, Homo sapiens
aaaaccaatgattcataacaatg

SEQ ID NO: 3947242 - DNA, 17 bp, Homo sapiens
aaaaccagaatcataat

SEQ ID NO: 3947243 - DNA, 19 bp, Homo sapiens
aaaaccagaatcataattt

SEQ ID NO: 3947244 - DNA, 21 bp, Homo sapiens
aaaaccagaatcataattttc

SEQ ID NO: 3947245 - DNA, 14 bp, Homo sapiens
aaaaccatgcagct

SEQ ID NO: 3947246 - DNA, 18 bp, Homo sapiens
aaaaccatgcagcttcat

SEQ ID NO: 3947247 - DNA, 12 bp, Homo sapiens
aaaacccagaga

SEQ ID NO: 3947248 - DNA, 15 bp, Homo sapiens
aaaacccagagagga

SEQ ID NO: 3947249 - DNA, 14 bp, Homo sapiens
aaaacccagcatgt

SEQ ID NO: 3947250 - DNA, 16 bp, Homo sapiens
aaaacccagcatgtac

SEQ ID NO: 3947251 - DNA, 19 bp, Homo sapiens
aaaacccagcatgtacaaa

SEQ ID NO: 3947252 - DNA, 22 bp, Homo sapiens
aaaacctagaacttcaaaatgt

SEQ ID NO: 3947253 - DNA, 13 bp, Homo sapiens
aaaacctttcaaa

SEQ ID NO: 3947254 - DNA, 20 bp, Homo sapiens
aaaacctttccccagacaca

SEQ ID NO: 3947255 - DNA, 17 bp, Homo sapiens
aaaacgcaaagggctga

SEQ ID NO: 3947256 - DNA, 13 bp, Homo sapiens
aaaacgcctcttt

SEQ ID NO: 3947257 - DNA, 13 bp, Homo sapiens
aaaacgtgggtat

SEQ ID NO: 3947258 - DNA, 21 bp, Homo sapiens
aaaacgtgggtatttcctgct

SEQ ID NO: 3947259 - DNA, 19 bp, Homo sapiens
aaaactaaatctctaatat

SEQ ID NO: 3947260 - DNA, 13 bp, Homo sapiens
aaaactcattttt

SEQ ID NO: 3947261 - DNA, 15 bp, Homo sapiens
aaaactgacagagga

SEQ ID NO: 3947262 - DNA, 17 bp, Homo sapiens
aaaactgatcaaaaata

SEQ ID NO: 3947263 - DNA, 20 bp, Homo sapiens
aaaactgatcaaaaataaac

SEQ ID NO: 3947264 - DNA, 22 bp, Homo sapiens
aaaactgatcaaaaataaacta

SEQ ID NO: 3947265 - DNA, 17 bp, Homo sapiens
aaaacttaacatattta

SEQ ID NO: 3947266 - DNA, 19 bp, Homo sapiens
aaaacttaacatatttact

SEQ ID NO: 3947267 - DNA, 17 bp, Homo sapiens
aaaacttgtaaatgctg

SEQ ID NO: 3947268 - DNA, 18 bp, Homo sapiens
aaaagaaaaaaaaagcat

SEQ ID NO: 3947269 - DNA, 17 bp, Homo sapiens
aaaagaaaaccatttta

SEQ ID NO: 3947270 - DNA, 17 bp, Homo sapiens
aaaagaacactagagtc

SEQ ID NO: 3947271 - DNA, 13 bp, Homo sapiens
aaaagaagactgg

SEQ ID NO: 3947272 - DNA, 16 bp, Homo sapiens
aaaagaagagccttgt

SEQ ID NO: 3947273 - DNA, 16 bp, Homo sapiens
aaaagaatacagaaag

SEQ ID NO: 3947274 - DNA, 20 bp, Homo sapiens
aaaagaccacagacttctgg

SEQ ID NO: 3947275 - DNA, 14 bp, Homo sapiens
aaaagaccagggct

SEQ ID NO: 3947276 - DNA, 19 bp, Homo sapiens
aaaagaccctgagactcca

SEQ ID NO: 3947277 - DNA, 16 bp, Homo sapiens
aaaagactcagtgttc

SEQ ID NO: 3947278 - DNA, 13 bp, Homo sapiens
aaaagactccaaa

SEQ ID NO: 3947279 - DNA, 19 bp, Homo sapiens
aaaagagagaaaacttatt

SEQ ID NO: 3947280 - DNA, 21 bp, Homo sapiens
aaaagagagaaaacttatttg

SEQ ID NO: 3947281 - DNA, 17 bp, Homo sapiens
aaaagataaagatgatc

SEQ ID NO: 3947282 - DNA, 18 bp, Homo sapiens
aaaagataaagatgatct

SEQ ID NO: 3947283 - DNA, 20 bp, Homo sapiens
aaaagataaagatgatctac

SEQ ID NO: 3947284 - DNA, 23 bp, Homo sapiens
aaaagcagacgcagcagctggga

SEQ ID NO: 3947285 - DNA, 13 bp, Homo sapiens
aaaagcataaatg

SEQ ID NO: 3947286 - DNA, 14 bp, Homo sapiens
aaaagctgcttgac

SEQ ID NO: 3947287 - DNA, 11 bp, Homo sapiens
aaaaggagaga

SEQ ID NO: 3947288 - DNA, 13 bp, Homo sapiens
aaaaggcctgggg

SEQ ID NO: 3947289 - DNA, 14 bp, Homo sapiens
aaaaggcctggggt

SEQ ID NO: 3947290 - DNA, 23 bp, Homo sapiens
aaaagggacagtattctcagtgc

SEQ ID NO: 3947291 - DNA, 14 bp, Homo sapiens
aaaagggcagccag

SEQ ID NO: 3947292 - DNA, 22 bp, Homo sapiens
aaaaggtagcttacctgacaca

SEQ ID NO: 3947293 - DNA, 22 bp, Homo sapiens
aaaaggtgcctgtgaggcaggg

SEQ ID NO: 3947294 - DNA, 20 bp, Homo sapiens
aaaaggttcttcatcccttt

SEQ ID NO: 3947295 - DNA, 21 bp, Homo sapiens
aaaagtacatttaatacagca

SEQ ID NO: 3947296 - DNA, 20 bp, Homo sapiens
aaaagtatacttttgtttca

SEQ ID NO: 3947297 - DNA, 14 bp, Homo sapiens
aaaagtgactctca

SEQ ID NO: 3947298 - DNA, 17 bp, Homo sapiens
aaaagtgactctcagcg

SEQ ID NO: 3947299 - DNA, 21 bp, Homo sapiens
aaaagtgatctgtcccctctc

SEQ ID NO: 3947300 - DNA, 16 bp, Homo sapiens
aaaagttcgaaagaaa

SEQ ID NO: 3947301 - DNA, 17 bp, Homo sapiens
aaaagttgcagtctcag

SEQ ID NO: 3947302 - DNA, 16 bp, Homo sapiens
aaaagtttgccagaag

SEQ ID NO: 3947303 - DNA, 18 bp, Homo sapiens
aaaataaaaaaatacagt

SEQ ID NO: 3947304 - DNA, 17 bp, Homo sapiens
aaaataaaaacataaaa

SEQ ID NO: 3947305 - DNA, 12 bp, Homo sapiens
aaaggcctggaa

SEQ ID NO: 3947306 - DNA, 20 bp, Homo sapiens
aaaggcctggaaccagggag

SEQ ID NO: 3947307 - DNA, 11 bp, Homo sapiens
aaaggcctggg

SEQ ID NO: 3947308 - DNA, 19 bp, Homo sapiens
aaaggctagtttattttgt

SEQ ID NO: 3947309 - DNA, 19 bp, Homo sapiens
aaagggagggctctgaggc

SEQ ID NO: 3947310 - DNA, 13 bp, Homo sapiens
aaaggggctgctg

SEQ ID NO: 3947311 - DNA, 14 bp, Homo sapiens
aaaggggctgctgg

SEQ ID NO: 3947312 - DNA, 15 bp, Homo sapiens
aaaggggctgctggg

SEQ ID NO: 3947313 - DNA, 23 bp, Homo sapiens
aaagggtctgataaacacagagg

SEQ ID NO: 3947314 - DNA, 16 bp, Homo sapiens
aaaggtagagatgtgt

SEQ ID NO: 3947315 - DNA, 20 bp, Homo sapiens
aaaggtagagatgtgtgtgt

SEQ ID NO: 3947316 - DNA, 21 bp, Homo sapiens
aaaggtagcttacctgacaca

SEQ ID NO: 3947317 - DNA, 16 bp, Homo sapiens
aaaggtataattttat

SEQ ID NO: 3947318 - DNA, 18 bp, Homo sapiens
aaaggtcattgtggctat

SEQ ID NO: 3947319 - DNA, 14 bp, Homo sapiens
aaaggttcttcatc

SEQ ID NO: 3947320 - DNA, 22 bp, Homo sapiens
aaaggttcttcatccctttcca

SEQ ID NO: 3947321 - DNA, 22 bp, Homo sapiens
aaaggtttcatgtagattttag

SEQ ID NO: 3947322 - DNA, 14 bp, Homo sapiens
aaaggttttcctct

SEQ ID NO: 3947323 - DNA, 22 bp, Homo sapiens
aaagtaaaggcctcatctcctt

SEQ ID NO: 3947324 - DNA, 19 bp, Homo sapiens
aaagtaacaaggtgtcttt

SEQ ID NO: 3947325 - DNA, 12 bp, Homo sapiens
aaagtacattta

SEQ ID NO: 3947326 - DNA, 13 bp, Homo sapiens
aaagtacatttaa

SEQ ID NO: 3947327 - DNA, 19 bp, Homo sapiens
aaagtagaattatatctaa

SEQ ID NO: 3947328 - DNA, 12 bp, Homo sapiens
aaagtatcatgc

SEQ ID NO: 3947329 - DNA, 14 bp, Homo sapiens
aaagtatcatgcat

SEQ ID NO: 3947330 - DNA, 16 bp, Homo sapiens
aaagtatcatgcattc

SEQ ID NO: 3947331 - DNA, 19 bp, Homo sapiens
aaagtatgtaaagtatgta

SEQ ID NO: 3947332 - DNA, 21 bp, Homo sapiens
aaagtatttttttaagttaga

SEQ ID NO: 3947333 - DNA, 18 bp, Homo sapiens
aaagtcaaaaggtgcctg

SEQ ID NO: 3947334 - DNA, 20 bp, Homo sapiens
aaagtcagctttcagagcca

SEQ ID NO: 3947335 - DNA, 19 bp, Homo sapiens
aaagtctaaagtttacagt

SEQ ID NO: 3947336 - DNA, 17 bp, Homo sapiens
aaagtctattgtttgtt

SEQ ID NO: 3947337 - DNA, 23 bp, Homo sapiens
aaagtctgtgtgatgaactttct

SEQ ID NO: 3947338 - DNA, 22 bp, Homo sapiens
aaagtgaggaagcctaaataaa

SEQ ID NO: 3947339 - DNA, 20 bp, Homo sapiens
aaagtgatctgtcccctctc

SEQ ID NO: 3947340 - DNA, 22 bp, Homo sapiens
aaagtgatctgtcccctctccc

SEQ ID NO: 3947341 - DNA, 15 bp, Homo sapiens
aaagtgcagcccttc

SEQ ID NO: 3947342 - DNA, 17 bp, Homo sapiens
aaagtgcagcccttcct

SEQ ID NO: 3947343 - DNA, 16 bp, Homo sapiens
aaagtgccagaaagtg

SEQ ID NO: 3947344 - DNA, 12 bp, Homo sapiens
aaagtgccctca

SEQ ID NO: 3947345 - DNA, 19 bp, Homo sapiens
aaagtgcttagaaagttat

SEQ ID NO: 3947346 - DNA, 17 bp, Homo sapiens
aaagtggccatgccacc

SEQ ID NO: 3947347 - DNA, 22 bp, Homo sapiens
aaagtggctaattcaatttatg

SEQ ID NO: 3947348 - DNA, 17 bp, Homo sapiens
aaagtgtaaaatagaat

SEQ ID NO: 3947349 - DNA, 15 bp, Homo sapiens
aaagtgtaataatat

SEQ ID NO: 3947350 - DNA, 19 bp, Homo sapiens
aaagtgttggctaatgaag

SEQ ID NO: 3947351 - DNA, 14 bp, Homo sapiens
aaagttagctgagc

SEQ ID NO: 3947352 - DNA, 22 bp, Homo sapiens
aaagttattgtgttgccttagc

SEQ ID NO: 3947353 - DNA, 23 bp, Homo sapiens
aaagttccctacttcctgtgact

SEQ ID NO: 3947354 - DNA, 18 bp, Homo sapiens
aaataaaaaaatacagta

SEQ ID NO: 3947355 - DNA, 19 bp, Homo sapiens
aaataaaaaaatacagtaa

SEQ ID NO: 3947356 - DNA, 22 bp, Homo sapiens
aaataaaaaccagaatcataat

SEQ ID NO: 3947357 - DNA, 12 bp, Homo sapiens
aaataaaacctt

SEQ ID NO: 3947358 - DNA, 13 bp, Homo sapiens
aaataaaaccttt

SEQ ID NO: 3947359 - DNA, 22 bp, Homo sapiens
aaataaaccaaaggacattatg

SEQ ID NO: 3947360 - DNA, 18 bp, Homo sapiens
aaataaacctggagatga

SEQ ID NO: 3947361 - DNA, 22 bp, Homo sapiens
aaataaacctggagatgatgat

SEQ ID NO: 3947362 - DNA, 14 bp, Homo sapiens
aaataaactctaaa

SEQ ID NO: 3947363 - DNA, 11 bp, Homo sapiens
aaataaagcct

SEQ ID NO: 3947364 - DNA, 19 bp, Homo sapiens
aaataaagtatcatgcatt

SEQ ID NO: 3947365 - DNA, 11 bp, Homo sapiens
aaataaatgtg

SEQ ID NO: 3947366 - DNA, 17 bp, Homo sapiens
aaataaatgtttttatt

SEQ ID NO: 3947367 - DNA, 17 bp, Homo sapiens
aaataaattatattaat

SEQ ID NO: 3947368 - DNA, 15 bp, Homo sapiens
aaataaattcaaacc

SEQ ID NO: 3947369 - DNA, 19 bp, Homo sapiens
aaataaattggtgataagt

SEQ ID NO: 3947370 - DNA, 22 bp, Homo sapiens
aaataaattggtgataagtgga

SEQ ID NO: 3947371 - DNA, 15 bp, Homo sapiens
aaataaattgtttga

SEQ ID NO: 3947372 - DNA, 17 bp, Homo sapiens
aaataactagtgttgct

SEQ ID NO: 3947373 - DNA, 15 bp, Homo sapiens
aaataatgaacagca

SEQ ID NO: 3947374 - DNA, 18 bp, Homo sapiens
aaataattttaaacaaag

SEQ ID NO: 3947375 - DNA, 13 bp, Homo sapiens
aaatacaaaataa

SEQ ID NO: 3947376 - DNA, 21 bp, Homo sapiens
aaatacaaaataaaattatgg

SEQ ID NO: 3947377 - DNA, 21 bp, Homo sapiens
aaatacaccacctcactcctg

SEQ ID NO: 3947378 - DNA, 23 bp, Homo sapiens
aaatacaccacctcactcctgtt

SEQ ID NO: 3947379 - DNA, 22 bp, Homo sapiens
aaatacagacactaagttatag

SEQ ID NO: 3947380 - DNA, 12 bp, Homo sapiens
aaatacatgtgt

SEQ ID NO: 3947381 - DNA, 21 bp, Homo sapiens
aaatacatgtgtggatgtgta

SEQ ID NO: 3947382 - DNA, 18 bp, Homo sapiens
aaataccagtgaaccaaa

SEQ ID NO: 3947383 - DNA, 17 bp, Homo sapiens
aaataccagtgtggttt

SEQ ID NO: 3947384 - DNA, 19 bp, Homo sapiens
aaataccatgtctctaagc

SEQ ID NO: 3947385 - DNA, 22 bp, Homo sapiens
aaatactgcctagaaaatgcaa

SEQ ID NO: 3947386 - DNA, 16 bp, Homo sapiens
aaatagacagtatatt

SEQ ID NO: 3947387 - DNA, 19 bp, Homo sapiens
aaatagagattaattttaa

SEQ ID NO: 3947388 - DNA, 16 bp, Homo sapiens
aaatagcttgtatagt

SEQ ID NO: 3947389 - DNA, 11 bp, Homo sapiens
aaatataaaac

SEQ ID NO: 3947390 - DNA, 12 bp, Homo sapiens
aaatataaatgc

SEQ ID NO: 3947391 - DNA, 23 bp, Homo sapiens
aaccaatgagctgtatctgtaat

SEQ ID NO: 3947392 - DNA, 19 bp, Homo sapiens
aaccaatgattcataacaa

SEQ ID NO: 3947393 - DNA, 22 bp, Homo sapiens
aaccaatgattcataacaatgt

SEQ ID NO: 3947394 - DNA, 17 bp, Homo sapiens
aaccacaactgacacag

SEQ ID NO: 3947395 - DNA, 15 bp, Homo sapiens
aaccacacacctcac

SEQ ID NO: 3947396 - DNA, 19 bp, Homo sapiens
aaccacctaatcaggctga

SEQ ID NO: 3947397 - DNA, 12 bp, Homo sapiens
aaccactgtaca

SEQ ID NO: 3947398 - DNA, 13 bp, Homo sapiens
aaccagagccccc

SEQ ID NO: 3947399 - DNA, 18 bp, Homo sapiens
aaccagagccccccacaa

SEQ ID NO: 3947400 - DNA, 20 bp, Homo sapiens
aaccagagccccccacaatg

SEQ ID NO: 3947401 - DNA, 15 bp, Homo sapiens
aaccagcagaaaagt

SEQ ID NO: 3947402 - DNA, 12 bp, Homo sapiens
aaccagcattca

SEQ ID NO: 3947403 - DNA, 13 bp, Homo sapiens
aaccagggaggag

SEQ ID NO: 3947404 - DNA, 16 bp, Homo sapiens
aaccagtacttctaag

SEQ ID NO: 3947405 - DNA, 13 bp, Homo sapiens
aaccataaacttc

SEQ ID NO: 3947406 - DNA, 18 bp, Homo sapiens
aaccataaacttcatggt

SEQ ID NO: 3947407 - DNA, 19 bp, Homo sapiens
aaccatgcaaatgctatga

SEQ ID NO: 3947408 - DNA, 12 bp, Homo sapiens
aaccatgtagtt

SEQ ID NO: 3947409 - DNA, 15 bp, Homo sapiens
aaccattacatgttt

SEQ ID NO: 3947410 - DNA, 13 bp, Homo sapiens
aaccattactgta

SEQ ID NO: 3947411 - DNA, 14 bp, Homo sapiens
aaccatttaattca

SEQ ID NO: 3947412 - DNA, 16 bp, Homo sapiens
aaccatttaattcata

SEQ ID NO: 3947413 - DNA, 17 bp, Homo sapiens
aaccatttaattcataa

SEQ ID NO: 3947414 - DNA, 18 bp, Homo sapiens
aaccatttaattcataat

SEQ ID NO: 3947415 - DNA, 19 bp, Homo sapiens
aaccatttaattcataatt

SEQ ID NO: 3947416 - DNA, 23 bp, Homo sapiens
aaccatttaattcataattagaa

SEQ ID NO: 3947417 - DNA, 20 bp, Homo sapiens
aacccaattcaggactggct

SEQ ID NO: 3947418 - DNA, 12 bp, Homo sapiens
aacccagagagg

SEQ ID NO: 3947419 - DNA, 17 bp, Homo sapiens
aacccagcaacagaaaa

SEQ ID NO: 3947420 - DNA, 23 bp, Homo sapiens
aacccagcaacagaaaaatggag

SEQ ID NO: 3947421 - DNA, 16 bp, Homo sapiens
aacccagcatgtacaa

SEQ ID NO: 3947422 - DNA, 20 bp, Homo sapiens
aacccagctcccttcttccc

SEQ ID NO: 3947423 - DNA, 18 bp, Homo sapiens
aaccccaacgcacaggaa

SEQ ID NO: 3947424 - DNA, 12 bp, Homo sapiens
aaccccagctgg

SEQ ID NO: 3947425 - DNA, 23 bp, Homo sapiens
aaccccagctggcctctagaaca

SEQ ID NO: 3947426 - DNA, 18 bp, Homo sapiens
aaccccaggcatcccatc

SEQ ID NO: 3947427 - DNA, 12 bp, Homo sapiens
aaccccagttct

SEQ ID NO: 3947428 - DNA, 18 bp, Homo sapiens
aaccccagttctgctcct

SEQ ID NO: 3947429 - DNA, 22 bp, Homo sapiens
aaccccagttctgctcctctcc

SEQ ID NO: 3947430 - DNA, 19 bp, Homo sapiens
aacccccagtgccacagag

SEQ ID NO: 3947431 - DNA, 16 bp, Homo sapiens
aacccccgctccagat

SEQ ID NO: 3947432 - DNA, 17 bp, Homo sapiens
aaccccgcggtgctctg

SEQ ID NO: 3947433 - DNA, 11 bp, Homo sapiens
aacccctgtgt

SEQ ID NO: 3947434 - DNA, 14 bp, Homo sapiens
aacccgtgccaagt

SEQ ID NO: 3947435 - DNA, 13 bp, Homo sapiens
aacccgtggaggc

SEQ ID NO: 3947436 - DNA, 12 bp, Homo sapiens
aaccctcagagc

SEQ ID NO: 3947437 - DNA, 16 bp, Homo sapiens
aaccctctcttcccta

SEQ ID NO: 3947438 - DNA, 22 bp, Homo sapiens
aaccctggcttgcttgccgagc

SEQ ID NO: 3947439 - DNA, 22 bp, Homo sapiens
aaccctgttttatactgtactt

SEQ ID NO: 3947440 - DNA, 23 bp, Homo sapiens
aaccctgttttatactgtactta

SEQ ID NO: 3947441 - DNA, 14 bp, Homo sapiens
aacccttctcttct

SEQ ID NO: 3947442 - DNA, 21 bp, Homo sapiens
aacccttggagccaatggaga

SEQ ID NO: 3947443 - DNA, 21 bp, Homo sapiens
aacccttttcctccagacaga

SEQ ID NO: 3947444 - DNA, 23 bp, Homo sapiens
aacccttttcctccagacagata

SEQ ID NO: 3947445 - DNA, 18 bp, Homo sapiens
aaccgcactcacccatgt

SEQ ID NO: 3947446 - DNA, 17 bp, Homo sapiens
aaccgtggcccttcctg

SEQ ID NO: 3947447 - DNA, 18 bp, Homo sapiens
aaccgtggcccttcctgg

SEQ ID NO: 3947448 - DNA, 19 bp, Homo sapiens
aaccgtggcccttcctgga

SEQ ID NO: 3947449 - DNA, 20 bp, Homo sapiens
aacctaccaccccttcctgt

SEQ ID NO: 3947450 - DNA, 16 bp, Homo sapiens
aacctagaacttcaaa

SEQ ID NO: 3947451 - DNA, 19 bp, Homo sapiens
aacctagaacttcaaaatg

SEQ ID NO: 3947452 - DNA, 13 bp, Homo sapiens
aacctagtactct

SEQ ID NO: 3947453 - DNA, 11 bp, Homo sapiens
aacctcaaact

SEQ ID NO: 3947454 - DNA, 18 bp, Homo sapiens
aacctcaatgccctgcca

SEQ ID NO: 3947455 - DNA, 17 bp, Homo sapiens
aacctcagccaaacaca

SEQ ID NO: 3947456 - DNA, 20 bp, Homo sapiens
aacctcatcctccttcttca

SEQ ID NO: 3947457 - DNA, 16 bp, Homo sapiens
aacctcatttaccata

SEQ ID NO: 3947458 - DNA, 15 bp, Homo sapiens
aacctcccaacccag

SEQ ID NO: 3947459 - DNA, 16 bp, Homo sapiens
aacctccgtgctgggc

SEQ ID NO: 3947460 - DNA, 15 bp, Homo sapiens
aacctcttcctcctg

SEQ ID NO: 3947461 - DNA, 17 bp, Homo sapiens
aacctgaattattccaa

SEQ ID NO: 3947462 - DNA, 17 bp, Homo sapiens
aacctgcagttcctgag

SEQ ID NO: 3947463 - DNA, 11 bp, Homo sapiens
aacctgctctc

SEQ ID NO: 3947464 - DNA, 15 bp, Homo sapiens
aacctggagatgatg

SEQ ID NO: 3947465 - DNA, 19 bp, Homo sapiens
aacctggcaagctagaacc

SEQ ID NO: 3947466 - DNA, 11 bp, Homo sapiens
aacctggcctt

SEQ ID NO: 3947467 - DNA, 21 bp, Homo sapiens
aacctggtggcaccagatgca

SEQ ID NO: 3947468 - DNA, 13 bp, Homo sapiens
aaccttccctcca

SEQ ID NO: 3947469 - DNA, 14 bp, Homo sapiens
aaccttgcagcatt

SEQ ID NO: 3947470 - DNA, 20 bp, Homo sapiens
aacctttaaagtaaaggcct

SEQ ID NO: 3947471 - DNA, 14 bp, Homo sapiens
aacctttcaaattt

SEQ ID NO: 3947472 - DNA, 23 bp, Homo sapiens
aacctttccgctgtcgccccagg

SEQ ID NO: 3947473 - DNA, 17 bp, Homo sapiens
aacgaacccactgtgct

SEQ ID NO: 3947474 - DNA, 17 bp, Homo sapiens
aacgactccgagaacaa

SEQ ID NO: 3947475 - DNA, 16 bp, Homo sapiens
aacgagcactggccag

SEQ ID NO: 3947476 - DNA, 12 bp, Homo sapiens
aacgagggataa

SEQ ID NO: 3947477 - DNA, 12 bp, Homo sapiens
aacgcacaggaa

SEQ ID NO: 3947478 - DNA, 17 bp, Homo sapiens
aagcaagggctccagca

SEQ ID NO: 3947479 - DNA, 13 bp, Homo sapiens
aagcaattatatt

SEQ ID NO: 3947480 - DNA, 17 bp, Homo sapiens
aagcaattgccctgtaa

SEQ ID NO: 3947481 - DNA, 21 bp, Homo sapiens
aagcacaatgtctcacatggg

SEQ ID NO: 3947482 - DNA, 16 bp, Homo sapiens
aagcacatgtttattt

SEQ ID NO: 3947483 - DNA, 12 bp, Homo sapiens
aagcacccttga

SEQ ID NO: 3947484 - DNA, 12 bp, Homo sapiens
aagcacctgccg

SEQ ID NO: 3947485 - DNA, 23 bp, Homo sapiens
aagcactcccttaggcattattt

SEQ ID NO: 3947486 - DNA, 20 bp, Homo sapiens
aagcactcgagaccatcctg

SEQ ID NO: 3947487 - DNA, 16 bp, Homo sapiens
aagcactgacttctaa

SEQ ID NO: 3947488 - DNA, 20 bp, Homo sapiens
aagcactgacttctaagtaa

SEQ ID NO: 3947489 - DNA, 19 bp, Homo sapiens
aagcacttgttccttctgc

SEQ ID NO: 3947490 - DNA, 21 bp, Homo sapiens
aagcacttgttccttctgctt

SEQ ID NO: 3947491 - DNA, 22 bp, Homo sapiens
aagcacttgttccttctgcttc

SEQ ID NO: 3947492 - DNA, 11 bp, Homo sapiens
aagcacttttt

SEQ ID NO: 3947493 - DNA, 16 bp, Homo sapiens
aagcactttttaaaaa

SEQ ID NO: 3947494 - DNA, 14 bp, Homo sapiens
aagcagcattcagc

SEQ ID NO: 3947495 - DNA, 16 bp, Homo sapiens
aagcaggaaggatggc

SEQ ID NO: 3947496 - DNA, 17 bp, Homo sapiens
aagcagggacacccccc

SEQ ID NO: 3947497 - DNA, 22 bp, Homo sapiens
aagcagggacaccccccgcccc

SEQ ID NO: 3947498 - DNA, 12 bp, Homo sapiens
aagcagtgcctc

SEQ ID NO: 3947499 - DNA, 20 bp, Homo sapiens
aagcagtgcctcgaggcacc

SEQ ID NO: 3947500 - DNA, 16 bp, Homo sapiens
aagcagtgcttgtaaa

SEQ ID NO: 3947501 - DNA, 19 bp, Homo sapiens
aagcatcttgtcaagaaat

SEQ ID NO: 3947502 - DNA, 11 bp, Homo sapiens
aagcatggact

SEQ ID NO: 3947503 - DNA, 22 bp, Homo sapiens
aagcatggtcccacatccctgg

SEQ ID NO: 3947504 - DNA, 23 bp, Homo sapiens
aagcatggtcccacatccctggg

SEQ ID NO: 3947505 - DNA, 17 bp, Homo sapiens
aagcatgtctcaatagt

SEQ ID NO: 3947506 - DNA, 16 bp, Homo sapiens
aagcattctgagctgg

SEQ ID NO: 3947507 - DNA, 18 bp, Homo sapiens
aagcattctgagctgggc

SEQ ID NO: 3947508 - DNA, 14 bp, Homo sapiens
aagcattgagatct

SEQ ID NO: 3947509 - DNA, 18 bp, Homo sapiens
aagcattgtaaatgtgct

SEQ ID NO: 3947510 - DNA, 22 bp, Homo sapiens
aagccaacttggctttcccgga

SEQ ID NO: 3947511 - DNA, 16 bp, Homo sapiens
aagccaacttgtaaat

SEQ ID NO: 3947512 - DNA, 15 bp, Homo sapiens
aagccacaagaaatt

SEQ ID NO: 3947513 - DNA, 16 bp, Homo sapiens
aagccacaagaaattt

SEQ ID NO: 3947514 - DNA, 19 bp, Homo sapiens
aagccacaggagccccacc

SEQ ID NO: 3947515 - DNA, 14 bp, Homo sapiens
aagccagagcctgg

SEQ ID NO: 3947516 - DNA, 21 bp, Homo sapiens
aagccaggagcaaatgtttct

SEQ ID NO: 3947517 - DNA, 19 bp, Homo sapiens
aagccatggtgacacacag

SEQ ID NO: 3947518 - DNA, 22 bp, Homo sapiens
aagccatggtgacacacagcag

SEQ ID NO: 3947519 - DNA, 23 bp, Homo sapiens
aagccattcacttccccaatctt

SEQ ID NO: 3947520 - DNA, 23 bp, Homo sapiens
aagccattcttactcgggcgacc

SEQ ID NO: 3947521 - DNA, 14 bp, Homo sapiens
aagcccaggctgga

SEQ ID NO: 3947522 - DNA, 16 bp, Homo sapiens
aagcccaggctggaga

SEQ ID NO: 3947523 - DNA, 17 bp, Homo sapiens
aagcccagtttcccttc

SEQ ID NO: 3947524 - DNA, 21 bp, Homo sapiens
aagcccataaggccagaaact

SEQ ID NO: 3947525 - DNA, 14 bp, Homo sapiens
aagccccagggcct

SEQ ID NO: 3947526 - DNA, 15 bp, Homo sapiens
aagccccagggcctg

SEQ ID NO: 3947527 - DNA, 15 bp, Homo sapiens
aagcccctcagccct

SEQ ID NO: 3947528 - DNA, 18 bp, Homo sapiens
aagccccttgtcctctcc

SEQ ID NO: 3947529 - DNA, 18 bp, Homo sapiens
aagcccgcctctgtccta

SEQ ID NO: 3947530 - DNA, 9 bp, Homo sapiens
aagccctcc

SEQ ID NO: 3947531 - DNA, 15 bp, Homo sapiens
aagccctccttccac

SEQ ID NO: 3947532 - DNA, 19 bp, Homo sapiens
aagccctgtcgagacactt

SEQ ID NO: 3947533 - DNA, 15 bp, Homo sapiens
aagcccttccatgtc

SEQ ID NO: 3947534 - DNA, 14 bp, Homo sapiens
aagccgtgcctttc

SEQ ID NO: 3947535 - DNA, 14 bp, Homo sapiens
aagccgtggcttcc

SEQ ID NO: 3947536 - DNA, 22 bp, Homo sapiens
aagcctcactattacttgaact

SEQ ID NO: 3947537 - DNA, 14 bp, Homo sapiens
aagcctcatattta

SEQ ID NO: 3947538 - DNA, 20 bp, Homo sapiens
aagcctcatatttaaagaca

SEQ ID NO: 3947539 - DNA, 17 bp, Homo sapiens
aagcctccgtcaggaga

SEQ ID NO: 3947540 - DNA, 18 bp, Homo sapiens
aagcctctgccccaaggg

SEQ ID NO: 3947541 - DNA, 14 bp, Homo sapiens
aagcctctgccctg

SEQ ID NO: 3947542 - DNA, 19 bp, Homo sapiens
aagcctgctttttaagtgt

SEQ ID NO: 3947543 - DNA, 17 bp, Homo sapiens
aagcctggactctaagc

SEQ ID NO: 3947544 - DNA, 15 bp, Homo sapiens
aagcctgggggcctg

SEQ ID NO: 3947545 - DNA, 20 bp, Homo sapiens
aagcctgggggcctggctgg

SEQ ID NO: 3947546 - DNA, 17 bp, Homo sapiens
aagcctgttcatggcag

SEQ ID NO: 3947547 - DNA, 18 bp, Homo sapiens
aagcctgttcatggcaga

SEQ ID NO: 3947548 - DNA, 15 bp, Homo sapiens
aagccttactcacct

SEQ ID NO: 3947549 - DNA, 17 bp, Homo sapiens
aagccttactcacctct

SEQ ID NO: 3947550 - DNA, 19 bp, Homo sapiens
aagcgattcttgtgcctca

SEQ ID NO: 3947551 - DNA, 19 bp, Homo sapiens
aagcgcagggaggatgcca

SEQ ID NO: 3947552 - DNA, 13 bp, Homo sapiens
aagcgctcatctg

SEQ ID NO: 3947553 - DNA, 22 bp, Homo sapiens
aagctaacagggaaggcaggca

SEQ ID NO: 3947554 - DNA, 19 bp, Homo sapiens
aagctagaaggccacatgt

SEQ ID NO: 3947555 - DNA, 14 bp, Homo sapiens
aagctagagatatg

SEQ ID NO: 3947556 - DNA, 17 bp, Homo sapiens
aagctatccaaataact

SEQ ID NO: 3947557 - DNA, 15 bp, Homo sapiens
aagctattgatgttt

SEQ ID NO: 3947558 - DNA, 11 bp, Homo sapiens
aagctcacagt

SEQ ID NO: 3947559 - DNA, 20 bp, Homo sapiens
aagctcacagttcctcgccc

SEQ ID NO: 3947560 - DNA, 22 bp, Homo sapiens
aagctcacagttcctcgccctg

SEQ ID NO: 3947561 - DNA, 23 bp, Homo sapiens
aagctcacagttcctcgccctgg

SEQ ID NO: 3947562 - DNA, 16 bp, Homo sapiens
aagctccactgtcacc

SEQ ID NO: 3947563 - DNA, 20 bp, Homo sapiens
aagctccatctccactccag

SEQ ID NO: 3947564 - DNA, 18 bp, Homo sapiens
aagctcccagatgctggg

SEQ ID NO: 3947565 - DNA, 19 bp, Homo sapiens
aataaacatagcttgtaac

SEQ ID NO: 3947566 - DNA, 16 bp, Homo sapiens
aataaaccaaaggaca

SEQ ID NO: 3947567 - DNA, 14 bp, Homo sapiens
aataaacctggaga

SEQ ID NO: 3947568 - DNA, 15 bp, Homo sapiens
aataaacctggagat

SEQ ID NO: 3947569 - DNA, 19 bp, Homo sapiens
aataaacctggagatgatg

SEQ ID NO: 3947570 - DNA, 20 bp, Homo sapiens
aataaacctggagatgatga

SEQ ID NO: 3947571 - DNA, 17 bp, Homo sapiens
aataaactagtttccag

SEQ ID NO: 3947572 - DNA, 19 bp, Homo sapiens
aataaacttagaataaaat

SEQ ID NO: 3947573 - DNA, 14 bp, Homo sapiens
aataaacttcagca

SEQ ID NO: 3947574 - DNA, 23 bp, Homo sapiens
aataaagaactccttattttgta

SEQ ID NO: 3947575 - DNA, 13 bp, Homo sapiens
aataaagagctca

SEQ ID NO: 3947576 - DNA, 11 bp, Homo sapiens
aataaagctgg

SEQ ID NO: 3947577 - DNA, 21 bp, Homo sapiens
aataaagctggacaagaagct

SEQ ID NO: 3947578 - DNA, 18 bp, Homo sapiens
aataaaggttgttttgaa

SEQ ID NO: 3947579 - DNA, 11 bp, Homo sapiens
aataaagtatc

SEQ ID NO: 3947580 - DNA, 18 bp, Homo sapiens
aataaagtatcatgcatt

SEQ ID NO: 3947581 - DNA, 19 bp, Homo sapiens
aataaagtatcatgcattc

SEQ ID NO: 3947582 - DNA, 19 bp, Homo sapiens
aataaagttctgagtgttt

SEQ ID NO: 3947583 - DNA, 21 bp, Homo sapiens
aataaatagatttgattattt

SEQ ID NO: 3947584 - DNA, 23 bp, Homo sapiens
aataaatagatttgattatttcc

SEQ ID NO: 3947585 - DNA, 13 bp, Homo sapiens
aataaatgaatct

SEQ ID NO: 3947586 - DNA, 21 bp, Homo sapiens
aataaatgccaactggtcact

SEQ ID NO: 3947587 - DNA, 12 bp, Homo sapiens
aataaatgtgcc

SEQ ID NO: 3947588 - DNA, 21 bp, Homo sapiens
aataaatgtgccttcattttt

SEQ ID NO: 3947589 - DNA, 13 bp, Homo sapiens
aataaatgtgtaa

SEQ ID NO: 3947590 - DNA, 14 bp, Homo sapiens
aataaatgtgtaaa

SEQ ID NO: 3947591 - DNA, 15 bp, Homo sapiens
aataaatgtgtaaat

SEQ ID NO: 3947592 - DNA, 17 bp, Homo sapiens
aataaatgtgtaaatgt

SEQ ID NO: 3947593 - DNA, 18 bp, Homo sapiens
aataaatgtgtaaatgtg

SEQ ID NO: 3947594 - DNA, 12 bp, Homo sapiens
aataaattcaaa

SEQ ID NO: 3947595 - DNA, 20 bp, Homo sapiens
aataaattgctccttgacat

SEQ ID NO: 3947596 - DNA, 19 bp, Homo sapiens
aataaattggtgataagtg

SEQ ID NO: 3947597 - DNA, 23 bp, Homo sapiens
aataaattggtgataagtggaaa

SEQ ID NO: 3947598 - DNA, 13 bp, Homo sapiens
aataaattttgtt

SEQ ID NO: 3947599 - DNA, 19 bp, Homo sapiens
aataacaatgtgctctcgg

SEQ ID NO: 3947600 - DNA, 19 bp, Homo sapiens
aataacttgtcctatgtca

SEQ ID NO: 3947601 - DNA, 15 bp, Homo sapiens
aataagaaagtataa

SEQ ID NO: 3947602 - DNA, 14 bp, Homo sapiens
aataagaatgattt

SEQ ID NO: 3947603 - DNA, 17 bp, Homo sapiens
aataaggggcacctggg

SEQ ID NO: 3947604 - DNA, 16 bp, Homo sapiens
aataaggtcaatgcca

SEQ ID NO: 3947605 - DNA, 12 bp, Homo sapiens
aataagtgctgt

SEQ ID NO: 3947606 - DNA, 16 bp, Homo sapiens
aataagtgctgtttga

SEQ ID NO: 3947607 - DNA, 11 bp, Homo sapiens
aataataatta

SEQ ID NO: 3947608 - DNA, 13 bp, Homo sapiens
aataatgtgcaaa

SEQ ID NO: 3947609 - DNA, 20 bp, Homo sapiens
aataatgtgcaaattttgca

SEQ ID NO: 3947610 - DNA, 21 bp, Homo sapiens
aataattaggatctatgcaat

SEQ ID NO: 3947611 - DNA, 23 bp, Homo sapiens
aataattaggatctatgcaattt

SEQ ID NO: 3947612 - DNA, 20 bp, Homo sapiens
aataattatgagtttgctta

SEQ ID NO: 3947613 - DNA, 21 bp, Homo sapiens
aataattgatcaaattcattt

SEQ ID NO: 3947614 - DNA, 20 bp, Homo sapiens
aataattgatttcaagacct

SEQ ID NO: 3947615 - DNA, 14 bp, Homo sapiens
aataatttaactaa

SEQ ID NO: 3947616 - DNA, 18 bp, Homo sapiens
aataatttaactaattta

SEQ ID NO: 3947617 - DNA, 20 bp, Homo sapiens
aataatttaactaatttaaa

SEQ ID NO: 3947618 - DNA, 20 bp, Homo sapiens
aatacaaaataaaattatgg

SEQ ID NO: 3947619 - DNA, 17 bp, Homo sapiens
aatacaacaagaacaac

SEQ ID NO: 3947620 - DNA, 19 bp, Homo sapiens
aatacaacaagaacaacaa

SEQ ID NO: 3947621 - DNA, 14 bp, Homo sapiens
aatacacactcaaa

SEQ ID NO: 3947622 - DNA, 13 bp, Homo sapiens
aatacagacacta

SEQ ID NO: 3947623 - DNA, 20 bp, Homo sapiens
aatacagacactaagttata

SEQ ID NO: 3947624 - DNA, 20 bp, Homo sapiens
aatacagtaaagtttaaaaa

SEQ ID NO: 3947625 - DNA, 21 bp, Homo sapiens
aatacagtaaagtttaaaaaa

SEQ ID NO: 3947626 - DNA, 19 bp, Homo sapiens
aatacatgtgtggatgtgt

SEQ ID NO: 3947627 - DNA, 16 bp, Homo sapiens
aataccaaatatttta

SEQ ID NO: 3947628 - DNA, 17 bp, Homo sapiens
aataccaaatattttag

SEQ ID NO: 3947629 - DNA, 15 bp, Homo sapiens
aatacccccagagac

SEQ ID NO: 3947630 - DNA, 16 bp, Homo sapiens
aatacctcatgggaca

SEQ ID NO: 3947631 - DNA, 16 bp, Homo sapiens
aatacctttggaaaaa

SEQ ID NO: 3947632 - DNA, 17 bp, Homo sapiens
aatacctttggaaaaat

SEQ ID NO: 3947633 - DNA, 21 bp, Homo sapiens
aatacctttggaaaaatcttg

SEQ ID NO: 3947634 - DNA, 18 bp, Homo sapiens
aatacgcactacatgtgg

SEQ ID NO: 3947635 - DNA, 16 bp, Homo sapiens
aatactacacatccaa

SEQ ID NO: 3947636 - DNA, 13 bp, Homo sapiens
aatactgtacata

SEQ ID NO: 3947637 - DNA, 22 bp, Homo sapiens
aatactgtacatagatgtatca

SEQ ID NO: 3947638 - DNA, 23 bp, Homo sapiens
aatacttctgagaccttgtttca

SEQ ID NO: 3947639 - DNA, 15 bp, Homo sapiens
aatagaagaacatcc

SEQ ID NO: 3947640 - DNA, 23 bp, Homo sapiens
aatagacaactcttccatttatt

SEQ ID NO: 3947641 - DNA, 20 bp, Homo sapiens
aatagacacatcaaatgccc

SEQ ID NO: 3947642 - DNA, 23 bp, Homo sapiens
aatagactgaagagaccacagca

SEQ ID NO: 3947643 - DNA, 17 bp, Homo sapiens
aatagcgaatcatctca

SEQ ID NO: 3947644 - DNA, 19 bp, Homo sapiens
aatagctattgcatgtaaa

SEQ ID NO: 3947645 - DNA, 20 bp, Homo sapiens
aatagctattgcatgtaaaa

SEQ ID NO: 3947646 - DNA, 23 bp, Homo sapiens
aatagctattgcatgtaaaatgc

SEQ ID NO: 3947647 - DNA, 14 bp, Homo sapiens
aatagcttgtatag

SEQ ID NO: 3947648 - DNA, 20 bp, Homo sapiens
aatagtaagcctccctcctc

SEQ ID NO: 3947649 - DNA, 21 bp, Homo sapiens
aatagtaagcctccctcctcg

SEQ ID NO: 3947650 - DNA, 13 bp, Homo sapiens
aatagtcaagaaa

SEQ ID NO: 3947651 - DNA, 14 bp, Homo sapiens
aatgcatagtttgt

SEQ ID NO: 3947652 - DNA, 20 bp, Homo sapiens
aatgcatgtaaggtcttctt

SEQ ID NO: 3947653 - DNA, 18 bp, Homo sapiens
aatgcatgttaggaaaat

SEQ ID NO: 3947654 - DNA, 21 bp, Homo sapiens
aatgcccaactcttcattttg

SEQ ID NO: 3947655 - DNA, 18 bp, Homo sapiens
aatgcccgtaatgcttag

SEQ ID NO: 3947656 - DNA, 12 bp, Homo sapiens
aatgccctgcca

SEQ ID NO: 3947657 - DNA, 13 bp, Homo sapiens
aatgccctgccat

SEQ ID NO: 3947658 - DNA, 14 bp, Homo sapiens
aatgccctgccatt

SEQ ID NO: 3947659 - DNA, 15 bp, Homo sapiens
aatgcctcctccctg

SEQ ID NO: 3947660 - DNA, 18 bp, Homo sapiens
aatgcgggtgagagtaat

SEQ ID NO: 3947661 - DNA, 12 bp, Homo sapiens
aatgctaaatgc

SEQ ID NO: 3947662 - DNA, 13 bp, Homo sapiens
aatgctaagaaat

SEQ ID NO: 3947663 - DNA, 16 bp, Homo sapiens
aatgctaagaaatgct

SEQ ID NO: 3947664 - DNA, 12 bp, Homo sapiens
aatgctattgaa

SEQ ID NO: 3947665 - DNA, 15 bp, Homo sapiens
aatgctattgaaatt

SEQ ID NO: 3947666 - DNA, 12 bp, Homo sapiens
aatgctcctgga

SEQ ID NO: 3947667 - DNA, 18 bp, Homo sapiens
aatgctcgtgtgatttcc

SEQ ID NO: 3947668 - DNA, 14 bp, Homo sapiens
aatgctctcctttc

SEQ ID NO: 3947669 - DNA, 20 bp, Homo sapiens
aatgcttcaagtgttgctct

SEQ ID NO: 3947670 - DNA, 13 bp, Homo sapiens
aatgctttctgaa

SEQ ID NO: 3947671 - DNA, 20 bp, Homo sapiens
aatgctttgggaggccaagg

SEQ ID NO: 3947672 - DNA, 21 bp, Homo sapiens
aatgctttgggaggccaaggc

SEQ ID NO: 3947673 - DNA, 14 bp, Homo sapiens
aatggaactgaccc

SEQ ID NO: 3947674 - DNA, 15 bp, Homo sapiens
aatggaagagaaatc

SEQ ID NO: 3947675 - DNA, 16 bp, Homo sapiens
aatggaagagaaatct

SEQ ID NO: 3947676 - DNA, 18 bp, Homo sapiens
aatggaaggtttgtatat

SEQ ID NO: 3947677 - DNA, 14 bp, Homo sapiens
aatggagggagcca

SEQ ID NO: 3947678 - DNA, 22 bp, Homo sapiens
aatggcaaagcggttgcttctg

SEQ ID NO: 3947679 - DNA, 22 bp, Homo sapiens
aatggccaaatggtttttgcaa

SEQ ID NO: 3947680 - DNA, 16 bp, Homo sapiens
aatggctaattcccag

SEQ ID NO: 3947681 - DNA, 18 bp, Homo sapiens
aatgggccaattaaaata

SEQ ID NO: 3947682 - DNA, 15 bp, Homo sapiens
aatgggcctgcccaa

SEQ ID NO: 3947683 - DNA, 15 bp, Homo sapiens
aatgggctttaacaa

SEQ ID NO: 3947684 - DNA, 13 bp, Homo sapiens
aatggtccagggt

SEQ ID NO: 3947685 - DNA, 15 bp, Homo sapiens
aatggtggtttgtca

SEQ ID NO: 3947686 - DNA, 16 bp, Homo sapiens
aatggtggtttgtcat

SEQ ID NO: 3947687 - DNA, 18 bp, Homo sapiens
aatggtggtttgtcatat

SEQ ID NO: 3947688 - DNA, 21 bp, Homo sapiens
aatggtggtttgtcatatatt

SEQ ID NO: 3947689 - DNA, 23 bp, Homo sapiens
aatggtggtttgtcatatattca

SEQ ID NO: 3947690 - DNA, 17 bp, Homo sapiens
aatggttgactgggttt

SEQ ID NO: 3947691 - DNA, 16 bp, Homo sapiens
aatgtaacttttgtaa

SEQ ID NO: 3947692 - DNA, 22 bp, Homo sapiens
aatgtaacttttgtaagacaaa

SEQ ID NO: 3947693 - DNA, 15 bp, Homo sapiens
aatgtaatgatcata

SEQ ID NO: 3947694 - DNA, 17 bp, Homo sapiens
aatgtacaagttttgta

SEQ ID NO: 3947695 - DNA, 18 bp, Homo sapiens
aatgtacaagttttgtat

SEQ ID NO: 3947696 - DNA, 19 bp, Homo sapiens
aatgtacaagttttgtata

SEQ ID NO: 3947697 - DNA, 16 bp, Homo sapiens
aatgtacagagtggcc

SEQ ID NO: 3947698 - DNA, 22 bp, Homo sapiens
aatgtacccaccgggccactcc

SEQ ID NO: 3947699 - DNA, 16 bp, Homo sapiens
aatgtaggtttagata

SEQ ID NO: 3947700 - DNA, 16 bp, Homo sapiens
aatgtatatacacata

SEQ ID NO: 3947701 - DNA, 19 bp, Homo sapiens
aatgtatatacacatatac

SEQ ID NO: 3947702 - DNA, 15 bp, Homo sapiens
aatgtatgtgaaagt

SEQ ID NO: 3947703 - DNA, 19 bp, Homo sapiens
aatgtatgtgaaagtgtaa

SEQ ID NO: 3947704 - DNA, 20 bp, Homo sapiens
aatgtatgtgaaagtgtaaa

SEQ ID NO: 3947705 - DNA, 19 bp, Homo sapiens
aatgtcaccaccttcccag

SEQ ID NO: 3947706 - DNA, 23 bp, Homo sapiens
aatgtcaccaccttcccagctct

SEQ ID NO: 3947707 - DNA, 20 bp, Homo sapiens
aatgtcagagctatgttccc

SEQ ID NO: 3947708 - DNA, 17 bp, Homo sapiens
aatgtcattatgtagaa

SEQ ID NO: 3947709 - DNA, 14 bp, Homo sapiens
aatgtccaaaatgt

SEQ ID NO: 3947710 - DNA, 14 bp, Homo sapiens
aatgtctcttcctc

SEQ ID NO: 3947711 - DNA, 16 bp, Homo sapiens
aatgtgaagggtgggg

SEQ ID NO: 3947712 - DNA, 15 bp, Homo sapiens
aatgtgaccaggggt

SEQ ID NO: 3947713 - DNA, 17 bp, Homo sapiens
aatgtgagtgtgtttgt

SEQ ID NO: 3947714 - DNA, 15 bp, Homo sapiens
aatgtgcaaattttg

SEQ ID NO: 3947715 - DNA, 20 bp, Homo sapiens
aatgtggatttcctatttta

SEQ ID NO: 3947716 - DNA, 14 bp, Homo sapiens
aatgtggctcctgg

SEQ ID NO: 3947717 - DNA, 13 bp, Homo sapiens
aatgtgtaaatgt

SEQ ID NO: 3947718 - DNA, 21 bp, Homo sapiens
aatgtgtaagcattgtataca

SEQ ID NO: 3947719 - DNA, 17 bp, Homo sapiens
aatgtgtggtgctaact

SEQ ID NO: 3947720 - DNA, 21 bp, Homo sapiens
aatgtgtgtatgtgtatttat

SEQ ID NO: 3947721 - DNA, 18 bp, Homo sapiens
aatgtgtgtctgaagact

SEQ ID NO: 3947722 - DNA, 14 bp, Homo sapiens
aatgttaaagtcag

SEQ ID NO: 3947723 - DNA, 15 bp, Homo sapiens
aatgttaaagtcagt

SEQ ID NO: 3947724 - DNA, 21 bp, Homo sapiens
aatgttatttgttattttcag

SEQ ID NO: 3947725 - DNA, 17 bp, Homo sapiens
aatgttcatcaattccc

SEQ ID NO: 3947726 - DNA, 14 bp, Homo sapiens
aatgttccctgcac

SEQ ID NO: 3947727 - DNA, 14 bp, Homo sapiens
aatgttgaaatctt

SEQ ID NO: 3947728 - DNA, 24 bp, Homo sapiens
aatgttgggatttatatctatagt

SEQ ID NO: 3947729 - DNA, 12 bp, Homo sapiens
aatgttgtccag

SEQ ID NO: 3947730 - DNA, 18 bp, Homo sapiens
aatgttgttatgctatta

SEQ ID NO: 3947731 - DNA, 15 bp, Homo sapiens
aatgtttatgttctc

SEQ ID NO: 3947732 - DNA, 20 bp, Homo sapiens
aatgtttattcctgataata

SEQ ID NO: 3947733 - DNA, 15 bp, Homo sapiens
aatgtttattccttg

SEQ ID NO: 3947734 - DNA, 15 bp, Homo sapiens
aatgtttctgcagta

SEQ ID NO: 3947735 - DNA, 16 bp, Homo sapiens
aatgtttgatttagta

SEQ ID NO: 3947736 - DNA, 18 bp, Homo sapiens
aatgtttgggcagaaggg

SEQ ID NO: 3947737 - DNA, 22 bp, Homo sapiens
aattaaaaaaatatatattgta

SEQ ID NO: 3947738 - DNA, 18 bp, Homo sapiens
acaccactttgtctctga

SEQ ID NO: 3947739 - DNA, 12 bp, Homo sapiens
acacccactggc

SEQ ID NO: 3947740 - DNA, 14 bp, Homo sapiens
acacccactggcca

SEQ ID NO: 3947741 - DNA, 12 bp, Homo sapiens
acaccccaaggg

SEQ ID NO: 3947742 - DNA, 16 bp, Homo sapiens
acaccccaagggacaa

SEQ ID NO: 3947743 - DNA, 13 bp, Homo sapiens
acaccccagcgcc

SEQ ID NO: 3947744 - DNA, 20 bp, Homo sapiens
acaccccccgccccccacct

SEQ ID NO: 3947745 - DNA, 21 bp, Homo sapiens
acaccccccgccccccacctt

SEQ ID NO: 3947746 - DNA, 18 bp, Homo sapiens
acaccccttatccaggac

SEQ ID NO: 3947747 - DNA, 19 bp, Homo sapiens
acaccccttatccaggact

SEQ ID NO: 3947748 - DNA, 20 bp, Homo sapiens
acacccttcacataccctcc

SEQ ID NO: 3947749 - DNA, 14 bp, Homo sapiens
acaccgggcctgga

SEQ ID NO: 3947750 - DNA, 16 bp, Homo sapiens
acacctaccatgctgc

SEQ ID NO: 3947751 - DNA, 18 bp, Homo sapiens
acacctaccatgctgctt

SEQ ID NO: 3947752 - DNA, 15 bp, Homo sapiens
acacctagcatctca

SEQ ID NO: 3947753 - DNA, 19 bp, Homo sapiens
acacctcccaggagacagt

SEQ ID NO: 3947754 - DNA, 15 bp, Homo sapiens
acacctcctagcaag

SEQ ID NO: 3947755 - DNA, 19 bp, Homo sapiens
acgcccagctgaggctggg

SEQ ID NO: 3947756 - DNA, 18 bp, Homo sapiens
acgcccctccctcctctg

SEQ ID NO: 3947757 - DNA, 13 bp, Homo sapiens
acgcctcctggcc

SEQ ID NO: 3947758 - DNA, 15 bp, Homo sapiens
acgcctcctggccag

SEQ ID NO: 3947759 - DNA, 20 bp, Homo sapiens
acgcctcttttccctctcta

SEQ ID NO: 3947760 - DNA, 21 bp, Homo sapiens
acgcctcttttccctctctag

SEQ ID NO: 3947761 - DNA, 18 bp, Homo sapiens
acgcctgagcccagggag

SEQ ID NO: 3947762 - DNA, 19 bp, Homo sapiens
acgcctgagcccagggagg

SEQ ID NO: 3947763 - DNA, 12 bp, Homo sapiens
acgcgtctcctg

SEQ ID NO: 3947764 - DNA, 20 bp, Homo sapiens
acgctcaagaatcctctggg

SEQ ID NO: 3947765 - DNA, 14 bp, Homo sapiens
acgctcccccgcag

SEQ ID NO: 3947766 - DNA, 11 bp, Homo sapiens
acgcttccaga

SEQ ID NO: 3947767 - DNA, 13 bp, Homo sapiens
acgcttccagacc

SEQ ID NO: 3947768 - DNA, 18 bp, Homo sapiens
acgcttccagaccacctg

SEQ ID NO: 3947769 - DNA, 20 bp, Homo sapiens
acgcttccagaccacctgcc

SEQ ID NO: 3947770 - DNA, 21 bp, Homo sapiens
acgcttccagaccacctgcca

SEQ ID NO: 3947771 - DNA, 22 bp, Homo sapiens
acgcttccagaccacctgccag

SEQ ID NO: 3947772 - DNA, 15 bp, Homo sapiens
acgcttgctcatttt

SEQ ID NO: 3947773 - DNA, 22 bp, Homo sapiens
acggacgtcctgctggcacctc

SEQ ID NO: 3947774 - DNA, 21 bp, Homo sapiens
acggagcctggagggatgcca

SEQ ID NO: 3947775 - DNA, 20 bp, Homo sapiens
acggatccatgtagcaggac

SEQ ID NO: 3947776 - DNA, 21 bp, Homo sapiens
acggcacctgggccctggggc

SEQ ID NO: 3947777 - DNA, 19 bp, Homo sapiens
acggcagagaccccaggat

SEQ ID NO: 3947778 - DNA, 15 bp, Homo sapiens
acggcagctgtagct

SEQ ID NO: 3947779 - DNA, 22 bp, Homo sapiens
acggcatgtgaattctgtgaag

SEQ ID NO: 3947780 - DNA, 10 bp, Homo sapiens
acggccaccc

SEQ ID NO: 3947781 - DNA, 18 bp, Homo sapiens
acggccaccctccttccc

SEQ ID NO: 3947782 - DNA, 17 bp, Homo sapiens
acggcggcggccctcaa

SEQ ID NO: 3947783 - DNA, 15 bp, Homo sapiens
acggctggacctgca

SEQ ID NO: 3947784 - DNA, 22 bp, Homo sapiens
acgggaagcctccgtcaggaga

SEQ ID NO: 3947785 - DNA, 22 bp, Homo sapiens
acgggagcctcctctgcttgca

SEQ ID NO: 3947786 - DNA, 14 bp, Homo sapiens
acgggaggcctcag

SEQ ID NO: 3947787 - DNA, 16 bp, Homo sapiens
acgggaggcctcagtt

SEQ ID NO: 3947788 - DNA, 14 bp, Homo sapiens
acgggcatgtatta

SEQ ID NO: 3947789 - DNA, 19 bp, Homo sapiens
acgggcctcagtttcccca

SEQ ID NO: 3947790 - DNA, 14 bp, Homo sapiens
acggggactgggga

SEQ ID NO: 3947791 - DNA, 21 bp, Homo sapiens
acggtcccacactggtgactg

SEQ ID NO: 3947792 - DNA, 13 bp, Homo sapiens
acggtgaaatcca

SEQ ID NO: 3947793 - DNA, 19 bp, Homo sapiens
acggtgcgtggctgtggca

SEQ ID NO: 3947794 - DNA, 20 bp, Homo sapiens
acggtgcgtggctgtggcac

SEQ ID NO: 3947795 - DNA, 13 bp, Homo sapiens
acggtgttgcaga

SEQ ID NO: 3947796 - DNA, 15 bp, Homo sapiens
acggttaacttgtat

SEQ ID NO: 3947797 - DNA, 17 bp, Homo sapiens
acggttaacttgtatat

SEQ ID NO: 3947798 - DNA, 15 bp, Homo sapiens
acggttgcttcacct

SEQ ID NO: 3947799 - DNA, 21 bp, Homo sapiens
acggttgcttcaccttggagc

SEQ ID NO: 3947800 - DNA, 16 bp, Homo sapiens
acggtttcaaaccagg

SEQ ID NO: 3947801 - DNA, 18 bp, Homo sapiens
acgtacaccatatgcaag

SEQ ID NO: 3947802 - DNA, 14 bp, Homo sapiens
acgtataaatatga

SEQ ID NO: 3947803 - DNA, 23 bp, Homo sapiens
acgtatgtcggcacgtcccatgt

SEQ ID NO: 3947804 - DNA, 21 bp, Homo sapiens
acgtatttatatttggaaaga

SEQ ID NO: 3947805 - DNA, 14 bp, Homo sapiens
acgtattttaaaag

SEQ ID NO: 3947806 - DNA, 14 bp, Homo sapiens
acgtcaaacatgaa

SEQ ID NO: 3947807 - DNA, 21 bp, Homo sapiens
acgtcactggaccactgggca

SEQ ID NO: 3947808 - DNA, 21 bp, Homo sapiens
acgtcatcggaggctgggccc

SEQ ID NO: 3947809 - DNA, 14 bp, Homo sapiens
acgtctgccaggcc

SEQ ID NO: 3947810 - DNA, 20 bp, Homo sapiens
acgtctgccaggcccatctc

SEQ ID NO: 3947811 - DNA, 17 bp, Homo sapiens
acgtctgggcccccact

SEQ ID NO: 3947812 - DNA, 13 bp, Homo sapiens
acgtcttgctatt

SEQ ID NO: 3947813 - DNA, 23 bp, Homo sapiens
acgtcttgctatttgagcatgca

SEQ ID NO: 3947814 - DNA, 18 bp, Homo sapiens
acgtgagagaatctgcct

SEQ ID NO: 3947815 - DNA, 15 bp, Homo sapiens
acgtgagccaggtaa

SEQ ID NO: 3947816 - DNA, 16 bp, Homo sapiens
acgtgccagctctagt

SEQ ID NO: 3947817 - DNA, 18 bp, Homo sapiens
acgtgccaggcccggggc

SEQ ID NO: 3947818 - DNA, 17 bp, Homo sapiens
acgtgctaggggatgag

SEQ ID NO: 3947819 - DNA, 16 bp, Homo sapiens
acgtgctcgcagcctg

SEQ ID NO: 3947820 - DNA, 17 bp, Homo sapiens
acgtggggagggtggag

SEQ ID NO: 3947821 - DNA, 20 bp, Homo sapiens
acgtgttaggaggctgcatg

SEQ ID NO: 3947822 - DNA, 21 bp, Homo sapiens
acgttaagggaaggaactctg

SEQ ID NO: 3947823 - DNA, 16 bp, Homo sapiens
acgttatatattgtat

SEQ ID NO: 3947824 - DNA, 14 bp, Homo sapiens
actcaccagggtcc

SEQ ID NO: 3947825 - DNA, 15 bp, Homo sapiens
actcaccagggtccg

SEQ ID NO: 3947826 - DNA, 18 bp, Homo sapiens
actcacccatgtgccaag

SEQ ID NO: 3947827 - DNA, 21 bp, Homo sapiens
actcacccatgtgccaaggtg

SEQ ID NO: 3947828 - DNA, 15 bp, Homo sapiens
actcacctcctccca

SEQ ID NO: 3947829 - DNA, 15 bp, Homo sapiens
actcacctctctcta

SEQ ID NO: 3947830 - DNA, 17 bp, Homo sapiens
actcacctctgcctcaa

SEQ ID NO: 3947831 - DNA, 16 bp, Homo sapiens
actcacgatgaaattg

SEQ ID NO: 3947832 - DNA, 15 bp, Homo sapiens
actcactccagccca

SEQ ID NO: 3947833 - DNA, 18 bp, Homo sapiens
actcactcttatgaaatg

SEQ ID NO: 3947834 - DNA, 22 bp, Homo sapiens
actcactgctcaagaagacatg

SEQ ID NO: 3947835 - DNA, 14 bp, Homo sapiens
actcagaagcctgg

SEQ ID NO: 3947836 - DNA, 15 bp, Homo sapiens
actcagaagcctggg

SEQ ID NO: 3947837 - DNA, 21 bp, Homo sapiens
actcagaagcctgggggcctg

SEQ ID NO: 3947838 - DNA, 15 bp, Homo sapiens
actcagaatgctcta

SEQ ID NO: 3947839 - DNA, 15 bp, Homo sapiens
actcagacattccaa

SEQ ID NO: 3947840 - DNA, 12 bp, Homo sapiens
actcagagcaga

SEQ ID NO: 3947841 - DNA, 14 bp, Homo sapiens
actcagagcagagc

SEQ ID NO: 3947842 - DNA, 17 bp, Homo sapiens
actcagagcccctccct

SEQ ID NO: 3947843 - DNA, 22 bp, Homo sapiens
actcagcagccctcctcacccc

SEQ ID NO: 3947844 - DNA, 14 bp, Homo sapiens
actcagccctgggc

SEQ ID NO: 3947845 - DNA, 19 bp, Homo sapiens
actcagctctcctgctgca

SEQ ID NO: 3947846 - DNA, 20 bp, Homo sapiens
actcatctgttatcctgcta

SEQ ID NO: 3947847 - DNA, 22 bp, Homo sapiens
actcatgttgttcccacacaca

SEQ ID NO: 3947848 - DNA, 13 bp, Homo sapiens
actcattcctgta

SEQ ID NO: 3947849 - DNA, 18 bp, Homo sapiens
actccaaagaaatgtaag

SEQ ID NO: 3947850 - DNA, 17 bp, Homo sapiens
actccaagaacaattgt

SEQ ID NO: 3947851 - DNA, 14 bp, Homo sapiens
actccaagcttcaa

SEQ ID NO: 3947852 - DNA, 19 bp, Homo sapiens
actccaagcttcaagtgat

SEQ ID NO: 3947853 - DNA, 15 bp, Homo sapiens
actccaccaacccat

SEQ ID NO: 3947854 - DNA, 18 bp, Homo sapiens
actccaccccctccagct

SEQ ID NO: 3947855 - DNA, 23 bp, Homo sapiens
actccaccccctccagctccagt

SEQ ID NO: 3947856 - DNA, 15 bp, Homo sapiens
actccacctccaccc

SEQ ID NO: 3947857 - DNA, 14 bp, Homo sapiens
actccactctcctt

SEQ ID NO: 3947858 - DNA, 23 bp, Homo sapiens
actccactctccttcgtgtctct

SEQ ID NO: 3947859 - DNA, 17 bp, Homo sapiens
actccagaatctgctgt

SEQ ID NO: 3947860 - DNA, 22 bp, Homo sapiens
actccagaatctgctgttgcca

SEQ ID NO: 3947861 - DNA, 15 bp, Homo sapiens
actccagacccctgg

SEQ ID NO: 3947862 - DNA, 18 bp, Homo sapiens
actccagacccctggctt

SEQ ID NO: 3947863 - DNA, 21 bp, Homo sapiens
actccagacccctggcttttc

SEQ ID NO: 3947864 - DNA, 16 bp, Homo sapiens
actccagagtctgagc

SEQ ID NO: 3947865 - DNA, 14 bp, Homo sapiens
actccagcccaaca

SEQ ID NO: 3947866 - DNA, 18 bp, Homo sapiens
actccagcctgggcaaca

SEQ ID NO: 3947867 - DNA, 20 bp, Homo sapiens
actccagcgcctgccctccc

SEQ ID NO: 3947868 - DNA, 22 bp, Homo sapiens
actccagcgcctgccctccctg

SEQ ID NO: 3947869 - DNA, 16 bp, Homo sapiens
actccagtgagctgga

SEQ ID NO: 3947870 - DNA, 16 bp, Homo sapiens
actccatacataactt

SEQ ID NO: 3947871 - DNA, 21 bp, Homo sapiens
actccattactaaagacagaa

SEQ ID NO: 3947872 - DNA, 19 bp, Homo sapiens
actcccaaagctcagactt

SEQ ID NO: 3947873 - DNA, 16 bp, Homo sapiens
actcccacacccaaga

SEQ ID NO: 3947874 - DNA, 12 bp, Homo sapiens
actcccagggac

SEQ ID NO: 3947875 - DNA, 19 bp, Homo sapiens
actccccaggccaggccac

SEQ ID NO: 3947876 - DNA, 14 bp, Homo sapiens
actcccccacctga

SEQ ID NO: 3947877 - DNA, 15 bp, Homo sapiens
actccccgcctgtcc

SEQ ID NO: 3947878 - DNA, 21 bp, Homo sapiens
actccccgcctgtcctgcctc

SEQ ID NO: 3947879 - DNA, 16 bp, Homo sapiens
actccctaagaaaccc

SEQ ID NO: 3947880 - DNA, 16 bp, Homo sapiens
actccctccatgtggc

SEQ ID NO: 3947881 - DNA, 18 bp, Homo sapiens
actccctgaacctcagtt

SEQ ID NO: 3947882 - DNA, 19 bp, Homo sapiens
actccctgaacctcagttt

SEQ ID NO: 3947883 - DNA, 12 bp, Homo sapiens
actccctgagct

SEQ ID NO: 3947884 - DNA, 19 bp, Homo sapiens
actcccttaggcattattt

SEQ ID NO: 3947885 - DNA, 18 bp, Homo sapiens
actcccttcctggcctca

SEQ ID NO: 3947886 - DNA, 18 bp, Homo sapiens
actccggaatgaccagca

SEQ ID NO: 3947887 - DNA, 20 bp, Homo sapiens
actccgggaccattgacctc

SEQ ID NO: 3947888 - DNA, 19 bp, Homo sapiens
actcctcagatctgaacac

SEQ ID NO: 3947889 - DNA, 12 bp, Homo sapiens
actcctcccaca

SEQ ID NO: 3947890 - DNA, 13 bp, Homo sapiens
actcctcccacaa

SEQ ID NO: 3947891 - DNA, 20 bp, Homo sapiens
actcctccttgcctgctttt

SEQ ID NO: 3947892 - DNA, 16 bp, Homo sapiens
actcctggaagctgtg

SEQ ID NO: 3947893 - DNA, 19 bp, Homo sapiens
actcctgtcccgccttcct

SEQ ID NO: 3947894 - DNA, 21 bp, Homo sapiens
actcctgtcccgccttcctcc

SEQ ID NO: 3947895 - DNA, 21 bp, Homo sapiens
actcctgtctgtcctggaggt

SEQ ID NO: 3947896 - DNA, 14 bp, Homo sapiens
actcctgtgctctg

SEQ ID NO: 3947897 - DNA, 16 bp, Homo sapiens
actcctgtgctctgga

SEQ ID NO: 3947898 - DNA, 19 bp, Homo sapiens
actcctgtgggagcctcgc

SEQ ID NO: 3947899 - DNA, 16 bp, Homo sapiens
actcctgttacttacc

SEQ ID NO: 3947900 - DNA, 17 bp, Homo sapiens
actcctgttacttacct

SEQ ID NO: 3947901 - DNA, 12 bp, Homo sapiens
actccttccagc

SEQ ID NO: 3947902 - DNA, 20 bp, Homo sapiens
actccttgtggtttatgtca

SEQ ID NO: 3947903 - DNA, 21 bp, Homo sapiens
actccttgtggtttatgtcat

SEQ ID NO: 3947904 - DNA, 19 bp, Homo sapiens
actcctttgcattccatga

SEQ ID NO: 3947905 - DNA, 22 bp, Homo sapiens
actcctttgcattccatgattt

SEQ ID NO: 3947906 - DNA, 22 bp, Homo sapiens
actcgagaccatcctggcccct

SEQ ID NO: 3947907 - DNA, 17 bp, Homo sapiens
actctaaattctttatt

SEQ ID NO: 3947908 - DNA, 23 bp, Homo sapiens
actctaaattctttatttctgtc

SEQ ID NO: 3947909 - DNA, 19 bp, Homo sapiens
actctaagctggagctctt

SEQ ID NO: 3947910 - DNA, 20 bp, Homo sapiens
actctacttagcatgtccct

SEQ ID NO: 3947911 - DNA, 21 bp, Homo sapiens
actctacttagcatgtcccta

SEQ ID NO: 3947912 - DNA, 20 bp, Homo sapiens
actctagaacatgcacattt

SEQ ID NO: 3947913 - DNA, 20 bp, Homo sapiens
actctagcctgggccagaga

SEQ ID NO: 3947914 - DNA, 17 bp, Homo sapiens
actctatgccccaaata

SEQ ID NO: 3947915 - DNA, 15 bp, Homo sapiens
actctcattccccag

SEQ ID NO: 3947916 - DNA, 16 bp, Homo sapiens
actctcccctccctct

SEQ ID NO: 3947917 - DNA, 17 bp, Homo sapiens
actctcccctccctctt

SEQ ID NO: 3947918 - DNA, 19 bp, Homo sapiens
actctcccctccctcttcc

SEQ ID NO: 3947919 - DNA, 20 bp, Homo sapiens
actctcccctccctcttcct

SEQ ID NO: 3947920 - DNA, 20 bp, Homo sapiens
actctcctcggccccctcca

SEQ ID NO: 3947921 - DNA, 23 bp, Homo sapiens
actctccttcgtgtctctcccac

SEQ ID NO: 3947922 - DNA, 13 bp, Homo sapiens
actctctgctcta

SEQ ID NO: 3947923 - DNA, 14 bp, Homo sapiens
actctctgctctag

SEQ ID NO: 3947924 - DNA, 19 bp, Homo sapiens
actctctgctctagccagg

SEQ ID NO: 3947925 - DNA, 23 bp, Homo sapiens
actctctgctctagccaggagtc

SEQ ID NO: 3947926 - DNA, 22 bp, Homo sapiens
actctctgtacaaaaacaaaac

SEQ ID NO: 3947927 - DNA, 13 bp, Homo sapiens
actctgaaaaaca

SEQ ID NO: 3947928 - DNA, 15 bp, Homo sapiens
actctgaaaaacatt

SEQ ID NO: 3947929 - DNA, 22 bp, Homo sapiens
actctgaaaagcaattgccctg

SEQ ID NO: 3947930 - DNA, 21 bp, Homo sapiens
actctgacaagggctgacctg

SEQ ID NO: 3947931 - DNA, 13 bp, Homo sapiens
actctgagcccag

SEQ ID NO: 3947932 - DNA, 15 bp, Homo sapiens
actctgagcccaggc

SEQ ID NO: 3947933 - DNA, 16 bp, Homo sapiens
actctgagcccaggcc

SEQ ID NO: 3947934 - DNA, 17 bp, Homo sapiens
actctgagcccaggccg

SEQ ID NO: 3947935 - DNA, 22 bp, Homo sapiens
actctgaggacatggagagaga

SEQ ID NO: 3947936 - DNA, 17 bp, Homo sapiens
actctgcactccatggc

SEQ ID NO: 3947937 - DNA, 21 bp, Homo sapiens
actctgcactccatggccacc

SEQ ID NO: 3947938 - DNA, 15 bp, Homo sapiens
actctgccccttctg

SEQ ID NO: 3947939 - DNA, 21 bp, Homo sapiens
actctgccccttctgtttcca

SEQ ID NO: 3947940 - DNA, 20 bp, Homo sapiens
actctgcggtggtgccagag

SEQ ID NO: 3947941 - DNA, 23 bp, Homo sapiens
actctggcaccccggatcgagga

SEQ ID NO: 3947942 - DNA, 17 bp, Homo sapiens
actctggcagccacact

SEQ ID NO: 3947943 - DNA, 13 bp, Homo sapiens
actctggcctctc

SEQ ID NO: 3947944 - DNA, 17 bp, Homo sapiens
actctggcctctcgagt

SEQ ID NO: 3947945 - DNA, 20 bp, Homo sapiens
actctggcctctcgagttct

SEQ ID NO: 3947946 - DNA, 13 bp, Homo sapiens
actctgggaaata

SEQ ID NO: 3947947 - DNA, 19 bp, Homo sapiens
actctgggaaataagagag

SEQ ID NO: 3947948 - DNA, 20 bp, Homo sapiens
actctggtggtgcttttgta

SEQ ID NO: 3947949 - DNA, 23 bp, Homo sapiens
actctgtcaatttccctgactcc

SEQ ID NO: 3947950 - DNA, 15 bp, Homo sapiens
actctgtcagccagc

SEQ ID NO: 3947951 - DNA, 19 bp, Homo sapiens
actctgtccaggccactgt

SEQ ID NO: 3947952 - DNA, 16 bp, Homo sapiens
actctgtgccagagcc

SEQ ID NO: 3947953 - DNA, 17 bp, Homo sapiens
actctgtgccagagcct

SEQ ID NO: 3947954 - DNA, 18 bp, Homo sapiens
actctgtgccagagcctg

SEQ ID NO: 3947955 - DNA, 20 bp, Homo sapiens
actctgtgccagagcctggg

SEQ ID NO: 3947956 - DNA, 21 bp, Homo sapiens
actctgtgccagagcctgggg

SEQ ID NO: 3947957 - DNA, 19 bp, Homo sapiens
actcttcaaggtctgcttt

SEQ ID NO: 3947958 - DNA, 23 bp, Homo sapiens
actcttcattttgagtctcaggc

SEQ ID NO: 3947959 - DNA, 20 bp, Homo sapiens
actcttcccccactcctctt

SEQ ID NO: 3947960 - DNA, 11 bp, Homo sapiens
actcttcctgc

SEQ ID NO: 3947961 - DNA, 21 bp, Homo sapiens
actctttatttctagcagagt

SEQ ID NO: 3947962 - DNA, 15 bp, Homo sapiens
actctttgctacaat

SEQ ID NO: 3947963 - DNA, 16 bp, Homo sapiens
actctttgctacaata

SEQ ID NO: 3947964 - DNA, 21 bp, Homo sapiens
actctttgctacaataaatgc

SEQ ID NO: 3947965 - DNA, 15 bp, Homo sapiens
actgaaaaatgtcag

SEQ ID NO: 3947966 - DNA, 17 bp, Homo sapiens
actgaaaaatgtcagtc

SEQ ID NO: 3947967 - DNA, 19 bp, Homo sapiens
actgaaaactgtaaataca

SEQ ID NO: 3947968 - DNA, 20 bp, Homo sapiens
actgaaaaggttcttcatcc

SEQ ID NO: 3947969 - DNA, 15 bp, Homo sapiens
actgaaaatctaata

SEQ ID NO: 3947970 - DNA, 15 bp, Homo sapiens
actgaaagcagcagc

SEQ ID NO: 3947971 - DNA, 13 bp, Homo sapiens
actgaaaggttac

SEQ ID NO: 3947972 - DNA, 14 bp, Homo sapiens
actgaaagtggttt

SEQ ID NO: 3947973 - DNA, 16 bp, Homo sapiens
actgaacatttgcttt

SEQ ID NO: 3947974 - DNA, 18 bp, Homo sapiens
actgaagacctccacatt

SEQ ID NO: 3947975 - DNA, 13 bp, Homo sapiens
actgaaggagaag

SEQ ID NO: 3947976 - DNA, 21 bp, Homo sapiens
actgaagttaacagagacaga

SEQ ID NO: 3947977 - DNA, 15 bp, Homo sapiens
actgaattaagttat

SEQ ID NO: 3947978 - DNA, 16 bp, Homo sapiens
actgaattaagttatt

SEQ ID NO: 3947979 - DNA, 20 bp, Homo sapiens
actgacaagaagctcccaga

SEQ ID NO: 3947980 - DNA, 15 bp, Homo sapiens
actgaccagcctcca

SEQ ID NO: 3947981 - DNA, 16 bp, Homo sapiens
actgaccccctcccct

SEQ ID NO: 3947982 - DNA, 13 bp, Homo sapiens
actgacccttcca

SEQ ID NO: 3947983 - DNA, 14 bp, Homo sapiens
actgagacggcaga

SEQ ID NO: 3947984 - DNA, 16 bp, Homo sapiens
actgagagcagatggt

SEQ ID NO: 3947985 - DNA, 17 bp, Homo sapiens
actgagatgtgaacaca

SEQ ID NO: 3947986 - DNA, 22 bp, Homo sapiens
actgagatgtgaacacatcagc

SEQ ID NO: 3947987 - DNA, 19 bp, Homo sapiens
actgagccaaacacactgt

SEQ ID NO: 3947988 - DNA, 22 bp, Homo sapiens
actgaggagtagctgagaggaa

SEQ ID NO: 3947989 - DNA, 12 bp, Homo sapiens
actgagggccac

SEQ ID NO: 3947990 - DNA, 22 bp, Homo sapiens
actgagggccacactattacca

SEQ ID NO: 3947991 - DNA, 22 bp, Homo sapiens
actgagtggcttgtgattctgg

SEQ ID NO: 3947992 - DNA, 13 bp, Homo sapiens
actgatcaaaaat

SEQ ID NO: 3947993 - DNA, 15 bp, Homo sapiens
actgatcaaaaataa

SEQ ID NO: 3947994 - DNA, 20 bp, Homo sapiens
actgatcaaaaataaactag

SEQ ID NO: 3947995 - DNA, 22 bp, Homo sapiens
actgatgcgaaaacttgaatct

SEQ ID NO: 3947996 - DNA, 18 bp, Homo sapiens
acatacatatatatctga

SEQ ID NO: 3947997 - DNA, 18 bp, Homo sapiens
acatacccttctttaaat

SEQ ID NO: 3947998 - DNA, 14 bp, Homo sapiens
acatacgaaacaca

SEQ ID NO: 3947999 - DNA, 23 bp, Homo sapiens
acatagatgtatcattaatgtag

SEQ ID NO: 3948000 - DNA, 14 bp, Homo sapiens
acatagattaatgg

SEQ ID NO: 3948001 - DNA, 18 bp, Homo sapiens
acataggcaaattggaaa

SEQ ID NO: 3948002 - DNA, 13 bp, Homo sapiens
acatagtcacaaa

SEQ ID NO: 3948003 - DNA, 16 bp, Homo sapiens
acatagtcacaaaaat

SEQ ID NO: 3948004 - DNA, 16 bp, Homo sapiens
acatagtgatggttcc

SEQ ID NO: 3948005 - DNA, 21 bp, Homo sapiens
acatagtgatggttcccctgt

SEQ ID NO: 3948006 - DNA, 15 bp, Homo sapiens
acatagttatttatt

SEQ ID NO: 3948007 - DNA, 13 bp, Homo sapiens
acatatacatata

SEQ ID NO: 3948008 - DNA, 17 bp, Homo sapiens
acatatacatatatata

SEQ ID NO: 3948009 - DNA, 20 bp, Homo sapiens
acatatatatatacacatac

SEQ ID NO: 3948010 - DNA, 17 bp, Homo sapiens
acatatatatctgataa

SEQ ID NO: 3948011 - DNA, 20 bp, Homo sapiens
acatatatatctgataaaat

SEQ ID NO: 3948012 - DNA, 21 bp, Homo sapiens
acatatatatgccttatgtaa

SEQ ID NO: 3948013 - DNA, 16 bp, Homo sapiens
acatatcaattcaaca

SEQ ID NO: 3948014 - DNA, 20 bp, Homo sapiens
acatatcaattcaacacatt

SEQ ID NO: 3948015 - DNA, 13 bp, Homo sapiens
acatatcagaaaa

SEQ ID NO: 3948016 - DNA, 19 bp, Homo sapiens
acatatcagaaaagtagaa

SEQ ID NO: 3948017 - DNA, 15 bp, Homo sapiens
acatatgggtgctgg

SEQ ID NO: 3948018 - DNA, 14 bp, Homo sapiens
acatatgtaaaata

SEQ ID NO: 3948019 - DNA, 16 bp, Homo sapiens
acatatgtagactata

SEQ ID NO: 3948020 - DNA, 17 bp, Homo sapiens
acatatgtattaagcca

SEQ ID NO: 3948021 - DNA, 13 bp, Homo sapiens
acatattataaat

SEQ ID NO: 3948022 - DNA, 14 bp, Homo sapiens
acatattataaata

SEQ ID NO: 3948023 - DNA, 15 bp, Homo sapiens
acatattataaataa

SEQ ID NO: 3948024 - DNA, 16 bp, Homo sapiens
acatattataaataaa

SEQ ID NO: 3948025 - DNA, 17 bp, Homo sapiens
acatattataaataaat

SEQ ID NO: 3948026 - DNA, 17 bp, Homo sapiens
acatattggaaaggtca

SEQ ID NO: 3948027 - DNA, 17 bp, Homo sapiens
acatcaaatttgccacc

SEQ ID NO: 3948028 - DNA, 13 bp, Homo sapiens
acatcaacattcc

SEQ ID NO: 3948029 - DNA, 17 bp, Homo sapiens
acatcaagcatgcaata

SEQ ID NO: 3948030 - DNA, 19 bp, Homo sapiens
acatcacttgtacaaaata

SEQ ID NO: 3948031 - DNA, 22 bp, Homo sapiens
acatccaaggagaaacagagac

SEQ ID NO: 3948032 - DNA, 15 bp, Homo sapiens
acatccaatgcatag

SEQ ID NO: 3948033 - DNA, 11 bp, Homo sapiens
acatccatgtc

SEQ ID NO: 3948034 - DNA, 13 bp, Homo sapiens
acatccattccca

SEQ ID NO: 3948035 - DNA, 14 bp, Homo sapiens
acatcccacagtgg

SEQ ID NO: 3948036 - DNA, 15 bp, Homo sapiens
acatcccaggagggg

SEQ ID NO: 3948037 - DNA, 15 bp, Homo sapiens
acatcccggcctctt

SEQ ID NO: 3948038 - DNA, 14 bp, Homo sapiens
acatccctgggcct

SEQ ID NO: 3948039 - DNA, 18 bp, Homo sapiens
acatccctgggcctgctg

SEQ ID NO: 3948040 - DNA, 21 bp, Homo sapiens
acatccctgggcctgctgctg

SEQ ID NO: 3948041 - DNA, 21 bp, Homo sapiens
acatcctttctattgaaaaat

SEQ ID NO: 3948042 - DNA, 15 bp, Homo sapiens
acatcgcactgtgga

SEQ ID NO: 3948043 - DNA, 23 bp, Homo sapiens
acatctaatgtctcttcctctgt

SEQ ID NO: 3948044 - DNA, 20 bp, Homo sapiens
acatctctttgatgtcatat

SEQ ID NO: 3948045 - DNA, 13 bp, Homo sapiens
acatctgaaagcc

SEQ ID NO: 3948046 - DNA, 12 bp, Homo sapiens
acatctgataac

SEQ ID NO: 3948047 - DNA, 16 bp, Homo sapiens
acatctgttttaaatt

SEQ ID NO: 3948048 - DNA, 17 bp, Homo sapiens
acatctgttttaaattt

SEQ ID NO: 3948049 - DNA, 17 bp, Homo sapiens
acatcttcagctcccat

SEQ ID NO: 3948050 - DNA, 16 bp, Homo sapiens
acatctttttcctccc

SEQ ID NO: 3948051 - DNA, 22 bp, Homo sapiens
acatgaaaaacacggcagctgt

SEQ ID NO: 3948052 - DNA, 23 bp, Homo sapiens
acatgaaaagataggtttgagtt

SEQ ID NO: 3948053 - DNA, 15 bp, Homo sapiens
acatgaaacagaaac

SEQ ID NO: 3948054 - DNA, 21 bp, Homo sapiens
acatgaagtgtgtttccttca

SEQ ID NO: 3948055 - DNA, 15 bp, Homo sapiens
acatgaatgcacact

SEQ ID NO: 3948056 - DNA, 15 bp, Homo sapiens
acatgacactgacct

SEQ ID NO: 3948057 - DNA, 16 bp, Homo sapiens
acatgacgtaaaattt

SEQ ID NO: 3948058 - DNA, 22 bp, Homo sapiens
acatgagaaaatcagtaattgg

SEQ ID NO: 3948059 - DNA, 13 bp, Homo sapiens
acatgaggagggt

SEQ ID NO: 3948060 - DNA, 14 bp, Homo sapiens
acatgcacatttat

SEQ ID NO: 3948061 - DNA, 16 bp, Homo sapiens
acatgcacatttatat

SEQ ID NO: 3948062 - DNA, 12 bp, Homo sapiens
acatgcactgac

SEQ ID NO: 3948063 - DNA, 14 bp, Homo sapiens
acatgcactgaccc

SEQ ID NO: 3948064 - DNA, 18 bp, Homo sapiens
acatgcactgacccttcc

SEQ ID NO: 3948065 - DNA, 19 bp, Homo sapiens
acatgccaccctctccatg

SEQ ID NO: 3948066 - DNA, 21 bp, Homo sapiens
acatgccaccctctccatgcc

SEQ ID NO: 3948067 - DNA, 22 bp, Homo sapiens
acatgccaccctctccatgccc

SEQ ID NO: 3948068 - DNA, 23 bp, Homo sapiens
acatgccagcttcctgtgggcca

SEQ ID NO: 3948069 - DNA, 17 bp, Homo sapiens
acatgccatttgtactg

SEQ ID NO: 3948070 - DNA, 17 bp, Homo sapiens
acatgctgtgctctttg

SEQ ID NO: 3948071 - DNA, 18 bp, Homo sapiens
acatgctgtgctctttga

SEQ ID NO: 3948072 - DNA, 20 bp, Homo sapiens
acatgctgtgctctttgaag

SEQ ID NO: 3948073 - DNA, 16 bp, Homo sapiens
acatggagactcctgc

SEQ ID NO: 3948074 - DNA, 17 bp, Homo sapiens
acatggagactcctgcc

SEQ ID NO: 3948075 - DNA, 22 bp, Homo sapiens
acatggagactcctgccctgtt

SEQ ID NO: 3948076 - DNA, 18 bp, Homo sapiens
acatggatgcacgcacat

SEQ ID NO: 3948077 - DNA, 21 bp, Homo sapiens
acatgtccagtgggaggtgag

SEQ ID NO: 3948078 - DNA, 19 bp, Homo sapiens
acatgtgaggactgggggc

SEQ ID NO: 3948079 - DNA, 11 bp, Homo sapiens
acatgtgctat

SEQ ID NO: 3948080 - DNA, 22 bp, Homo sapiens
acatgtgctattgaactgagcc

SEQ ID NO: 3948081 - DNA, 16 bp, Homo sapiens
acatgtggtttataga

SEQ ID NO: 3948082 - DNA, 19 bp, Homo sapiens
acatgtgtctgtgtggtat

SEQ ID NO: 3948083 - DNA, 14 bp, Homo sapiens
accccatctctctt

SEQ ID NO: 3948084 - DNA, 13 bp, Homo sapiens
accccatgggctt

SEQ ID NO: 3948085 - DNA, 14 bp, Homo sapiens
accccatgggcttg

SEQ ID NO: 3948086 - DNA, 15 bp, Homo sapiens
acccccagcctgggc

SEQ ID NO: 3948087 - DNA, 17 bp, Homo sapiens
acccccagcctgggcct

SEQ ID NO: 3948088 - DNA, 16 bp, Homo sapiens
acccccagtgccacag

SEQ ID NO: 3948089 - DNA, 21 bp, Homo sapiens
acccccagtgccacagagaag

SEQ ID NO: 3948090 - DNA, 11 bp, Homo sapiens
acccccagtgt

SEQ ID NO: 3948091 - DNA, 19 bp, Homo sapiens
acccccgccacggccaccc

SEQ ID NO: 3948092 - DNA, 23 bp, Homo sapiens
acccccgccacggccaccctcct

SEQ ID NO: 3948093 - DNA, 15 bp, Homo sapiens
acccccgctccagat

SEQ ID NO: 3948094 - DNA, 11 bp, Homo sapiens
accccctcatt

SEQ ID NO: 3948095 - DNA, 18 bp, Homo sapiens
accccctccagctccagt

SEQ ID NO: 3948096 - DNA, 12 bp, Homo sapiens
accccctcccca

SEQ ID NO: 3948097 - DNA, 14 bp, Homo sapiens
accccctccccagg

SEQ ID NO: 3948098 - DNA, 22 bp, Homo sapiens
accccctgagtcaactggagca

SEQ ID NO: 3948099 - DNA, 13 bp, Homo sapiens
accccctgcagct

SEQ ID NO: 3948100 - DNA, 15 bp, Homo sapiens
accccctgcagcttg

SEQ ID NO: 3948101 - DNA, 18 bp, Homo sapiens
acccccttcagtgcccac

SEQ ID NO: 3948102 - DNA, 22 bp, Homo sapiens
accccgcctcccagccccaggg

SEQ ID NO: 3948103 - DNA, 19 bp, Homo sapiens
accccgcggtgctctggcg

SEQ ID NO: 3948104 - DNA, 22 bp, Homo sapiens
acccctaaagagatactttgat

SEQ ID NO: 3948105 - DNA, 16 bp, Homo sapiens
acccctacatgaaaca

SEQ ID NO: 3948106 - DNA, 22 bp, Homo sapiens
acccctccaaagccccaccttt

SEQ ID NO: 3948107 - DNA, 14 bp, Homo sapiens
acccctcccaacct

SEQ ID NO: 3948108 - DNA, 16 bp, Homo sapiens
acccctcccaacctca

SEQ ID NO: 3948109 - DNA, 11 bp, Homo sapiens
acccctccctt

SEQ ID NO: 3948110 - DNA, 22 bp, Homo sapiens
acccctcccttgctcagtgcct

SEQ ID NO: 3948111 - DNA, 20 bp, Homo sapiens
acccctgcaccagcccttcc

SEQ ID NO: 3948112 - DNA, 13 bp, Homo sapiens
acccctgcctggg

SEQ ID NO: 3948113 - DNA, 12 bp, Homo sapiens
acccctggcttt

SEQ ID NO: 3948114 - DNA, 19 bp, Homo sapiens
acccctggcttttcactgc

SEQ ID NO: 3948115 - DNA, 12 bp, Homo sapiens
acccctgtaccc

SEQ ID NO: 3948116 - DNA, 10 bp, Homo sapiens
acccctgtgt

SEQ ID NO: 3948117 - DNA, 21 bp, Homo sapiens
acccctgttaagcaattcctt

SEQ ID NO: 3948118 - DNA, 16 bp, Homo sapiens
accccttatccaggac

SEQ ID NO: 3948119 - DNA, 18 bp, Homo sapiens
accccttatccaggactc

SEQ ID NO: 3948120 - DNA, 11 bp, Homo sapiens
accccttcctt

SEQ ID NO: 3948121 - DNA, 18 bp, Homo sapiens
accccttcctttcctctg

SEQ ID NO: 3948122 - DNA, 24 bp, Homo sapiens
accccttcctttcctctgcagcac

SEQ ID NO: 3948123 - DNA, 12 bp, Homo sapiens
acccctttcctg

SEQ ID NO: 3948124 - DNA, 23 bp, Homo sapiens
acccgaagcccaggctgaagagt

SEQ ID NO: 3948125 - DNA, 14 bp, Homo sapiens
acccgactgtgaaa

SEQ ID NO: 3948126 - DNA, 21 bp, Homo sapiens
acccgagcccagctacattcc

SEQ ID NO: 3948127 - DNA, 15 bp, Homo sapiens
acccgccccactccc

SEQ ID NO: 3948128 - DNA, 18 bp, Homo sapiens
acccgctcatcactggat

SEQ ID NO: 3948129 - DNA, 18 bp, Homo sapiens
acccggcaccccctgcag

SEQ ID NO: 3948130 - DNA, 20 bp, Homo sapiens
acccggcaccccctgcagct

SEQ ID NO: 3948131 - DNA, 17 bp, Homo sapiens
acccgtaggcagcctct

SEQ ID NO: 3948132 - DNA, 20 bp, Homo sapiens
acccgtaggcagcctctctg

SEQ ID NO: 3948133 - DNA, 23 bp, Homo sapiens
acccgtaggcagcctctctgcta

SEQ ID NO: 3948134 - DNA, 13 bp, Homo sapiens
acccgtggaggct

SEQ ID NO: 3948135 - DNA, 17 bp, Homo sapiens
acccgtggaggctgctc

SEQ ID NO: 3948136 - DNA, 14 bp, Homo sapiens
accctaaaatttta

SEQ ID NO: 3948137 - DNA, 21 bp, Homo sapiens
accctaatagactaaatgaaa

SEQ ID NO: 3948138 - DNA, 14 bp, Homo sapiens
accctaccccacca

SEQ ID NO: 3948139 - DNA, 23 bp, Homo sapiens
accctatagagagggggctctcc

SEQ ID NO: 3948140 - DNA, 18 bp, Homo sapiens
accctcaaaccctgtggg

SEQ ID NO: 3948141 - DNA, 20 bp, Homo sapiens
accctcaaatgtcagagcta

SEQ ID NO: 3948142 - DNA, 22 bp, Homo sapiens
accctcaaatgtcagagctatg

SEQ ID NO: 3948143 - DNA, 18 bp, Homo sapiens
accctccaccgcagaagg

SEQ ID NO: 3948144 - DNA, 20 bp, Homo sapiens
accctcccctgtcttctctc

SEQ ID NO: 3948145 - DNA, 14 bp, Homo sapiens
accctcctccactc

SEQ ID NO: 3948146 - DNA, 14 bp, Homo sapiens
accctcgcagcagg

SEQ ID NO: 3948147 - DNA, 16 bp, Homo sapiens
accctctccatgccca

SEQ ID NO: 3948148 - DNA, 21 bp, Homo sapiens
accctctcctgggggtggcag

SEQ ID NO: 3948149 - DNA, 12 bp, Homo sapiens
accctctcttcc

SEQ ID NO: 3948150 - DNA, 14 bp, Homo sapiens
accctctcttccct

SEQ ID NO: 3948151 - DNA, 21 bp, Homo sapiens
accctctgggcagctgtcatg

SEQ ID NO: 3948152 - DNA, 22 bp, Homo sapiens
accctgaatggttccatgcctg

SEQ ID NO: 3948153 - DNA, 17 bp, Homo sapiens
accctgacctgctgtgc

SEQ ID NO: 3948154 - DNA, 13 bp, Homo sapiens
accctgaggagtc

SEQ ID NO: 3948155 - DNA, 14 bp, Homo sapiens
accctgaggagtct

SEQ ID NO: 3948156 - DNA, 19 bp, Homo sapiens
accctgaggagtctgaggt

SEQ ID NO: 3948157 - DNA, 14 bp, Homo sapiens
accctgcccatacc

SEQ ID NO: 3948158 - DNA, 14 bp, Homo sapiens
accctgcctgagcc

SEQ ID NO: 3948159 - DNA, 15 bp, Homo sapiens
accctgcctgagccc

SEQ ID NO: 3948160 - DNA, 16 bp, Homo sapiens
accctgcctgagccca

SEQ ID NO: 3948161 - DNA, 20 bp, Homo sapiens
accctgcctgagcccaggag

SEQ ID NO: 3948162 - DNA, 23 bp, Homo sapiens
accctgcctgagcccaggagctg

SEQ ID NO: 3948163 - DNA, 19 bp, Homo sapiens
accctggaaaggggagttg

SEQ ID NO: 3948164 - DNA, 18 bp, Homo sapiens
accctggaattcagcacc

SEQ ID NO: 3948165 - DNA, 21 bp, Homo sapiens
accctggaattcagcaccctg

SEQ ID NO: 3948166 - DNA, 11 bp, Homo sapiens
accctggcccg

SEQ ID NO: 3948167 - DNA, 18 bp, Homo sapiens
accctggcccgcccctcg

SEQ ID NO: 3948168 - DNA, 21 bp, Homo sapiens
accctggcccgcccctcgctg

SEQ ID NO: 3948169 - DNA, 11 bp, Homo sapiens
accctgtctct

SEQ ID NO: 3948170 - DNA, 23 bp, Homo sapiens
acctggagaactagaacctggag

SEQ ID NO: 3948171 - DNA, 23 bp, Homo sapiens
acctggagagccagaacctggag

SEQ ID NO: 3948172 - DNA, 21 bp, Homo sapiens
acctggagagctagaacctag

SEQ ID NO: 3948173 - DNA, 21 bp, Homo sapiens
acctggagggctagaacctag

SEQ ID NO: 3948174 - DNA, 22 bp, Homo sapiens
acctggagggctagaacctggc

SEQ ID NO: 3948175 - DNA, 14 bp, Homo sapiens
acctggaggggcta

SEQ ID NO: 3948176 - DNA, 20 bp, Homo sapiens
acctggcaagctagaacctg

SEQ ID NO: 3948177 - DNA, 23 bp, Homo sapiens
acctggccccatgtctctcagaa

SEQ ID NO: 3948178 - DNA, 19 bp, Homo sapiens
acctgggaaaacagaggaa

SEQ ID NO: 3948179 - DNA, 15 bp, Homo sapiens
acctgggaaaggacc

SEQ ID NO: 3948180 - DNA, 23 bp, Homo sapiens
acctgggaaaggacccacccatc

SEQ ID NO: 3948181 - DNA, 24 bp, Homo sapiens
acctgggaaaggacccacccatct

SEQ ID NO: 3948182 - DNA, 19 bp, Homo sapiens
agccagccctgcctggagg

SEQ ID NO: 3948183 - DNA, 18 bp, Homo sapiens
agccagccggtgcctggc

SEQ ID NO: 3948184 - DNA, 14 bp, Homo sapiens
agccagcctgggac

SEQ ID NO: 3948185 - DNA, 20 bp, Homo sapiens
agccagcctgggactcccag

SEQ ID NO: 3948186 - DNA, 14 bp, Homo sapiens
agccagctctctct

SEQ ID NO: 3948187 - DNA, 20 bp, Homo sapiens
agccagctgccgaccagagc

SEQ ID NO: 3948188 - DNA, 22 bp, Homo sapiens
agccagctgtgttcacactgta

SEQ ID NO: 3948189 - DNA, 23 bp, Homo sapiens
agccaggagcaaatgtttctgca

SEQ ID NO: 3948190 - DNA, 21 bp, Homo sapiens
agccaggagtctgtgctcttt

SEQ ID NO: 3948191 - DNA, 12 bp, Homo sapiens
agccagggccag

SEQ ID NO: 3948192 - DNA, 13 bp, Homo sapiens
agccagggccagg

SEQ ID NO: 3948193 - DNA, 23 bp, Homo sapiens
agccaggtaatgagggactggaa

SEQ ID NO: 3948194 - DNA, 17 bp, Homo sapiens
agccagtcttgcctagg

SEQ ID NO: 3948195 - DNA, 13 bp, Homo sapiens
agccagtgaagga

SEQ ID NO: 3948196 - DNA, 13 bp, Homo sapiens
agccagtgacttt

SEQ ID NO: 3948197 - DNA, 17 bp, Homo sapiens
agccatattcacacctc

SEQ ID NO: 3948198 - DNA, 18 bp, Homo sapiens
agccatattcacacctca

SEQ ID NO: 3948199 - DNA, 18 bp, Homo sapiens
agccatcaacaagagttg

SEQ ID NO: 3948200 - DNA, 18 bp, Homo sapiens
agccatcccgtcttctcc

SEQ ID NO: 3948201 - DNA, 22 bp, Homo sapiens
agccatgaccagttctggccag

SEQ ID NO: 3948202 - DNA, 18 bp, Homo sapiens
agccatgataactgcaat

SEQ ID NO: 3948203 - DNA, 22 bp, Homo sapiens
agccatgatcgagccactgcac

SEQ ID NO: 3948204 - DNA, 16 bp, Homo sapiens
agccatggctcaggca

SEQ ID NO: 3948205 - DNA, 21 bp, Homo sapiens
agccatggctcaggcaagccc

SEQ ID NO: 3948206 - DNA, 22 bp, Homo sapiens
agccatttgttggggcagtggt

SEQ ID NO: 3948207 - DNA, 21 bp, Homo sapiens
agcccaacgggaagcaacctc

SEQ ID NO: 3948208 - DNA, 13 bp, Homo sapiens
agcccaagtgcca

SEQ ID NO: 3948209 - DNA, 16 bp, Homo sapiens
agcccaataaacctct

SEQ ID NO: 3948210 - DNA, 10 bp, Homo sapiens
agcccacacc

SEQ ID NO: 3948211 - DNA, 20 bp, Homo sapiens
agcccagagggccaagagag

SEQ ID NO: 3948212 - DNA, 20 bp, Homo sapiens
agcccagatggaaagacgtt

SEQ ID NO: 3948213 - DNA, 15 bp, Homo sapiens
agcccagcagggcct

SEQ ID NO: 3948214 - DNA, 20 bp, Homo sapiens
agcccagcagggcctcaaag

SEQ ID NO: 3948215 - DNA, 15 bp, Homo sapiens
agcccagctacattc

SEQ ID NO: 3948216 - DNA, 16 bp, Homo sapiens
agcccagctacattcc

SEQ ID NO: 3948217 - DNA, 18 bp, Homo sapiens
agcccagcttcctggtgt

SEQ ID NO: 3948218 - DNA, 16 bp, Homo sapiens
agcccaggagctgagt

SEQ ID NO: 3948219 - DNA, 21 bp, Homo sapiens
agcccaggccgttccccttgg

SEQ ID NO: 3948220 - DNA, 23 bp, Homo sapiens
agcccaggccgttccccttggct

SEQ ID NO: 3948221 - DNA, 12 bp, Homo sapiens
agcccaggctga

SEQ ID NO: 3948222 - DNA, 19 bp, Homo sapiens
agcccaggctggagatcct

SEQ ID NO: 3948223 - DNA, 14 bp, Homo sapiens
agcccaggtcctcc

SEQ ID NO: 3948224 - DNA, 23 bp, Homo sapiens
agcccaggtcctctgatacccag

SEQ ID NO: 3948225 - DNA, 14 bp, Homo sapiens
agcccagtttccct

SEQ ID NO: 3948226 - DNA, 15 bp, Homo sapiens
agcccattctctctc

SEQ ID NO: 3948227 - DNA, 17 bp, Homo sapiens
agccccacagcacccag

SEQ ID NO: 3948228 - DNA, 23 bp, Homo sapiens
agccccacagcacccaggctcca

SEQ ID NO: 3948229 - DNA, 15 bp, Homo sapiens
agccccagggcccta

SEQ ID NO: 3948230 - DNA, 14 bp, Homo sapiens
agccccagggcctg

SEQ ID NO: 3948231 - DNA, 15 bp, Homo sapiens
agccccagggcctgg

SEQ ID NO: 3948232 - DNA, 16 bp, Homo sapiens
agccccagggcctggg

SEQ ID NO: 3948233 - DNA, 13 bp, Homo sapiens
agccccaggggtg

SEQ ID NO: 3948234 - DNA, 21 bp, Homo sapiens
agcccccaaccccgcggtgct

SEQ ID NO: 3948235 - DNA, 22 bp, Homo sapiens
agccccccacctttctcgctgg

SEQ ID NO: 3948236 - DNA, 23 bp, Homo sapiens
agccccccacctttctcgctgga

SEQ ID NO: 3948237 - DNA, 20 bp, Homo sapiens
agccccctggatgtcccctg

SEQ ID NO: 3948238 - DNA, 18 bp, Homo sapiens
agcccctcagcccttgcc

SEQ ID NO: 3948239 - DNA, 12 bp, Homo sapiens
agcccctcctct

SEQ ID NO: 3948240 - DNA, 15 bp, Homo sapiens
agcccctcctctgcc

SEQ ID NO: 3948241 - DNA, 16 bp, Homo sapiens
agcccctcctctgcca

SEQ ID NO: 3948242 - DNA, 21 bp, Homo sapiens
agcccctcttttcccacattc

SEQ ID NO: 3948243 - DNA, 20 bp, Homo sapiens
agccccttcgaggttgcccc

SEQ ID NO: 3948244 - DNA, 21 bp, Homo sapiens
agccccttcgaggttgcccct

SEQ ID NO: 3948245 - DNA, 20 bp, Homo sapiens
agccccttgctctcccctgc

SEQ ID NO: 3948246 - DNA, 23 bp, Homo sapiens
agccccttgctctcccctgccct

SEQ ID NO: 3948247 - DNA, 18 bp, Homo sapiens
agccccttgtcctctccc

SEQ ID NO: 3948248 - DNA, 19 bp, Homo sapiens
agccccttgtcctctcccg

SEQ ID NO: 3948249 - DNA, 14 bp, Homo sapiens
agcccgaagcccag

SEQ ID NO: 3948250 - DNA, 18 bp, Homo sapiens
agcccgaagcccagtttc

SEQ ID NO: 3948251 - DNA, 18 bp, Homo sapiens
agcccgaggaccgggctg

SEQ ID NO: 3948252 - DNA, 19 bp, Homo sapiens
agcccgaggaccgggctgg

SEQ ID NO: 3948253 - DNA, 18 bp, Homo sapiens
agcccgagggcctgacag

SEQ ID NO: 3948254 - DNA, 13 bp, Homo sapiens
agcccggccaggg

SEQ ID NO: 3948255 - DNA, 14 bp, Homo sapiens
agcctcccccacaa

SEQ ID NO: 3948256 - DNA, 13 bp, Homo sapiens
agcctccccctca

SEQ ID NO: 3948257 - DNA, 18 bp, Homo sapiens
agcctccccctgctgctc

SEQ ID NO: 3948258 - DNA, 13 bp, Homo sapiens
agcctccctcctc

SEQ ID NO: 3948259 - DNA, 17 bp, Homo sapiens
agcctccgccattccaa

SEQ ID NO: 3948260 - DNA, 15 bp, Homo sapiens
agcctccgtcaggag

SEQ ID NO: 3948261 - DNA, 18 bp, Homo sapiens
agcctccgtttatgggcc

SEQ ID NO: 3948262 - DNA, 20 bp, Homo sapiens
agcctccgtttatgggcctt

SEQ ID NO: 3948263 - DNA, 23 bp, Homo sapiens
agcctccgtttatgggccttgct

SEQ ID NO: 3948264 - DNA, 18 bp, Homo sapiens
agcctcctaagcagctgg

SEQ ID NO: 3948265 - DNA, 19 bp, Homo sapiens
agcctcctaagcagctggg

SEQ ID NO: 3948266 - DNA, 16 bp, Homo sapiens
agcctcctcctgacca

SEQ ID NO: 3948267 - DNA, 16 bp, Homo sapiens
agcctcctgacctgag

SEQ ID NO: 3948268 - DNA, 18 bp, Homo sapiens
agcctcctgacctgaggc

SEQ ID NO: 3948269 - DNA, 15 bp, Homo sapiens
agcctcctgggcagt

SEQ ID NO: 3948270 - DNA, 21 bp, Homo sapiens
agcctcgcaacccgtgccaag

SEQ ID NO: 3948271 - DNA, 23 bp, Homo sapiens
agcctcgcaacccgtgccaagtc

SEQ ID NO: 3948272 - DNA, 10 bp, Homo sapiens
agcctctccc

SEQ ID NO: 3948273 - DNA, 21 bp, Homo sapiens
agcctctcccggctgcctgcc

SEQ ID NO: 3948274 - DNA, 22 bp, Homo sapiens
agcctctcccggctgcctgccg

SEQ ID NO: 3948275 - DNA, 15 bp, Homo sapiens
agcctctgccccaag

SEQ ID NO: 3948276 - DNA, 17 bp, Homo sapiens
agcctctgccccaaggg

SEQ ID NO: 3948277 - DNA, 17 bp, Homo sapiens
agcctctgccctgcctc

SEQ ID NO: 3948278 - DNA, 20 bp, Homo sapiens
agcctcttaaagctgcctgt

SEQ ID NO: 3948279 - DNA, 23 bp, Homo sapiens
agcctcttaaagctgcctgtagt

SEQ ID NO: 3948280 - DNA, 20 bp, Homo sapiens
agcctgaacatgacatttct

SEQ ID NO: 3948281 - DNA, 20 bp, Homo sapiens
agcctgaattttgttgctgt

SEQ ID NO: 3948282 - DNA, 15 bp, Homo sapiens
agcctgatggccaag

SEQ ID NO: 3948283 - DNA, 16 bp, Homo sapiens
agcctgatggccaagg

SEQ ID NO: 3948284 - DNA, 19 bp, Homo sapiens
agcctgctcccccaccccc

SEQ ID NO: 3948285 - DNA, 21 bp, Homo sapiens
agcctgctcccccaccccctc

SEQ ID NO: 3948286 - DNA, 20 bp, Homo sapiens
agcctgctccttcccaggag

SEQ ID NO: 3948287 - DNA, 22 bp, Homo sapiens
agcctgctccttcccaggagtg

SEQ ID NO: 3948288 - DNA, 22 bp, Homo sapiens
agcctggactctaagctggagc

SEQ ID NO: 3948289 - DNA, 23 bp, Homo sapiens
agcctggactctaagctggagct

SEQ ID NO: 3948290 - DNA, 17 bp, Homo sapiens
agcctggagggatgcca

SEQ ID NO: 3948291 - DNA, 13 bp, Homo sapiens
agcctggcacagg

SEQ ID NO: 3948292 - DNA, 16 bp, Homo sapiens
agcctggcccatagaa

SEQ ID NO: 3948293 - DNA, 13 bp, Homo sapiens
agcctggcctcct

SEQ ID NO: 3948294 - DNA, 17 bp, Homo sapiens
agcctggcggggcagga

SEQ ID NO: 3948295 - DNA, 21 bp, Homo sapiens
agcctggcggggcaggaggcc

SEQ ID NO: 3948296 - DNA, 18 bp, Homo sapiens
agcctgggactcccagtg

SEQ ID NO: 3948297 - DNA, 12 bp, Homo sapiens
agcctgggccta

SEQ ID NO: 3948298 - DNA, 22 bp, Homo sapiens
agcctggggctctaacgcctga

SEQ ID NO: 3948299 - DNA, 14 bp, Homo sapiens
agcctgggggcctg

SEQ ID NO: 3948300 - DNA, 15 bp, Homo sapiens
agcctgggggcctgg

SEQ ID NO: 3948301 - DNA, 17 bp, Homo sapiens
agcctgggggcctggct

SEQ ID NO: 3948302 - DNA, 22 bp, Homo sapiens
agcctgggggcctggctggctg

SEQ ID NO: 3948303 - DNA, 16 bp, Homo sapiens
agcctggggtgttctc

SEQ ID NO: 3948304 - DNA, 22 bp, Homo sapiens
agcctgggtgagaatcctgcct

SEQ ID NO: 3948305 - DNA, 18 bp, Homo sapiens
agcctggtttagcctgga

SEQ ID NO: 3948306 - DNA, 17 bp, Homo sapiens
agcctggttttcacata

SEQ ID NO: 3948307 - DNA, 15 bp, Homo sapiens
agcctgtaatcccag

SEQ ID NO: 3948308 - DNA, 19 bp, Homo sapiens
agcctgtatagacagcact

SEQ ID NO: 3948309 - DNA, 13 bp, Homo sapiens
agcctgtcctggt

SEQ ID NO: 3948310 - DNA, 14 bp, Homo sapiens
agcctgtcctggta

SEQ ID NO: 3948311 - DNA, 21 bp, Homo sapiens
agcctgtcctggtacagcagg

SEQ ID NO: 3948312 - DNA, 22 bp, Homo sapiens
agcctgtcctggtacagcaggg

SEQ ID NO: 3948313 - DNA, 22 bp, Homo sapiens
agcctgtgaacccaggacaagc

SEQ ID NO: 3948314 - DNA, 22 bp, Homo sapiens
agcctgtgaataaaaaccctgt

SEQ ID NO: 3948315 - DNA, 21 bp, Homo sapiens
agcctgtgattaacttgctta

SEQ ID NO: 3948316 - DNA, 12 bp, Homo sapiens
agcctgtgcctc

SEQ ID NO: 3948317 - DNA, 17 bp, Homo sapiens
agcctgtggcggtgcct

SEQ ID NO: 3948318 - DNA, 18 bp, Homo sapiens
agcctgtgggagtagaaa

SEQ ID NO: 3948319 - DNA, 22 bp, Homo sapiens
agccttaaatttttgtcatttt

SEQ ID NO: 3948320 - DNA, 16 bp, Homo sapiens
agccttactcacctct

SEQ ID NO: 3948321 - DNA, 21 bp, Homo sapiens
agccttgccttttaaaagaaa

SEQ ID NO: 3948322 - DNA, 12 bp, Homo sapiens
agccttgctcag

SEQ ID NO: 3948323 - DNA, 23 bp, Homo sapiens
agccttggataatgctgttgcct

SEQ ID NO: 3948324 - DNA, 18 bp, Homo sapiens
agccttggtgtccacctg

SEQ ID NO: 3948325 - DNA, 18 bp, Homo sapiens
agccttgtgccctgcccc

SEQ ID NO: 3948326 - DNA, 21 bp, Homo sapiens
agccttgtgccctgcccccat

SEQ ID NO: 3948327 - DNA, 17 bp, Homo sapiens
agccttgtgtttctgtg

SEQ ID NO: 3948328 - DNA, 13 bp, Homo sapiens
agcctttgccctg

SEQ ID NO: 3948329 - DNA, 20 bp, Homo sapiens
agcctttggatgaccagaac

SEQ ID NO: 3948330 - DNA, 12 bp, Homo sapiens
agcgagaccctt

SEQ ID NO: 3948331 - DNA, 14 bp, Homo sapiens
agcgagctgctctg

SEQ ID NO: 3948332 - DNA, 16 bp, Homo sapiens
agcgagctgctctgct

SEQ ID NO: 3948333 - DNA, 19 bp, Homo sapiens
agcgattccctctcccagg

SEQ ID NO: 3948334 - DNA, 20 bp, Homo sapiens
agcgattcttgtgcctcagc

SEQ ID NO: 3948335 - DNA, 22 bp, Homo sapiens
agcgcagccgccgggcaggcct

SEQ ID NO: 3948336 - DNA, 12 bp, Homo sapiens
agcgcagggagg

SEQ ID NO: 3948337 - DNA, 17 bp, Homo sapiens
agcgcagggaggatgcc

SEQ ID NO: 3948338 - DNA, 13 bp, Homo sapiens
agcgccctgcaga

SEQ ID NO: 3948339 - DNA, 14 bp, Homo sapiens
agcgccctgcagac

SEQ ID NO: 3948340 - DNA, 16 bp, Homo sapiens
agcgccctgcagaccc

SEQ ID NO: 3948341 - DNA, 15 bp, Homo sapiens
actgccaggagggac

SEQ ID NO: 3948342 - DNA, 12 bp, Homo sapiens
actgccaggcac

SEQ ID NO: 3948343 - DNA, 16 bp, Homo sapiens
actgccaggcacctgg

SEQ ID NO: 3948344 - DNA, 20 bp, Homo sapiens
actgccaggcacctggcctg

SEQ ID NO: 3948345 - DNA, 22 bp, Homo sapiens
actgccaggcacctggcctgct

SEQ ID NO: 3948346 - DNA, 20 bp, Homo sapiens
actgccatgcctcaagaaca

SEQ ID NO: 3948347 - DNA, 11 bp, Homo sapiens
actgccctgcc

SEQ ID NO: 3948348 - DNA, 16 bp, Homo sapiens
actgccctgcctgccc

SEQ ID NO: 3948349 - DNA, 20 bp, Homo sapiens
actgccggtcacccaggctc

SEQ ID NO: 3948350 - DNA, 14 bp, Homo sapiens
actgcctttctgct

SEQ ID NO: 3948351 - DNA, 18 bp, Homo sapiens
actgcgatcttcagagca

SEQ ID NO: 3948352 - DNA, 19 bp, Homo sapiens
actgcgggcaccagaatgc

SEQ ID NO: 3948353 - DNA, 17 bp, Homo sapiens
actgctaaatactgtac

SEQ ID NO: 3948354 - DNA, 18 bp, Homo sapiens
actgctaggcgagtgcca

SEQ ID NO: 3948355 - DNA, 23 bp, Homo sapiens
actgctaggcgagtgccaggact

SEQ ID NO: 3948356 - DNA, 18 bp, Homo sapiens
actgctcaagaagacatg

SEQ ID NO: 3948357 - DNA, 20 bp, Homo sapiens
actgctccccagccctggct

SEQ ID NO: 3948358 - DNA, 12 bp, Homo sapiens
actgctctgaat

SEQ ID NO: 3948359 - DNA, 12 bp, Homo sapiens
actgctgagcca

SEQ ID NO: 3948360 - DNA, 15 bp, Homo sapiens
actgctgagccactc

SEQ ID NO: 3948361 - DNA, 15 bp, Homo sapiens
actgctgcaaagtgc

SEQ ID NO: 3948362 - DNA, 17 bp, Homo sapiens
actgctgcaaagtgcaa

SEQ ID NO: 3948363 - DNA, 18 bp, Homo sapiens
actgctgcccagcctcca

SEQ ID NO: 3948364 - DNA, 20 bp, Homo sapiens
actggaaaataaattttgaa

SEQ ID NO: 3948365 - DNA, 15 bp, Homo sapiens
actggaacagcccat

SEQ ID NO: 3948366 - DNA, 16 bp, Homo sapiens
actggaaccagggaga

SEQ ID NO: 3948367 - DNA, 20 bp, Homo sapiens
actggaagcatgtaggagaa

SEQ ID NO: 3948368 - DNA, 18 bp, Homo sapiens
actggaatcgatctgtac

SEQ ID NO: 3948369 - DNA, 19 bp, Homo sapiens
actggaatcgatctgtact

SEQ ID NO: 3948370 - DNA, 20 bp, Homo sapiens
actggaccactgggcaatga

SEQ ID NO: 3948371 - DNA, 16 bp, Homo sapiens
actggaccccgcctcc

SEQ ID NO: 3948372 - DNA, 22 bp, Homo sapiens
actggacgcccagctgaggctg

SEQ ID NO: 3948373 - DNA, 15 bp, Homo sapiens
actggagcaccaggc

SEQ ID NO: 3948374 - DNA, 16 bp, Homo sapiens
actggagcaccaggca

SEQ ID NO: 3948375 - DNA, 19 bp, Homo sapiens
actggagcaccaggcacga

SEQ ID NO: 3948376 - DNA, 14 bp, Homo sapiens
actggaggtcacat

SEQ ID NO: 3948377 - DNA, 19 bp, Homo sapiens
actggaggtcacattcagg

SEQ ID NO: 3948378 - DNA, 20 bp, Homo sapiens
actggaggtcacattcagga

SEQ ID NO: 3948379 - DNA, 13 bp, Homo sapiens
actggagtagttg

SEQ ID NO: 3948380 - DNA, 20 bp, Homo sapiens
actggagtgaggcttccagg

SEQ ID NO: 3948381 - DNA, 22 bp, Homo sapiens
actggagtgaggcttccaggct

SEQ ID NO: 3948382 - DNA, 17 bp, Homo sapiens
actggagtgcagggagg

SEQ ID NO: 3948383 - DNA, 16 bp, Homo sapiens
actggagttacattaa

SEQ ID NO: 3948384 - DNA, 12 bp, Homo sapiens
actggatatgtt

SEQ ID NO: 3948385 - DNA, 22 bp, Homo sapiens
actggcaggtgcagatgggctg

SEQ ID NO: 3948386 - DNA, 16 bp, Homo sapiens
actggccaagctgagg

SEQ ID NO: 3948387 - DNA, 15 bp, Homo sapiens
actggccacccaaca

SEQ ID NO: 3948388 - DNA, 12 bp, Homo sapiens
actggccagaga

SEQ ID NO: 3948389 - DNA, 13 bp, Homo sapiens
actggccagagag

SEQ ID NO: 3948390 - DNA, 17 bp, Homo sapiens
actggccagagagggcc

SEQ ID NO: 3948391 - DNA, 22 bp, Homo sapiens
actggccagagagggcccagct

SEQ ID NO: 3948392 - DNA, 13 bp, Homo sapiens
actggccagtcct

SEQ ID NO: 3948393 - DNA, 20 bp, Homo sapiens
actggccagtcctagagctc

SEQ ID NO: 3948394 - DNA, 22 bp, Homo sapiens
actggccagtcctagagctcct

SEQ ID NO: 3948395 - DNA, 19 bp, Homo sapiens
actggcgaaccatctcaat

SEQ ID NO: 3948396 - DNA, 13 bp, Homo sapiens
actggctggggca

SEQ ID NO: 3948397 - DNA, 15 bp, Homo sapiens
actggcttctgtgca

SEQ ID NO: 3948398 - DNA, 23 bp, Homo sapiens
actggcttctgtgcactagcctg

SEQ ID NO: 3948399 - DNA, 12 bp, Homo sapiens
actgggaaggct

SEQ ID NO: 3948400 - DNA, 17 bp, Homo sapiens
actgggaaggctacttc

SEQ ID NO: 3948401 - DNA, 16 bp, Homo sapiens
actgggatgagccgct

SEQ ID NO: 3948402 - DNA, 18 bp, Homo sapiens
actgggcaatgatggcaa

SEQ ID NO: 3948403 - DNA, 18 bp, Homo sapiens
actggggagaaataattg

SEQ ID NO: 3948404 - DNA, 14 bp, Homo sapiens
actggggcttgcaa

SEQ ID NO: 3948405 - DNA, 15 bp, Homo sapiens
actgggtctcactcc

SEQ ID NO: 3948406 - DNA, 23 bp, Homo sapiens
actgggtgggatggatgctgggg

SEQ ID NO: 3948407 - DNA, 21 bp, Homo sapiens
actgggttatttttgtccctg

SEQ ID NO: 3948408 - DNA, 20 bp, Homo sapiens
actgggttgactttcaggta

SEQ ID NO: 3948409 - DNA, 18 bp, Homo sapiens
agatgtcaaatatctcag

SEQ ID NO: 3948410 - DNA, 19 bp, Homo sapiens
agatgtcaaatatctcaga

SEQ ID NO: 3948411 - DNA, 17 bp, Homo sapiens
agatgtgaacacatcag

SEQ ID NO: 3948412 - DNA, 23 bp, Homo sapiens
agatgtggcaaagtgctgtaccc

SEQ ID NO: 3948413 - DNA, 11 bp, Homo sapiens
agattaaagga

SEQ ID NO: 3948414 - DNA, 16 bp, Homo sapiens
agattaaaggaaggaa

SEQ ID NO: 3948415 - DNA, 18 bp, Homo sapiens
agattaaaggaaggaaaa

SEQ ID NO: 3948416 - DNA, 15 bp, Homo sapiens
agattaatggcactg

SEQ ID NO: 3948417 - DNA, 20 bp, Homo sapiens
agattacctgccacttccag

SEQ ID NO: 3948418 - DNA, 16 bp, Homo sapiens
agattactttgtcccg

SEQ ID NO: 3948419 - DNA, 18 bp, Homo sapiens
agattccagagagtggct

SEQ ID NO: 3948420 - DNA, 21 bp, Homo sapiens
agattccagagagtggctcct

SEQ ID NO: 3948421 - DNA, 15 bp, Homo sapiens
agattccctgagcag

SEQ ID NO: 3948422 - DNA, 19 bp, Homo sapiens
agattcctcttgcctctct

SEQ ID NO: 3948423 - DNA, 14 bp, Homo sapiens
agattcctgggcct

SEQ ID NO: 3948424 - DNA, 19 bp, Homo sapiens
agattctagccaaactatt

SEQ ID NO: 3948425 - DNA, 23 bp, Homo sapiens
agattctgatttttttgttgttg

SEQ ID NO: 3948426 - DNA, 20 bp, Homo sapiens
agattcttccactggctcca

SEQ ID NO: 3948427 - DNA, 19 bp, Homo sapiens
agattgaggcctgccctca

SEQ ID NO: 3948428 - DNA, 16 bp, Homo sapiens
agattgcttaaaatag

SEQ ID NO: 3948429 - DNA, 13 bp, Homo sapiens
agattgtgtaaca

SEQ ID NO: 3948430 - DNA, 14 bp, Homo sapiens
agattgttaaaata

SEQ ID NO: 3948431 - DNA, 15 bp, Homo sapiens
agattgttaaaataa

SEQ ID NO: 3948432 - DNA, 23 bp, Homo sapiens
agattgttttatatgtagtacta

SEQ ID NO: 3948433 - DNA, 18 bp, Homo sapiens
agatttagtgaaagctag

SEQ ID NO: 3948434 - DNA, 14 bp, Homo sapiens
agatttctcctgac

SEQ ID NO: 3948435 - DNA, 22 bp, Homo sapiens
agattttaaattcacaatagaa

SEQ ID NO: 3948436 - DNA, 12 bp, Homo sapiens
agattttagttc

SEQ ID NO: 3948437 - DNA, 13 bp, Homo sapiens
agattttagttca

SEQ ID NO: 3948438 - DNA, 14 bp, Homo sapiens
agattttcttggca

SEQ ID NO: 3948439 - DNA, 19 bp, Homo sapiens
agattttttttgtaacttc

SEQ ID NO: 3948440 - DNA, 16 bp, Homo sapiens
agcaaaaatataaaat

SEQ ID NO: 3948441 - DNA, 22 bp, Homo sapiens
agcaaacctcagtcatattctt

SEQ ID NO: 3948442 - DNA, 12 bp, Homo sapiens
agcaaagagtgg

SEQ ID NO: 3948443 - DNA, 15 bp, Homo sapiens
agcaaagcaccagct

SEQ ID NO: 3948444 - DNA, 22 bp, Homo sapiens
agcaaagcaccagcttctccag

SEQ ID NO: 3948445 - DNA, 15 bp, Homo sapiens
agcaaaggaaaccaa

SEQ ID NO: 3948446 - DNA, 17 bp, Homo sapiens
agcaaaggaaaccaaag

SEQ ID NO: 3948447 - DNA, 14 bp, Homo sapiens
agcaaagtctaaag

SEQ ID NO: 3948448 - DNA, 13 bp, Homo sapiens
agcaaatgtttct

SEQ ID NO: 3948449 - DNA, 14 bp, Homo sapiens
agcaaatgtttctg

SEQ ID NO: 3948450 - DNA, 16 bp, Homo sapiens
agcaaatgtttctgca

SEQ ID NO: 3948451 - DNA, 19 bp, Homo sapiens
agcaaatttcaaaagacat

SEQ ID NO: 3948452 - DNA, 17 bp, Homo sapiens
agcaacacaagctggaa

SEQ ID NO: 3948453 - DNA, 13 bp, Homo sapiens
agcaacagaaaaa

SEQ ID NO: 3948454 - DNA, 18 bp, Homo sapiens
agcaacaggttttataat

SEQ ID NO: 3948455 - DNA, 13 bp, Homo sapiens
agcaacattttat

SEQ ID NO: 3948456 - DNA, 14 bp, Homo sapiens
agcaacattttatt

SEQ ID NO: 3948457 - DNA, 20 bp, Homo sapiens
agcaacccctgtacccagct

SEQ ID NO: 3948458 - DNA, 21 bp, Homo sapiens
agcaacccctgtacccagctc

SEQ ID NO: 3948459 - DNA, 22 bp, Homo sapiens
agcaacccctgtacccagctcc

SEQ ID NO: 3948460 - DNA, 23 bp, Homo sapiens
agcaacccctgtacccagctcct

SEQ ID NO: 3948461 - DNA, 20 bp, Homo sapiens
agcaaccgtggcccttcctg

SEQ ID NO: 3948462 - DNA, 22 bp, Homo sapiens
agcaaccgtggcccttcctgga

SEQ ID NO: 3948463 - DNA, 13 bp, Homo sapiens
agcaacctcccaa

SEQ ID NO: 3948464 - DNA, 14 bp, Homo sapiens
agcaacgcaggccc

SEQ ID NO: 3948465 - DNA, 18 bp, Homo sapiens
agcaactctccactccat

SEQ ID NO: 3948466 - DNA, 14 bp, Homo sapiens
agcaagggctccag

SEQ ID NO: 3948467 - DNA, 20 bp, Homo sapiens
agcaagggctccagcatcca

SEQ ID NO: 3948468 - DNA, 14 bp, Homo sapiens
agcaaggtttctgg

SEQ ID NO: 3948469 - DNA, 17 bp, Homo sapiens
agcaagttctagagaag

SEQ ID NO: 3948470 - DNA, 21 bp, Homo sapiens
agcaagttctagagaagaggc

SEQ ID NO: 3948471 - DNA, 11 bp, Homo sapiens
agcaataatta

SEQ ID NO: 3948472 - DNA, 19 bp, Homo sapiens
agcaataattaggatctat

SEQ ID NO: 3948473 - DNA, 22 bp, Homo sapiens
agcaataattaggatctatgca

SEQ ID NO: 3948474 - DNA, 17 bp, Homo sapiens
agcaatccatgttagtt

SEQ ID NO: 3948475 - DNA, 20 bp, Homo sapiens
agcaatccatgttagttttt

SEQ ID NO: 3948476 - DNA, 22 bp, Homo sapiens
agcaatccatgttagtttttac

SEQ ID NO: 3948477 - DNA, 14 bp, Homo sapiens
agcaattatattgt

SEQ ID NO: 3948478 - DNA, 21 bp, Homo sapiens
agcaattcatttcactttaaa

SEQ ID NO: 3948479 - DNA, 18 bp, Homo sapiens
agcacaccccaagggaca

SEQ ID NO: 3948480 - DNA, 15 bp, Homo sapiens
agcacagacattaaa

SEQ ID NO: 3948481 - DNA, 16 bp, Homo sapiens
agcacagccctgggag

SEQ ID NO: 3948482 - DNA, 13 bp, Homo sapiens
agcacaggcagct

SEQ ID NO: 3948483 - DNA, 16 bp, Homo sapiens
agcacaggggccccag

SEQ ID NO: 3948484 - DNA, 19 bp, Homo sapiens
agcacaggggccccagatc

SEQ ID NO: 3948485 - DNA, 17 bp, Homo sapiens
agcaccagcttctccag

SEQ ID NO: 3948486 - DNA, 21 bp, Homo sapiens
agcaccagcttctccaggctc

SEQ ID NO: 3948487 - DNA, 23 bp, Homo sapiens
agcacccacgtgagagaatctgc

SEQ ID NO: 3948488 - DNA, 12 bp, Homo sapiens
agcacccaggct

SEQ ID NO: 3948489 - DNA, 12 bp, Homo sapiens
agcaccccctca

SEQ ID NO: 3948490 - DNA, 18 bp, Homo sapiens
agcaccccctcattcccc

SEQ ID NO: 3948491 - DNA, 20 bp, Homo sapiens
agcaccccctcattcccctc

SEQ ID NO: 3948492 - DNA, 21 bp, Homo sapiens
agcaccccctcattcccctcg

SEQ ID NO: 3948493 - DNA, 17 bp, Homo sapiens
agcaccctgggtgccat

SEQ ID NO: 3948494 - DNA, 16 bp, Homo sapiens
agcacccttctgctgt

SEQ ID NO: 3948495 - DNA, 17 bp, Homo sapiens
agcacccttctgctgta

SEQ ID NO: 3948496 - DNA, 19 bp, Homo sapiens
agcagggaaagctccacgg

SEQ ID NO: 3948497 - DNA, 19 bp, Homo sapiens
agcagggcatggctgggaa

SEQ ID NO: 3948498 - DNA, 23 bp, Homo sapiens
agcagggctctgccccagaggcc

SEQ ID NO: 3948499 - DNA, 22 bp, Homo sapiens
agcaggggtccttggtgtgacc

SEQ ID NO: 3948500 - DNA, 15 bp, Homo sapiens
agcagggtgctgtgg

SEQ ID NO: 3948501 - DNA, 16 bp, Homo sapiens
agcaggtgcaagagac

SEQ ID NO: 3948502 - DNA, 21 bp, Homo sapiens
agcaggtgcaagagacagagc

SEQ ID NO: 3948503 - DNA, 19 bp, Homo sapiens
agcaggtggcatctctaat

SEQ ID NO: 3948504 - DNA, 17 bp, Homo sapiens
agcaggtgggaaatggt

SEQ ID NO: 3948505 - DNA, 13 bp, Homo sapiens
agcaggtggtcct

SEQ ID NO: 3948506 - DNA, 20 bp, Homo sapiens
agcaggtggtcctgagacct

SEQ ID NO: 3948507 - DNA, 14 bp, Homo sapiens
agcaggtgtggtgg

SEQ ID NO: 3948508 - DNA, 16 bp, Homo sapiens
agcaggtgtggtggct

SEQ ID NO: 3948509 - DNA, 14 bp, Homo sapiens
agcaggttcttgat

SEQ ID NO: 3948510 - DNA, 21 bp, Homo sapiens
agcaggttcttgatgtcatgt

SEQ ID NO: 3948511 - DNA, 14 bp, Homo sapiens
agcagtatgaatga

SEQ ID NO: 3948512 - DNA, 17 bp, Homo sapiens
agcagtatgaatgatgt

SEQ ID NO: 3948513 - DNA, 16 bp, Homo sapiens
agcagtgagaaaaagc

SEQ ID NO: 3948514 - DNA, 23 bp, Homo sapiens
agcagtgagttacagcgagaggc

SEQ ID NO: 3948515 - DNA, 15 bp, Homo sapiens
agcagtgcctcgagg

SEQ ID NO: 3948516 - DNA, 16 bp, Homo sapiens
agcagtgcctcgaggc

SEQ ID NO: 3948517 - DNA, 15 bp, Homo sapiens
agcagtgtcatcaga

SEQ ID NO: 3948518 - DNA, 19 bp, Homo sapiens
agcagtgtcatcagaagat

SEQ ID NO: 3948519 - DNA, 16 bp, Homo sapiens
agcagtgtgtccttgg

SEQ ID NO: 3948520 - DNA, 21 bp, Homo sapiens
agcagtgtgtccttggggcac

SEQ ID NO: 3948521 - DNA, 15 bp, Homo sapiens
agcagttaactttaa

SEQ ID NO: 3948522 - DNA, 13 bp, Homo sapiens
agcataaatgcaa

SEQ ID NO: 3948523 - DNA, 21 bp, Homo sapiens
agcataatgctcccatctcct

SEQ ID NO: 3948524 - DNA, 13 bp, Homo sapiens
agcataccaacac

SEQ ID NO: 3948525 - DNA, 19 bp, Homo sapiens
agcataccaacacgagcag

SEQ ID NO: 3948526 - DNA, 17 bp, Homo sapiens
agcatacctttattgtg

SEQ ID NO: 3948527 - DNA, 16 bp, Homo sapiens
agcatcatgcctctga

SEQ ID NO: 3948528 - DNA, 23 bp, Homo sapiens
agcatcatgcctctgaggccagc

SEQ ID NO: 3948529 - DNA, 12 bp, Homo sapiens
agcatccagcct

SEQ ID NO: 3948530 - DNA, 12 bp, Homo sapiens
agcatcctgctt

SEQ ID NO: 3948531 - DNA, 22 bp, Homo sapiens
agcatcgtgacccttcagggcc

SEQ ID NO: 3948532 - DNA, 19 bp, Homo sapiens
agcatcttgtcaagaaata

SEQ ID NO: 3948533 - DNA, 18 bp, Homo sapiens
agcatgcacagctgcttg

SEQ ID NO: 3948534 - DNA, 23 bp, Homo sapiens
agcatggactaaccccaacgcac

SEQ ID NO: 3948535 - DNA, 22 bp, Homo sapiens
agcatggagagcctcttagtga

SEQ ID NO: 3948536 - DNA, 22 bp, Homo sapiens
agcatgggactgtgcctttggg

SEQ ID NO: 3948537 - DNA, 20 bp, Homo sapiens
agcatgggtgtgcccttggg

SEQ ID NO: 3948538 - DNA, 15 bp, Homo sapiens
agcatgtaggagaat

SEQ ID NO: 3948539 - DNA, 14 bp, Homo sapiens
agcattaggctttt

SEQ ID NO: 3948540 - DNA, 21 bp, Homo sapiens
agcattaggcttttaagaaac

SEQ ID NO: 3948541 - DNA, 15 bp, Homo sapiens
agcattattcttcag

SEQ ID NO: 3948542 - DNA, 18 bp, Homo sapiens
agcattctgagctgggct

SEQ ID NO: 3948543 - DNA, 22 bp, Homo sapiens
agcattgaacatttcttatgat

SEQ ID NO: 3948544 - DNA, 18 bp, Homo sapiens
agcattgagacggtgctc

SEQ ID NO: 3948545 - DNA, 13 bp, Homo sapiens
agcattgcatgga

SEQ ID NO: 3948546 - DNA, 18 bp, Homo sapiens
agcattgtaaatgtgctt

SEQ ID NO: 3948547 - DNA, 14 bp, Homo sapiens
agcattttcacatt

SEQ ID NO: 3948548 - DNA, 17 bp, Homo sapiens
agccaacaggtggcagg

SEQ ID NO: 3948549 - DNA, 21 bp, Homo sapiens
agccaacaggtggcaggacca

SEQ ID NO: 3948550 - DNA, 23 bp, Homo sapiens
agccaacaggtggcaggaccagg

SEQ ID NO: 3948551 - DNA, 20 bp, Homo sapiens
agccaactcactcttatgaa

SEQ ID NO: 3948552 - DNA, 15 bp, Homo sapiens
agccaacttgtaaat

SEQ ID NO: 3948553 - DNA, 19 bp, Homo sapiens
agccaacttgtaaatacac

SEQ ID NO: 3948554 - DNA, 20 bp, Homo sapiens
agccaacttgtaaatacacc

SEQ ID NO: 3948555 - DNA, 19 bp, Homo sapiens
agccaagatcgcgccactg

SEQ ID NO: 3948556 - DNA, 20 bp, Homo sapiens
agccacaaagtagttgtccc

SEQ ID NO: 3948557 - DNA, 19 bp, Homo sapiens
agccacaagaaatttgatt

SEQ ID NO: 3948558 - DNA, 18 bp, Homo sapiens
agccacacttctcaggac

SEQ ID NO: 3948559 - DNA, 12 bp, Homo sapiens
agccacagaagc

SEQ ID NO: 3948560 - DNA, 18 bp, Homo sapiens
agccacagaagccaggag

SEQ ID NO: 3948561 - DNA, 21 bp, Homo sapiens
agccacatagagtgactccaa

SEQ ID NO: 3948562 - DNA, 23 bp, Homo sapiens
agccacatccctttgaaacaaga

SEQ ID NO: 3948563 - DNA, 12 bp, Homo sapiens
agccaccctgag

SEQ ID NO: 3948564 - DNA, 13 bp, Homo sapiens
agccaccctgagg

SEQ ID NO: 3948565 - DNA, 21 bp, Homo sapiens
agccaccctgaggagtctgag

SEQ ID NO: 3948566 - DNA, 22 bp, Homo sapiens
agccaccctgaggagtctgagg

SEQ ID NO: 3948567 - DNA, 15 bp, Homo sapiens
agccacctcccaccc

SEQ ID NO: 3948568 - DNA, 23 bp, Homo sapiens
agccacctcccaccccactccag

SEQ ID NO: 3948569 - DNA, 15 bp, Homo sapiens
agccacgctgtcctc

SEQ ID NO: 3948570 - DNA, 20 bp, Homo sapiens
agccacgctgtcctctcgag

SEQ ID NO: 3948571 - DNA, 17 bp, Homo sapiens
agccacgttccttactg

SEQ ID NO: 3948572 - DNA, 18 bp, Homo sapiens
agccacgttccttactgc

SEQ ID NO: 3948573 - DNA, 23 bp, Homo sapiens
agccacgttccttactgcagaat

SEQ ID NO: 3948574 - DNA, 16 bp, Homo sapiens
agccactacctttgtc

SEQ ID NO: 3948575 - DNA, 23 bp, Homo sapiens
agccactcctgtcccgccttcct

SEQ ID NO: 3948576 - DNA, 20 bp, Homo sapiens
agccactcgcagtcgcagga

SEQ ID NO: 3948577 - DNA, 19 bp, Homo sapiens
agccactcgggaggctgag

SEQ ID NO: 3948578 - DNA, 14 bp, Homo sapiens
agccagacacatgg

SEQ ID NO: 3948579 - DNA, 19 bp, Homo sapiens
agccagactggcacagttt

SEQ ID NO: 3948580 - DNA, 12 bp, Homo sapiens
agccagagagga

SEQ ID NO: 3948581 - DNA, 18 bp, Homo sapiens
agccagagaggagcacct

SEQ ID NO: 3948582 - DNA, 16 bp, Homo sapiens
agggaatgttccctgc

SEQ ID NO: 3948583 - DNA, 17 bp, Homo sapiens
agggaatgttccctgca

SEQ ID NO: 3948584 - DNA, 13 bp, Homo sapiens
agggacaaagagg

SEQ ID NO: 3948585 - DNA, 17 bp, Homo sapiens
agggacaaaggagcctg

SEQ ID NO: 3948586 - DNA, 21 bp, Homo sapiens
agggacaaaggagcctgtgaa

SEQ ID NO: 3948587 - DNA, 13 bp, Homo sapiens
agggacaacccca

SEQ ID NO: 3948588 - DNA, 14 bp, Homo sapiens
agggacacacacac

SEQ ID NO: 3948589 - DNA, 20 bp, Homo sapiens
agggacagagacacctgcac

SEQ ID NO: 3948590 - DNA, 15 bp, Homo sapiens
agggacagagatgga

SEQ ID NO: 3948591 - DNA, 17 bp, Homo sapiens
agggacaggataagagg

SEQ ID NO: 3948592 - DNA, 17 bp, Homo sapiens
agggacccgaagcccag

SEQ ID NO: 3948593 - DNA, 18 bp, Homo sapiens
agggacccgaagcccagg

SEQ ID NO: 3948594 - DNA, 18 bp, Homo sapiens
agggactggaaccaggga

SEQ ID NO: 3948595 - DNA, 12 bp, Homo sapiens
agggacttaaaa

SEQ ID NO: 3948596 - DNA, 23 bp, Homo sapiens
agggacttctgtcttcacaacag

SEQ ID NO: 3948597 - DNA, 22 bp, Homo sapiens
agggagaaggatctagaatgtg

SEQ ID NO: 3948598 - DNA, 13 bp, Homo sapiens
agggagaggagtg

SEQ ID NO: 3948599 - DNA, 17 bp, Homo sapiens
agggagcaatgggaggg

SEQ ID NO: 3948600 - DNA, 14 bp, Homo sapiens
agggagcatggctg

SEQ ID NO: 3948601 - DNA, 15 bp, Homo sapiens
agggagcccctagga

SEQ ID NO: 3948602 - DNA, 21 bp, Homo sapiens
agggaggatgccacagcccca

SEQ ID NO: 3948603 - DNA, 16 bp, Homo sapiens
agggagggctctgagg

SEQ ID NO: 3948604 - DNA, 17 bp, Homo sapiens
agggagggctctgaggc

SEQ ID NO: 3948605 - DNA, 24 bp, Homo sapiens
agggagggggcgctcaggacccag

SEQ ID NO: 3948606 - DNA, 14 bp, Homo sapiens
agggaggggtcctg

SEQ ID NO: 3948607 - DNA, 14 bp, Homo sapiens
agggataattcaaa

SEQ ID NO: 3948608 - DNA, 13 bp, Homo sapiens
agggatcacaggg

SEQ ID NO: 3948609 - DNA, 15 bp, Homo sapiens
agggatcacagggcc

SEQ ID NO: 3948610 - DNA, 19 bp, Homo sapiens
agggatcttgcattcccag

SEQ ID NO: 3948611 - DNA, 22 bp, Homo sapiens
agggatcttgcattcccagtgg

SEQ ID NO: 3948612 - DNA, 22 bp, Homo sapiens
agggatgagagtggcttaaaaa

SEQ ID NO: 3948613 - DNA, 20 bp, Homo sapiens
agggatgggggatgggccag

SEQ ID NO: 3948614 - DNA, 23 bp, Homo sapiens
agggatgtgaattgcctgcagag

SEQ ID NO: 3948615 - DNA, 21 bp, Homo sapiens
agggattctggtcttcactgc

SEQ ID NO: 3948616 - DNA, 22 bp, Homo sapiens
agggattctggtcttcactgcc

SEQ ID NO: 3948617 - DNA, 12 bp, Homo sapiens
agggatttgagg

SEQ ID NO: 3948618 - DNA, 18 bp, Homo sapiens
agggcaaaccatttcaaa

SEQ ID NO: 3948619 - DNA, 20 bp, Homo sapiens
agggcaaatgacatgcactg

SEQ ID NO: 3948620 - DNA, 22 bp, Homo sapiens
agggcaaatgacatgcactgac

SEQ ID NO: 3948621 - DNA, 17 bp, Homo sapiens
agggcaaattattttaa

SEQ ID NO: 3948622 - DNA, 12 bp, Homo sapiens
agggcacaggag

SEQ ID NO: 3948623 - DNA, 13 bp, Homo sapiens
agggcacaggagc

SEQ ID NO: 3948624 - DNA, 15 bp, Homo sapiens
agggcacaggagcta

SEQ ID NO: 3948625 - DNA, 19 bp, Homo sapiens
agggcacaggagctacctg

SEQ ID NO: 3948626 - DNA, 20 bp, Homo sapiens
agggcacaggagctacctgt

SEQ ID NO: 3948627 - DNA, 23 bp, Homo sapiens
agggcacaggagctacctgtgtg

SEQ ID NO: 3948628 - DNA, 14 bp, Homo sapiens
agggcactggtggc

SEQ ID NO: 3948629 - DNA, 19 bp, Homo sapiens
agggcagagccatgggcct

SEQ ID NO: 3948630 - DNA, 23 bp, Homo sapiens
agggcagagccatgggcctgggc

SEQ ID NO: 3948631 - DNA, 15 bp, Homo sapiens
agggcagaggctgga

SEQ ID NO: 3948632 - DNA, 22 bp, Homo sapiens
agggcagaggctggaggcaggg

SEQ ID NO: 3948633 - DNA, 20 bp, Homo sapiens
agggcagcagccagccctgc

SEQ ID NO: 3948634 - DNA, 16 bp, Homo sapiens
agggcagcccccactt

SEQ ID NO: 3948635 - DNA, 22 bp, Homo sapiens
agggcagcctccaccttgctct

SEQ ID NO: 3948636 - DNA, 16 bp, Homo sapiens
agggcagtacctggga

SEQ ID NO: 3948637 - DNA, 16 bp, Homo sapiens
agggcagttcgcagcc

SEQ ID NO: 3948638 - DNA, 20 bp, Homo sapiens
agggcagttcgcagccaccc

SEQ ID NO: 3948639 - DNA, 21 bp, Homo sapiens
agggcagttcgcagccaccct

SEQ ID NO: 3948640 - DNA, 22 bp, Homo sapiens
agggcagttcgcagccaccctg

SEQ ID NO: 3948641 - DNA, 15 bp, Homo sapiens
agggcatcaggcact

SEQ ID NO: 3948642 - DNA, 17 bp, Homo sapiens
agggcatggccaggtgg

SEQ ID NO: 3948643 - DNA, 16 bp, Homo sapiens
agggcatgggagggag

SEQ ID NO: 3948644 - DNA, 16 bp, Homo sapiens
agggccaagacttggc

SEQ ID NO: 3948645 - DNA, 16 bp, Homo sapiens
agggccaagagagaca

SEQ ID NO: 3948646 - DNA, 16 bp, Homo sapiens
agggccacgtgccagg

SEQ ID NO: 3948647 - DNA, 19 bp, Homo sapiens
agggccacgtgccaggccc

SEQ ID NO: 3948648 - DNA, 12 bp, Homo sapiens
agggccagaagg

SEQ ID NO: 3948649 - DNA, 14 bp, Homo sapiens
agggccagaaggag

SEQ ID NO: 3948650 - DNA, 19 bp, Homo sapiens
agggccagaaggagggcag

SEQ ID NO: 3948651 - DNA, 21 bp, Homo sapiens
agggccagaaggagggcagag

SEQ ID NO: 3948652 - DNA, 21 bp, Homo sapiens
agggccagccctacatcttca

SEQ ID NO: 3948653 - DNA, 22 bp, Homo sapiens
agggccagctcacaagcccagg

SEQ ID NO: 3948654 - DNA, 12 bp, Homo sapiens
agggccaggaga

SEQ ID NO: 3948655 - DNA, 18 bp, Homo sapiens
agggccaggattcctctc

SEQ ID NO: 3948656 - DNA, 14 bp, Homo sapiens
agggccaggcaggt

SEQ ID NO: 3948657 - DNA, 21 bp, Homo sapiens
agggccaggcaggtgcctgga

SEQ ID NO: 3948658 - DNA, 20 bp, Homo sapiens
agggccaggggtctccctgg

SEQ ID NO: 3948659 - DNA, 21 bp, Homo sapiens
agggccaggggtctccctgga

SEQ ID NO: 3948660 - DNA, 15 bp, Homo sapiens
agggccagtctgggc

SEQ ID NO: 3948661 - DNA, 23 bp, Homo sapiens
agggccatacttttgagaggggt

SEQ ID NO: 3948662 - DNA, 19 bp, Homo sapiens
agggcccagctgtagccat

SEQ ID NO: 3948663 - DNA, 22 bp, Homo sapiens
agggcccagctgtagccatggc

SEQ ID NO: 3948664 - DNA, 19 bp, Homo sapiens
agggcccctccctctgccc

SEQ ID NO: 3948665 - DNA, 20 bp, Homo sapiens
agggcccctccctctgcccc

SEQ ID NO: 3948666 - DNA, 18 bp, Homo sapiens
agggccggggaactggcc

SEQ ID NO: 3948667 - DNA, 20 bp, Homo sapiens
agggccggggaactggccaa

SEQ ID NO: 3948668 - DNA, 16 bp, Homo sapiens
agggtgacatcccagg

SEQ ID NO: 3948669 - DNA, 17 bp, Homo sapiens
agggtgacatcccagga

SEQ ID NO: 3948670 - DNA, 21 bp, Homo sapiens
agggtgagtgaatggcaaagc

SEQ ID NO: 3948671 - DNA, 23 bp, Homo sapiens
agggtgcatggcttggggagcag

SEQ ID NO: 3948672 - DNA, 20 bp, Homo sapiens
agggtgctaacgtatctcta

SEQ ID NO: 3948673 - DNA, 21 bp, Homo sapiens
agggtggagactaagccctgt

SEQ ID NO: 3948674 - DNA, 18 bp, Homo sapiens
agggtggaggaaggtgct

SEQ ID NO: 3948675 - DNA, 19 bp, Homo sapiens
agggtggaggaaggtgctg

SEQ ID NO: 3948676 - DNA, 23 bp, Homo sapiens
agggtggaggaaggtgctgagct

SEQ ID NO: 3948677 - DNA, 20 bp, Homo sapiens
agggtggccccctgtgccag

SEQ ID NO: 3948678 - DNA, 24 bp, Homo sapiens
agggtggccccctgtgccagctca

SEQ ID NO: 3948679 - DNA, 18 bp, Homo sapiens
agggtgggccactctccc

SEQ ID NO: 3948680 - DNA, 22 bp, Homo sapiens
agggtggggccgggtgaaaatg

SEQ ID NO: 3948681 - DNA, 21 bp, Homo sapiens
agggttgaaggcagtctgaac

SEQ ID NO: 3948682 - DNA, 14 bp, Homo sapiens
agggttgatcacac

SEQ ID NO: 3948683 - DNA, 20 bp, Homo sapiens
agggttggtgggctggccca

SEQ ID NO: 3948684 - DNA, 20 bp, Homo sapiens
agggttgtactattgtttaa

SEQ ID NO: 3948685 - DNA, 21 bp, Homo sapiens
agggttgttaatggtgcaaat

SEQ ID NO: 3948686 - DNA, 23 bp, Homo sapiens
aggcctgtgtagctgtgacctgc

SEQ ID NO: 3948687 - DNA, 21 bp, Homo sapiens
aggcctttagatattattcat

SEQ ID NO: 3948688 - DNA, 16 bp, Homo sapiens
aggccttttgactctt

SEQ ID NO: 3948689 - DNA, 16 bp, Homo sapiens
aggccttttggaatgt

SEQ ID NO: 3948690 - DNA, 14 bp, Homo sapiens
aggcgaataaatgt

SEQ ID NO: 3948691 - DNA, 18 bp, Homo sapiens
aggcgaataaatgttcaa

SEQ ID NO: 3948692 - DNA, 15 bp, Homo sapiens
aggcgaggagagtgg

SEQ ID NO: 3948693 - DNA, 15 bp, Homo sapiens
aggcgagtgccagga

SEQ ID NO: 3948694 - DNA, 17 bp, Homo sapiens
aggcgagtgccaggact

SEQ ID NO: 3948695 - DNA, 19 bp, Homo sapiens
aggcgcagcccgaagccca

SEQ ID NO: 3948696 - DNA, 20 bp, Homo sapiens
aggcgcagcccgaagcccag

SEQ ID NO: 3948697 - DNA, 21 bp, Homo sapiens
aggcgcagtgcttctctacag

SEQ ID NO: 3948698 - DNA, 18 bp, Homo sapiens
aggcgcatgtgccagttg

SEQ ID NO: 3948699 - DNA, 22 bp, Homo sapiens
aggcgcgtctgccccaccctca

SEQ ID NO: 3948700 - DNA, 14 bp, Homo sapiens
aggcggaaaccttg

SEQ ID NO: 3948701 - DNA, 19 bp, Homo sapiens
aggcggaaaccttgcagca

SEQ ID NO: 3948702 - DNA, 24 bp, Homo sapiens
aggcggagagtacagtgagccaag

SEQ ID NO: 3948703 - DNA, 16 bp, Homo sapiens
agctgagtcacctcct

SEQ ID NO: 3948704 - DNA, 18 bp, Homo sapiens
agctgagtgagagggttt

SEQ ID NO: 3948705 - DNA, 21 bp, Homo sapiens
agctgagttacttgtctgagg

SEQ ID NO: 3948706 - DNA, 22 bp, Homo sapiens
agctgagttacttgtctgaggc

SEQ ID NO: 3948707 - DNA, 20 bp, Homo sapiens
agctgatgatgtctcttgta

SEQ ID NO: 3948708 - DNA, 23 bp, Homo sapiens
agctgatgatgtctcttgtagaa

SEQ ID NO: 3948709 - DNA, 15 bp, Homo sapiens
agctgatggagaagg

SEQ ID NO: 3948710 - DNA, 17 bp, Homo sapiens
agctgatttccaggccc

SEQ ID NO: 3948711 - DNA, 21 bp, Homo sapiens
agctgatttccaggcccctga

SEQ ID NO: 3948712 - DNA, 20 bp, Homo sapiens
agctgattttgtcactgtct

SEQ ID NO: 3948713 - DNA, 21 bp, Homo sapiens
agctgcaagtgacatctcttt

SEQ ID NO: 3948714 - DNA, 14 bp, Homo sapiens
agctgcacattcct

SEQ ID NO: 3948715 - DNA, 19 bp, Homo sapiens
agctgcacattcctggccc

SEQ ID NO: 3948716 - DNA, 20 bp, Homo sapiens
agctgcacattcctggcccc

SEQ ID NO: 3948717 - DNA, 22 bp, Homo sapiens
agctgcacattcctggccccgg

SEQ ID NO: 3948718 - DNA, 17 bp, Homo sapiens
agctgcaccatcacaca

SEQ ID NO: 3948719 - DNA, 12 bp, Homo sapiens
agctgcagctgg

SEQ ID NO: 3948720 - DNA, 14 bp, Homo sapiens
agctgcagcttcct

SEQ ID NO: 3948721 - DNA, 13 bp, Homo sapiens
agctgccgaccag

SEQ ID NO: 3948722 - DNA, 17 bp, Homo sapiens
agctgccgaccagagcc

SEQ ID NO: 3948723 - DNA, 14 bp, Homo sapiens
agctgcctgtagtt

SEQ ID NO: 3948724 - DNA, 19 bp, Homo sapiens
agctgcctgtagttaggaa

SEQ ID NO: 3948725 - DNA, 22 bp, Homo sapiens
agctgcctgtagttaggaaata

SEQ ID NO: 3948726 - DNA, 18 bp, Homo sapiens
agctgccttcctcatccc

SEQ ID NO: 3948727 - DNA, 12 bp, Homo sapiens
agctgccttttt

SEQ ID NO: 3948728 - DNA, 12 bp, Homo sapiens
agctgctctgcc

SEQ ID NO: 3948729 - DNA, 12 bp, Homo sapiens
agctgctctgct

SEQ ID NO: 3948730 - DNA, 14 bp, Homo sapiens
agctgctctggaaa

SEQ ID NO: 3948731 - DNA, 16 bp, Homo sapiens
agctgctgaagaggca

SEQ ID NO: 3948732 - DNA, 23 bp, Homo sapiens
agctgctgaagaggcaagagaca

SEQ ID NO: 3948733 - DNA, 20 bp, Homo sapiens
agctgctgaagttctgagcc

SEQ ID NO: 3948734 - DNA, 13 bp, Homo sapiens
agctgctgctctg

SEQ ID NO: 3948735 - DNA, 19 bp, Homo sapiens
agctgcttgtcctgctctc

SEQ ID NO: 3948736 - DNA, 18 bp, Homo sapiens
agctggaaataaacctgg

SEQ ID NO: 3948737 - DNA, 22 bp, Homo sapiens
agctggaaataaacctggagat

SEQ ID NO: 3948738 - DNA, 15 bp, Homo sapiens
agctggaaggcaggg

SEQ ID NO: 3948739 - DNA, 18 bp, Homo sapiens
agctggaaggcagggcag

SEQ ID NO: 3948740 - DNA, 20 bp, Homo sapiens
agctggaaggcagggcagag

SEQ ID NO: 3948741 - DNA, 17 bp, Homo sapiens
agctggacaagaagctg

SEQ ID NO: 3948742 - DNA, 16 bp, Homo sapiens
agctggacatgctttg

SEQ ID NO: 3948743 - DNA, 15 bp, Homo sapiens
agctggagaagaccc

SEQ ID NO: 3948744 - DNA, 17 bp, Homo sapiens
agctggagctcttggaa

SEQ ID NO: 3948745 - DNA, 13 bp, Homo sapiens
agctggaggacta

SEQ ID NO: 3948746 - DNA, 11 bp, Homo sapiens
agctggcagga

SEQ ID NO: 3948747 - DNA, 11 bp, Homo sapiens
agctggcctct

SEQ ID NO: 3948748 - DNA, 18 bp, Homo sapiens
agctggcctctagaacac

SEQ ID NO: 3948749 - DNA, 20 bp, Homo sapiens
agctggcgactgcagctgca

SEQ ID NO: 3948750 - DNA, 22 bp, Homo sapiens
agctgggaaaaaagttttgatg

SEQ ID NO: 3948751 - DNA, 20 bp, Homo sapiens
agctgggaaacagggagccc

SEQ ID NO: 3948752 - DNA, 21 bp, Homo sapiens
agctgggaacccgactgtgaa

SEQ ID NO: 3948753 - DNA, 12 bp, Homo sapiens
agctgggaggaa

SEQ ID NO: 3948754 - DNA, 15 bp, Homo sapiens
agctgggaggaaaag

SEQ ID NO: 3948755 - DNA, 20 bp, Homo sapiens
agctgggaggcatggccctg

SEQ ID NO: 3948756 - DNA, 20 bp, Homo sapiens
agctgggcaaacccttctct

SEQ ID NO: 3948757 - DNA, 21 bp, Homo sapiens
agctgggcaaacccttctctt

SEQ ID NO: 3948758 - DNA, 17 bp, Homo sapiens
agctgggccccacctac

SEQ ID NO: 3948759 - DNA, 20 bp, Homo sapiens
agctgggccccatgctctgc

SEQ ID NO: 3948760 - DNA, 19 bp, Homo sapiens
agctggggcctggagaggg

SEQ ID NO: 3948761 - DNA, 21 bp, Homo sapiens
agctggggcctggagaggggc

SEQ ID NO: 3948762 - DNA, 14 bp, Homo sapiens
agctggggtacagg

SEQ ID NO: 3948763 - DNA, 16 bp, Homo sapiens
agctggtccagggcct

SEQ ID NO: 3948764 - DNA, 17 bp, Homo sapiens
agctggtccagggcctg

SEQ ID NO: 3948765 - DNA, 15 bp, Homo sapiens
agctggttgctacat

SEQ ID NO: 3948766 - DNA, 15 bp, Homo sapiens
agctggttggagagc

SEQ ID NO: 3948767 - DNA, 19 bp, Homo sapiens
agctgtaaaaagagagaaa

SEQ ID NO: 3948768 - DNA, 13 bp, Homo sapiens
agctgtactcaga

SEQ ID NO: 3948769 - DNA, 15 bp, Homo sapiens
agctgtactcagagc

SEQ ID NO: 3948770 - DNA, 20 bp, Homo sapiens
agctgtactcagagcagagc

SEQ ID NO: 3948771 - DNA, 15 bp, Homo sapiens
agctgtagaaatgta

SEQ ID NO: 3948772 - DNA, 14 bp, Homo sapiens
agctgtagccatgg

SEQ ID NO: 3948773 - DNA, 15 bp, Homo sapiens
agctgtagccatggc

SEQ ID NO: 3948774 - DNA, 21 bp, Homo sapiens
agctgtagtagccctttctgt

SEQ ID NO: 3948775 - DNA, 22 bp, Homo sapiens
agctgtagtagccctttctgtg

SEQ ID NO: 3948776 - DNA, 21 bp, Homo sapiens
agctgtatatatatatgtgtg

SEQ ID NO: 3948777 - DNA, 23 bp, Homo sapiens
agctgtatatatatatgtgtgtg

SEQ ID NO: 3948778 - DNA, 21 bp, Homo sapiens
agctgtcatggaaaagcccag

SEQ ID NO: 3948779 - DNA, 22 bp, Homo sapiens
agctgtcatggaaaagcccagt

SEQ ID NO: 3948780 - DNA, 15 bp, Homo sapiens
agctgtcattcagga

SEQ ID NO: 3948781 - DNA, 16 bp, Homo sapiens
agctgtcccctctgtc

SEQ ID NO: 3948782 - DNA, 20 bp, Homo sapiens
agctgtccctgtcaccaagc

SEQ ID NO: 3948783 - DNA, 17 bp, Homo sapiens
agctgtgaacatggact

SEQ ID NO: 3948784 - DNA, 15 bp, Homo sapiens
agctgtgacctgctg

SEQ ID NO: 3948785 - DNA, 22 bp, Homo sapiens
agctgtgacctgctgagctctg

SEQ ID NO: 3948786 - DNA, 20 bp, Homo sapiens
agctgtgtccttgcacctgc

SEQ ID NO: 3948787 - DNA, 21 bp, Homo sapiens
agctgtgtccttgcacctgca

SEQ ID NO: 3948788 - DNA, 14 bp, Homo sapiens
agctgtgtgaaata

SEQ ID NO: 3948789 - DNA, 14 bp, Homo sapiens
agctgttcacagcc

SEQ ID NO: 3948790 - DNA, 16 bp, Homo sapiens
agctgttggcctcgcc

SEQ ID NO: 3948791 - DNA, 19 bp, Homo sapiens
agctgttggcctcgcctgg

SEQ ID NO: 3948792 - DNA, 22 bp, Homo sapiens
agctgttggcctcgcctgggcc

SEQ ID NO: 3948793 - DNA, 19 bp, Homo sapiens
agctgtttatttattcact

SEQ ID NO: 3948794 - DNA, 16 bp, Homo sapiens
agcttaaataaattca

SEQ ID NO: 3948795 - DNA, 16 bp, Homo sapiens
agcttaacattgactt

SEQ ID NO: 3948796 - DNA, 22 bp, Homo sapiens
agcttaacattgacttcttggt

SEQ ID NO: 3948797 - DNA, 16 bp, Homo sapiens
agcttagccttgtgcc

SEQ ID NO: 3948798 - DNA, 17 bp, Homo sapiens
agcttattggccactgg

SEQ ID NO: 3948799 - DNA, 21 bp, Homo sapiens
agcttcaagtgatatatgtat

SEQ ID NO: 3948800 - DNA, 13 bp, Homo sapiens
agcttcagagcct

SEQ ID NO: 3948801 - DNA, 16 bp, Homo sapiens
agcttcagagcctagc

SEQ ID NO: 3948802 - DNA, 21 bp, Homo sapiens
agcttcagagcctagccacct

SEQ ID NO: 3948803 - DNA, 17 bp, Homo sapiens
agcttcatcaattttta

SEQ ID NO: 3948804 - DNA, 21 bp, Homo sapiens
agcttcatcaatttttataca

SEQ ID NO: 3948805 - DNA, 22 bp, Homo sapiens
agcttcatcaatttttatacat

SEQ ID NO: 3948806 - DNA, 19 bp, Homo sapiens
agcttcatgcctcagtttc

SEQ ID NO: 3948807 - DNA, 23 bp, Homo sapiens
agcttcatgcctcagtttcccca

SEQ ID NO: 3948808 - DNA, 22 bp, Homo sapiens
agcttcctccagacccctgtgg

SEQ ID NO: 3948809 - DNA, 23 bp, Homo sapiens
agcttcctccagacccctgtggc

SEQ ID NO: 3948810 - DNA, 15 bp, Homo sapiens
agcttcctgtcaaca

SEQ ID NO: 3948811 - DNA, 22 bp, Homo sapiens
agcttcctgtgggccaggagct

SEQ ID NO: 3948812 - DNA, 14 bp, Homo sapiens
agcttctccaggct

SEQ ID NO: 3948813 - DNA, 23 bp, Homo sapiens
agcttctccaggctctttggggt

SEQ ID NO: 3948814 - DNA, 16 bp, Homo sapiens
agcttgaccagaccta

SEQ ID NO: 3948815 - DNA, 18 bp, Homo sapiens
agcttgccctgttaaaag

SEQ ID NO: 3948816 - DNA, 22 bp, Homo sapiens
agcttgctcttcagtgggagaa

SEQ ID NO: 3948817 - DNA, 19 bp, Homo sapiens
agcttggacagtctgagct

SEQ ID NO: 3948818 - DNA, 21 bp, Homo sapiens
agcttgggggatgactagagg

SEQ ID NO: 3948819 - DNA, 16 bp, Homo sapiens
agcttggtggctgagc

SEQ ID NO: 3948820 - DNA, 23 bp, Homo sapiens
agcttggtggctgagcttggccc

SEQ ID NO: 3948821 - DNA, 14 bp, Homo sapiens
agcttgtagccagc

SEQ ID NO: 3948822 - DNA, 15 bp, Homo sapiens
agcttgtagccagcc

SEQ ID NO: 3948823 - DNA, 16 bp, Homo sapiens
agcttgtagccagccg

SEQ ID NO: 3948824 - DNA, 21 bp, Homo sapiens
agcttgtatagtgtaaaataa

SEQ ID NO: 3948825 - DNA, 14 bp, Homo sapiens
agcttgtatataca

SEQ ID NO: 3948826 - DNA, 15 bp, Homo sapiens
agcttgtatatacat

SEQ ID NO: 3948827 - DNA, 17 bp, Homo sapiens
agcttgtatatacatat

SEQ ID NO: 3948828 - DNA, 15 bp, Homo sapiens
agcttgtgagagctg

SEQ ID NO: 3948829 - DNA, 16 bp, Homo sapiens
agcttgtgagagctgg

SEQ ID NO: 3948830 - DNA, 17 bp, Homo sapiens
agcttgtgagagctggt

SEQ ID NO: 3948831 - DNA, 13 bp, Homo sapiens
agctttacacaca

SEQ ID NO: 3948832 - DNA, 16 bp, Homo sapiens
agctttagcttctctg

SEQ ID NO: 3948833 - DNA, 17 bp, Homo sapiens
agctttcaaagaaggaa

SEQ ID NO: 3948834 - DNA, 16 bp, Homo sapiens
agctttcagagccagt

SEQ ID NO: 3948835 - DNA, 16 bp, Homo sapiens
agctttctcagggggt

SEQ ID NO: 3948836 - DNA, 23 bp, Homo sapiens
agctttctcagggggtcagcaga

SEQ ID NO: 3948837 - DNA, 14 bp, Homo sapiens
agctttctcctttg

SEQ ID NO: 3948838 - DNA, 22 bp, Homo sapiens
agctttcttctacaaccagagc

SEQ ID NO: 3948839 - DNA, 20 bp, Homo sapiens
agctttctttcacaaaaaag

SEQ ID NO: 3948840 - DNA, 19 bp, Homo sapiens
agctttgaaggccgaaggc

SEQ ID NO: 3948841 - DNA, 21 bp, Homo sapiens
agctttgaatacccccagaga

SEQ ID NO: 3948842 - DNA, 10 bp, Homo sapiens
agctttgctc

SEQ ID NO: 3948843 - DNA, 16 bp, Homo sapiens
agctttggaaacagga

SEQ ID NO: 3948844 - DNA, 19 bp, Homo sapiens
agcttttattgtataaact

SEQ ID NO: 3948845 - DNA, 16 bp, Homo sapiens
agcttttcatggaagt

SEQ ID NO: 3948846 - DNA, 13 bp, Homo sapiens
agctttttgtctt

SEQ ID NO: 3948847 - DNA, 17 bp, Homo sapiens
agctttttgtcttttct

SEQ ID NO: 3948848 - DNA, 14 bp, Homo sapiens
aggaaaaaaatgac

SEQ ID NO: 3948849 - DNA, 22 bp, Homo sapiens
aggaaaaccaagccgtggcttc

SEQ ID NO: 3948850 - DNA, 14 bp, Homo sapiens
aggaaaaccaggga

SEQ ID NO: 3948851 - DNA, 17 bp, Homo sapiens
aggaaaaccagggatag

SEQ ID NO: 3948852 - DNA, 18 bp, Homo sapiens
aggaaaaccagggatagc

SEQ ID NO: 3948853 - DNA, 19 bp, Homo sapiens
aggaaaaccagggatagct

SEQ ID NO: 3948854 - DNA, 14 bp, Homo sapiens
aggaaaaggcctgg

SEQ ID NO: 3948855 - DNA, 17 bp, Homo sapiens
aggaaaaggcctggggt

SEQ ID NO: 3948856 - DNA, 18 bp, Homo sapiens
aggaaaaggcctggggtg

SEQ ID NO: 3948857 - DNA, 16 bp, Homo sapiens
aggaaaagtacattta

SEQ ID NO: 3948858 - DNA, 22 bp, Homo sapiens
aggaaaatgcttctgttgtaat

SEQ ID NO: 3948859 - DNA, 12 bp, Homo sapiens
aggaaaccaaag

SEQ ID NO: 3948860 - DNA, 13 bp, Homo sapiens
aggaaaccaacac

SEQ ID NO: 3948861 - DNA, 16 bp, Homo sapiens
aggaaagcagtgtgtc

SEQ ID NO: 3948862 - DNA, 21 bp, Homo sapiens
aggaaagcagtgtgtccttgg

SEQ ID NO: 3948863 - DNA, 16 bp, Homo sapiens
aggaaataaaaccttt

SEQ ID NO: 3948864 - DNA, 21 bp, Homo sapiens
aggaaataaaacctttcaaat

SEQ ID NO: 3948865 - DNA, 22 bp, Homo sapiens
aggaaataaaacctttcaaatt

SEQ ID NO: 3948866 - DNA, 23 bp, Homo sapiens
aggaaatgtttgagttttcaaag

SEQ ID NO: 3948867 - DNA, 14 bp, Homo sapiens
aggaacactggaaa

SEQ ID NO: 3948868 - DNA, 14 bp, Homo sapiens
aggaacagagactc

SEQ ID NO: 3948869 - DNA, 17 bp, Homo sapiens
aggaacagagactctgg

SEQ ID NO: 3948870 - DNA, 18 bp, Homo sapiens
aggaacagagactctgga

SEQ ID NO: 3948871 - DNA, 21 bp, Homo sapiens
aggaacagagactctggaagc

SEQ ID NO: 3948872 - DNA, 23 bp, Homo sapiens
aggaacagagactctggaagccc

SEQ ID NO: 3948873 - DNA, 22 bp, Homo sapiens
aggaacgagcactggccagaga

SEQ ID NO: 3948874 - DNA, 14 bp, Homo sapiens
aggaactcccagca

SEQ ID NO: 3948875 - DNA, 17 bp, Homo sapiens
aggaagaaaccccaagc

SEQ ID NO: 3948876 - DNA, 23 bp, Homo sapiens
aggaagagcaggcacatggagga

SEQ ID NO: 3948877 - DNA, 17 bp, Homo sapiens
aggaagatgaagagaag

SEQ ID NO: 3948878 - DNA, 19 bp, Homo sapiens
aggaagatgaagagaagct

SEQ ID NO: 3948879 - DNA, 20 bp, Homo sapiens
aggaagatgaagagaagctg

SEQ ID NO: 3948880 - DNA, 16 bp, Homo sapiens
aggaagcaagaaagcc

SEQ ID NO: 3948881 - DNA, 16 bp, Homo sapiens
aggaagcatgagtgct

SEQ ID NO: 3948882 - DNA, 15 bp, Homo sapiens
aggaagctccactgt

SEQ ID NO: 3948883 - DNA, 19 bp, Homo sapiens
aggaaggagactcacctct

SEQ ID NO: 3948884 - DNA, 12 bp, Homo sapiens
aggaaggcagct

SEQ ID NO: 3948885 - DNA, 19 bp, Homo sapiens
aggaaggcagctgctctta

SEQ ID NO: 3948886 - DNA, 16 bp, Homo sapiens
aggaagggacacacac

SEQ ID NO: 3948887 - DNA, 12 bp, Homo sapiens
aggaagggccag

SEQ ID NO: 3948888 - DNA, 19 bp, Homo sapiens
aggaagggccaggagagag

SEQ ID NO: 3948889 - DNA, 20 bp, Homo sapiens
aggaagggccaggagagaga

SEQ ID NO: 3948890 - DNA, 21 bp, Homo sapiens
aggaaggtgctgagcttagcc

SEQ ID NO: 3948891 - DNA, 20 bp, Homo sapiens
aggaataaattgctccttga

SEQ ID NO: 3948892 - DNA, 15 bp, Homo sapiens
aggaatagccagaga

SEQ ID NO: 3948893 - DNA, 15 bp, Homo sapiens
aggaatatgttcaat

SEQ ID NO: 3948894 - DNA, 16 bp, Homo sapiens
aggaatcatgttggat

SEQ ID NO: 3948895 - DNA, 23 bp, Homo sapiens
aggaatgaaatcctgcttcagtg

SEQ ID NO: 3948896 - DNA, 21 bp, Homo sapiens
aggaatgaccacgggcctcag

SEQ ID NO: 3948897 - DNA, 22 bp, Homo sapiens
aggaattcccagcccaaagctg

SEQ ID NO: 3948898 - DNA, 23 bp, Homo sapiens
aggaattcccagcccaaagctgt

SEQ ID NO: 3948899 - DNA, 22 bp, Homo sapiens
aggaattctaggcatcccaggg

SEQ ID NO: 3948900 - DNA, 22 bp, Homo sapiens
aggaatttctcctactttacac

SEQ ID NO: 3948901 - DNA, 14 bp, Homo sapiens
aggaattttctttg

SEQ ID NO: 3948902 - DNA, 18 bp, Homo sapiens
aggacaaagagaataaag

SEQ ID NO: 3948903 - DNA, 14 bp, Homo sapiens
aggacaaccattcc

SEQ ID NO: 3948904 - DNA, 18 bp, Homo sapiens
aggacaacctgcccctcc

SEQ ID NO: 3948905 - DNA, 13 bp, Homo sapiens
aggacaagcatgg

SEQ ID NO: 3948906 - DNA, 14 bp, Homo sapiens
aggacacacagtct

SEQ ID NO: 3948907 - DNA, 11 bp, Homo sapiens
aggacacaggc

SEQ ID NO: 3948908 - DNA, 12 bp, Homo sapiens
aggacacaggcc

SEQ ID NO: 3948909 - DNA, 16 bp, Homo sapiens
aggacacaggcctgtg

SEQ ID NO: 3948910 - DNA, 13 bp, Homo sapiens
aggacacatcccg

SEQ ID NO: 3948911 - DNA, 20 bp, Homo sapiens
aggacacatcccggcctctt

SEQ ID NO: 3948912 - DNA, 21 bp, Homo sapiens
aggacacatcccggcctcttc

SEQ ID NO: 3948913 - DNA, 23 bp, Homo sapiens
aggacacatcccggcctcttcca

SEQ ID NO: 3948914 - DNA, 10 bp, Homo sapiens
aggacacctg

SEQ ID NO: 3948915 - DNA, 15 bp, Homo sapiens
aggacacctgcccca

SEQ ID NO: 3948916 - DNA, 17 bp, Homo sapiens
aggacacctgccccagc

SEQ ID NO: 3948917 - DNA, 12 bp, Homo sapiens
aggacaggcccg

SEQ ID NO: 3948918 - DNA, 14 bp, Homo sapiens
aggacatggggcat

SEQ ID NO: 3948919 - DNA, 18 bp, Homo sapiens
aggacatggggcatagaa

SEQ ID NO: 3948920 - DNA, 23 bp, Homo sapiens
aggacatggggcatagaaactga

SEQ ID NO: 3948921 - DNA, 16 bp, Homo sapiens
aggacatgtttttgtt

SEQ ID NO: 3948922 - DNA, 16 bp, Homo sapiens
aggacattatgtgtgc

SEQ ID NO: 3948923 - DNA, 17 bp, Homo sapiens
aggaccaactggcttct

SEQ ID NO: 3948924 - DNA, 22 bp, Homo sapiens
aggacccacccatcttcctgct

SEQ ID NO: 3948925 - DNA, 11 bp, Homo sapiens
aggacccaggc

SEQ ID NO: 3948926 - DNA, 12 bp, Homo sapiens
aggacccaggcc

SEQ ID NO: 3948927 - DNA, 16 bp, Homo sapiens
aggacccaggccctcc

SEQ ID NO: 3948928 - DNA, 17 bp, Homo sapiens
aggacccaggccctcca

SEQ ID NO: 3948929 - DNA, 19 bp, Homo sapiens
aggacccaggccctccatg

SEQ ID NO: 3948930 - DNA, 18 bp, Homo sapiens
aggacccggaggggcctg

SEQ ID NO: 3948931 - DNA, 20 bp, Homo sapiens
aggacccggaggggcctggc

SEQ ID NO: 3948932 - DNA, 20 bp, Homo sapiens
aggaccctgttttccacacc

SEQ ID NO: 3948933 - DNA, 17 bp, Homo sapiens
aggacctccggggagag

SEQ ID NO: 3948934 - DNA, 12 bp, Homo sapiens
aggacctgagcc

SEQ ID NO: 3948935 - DNA, 16 bp, Homo sapiens
aggacctgagcctgcc

SEQ ID NO: 3948936 - DNA, 18 bp, Homo sapiens
aggacctgagcctgccga

SEQ ID NO: 3948937 - DNA, 19 bp, Homo sapiens
aggacctgagcctgccgag

SEQ ID NO: 3948938 - DNA, 21 bp, Homo sapiens
aggacctgagcctgccgagca

SEQ ID NO: 3948939 - DNA, 20 bp, Homo sapiens
aggacggttgtaagcagttg

SEQ ID NO: 3948940 - DNA, 21 bp, Homo sapiens
aggacggttgtaagcagttgt

SEQ ID NO: 3948941 - DNA, 17 bp, Homo sapiens
aggactaacactcagaa

SEQ ID NO: 3948942 - DNA, 20 bp, Homo sapiens
aggactaacactcagaagcc

SEQ ID NO: 3948943 - DNA, 22 bp, Homo sapiens
aggactaacactcagaagcctg

SEQ ID NO: 3948944 - DNA, 15 bp, Homo sapiens
aggatcaagaaagtg

SEQ ID NO: 3948945 - DNA, 18 bp, Homo sapiens
aggatcacagtgctgaga

SEQ ID NO: 3948946 - DNA, 22 bp, Homo sapiens
aggatcagaatggaaagaaact

SEQ ID NO: 3948947 - DNA, 20 bp, Homo sapiens
aggatcatttgttggaatga

SEQ ID NO: 3948948 - DNA, 21 bp, Homo sapiens
aggatcatttgttggaatgaa

SEQ ID NO: 3948949 - DNA, 12 bp, Homo sapiens
aggatccagaga

SEQ ID NO: 3948950 - DNA, 20 bp, Homo sapiens
aggatcctcacaggagcaga

SEQ ID NO: 3948951 - DNA, 13 bp, Homo sapiens
aggatcctgcagg

SEQ ID NO: 3948952 - DNA, 14 bp, Homo sapiens
aggatctagcttca

SEQ ID NO: 3948953 - DNA, 23 bp, Homo sapiens
aggatctagcttcatgcctcagt

SEQ ID NO: 3948954 - DNA, 15 bp, Homo sapiens
aggatctatgcaatt

SEQ ID NO: 3948955 - DNA, 16 bp, Homo sapiens
aggatctatgcaattt

SEQ ID NO: 3948956 - DNA, 18 bp, Homo sapiens
aggatctatgcaattttt

SEQ ID NO: 3948957 - DNA, 21 bp, Homo sapiens
aggatctatgcaatttttaaa

SEQ ID NO: 3948958 - DNA, 21 bp, Homo sapiens
aggatctctcaggagcacagg

SEQ ID NO: 3948959 - DNA, 15 bp, Homo sapiens
cagagcttcccagga

SEQ ID NO: 3948960 - DNA, 15 bp, Homo sapiens
cagaggaagagcagg

SEQ ID NO: 3948961 - DNA, 16 bp, Homo sapiens
cagaggaagagcaggc

SEQ ID NO: 3948962 - DNA, 17 bp, Homo sapiens
cagaggaatctacctgt

SEQ ID NO: 3948963 - DNA, 13 bp, Homo sapiens
cagaggaccacag

SEQ ID NO: 3948964 - DNA, 12 bp, Homo sapiens
cagaggagaaga

SEQ ID NO: 3948965 - DNA, 17 bp, Homo sapiens
cagaggagcaaggttta

SEQ ID NO: 3948966 - DNA, 16 bp, Homo sapiens
cagaggcaggagtggc

SEQ ID NO: 3948967 - DNA, 18 bp, Homo sapiens
cagaggcaggagtggcag

SEQ ID NO: 3948968 - DNA, 20 bp, Homo sapiens
cagaggccaggaatctgcca

SEQ ID NO: 3948969 - DNA, 23 bp, Homo sapiens
cagaggcggaaaccttgcagcat

SEQ ID NO: 3948970 - DNA, 20 bp, Homo sapiens
cagaggctattattttcact

SEQ ID NO: 3948971 - DNA, 21 bp, Homo sapiens
cagaggctggaggcagggcct

SEQ ID NO: 3948972 - DNA, 20 bp, Homo sapiens
cagagggaaggggcctacac

SEQ ID NO: 3948973 - DNA, 19 bp, Homo sapiens
cagagggaatgttccctgc

SEQ ID NO: 3948974 - DNA, 20 bp, Homo sapiens
cagagggaatgttccctgca

SEQ ID NO: 3948975 - DNA, 21 bp, Homo sapiens
cagagggaatgttccctgcac

SEQ ID NO: 3948976 - DNA, 17 bp, Homo sapiens
cagagggacagggtgga

SEQ ID NO: 3948977 - DNA, 13 bp, Homo sapiens
cagaggggcagcc

SEQ ID NO: 3948978 - DNA, 18 bp, Homo sapiens
cagaggggcagccgctag

SEQ ID NO: 3948979 - DNA, 18 bp, Homo sapiens
cagaggggcaggggagtg

SEQ ID NO: 3948980 - DNA, 15 bp, Homo sapiens
cagaggggtaggcag

SEQ ID NO: 3948981 - DNA, 21 bp, Homo sapiens
cagaggggtaggcagagcctt

SEQ ID NO: 3948982 - DNA, 18 bp, Homo sapiens
cagaggggtgctgctcct

SEQ ID NO: 3948983 - DNA, 20 bp, Homo sapiens
cagagggtagggcagcagat

SEQ ID NO: 3948984 - DNA, 22 bp, Homo sapiens
cagagggttgtactattgttta

SEQ ID NO: 3948985 - DNA, 15 bp, Homo sapiens
cagaggtgacagtgg

SEQ ID NO: 3948986 - DNA, 14 bp, Homo sapiens
cagaggtggccaga

SEQ ID NO: 3948987 - DNA, 21 bp, Homo sapiens
cagaggtggccagagctggga

SEQ ID NO: 3948988 - DNA, 17 bp, Homo sapiens
cagaggttatctgcctg

SEQ ID NO: 3948989 - DNA, 18 bp, Homo sapiens
cagaggttatctgcctgg

SEQ ID NO: 3948990 - DNA, 13 bp, Homo sapiens
cagagtatgacga

SEQ ID NO: 3948991 - DNA, 17 bp, Homo sapiens
cagagtgaggatgtgtt

SEQ ID NO: 3948992 - DNA, 18 bp, Homo sapiens
cagagtggagccctcagt

SEQ ID NO: 3948993 - DNA, 17 bp, Homo sapiens
cagagtggagtctgagt

SEQ ID NO: 3948994 - DNA, 19 bp, Homo sapiens
cagagtggagtctgagtct

SEQ ID NO: 3948995 - DNA, 16 bp, Homo sapiens
cagagtgtagaataat

SEQ ID NO: 3948996 - DNA, 22 bp, Homo sapiens
cagagttattgaatcttaattt

SEQ ID NO: 3948997 - DNA, 15 bp, Homo sapiens
cagagttctgctcta

SEQ ID NO: 3948998 - DNA, 16 bp, Homo sapiens
cagataaagacagctg

SEQ ID NO: 3948999 - DNA, 22 bp, Homo sapiens
cagataaagacagctgacagat

SEQ ID NO: 3949000 - DNA, 17 bp, Homo sapiens
cagataaccagctgtaa

SEQ ID NO: 3949001 - DNA, 22 bp, Homo sapiens
cagatacagccccaaaccaggg

SEQ ID NO: 3949002 - DNA, 16 bp, Homo sapiens
cagatacatagatgga

SEQ ID NO: 3949003 - DNA, 20 bp, Homo sapiens
cagatacatagatggaccag

SEQ ID NO: 3949004 - DNA, 12 bp, Homo sapiens
cagatagccaga

SEQ ID NO: 3949005 - DNA, 19 bp, Homo sapiens
cagatagccagacacatgg

SEQ ID NO: 3949006 - DNA, 20 bp, Homo sapiens
cagatataaatggctggttt

SEQ ID NO: 3949007 - DNA, 22 bp, Homo sapiens
cagatataaatggctggttttt

SEQ ID NO: 3949008 - DNA, 20 bp, Homo sapiens
cagatatatatcatattggt

SEQ ID NO: 3949009 - DNA, 13 bp, Homo sapiens
cagatatattttt

SEQ ID NO: 3949010 - DNA, 21 bp, Homo sapiens
cagatcaccagcccggcctgc

SEQ ID NO: 3949011 - DNA, 18 bp, Homo sapiens
cagatcatgtaaggaagg

SEQ ID NO: 3949012 - DNA, 14 bp, Homo sapiens
cagatcccatccat

SEQ ID NO: 3949013 - DNA, 21 bp, Homo sapiens
cagatcgtattaattatctga

SEQ ID NO: 3949014 - DNA, 15 bp, Homo sapiens
cagatctgcactggg

SEQ ID NO: 3949015 - DNA, 14 bp, Homo sapiens
cagatctgcctggg

SEQ ID NO: 3949016 - DNA, 18 bp, Homo sapiens
cagatctgcctgggcctg

SEQ ID NO: 3949017 - DNA, 23 bp, Homo sapiens
cagatctgcctgggcctgtgcag

SEQ ID NO: 3949018 - DNA, 12 bp, Homo sapiens
cagatgagctgt

SEQ ID NO: 3949019 - DNA, 15 bp, Homo sapiens
cagatgatctctcca

SEQ ID NO: 3949020 - DNA, 13 bp, Homo sapiens
cagatgcaacctc

SEQ ID NO: 3949021 - DNA, 16 bp, Homo sapiens
cagatgccacacctgc

SEQ ID NO: 3949022 - DNA, 22 bp, Homo sapiens
cagatgctggggagaatgaaga

SEQ ID NO: 3949023 - DNA, 15 bp, Homo sapiens
cagatgtaggaggga

SEQ ID NO: 3949024 - DNA, 17 bp, Homo sapiens
cagatgtaggagggact

SEQ ID NO: 3949025 - DNA, 18 bp, Homo sapiens
cagatgtaggagggactg

SEQ ID NO: 3949026 - DNA, 14 bp, Homo sapiens
cagattcccagagc

SEQ ID NO: 3949027 - DNA, 17 bp, Homo sapiens
cagattcccagagcaaa

SEQ ID NO: 3949028 - DNA, 18 bp, Homo sapiens
cagattcccagagcaaaa

SEQ ID NO: 3949029 - DNA, 21 bp, Homo sapiens
cagattcccagagcaaaataa

SEQ ID NO: 3949030 - DNA, 14 bp, Homo sapiens
cagattcctgggcc

SEQ ID NO: 3949031 - DNA, 19 bp, Homo sapiens
cagattcctgggcctgtcc

SEQ ID NO: 3949032 - DNA, 23 bp, Homo sapiens
cagattctgatttttttgttgtt

SEQ ID NO: 3949033 - DNA, 22 bp, Homo sapiens
cagatttagtgaaagctagaga

SEQ ID NO: 3949034 - DNA, 12 bp, Homo sapiens
cagattttagac

SEQ ID NO: 3949035 - DNA, 14 bp, Homo sapiens
cagcaaaaatataa

SEQ ID NO: 3949036 - DNA, 18 bp, Homo sapiens
cagcaaaaatataaaata

SEQ ID NO: 3949037 - DNA, 19 bp, Homo sapiens
cagcaaagagtgggctgca

SEQ ID NO: 3949038 - DNA, 13 bp, Homo sapiens
cagcaacacagag

SEQ ID NO: 3949039 - DNA, 14 bp, Homo sapiens
cagcaacacagagc

SEQ ID NO: 3949040 - DNA, 13 bp, Homo sapiens
cagcaacagaaaa

SEQ ID NO: 3949041 - DNA, 14 bp, Homo sapiens
cagcaacagaaaaa

SEQ ID NO: 3949042 - DNA, 14 bp, Homo sapiens
cagcaactcccacg

SEQ ID NO: 3949043 - DNA, 15 bp, Homo sapiens
cagcaactcccacga

SEQ ID NO: 3949044 - DNA, 22 bp, Homo sapiens
cagcaagggtgatgggaaagca

SEQ ID NO: 3949045 - DNA, 23 bp, Homo sapiens
cagcaagggtgatgggaaagcat

SEQ ID NO: 3949046 - DNA, 18 bp, Homo sapiens
cagcaagtttcaccttgg

SEQ ID NO: 3949047 - DNA, 20 bp, Homo sapiens
cagcaatgatgtccagaaga

SEQ ID NO: 3949048 - DNA, 22 bp, Homo sapiens
cagcaatgatgtccagaagaat

SEQ ID NO: 3949049 - DNA, 11 bp, Homo sapiens
cagcacccagg

SEQ ID NO: 3949050 - DNA, 12 bp, Homo sapiens
cagcacccaggc

SEQ ID NO: 3949051 - DNA, 13 bp, Homo sapiens
cagcacccaggct

SEQ ID NO: 3949052 - DNA, 17 bp, Homo sapiens
cagcaccctctcctggg

SEQ ID NO: 3949053 - DNA, 23 bp, Homo sapiens
cagcaccctctcctgggggtggc

SEQ ID NO: 3949054 - DNA, 19 bp, Homo sapiens
cagcactaaggccgtgtct

SEQ ID NO: 3949055 - DNA, 22 bp, Homo sapiens
cagcactaaggccgtgtctctg

SEQ ID NO: 3949056 - DNA, 17 bp, Homo sapiens
cagcactttaaccctct

SEQ ID NO: 3949057 - DNA, 18 bp, Homo sapiens
cagcactttaaccctctc

SEQ ID NO: 3949058 - DNA, 23 bp, Homo sapiens
cagcactttaaccctctcttccc

SEQ ID NO: 3949059 - DNA, 11 bp, Homo sapiens
cagcagaaaag

SEQ ID NO: 3949060 - DNA, 13 bp, Homo sapiens
cagcagaaaagtg

SEQ ID NO: 3949061 - DNA, 15 bp, Homo sapiens
cagcagccagccctg

SEQ ID NO: 3949062 - DNA, 23 bp, Homo sapiens
cagcagccagccctgcctggagg

SEQ ID NO: 3949063 - DNA, 18 bp, Homo sapiens
cagcagcccagcttcctg

SEQ ID NO: 3949064 - DNA, 23 bp, Homo sapiens
cagcagcccatggcctctggcca

SEQ ID NO: 3949065 - DNA, 12 bp, Homo sapiens
cagcagcccccc

SEQ ID NO: 3949066 - DNA, 14 bp, Homo sapiens
cagcagccccccag

SEQ ID NO: 3949067 - DNA, 16 bp, Homo sapiens
cagcagccccccagca

SEQ ID NO: 3949068 - DNA, 23 bp, Homo sapiens
cagcagcccctgcacaaagccct

SEQ ID NO: 3949069 - DNA, 16 bp, Homo sapiens
cagcagccctaaggat

SEQ ID NO: 3949070 - DNA, 20 bp, Homo sapiens
cagcagccctaaggatctct

SEQ ID NO: 3949071 - DNA, 12 bp, Homo sapiens
cagcagccctcc

SEQ ID NO: 3949072 - DNA, 14 bp, Homo sapiens
cagcagccctcctc

SEQ ID NO: 3949073 - DNA, 19 bp, Homo sapiens
cagcagccctcctcacccc

SEQ ID NO: 3949074 - DNA, 18 bp, Homo sapiens
cagcagctgaacagccaa

SEQ ID NO: 3949075 - DNA, 11 bp, Homo sapiens
cagcagctgcg

SEQ ID NO: 3949076 - DNA, 19 bp, Homo sapiens
cagcagctgggacccctcc

SEQ ID NO: 3949077 - DNA, 15 bp, Homo sapiens
cagcagctgggccgg

SEQ ID NO: 3949078 - DNA, 22 bp, Homo sapiens
cagcagctgggccggccagcct

SEQ ID NO: 3949079 - DNA, 18 bp, Homo sapiens
cagcaggaacctgtactg

SEQ ID NO: 3949080 - DNA, 17 bp, Homo sapiens
cagcagggctgctgtga

SEQ ID NO: 3949081 - DNA, 18 bp, Homo sapiens
cagcagggctgctgtgaa

SEQ ID NO: 3949082 - DNA, 19 bp, Homo sapiens
cagcaggtgcaagagacag

SEQ ID NO: 3949083 - DNA, 18 bp, Homo sapiens
cagcaggtgtggtggctc

SEQ ID NO: 3949084 - DNA, 19 bp, Homo sapiens
cagcaggtgtggtggctca

SEQ ID NO: 3949085 - DNA, 22 bp, Homo sapiens
cagcaggtgtggtggctcatgg

SEQ ID NO: 3949086 - DNA, 16 bp, Homo sapiens
cagcagtatgaatgat

SEQ ID NO: 3949087 - DNA, 17 bp, Homo sapiens
cagcagtatgaatgatg

SEQ ID NO: 3949088 - DNA, 19 bp, Homo sapiens
cagcagtggagagtgttcc

SEQ ID NO: 3949089 - DNA, 12 bp, Homo sapiens
cagcagtgttcc

SEQ ID NO: 3949090 - DNA, 17 bp, Homo sapiens
cagcagtgttccccatc

SEQ ID NO: 3949091 - DNA, 21 bp, Homo sapiens
cagcagttgaaaagactccaa

SEQ ID NO: 3949092 - DNA, 22 bp, Homo sapiens
cagcagttgaaaagactccaaa

SEQ ID NO: 3949093 - DNA, 19 bp, Homo sapiens
cagcatacctttattgtga

SEQ ID NO: 3949094 - DNA, 12 bp, Homo sapiens
cagcatatttat

SEQ ID NO: 3949095 - DNA, 13 bp, Homo sapiens
cagcatccagcct

SEQ ID NO: 3949096 - DNA, 17 bp, Homo sapiens
cagcatccagcctgtgt

SEQ ID NO: 3949097 - DNA, 13 bp, Homo sapiens
cagcatgtacaaa

SEQ ID NO: 3949098 - DNA, 18 bp, Homo sapiens
cagcattattcctccagg

SEQ ID NO: 3949099 - DNA, 12 bp, Homo sapiens
cagcattcagca

SEQ ID NO: 3949100 - DNA, 15 bp, Homo sapiens
cagcattcagcacac

SEQ ID NO: 3949101 - DNA, 13 bp, Homo sapiens
cagcattcatgcc

SEQ ID NO: 3949102 - DNA, 15 bp, Homo sapiens
cagcattcatgccga

SEQ ID NO: 3949103 - DNA, 15 bp, Homo sapiens
cagcattttcacatt

SEQ ID NO: 3949104 - DNA, 19 bp, Homo sapiens
cagcattttcacattttgc

SEQ ID NO: 3949105 - DNA, 19 bp, Homo sapiens
cagccaacaggtggcagga

SEQ ID NO: 3949106 - DNA, 23 bp, Homo sapiens
cagccaacaggtggcaggaccag

SEQ ID NO: 3949107 - DNA, 14 bp, Homo sapiens
cagccacacttctc

SEQ ID NO: 3949108 - DNA, 17 bp, Homo sapiens
cagccacacttctcagg

SEQ ID NO: 3949109 - DNA, 16 bp, Homo sapiens
cagccaccctgaggag

SEQ ID NO: 3949110 - DNA, 20 bp, Homo sapiens
cagccaccctgaggagtctg

SEQ ID NO: 3949111 - DNA, 22 bp, Homo sapiens
cagccaccctgaggagtctgag

SEQ ID NO: 3949112 - DNA, 14 bp, Homo sapiens
cagccactcgggag

SEQ ID NO: 3949113 - DNA, 15 bp, Homo sapiens
cagccagactggcac

SEQ ID NO: 3949114 - DNA, 13 bp, Homo sapiens
cagccagcaatga

SEQ ID NO: 3949115 - DNA, 14 bp, Homo sapiens
cagccagccagtct

SEQ ID NO: 3949116 - DNA, 11 bp, Homo sapiens
cagccagccca

SEQ ID NO: 3949117 - DNA, 20 bp, Homo sapiens
cagccagcccagcccagctg

SEQ ID NO: 3949118 - DNA, 14 bp, Homo sapiens
cagccagccctgcc

SEQ ID NO: 3949119 - DNA, 15 bp, Homo sapiens
cagccagccctgcct

SEQ ID NO: 3949120 - DNA, 16 bp, Homo sapiens
cagccagccctgcctg

SEQ ID NO: 3949121 - DNA, 18 bp, Homo sapiens
cagccagccctgcctgga

SEQ ID NO: 3949122 - DNA, 21 bp, Homo sapiens
cagccagccctgcctggagga

SEQ ID NO: 3949123 - DNA, 17 bp, Homo sapiens
cagccagccgccctggg

SEQ ID NO: 3949124 - DNA, 12 bp, Homo sapiens
cagccagggcca

SEQ ID NO: 3949125 - DNA, 12 bp, Homo sapiens
cagccaggggct

SEQ ID NO: 3949126 - DNA, 20 bp, Homo sapiens
cagccaggggctgctcatca

SEQ ID NO: 3949127 - DNA, 19 bp, Homo sapiens
cagccagtcttgcctaggc

SEQ ID NO: 3949128 - DNA, 16 bp, Homo sapiens
cagccatgcctcatgc

SEQ ID NO: 3949129 - DNA, 19 bp, Homo sapiens
cagccatgcctcatgccac

SEQ ID NO: 3949130 - DNA, 17 bp, Homo sapiens
cagcccacacccctcca

SEQ ID NO: 3949131 - DNA, 15 bp, Homo sapiens
cagcccagcccagct

SEQ ID NO: 3949132 - DNA, 12 bp, Homo sapiens
cagcccagccta

SEQ ID NO: 3949133 - DNA, 16 bp, Homo sapiens
cagcccagcctagccc

SEQ ID NO: 3949134 - DNA, 11 bp, Homo sapiens
cagcccagctt

SEQ ID NO: 3949135 - DNA, 20 bp, Homo sapiens
cagcccattctctctcctgt

SEQ ID NO: 3949136 - DNA, 21 bp, Homo sapiens
cagcccattctctctcctgtc

SEQ ID NO: 3949137 - DNA, 22 bp, Homo sapiens
cagcccattctctctcctgtcc

SEQ ID NO: 3949138 - DNA, 16 bp, Homo sapiens
cagccccaaaccaggg

SEQ ID NO: 3949139 - DNA, 16 bp, Homo sapiens
cagccccacagcaccc

SEQ ID NO: 3949140 - DNA, 21 bp, Homo sapiens
cagccccacagcacccaggct

SEQ ID NO: 3949141 - DNA, 12 bp, Homo sapiens
cagccccagggc

SEQ ID NO: 3949142 - DNA, 14 bp, Homo sapiens
cagccccaggggtg

SEQ ID NO: 3949143 - DNA, 15 bp, Homo sapiens
cagccccaggggtgc

SEQ ID NO: 3949144 - DNA, 15 bp, Homo sapiens
cagcccccactttcc

SEQ ID NO: 3949145 - DNA, 14 bp, Homo sapiens
cagccccccagcac

SEQ ID NO: 3949146 - DNA, 16 bp, Homo sapiens
cagccccccagcacta

SEQ ID NO: 3949147 - DNA, 15 bp, Homo sapiens
cagccccctggatgg

SEQ ID NO: 3949148 - DNA, 20 bp, Homo sapiens
cagccccgctcctcccctct

SEQ ID NO: 3949149 - DNA, 13 bp, Homo sapiens
cagcccctcctct

SEQ ID NO: 3949150 - DNA, 15 bp, Homo sapiens
cagcccctcctctgc

SEQ ID NO: 3949151 - DNA, 20 bp, Homo sapiens
cagcccctcctctgccacct

SEQ ID NO: 3949152 - DNA, 21 bp, Homo sapiens
cagcccctcctctgccacctc

SEQ ID NO: 3949153 - DNA, 14 bp, Homo sapiens
cagcccgaagccca

SEQ ID NO: 3949154 - DNA, 20 bp, Homo sapiens
cagcccggcctgctcccagc

SEQ ID NO: 3949155 - DNA, 14 bp, Homo sapiens
cagcccgggacagg

SEQ ID NO: 3949156 - DNA, 21 bp, Homo sapiens
cagcccgggtgtgcctgccct

SEQ ID NO: 3949157 - DNA, 22 bp, Homo sapiens
cagcccgggtgtgcctgccctg

SEQ ID NO: 3949158 - DNA, 18 bp, Homo sapiens
cagcccgtgaagcagtgc

SEQ ID NO: 3949159 - DNA, 20 bp, Homo sapiens
cagcccgtgaagcagtgcct

SEQ ID NO: 3949160 - DNA, 20 bp, Homo sapiens
cagccctaaggatctctcag

SEQ ID NO: 3949161 - DNA, 16 bp, Homo sapiens
cagccctacatcttca

SEQ ID NO: 3949162 - DNA, 21 bp, Homo sapiens
cagccctacatcttcagctcc

SEQ ID NO: 3949163 - DNA, 15 bp, Homo sapiens
cagccctatggatgt

SEQ ID NO: 3949164 - DNA, 15 bp, Homo sapiens
cagccctccctgtcc

SEQ ID NO: 3949165 - DNA, 19 bp, Homo sapiens
cagccctccctgtcctcct

SEQ ID NO: 3949166 - DNA, 22 bp, Homo sapiens
cagccctccctgtcctcctcgg

SEQ ID NO: 3949167 - DNA, 12 bp, Homo sapiens
cagccctcctca

SEQ ID NO: 3949168 - DNA, 22 bp, Homo sapiens
cagccctcctcaccccgtctgg

SEQ ID NO: 3949169 - DNA, 15 bp, Homo sapiens
cagccctgccaggag

SEQ ID NO: 3949170 - DNA, 21 bp, Homo sapiens
cagccctgccaggaggctgcg

SEQ ID NO: 3949171 - DNA, 13 bp, Homo sapiens
cagccctgcctgg

SEQ ID NO: 3949172 - DNA, 14 bp, Homo sapiens
cagccctgcctgga

SEQ ID NO: 3949173 - DNA, 16 bp, Homo sapiens
cagccctgcctggagg

SEQ ID NO: 3949174 - DNA, 19 bp, Homo sapiens
cagccctgcctggaggacc

SEQ ID NO: 3949175 - DNA, 21 bp, Homo sapiens
cagccctgcctggaggacctg

SEQ ID NO: 3949176 - DNA, 11 bp, Homo sapiens
cagccctgctt

SEQ ID NO: 3949177 - DNA, 22 bp, Homo sapiens
cagccctgctttgggctgccct

SEQ ID NO: 3949178 - DNA, 18 bp, Homo sapiens
cagccctgggccccacca

SEQ ID NO: 3949179 - DNA, 22 bp, Homo sapiens
cagccctgggccccaccaccta

SEQ ID NO: 3949180 - DNA, 23 bp, Homo sapiens
cagccctgggccccaccacctag

SEQ ID NO: 3949181 - DNA, 13 bp, Homo sapiens
cagccctgggggc

SEQ ID NO: 3949182 - DNA, 20 bp, Homo sapiens
cagccctgggggccagctgg

SEQ ID NO: 3949183 - DNA, 21 bp, Homo sapiens
cagccctgggggccagctggt

SEQ ID NO: 3949184 - DNA, 22 bp, Homo sapiens
cagccctgtcccctgaaaaact

SEQ ID NO: 3949185 - DNA, 12 bp, Homo sapiens
cagcccttccct

SEQ ID NO: 3949186 - DNA, 22 bp, Homo sapiens
cagcccttccctgctttgagga

SEQ ID NO: 3949187 - DNA, 15 bp, Homo sapiens
cagcccttcctcctg

SEQ ID NO: 3949188 - DNA, 22 bp, Homo sapiens
cagcccttcctcctgaagcctc

SEQ ID NO: 3949189 - DNA, 15 bp, Homo sapiens
cagcccttgccccca

SEQ ID NO: 3949190 - DNA, 17 bp, Homo sapiens
cagccctttgcaggccc

SEQ ID NO: 3949191 - DNA, 22 bp, Homo sapiens
cagccctttgcaggcccagcag

SEQ ID NO: 3949192 - DNA, 18 bp, Homo sapiens
cagccgagccgggcctgg

SEQ ID NO: 3949193 - DNA, 18 bp, Homo sapiens
cagccgcagacaagtaat

SEQ ID NO: 3949194 - DNA, 15 bp, Homo sapiens
cagccgccctgggct

SEQ ID NO: 3949195 - DNA, 15 bp, Homo sapiens
cagccggggcgagtg

SEQ ID NO: 3949196 - DNA, 17 bp, Homo sapiens
cagccggggcgagtggc

SEQ ID NO: 3949197 - DNA, 15 bp, Homo sapiens
cagccggtgcctggc

SEQ ID NO: 3949198 - DNA, 19 bp, Homo sapiens
cagccgtgatgctcaggct

SEQ ID NO: 3949199 - DNA, 15 bp, Homo sapiens
cagccgtgcactccc

SEQ ID NO: 3949200 - DNA, 15 bp, Homo sapiens
cagcctaccatgaga

SEQ ID NO: 3949201 - DNA, 13 bp, Homo sapiens
cagcctcacagaa

SEQ ID NO: 3949202 - DNA, 12 bp, Homo sapiens
cagcctcagctc

SEQ ID NO: 3949203 - DNA, 13 bp, Homo sapiens
cagcctcagctca

SEQ ID NO: 3949204 - DNA, 15 bp, Homo sapiens
cagcctcagctcagc

SEQ ID NO: 3949205 - DNA, 21 bp, Homo sapiens
cagcctcagctcagcctcccc

SEQ ID NO: 3949206 - DNA, 20 bp, Homo sapiens
cagcctccaagctccatctc

SEQ ID NO: 3949207 - DNA, 16 bp, Homo sapiens
cagcctccagagccag

SEQ ID NO: 3949208 - DNA, 20 bp, Homo sapiens
cagcctccagagccagcctg

SEQ ID NO: 3949209 - DNA, 23 bp, Homo sapiens
cagcctccagagccagcctggga

SEQ ID NO: 3949210 - DNA, 17 bp, Homo sapiens
cagcctccatgctgcct

SEQ ID NO: 3949211 - DNA, 20 bp, Homo sapiens
cagcctccatgctgcctcca

SEQ ID NO: 3949212 - DNA, 12 bp, Homo sapiens
cagcctcccaga

SEQ ID NO: 3949213 - DNA, 13 bp, Homo sapiens
cagcctccccaca

SEQ ID NO: 3949214 - DNA, 20 bp, Homo sapiens
cagcctccccctgctgctca

SEQ ID NO: 3949215 - DNA, 17 bp, Homo sapiens
cagcctccgccattcca

SEQ ID NO: 3949216 - DNA, 14 bp, Homo sapiens
cagcctctcccggc

SEQ ID NO: 3949217 - DNA, 16 bp, Homo sapiens
cagcctctcccggctg

SEQ ID NO: 3949218 - DNA, 20 bp, Homo sapiens
cagcctctcccggctgcctg

SEQ ID NO: 3949219 - DNA, 20 bp, Homo sapiens
cagcctgagtctcctgtgcc

SEQ ID NO: 3949220 - DNA, 20 bp, Homo sapiens
cagcctggcacagggcagtg

SEQ ID NO: 3949221 - DNA, 15 bp, Homo sapiens
cagcctggccatccc

SEQ ID NO: 3949222 - DNA, 20 bp, Homo sapiens
cagcctggcctcctgcctct

SEQ ID NO: 3949223 - DNA, 16 bp, Homo sapiens
cagcctgggactccca

SEQ ID NO: 3949224 - DNA, 17 bp, Homo sapiens
cagcctgggactcccag

SEQ ID NO: 3949225 - DNA, 20 bp, Homo sapiens
cagcctgggactcccagtga

SEQ ID NO: 3949226 - DNA, 21 bp, Homo sapiens
cagcctgggactcccagtgaa

SEQ ID NO: 3949227 - DNA, 12 bp, Homo sapiens
cagcctgggcct

SEQ ID NO: 3949228 - DNA, 17 bp, Homo sapiens
cagcctgggcctatgga

SEQ ID NO: 3949229 - DNA, 14 bp, Homo sapiens
cagcctgtcctggt

SEQ ID NO: 3949230 - DNA, 18 bp, Homo sapiens
cagcctgtcctggtacag

SEQ ID NO: 3949231 - DNA, 19 bp, Homo sapiens
cagcctgtggcggtgcctg

SEQ ID NO: 3949232 - DNA, 20 bp, Homo sapiens
cagcctgtggcggtgcctgg

SEQ ID NO: 3949233 - DNA, 16 bp, Homo sapiens
cagcctgttggacccg

SEQ ID NO: 3949234 - DNA, 23 bp, Homo sapiens
cagcgagacccttgcattagaaa

SEQ ID NO: 3949235 - DNA, 13 bp, Homo sapiens
cagcgagaggcag

SEQ ID NO: 3949236 - DNA, 20 bp, Homo sapiens
cagcgagaggcagagaaaga

SEQ ID NO: 3949237 - DNA, 21 bp, Homo sapiens
cagcgcagccgccgggcaggc

SEQ ID NO: 3949238 - DNA, 21 bp, Homo sapiens
cagcgcctgccctccctgggg

SEQ ID NO: 3949239 - DNA, 22 bp, Homo sapiens
cagcgcctgccctccctggggt

SEQ ID NO: 3949240 - DNA, 19 bp, Homo sapiens
cagcgcctgtgctgaggac

SEQ ID NO: 3949241 - DNA, 20 bp, Homo sapiens
cagcgcggcttggccgccat

SEQ ID NO: 3949242 - DNA, 15 bp, Homo sapiens
cagcgcgtgcacagc

SEQ ID NO: 3949243 - DNA, 19 bp, Homo sapiens
cagcgcgtgcacagcgcgg

SEQ ID NO: 3949244 - DNA, 17 bp, Homo sapiens
cagcgtccctagcagtg

SEQ ID NO: 3949245 - DNA, 18 bp, Homo sapiens
cagcgtccctagcagtga

SEQ ID NO: 3949246 - DNA, 13 bp, Homo sapiens
cagcgtggccttg

SEQ ID NO: 3949247 - DNA, 24 bp, Homo sapiens
cagcgtttagtttctagaggcctc

SEQ ID NO: 3949248 - DNA, 12 bp, Homo sapiens
cagctaatctgt

SEQ ID NO: 3949249 - DNA, 14 bp, Homo sapiens
cagctaatctgtag

SEQ ID NO: 3949250 - DNA, 12 bp, Homo sapiens
cagctacattcc

SEQ ID NO: 3949251 - DNA, 15 bp, Homo sapiens
cagctacattcctca

SEQ ID NO: 3949252 - DNA, 16 bp, Homo sapiens
cagctacattcctcag

SEQ ID NO: 3949253 - DNA, 18 bp, Homo sapiens
cagctacattcctcagct

SEQ ID NO: 3949254 - DNA, 20 bp, Homo sapiens
cagctacattcctcagctgc

SEQ ID NO: 3949255 - DNA, 22 bp, Homo sapiens
cagctacattcctcagctgcca

SEQ ID NO: 3949256 - DNA, 23 bp, Homo sapiens
cagctactcgggaggctgaggca

SEQ ID NO: 3949257 - DNA, 14 bp, Homo sapiens
cagctactctgtcc

SEQ ID NO: 3949258 - DNA, 15 bp, Homo sapiens
cagctactctgtcca

SEQ ID NO: 3949259 - DNA, 16 bp, Homo sapiens
cagctactgatttttg

SEQ ID NO: 3949260 - DNA, 13 bp, Homo sapiens
cagctagactgga

SEQ ID NO: 3949261 - DNA, 15 bp, Homo sapiens
cagctagactggagt

SEQ ID NO: 3949262 - DNA, 19 bp, Homo sapiens
cagctagccaactcctcct

SEQ ID NO: 3949263 - DNA, 14 bp, Homo sapiens
cagctaggactgag

SEQ ID NO: 3949264 - DNA, 19 bp, Homo sapiens
cagctaggtggggcctaga

SEQ ID NO: 3949265 - DNA, 18 bp, Homo sapiens
cagctagtgacccacatg

SEQ ID NO: 3949266 - DNA, 22 bp, Homo sapiens
cagctagtgacccacatgccat

SEQ ID NO: 3949267 - DNA, 22 bp, Homo sapiens
cagctatctgtcatctctctgg

SEQ ID NO: 3949268 - DNA, 17 bp, Homo sapiens
cagctatggccccaggg

SEQ ID NO: 3949269 - DNA, 19 bp, Homo sapiens
cagctatggccccagggtt

SEQ ID NO: 3949270 - DNA, 20 bp, Homo sapiens
cagctatggccccagggttg

SEQ ID NO: 3949271 - DNA, 16 bp, Homo sapiens
cagctcacctctgaag

SEQ ID NO: 3949272 - DNA, 12 bp, Homo sapiens
cagctcagcctc

SEQ ID NO: 3949273 - DNA, 23 bp, Homo sapiens
cagctccaacagcttgaccagac

SEQ ID NO: 3949274 - DNA, 18 bp, Homo sapiens
cagctcccatagcgctgg

SEQ ID NO: 3949275 - DNA, 20 bp, Homo sapiens
cagctcccatagcgctggct

SEQ ID NO: 3949276 - DNA, 23 bp, Homo sapiens
cagctcccatagcgctggctcag

SEQ ID NO: 3949277 - DNA, 16 bp, Homo sapiens
cagctcccctcggaga

SEQ ID NO: 3949278 - DNA, 21 bp, Homo sapiens
cagctcccctcggagaagagc

SEQ ID NO: 3949279 - DNA, 22 bp, Homo sapiens
cagctcccttcccctgcctggt

SEQ ID NO: 3949280 - DNA, 13 bp, Homo sapiens
cagctcctctcct

SEQ ID NO: 3949281 - DNA, 14 bp, Homo sapiens
cagctcctctgtct

SEQ ID NO: 3949282 - DNA, 19 bp, Homo sapiens
cagctccttttgtccccag

SEQ ID NO: 3949283 - DNA, 21 bp, Homo sapiens
cagctccttttgtccccaggg

SEQ ID NO: 3949284 - DNA, 14 bp, Homo sapiens
cagctctccctctg

SEQ ID NO: 3949285 - DNA, 18 bp, Homo sapiens
cagctctccctctggccc

SEQ ID NO: 3949286 - DNA, 23 bp, Homo sapiens
cagctctccctctggccctgcct

SEQ ID NO: 3949287 - DNA, 16 bp, Homo sapiens
cagctctctctacccg

SEQ ID NO: 3949288 - DNA, 23 bp, Homo sapiens
cagctctctctacccggcccaga

SEQ ID NO: 3949289 - DNA, 15 bp, Homo sapiens
cagctctgtggcctg

SEQ ID NO: 3949290 - DNA, 18 bp, Homo sapiens
cagctctgtggcctgtgt

SEQ ID NO: 3949291 - DNA, 20 bp, Homo sapiens
cagctctgtggcctgtgtcc

SEQ ID NO: 3949292 - DNA, 23 bp, Homo sapiens
cagctctgtggcctgtgtccagc

SEQ ID NO: 3949293 - DNA, 24 bp, Homo sapiens
cagctctgtggcctgtgtccagca

SEQ ID NO: 3949294 - DNA, 19 bp, Homo sapiens
cagctgacacataatttga

SEQ ID NO: 3949295 - DNA, 20 bp, Homo sapiens
cagctgacacataatttgaa

SEQ ID NO: 3949296 - DNA, 15 bp, Homo sapiens
cagctgacagataca

SEQ ID NO: 3949297 - DNA, 22 bp, Homo sapiens
cagctgacagatacatagatgg

SEQ ID NO: 3949298 - DNA, 14 bp, Homo sapiens
cagctgacagctgc

SEQ ID NO: 3949299 - DNA, 15 bp, Homo sapiens
cagctgagagccctg

SEQ ID NO: 3949300 - DNA, 20 bp, Homo sapiens
cagctgagagccctgctgtg

SEQ ID NO: 3949301 - DNA, 15 bp, Homo sapiens
cagctgagcagggcc

SEQ ID NO: 3949302 - DNA, 16 bp, Homo sapiens
cagctgagcagggccg

SEQ ID NO: 3949303 - DNA, 20 bp, Homo sapiens
cagctgagcagggccgggga

SEQ ID NO: 3949304 - DNA, 18 bp, Homo sapiens
cagctgagtgaaaaatct

SEQ ID NO: 3949305 - DNA, 19 bp, Homo sapiens
cagctgatattatggcaag

SEQ ID NO: 3949306 - DNA, 15 bp, Homo sapiens
cagctgattttgtca

SEQ ID NO: 3949307 - DNA, 21 bp, Homo sapiens
cagctgattttgtcactgtct

SEQ ID NO: 3949308 - DNA, 16 bp, Homo sapiens
cagctgcacattcctg

SEQ ID NO: 3949309 - DNA, 21 bp, Homo sapiens
cagctgcacattcctggcccc

SEQ ID NO: 3949310 - DNA, 13 bp, Homo sapiens
cagctgcagctgg

SEQ ID NO: 3949311 - DNA, 16 bp, Homo sapiens
cagctgcagctgggcc

SEQ ID NO: 3949312 - DNA, 18 bp, Homo sapiens
cagctgcagctgggcccc

SEQ ID NO: 3949313 - DNA, 17 bp, Homo sapiens
cagctgcatctactcag

SEQ ID NO: 3949314 - DNA, 12 bp, Homo sapiens
cagctgccaagc

SEQ ID NO: 3949315 - DNA, 21 bp, Homo sapiens
cagctgccaagcactcgagac

SEQ ID NO: 3949316 - DNA, 23 bp, Homo sapiens
cagctgccaagcactcgagacca

SEQ ID NO: 3949317 - DNA, 19 bp, Homo sapiens
cagctgcgggtctgaagga

SEQ ID NO: 3949318 - DNA, 12 bp, Homo sapiens
cagctgctctgc

SEQ ID NO: 3949319 - DNA, 13 bp, Homo sapiens
cagctgctctgcc

SEQ ID NO: 3949320 - DNA, 15 bp, Homo sapiens
cagctgctctgcccc

SEQ ID NO: 3949321 - DNA, 17 bp, Homo sapiens
cagctgctctgcccctt

SEQ ID NO: 3949322 - DNA, 21 bp, Homo sapiens
cagctgctgaaacaacaaata

SEQ ID NO: 3949323 - DNA, 15 bp, Homo sapiens
cagctgctgaagagg

SEQ ID NO: 3949324 - DNA, 21 bp, Homo sapiens
cagctgcttgtgggcccggag

SEQ ID NO: 3949325 - DNA, 10 bp, Homo sapiens
cagctggcct

SEQ ID NO: 3949326 - DNA, 12 bp, Homo sapiens
cagctgggcccc

SEQ ID NO: 3949327 - DNA, 18 bp, Homo sapiens
cagctgggccccatgctc

SEQ ID NO: 3949328 - DNA, 21 bp, Homo sapiens
cagctgggccccatgctctgc

SEQ ID NO: 3949329 - DNA, 14 bp, Homo sapiens
cagctggtgctgca

SEQ ID NO: 3949330 - DNA, 17 bp, Homo sapiens
cagctggtgctgcaagg

SEQ ID NO: 3949331 - DNA, 22 bp, Homo sapiens
cagctggtgggaagcgtctgtc

SEQ ID NO: 3949332 - DNA, 20 bp, Homo sapiens
cagctgtaacacagctgaga

SEQ ID NO: 3949333 - DNA, 12 bp, Homo sapiens
cagctgtagcca

SEQ ID NO: 3949334 - DNA, 19 bp, Homo sapiens
cagctgtagccatggctca

SEQ ID NO: 3949335 - DNA, 22 bp, Homo sapiens
cagctgtagccatggctcaggc

SEQ ID NO: 3949336 - DNA, 18 bp, Homo sapiens
cagctgtcccctctccct

SEQ ID NO: 3949337 - DNA, 12 bp, Homo sapiens
cagctgtccctg

SEQ ID NO: 3949338 - DNA, 17 bp, Homo sapiens
cagctgtccctgtcacc

SEQ ID NO: 3949339 - DNA, 22 bp, Homo sapiens
cagctgtccctgtcaccaagct

SEQ ID NO: 3949340 - DNA, 14 bp, Homo sapiens
cagctgtcgcatct

SEQ ID NO: 3949341 - DNA, 20 bp, Homo sapiens
cagctgtgaacatggactct

SEQ ID NO: 3949342 - DNA, 11 bp, Homo sapiens
cagctgtgcct

SEQ ID NO: 3949343 - DNA, 13 bp, Homo sapiens
cagctgtgcctcg

SEQ ID NO: 3949344 - DNA, 20 bp, Homo sapiens
cagctgtgcctcgctcccca

SEQ ID NO: 3949345 - DNA, 14 bp, Homo sapiens
cagctgtttaagat

SEQ ID NO: 3949346 - DNA, 20 bp, Homo sapiens
cagcttaagtataattaata

SEQ ID NO: 3949347 - DNA, 12 bp, Homo sapiens
cagcttcagttg

SEQ ID NO: 3949348 - DNA, 16 bp, Homo sapiens
cagcttcatcaatttt

SEQ ID NO: 3949349 - DNA, 23 bp, Homo sapiens
cagcttcatcaatttttatacat

SEQ ID NO: 3949350 - DNA, 19 bp, Homo sapiens
cagctttcagagccagtga

SEQ ID NO: 3949351 - DNA, 11 bp, Homo sapiens
cagctttgcta

SEQ ID NO: 3949352 - DNA, 14 bp, Homo sapiens
cagcttttaataaa

SEQ ID NO: 3949353 - DNA, 13 bp, Homo sapiens
cagctttttgtct

SEQ ID NO: 3949354 - DNA, 18 bp, Homo sapiens
caggaaaaaaaataatgt

SEQ ID NO: 3949355 - DNA, 18 bp, Homo sapiens
caggaaaaggcctggggt

SEQ ID NO: 3949356 - DNA, 19 bp, Homo sapiens
caggaaaaggcctggggtg

SEQ ID NO: 3949357 - DNA, 18 bp, Homo sapiens
caggaaaccaacacccaa

SEQ ID NO: 3949358 - DNA, 19 bp, Homo sapiens
caggaaaccctggcttgct

SEQ ID NO: 3949359 - DNA, 15 bp, Homo sapiens
caggaaagccctccc

SEQ ID NO: 3949360 - DNA, 13 bp, Homo sapiens
cacctgcccaacc

SEQ ID NO: 3949361 - DNA, 18 bp, Homo sapiens
cacctgcccaacctgctc

SEQ ID NO: 3949362 - DNA, 13 bp, Homo sapiens
cacctgccccagc

SEQ ID NO: 3949363 - DNA, 19 bp, Homo sapiens
cacctgccccagcgcggct

SEQ ID NO: 3949364 - DNA, 12 bp, Homo sapiens
cacctgccctgc

SEQ ID NO: 3949365 - DNA, 19 bp, Homo sapiens
cacctgccctgcctgcatc

SEQ ID NO: 3949366 - DNA, 13 bp, Homo sapiens
cacctgccgacct

SEQ ID NO: 3949367 - DNA, 19 bp, Homo sapiens
cacctgcgagaggtccctg

SEQ ID NO: 3949368 - DNA, 14 bp, Homo sapiens
cacctgctcttcta

SEQ ID NO: 3949369 - DNA, 18 bp, Homo sapiens
cacctgctgagagaccca

SEQ ID NO: 3949370 - DNA, 13 bp, Homo sapiens
cacctgctggaaa

SEQ ID NO: 3949371 - DNA, 16 bp, Homo sapiens
cacctggcctgctggg

SEQ ID NO: 3949372 - DNA, 18 bp, Homo sapiens
cacctgggccctggggcc

SEQ ID NO: 3949373 - DNA, 22 bp, Homo sapiens
cacctgggccctggggcctgta

SEQ ID NO: 3949374 - DNA, 15 bp, Homo sapiens
cacctgggcctttcc

SEQ ID NO: 3949375 - DNA, 18 bp, Homo sapiens
cacctggtttctgttctg

SEQ ID NO: 3949376 - DNA, 20 bp, Homo sapiens
cacctgtaatcccagcactt

SEQ ID NO: 3949377 - DNA, 11 bp, Homo sapiens
cacctgtctgt

SEQ ID NO: 3949378 - DNA, 23 bp, Homo sapiens
cacctgtgcagcgaagcttagcg

SEQ ID NO: 3949379 - DNA, 18 bp, Homo sapiens
caccttaatattattggg

SEQ ID NO: 3949380 - DNA, 21 bp, Homo sapiens
caccttaatattattggggtt

SEQ ID NO: 3949381 - DNA, 13 bp, Homo sapiens
caccttacattcc

SEQ ID NO: 3949382 - DNA, 17 bp, Homo sapiens
caccttaccaactttct

SEQ ID NO: 3949383 - DNA, 18 bp, Homo sapiens
caccttaccaactttctg

SEQ ID NO: 3949384 - DNA, 19 bp, Homo sapiens
caccttaccaactttctgt

SEQ ID NO: 3949385 - DNA, 14 bp, Homo sapiens
caccttatgtatta

SEQ ID NO: 3949386 - DNA, 21 bp, Homo sapiens
caccttccccagactcagctc

SEQ ID NO: 3949387 - DNA, 16 bp, Homo sapiens
caccttcttggcttct

SEQ ID NO: 3949388 - DNA, 18 bp, Homo sapiens
caccttgccaagctttct

SEQ ID NO: 3949389 - DNA, 16 bp, Homo sapiens
caccttgccgagagag

SEQ ID NO: 3949390 - DNA, 19 bp, Homo sapiens
caccttgccgagagaggcg

SEQ ID NO: 3949391 - DNA, 15 bp, Homo sapiens
caccttggagcctga

SEQ ID NO: 3949392 - DNA, 19 bp, Homo sapiens
cacctttctcgctggaatc

SEQ ID NO: 3949393 - DNA, 20 bp, Homo sapiens
cacctttctcgctggaatca

SEQ ID NO: 3949394 - DNA, 19 bp, Homo sapiens
cacctttgggatcagcctc

SEQ ID NO: 3949395 - DNA, 13 bp, Homo sapiens
cacctttggtgca

SEQ ID NO: 3949396 - DNA, 21 bp, Homo sapiens
cacctttgtttagaacactgg

SEQ ID NO: 3949397 - DNA, 15 bp, Homo sapiens
caccttttataccag

SEQ ID NO: 3949398 - DNA, 15 bp, Homo sapiens
cacctttttgacttt

SEQ ID NO: 3949399 - DNA, 22 bp, Homo sapiens
cacgaagctgtgaactcagagc

SEQ ID NO: 3949400 - DNA, 18 bp, Homo sapiens
cacgaatttgctggggaa

SEQ ID NO: 3949401 - DNA, 17 bp, Homo sapiens
cacgagcaggctactgt

SEQ ID NO: 3949402 - DNA, 20 bp, Homo sapiens
cacgagcaggctactgtcag

SEQ ID NO: 3949403 - DNA, 17 bp, Homo sapiens
cacgagtcacctgcaag

SEQ ID NO: 3949404 - DNA, 19 bp, Homo sapiens
cacgagtcacctgcaagcc

SEQ ID NO: 3949405 - DNA, 15 bp, Homo sapiens
cacgatcttgtaaga

SEQ ID NO: 3949406 - DNA, 14 bp, Homo sapiens
cacgatgtggccct

SEQ ID NO: 3949407 - DNA, 15 bp, Homo sapiens
cacgatgtggccctg

SEQ ID NO: 3949408 - DNA, 17 bp, Homo sapiens
cacgatgtggccctggc

SEQ ID NO: 3949409 - DNA, 18 bp, Homo sapiens
cacgatgtggccctggcc

SEQ ID NO: 3949410 - DNA, 22 bp, Homo sapiens
cacgatgtggccctggcctgct

SEQ ID NO: 3949411 - DNA, 15 bp, Homo sapiens
cacgcaacccttgct

SEQ ID NO: 3949412 - DNA, 19 bp, Homo sapiens
cacgcaacccttgctgctg

SEQ ID NO: 3949413 - DNA, 21 bp, Homo sapiens
cacgcaagggcatcaggcact

SEQ ID NO: 3949414 - DNA, 22 bp, Homo sapiens
cacgcacatgccaatgcacgca

SEQ ID NO: 3949415 - DNA, 20 bp, Homo sapiens
cacgcaggaactcccagcaa

SEQ ID NO: 3949416 - DNA, 18 bp, Homo sapiens
cacgccaccgctgccttt

SEQ ID NO: 3949417 - DNA, 16 bp, Homo sapiens
cacgcccgactagcag

SEQ ID NO: 3949418 - DNA, 13 bp, Homo sapiens
cacgcctcctggc

SEQ ID NO: 3949419 - DNA, 17 bp, Homo sapiens
cacgcctcctggccaga

SEQ ID NO: 3949420 - DNA, 18 bp, Homo sapiens
cacgcctgtaatcccagc

SEQ ID NO: 3949421 - DNA, 19 bp, Homo sapiens
cacgcctgtaatcccagca

SEQ ID NO: 3949422 - DNA, 17 bp, Homo sapiens
cacgctcccccgcagtc

SEQ ID NO: 3949423 - DNA, 18 bp, Homo sapiens
cacgctgtcctctcgagc

SEQ ID NO: 3949424 - DNA, 18 bp, Homo sapiens
cacggacgtttccatcag

SEQ ID NO: 3949425 - DNA, 14 bp, Homo sapiens
cacggagagaaggc

SEQ ID NO: 3949426 - DNA, 22 bp, Homo sapiens
cacggagagaaggcccatacct

SEQ ID NO: 3949427 - DNA, 20 bp, Homo sapiens
cacggatccatgtagcagga

SEQ ID NO: 3949428 - DNA, 22 bp, Homo sapiens
cacggcacctgggccctggggc

SEQ ID NO: 3949429 - DNA, 15 bp, Homo sapiens
cacggggtattttag

SEQ ID NO: 3949430 - DNA, 16 bp, Homo sapiens
cacggtgaaatccagg

SEQ ID NO: 3949431 - DNA, 21 bp, Homo sapiens
cacggtgcgtggctgtggcac

SEQ ID NO: 3949432 - DNA, 13 bp, Homo sapiens
cacgtcccatgtg

SEQ ID NO: 3949433 - DNA, 13 bp, Homo sapiens
cacgtccccctgg

SEQ ID NO: 3949434 - DNA, 15 bp, Homo sapiens
cacgtctgccaggcc

SEQ ID NO: 3949435 - DNA, 21 bp, Homo sapiens
cacgtctgccaggcccatctc

SEQ ID NO: 3949436 - DNA, 14 bp, Homo sapiens
cacgtgaaatattt

SEQ ID NO: 3949437 - DNA, 17 bp, Homo sapiens
cacgtggtgtccctgcg

SEQ ID NO: 3949438 - DNA, 18 bp, Homo sapiens
cactaagctttctccttt

SEQ ID NO: 3949439 - DNA, 19 bp, Homo sapiens
cactaagctttctcctttg

SEQ ID NO: 3949440 - DNA, 20 bp, Homo sapiens
cactaagctttctcctttga

SEQ ID NO: 3949441 - DNA, 17 bp, Homo sapiens
cactaagttatagtata

SEQ ID NO: 3949442 - DNA, 22 bp, Homo sapiens
cactaagttatagtatatctgg

SEQ ID NO: 3949443 - DNA, 19 bp, Homo sapiens
cactacatgtggtttatag

SEQ ID NO: 3949444 - DNA, 21 bp, Homo sapiens
cactacccggccggagccgcc

SEQ ID NO: 3949445 - DNA, 17 bp, Homo sapiens
cactaccttctgacctc

SEQ ID NO: 3949446 - DNA, 18 bp, Homo sapiens
cagacaagagctgctgtc

SEQ ID NO: 3949447 - DNA, 14 bp, Homo sapiens
cagacaatccactc

SEQ ID NO: 3949448 - DNA, 20 bp, Homo sapiens
cagacaatccactctcagga

SEQ ID NO: 3949449 - DNA, 22 bp, Homo sapiens
cagacagagaaatgtgaagggt

SEQ ID NO: 3949450 - DNA, 12 bp, Homo sapiens
cagacagataca

SEQ ID NO: 3949451 - DNA, 17 bp, Homo sapiens
cagacatacgaaacaca

SEQ ID NO: 3949452 - DNA, 18 bp, Homo sapiens
cagacatacgaaacacaa

SEQ ID NO: 3949453 - DNA, 19 bp, Homo sapiens
cagacatacgaaacacaaa

SEQ ID NO: 3949454 - DNA, 19 bp, Homo sapiens
cagacatccatgtttgtaa

SEQ ID NO: 3949455 - DNA, 17 bp, Homo sapiens
cagacattaaacctgga

SEQ ID NO: 3949456 - DNA, 15 bp, Homo sapiens
cagaccaactctctc

SEQ ID NO: 3949457 - DNA, 18 bp, Homo sapiens
cagaccaactctctcctg

SEQ ID NO: 3949458 - DNA, 13 bp, Homo sapiens
cagaccacctgcc

SEQ ID NO: 3949459 - DNA, 15 bp, Homo sapiens
cagaccacctgccag

SEQ ID NO: 3949460 - DNA, 17 bp, Homo sapiens
cagaccacctgccagcc

SEQ ID NO: 3949461 - DNA, 17 bp, Homo sapiens
cagaccattgtcttcca

SEQ ID NO: 3949462 - DNA, 21 bp, Homo sapiens
cagaccattgtcttccaaccc

SEQ ID NO: 3949463 - DNA, 24 bp, Homo sapiens
cagaccattgtcttccaaccccag

SEQ ID NO: 3949464 - DNA, 15 bp, Homo sapiens
cagacccacacatgt

SEQ ID NO: 3949465 - DNA, 12 bp, Homo sapiens
cagaccccagcg

SEQ ID NO: 3949466 - DNA, 15 bp, Homo sapiens
cagacccctggcttt

SEQ ID NO: 3949467 - DNA, 18 bp, Homo sapiens
cagacccctggcttttca

SEQ ID NO: 3949468 - DNA, 17 bp, Homo sapiens
cagaccccttggctttt

SEQ ID NO: 3949469 - DNA, 15 bp, Homo sapiens
cagaccctaccccac

SEQ ID NO: 3949470 - DNA, 16 bp, Homo sapiens
cagaccctaccccacc

SEQ ID NO: 3949471 - DNA, 13 bp, Homo sapiens
cagaccctgccct

SEQ ID NO: 3949472 - DNA, 20 bp, Homo sapiens
cagaccgggggccagacaca

SEQ ID NO: 3949473 - DNA, 14 bp, Homo sapiens
cagacctagacctg

SEQ ID NO: 3949474 - DNA, 11 bp, Homo sapiens
cagacctctga

SEQ ID NO: 3949475 - DNA, 16 bp, Homo sapiens
cagacctctgatccct

SEQ ID NO: 3949476 - DNA, 12 bp, Homo sapiens
cagacctgacac

SEQ ID NO: 3949477 - DNA, 14 bp, Homo sapiens
cagacgcagcagct

SEQ ID NO: 3949478 - DNA, 15 bp, Homo sapiens
cagacgcagcagctg

SEQ ID NO: 3949479 - DNA, 18 bp, Homo sapiens
cagactatttaacttgag

SEQ ID NO: 3949480 - DNA, 13 bp, Homo sapiens
cagactcagctcc

SEQ ID NO: 3949481 - DNA, 16 bp, Homo sapiens
cagactcagctccaga

SEQ ID NO: 3949482 - DNA, 18 bp, Homo sapiens
cagactcctcagatctga

SEQ ID NO: 3949483 - DNA, 21 bp, Homo sapiens
cagactcctgtgcaactttcc

SEQ ID NO: 3949484 - DNA, 18 bp, Homo sapiens
cagactgcgatttgtccc

SEQ ID NO: 3949485 - DNA, 14 bp, Homo sapiens
cagacttcacactg

SEQ ID NO: 3949486 - DNA, 15 bp, Homo sapiens
cagacttcacactgc

SEQ ID NO: 3949487 - DNA, 20 bp, Homo sapiens
cagacttctccagacccacc

SEQ ID NO: 3949488 - DNA, 19 bp, Homo sapiens
cagacttctggaaggctgg

SEQ ID NO: 3949489 - DNA, 20 bp, Homo sapiens
cagactttctacacctgttg

SEQ ID NO: 3949490 - DNA, 22 bp, Homo sapiens
cagagaaatgtgaagggtgggg

SEQ ID NO: 3949491 - DNA, 14 bp, Homo sapiens
cagagaagaaagaa

SEQ ID NO: 3949492 - DNA, 19 bp, Homo sapiens
cagagaagaaagaacggaa

SEQ ID NO: 3949493 - DNA, 19 bp, Homo sapiens
cagagaagataatgttctt

SEQ ID NO: 3949494 - DNA, 15 bp, Homo sapiens
cagagaaggcctctt

SEQ ID NO: 3949495 - DNA, 22 bp, Homo sapiens
cagagaaggcctcttgtgctca

SEQ ID NO: 3949496 - DNA, 22 bp, Homo sapiens
cagagaatttctaccatttcag

SEQ ID NO: 3949497 - DNA, 16 bp, Homo sapiens
cagagacacctgcacc

SEQ ID NO: 3949498 - DNA, 17 bp, Homo sapiens
cagagacacctgcacct

SEQ ID NO: 3949499 - DNA, 20 bp, Homo sapiens
cagagacacctgcacctccc

SEQ ID NO: 3949500 - DNA, 13 bp, Homo sapiens
cagagacagaaac

SEQ ID NO: 3949501 - DNA, 19 bp, Homo sapiens
cagagacagaaacagagag

SEQ ID NO: 3949502 - DNA, 13 bp, Homo sapiens
cagagacaggaaa

SEQ ID NO: 3949503 - DNA, 15 bp, Homo sapiens
cagagacaggaaaat

SEQ ID NO: 3949504 - DNA, 21 bp, Homo sapiens
cagagacaggaaaatcctctg

SEQ ID NO: 3949505 - DNA, 17 bp, Homo sapiens
cagagacaggaaagaat

SEQ ID NO: 3949506 - DNA, 16 bp, Homo sapiens
cagagaccccaggatc

SEQ ID NO: 3949507 - DNA, 15 bp, Homo sapiens
cagagaccccttcct

SEQ ID NO: 3949508 - DNA, 10 bp, Homo sapiens
cagagacctt

SEQ ID NO: 3949509 - DNA, 15 bp, Homo sapiens
cagagacgcaaggga

SEQ ID NO: 3949510 - DNA, 22 bp, Homo sapiens
cagagactctggaagcccccca

SEQ ID NO: 3949511 - DNA, 19 bp, Homo sapiens
cagagacttggggaccaga

SEQ ID NO: 3949512 - DNA, 20 bp, Homo sapiens
cagagacttggggaccagag

SEQ ID NO: 3949513 - DNA, 14 bp, Homo sapiens
cagagagaagcctg

SEQ ID NO: 3949514 - DNA, 12 bp, Homo sapiens
cagagagagtgt

SEQ ID NO: 3949515 - DNA, 22 bp, Homo sapiens
cagagagggcccagctgtagcc

SEQ ID NO: 3949516 - DNA, 15 bp, Homo sapiens
cagagagtcctctgg

SEQ ID NO: 3949517 - DNA, 15 bp, Homo sapiens
cagagatctgggagg

SEQ ID NO: 3949518 - DNA, 15 bp, Homo sapiens
cagagatgcctccac

SEQ ID NO: 3949519 - DNA, 18 bp, Homo sapiens
cagagatgcctccaccgc

SEQ ID NO: 3949520 - DNA, 15 bp, Homo sapiens
cagagattgcttctc

SEQ ID NO: 3949521 - DNA, 16 bp, Homo sapiens
cagagcaaaataattt

SEQ ID NO: 3949522 - DNA, 22 bp, Homo sapiens
cagagcactaggttcaattccc

SEQ ID NO: 3949523 - DNA, 13 bp, Homo sapiens
cagagcagagagc

SEQ ID NO: 3949524 - DNA, 20 bp, Homo sapiens
cagagcaggccacgctcagg

SEQ ID NO: 3949525 - DNA, 21 bp, Homo sapiens
cagagcaggccacgctcaggc

SEQ ID NO: 3949526 - DNA, 22 bp, Homo sapiens
cagagcaggccacgctcaggcc

SEQ ID NO: 3949527 - DNA, 22 bp, Homo sapiens
cagagccacccctaaagagata

SEQ ID NO: 3949528 - DNA, 15 bp, Homo sapiens
cagagccagcctggg

SEQ ID NO: 3949529 - DNA, 16 bp, Homo sapiens
cagagccagcctggga

SEQ ID NO: 3949530 - DNA, 23 bp, Homo sapiens
cagagccagcctgggactcccag

SEQ ID NO: 3949531 - DNA, 18 bp, Homo sapiens
cagagccaggctctgcct

SEQ ID NO: 3949532 - DNA, 20 bp, Homo sapiens
cagagccaggctctgcctgg

SEQ ID NO: 3949533 - DNA, 15 bp, Homo sapiens
cacaccgatgcacac

SEQ ID NO: 3949534 - DNA, 17 bp, Homo sapiens
cacacctccctgaacca

SEQ ID NO: 3949535 - DNA, 21 bp, Homo sapiens
cacacctctggatccctggag

SEQ ID NO: 3949536 - DNA, 20 bp, Homo sapiens
cacacctgtaatcccagcac

SEQ ID NO: 3949537 - DNA, 21 bp, Homo sapiens
cacacgcaggaactcccagca

SEQ ID NO: 3949538 - DNA, 14 bp, Homo sapiens
cacacgccaatgca

SEQ ID NO: 3949539 - DNA, 18 bp, Homo sapiens
cacacggaggcatctgca

SEQ ID NO: 3949540 - DNA, 21 bp, Homo sapiens
cacacggaggcatctgcaccc

SEQ ID NO: 3949541 - DNA, 22 bp, Homo sapiens
cacacgtatttatatttggaaa

SEQ ID NO: 3949542 - DNA, 16 bp, Homo sapiens
cacacgtgctcgcagc

SEQ ID NO: 3949543 - DNA, 19 bp, Homo sapiens
cacacgtgctcgcagcctg

SEQ ID NO: 3949544 - DNA, 18 bp, Homo sapiens
cacactagcctctccagg

SEQ ID NO: 3949545 - DNA, 18 bp, Homo sapiens
cacactattaccatgaga

SEQ ID NO: 3949546 - DNA, 19 bp, Homo sapiens
cacactcaaatcaagaaac

SEQ ID NO: 3949547 - DNA, 12 bp, Homo sapiens
cacactcagcag

SEQ ID NO: 3949548 - DNA, 13 bp, Homo sapiens
cacactcagcagc

SEQ ID NO: 3949549 - DNA, 16 bp, Homo sapiens
cacactgcaagagcct

SEQ ID NO: 3949550 - DNA, 18 bp, Homo sapiens
cacactgcaagagccttg

SEQ ID NO: 3949551 - DNA, 21 bp, Homo sapiens
cacactgcaagagccttggtg

SEQ ID NO: 3949552 - DNA, 12 bp, Homo sapiens
cacactgtaaat

SEQ ID NO: 3949553 - DNA, 22 bp, Homo sapiens
cacactgtaaatatccacagac

SEQ ID NO: 3949554 - DNA, 12 bp, Homo sapiens
cacactgtcaga

SEQ ID NO: 3949555 - DNA, 22 bp, Homo sapiens
cacactgtcagagctgttggcc

SEQ ID NO: 3949556 - DNA, 17 bp, Homo sapiens
cacactttgagaacctg

SEQ ID NO: 3949557 - DNA, 19 bp, Homo sapiens
cacagaaatatatatacat

SEQ ID NO: 3949558 - DNA, 20 bp, Homo sapiens
cacagaaatatatatacata

SEQ ID NO: 3949559 - DNA, 23 bp, Homo sapiens
cacagaacactgggtagtagcta

SEQ ID NO: 3949560 - DNA, 14 bp, Homo sapiens
cacagaagccagga

SEQ ID NO: 3949561 - DNA, 16 bp, Homo sapiens
cacagaagccaggagc

SEQ ID NO: 3949562 - DNA, 20 bp, Homo sapiens
cacagacagatcccatccat

SEQ ID NO: 3949563 - DNA, 14 bp, Homo sapiens
cacagacccacaca

SEQ ID NO: 3949564 - DNA, 16 bp, Homo sapiens
cacagacccacacatg

SEQ ID NO: 3949565 - DNA, 12 bp, Homo sapiens
cacagactccct

SEQ ID NO: 3949566 - DNA, 13 bp, Homo sapiens
cacagactccctc

SEQ ID NO: 3949567 - DNA, 20 bp, Homo sapiens
cacagacttctggaaggctg

SEQ ID NO: 3949568 - DNA, 22 bp, Homo sapiens
cacagacttctggaaggctggc

SEQ ID NO: 3949569 - DNA, 13 bp, Homo sapiens
cacagagatgcat

SEQ ID NO: 3949570 - DNA, 21 bp, Homo sapiens
cacagagctgctattaaatta

SEQ ID NO: 3949571 - DNA, 21 bp, Homo sapiens
cacagagctggcgactgcagc

SEQ ID NO: 3949572 - DNA, 22 bp, Homo sapiens
cacagagctggcgactgcagct

SEQ ID NO: 3949573 - DNA, 17 bp, Homo sapiens
cacagaggaagagcagg

SEQ ID NO: 3949574 - DNA, 15 bp, Homo sapiens
cacagatacatgggg

SEQ ID NO: 3949575 - DNA, 22 bp, Homo sapiens
cacagatgcacacacagatgca

SEQ ID NO: 3949576 - DNA, 18 bp, Homo sapiens
cacagatggtcacacaga

SEQ ID NO: 3949577 - DNA, 18 bp, Homo sapiens
cacagatttttgggctcc

SEQ ID NO: 3949578 - DNA, 16 bp, Homo sapiens
cacagcacccaggctc

SEQ ID NO: 3949579 - DNA, 20 bp, Homo sapiens
cacagcacccaggctccatg

SEQ ID NO: 3949580 - DNA, 21 bp, Homo sapiens
cacagcacccaggctccatgg

SEQ ID NO: 3949581 - DNA, 22 bp, Homo sapiens
cacagcacccaggctccatggg

SEQ ID NO: 3949582 - DNA, 19 bp, Homo sapiens
cacagcagctgaacagcca

SEQ ID NO: 3949583 - DNA, 21 bp, Homo sapiens
cacagcagttctgcagaggac

SEQ ID NO: 3949584 - DNA, 21 bp, Homo sapiens
cacagcagttgaaaagactcc

SEQ ID NO: 3949585 - DNA, 22 bp, Homo sapiens
cacagcagttgaaaagactcca

SEQ ID NO: 3949586 - DNA, 14 bp, Homo sapiens
cacagccaaggact

SEQ ID NO: 3949587 - DNA, 17 bp, Homo sapiens
cacagccagactggcac

SEQ ID NO: 3949588 - DNA, 18 bp, Homo sapiens
cacagccagactggcaca

SEQ ID NO: 3949589 - DNA, 19 bp, Homo sapiens
cacagccccacagcaccca

SEQ ID NO: 3949590 - DNA, 14 bp, Homo sapiens
cacagccctgggag

SEQ ID NO: 3949591 - DNA, 18 bp, Homo sapiens
caccaaaaaaatacttga

SEQ ID NO: 3949592 - DNA, 21 bp, Homo sapiens
caccaaaaaaatacttgagct

SEQ ID NO: 3949593 - DNA, 16 bp, Homo sapiens
caccaaactgcacaca

SEQ ID NO: 3949594 - DNA, 21 bp, Homo sapiens
caccaaactgcacacacagct

SEQ ID NO: 3949595 - DNA, 17 bp, Homo sapiens
caccaacatcccattgc

SEQ ID NO: 3949596 - DNA, 23 bp, Homo sapiens
caccaacatcccattgccctggt

SEQ ID NO: 3949597 - DNA, 16 bp, Homo sapiens
caccaactctgcactc

SEQ ID NO: 3949598 - DNA, 20 bp, Homo sapiens
caccaagctcacagttcctc

SEQ ID NO: 3949599 - DNA, 15 bp, Homo sapiens
caccaagttctggaa

SEQ ID NO: 3949600 - DNA, 22 bp, Homo sapiens
caccaatgtacccaccgggcca

SEQ ID NO: 3949601 - DNA, 23 bp, Homo sapiens
caccacctaggccactcctccaa

SEQ ID NO: 3949602 - DNA, 23 bp, Homo sapiens
caccaccttggactcctcccaca

SEQ ID NO: 3949603 - DNA, 16 bp, Homo sapiens
caccacggcgtttttt

SEQ ID NO: 3949604 - DNA, 14 bp, Homo sapiens
caccacgtctgcca

SEQ ID NO: 3949605 - DNA, 13 bp, Homo sapiens
caccactagggtc

SEQ ID NO: 3949606 - DNA, 21 bp, Homo sapiens
caccactagggtcctggccct

SEQ ID NO: 3949607 - DNA, 23 bp, Homo sapiens
caccactagggtcctggccctct

SEQ ID NO: 3949608 - DNA, 16 bp, Homo sapiens
caccactccattccca

SEQ ID NO: 3949609 - DNA, 19 bp, Homo sapiens
caccactctggcagccaca

SEQ ID NO: 3949610 - DNA, 21 bp, Homo sapiens
caccactctggcagccacact

SEQ ID NO: 3949611 - DNA, 18 bp, Homo sapiens
caccactgccctgcctgc

SEQ ID NO: 3949612 - DNA, 22 bp, Homo sapiens
caccactgccctgcctgcccac

SEQ ID NO: 3949613 - DNA, 16 bp, Homo sapiens
caccacttcttttata

SEQ ID NO: 3949614 - DNA, 22 bp, Homo sapiens
caccactttgtctctgagaaca

SEQ ID NO: 3949615 - DNA, 20 bp, Homo sapiens
caccagaggctgcagaaggc

SEQ ID NO: 3949616 - DNA, 14 bp, Homo sapiens
caccagcaacatct

SEQ ID NO: 3949617 - DNA, 21 bp, Homo sapiens
caccagcctggtgcccatcct

SEQ ID NO: 3949618 - DNA, 19 bp, Homo sapiens
caccagctctgtggcctgt

SEQ ID NO: 3949619 - DNA, 22 bp, Homo sapiens
caccagctctgtggcctgtgtc

SEQ ID NO: 3949620 - DNA, 12 bp, Homo sapiens
caccagctgctc

SEQ ID NO: 3949621 - DNA, 14 bp, Homo sapiens
caccagctgctctg

SEQ ID NO: 3949622 - DNA, 16 bp, Homo sapiens
caccagctgctctgcc

SEQ ID NO: 3949623 - DNA, 17 bp, Homo sapiens
caccagctgctctgccc

SEQ ID NO: 3949624 - DNA, 18 bp, Homo sapiens
caccagctgctctgcccc

SEQ ID NO: 3949625 - DNA, 19 bp, Homo sapiens
caccagcttctccaggctc

SEQ ID NO: 3949626 - DNA, 17 bp, Homo sapiens
caccaggaatgttaaag

SEQ ID NO: 3949627 - DNA, 19 bp, Homo sapiens
caccaggatgaaggcgtgc

SEQ ID NO: 3949628 - DNA, 13 bp, Homo sapiens
caccaggatggcc

SEQ ID NO: 3949629 - DNA, 15 bp, Homo sapiens
caccaggatggccct

SEQ ID NO: 3949630 - DNA, 19 bp, Homo sapiens
caccaggcacgaacccacc

SEQ ID NO: 3949631 - DNA, 19 bp, Homo sapiens
caccagggtccgcaccagc

SEQ ID NO: 3949632 - DNA, 20 bp, Homo sapiens
caccagggtccgcaccagct

SEQ ID NO: 3949633 - DNA, 22 bp, Homo sapiens
caccagggtccgcaccagctgc

SEQ ID NO: 3949634 - DNA, 15 bp, Homo sapiens
caccagtcactgtcc

SEQ ID NO: 3949635 - DNA, 13 bp, Homo sapiens
caccagtgtcccc

SEQ ID NO: 3949636 - DNA, 14 bp, Homo sapiens
caccagtgtcccct

SEQ ID NO: 3949637 - DNA, 18 bp, Homo sapiens
caccagtgtcccctccac

SEQ ID NO: 3949638 - DNA, 15 bp, Homo sapiens
caccatcacacatgc

SEQ ID NO: 3949639 - DNA, 19 bp, Homo sapiens
caccatcaccctctgggca

SEQ ID NO: 3949640 - DNA, 20 bp, Homo sapiens
caccatcctgcagcctcctc

SEQ ID NO: 3949641 - DNA, 12 bp, Homo sapiens
caccatctgctt

SEQ ID NO: 3949642 - DNA, 13 bp, Homo sapiens
caccatctgcttg

SEQ ID NO: 3949643 - DNA, 11 bp, Homo sapiens
caccatgaaac

SEQ ID NO: 3949644 - DNA, 21 bp, Homo sapiens
caccatgccaggctaattttt

SEQ ID NO: 3949645 - DNA, 16 bp, Homo sapiens
caccatgtaacaacca

SEQ ID NO: 3949646 - DNA, 23 bp, Homo sapiens
caccattcacatttgatgtacat

SEQ ID NO: 3949647 - DNA, 18 bp, Homo sapiens
cacccaaagcatggacta

SEQ ID NO: 3949648 - DNA, 16 bp, Homo sapiens
cacccaagcaaggcca

SEQ ID NO: 3949649 - DNA, 15 bp, Homo sapiens
cacccactcaccagg

SEQ ID NO: 3949650 - DNA, 18 bp, Homo sapiens
cacccactcaccagggtc

SEQ ID NO: 3949651 - DNA, 12 bp, Homo sapiens
cacccactggcc

SEQ ID NO: 3949652 - DNA, 23 bp, Homo sapiens
cacccactggccagtcctagagc

SEQ ID NO: 3949653 - DNA, 14 bp, Homo sapiens
cacccactgtccgc

SEQ ID NO: 3949654 - DNA, 17 bp, Homo sapiens
cacccagcaacacagag

SEQ ID NO: 3949655 - DNA, 23 bp, Homo sapiens
cacccagcccattctctctcctg

SEQ ID NO: 3949656 - DNA, 11 bp, Homo sapiens
cacccaggctc

SEQ ID NO: 3949657 - DNA, 12 bp, Homo sapiens
cacccaggctgc

SEQ ID NO: 3949658 - DNA, 21 bp, Homo sapiens
cacccaggctgcactgcagtg

SEQ ID NO: 3949659 - DNA, 16 bp, Homo sapiens
cacccagggctccctc

SEQ ID NO: 3949660 - DNA, 17 bp, Homo sapiens
cacccagtctgttcccc

SEQ ID NO: 3949661 - DNA, 17 bp, Homo sapiens
cacccagtgctgccatg

SEQ ID NO: 3949662 - DNA, 23 bp, Homo sapiens
cacccagtgctgccatgccactg

SEQ ID NO: 3949663 - DNA, 20 bp, Homo sapiens
cacccatcttcctgctgctg

SEQ ID NO: 3949664 - DNA, 21 bp, Homo sapiens
cacccatcttcctgctgctgt

SEQ ID NO: 3949665 - DNA, 22 bp, Homo sapiens
cacccattcccccatgtggctg

SEQ ID NO: 3949666 - DNA, 15 bp, Homo sapiens
cacccattttcacat

SEQ ID NO: 3949667 - DNA, 13 bp, Homo sapiens
caccccactccag

SEQ ID NO: 3949668 - DNA, 18 bp, Homo sapiens
caccccactccagccctg

SEQ ID NO: 3949669 - DNA, 12 bp, Homo sapiens
caccccagcgcc

SEQ ID NO: 3949670 - DNA, 17 bp, Homo sapiens
cacccccagcctgggcc

SEQ ID NO: 3949671 - DNA, 12 bp, Homo sapiens
cacccccagctt

SEQ ID NO: 3949672 - DNA, 15 bp, Homo sapiens
caccccccaagctgt

SEQ ID NO: 3949673 - DNA, 11 bp, Homo sapiens
caccccctcat

SEQ ID NO: 3949674 - DNA, 13 bp, Homo sapiens
caccccctccagc

SEQ ID NO: 3949675 - DNA, 18 bp, Homo sapiens
caccccctccccagggga

SEQ ID NO: 3949676 - DNA, 14 bp, Homo sapiens
caccccctgcagct

SEQ ID NO: 3949677 - DNA, 17 bp, Homo sapiens
caccccctgcagcttgt

SEQ ID NO: 3949678 - DNA, 16 bp, Homo sapiens
cacccccttcagtgcc

SEQ ID NO: 3949679 - DNA, 21 bp, Homo sapiens
cacccccttcagtgcccacca

SEQ ID NO: 3949680 - DNA, 18 bp, Homo sapiens
caccccggcctccactcc

SEQ ID NO: 3949681 - DNA, 15 bp, Homo sapiens
caccccgtgccaccc

SEQ ID NO: 3949682 - DNA, 15 bp, Homo sapiens
cacccctaaagagat

SEQ ID NO: 3949683 - DNA, 17 bp, Homo sapiens
cacccctcactctggcc

SEQ ID NO: 3949684 - DNA, 15 bp, Homo sapiens
cacccctccaaagcc

SEQ ID NO: 3949685 - DNA, 13 bp, Homo sapiens
cacccctgcactt

SEQ ID NO: 3949686 - DNA, 18 bp, Homo sapiens
caccccttatccaggact

SEQ ID NO: 3949687 - DNA, 22 bp, Homo sapiens
caccccttcctgtcccacctct

SEQ ID NO: 3949688 - DNA, 15 bp, Homo sapiens
cacccgactcctcaa

SEQ ID NO: 3949689 - DNA, 17 bp, Homo sapiens
cacccgcttcctgtttc

SEQ ID NO: 3949690 - DNA, 16 bp, Homo sapiens
cacccgtaggcagcct

SEQ ID NO: 3949691 - DNA, 17 bp, Homo sapiens
cacccgtaggcagcctc

SEQ ID NO: 3949692 - DNA, 19 bp, Homo sapiens
cacccgttctgctggcctg

SEQ ID NO: 3949693 - DNA, 20 bp, Homo sapiens
cacccgttctgctggcctgg

SEQ ID NO: 3949694 - DNA, 17 bp, Homo sapiens
caccctatccctgtaca

SEQ ID NO: 3949695 - DNA, 18 bp, Homo sapiens
caccctcaaaccctgtgg

SEQ ID NO: 3949696 - DNA, 21 bp, Homo sapiens
caccctcaaatgtcagagcta

SEQ ID NO: 3949697 - DNA, 17 bp, Homo sapiens
caccctccacctcttca

SEQ ID NO: 3949698 - DNA, 20 bp, Homo sapiens
caccctcgtggacacctgcc

SEQ ID NO: 3949699 - DNA, 15 bp, Homo sapiens
caccctctcctgggg

SEQ ID NO: 3949700 - DNA, 14 bp, Homo sapiens
caccctctgggcag

SEQ ID NO: 3949701 - DNA, 18 bp, Homo sapiens
caccctgaggagtctgag

SEQ ID NO: 3949702 - DNA, 19 bp, Homo sapiens
caccctgaggcctctggaa

SEQ ID NO: 3949703 - DNA, 18 bp, Homo sapiens
ataagtggaaaaaagaga

SEQ ID NO: 3949704 - DNA, 22 bp, Homo sapiens
ataagtggaaaaaagagaaaaa

SEQ ID NO: 3949705 - DNA, 17 bp, Homo sapiens
ataagtgggagctaaat

SEQ ID NO: 3949706 - DNA, 21 bp, Homo sapiens
ataagtgtgtggtcccaagtt

SEQ ID NO: 3949707 - DNA, 13 bp, Homo sapiens
ataataaagccag

SEQ ID NO: 3949708 - DNA, 14 bp, Homo sapiens
ataataatgttctc

SEQ ID NO: 3949709 - DNA, 21 bp, Homo sapiens
ataatacactaattcctttct

SEQ ID NO: 3949710 - DNA, 17 bp, Homo sapiens
ataatactaaagtgtct

SEQ ID NO: 3949711 - DNA, 13 bp, Homo sapiens
ataatagaagaac

SEQ ID NO: 3949712 - DNA, 16 bp, Homo sapiens
ataatagacacatcaa

SEQ ID NO: 3949713 - DNA, 22 bp, Homo sapiens
ataataggatataaaacacatc

SEQ ID NO: 3949714 - DNA, 18 bp, Homo sapiens
ataatataccaatgcttt

SEQ ID NO: 3949715 - DNA, 17 bp, Homo sapiens
ataatcagcctcttaaa

SEQ ID NO: 3949716 - DNA, 20 bp, Homo sapiens
ataatcagcgccctggagtc

SEQ ID NO: 3949717 - DNA, 18 bp, Homo sapiens
ataatcatctctgtcaca

SEQ ID NO: 3949718 - DNA, 21 bp, Homo sapiens
ataatcattctttcccctcag

SEQ ID NO: 3949719 - DNA, 15 bp, Homo sapiens
ataatctatttacat

SEQ ID NO: 3949720 - DNA, 18 bp, Homo sapiens
ataatctggactcctctg

SEQ ID NO: 3949721 - DNA, 20 bp, Homo sapiens
ataatctggactcctctgtc

SEQ ID NO: 3949722 - DNA, 22 bp, Homo sapiens
ataatctggactcctctgtcca

SEQ ID NO: 3949723 - DNA, 20 bp, Homo sapiens
ataatgctcccatctcctga

SEQ ID NO: 3949724 - DNA, 18 bp, Homo sapiens
ataatggttgactgggtt

SEQ ID NO: 3949725 - DNA, 23 bp, Homo sapiens
ataatgtggatttcctattttaa

SEQ ID NO: 3949726 - DNA, 18 bp, Homo sapiens
ataatgtgtgtatgtgta

SEQ ID NO: 3949727 - DNA, 11 bp, Homo sapiens
ataatgttctt

SEQ ID NO: 3949728 - DNA, 16 bp, Homo sapiens
ataatgttctttaatg

SEQ ID NO: 3949729 - DNA, 13 bp, Homo sapiens
ataattaggatct

SEQ ID NO: 3949730 - DNA, 16 bp, Homo sapiens
ataattaggatctatg

SEQ ID NO: 3949731 - DNA, 22 bp, Homo sapiens
ataattcttccagtgcaacaaa

SEQ ID NO: 3949732 - DNA, 15 bp, Homo sapiens
ataattgatcaaatt

SEQ ID NO: 3949733 - DNA, 21 bp, Homo sapiens
ataattgttgattaatttgag

SEQ ID NO: 3949734 - DNA, 12 bp, Homo sapiens
ataatttaacta

SEQ ID NO: 3949735 - DNA, 16 bp, Homo sapiens
ataatttaactaattt

SEQ ID NO: 3949736 - DNA, 19 bp, Homo sapiens
ataatttaactaatttaaa

SEQ ID NO: 3949737 - DNA, 20 bp, Homo sapiens
ataatttaactaatttaaac

SEQ ID NO: 3949738 - DNA, 23 bp, Homo sapiens
ataatttaactaatttaaaccag

SEQ ID NO: 3949739 - DNA, 19 bp, Homo sapiens
ataatttgtacatatgtaa

SEQ ID NO: 3949740 - DNA, 21 bp, Homo sapiens
ataattttcaagagaagaaaa

SEQ ID NO: 3949741 - DNA, 15 bp, Homo sapiens
ataattttttattca

SEQ ID NO: 3949742 - DNA, 18 bp, Homo sapiens
atacaaaataaaattatg

SEQ ID NO: 3949743 - DNA, 16 bp, Homo sapiens
atacaaaataatttaa

SEQ ID NO: 3949744 - DNA, 16 bp, Homo sapiens
atacaaacaagcacag

SEQ ID NO: 3949745 - DNA, 17 bp, Homo sapiens
atacaacaagaacaaca

SEQ ID NO: 3949746 - DNA, 14 bp, Homo sapiens
atacaataacataa

SEQ ID NO: 3949747 - DNA, 13 bp, Homo sapiens
atacaatatataa

SEQ ID NO: 3949748 - DNA, 19 bp, Homo sapiens
atacaatatataaaaatat

SEQ ID NO: 3949749 - DNA, 20 bp, Homo sapiens
atacaatatataaaaatata

SEQ ID NO: 3949750 - DNA, 13 bp, Homo sapiens
atacaatttgcac

SEQ ID NO: 3949751 - DNA, 15 bp, Homo sapiens
atacacaagtaaaca

SEQ ID NO: 3949752 - DNA, 11 bp, Homo sapiens
atacacacata

SEQ ID NO: 3949753 - DNA, 14 bp, Homo sapiens
atacacacatatac

SEQ ID NO: 3949754 - DNA, 18 bp, Homo sapiens
atacacactcaaatcaag

SEQ ID NO: 3949755 - DNA, 20 bp, Homo sapiens
atacacactcaaatcaagaa

SEQ ID NO: 3949756 - DNA, 16 bp, Homo sapiens
atacacagatgattaa

SEQ ID NO: 3949757 - DNA, 15 bp, Homo sapiens
atacacatacataca

SEQ ID NO: 3949758 - DNA, 21 bp, Homo sapiens
atacacatatacctataatgt

SEQ ID NO: 3949759 - DNA, 20 bp, Homo sapiens
atacaccacctcactcctgt

SEQ ID NO: 3949760 - DNA, 15 bp, Homo sapiens
atacacttgtataaa

SEQ ID NO: 3949761 - DNA, 12 bp, Homo sapiens
atacagacacta

SEQ ID NO: 3949762 - DNA, 19 bp, Homo sapiens
atacagacactaagttata

SEQ ID NO: 3949763 - DNA, 18 bp, Homo sapiens
atacagaggtaactatca

SEQ ID NO: 3949764 - DNA, 21 bp, Homo sapiens
atacagccccaaaccagggtg

SEQ ID NO: 3949765 - DNA, 22 bp, Homo sapiens
atacagccccaaaccagggtgc

SEQ ID NO: 3949766 - DNA, 23 bp, Homo sapiens
atacagccccaaaccagggtgca

SEQ ID NO: 3949767 - DNA, 14 bp, Homo sapiens
atacatacacatac

SEQ ID NO: 3949768 - DNA, 22 bp, Homo sapiens
atacatacacttgtataaatgt

SEQ ID NO: 3949769 - DNA, 11 bp, Homo sapiens
atacatacata

SEQ ID NO: 3949770 - DNA, 15 bp, Homo sapiens
atacatacatacata

SEQ ID NO: 3949771 - DNA, 17 bp, Homo sapiens
atacatacatacataca

SEQ ID NO: 3949772 - DNA, 18 bp, Homo sapiens
atacatacatacatacat

SEQ ID NO: 3949773 - DNA, 12 bp, Homo sapiens
atacatacatat

SEQ ID NO: 3949774 - DNA, 14 bp, Homo sapiens
atacatacatatat

SEQ ID NO: 3949775 - DNA, 14 bp, Homo sapiens
atacatagtcacaa

SEQ ID NO: 3949776 - DNA, 11 bp, Homo sapiens
atacatatata

SEQ ID NO: 3949777 - DNA, 24 bp, Homo sapiens
atacatatatatatacacatacat

SEQ ID NO: 3949778 - DNA, 15 bp, Homo sapiens
atacatatatatctg

SEQ ID NO: 3949779 - DNA, 20 bp, Homo sapiens
atacatatatatctgataaa

SEQ ID NO: 3949780 - DNA, 21 bp, Homo sapiens
atacatatgtagactatatac

SEQ ID NO: 3949781 - DNA, 16 bp, Homo sapiens
atacatattataaata

SEQ ID NO: 3949782 - DNA, 15 bp, Homo sapiens
atacatgctgctaat

SEQ ID NO: 3949783 - DNA, 21 bp, Homo sapiens
atacatgtactccagagggac

SEQ ID NO: 3949784 - DNA, 20 bp, Homo sapiens
atacatgtgtgtatatatgt

SEQ ID NO: 3949785 - DNA, 22 bp, Homo sapiens
atacattccctatcaaaacata

SEQ ID NO: 3949786 - DNA, 18 bp, Homo sapiens
atacattttgttatagaa

SEQ ID NO: 3949787 - DNA, 24 bp, Homo sapiens
ataccaaatagcttctgttttgtt

SEQ ID NO: 3949788 - DNA, 12 bp, Homo sapiens
ataccagagacc

SEQ ID NO: 3949789 - DNA, 18 bp, Homo sapiens
atataaatgcatgatttt

SEQ ID NO: 3949790 - DNA, 23 bp, Homo sapiens
atataaatggctggtttttagaa

SEQ ID NO: 3949791 - DNA, 16 bp, Homo sapiens
atataaattaagactt

SEQ ID NO: 3949792 - DNA, 17 bp, Homo sapiens
atataaattaagacttt

SEQ ID NO: 3949793 - DNA, 18 bp, Homo sapiens
atataactttagaaataa

SEQ ID NO: 3949794 - DNA, 16 bp, Homo sapiens
atataaggaggaaaac

SEQ ID NO: 3949795 - DNA, 14 bp, Homo sapiens
atataatactaaag

SEQ ID NO: 3949796 - DNA, 19 bp, Homo sapiens
atataatactaaagtgtct

SEQ ID NO: 3949797 - DNA, 22 bp, Homo sapiens
atataatactaaagtgtctatt

SEQ ID NO: 3949798 - DNA, 14 bp, Homo sapiens
atataatgaacacg

SEQ ID NO: 3949799 - DNA, 14 bp, Homo sapiens
atatacaaaagcaa

SEQ ID NO: 3949800 - DNA, 14 bp, Homo sapiens
atatacaaataaac

SEQ ID NO: 3949801 - DNA, 16 bp, Homo sapiens
atatacaataacataa

SEQ ID NO: 3949802 - DNA, 14 bp, Homo sapiens
atatacacatacat

SEQ ID NO: 3949803 - DNA, 15 bp, Homo sapiens
atatacacatacata

SEQ ID NO: 3949804 - DNA, 15 bp, Homo sapiens
atatacatatatata

SEQ ID NO: 3949805 - DNA, 22 bp, Homo sapiens
caaggactgcagggactgccag

SEQ ID NO: 3949806 - DNA, 16 bp, Homo sapiens
caaggagatataaaat

SEQ ID NO: 3949807 - DNA, 20 bp, Homo sapiens
caaggagctgatttccaggc

SEQ ID NO: 3949808 - DNA, 21 bp, Homo sapiens
caaggagctgatttccaggcc

SEQ ID NO: 3949809 - DNA, 18 bp, Homo sapiens
caaggagtatgcagggag

SEQ ID NO: 3949810 - DNA, 23 bp, Homo sapiens
caaggagttccatgaagaccaca

SEQ ID NO: 3949811 - DNA, 14 bp, Homo sapiens
caaggcacttgtca

SEQ ID NO: 3949812 - DNA, 15 bp, Homo sapiens
caaggcagcaaggcc

SEQ ID NO: 3949813 - DNA, 12 bp, Homo sapiens
caaggcagcctc

SEQ ID NO: 3949814 - DNA, 14 bp, Homo sapiens
caaggcagcctcca

SEQ ID NO: 3949815 - DNA, 16 bp, Homo sapiens
caaggcagcctccaga

SEQ ID NO: 3949816 - DNA, 23 bp, Homo sapiens
caaggcaggtagatcgcttgagc

SEQ ID NO: 3949817 - DNA, 13 bp, Homo sapiens
caaggcccagcta

SEQ ID NO: 3949818 - DNA, 18 bp, Homo sapiens
caaggcccgagcagctga

SEQ ID NO: 3949819 - DNA, 23 bp, Homo sapiens
caaggctgaccaagagagaaaga

SEQ ID NO: 3949820 - DNA, 15 bp, Homo sapiens
caagggcatcaggca

SEQ ID NO: 3949821 - DNA, 17 bp, Homo sapiens
caagggcatcaggcact

SEQ ID NO: 3949822 - DNA, 14 bp, Homo sapiens
caagggctccagca

SEQ ID NO: 3949823 - DNA, 20 bp, Homo sapiens
caagggctccagcatccagc

SEQ ID NO: 3949824 - DNA, 15 bp, Homo sapiens
caaggggacttgtgc

SEQ ID NO: 3949825 - DNA, 18 bp, Homo sapiens
caaggggacttgtgccag

SEQ ID NO: 3949826 - DNA, 17 bp, Homo sapiens
caaggggagggccagga

SEQ ID NO: 3949827 - DNA, 20 bp, Homo sapiens
caaggggctcagcaaggtgt

SEQ ID NO: 3949828 - DNA, 22 bp, Homo sapiens
caagggggtgtcatctgaggag

SEQ ID NO: 3949829 - DNA, 18 bp, Homo sapiens
caagggtatgggaagcca

SEQ ID NO: 3949830 - DNA, 17 bp, Homo sapiens
caagggtctagggagag

SEQ ID NO: 3949831 - DNA, 13 bp, Homo sapiens
caaggtctgcttt

SEQ ID NO: 3949832 - DNA, 21 bp, Homo sapiens
caaggtgggtggatcacctga

SEQ ID NO: 3949833 - DNA, 12 bp, Homo sapiens
caaggtgtcttt

SEQ ID NO: 3949834 - DNA, 13 bp, Homo sapiens
caagtaaacattc

SEQ ID NO: 3949835 - DNA, 20 bp, Homo sapiens
caagtacatggctagctttt

SEQ ID NO: 3949836 - DNA, 19 bp, Homo sapiens
caagtatgaataaagacac

SEQ ID NO: 3949837 - DNA, 23 bp, Homo sapiens
caagtattaggggtaatatattg

SEQ ID NO: 3949838 - DNA, 17 bp, Homo sapiens
caagtcaacactcttct

SEQ ID NO: 3949839 - DNA, 18 bp, Homo sapiens
caagtcacagctgcagct

SEQ ID NO: 3949840 - DNA, 12 bp, Homo sapiens
caagtccagagc

SEQ ID NO: 3949841 - DNA, 13 bp, Homo sapiens
caagtccagagcc

SEQ ID NO: 3949842 - DNA, 14 bp, Homo sapiens
caagtccagagccg

SEQ ID NO: 3949843 - DNA, 15 bp, Homo sapiens
caagtccaggtcctg

SEQ ID NO: 3949844 - DNA, 24 bp, Homo sapiens
caagtccaggtcctggtggggcag

SEQ ID NO: 3949845 - DNA, 17 bp, Homo sapiens
caagtcctgtgaatttc

SEQ ID NO: 3949846 - DNA, 12 bp, Homo sapiens
caagtctagaaa

SEQ ID NO: 3949847 - DNA, 13 bp, Homo sapiens
caagtctggatct

SEQ ID NO: 3949848 - DNA, 16 bp, Homo sapiens
caagtgagagagcaag

SEQ ID NO: 3949849 - DNA, 16 bp, Homo sapiens
caagtgatatatgtat

SEQ ID NO: 3949850 - DNA, 17 bp, Homo sapiens
caagtgatatatgtatt

SEQ ID NO: 3949851 - DNA, 17 bp, Homo sapiens
caagtgcatgctctctg

SEQ ID NO: 3949852 - DNA, 13 bp, Homo sapiens
caagtgccatccc

SEQ ID NO: 3949853 - DNA, 14 bp, Homo sapiens
caagtgccatccca

SEQ ID NO: 3949854 - DNA, 16 bp, Homo sapiens
caagtgccatcccaca

SEQ ID NO: 3949855 - DNA, 18 bp, Homo sapiens
caagtgccatcccacatt

SEQ ID NO: 3949856 - DNA, 16 bp, Homo sapiens
caagtgcctcttgttg

SEQ ID NO: 3949857 - DNA, 15 bp, Homo sapiens
caagtgctatgccaa

SEQ ID NO: 3949858 - DNA, 13 bp, Homo sapiens
caagtgggggcag

SEQ ID NO: 3949859 - DNA, 18 bp, Homo sapiens
caagtgtatatcagaaaa

SEQ ID NO: 3949860 - DNA, 17 bp, Homo sapiens
caagttatattgaatat

SEQ ID NO: 3949861 - DNA, 12 bp, Homo sapiens
caagttattgta

SEQ ID NO: 3949862 - DNA, 12 bp, Homo sapiens
caagttcaatct

SEQ ID NO: 3949863 - DNA, 17 bp, Homo sapiens
caagttcagggaagcag

SEQ ID NO: 3949864 - DNA, 21 bp, Homo sapiens
caagttcagggaagcaggcag

SEQ ID NO: 3949865 - DNA, 15 bp, Homo sapiens
caagttccagctggt

SEQ ID NO: 3949866 - DNA, 23 bp, Homo sapiens
caatgtatgtgaaagtgtaaaat

SEQ ID NO: 3949867 - DNA, 21 bp, Homo sapiens
caatgtggttgcaaggccgct

SEQ ID NO: 3949868 - DNA, 21 bp, Homo sapiens
caatgtttatttcataaagaa

SEQ ID NO: 3949869 - DNA, 16 bp, Homo sapiens
caatgtttcttttatc

SEQ ID NO: 3949870 - DNA, 13 bp, Homo sapiens
caattaaaatata

SEQ ID NO: 3949871 - DNA, 14 bp, Homo sapiens
caattaaaatatat

SEQ ID NO: 3949872 - DNA, 17 bp, Homo sapiens
caattaaaatatatata

SEQ ID NO: 3949873 - DNA, 20 bp, Homo sapiens
caattaaaatatatataaat

SEQ ID NO: 3949874 - DNA, 15 bp, Homo sapiens
caattaataaaaaat

SEQ ID NO: 3949875 - DNA, 18 bp, Homo sapiens
caattaataaaaaatgga

SEQ ID NO: 3949876 - DNA, 21 bp, Homo sapiens
caattaattgtccctgtttca

SEQ ID NO: 3949877 - DNA, 16 bp, Homo sapiens
caattagggcctagcc

SEQ ID NO: 3949878 - DNA, 15 bp, Homo sapiens
caattagtacagtag

SEQ ID NO: 3949879 - DNA, 17 bp, Homo sapiens
caattatgcactggcca

SEQ ID NO: 3949880 - DNA, 18 bp, Homo sapiens
caattattgtacactaac

SEQ ID NO: 3949881 - DNA, 22 bp, Homo sapiens
caattcaacacattacttgcac

SEQ ID NO: 3949882 - DNA, 20 bp, Homo sapiens
caattcaggactggctcacc

SEQ ID NO: 3949883 - DNA, 22 bp, Homo sapiens
caattcatttcactttaaagtc

SEQ ID NO: 3949884 - DNA, 15 bp, Homo sapiens
caattccaaaggaat

SEQ ID NO: 3949885 - DNA, 14 bp, Homo sapiens
caattccatcaccc

SEQ ID NO: 3949886 - DNA, 19 bp, Homo sapiens
caattgactgtcactgttc

SEQ ID NO: 3949887 - DNA, 22 bp, Homo sapiens
caattgctttgtcatatagctg

SEQ ID NO: 3949888 - DNA, 12 bp, Homo sapiens
caattgtatttt

SEQ ID NO: 3949889 - DNA, 15 bp, Homo sapiens
caattgtattttata

SEQ ID NO: 3949890 - DNA, 20 bp, Homo sapiens
caatttaaaatcattcaata

SEQ ID NO: 3949891 - DNA, 14 bp, Homo sapiens
caatttattaaaat

SEQ ID NO: 3949892 - DNA, 17 bp, Homo sapiens
caatttcaaattactct

SEQ ID NO: 3949893 - DNA, 17 bp, Homo sapiens
caatttcccagaaggga

SEQ ID NO: 3949894 - DNA, 19 bp, Homo sapiens
caatttcctttatatttag

SEQ ID NO: 3949895 - DNA, 19 bp, Homo sapiens
caatttgagcaattcattt

SEQ ID NO: 3949896 - DNA, 21 bp, Homo sapiens
caatttgagcaattcatttca

SEQ ID NO: 3949897 - DNA, 14 bp, Homo sapiens
caatttgtatatca

SEQ ID NO: 3949898 - DNA, 17 bp, Homo sapiens
caattttaatgctattt

SEQ ID NO: 3949899 - DNA, 23 bp, Homo sapiens
caattttcaggtttcttaaaaac

SEQ ID NO: 3949900 - DNA, 20 bp, Homo sapiens
caattttctggaatacatga

SEQ ID NO: 3949901 - DNA, 12 bp, Homo sapiens
caattttgtaac

SEQ ID NO: 3949902 - DNA, 13 bp, Homo sapiens
caatttttataca

SEQ ID NO: 3949903 - DNA, 14 bp, Homo sapiens
caatttttatacat

SEQ ID NO: 3949904 - DNA, 15 bp, Homo sapiens
caatttttatacata

SEQ ID NO: 3949905 - DNA, 23 bp, Homo sapiens
caatttttatacatatcagaaaa

SEQ ID NO: 3949906 - DNA, 17 bp, Homo sapiens
cacaaaatgataatcaa

SEQ ID NO: 3949907 - DNA, 12 bp, Homo sapiens
cacaaaatgcaa

SEQ ID NO: 3949908 - DNA, 13 bp, Homo sapiens
cacaaacacctcc

SEQ ID NO: 3949909 - DNA, 19 bp, Homo sapiens
cacaaaccacaactgacac

SEQ ID NO: 3949910 - DNA, 20 bp, Homo sapiens
cacaaaccacaactgacaca

SEQ ID NO: 3949911 - DNA, 15 bp, Homo sapiens
cacaaaccatgcaaa

SEQ ID NO: 3949912 - DNA, 16 bp, Homo sapiens
cacaaactttaaattc

SEQ ID NO: 3949913 - DNA, 18 bp, Homo sapiens
cacaaagagaaaaagaaa

SEQ ID NO: 3949914 - DNA, 18 bp, Homo sapiens
cacaaagcccttccatgt

SEQ ID NO: 3949915 - DNA, 21 bp, Homo sapiens
cacaaaggggagaagggccag

SEQ ID NO: 3949916 - DNA, 11 bp, Homo sapiens
cacaacagatt

SEQ ID NO: 3949917 - DNA, 17 bp, Homo sapiens
cacaaccttctgtggct

SEQ ID NO: 3949918 - DNA, 23 bp, Homo sapiens
cacaaccttctgtggctcacaga

SEQ ID NO: 3949919 - DNA, 11 bp, Homo sapiens
cacaactagga

SEQ ID NO: 3949920 - DNA, 15 bp, Homo sapiens
cacaactgacacagg

SEQ ID NO: 3949921 - DNA, 17 bp, Homo sapiens
cacaactgacacaggaa

SEQ ID NO: 3949922 - DNA, 19 bp, Homo sapiens
cacaagaagaccagactgt

SEQ ID NO: 3949923 - DNA, 14 bp, Homo sapiens
cacaagattcccag

SEQ ID NO: 3949924 - DNA, 18 bp, Homo sapiens
cacaagattcccagagac

SEQ ID NO: 3949925 - DNA, 21 bp, Homo sapiens
cacaagcaataattaggatct

SEQ ID NO: 3949926 - DNA, 17 bp, Homo sapiens
cacaagccacagaagcc

SEQ ID NO: 3949927 - DNA, 16 bp, Homo sapiens
cacaagctggaagcac

SEQ ID NO: 3949928 - DNA, 13 bp, Homo sapiens
cacaagcttgtat

SEQ ID NO: 3949929 - DNA, 22 bp, Homo sapiens
cacaagcttgtatatacatatt

SEQ ID NO: 3949930 - DNA, 11 bp, Homo sapiens
cacaaggcagc

SEQ ID NO: 3949931 - DNA, 14 bp, Homo sapiens
cacaaggcagcaag

SEQ ID NO: 3949932 - DNA, 15 bp, Homo sapiens
cacaaggcagcaagg

SEQ ID NO: 3949933 - DNA, 17 bp, Homo sapiens
cacaaggcagcaaggcc

SEQ ID NO: 3949934 - DNA, 22 bp, Homo sapiens
cacaaggcagcaaggcccgagc

SEQ ID NO: 3949935 - DNA, 18 bp, Homo sapiens
cacaaggctgaccaagag

SEQ ID NO: 3949936 - DNA, 13 bp, Homo sapiens
cacaagtaaacat

SEQ ID NO: 3949937 - DNA, 16 bp, Homo sapiens
cacaagtcctgtgaat

SEQ ID NO: 3949938 - DNA, 20 bp, Homo sapiens
cacaagtcctgtgaatttct

SEQ ID NO: 3949939 - DNA, 18 bp, Homo sapiens
cacaatctgggactttca

SEQ ID NO: 3949940 - DNA, 18 bp, Homo sapiens
cacaatctttccttgtct

SEQ ID NO: 3949941 - DNA, 16 bp, Homo sapiens
cacaatgcctctccca

SEQ ID NO: 3949942 - DNA, 20 bp, Homo sapiens
cacaatggctaattcccaga

SEQ ID NO: 3949943 - DNA, 19 bp, Homo sapiens
cacaattgatacttcaggt

SEQ ID NO: 3949944 - DNA, 23 bp, Homo sapiens
cacaattgatacttcaggtgctt

SEQ ID NO: 3949945 - DNA, 21 bp, Homo sapiens
cacaatttagaaaacattcat

SEQ ID NO: 3949946 - DNA, 15 bp, Homo sapiens
cacacaaacacctcc

SEQ ID NO: 3949947 - DNA, 18 bp, Homo sapiens
cacacaaaggtataattt

SEQ ID NO: 3949948 - DNA, 14 bp, Homo sapiens
cacacaaggctggg

SEQ ID NO: 3949949 - DNA, 15 bp, Homo sapiens
cacacacacacacac

SEQ ID NO: 3949950 - DNA, 13 bp, Homo sapiens
cacacacagagat

SEQ ID NO: 3949951 - DNA, 14 bp, Homo sapiens
cacacacagaggaa

SEQ ID NO: 3949952 - DNA, 23 bp, Homo sapiens
cacacacagaggaagagcaggca

SEQ ID NO: 3949953 - DNA, 15 bp, Homo sapiens
attcccaccaaggtc

SEQ ID NO: 3949954 - DNA, 19 bp, Homo sapiens
attcccagagcaaaataat

SEQ ID NO: 3949955 - DNA, 14 bp, Homo sapiens
attcccagctgtct

SEQ ID NO: 3949956 - DNA, 15 bp, Homo sapiens
attccctatcaaaac

SEQ ID NO: 3949957 - DNA, 17 bp, Homo sapiens
attccctatcaaaacat

SEQ ID NO: 3949958 - DNA, 19 bp, Homo sapiens
attccctgagtcaccagga

SEQ ID NO: 3949959 - DNA, 18 bp, Homo sapiens
attcctacaaagatgttt

SEQ ID NO: 3949960 - DNA, 15 bp, Homo sapiens
attcctagagagcag

SEQ ID NO: 3949961 - DNA, 21 bp, Homo sapiens
attcctagagagcagaaataa

SEQ ID NO: 3949962 - DNA, 17 bp, Homo sapiens
attcctcagctgccaag

SEQ ID NO: 3949963 - DNA, 18 bp, Homo sapiens
attcctcttgcctctctc

SEQ ID NO: 3949964 - DNA, 14 bp, Homo sapiens
attcctgaagccag

SEQ ID NO: 3949965 - DNA, 21 bp, Homo sapiens
attcctgaccctccctacctg

SEQ ID NO: 3949966 - DNA, 18 bp, Homo sapiens
attcctgcatttgtgaaa

SEQ ID NO: 3949967 - DNA, 13 bp, Homo sapiens
attcctgggcctg

SEQ ID NO: 3949968 - DNA, 15 bp, Homo sapiens
attcctgggcctgtc

SEQ ID NO: 3949969 - DNA, 16 bp, Homo sapiens
attcctgtagcatctt

SEQ ID NO: 3949970 - DNA, 18 bp, Homo sapiens
attcctgtagcatcttct

SEQ ID NO: 3949971 - DNA, 11 bp, Homo sapiens
attccttccca

SEQ ID NO: 3949972 - DNA, 18 bp, Homo sapiens
attccttcccactcatgt

SEQ ID NO: 3949973 - DNA, 16 bp, Homo sapiens
attccttgtcaccagc

SEQ ID NO: 3949974 - DNA, 20 bp, Homo sapiens
attccttttgatggggagaa

SEQ ID NO: 3949975 - DNA, 19 bp, Homo sapiens
attcgaggtgtcaccctgc

SEQ ID NO: 3949976 - DNA, 22 bp, Homo sapiens
attcgaggtgtcaccctgcaga

SEQ ID NO: 3949977 - DNA, 21 bp, Homo sapiens
attcggaccctgcccataccc

SEQ ID NO: 3949978 - DNA, 17 bp, Homo sapiens
attctaaagctttctga

SEQ ID NO: 3949979 - DNA, 15 bp, Homo sapiens
attctaaatgctggt

SEQ ID NO: 3949980 - DNA, 16 bp, Homo sapiens
attctagccaaactat

SEQ ID NO: 3949981 - DNA, 13 bp, Homo sapiens
attctaggcatcc

SEQ ID NO: 3949982 - DNA, 15 bp, Homo sapiens
attctatgagaacaa

SEQ ID NO: 3949983 - DNA, 14 bp, Homo sapiens
attctattcaaaag

SEQ ID NO: 3949984 - DNA, 13 bp, Homo sapiens
attctcaccagga

SEQ ID NO: 3949985 - DNA, 14 bp, Homo sapiens
attctcaccaggaa

SEQ ID NO: 3949986 - DNA, 17 bp, Homo sapiens
attctcactccaccacc

SEQ ID NO: 3949987 - DNA, 19 bp, Homo sapiens
attctcatatgtagccctc

SEQ ID NO: 3949988 - DNA, 23 bp, Homo sapiens
attctcatgtctcagcctcctca

SEQ ID NO: 3949989 - DNA, 15 bp, Homo sapiens
attctcatgtgatcc

SEQ ID NO: 3949990 - DNA, 12 bp, Homo sapiens
attctcctcctc

SEQ ID NO: 3949991 - DNA, 14 bp, Homo sapiens
attctcctgtgcta

SEQ ID NO: 3949992 - DNA, 17 bp, Homo sapiens
attctcgggaaattatt

SEQ ID NO: 3949993 - DNA, 16 bp, Homo sapiens
attctctctcctgtcc

SEQ ID NO: 3949994 - DNA, 13 bp, Homo sapiens
attctcttaccca

SEQ ID NO: 3949995 - DNA, 20 bp, Homo sapiens
attctctttctttttctgtc

SEQ ID NO: 3949996 - DNA, 20 bp, Homo sapiens
attctgatttttttgttgtt

SEQ ID NO: 3949997 - DNA, 20 bp, Homo sapiens
attctgcttctagtattttt

SEQ ID NO: 3949998 - DNA, 18 bp, Homo sapiens
attctggaaaaaaaatat

SEQ ID NO: 3949999 - DNA, 21 bp, Homo sapiens
attctggaaaaaaaatatata

SEQ ID NO: 3950000 - DNA, 23 bp, Homo sapiens
attctggaaaaaaaatatatata

SEQ ID NO: 3950001 - DNA, 10 bp, Homo sapiens
attctgggat

SEQ ID NO: 3950002 - DNA, 14 bp, Homo sapiens
attctgtgaagaat

SEQ ID NO: 3950003 - DNA, 17 bp, Homo sapiens
attctgtggtgggaaca

SEQ ID NO: 3950004 - DNA, 20 bp, Homo sapiens
attcttaagatttctcctga

SEQ ID NO: 3950005 - DNA, 20 bp, Homo sapiens
attcttaccgagaaaaggag

SEQ ID NO: 3950006 - DNA, 14 bp, Homo sapiens
attcttatgcttat

SEQ ID NO: 3950007 - DNA, 19 bp, Homo sapiens
attcttccagtgcaacaaa

SEQ ID NO: 3950008 - DNA, 12 bp, Homo sapiens
attcttcctagt

SEQ ID NO: 3950009 - DNA, 19 bp, Homo sapiens
attcttcctagttttctcc

SEQ ID NO: 3950010 - DNA, 17 bp, Homo sapiens
attctttatcttgacat

SEQ ID NO: 3950011 - DNA, 15 bp, Homo sapiens
attgaaaatatattt

SEQ ID NO: 3950012 - DNA, 14 bp, Homo sapiens
attgaacagcaaag

SEQ ID NO: 3950013 - DNA, 14 bp, Homo sapiens
attgaacccaggag

SEQ ID NO: 3950014 - DNA, 12 bp, Homo sapiens
attgaacctggt

SEQ ID NO: 3950015 - DNA, 20 bp, Homo sapiens
attgttttatggtgtgttcc

SEQ ID NO: 3950016 - DNA, 13 bp, Homo sapiens
atttaaaaaataa

SEQ ID NO: 3950017 - DNA, 23 bp, Homo sapiens
atttaaaaaataaaaaaatacag

SEQ ID NO: 3950018 - DNA, 15 bp, Homo sapiens
atttaaaaaataact

SEQ ID NO: 3950019 - DNA, 18 bp, Homo sapiens
atttaaaccagcagaaaa

SEQ ID NO: 3950020 - DNA, 19 bp, Homo sapiens
atttaaaccagcagaaaag

SEQ ID NO: 3950021 - DNA, 20 bp, Homo sapiens
atttaaaccagcagaaaagt

SEQ ID NO: 3950022 - DNA, 18 bp, Homo sapiens
atttaaactgttctgtgt

SEQ ID NO: 3950023 - DNA, 18 bp, Homo sapiens
atttaaatgttgaaatct

SEQ ID NO: 3950024 - DNA, 19 bp, Homo sapiens
atttaaatgttgaaatctt

SEQ ID NO: 3950025 - DNA, 22 bp, Homo sapiens
atttaaatgttgaaatcttaaa

SEQ ID NO: 3950026 - DNA, 16 bp, Homo sapiens
atttaacagtcattta

SEQ ID NO: 3950027 - DNA, 18 bp, Homo sapiens
atttaacagtcatttaaa

SEQ ID NO: 3950028 - DNA, 13 bp, Homo sapiens
atttaacatgcaa

SEQ ID NO: 3950029 - DNA, 14 bp, Homo sapiens
atttaactaattta

SEQ ID NO: 3950030 - DNA, 19 bp, Homo sapiens
atttaactaatttaaacca

SEQ ID NO: 3950031 - DNA, 13 bp, Homo sapiens
atttaactgcctt

SEQ ID NO: 3950032 - DNA, 17 bp, Homo sapiens
atttaagaataaagtct

SEQ ID NO: 3950033 - DNA, 17 bp, Homo sapiens
atttaagcctcatattt

SEQ ID NO: 3950034 - DNA, 17 bp, Homo sapiens
atttaagccttttgtgt

SEQ ID NO: 3950035 - DNA, 13 bp, Homo sapiens
atttaagtatata

SEQ ID NO: 3950036 - DNA, 21 bp, Homo sapiens
atttaagtatatagtatattt

SEQ ID NO: 3950037 - DNA, 23 bp, Homo sapiens
atttaagtatatagtatatttat

SEQ ID NO: 3950038 - DNA, 22 bp, Homo sapiens
atttaagtttgttgctgtcaag

SEQ ID NO: 3950039 - DNA, 13 bp, Homo sapiens
atttaatatttat

SEQ ID NO: 3950040 - DNA, 19 bp, Homo sapiens
atttaatggccaaatggtt

SEQ ID NO: 3950041 - DNA, 15 bp, Homo sapiens
atttaatgtttgatt

SEQ ID NO: 3950042 - DNA, 16 bp, Homo sapiens
atttaatgttttctgc

SEQ ID NO: 3950043 - DNA, 17 bp, Homo sapiens
atttaatttttacatga

SEQ ID NO: 3950044 - DNA, 16 bp, Homo sapiens
atttacagagaagtga

SEQ ID NO: 3950045 - DNA, 18 bp, Homo sapiens
atttaccacagcagctga

SEQ ID NO: 3950046 - DNA, 21 bp, Homo sapiens
atttaccacagcagctgaaca

SEQ ID NO: 3950047 - DNA, 15 bp, Homo sapiens
atttactaagccaca

SEQ ID NO: 3950048 - DNA, 15 bp, Homo sapiens
atttactacttttgc

SEQ ID NO: 3950049 - DNA, 20 bp, Homo sapiens
atttagcacccttctgctgt

SEQ ID NO: 3950050 - DNA, 13 bp, Homo sapiens
atttaggcaagag

SEQ ID NO: 3950051 - DNA, 17 bp, Homo sapiens
atttaggcaagagaaaa

SEQ ID NO: 3950052 - DNA, 17 bp, Homo sapiens
atttagggaagcaggga

SEQ ID NO: 3950053 - DNA, 23 bp, Homo sapiens
atttaggtttttgtttgtttcct

SEQ ID NO: 3950054 - DNA, 20 bp, Homo sapiens
atttagtgaaagctagagat

SEQ ID NO: 3950055 - DNA, 18 bp, Homo sapiens
atttataaactagatctc

SEQ ID NO: 3950056 - DNA, 19 bp, Homo sapiens
atttataaactagatctcc

SEQ ID NO: 3950057 - DNA, 14 bp, Homo sapiens
atttataaatgtgt

SEQ ID NO: 3950058 - DNA, 22 bp, Homo sapiens
atttataagcagatttaacaat

SEQ ID NO: 3950059 - DNA, 15 bp, Homo sapiens
atttatacaaaataa

SEQ ID NO: 3950060 - DNA, 23 bp, Homo sapiens
atttatactctagaacatgcaca

SEQ ID NO: 3950061 - DNA, 12 bp, Homo sapiens
atttatagtttg

SEQ ID NO: 3950062 - DNA, 18 bp, Homo sapiens
atttatatatcagttata

SEQ ID NO: 3950063 - DNA, 18 bp, Homo sapiens
atttatatgttaatttgt

SEQ ID NO: 3950064 - DNA, 17 bp, Homo sapiens
atttatattgtatattc

SEQ ID NO: 3950065 - DNA, 20 bp, Homo sapiens
atttatattgtatattctgg

SEQ ID NO: 3950066 - DNA, 16 bp, Homo sapiens
atttatatttgaaatt

SEQ ID NO: 3950067 - DNA, 18 bp, Homo sapiens
atttatcaaacttgtgct

SEQ ID NO: 3950068 - DNA, 17 bp, Homo sapiens
atttatcaccagcatat

SEQ ID NO: 3950069 - DNA, 19 bp, Homo sapiens
atttatcctgaaatttcag

SEQ ID NO: 3950070 - DNA, 14 bp, Homo sapiens
atttatctctattt

SEQ ID NO: 3950071 - DNA, 19 bp, Homo sapiens
atttatctctatttaatat

SEQ ID NO: 3950072 - DNA, 22 bp, Homo sapiens
atttatctctatttaatattta

SEQ ID NO: 3950073 - DNA, 20 bp, Homo sapiens
atttatctgtattttttaca

SEQ ID NO: 3950074 - DNA, 16 bp, Homo sapiens
atttatctgtgcaaat

SEQ ID NO: 3950075 - DNA, 19 bp, Homo sapiens
atttatgcttaaaatatgt

SEQ ID NO: 3950076 - DNA, 21 bp, Homo sapiens
atttatgcttaaaatatgtat

SEQ ID NO: 3950077 - DNA, 12 bp, Homo sapiens
atttatggctta

SEQ ID NO: 3950078 - DNA, 16 bp, Homo sapiens
atttatggtttctgcg

SEQ ID NO: 3950079 - DNA, 19 bp, Homo sapiens
atttattaaaatgattgta

SEQ ID NO: 3950080 - DNA, 23 bp, Homo sapiens
atttattaaaatgattgtaaaat

SEQ ID NO: 3950081 - DNA, 15 bp, Homo sapiens
atttattagctgtaa

SEQ ID NO: 3950082 - DNA, 16 bp, Homo sapiens
atttattagttaatat

SEQ ID NO: 3950083 - DNA, 12 bp, Homo sapiens
atttattattga

SEQ ID NO: 3950084 - DNA, 23 bp, Homo sapiens
atttattttaacaaaagaagatt

SEQ ID NO: 3950085 - DNA, 15 bp, Homo sapiens
atttattttgtttaa

SEQ ID NO: 3950086 - DNA, 14 bp, Homo sapiens
atttcaaaagacat

SEQ ID NO: 3950087 - DNA, 16 bp, Homo sapiens
atttcaaaagacatgt

SEQ ID NO: 3950088 - DNA, 21 bp, Homo sapiens
atttcaaaagacatgttgtaa

SEQ ID NO: 3950089 - DNA, 21 bp, Homo sapiens
atttcaaaatggacgtactgg

SEQ ID NO: 3950090 - DNA, 14 bp, Homo sapiens
atttcaactccaga

SEQ ID NO: 3950091 - DNA, 19 bp, Homo sapiens
atttcaagaaaaaataaat

SEQ ID NO: 3950092 - DNA, 22 bp, Homo sapiens
atttcaagaaaaaataaatgga

SEQ ID NO: 3950093 - DNA, 13 bp, Homo sapiens
atttcacaacaga

SEQ ID NO: 3950094 - DNA, 20 bp, Homo sapiens
atttcacatcagctttagga

SEQ ID NO: 3950095 - DNA, 16 bp, Homo sapiens
atttcacattaatggt

SEQ ID NO: 3950096 - DNA, 16 bp, Homo sapiens
atttcagagaggcctt

SEQ ID NO: 3950097 - DNA, 13 bp, Homo sapiens
atttcagttactt

SEQ ID NO: 3950098 - DNA, 21 bp, Homo sapiens
atttcataaggcctgccctcc

SEQ ID NO: 3950099 - DNA, 20 bp, Homo sapiens
atttcatacctatcatctta

SEQ ID NO: 3950100 - DNA, 23 bp, Homo sapiens
atttcatccagtttgttctccgg

SEQ ID NO: 3950101 - DNA, 18 bp, Homo sapiens
atttcatgctatctctgt

SEQ ID NO: 3950102 - DNA, 23 bp, Homo sapiens
atttcattttgtaacaaatgaac

SEQ ID NO: 3950103 - DNA, 16 bp, Homo sapiens
atttcattttttgcat

SEQ ID NO: 3950104 - DNA, 13 bp, Homo sapiens
atttccaaataaa

SEQ ID NO: 3950105 - DNA, 14 bp, Homo sapiens
atttccaggcccct

SEQ ID NO: 3950106 - DNA, 18 bp, Homo sapiens
atttccaggcccctgagg

SEQ ID NO: 3950107 - DNA, 19 bp, Homo sapiens
atttccaggcccctgagga

SEQ ID NO: 3950108 - DNA, 15 bp, Homo sapiens
atttcccagaaggga

SEQ ID NO: 3950109 - DNA, 15 bp, Homo sapiens
atttcctacagaaat

SEQ ID NO: 3950110 - DNA, 22 bp, Homo sapiens
atttcctacagaaatactgctc

SEQ ID NO: 3950111 - DNA, 21 bp, Homo sapiens
atttcctattttaaaaccatg

SEQ ID NO: 3950112 - DNA, 19 bp, Homo sapiens
atttccttttttgttatta

SEQ ID NO: 3950113 - DNA, 14 bp, Homo sapiens
atttctagcagagt

SEQ ID NO: 3950114 - DNA, 13 bp, Homo sapiens
atttctcctactt

SEQ ID NO: 3950115 - DNA, 23 bp, Homo sapiens
atttctgagtttcattctcctgc

SEQ ID NO: 3950116 - DNA, 21 bp, Homo sapiens
atttctgtcattcaaatgggt

SEQ ID NO: 3950117 - DNA, 11 bp, Homo sapiens
atttcttatag

SEQ ID NO: 3950118 - DNA, 14 bp, Homo sapiens
atttcttatgattt

SEQ ID NO: 3950119 - DNA, 16 bp, Homo sapiens
atttcttcgctgctct

SEQ ID NO: 3950120 - DNA, 22 bp, Homo sapiens
atttcttttaaagaagtaaatt

SEQ ID NO: 3950121 - DNA, 17 bp, Homo sapiens
atttgaatatcattaaa

SEQ ID NO: 3950122 - DNA, 21 bp, Homo sapiens
atttgaatggtgcagaaaaaa

SEQ ID NO: 3950123 - DNA, 20 bp, Homo sapiens
atttgacccactcacacttg

SEQ ID NO: 3950124 - DNA, 14 bp, Homo sapiens
atttgagagaagcc

SEQ ID NO: 3950125 - DNA, 15 bp, Homo sapiens
atttgagagaagcca

SEQ ID NO: 3950126 - DNA, 17 bp, Homo sapiens
atttgagcaattcattt

SEQ ID NO: 3950127 - DNA, 22 bp, Homo sapiens
atttgagcatgcacagctgctt

SEQ ID NO: 3950128 - DNA, 19 bp, Homo sapiens
atttgaggagcagcttcag

SEQ ID NO: 3950129 - DNA, 18 bp, Homo sapiens
atttgagtgattatttgt

SEQ ID NO: 3950130 - DNA, 15 bp, Homo sapiens
atttgatacaaaatg

SEQ ID NO: 3950131 - DNA, 19 bp, Homo sapiens
atttgattgtaaaaacaaa

SEQ ID NO: 3950132 - DNA, 13 bp, Homo sapiens
atttgatttctat

SEQ ID NO: 3950133 - DNA, 17 bp, Homo sapiens
atttgatttctattcaa

SEQ ID NO: 3950134 - DNA, 16 bp, Homo sapiens
atttgccattcctgga

SEQ ID NO: 3950135 - DNA, 17 bp, Homo sapiens
atttgcctaattcctgg

SEQ ID NO: 3950136 - DNA, 13 bp, Homo sapiens
atttgctggggaa

SEQ ID NO: 3950137 - DNA, 16 bp, Homo sapiens
atttgggccaaggtgt

SEQ ID NO: 3950138 - DNA, 14 bp, Homo sapiens
atttggtctctatt

SEQ ID NO: 3950139 - DNA, 21 bp, Homo sapiens
atttggtgcacttttctgtgt

SEQ ID NO: 3950140 - DNA, 21 bp, Homo sapiens
atttggtgtggctgtattcag

SEQ ID NO: 3950141 - DNA, 19 bp, Homo sapiens
atttgtacatatgtaaaat

SEQ ID NO: 3950142 - DNA, 14 bp, Homo sapiens
atttgtatctgaag

SEQ ID NO: 3950143 - DNA, 17 bp, Homo sapiens
atttgtatctgaaggag

SEQ ID NO: 3950144 - DNA, 20 bp, Homo sapiens
atttgtcctctttacatgaa

SEQ ID NO: 3950145 - DNA, 15 bp, Homo sapiens
atttgtctttcagga

SEQ ID NO: 3950146 - DNA, 13 bp, Homo sapiens
atttgtgtatgtg

SEQ ID NO: 3950147 - DNA, 19 bp, Homo sapiens
atttgttatttgtacagtt

SEQ ID NO: 3950148 - DNA, 14 bp, Homo sapiens
atttgttggaatga

SEQ ID NO: 3950149 - DNA, 21 bp, Homo sapiens
atttgttgtgactggcaccca

SEQ ID NO: 3950150 - DNA, 21 bp, Homo sapiens
atttgttttgacggatgattg

SEQ ID NO: 3950151 - DNA, 19 bp, Homo sapiens
attttaaaaaatgaaaata

SEQ ID NO: 3950152 - DNA, 19 bp, Homo sapiens
attttaaaaagatttgttt

SEQ ID NO: 3950153 - DNA, 13 bp, Homo sapiens
attttaaaaccat

SEQ ID NO: 3950154 - DNA, 14 bp, Homo sapiens
attttaaaaccatg

SEQ ID NO: 3950155 - DNA, 15 bp, Homo sapiens
attttaaaaccatgc

SEQ ID NO: 3950156 - DNA, 16 bp, Homo sapiens
attttaaaaccatgca

SEQ ID NO: 3950157 - DNA, 21 bp, Homo sapiens
attttaaaagcaattatattg

SEQ ID NO: 3950158 - DNA, 19 bp, Homo sapiens
attttaaaagccacataga

SEQ ID NO: 3950159 - DNA, 22 bp, Homo sapiens
attttaaacaaaggttgagatg

SEQ ID NO: 3950160 - DNA, 16 bp, Homo sapiens
attttaaagtggttct

SEQ ID NO: 3950161 - DNA, 11 bp, Homo sapiens
attttaaatgt

SEQ ID NO: 3950162 - DNA, 16 bp, Homo sapiens
attttaaatgttttac

SEQ ID NO: 3950163 - DNA, 13 bp, Homo sapiens
attttaacaaaag

SEQ ID NO: 3950164 - DNA, 15 bp, Homo sapiens
attttaactgtgtga

SEQ ID NO: 3950165 - DNA, 16 bp, Homo sapiens
attttaacttaaattt

SEQ ID NO: 3950166 - DNA, 17 bp, Homo sapiens
attttaagacgtgaatg

SEQ ID NO: 3950167 - DNA, 23 bp, Homo sapiens
attttaagacgtgaatgtctcag

SEQ ID NO: 3950168 - DNA, 18 bp, Homo sapiens
attttaagcttgaagatt

SEQ ID NO: 3950169 - DNA, 19 bp, Homo sapiens
attttaatttatatttgaa

SEQ ID NO: 3950170 - DNA, 19 bp, Homo sapiens
attttaatttgatacaaaa

SEQ ID NO: 3950171 - DNA, 12 bp, Homo sapiens
attttacagaga

SEQ ID NO: 3950172 - DNA, 14 bp, Homo sapiens
attttacagagaat

SEQ ID NO: 3950173 - DNA, 19 bp, Homo sapiens
attttacagagaatctgaa

SEQ ID NO: 3950174 - DNA, 16 bp, Homo sapiens
attttaggagacagtc

SEQ ID NO: 3950175 - DNA, 23 bp, Homo sapiens
attttaggcctcctctctgccac

SEQ ID NO: 3950176 - DNA, 18 bp, Homo sapiens
attttagtgactgtaatt

SEQ ID NO: 3950177 - DNA, 19 bp, Homo sapiens
attttataagcaaatttca

SEQ ID NO: 3950178 - DNA, 12 bp, Homo sapiens
attttataattt

SEQ ID NO: 3950179 - DNA, 20 bp, Homo sapiens
attttatacatagtcacaaa

SEQ ID NO: 3950180 - DNA, 21 bp, Homo sapiens
attttatctgtgttgtctctc

SEQ ID NO: 3950181 - DNA, 16 bp, Homo sapiens
attttattaaagcaac

SEQ ID NO: 3950182 - DNA, 16 bp, Homo sapiens
attttatttagttctt

SEQ ID NO: 3950183 - DNA, 20 bp, Homo sapiens
attttatttattagctgtaa

SEQ ID NO: 3950184 - DNA, 13 bp, Homo sapiens
attttatttgtat

SEQ ID NO: 3950185 - DNA, 14 bp, Homo sapiens
attttcaagaaact

SEQ ID NO: 3950186 - DNA, 17 bp, Homo sapiens
attttcaagaaactgag

SEQ ID NO: 3950187 - DNA, 22 bp, Homo sapiens
attttcaagaaactgaggaatt

SEQ ID NO: 3950188 - DNA, 23 bp, Homo sapiens
attttcaagaaactgaggaattt

SEQ ID NO: 3950189 - DNA, 20 bp, Homo sapiens
attttcaagagaagaaaaaa

SEQ ID NO: 3950190 - DNA, 17 bp, Homo sapiens
attttcaatgcacatta

SEQ ID NO: 3950191 - DNA, 14 bp, Homo sapiens
attttcatcaattt

SEQ ID NO: 3950192 - DNA, 19 bp, Homo sapiens
attttcatgacttttccat

SEQ ID NO: 3950193 - DNA, 15 bp, Homo sapiens
attttcattacaatg

SEQ ID NO: 3950194 - DNA, 16 bp, Homo sapiens
attttcattacaatgg

SEQ ID NO: 3950195 - DNA, 16 bp, Homo sapiens
attttcattttaattt

SEQ ID NO: 3950196 - DNA, 19 bp, Homo sapiens
attttcattttaatttata

SEQ ID NO: 3950197 - DNA, 17 bp, Homo sapiens
attttcccctgaagact

SEQ ID NO: 3950198 - DNA, 21 bp, Homo sapiens
attttcctgaatattaatccc

SEQ ID NO: 3950199 - DNA, 23 bp, Homo sapiens
attttctacctgtgttcattctt

SEQ ID NO: 3950200 - DNA, 16 bp, Homo sapiens
attttctagactttct

SEQ ID NO: 3950201 - DNA, 18 bp, Homo sapiens
attttctagactttctgt

SEQ ID NO: 3950202 - DNA, 18 bp, Homo sapiens
attttctggaatacatga

SEQ ID NO: 3950203 - DNA, 19 bp, Homo sapiens
attttctggaatacatgaa

SEQ ID NO: 3950204 - DNA, 22 bp, Homo sapiens
attttctggaatacatgaaata

SEQ ID NO: 3950205 - DNA, 15 bp, Homo sapiens
attttcttgcctgag

SEQ ID NO: 3950206 - DNA, 17 bp, Homo sapiens
attttcttgcctgaggc

SEQ ID NO: 3950207 - DNA, 18 bp, Homo sapiens
attttcttgcctgaggct

SEQ ID NO: 3950208 - DNA, 21 bp, Homo sapiens
attttctttctttttctggaa

SEQ ID NO: 3950209 - DNA, 16 bp, Homo sapiens
attttcttttgtaaat

SEQ ID NO: 3950210 - DNA, 17 bp, Homo sapiens
attttcttttgtaaatg

SEQ ID NO: 3950211 - DNA, 14 bp, Homo sapiens
attttgaatgttta

SEQ ID NO: 3950212 - DNA, 20 bp, Homo sapiens
attttgaatgtttatgttct

SEQ ID NO: 3950213 - DNA, 12 bp, Homo sapiens
attttgcacaaa

SEQ ID NO: 3950214 - DNA, 12 bp, Homo sapiens
attttgcattta

SEQ ID NO: 3950215 - DNA, 18 bp, Homo sapiens
attttgcctcttttctct

SEQ ID NO: 3950216 - DNA, 21 bp, Homo sapiens
attttgcctcttttctctgtg

SEQ ID NO: 3950217 - DNA, 22 bp, Homo sapiens
attttgggggtttttaatcttt

SEQ ID NO: 3950218 - DNA, 10 bp, Homo sapiens
attttgtaaa

SEQ ID NO: 3950219 - DNA, 10 bp, Homo sapiens
attttgtaca

SEQ ID NO: 3950220 - DNA, 16 bp, Homo sapiens
attttgtacagaattt

SEQ ID NO: 3950221 - DNA, 14 bp, Homo sapiens
attttgtatatatc

SEQ ID NO: 3950222 - DNA, 20 bp, Homo sapiens
attttgtattacatctaatg

SEQ ID NO: 3950223 - DNA, 16 bp, Homo sapiens
attttgtattttcaac

SEQ ID NO: 3950224 - DNA, 22 bp, Homo sapiens
attttgtctcctacctgctgct

SEQ ID NO: 3950225 - DNA, 22 bp, Homo sapiens
attttgttatagaatacttttt

SEQ ID NO: 3950226 - DNA, 19 bp, Homo sapiens
attttgttgctgttttgat

SEQ ID NO: 3950227 - DNA, 13 bp, Homo sapiens
attttgttgtgat

SEQ ID NO: 3950228 - DNA, 16 bp, Homo sapiens
attttgtttgtaatcc

SEQ ID NO: 3950229 - DNA, 17 bp, Homo sapiens
attttgtttgtaatcct

SEQ ID NO: 3950230 - DNA, 14 bp, Homo sapiens
atttttaaactagt

SEQ ID NO: 3950231 - DNA, 14 bp, Homo sapiens
atttttaaattata

SEQ ID NO: 3950232 - DNA, 15 bp, Homo sapiens
atttttaatgacttt

SEQ ID NO: 3950233 - DNA, 18 bp, Homo sapiens
atttttaatgacttttta

SEQ ID NO: 3950234 - DNA, 16 bp, Homo sapiens
atttttagtaaagaca

SEQ ID NO: 3950235 - DNA, 15 bp, Homo sapiens
atttttatacatatc

SEQ ID NO: 3950236 - DNA, 16 bp, Homo sapiens
atttttatacatatca

SEQ ID NO: 3950237 - DNA, 17 bp, Homo sapiens
atttttatacatatcag

SEQ ID NO: 3950238 - DNA, 20 bp, Homo sapiens
atttttatatcagcctgagt

SEQ ID NO: 3950239 - DNA, 12 bp, Homo sapiens
atttttatccat

SEQ ID NO: 3950240 - DNA, 16 bp, Homo sapiens
atttttatttttctaa

SEQ ID NO: 3950241 - DNA, 15 bp, Homo sapiens
atttttcaaccagca

SEQ ID NO: 3950242 - DNA, 20 bp, Homo sapiens
atttttcagctctctgtata

SEQ ID NO: 3950243 - DNA, 15 bp, Homo sapiens
atttttcttatttca

SEQ ID NO: 3950244 - DNA, 19 bp, Homo sapiens
atttttgaggaattatcat

SEQ ID NO: 3950245 - DNA, 19 bp, Homo sapiens
atttttggttgtcaatatt

SEQ ID NO: 3950246 - DNA, 13 bp, Homo sapiens
atttttgtaataa

SEQ ID NO: 3950247 - DNA, 18 bp, Homo sapiens
atttttgtaataaaaggt

SEQ ID NO: 3950248 - DNA, 20 bp, Homo sapiens
atttttgtacccttcctaca

SEQ ID NO: 3950249 - DNA, 22 bp, Homo sapiens
atttttgtacgttatatattgt

SEQ ID NO: 3950250 - DNA, 13 bp, Homo sapiens
atttttgtccctg

SEQ ID NO: 3950251 - DNA, 16 bp, Homo sapiens
atttttgtccctgctc

SEQ ID NO: 3950252 - DNA, 17 bp, Homo sapiens
atttttgtccctgctcc

SEQ ID NO: 3950253 - DNA, 21 bp, Homo sapiens
atttttgttttcattatctca

SEQ ID NO: 3950254 - DNA, 17 bp, Homo sapiens
attttttaaaagaaatt

SEQ ID NO: 3950255 - DNA, 12 bp, Homo sapiens
attttttaaagc

SEQ ID NO: 3950256 - DNA, 12 bp, Homo sapiens
attttttattgt

SEQ ID NO: 3950257 - DNA, 14 bp, Homo sapiens
attttttctacaca

SEQ ID NO: 3950258 - DNA, 18 bp, Homo sapiens
atttttttaagctgtaaa

SEQ ID NO: 3950259 - DNA, 14 bp, Homo sapiens
atttttttatacta

SEQ ID NO: 3950260 - DNA, 21 bp, Homo sapiens
atttttttcactggagttaca

SEQ ID NO: 3950261 - DNA, 18 bp, Homo sapiens
caaaaaaaaaccatgcat

SEQ ID NO: 3950262 - DNA, 13 bp, Homo sapiens
caaaaaaacacta

SEQ ID NO: 3950263 - DNA, 16 bp, Homo sapiens
caaaaaaacactagtt

SEQ ID NO: 3950264 - DNA, 15 bp, Homo sapiens
caaaaaagtattttt

SEQ ID NO: 3950265 - DNA, 12 bp, Homo sapiens
caaaaacaaaac

SEQ ID NO: 3950266 - DNA, 15 bp, Homo sapiens
caaaaacaaaacaaa

SEQ ID NO: 3950267 - DNA, 15 bp, Homo sapiens
caaaaaccagcaggt

SEQ ID NO: 3950268 - DNA, 21 bp, Homo sapiens
caaaaacccagcaacagaaaa

SEQ ID NO: 3950269 - DNA, 18 bp, Homo sapiens
caaaaagacagtgtgtgt

SEQ ID NO: 3950270 - DNA, 18 bp, Homo sapiens
caaaaaggaccaactggc

SEQ ID NO: 3950271 - DNA, 22 bp, Homo sapiens
caaaaaggaccaactggcttct

SEQ ID NO: 3950272 - DNA, 16 bp, Homo sapiens
caaaaataaactagtt

SEQ ID NO: 3950273 - DNA, 19 bp, Homo sapiens
caaaaataaactagtttcc

SEQ ID NO: 3950274 - DNA, 23 bp, Homo sapiens
caaaaataaactagtttccagtg

SEQ ID NO: 3950275 - DNA, 16 bp, Homo sapiens
caaaggggagaagggc

SEQ ID NO: 3950276 - DNA, 22 bp, Homo sapiens
caaaggggagaagggccagccc

SEQ ID NO: 3950277 - DNA, 15 bp, Homo sapiens
caaaggggctgctgg

SEQ ID NO: 3950278 - DNA, 13 bp, Homo sapiens
caaaggtcttttt

SEQ ID NO: 3950279 - DNA, 13 bp, Homo sapiens
caaaggtggctct

SEQ ID NO: 3950280 - DNA, 21 bp, Homo sapiens
caaagtaaaaaattaaagccc

SEQ ID NO: 3950281 - DNA, 21 bp, Homo sapiens
caaagtaaaacttgctgcctg

SEQ ID NO: 3950282 - DNA, 23 bp, Homo sapiens
caaagtattaatgtacagagtgg

SEQ ID NO: 3950283 - DNA, 16 bp, Homo sapiens
caaagtctaaagttta

SEQ ID NO: 3950284 - DNA, 19 bp, Homo sapiens
caaagtctaaagtttacag

SEQ ID NO: 3950285 - DNA, 19 bp, Homo sapiens
caaagtgcaaatactccaa

SEQ ID NO: 3950286 - DNA, 19 bp, Homo sapiens
caaagtgcagcccttcctc

SEQ ID NO: 3950287 - DNA, 23 bp, Homo sapiens
caaagtgcagcccttcctcctga

SEQ ID NO: 3950288 - DNA, 16 bp, Homo sapiens
caaagtgccactcatt

SEQ ID NO: 3950289 - DNA, 14 bp, Homo sapiens
caaagtgccctcat

SEQ ID NO: 3950290 - DNA, 21 bp, Homo sapiens
caaagtgttttctcagaacag

SEQ ID NO: 3950291 - DNA, 16 bp, Homo sapiens
caaagttccaaaatgc

SEQ ID NO: 3950292 - DNA, 18 bp, Homo sapiens
caaagttccaaaatgcca

SEQ ID NO: 3950293 - DNA, 22 bp, Homo sapiens
caaagttccctacttcctgtga

SEQ ID NO: 3950294 - DNA, 18 bp, Homo sapiens
caaagttcctgttcacct

SEQ ID NO: 3950295 - DNA, 14 bp, Homo sapiens
atgccccaaatata

SEQ ID NO: 3950296 - DNA, 19 bp, Homo sapiens
atgccctccaatcctttcc

SEQ ID NO: 3950297 - DNA, 18 bp, Homo sapiens
atgccgcggtaggtaagg

SEQ ID NO: 3950298 - DNA, 23 bp, Homo sapiens
atgccgtgtgtctcgtctcctga

SEQ ID NO: 3950299 - DNA, 18 bp, Homo sapiens
atgcctaatatttaggca

SEQ ID NO: 3950300 - DNA, 15 bp, Homo sapiens
atgcctcaatgtgac

SEQ ID NO: 3950301 - DNA, 12 bp, Homo sapiens
atgcctcagttt

SEQ ID NO: 3950302 - DNA, 14 bp, Homo sapiens
atgcctcagtttcc

SEQ ID NO: 3950303 - DNA, 15 bp, Homo sapiens
atgcctcagtttccc

SEQ ID NO: 3950304 - DNA, 14 bp, Homo sapiens
atgcctccaagcca

SEQ ID NO: 3950305 - DNA, 19 bp, Homo sapiens
atgcctccaagccattcac

SEQ ID NO: 3950306 - DNA, 13 bp, Homo sapiens
atgcctccaccgc

SEQ ID NO: 3950307 - DNA, 13 bp, Homo sapiens
atgcctctgaggc

SEQ ID NO: 3950308 - DNA, 21 bp, Homo sapiens
atgcctctgaggccagcctgg

SEQ ID NO: 3950309 - DNA, 22 bp, Homo sapiens
atgcctctgaggccagcctggc

SEQ ID NO: 3950310 - DNA, 13 bp, Homo sapiens
atgcctggccccc

SEQ ID NO: 3950311 - DNA, 18 bp, Homo sapiens
atgcctggcccccctcca

SEQ ID NO: 3950312 - DNA, 22 bp, Homo sapiens
atgcctggcccccctccaggca

SEQ ID NO: 3950313 - DNA, 20 bp, Homo sapiens
atgcctgtcagtttcatgga

SEQ ID NO: 3950314 - DNA, 21 bp, Homo sapiens
atgcctgtcagtttcatggag

SEQ ID NO: 3950315 - DNA, 15 bp, Homo sapiens
atgccttatgtaatt

SEQ ID NO: 3950316 - DNA, 18 bp, Homo sapiens
atgccttatgtaattatt

SEQ ID NO: 3950317 - DNA, 22 bp, Homo sapiens
atgccttcctgtctttctggcc

SEQ ID NO: 3950318 - DNA, 20 bp, Homo sapiens
atgctaaatgcaaacactgt

SEQ ID NO: 3950319 - DNA, 16 bp, Homo sapiens
atgctatttctggcct

SEQ ID NO: 3950320 - DNA, 21 bp, Homo sapiens
atgctatttctggcctcagca

SEQ ID NO: 3950321 - DNA, 14 bp, Homo sapiens
atgctcaagttttt

SEQ ID NO: 3950322 - DNA, 21 bp, Homo sapiens
atgctcccatctcctgatttc

SEQ ID NO: 3950323 - DNA, 15 bp, Homo sapiens
atgctcgtgtgattt

SEQ ID NO: 3950324 - DNA, 17 bp, Homo sapiens
atgctcgtgtgatttcc

SEQ ID NO: 3950325 - DNA, 16 bp, Homo sapiens
atgctctacttctttt

SEQ ID NO: 3950326 - DNA, 14 bp, Homo sapiens
atgctctcctttcc

SEQ ID NO: 3950327 - DNA, 21 bp, Homo sapiens
atgctctctgcagccagccca

SEQ ID NO: 3950328 - DNA, 22 bp, Homo sapiens
atgctctctgcagccagcccag

SEQ ID NO: 3950329 - DNA, 23 bp, Homo sapiens
atgctctctgcagccagcccagc

SEQ ID NO: 3950330 - DNA, 21 bp, Homo sapiens
atgctctgccccaagccccca

SEQ ID NO: 3950331 - DNA, 11 bp, Homo sapiens
atgctgaatta

SEQ ID NO: 3950332 - DNA, 18 bp, Homo sapiens
atgctgaattattttgtt

SEQ ID NO: 3950333 - DNA, 19 bp, Homo sapiens
atgctgctttttggcacag

SEQ ID NO: 3950334 - DNA, 14 bp, Homo sapiens
atgctggccagcac

SEQ ID NO: 3950335 - DNA, 18 bp, Homo sapiens
atgctggccagcaccctc

SEQ ID NO: 3950336 - DNA, 21 bp, Homo sapiens
atgctggcggcgcagagggaa

SEQ ID NO: 3950337 - DNA, 18 bp, Homo sapiens
atgctggggagaatgaag

SEQ ID NO: 3950338 - DNA, 19 bp, Homo sapiens
atgctgtagaatgcttggc

SEQ ID NO: 3950339 - DNA, 15 bp, Homo sapiens
atgcttaaaatatgt

SEQ ID NO: 3950340 - DNA, 20 bp, Homo sapiens
atgcttaaaatatgtatgtc

SEQ ID NO: 3950341 - DNA, 15 bp, Homo sapiens
atgctttccttttct

SEQ ID NO: 3950342 - DNA, 13 bp, Homo sapiens
atgctttctcctt

SEQ ID NO: 3950343 - DNA, 22 bp, Homo sapiens
atgctttctgaagctttaccag

SEQ ID NO: 3950344 - DNA, 16 bp, Homo sapiens
atgctttgggaggcca

SEQ ID NO: 3950345 - DNA, 16 bp, Homo sapiens
atggaaaaatactgcc

SEQ ID NO: 3950346 - DNA, 13 bp, Homo sapiens
atggaaaagccca

SEQ ID NO: 3950347 - DNA, 14 bp, Homo sapiens
atggaaaagcccag

SEQ ID NO: 3950348 - DNA, 19 bp, Homo sapiens
atggaaaagcccagtgacc

SEQ ID NO: 3950349 - DNA, 16 bp, Homo sapiens
atggaaaataaattat

SEQ ID NO: 3950350 - DNA, 19 bp, Homo sapiens
atggaaaatgtcctgtggt

SEQ ID NO: 3950351 - DNA, 15 bp, Homo sapiens
atggaaacagggcag

SEQ ID NO: 3950352 - DNA, 16 bp, Homo sapiens
atggaaacctgaaaaa

SEQ ID NO: 3950353 - DNA, 17 bp, Homo sapiens
atggaaagaatctaata

SEQ ID NO: 3950354 - DNA, 13 bp, Homo sapiens
atggaaccttccc

SEQ ID NO: 3950355 - DNA, 14 bp, Homo sapiens
atggaactgacccc

SEQ ID NO: 3950356 - DNA, 19 bp, Homo sapiens
atggaagacaaaatgtttt

SEQ ID NO: 3950357 - DNA, 13 bp, Homo sapiens
atggaagggaggg

SEQ ID NO: 3950358 - DNA, 15 bp, Homo sapiens
atggaagggaggggt

SEQ ID NO: 3950359 - DNA, 22 bp, Homo sapiens
atggaaggtttgtatattgtca

SEQ ID NO: 3950360 - DNA, 17 bp, Homo sapiens
atggaatacagtgttat

SEQ ID NO: 3950361 - DNA, 22 bp, Homo sapiens
atggaatacagtgttattttct

SEQ ID NO: 3950362 - DNA, 22 bp, Homo sapiens
atggaatagaaaagatgagagg

SEQ ID NO: 3950363 - DNA, 23 bp, Homo sapiens
atggaatagaaaagatgagaggc

SEQ ID NO: 3950364 - DNA, 13 bp, Homo sapiens
atggacacagacc

SEQ ID NO: 3950365 - DNA, 13 bp, Homo sapiens
atggaccagtaga

SEQ ID NO: 3950366 - DNA, 15 bp, Homo sapiens
atggacccctccctt

SEQ ID NO: 3950367 - DNA, 16 bp, Homo sapiens
atggaccctcgcagca

SEQ ID NO: 3950368 - DNA, 18 bp, Homo sapiens
atggaccctcgcagcagg

SEQ ID NO: 3950369 - DNA, 21 bp, Homo sapiens
atggaccgggtgggcctggcc

SEQ ID NO: 3950370 - DNA, 23 bp, Homo sapiens
atggactcatggcttagaaatct

SEQ ID NO: 3950371 - DNA, 17 bp, Homo sapiens
atggactcttcccccac

SEQ ID NO: 3950372 - DNA, 19 bp, Homo sapiens
atggacttttgggggttgg

SEQ ID NO: 3950373 - DNA, 12 bp, Homo sapiens
atggagaaggaa

SEQ ID NO: 3950374 - DNA, 18 bp, Homo sapiens
atggagactgtctcaaga

SEQ ID NO: 3950375 - DNA, 14 bp, Homo sapiens
atggagagagactc

SEQ ID NO: 3950376 - DNA, 14 bp, Homo sapiens
atggagagagggga

SEQ ID NO: 3950377 - DNA, 13 bp, Homo sapiens
atggagagccctg

SEQ ID NO: 3950378 - DNA, 17 bp, Homo sapiens
atggagagggggtacaa

SEQ ID NO: 3950379 - DNA, 21 bp, Homo sapiens
atggagccagctctgcattat

SEQ ID NO: 3950380 - DNA, 22 bp, Homo sapiens
atggagcctggcacaggactga

SEQ ID NO: 3950381 - DNA, 11 bp, Homo sapiens
atggagctgag

SEQ ID NO: 3950382 - DNA, 22 bp, Homo sapiens
atggtcccacatccctgggcct

SEQ ID NO: 3950383 - DNA, 22 bp, Homo sapiens
atggtctcctctgattatcagg

SEQ ID NO: 3950384 - DNA, 19 bp, Homo sapiens
atggtctctcgggcccccc

SEQ ID NO: 3950385 - DNA, 17 bp, Homo sapiens
atggtgaaatttattag

SEQ ID NO: 3950386 - DNA, 13 bp, Homo sapiens
atggtgacacaca

SEQ ID NO: 3950387 - DNA, 23 bp, Homo sapiens
atggtgacttcctcgcctctccc

SEQ ID NO: 3950388 - DNA, 14 bp, Homo sapiens
atggtgagctggga

SEQ ID NO: 3950389 - DNA, 18 bp, Homo sapiens
atggtgcagttgacagca

SEQ ID NO: 3950390 - DNA, 16 bp, Homo sapiens
atggtgggaaccctcc

SEQ ID NO: 3950391 - DNA, 18 bp, Homo sapiens
atggtgggaaccctcccc

SEQ ID NO: 3950392 - DNA, 22 bp, Homo sapiens
atggtggtaaacattctctcag

SEQ ID NO: 3950393 - DNA, 13 bp, Homo sapiens
atggtgtaatgca

SEQ ID NO: 3950394 - DNA, 17 bp, Homo sapiens
atggtgtaatgcacaat

SEQ ID NO: 3950395 - DNA, 16 bp, Homo sapiens
atggttccatgcctga

SEQ ID NO: 3950396 - DNA, 17 bp, Homo sapiens
atggttccatgcctgag

SEQ ID NO: 3950397 - DNA, 22 bp, Homo sapiens
atggttccatgcctgagggtgg

SEQ ID NO: 3950398 - DNA, 18 bp, Homo sapiens
atggttcccaataaaagt

SEQ ID NO: 3950399 - DNA, 13 bp, Homo sapiens
atggttccttccc

SEQ ID NO: 3950400 - DNA, 17 bp, Homo sapiens
atggttctcagatcttg

SEQ ID NO: 3950401 - DNA, 17 bp, Homo sapiens
atggttgattcccagca

SEQ ID NO: 3950402 - DNA, 17 bp, Homo sapiens
atggttgccttaaagaa

SEQ ID NO: 3950403 - DNA, 23 bp, Homo sapiens
atggttggtaacacaaattttca

SEQ ID NO: 3950404 - DNA, 21 bp, Homo sapiens
atgtaaaagagtcatctggta

SEQ ID NO: 3950405 - DNA, 15 bp, Homo sapiens
atgtaaaataagtat

SEQ ID NO: 3950406 - DNA, 14 bp, Homo sapiens
atgtaaacaggaga

SEQ ID NO: 3950407 - DNA, 17 bp, Homo sapiens
atgtaaacagtgcctgc

SEQ ID NO: 3950408 - DNA, 13 bp, Homo sapiens
atgtaacaaccag

SEQ ID NO: 3950409 - DNA, 21 bp, Homo sapiens
atgtaacaaccagagatgact

SEQ ID NO: 3950410 - DNA, 17 bp, Homo sapiens
atgtaactattgaattg

SEQ ID NO: 3950411 - DNA, 22 bp, Homo sapiens
atgtaactctatagttattgtt

SEQ ID NO: 3950412 - DNA, 14 bp, Homo sapiens
atgtaacttttgta

SEQ ID NO: 3950413 - DNA, 22 bp, Homo sapiens
atgtaagtaattgcatttctgc

SEQ ID NO: 3950414 - DNA, 15 bp, Homo sapiens
atgtaataaatctga

SEQ ID NO: 3950415 - DNA, 18 bp, Homo sapiens
atgtacaaaagtaccata

SEQ ID NO: 3950416 - DNA, 21 bp, Homo sapiens
atgtacaaaatcgattggctt

SEQ ID NO: 3950417 - DNA, 22 bp, Homo sapiens
atgtacaagttttgtataaata

SEQ ID NO: 3950418 - DNA, 18 bp, Homo sapiens
atgtacactggatatgtt

SEQ ID NO: 3950419 - DNA, 13 bp, Homo sapiens
atgtacagagtgg

SEQ ID NO: 3950420 - DNA, 22 bp, Homo sapiens
atgtacatgtgtagggaaagtt

SEQ ID NO: 3950421 - DNA, 19 bp, Homo sapiens
atgtactataatgtgatga

SEQ ID NO: 3950422 - DNA, 20 bp, Homo sapiens
atgtactctacgccaaagtg

SEQ ID NO: 3950423 - DNA, 15 bp, Homo sapiens
atgtacttcctgtgt

SEQ ID NO: 3950424 - DNA, 20 bp, Homo sapiens
atgtacttcctgtgtactct

SEQ ID NO: 3950425 - DNA, 23 bp, Homo sapiens
atgtagaaatattataaatccaa

SEQ ID NO: 3950426 - DNA, 19 bp, Homo sapiens
atgtagattaaggtgatgt

SEQ ID NO: 3950427 - DNA, 22 bp, Homo sapiens
atgtagattaaggtgatgtgat

SEQ ID NO: 3950428 - DNA, 15 bp, Homo sapiens
atgtaggtgtctgca

SEQ ID NO: 3950429 - DNA, 14 bp, Homo sapiens
atgtatacacacat

SEQ ID NO: 3950430 - DNA, 15 bp, Homo sapiens
atgtatacacacata

SEQ ID NO: 3950431 - DNA, 16 bp, Homo sapiens
atgtatatacacatat

SEQ ID NO: 3950432 - DNA, 22 bp, Homo sapiens
atgtatatactatacaacaatg

SEQ ID NO: 3950433 - DNA, 13 bp, Homo sapiens
atgtatatgtata

SEQ ID NO: 3950434 - DNA, 20 bp, Homo sapiens
atgtatatgtcatttatttt

SEQ ID NO: 3950435 - DNA, 16 bp, Homo sapiens
atgtatcatagaaatg

SEQ ID NO: 3950436 - DNA, 15 bp, Homo sapiens
atgtatctacctcac

SEQ ID NO: 3950437 - DNA, 19 bp, Homo sapiens
atgtatgttcagaagaaat

SEQ ID NO: 3950438 - DNA, 14 bp, Homo sapiens
atgtatgtttacat

SEQ ID NO: 3950439 - DNA, 17 bp, Homo sapiens
atgtatgtttacatatc

SEQ ID NO: 3950440 - DNA, 20 bp, Homo sapiens
atgtattaagccaaacatga

SEQ ID NO: 3950441 - DNA, 17 bp, Homo sapiens
atgtattatcacatcaa

SEQ ID NO: 3950442 - DNA, 16 bp, Homo sapiens
atgtattattttctat

SEQ ID NO: 3950443 - DNA, 17 bp, Homo sapiens
atgtcaaggactcctgt

SEQ ID NO: 3950444 - DNA, 18 bp, Homo sapiens
atgtcaatttgtatatca

SEQ ID NO: 3950445 - DNA, 20 bp, Homo sapiens
atgtcaatttgtatatcatg

SEQ ID NO: 3950446 - DNA, 13 bp, Homo sapiens
atgtcaccacctt

SEQ ID NO: 3950447 - DNA, 15 bp, Homo sapiens
atgtcaccagtcctg

SEQ ID NO: 3950448 - DNA, 21 bp, Homo sapiens
atgtcacctcagctgatatta

SEQ ID NO: 3950449 - DNA, 16 bp, Homo sapiens
atgtcagagccaggct

SEQ ID NO: 3950450 - DNA, 15 bp, Homo sapiens
atgtcagagctatgt

SEQ ID NO: 3950451 - DNA, 12 bp, Homo sapiens
atgtcagccttg

SEQ ID NO: 3950452 - DNA, 16 bp, Homo sapiens
atgtcagtctggttta

SEQ ID NO: 3950453 - DNA, 14 bp, Homo sapiens
atgtcatcatacat

SEQ ID NO: 3950454 - DNA, 22 bp, Homo sapiens
atgtcatccccttgtgtcagag

SEQ ID NO: 3950455 - DNA, 16 bp, Homo sapiens
atgtcattaatgtgtt

SEQ ID NO: 3950456 - DNA, 20 bp, Homo sapiens
atgtcccaacttgtaaaaat

SEQ ID NO: 3950457 - DNA, 24 bp, Homo sapiens
atgtccctaccgagtctcttctcc

SEQ ID NO: 3950458 - DNA, 20 bp, Homo sapiens
atgtcctaaggacacactaa

SEQ ID NO: 3950459 - DNA, 22 bp, Homo sapiens
atgtcctccaacaataaagagc

SEQ ID NO: 3950460 - DNA, 13 bp, Homo sapiens
atgtctaaagagc

SEQ ID NO: 3950461 - DNA, 15 bp, Homo sapiens
atgtctatttaagcc

SEQ ID NO: 3950462 - DNA, 23 bp, Homo sapiens
atgtctatttaagcctcatattt

SEQ ID NO: 3950463 - DNA, 17 bp, Homo sapiens
atgtctcaggtccctgc

SEQ ID NO: 3950464 - DNA, 22 bp, Homo sapiens
atgtctcaggtccctgcagggc

SEQ ID NO: 3950465 - DNA, 16 bp, Homo sapiens
atgtctcgctagtgat

SEQ ID NO: 3950466 - DNA, 16 bp, Homo sapiens
atgtctctcagaattc

SEQ ID NO: 3950467 - DNA, 13 bp, Homo sapiens
atgtctcttgtag

SEQ ID NO: 3950468 - DNA, 16 bp, Homo sapiens
atgtctgccacagaga

SEQ ID NO: 3950469 - DNA, 15 bp, Homo sapiens
atgtgaatcagaccc

SEQ ID NO: 3950470 - DNA, 12 bp, Homo sapiens
atgtgacagaca

SEQ ID NO: 3950471 - DNA, 20 bp, Homo sapiens
atgtgacccagatcctcaca

SEQ ID NO: 3950472 - DNA, 21 bp, Homo sapiens
atgtgagattactttgtcccg

SEQ ID NO: 3950473 - DNA, 16 bp, Homo sapiens
atgtgagcacatgcgt

SEQ ID NO: 3950474 - DNA, 20 bp, Homo sapiens
atgtgataaggatcagaaca

SEQ ID NO: 3950475 - DNA, 15 bp, Homo sapiens
atgtgattcaaaaga

SEQ ID NO: 3950476 - DNA, 14 bp, Homo sapiens
atgtgcaaatgcaa

SEQ ID NO: 3950477 - DNA, 15 bp, Homo sapiens
atgtgcaaattttgc

SEQ ID NO: 3950478 - DNA, 20 bp, Homo sapiens
atgtgcacatgtgtctgtgt

SEQ ID NO: 3950479 - DNA, 22 bp, Homo sapiens
atgtgcatggaaatgtcctcca

SEQ ID NO: 3950480 - DNA, 13 bp, Homo sapiens
atgtgccaaggtg

SEQ ID NO: 3950481 - DNA, 17 bp, Homo sapiens
atgtgctattgaactga

SEQ ID NO: 3950482 - DNA, 22 bp, Homo sapiens
atgtgcttccctaggctgagct

SEQ ID NO: 3950483 - DNA, 17 bp, Homo sapiens
atgtggaatataaagat

SEQ ID NO: 3950484 - DNA, 19 bp, Homo sapiens
atgtggagtggacattcaa

SEQ ID NO: 3950485 - DNA, 22 bp, Homo sapiens
atgtggattagctagaatgcac

SEQ ID NO: 3950486 - DNA, 15 bp, Homo sapiens
atgtggatttcctat

SEQ ID NO: 3950487 - DNA, 22 bp, Homo sapiens
atgtggatttcctattttaaaa

SEQ ID NO: 3950488 - DNA, 17 bp, Homo sapiens
atgtggcattggggggc

SEQ ID NO: 3950489 - DNA, 18 bp, Homo sapiens
atgtggccccaggtgcca

SEQ ID NO: 3950490 - DNA, 20 bp, Homo sapiens
atgtggcccctgaacaagaa

SEQ ID NO: 3950491 - DNA, 13 bp, Homo sapiens
atgtggccctggc

SEQ ID NO: 3950492 - DNA, 14 bp, Homo sapiens
atgtggccctggcc

SEQ ID NO: 3950493 - DNA, 19 bp, Homo sapiens
atgtggcctaaaaatgcaa

SEQ ID NO: 3950494 - DNA, 15 bp, Homo sapiens
atgtggtatgtagcc

SEQ ID NO: 3950495 - DNA, 19 bp, Homo sapiens
atgtggtttatagagggcc

SEQ ID NO: 3950496 - DNA, 11 bp, Homo sapiens
atgtgtaaatg

SEQ ID NO: 3950497 - DNA, 13 bp, Homo sapiens
atgtgtaaatgga

SEQ ID NO: 3950498 - DNA, 16 bp, Homo sapiens
atgtgtagggaaagtt

SEQ ID NO: 3950499 - DNA, 20 bp, Homo sapiens
atgtgtagggaaagttaaaa

SEQ ID NO: 3950500 - DNA, 23 bp, Homo sapiens
atgtgtatatatacatacacttg

SEQ ID NO: 3950501 - DNA, 21 bp, Homo sapiens
atgtgtatttgtatgtactgt

SEQ ID NO: 3950502 - DNA, 13 bp, Homo sapiens
atgtgtcccctca

SEQ ID NO: 3950503 - DNA, 24 bp, Homo sapiens
atgtgtcccctcactctgtcagcc

SEQ ID NO: 3950504 - DNA, 18 bp, Homo sapiens
atgtgtgcctgtggcaga

SEQ ID NO: 3950505 - DNA, 14 bp, Homo sapiens
atgtgtgctgtgct

SEQ ID NO: 3950506 - DNA, 13 bp, Homo sapiens
atgtgtgtataag

SEQ ID NO: 3950507 - DNA, 14 bp, Homo sapiens
atgtgtgtatatat

SEQ ID NO: 3950508 - DNA, 15 bp, Homo sapiens
atgtgtgtatatatg

SEQ ID NO: 3950509 - DNA, 18 bp, Homo sapiens
atgtgtgtatatatgtgt

SEQ ID NO: 3950510 - DNA, 11 bp, Homo sapiens
atgtgtgtggt

SEQ ID NO: 3950511 - DNA, 16 bp, Homo sapiens
atgtgtgtggtgtgtg

SEQ ID NO: 3950512 - DNA, 19 bp, Homo sapiens
atgtgtgtggtgtgtgtgc

SEQ ID NO: 3950513 - DNA, 14 bp, Homo sapiens
atgtgtgtgtctgt

SEQ ID NO: 3950514 - DNA, 16 bp, Homo sapiens
atgtgtgtttaaataa

SEQ ID NO: 3950515 - DNA, 18 bp, Homo sapiens
atgtgtttatgtgagctg

SEQ ID NO: 3950516 - DNA, 14 bp, Homo sapiens
atgtgttttctgaa

SEQ ID NO: 3950517 - DNA, 22 bp, Homo sapiens
atgtgttttgcacgtcttgcta

SEQ ID NO: 3950518 - DNA, 18 bp, Homo sapiens
atgttaaagcatcagaga

SEQ ID NO: 3950519 - DNA, 22 bp, Homo sapiens
atgttaactattattaataaat

SEQ ID NO: 3950520 - DNA, 17 bp, Homo sapiens
atgttaagttacttcac

SEQ ID NO: 3950521 - DNA, 23 bp, Homo sapiens
atgttaattcagcactgatttca

SEQ ID NO: 3950522 - DNA, 17 bp, Homo sapiens
atgttacatcacagtgt

SEQ ID NO: 3950523 - DNA, 15 bp, Homo sapiens
atgttattgcataat

SEQ ID NO: 3950524 - DNA, 12 bp, Homo sapiens
atgttatttata

SEQ ID NO: 3950525 - DNA, 20 bp, Homo sapiens
atgttatttatatattggta

SEQ ID NO: 3950526 - DNA, 16 bp, Homo sapiens
atgttcagaagaaatt

SEQ ID NO: 3950527 - DNA, 17 bp, Homo sapiens
atgttcagaagaaattc

SEQ ID NO: 3950528 - DNA, 12 bp, Homo sapiens
atgttccctgca

SEQ ID NO: 3950529 - DNA, 17 bp, Homo sapiens
atgttcctagtgaaaga

SEQ ID NO: 3950530 - DNA, 16 bp, Homo sapiens
atgttctggacctccc

SEQ ID NO: 3950531 - DNA, 22 bp, Homo sapiens
atgttgaatgcccacaggcaaa

SEQ ID NO: 3950532 - DNA, 14 bp, Homo sapiens
atgttgagggaaca

SEQ ID NO: 3950533 - DNA, 14 bp, Homo sapiens
atgttgcccaggct

SEQ ID NO: 3950534 - DNA, 18 bp, Homo sapiens
atgttgggatttatatct

SEQ ID NO: 3950535 - DNA, 18 bp, Homo sapiens
atgttgtaaacaggaagc

SEQ ID NO: 3950536 - DNA, 23 bp, Homo sapiens
atgttgtaataaaacttatgcta

SEQ ID NO: 3950537 - DNA, 21 bp, Homo sapiens
atgttgtgattaacatcatca

SEQ ID NO: 3950538 - DNA, 13 bp, Homo sapiens
atgttgttaaaca

SEQ ID NO: 3950539 - DNA, 17 bp, Homo sapiens
atgttgttatgctatta

SEQ ID NO: 3950540 - DNA, 16 bp, Homo sapiens
atgttgttcccacaca

SEQ ID NO: 3950541 - DNA, 13 bp, Homo sapiens
atgtttacatatc

SEQ ID NO: 3950542 - DNA, 20 bp, Homo sapiens
atgtttacatatcacctcat

SEQ ID NO: 3950543 - DNA, 18 bp, Homo sapiens
atgtttactttattagag

SEQ ID NO: 3950544 - DNA, 18 bp, Homo sapiens
atgtttagattccaggat

SEQ ID NO: 3950545 - DNA, 20 bp, Homo sapiens
atgtttattcatgggtgtca

SEQ ID NO: 3950546 - DNA, 14 bp, Homo sapiens
atgtttattcctga

SEQ ID NO: 3950547 - DNA, 13 bp, Homo sapiens
atgtttatttata

SEQ ID NO: 3950548 - DNA, 21 bp, Homo sapiens
atgtttatttattctgcattt

SEQ ID NO: 3950549 - DNA, 23 bp, Homo sapiens
atgtttatttcataaagaattgt

SEQ ID NO: 3950550 - DNA, 19 bp, Homo sapiens
atgtttcacgaagtttgtt

SEQ ID NO: 3950551 - DNA, 17 bp, Homo sapiens
atgtttccagaaaatat

SEQ ID NO: 3950552 - DNA, 21 bp, Homo sapiens
atgtttccagaaaatataaat

SEQ ID NO: 3950553 - DNA, 22 bp, Homo sapiens
atgtttctgcagtagtctctgt

SEQ ID NO: 3950554 - DNA, 12 bp, Homo sapiens
atgtttgattta

SEQ ID NO: 3950555 - DNA, 21 bp, Homo sapiens
attataactgaaggagaaggt

SEQ ID NO: 3950556 - DNA, 20 bp, Homo sapiens
attataacttaaaatatttt

SEQ ID NO: 3950557 - DNA, 14 bp, Homo sapiens
attataagatgtca

SEQ ID NO: 3950558 - DNA, 20 bp, Homo sapiens
attatagagtatactaaaaa

SEQ ID NO: 3950559 - DNA, 17 bp, Homo sapiens
attataggatcatttgt

SEQ ID NO: 3950560 - DNA, 15 bp, Homo sapiens
attatatctaattta

SEQ ID NO: 3950561 - DNA, 22 bp, Homo sapiens
attatatctaatttatacaaaa

SEQ ID NO: 3950562 - DNA, 16 bp, Homo sapiens
attatggcaagtgata

SEQ ID NO: 3950563 - DNA, 11 bp, Homo sapiens
attatggtgaa

SEQ ID NO: 3950564 - DNA, 16 bp, Homo sapiens
attatggtgtaatgca

SEQ ID NO: 3950565 - DNA, 18 bp, Homo sapiens
attatggtgtaatgcaca

SEQ ID NO: 3950566 - DNA, 23 bp, Homo sapiens
attatggtgtaatgcacaattta

SEQ ID NO: 3950567 - DNA, 17 bp, Homo sapiens
attatgtaacatccaga

SEQ ID NO: 3950568 - DNA, 18 bp, Homo sapiens
attatgtaacatccagaa

SEQ ID NO: 3950569 - DNA, 19 bp, Homo sapiens
attatgtaacatccagaag

SEQ ID NO: 3950570 - DNA, 12 bp, Homo sapiens
attatgtagaaa

SEQ ID NO: 3950571 - DNA, 15 bp, Homo sapiens
attatgtatgtttac

SEQ ID NO: 3950572 - DNA, 16 bp, Homo sapiens
attatgtatgtttaca

SEQ ID NO: 3950573 - DNA, 16 bp, Homo sapiens
attatgtctcaaaata

SEQ ID NO: 3950574 - DNA, 17 bp, Homo sapiens
attatgtctcaaaataa

SEQ ID NO: 3950575 - DNA, 23 bp, Homo sapiens
attatgtgttcaaggaccacatg

SEQ ID NO: 3950576 - DNA, 13 bp, Homo sapiens
attatgttgttca

SEQ ID NO: 3950577 - DNA, 13 bp, Homo sapiens
attattaataaat

SEQ ID NO: 3950578 - DNA, 21 bp, Homo sapiens
attattacttatttttgacag

SEQ ID NO: 3950579 - DNA, 21 bp, Homo sapiens
attattcaagtgcctcttgtt

SEQ ID NO: 3950580 - DNA, 18 bp, Homo sapiens
attattcatttaaaatga

SEQ ID NO: 3950581 - DNA, 12 bp, Homo sapiens
attattccctct

SEQ ID NO: 3950582 - DNA, 13 bp, Homo sapiens
attattcctccag

SEQ ID NO: 3950583 - DNA, 16 bp, Homo sapiens
attattctgattccac

SEQ ID NO: 3950584 - DNA, 22 bp, Homo sapiens
attatttaaatgttgaaatctt

SEQ ID NO: 3950585 - DNA, 21 bp, Homo sapiens
attatttaataaaaaaacaat

SEQ ID NO: 3950586 - DNA, 12 bp, Homo sapiens
attatttaatgt

SEQ ID NO: 3950587 - DNA, 13 bp, Homo sapiens
attatttaatgtt

SEQ ID NO: 3950588 - DNA, 14 bp, Homo sapiens
attatttaatgttt

SEQ ID NO: 3950589 - DNA, 22 bp, Homo sapiens
attatttcaaccgcttgccata

SEQ ID NO: 3950590 - DNA, 15 bp, Homo sapiens
attatttgtgtaata

SEQ ID NO: 3950591 - DNA, 20 bp, Homo sapiens
attatttgtgtaatagaaaa

SEQ ID NO: 3950592 - DNA, 22 bp, Homo sapiens
attatttgttatttgtacagtt

SEQ ID NO: 3950593 - DNA, 16 bp, Homo sapiens
attattttaatatttt

SEQ ID NO: 3950594 - DNA, 14 bp, Homo sapiens
attattttcattac

SEQ ID NO: 3950595 - DNA, 21 bp, Homo sapiens
attattttcattacaatggaa

SEQ ID NO: 3950596 - DNA, 16 bp, Homo sapiens
attattttgttgtgat

SEQ ID NO: 3950597 - DNA, 17 bp, Homo sapiens
attatttttgtgtttct

SEQ ID NO: 3950598 - DNA, 20 bp, Homo sapiens
attatttttgtgtttctaaa

SEQ ID NO: 3950599 - DNA, 20 bp, Homo sapiens
attcaaacagtctcaggaaa

SEQ ID NO: 3950600 - DNA, 12 bp, Homo sapiens
attcaaaccatt

SEQ ID NO: 3950601 - DNA, 13 bp, Homo sapiens
attcaaaccattt

SEQ ID NO: 3950602 - DNA, 17 bp, Homo sapiens
attcaaaccatttaatt

SEQ ID NO: 3950603 - DNA, 14 bp, Homo sapiens
attcaaatgggtga

SEQ ID NO: 3950604 - DNA, 13 bp, Homo sapiens
attcaacacatta

SEQ ID NO: 3950605 - DNA, 19 bp, Homo sapiens
attcaacacattacttgca

SEQ ID NO: 3950606 - DNA, 22 bp, Homo sapiens
attcaacacattacttgcacaa

SEQ ID NO: 3950607 - DNA, 23 bp, Homo sapiens
attcaacacattacttgcacaag

SEQ ID NO: 3950608 - DNA, 22 bp, Homo sapiens
attcaagcctgtgaataaaaac

SEQ ID NO: 3950609 - DNA, 14 bp, Homo sapiens
attcaagtgcctct

SEQ ID NO: 3950610 - DNA, 14 bp, Homo sapiens
attcaagttattgt

SEQ ID NO: 3950611 - DNA, 13 bp, Homo sapiens
attcaataaagct

SEQ ID NO: 3950612 - DNA, 20 bp, Homo sapiens
attcacacctcacgctctgg

SEQ ID NO: 3950613 - DNA, 12 bp, Homo sapiens
attcacacctta

SEQ ID NO: 3950614 - DNA, 22 bp, Homo sapiens
attcacatccaatgcatagttt

SEQ ID NO: 3950615 - DNA, 20 bp, Homo sapiens
attcacatttgatgtacatg

SEQ ID NO: 3950616 - DNA, 21 bp, Homo sapiens
attcacatttgatgtacatgt

SEQ ID NO: 3950617 - DNA, 15 bp, Homo sapiens
attcactgtaagttt

SEQ ID NO: 3950618 - DNA, 14 bp, Homo sapiens
attcagagaatatc

SEQ ID NO: 3950619 - DNA, 18 bp, Homo sapiens
attcagatcgtattaatt

SEQ ID NO: 3950620 - DNA, 19 bp, Homo sapiens
attcagatcgtattaatta

SEQ ID NO: 3950621 - DNA, 22 bp, Homo sapiens
attcagatcgtattaattatct

SEQ ID NO: 3950622 - DNA, 19 bp, Homo sapiens
attcagcacaccccaaggg

SEQ ID NO: 3950623 - DNA, 18 bp, Homo sapiens
attcagcaccctgggtgc

SEQ ID NO: 3950624 - DNA, 17 bp, Homo sapiens
attcagcctggccatcc

SEQ ID NO: 3950625 - DNA, 19 bp, Homo sapiens
attcagcctggccatcccc

SEQ ID NO: 3950626 - DNA, 22 bp, Homo sapiens
attcaggaaaactgacagagga

SEQ ID NO: 3950627 - DNA, 19 bp, Homo sapiens
attcaggaaaaggcctggg

SEQ ID NO: 3950628 - DNA, 21 bp, Homo sapiens
attcaggaaaaggcctggggt

SEQ ID NO: 3950629 - DNA, 17 bp, Homo sapiens
attcaggactggctcac

SEQ ID NO: 3950630 - DNA, 21 bp, Homo sapiens
attcaggacttaacggctcca

SEQ ID NO: 3950631 - DNA, 22 bp, Homo sapiens
attcaggacttaacggctccag

SEQ ID NO: 3950632 - DNA, 19 bp, Homo sapiens
attcaggtgaaaatgttca

SEQ ID NO: 3950633 - DNA, 14 bp, Homo sapiens
attcagtgcttctt

SEQ ID NO: 3950634 - DNA, 19 bp, Homo sapiens
attcagtgcttcttaaaga

SEQ ID NO: 3950635 - DNA, 13 bp, Homo sapiens
attcataattaga

SEQ ID NO: 3950636 - DNA, 15 bp, Homo sapiens
attcataattagaac

SEQ ID NO: 3950637 - DNA, 16 bp, Homo sapiens
attcataattagaaca

SEQ ID NO: 3950638 - DNA, 18 bp, Homo sapiens
attcatccagttgcaata

SEQ ID NO: 3950639 - DNA, 19 bp, Homo sapiens
attcatccagttgcaataa

SEQ ID NO: 3950640 - DNA, 22 bp, Homo sapiens
attcatccagttgcaataaaat

SEQ ID NO: 3950641 - DNA, 20 bp, Homo sapiens
atccgggacgcttccagacc

SEQ ID NO: 3950642 - DNA, 18 bp, Homo sapiens
atcctaactgaagagaca

SEQ ID NO: 3950643 - DNA, 20 bp, Homo sapiens
atcctaagtgggaagtgaag

SEQ ID NO: 3950644 - DNA, 22 bp, Homo sapiens
atcctaagtgggaagtgaagcc

SEQ ID NO: 3950645 - DNA, 16 bp, Homo sapiens
atcctaccaatgcatg

SEQ ID NO: 3950646 - DNA, 20 bp, Homo sapiens
atcctcaacaacaaaccaaa

SEQ ID NO: 3950647 - DNA, 17 bp, Homo sapiens
atcctcacaggagcaga

SEQ ID NO: 3950648 - DNA, 23 bp, Homo sapiens
atcctcaccatccacagcaagat

SEQ ID NO: 3950649 - DNA, 19 bp, Homo sapiens
atcctccaacgttaaaaga

SEQ ID NO: 3950650 - DNA, 19 bp, Homo sapiens
atcctccttataagcccag

SEQ ID NO: 3950651 - DNA, 14 bp, Homo sapiens
atcctctggctggc

SEQ ID NO: 3950652 - DNA, 16 bp, Homo sapiens
atcctgaagaaaccac

SEQ ID NO: 3950653 - DNA, 20 bp, Homo sapiens
atcctgataaacattaaaca

SEQ ID NO: 3950654 - DNA, 16 bp, Homo sapiens
atcctgcagcctcctc

SEQ ID NO: 3950655 - DNA, 20 bp, Homo sapiens
atcctgcagcctcctcctga

SEQ ID NO: 3950656 - DNA, 21 bp, Homo sapiens
atcctgcaggaacgagcactg

SEQ ID NO: 3950657 - DNA, 17 bp, Homo sapiens
atcctgcagttgggcca

SEQ ID NO: 3950658 - DNA, 15 bp, Homo sapiens
atcctgctagctgta

SEQ ID NO: 3950659 - DNA, 19 bp, Homo sapiens
atcctgctagctgtagaaa

SEQ ID NO: 3950660 - DNA, 22 bp, Homo sapiens
atcctgctcataacatctttga

SEQ ID NO: 3950661 - DNA, 16 bp, Homo sapiens
atcctgctgtggcctc

SEQ ID NO: 3950662 - DNA, 17 bp, Homo sapiens
atcctgctgtggcctca

SEQ ID NO: 3950663 - DNA, 18 bp, Homo sapiens
atcctgctgtggcctcac

SEQ ID NO: 3950664 - DNA, 18 bp, Homo sapiens
atcctgctttccctcccc

SEQ ID NO: 3950665 - DNA, 15 bp, Homo sapiens
atcctggcccctcca

SEQ ID NO: 3950666 - DNA, 20 bp, Homo sapiens
atcctggcccctccagaccc

SEQ ID NO: 3950667 - DNA, 22 bp, Homo sapiens
atcctggcccctccagaccctg

SEQ ID NO: 3950668 - DNA, 23 bp, Homo sapiens
atcctgtatattatggtgtaatg

SEQ ID NO: 3950669 - DNA, 17 bp, Homo sapiens
atcctgtgtggggaggc

SEQ ID NO: 3950670 - DNA, 14 bp, Homo sapiens
atccttccagtggc

SEQ ID NO: 3950671 - DNA, 19 bp, Homo sapiens
atccttggagagcagctgg

SEQ ID NO: 3950672 - DNA, 20 bp, Homo sapiens
atccttggagagcagctggc

SEQ ID NO: 3950673 - DNA, 24 bp, Homo sapiens
atccttggagagcagctggctctc

SEQ ID NO: 3950674 - DNA, 17 bp, Homo sapiens
atcctttaaatccttcc

SEQ ID NO: 3950675 - DNA, 15 bp, Homo sapiens
atcctttctattgaa

SEQ ID NO: 3950676 - DNA, 17 bp, Homo sapiens
atcctttgagaatgtga

SEQ ID NO: 3950677 - DNA, 19 bp, Homo sapiens
atcctttgagaatgtgatt

SEQ ID NO: 3950678 - DNA, 22 bp, Homo sapiens
atcctttgagttatagtttgct

SEQ ID NO: 3950679 - DNA, 12 bp, Homo sapiens
atcgaaaattca

SEQ ID NO: 3950680 - DNA, 16 bp, Homo sapiens
atcgaaaattcatttc

SEQ ID NO: 3950681 - DNA, 20 bp, Homo sapiens
atcgcaccactgtgtattta

SEQ ID NO: 3950682 - DNA, 22 bp, Homo sapiens
atcgctgtgaaaatgaggagga

SEQ ID NO: 3950683 - DNA, 22 bp, Homo sapiens
atcggaggctgggcccctggga

SEQ ID NO: 3950684 - DNA, 19 bp, Homo sapiens
atcggcccacagctcccac

SEQ ID NO: 3950685 - DNA, 23 bp, Homo sapiens
atcgtctcctttgacatttcctt

SEQ ID NO: 3950686 - DNA, 20 bp, Homo sapiens
atcgtgacccttcagggcca

SEQ ID NO: 3950687 - DNA, 19 bp, Homo sapiens
atcgtgccgttactctcca

SEQ ID NO: 3950688 - DNA, 15 bp, Homo sapiens
atcgtgcctataaat

SEQ ID NO: 3950689 - DNA, 23 bp, Homo sapiens
atcgttcctatacatttctgttc

SEQ ID NO: 3950690 - DNA, 15 bp, Homo sapiens
atctaagctgcagct

SEQ ID NO: 3950691 - DNA, 21 bp, Homo sapiens
atctaatagcgggttactttc

SEQ ID NO: 3950692 - DNA, 21 bp, Homo sapiens
atctaatttatacaaaataat

SEQ ID NO: 3950693 - DNA, 14 bp, Homo sapiens
atctacctgtggtg

SEQ ID NO: 3950694 - DNA, 19 bp, Homo sapiens
atctagatcaattaattct

SEQ ID NO: 3950695 - DNA, 21 bp, Homo sapiens
atctagatcaattaattctta

SEQ ID NO: 3950696 - DNA, 21 bp, Homo sapiens
atctagcttcatgcctcagtt

SEQ ID NO: 3950697 - DNA, 22 bp, Homo sapiens
atctagcttcatgcctcagttt

SEQ ID NO: 3950698 - DNA, 17 bp, Homo sapiens
atctagttttttttgta

SEQ ID NO: 3950699 - DNA, 18 bp, Homo sapiens
atctatagtagtcaatta

SEQ ID NO: 3950700 - DNA, 15 bp, Homo sapiens
atctatattaaagtg

SEQ ID NO: 3950701 - DNA, 13 bp, Homo sapiens
atctatgcaattt

SEQ ID NO: 3950702 - DNA, 17 bp, Homo sapiens
atctatgcaatttttaa

SEQ ID NO: 3950703 - DNA, 20 bp, Homo sapiens
atctatgcaatttttaaact

SEQ ID NO: 3950704 - DNA, 22 bp, Homo sapiens
atctatggccctgcaaaaatat

SEQ ID NO: 3950705 - DNA, 23 bp, Homo sapiens
atctatggccctgcaaaaatata

SEQ ID NO: 3950706 - DNA, 17 bp, Homo sapiens
atctattataaaaccat

SEQ ID NO: 3950707 - DNA, 19 bp, Homo sapiens
atctcaaaactgcactgtc

SEQ ID NO: 3950708 - DNA, 22 bp, Homo sapiens
atctcaatcttcggggtgtgat

SEQ ID NO: 3950709 - DNA, 15 bp, Homo sapiens
atctcactgcccagt

SEQ ID NO: 3950710 - DNA, 20 bp, Homo sapiens
atctcagaattccttttcta

SEQ ID NO: 3950711 - DNA, 17 bp, Homo sapiens
atctcaggtgccactcc

SEQ ID NO: 3950712 - DNA, 24 bp, Homo sapiens
atctcaggtgccactccctgagct

SEQ ID NO: 3950713 - DNA, 15 bp, Homo sapiens
atctcatacctctga

SEQ ID NO: 3950714 - DNA, 17 bp, Homo sapiens
atctccagggctgcccc

SEQ ID NO: 3950715 - DNA, 15 bp, Homo sapiens
atctccagtattctt

SEQ ID NO: 3950716 - DNA, 13 bp, Homo sapiens
atctccagtgtgc

SEQ ID NO: 3950717 - DNA, 14 bp, Homo sapiens
atctccatttcaca

SEQ ID NO: 3950718 - DNA, 15 bp, Homo sapiens
atctccatttcacac

SEQ ID NO: 3950719 - DNA, 13 bp, Homo sapiens
atctccccactct

SEQ ID NO: 3950720 - DNA, 22 bp, Homo sapiens
atctccccaggcctccagcctc

SEQ ID NO: 3950721 - DNA, 14 bp, Homo sapiens
atctccctcccaca

SEQ ID NO: 3950722 - DNA, 12 bp, Homo sapiens
atctccctgccg

SEQ ID NO: 3950723 - DNA, 21 bp, Homo sapiens
atctcctatttttcagaatgc

SEQ ID NO: 3950724 - DNA, 15 bp, Homo sapiens
atctcgagccccctg

SEQ ID NO: 3950725 - DNA, 16 bp, Homo sapiens
atctctatttaatatt

SEQ ID NO: 3950726 - DNA, 16 bp, Homo sapiens
atctctcaggagcaca

SEQ ID NO: 3950727 - DNA, 16 bp, Homo sapiens
atctctctggggccct

SEQ ID NO: 3950728 - DNA, 20 bp, Homo sapiens
atctctctggggccctgggc

SEQ ID NO: 3950729 - DNA, 23 bp, Homo sapiens
atctctcttccctaatcctccaa

SEQ ID NO: 3950730 - DNA, 11 bp, Homo sapiens
atctctgaaag

SEQ ID NO: 3950731 - DNA, 17 bp, Homo sapiens
atctctgtgtgcacaaa

SEQ ID NO: 3950732 - DNA, 19 bp, Homo sapiens
atctctgtgtgcacaaata

SEQ ID NO: 3950733 - DNA, 22 bp, Homo sapiens
atctcttcctacccaaccactc

SEQ ID NO: 3950734 - DNA, 14 bp, Homo sapiens
atctgaaaggcaca

SEQ ID NO: 3950735 - DNA, 14 bp, Homo sapiens
atctgaaagtatat

SEQ ID NO: 3950736 - DNA, 17 bp, Homo sapiens
atctgaagctattgatg

SEQ ID NO: 3950737 - DNA, 22 bp, Homo sapiens
atctgacagttactcttcagtt

SEQ ID NO: 3950738 - DNA, 19 bp, Homo sapiens
atctgagatctccctccag

SEQ ID NO: 3950739 - DNA, 22 bp, Homo sapiens
atctgagcctaaatctaatcag

SEQ ID NO: 3950740 - DNA, 16 bp, Homo sapiens
atctgataaaattgtg

SEQ ID NO: 3950741 - DNA, 19 bp, Homo sapiens
atctgatatgcagagtatt

SEQ ID NO: 3950742 - DNA, 22 bp, Homo sapiens
atctgatcgggataacaaaatc

SEQ ID NO: 3950743 - DNA, 12 bp, Homo sapiens
atctgcagggag

SEQ ID NO: 3950744 - DNA, 15 bp, Homo sapiens
atctgcctggcctgg

SEQ ID NO: 3950745 - DNA, 16 bp, Homo sapiens
atctgcctggcctggc

SEQ ID NO: 3950746 - DNA, 18 bp, Homo sapiens
atctgcctggcctggctc

SEQ ID NO: 3950747 - DNA, 19 bp, Homo sapiens
atctgcctggcctggctcc

SEQ ID NO: 3950748 - DNA, 11 bp, Homo sapiens
atctgcctggg

SEQ ID NO: 3950749 - DNA, 16 bp, Homo sapiens
atctgcctgggcctgt

SEQ ID NO: 3950750 - DNA, 17 bp, Homo sapiens
atctgcctgggcctgtg

SEQ ID NO: 3950751 - DNA, 21 bp, Homo sapiens
atctgcctgggcctgtgcagc

SEQ ID NO: 3950752 - DNA, 23 bp, Homo sapiens
atctgcctgggcctgtgcagcag

SEQ ID NO: 3950753 - DNA, 15 bp, Homo sapiens
atctgctgttgccat

SEQ ID NO: 3950754 - DNA, 17 bp, Homo sapiens
atctggaaatctgtttt

SEQ ID NO: 3950755 - DNA, 22 bp, Homo sapiens
atctggactcctctgtccaggc

SEQ ID NO: 3950756 - DNA, 17 bp, Homo sapiens
atctggctcctgtttcc

SEQ ID NO: 3950757 - DNA, 22 bp, Homo sapiens
atctgggaccctttccttcctt

SEQ ID NO: 3950758 - DNA, 23 bp, Homo sapiens
atctgggaccctttccttccttc

SEQ ID NO: 3950759 - DNA, 18 bp, Homo sapiens
atctgggtccttgcaccc

SEQ ID NO: 3950760 - DNA, 22 bp, Homo sapiens
atctggttagataatgaatgat

SEQ ID NO: 3950761 - DNA, 20 bp, Homo sapiens
atctgtactgtaattttgtt

SEQ ID NO: 3950762 - DNA, 14 bp, Homo sapiens
atctgtagggctgg

SEQ ID NO: 3950763 - DNA, 14 bp, Homo sapiens
atctgtatatacaa

SEQ ID NO: 3950764 - DNA, 14 bp, Homo sapiens
atctgtccaaggaa

SEQ ID NO: 3950765 - DNA, 17 bp, Homo sapiens
atctgtgaattgagctg

SEQ ID NO: 3950766 - DNA, 13 bp, Homo sapiens
atctgtgtgaaaa

SEQ ID NO: 3950767 - DNA, 19 bp, Homo sapiens
atctgtgttgtctctctaa

SEQ ID NO: 3950768 - DNA, 14 bp, Homo sapiens
atctgttttaaatt

SEQ ID NO: 3950769 - DNA, 13 bp, Homo sapiens
atctgttttcaac

SEQ ID NO: 3950770 - DNA, 18 bp, Homo sapiens
atctgttttgtatatgat

SEQ ID NO: 3950771 - DNA, 16 bp, Homo sapiens
atcttacctgtaaagt

SEQ ID NO: 3950772 - DNA, 18 bp, Homo sapiens
atcttacctgtaaagtct

SEQ ID NO: 3950773 - DNA, 11 bp, Homo sapiens
atcttagcatg

SEQ ID NO: 3950774 - DNA, 17 bp, Homo sapiens
atcttatgttaaaggag

SEQ ID NO: 3950775 - DNA, 18 bp, Homo sapiens
atcttcagagcaggggtc

SEQ ID NO: 3950776 - DNA, 13 bp, Homo sapiens
atcttcagctccc

SEQ ID NO: 3950777 - DNA, 15 bp, Homo sapiens
atcttcagctcccat

SEQ ID NO: 3950778 - DNA, 18 bp, Homo sapiens
atcttcagctcccatagc

SEQ ID NO: 3950779 - DNA, 16 bp, Homo sapiens
atcttcctgctgctgt

SEQ ID NO: 3950780 - DNA, 14 bp, Homo sapiens
atcttcgtcctgcc

SEQ ID NO: 3950781 - DNA, 15 bp, Homo sapiens
atcttcgtcctgccc

SEQ ID NO: 3950782 - DNA, 16 bp, Homo sapiens
atcttcgtcctgcccc

SEQ ID NO: 3950783 - DNA, 14 bp, Homo sapiens
atcttctccattct

SEQ ID NO: 3950784 - DNA, 20 bp, Homo sapiens
atcttctggagtctccagtg

SEQ ID NO: 3950785 - DNA, 12 bp, Homo sapiens
atcttctggctt

SEQ ID NO: 3950786 - DNA, 21 bp, Homo sapiens
atcttgacacggtgaaatcca

SEQ ID NO: 3950787 - DNA, 17 bp, Homo sapiens
atcttgacatgtaatga

SEQ ID NO: 3950788 - DNA, 21 bp, Homo sapiens
atcttgctggattaatgtttt

SEQ ID NO: 3950789 - DNA, 15 bp, Homo sapiens
atcttggctcactgc

SEQ ID NO: 3950790 - DNA, 14 bp, Homo sapiens
atcttgtccacagt

SEQ ID NO: 3950791 - DNA, 11 bp, Homo sapiens
atctttcctcc

SEQ ID NO: 3950792 - DNA, 19 bp, Homo sapiens
atctttcctccaaactcct

SEQ ID NO: 3950793 - DNA, 21 bp, Homo sapiens
atctttcctccaaactcctgc

SEQ ID NO: 3950794 - DNA, 19 bp, Homo sapiens
atctttcttctattttatt

SEQ ID NO: 3950795 - DNA, 18 bp, Homo sapiens
atctttctttacctgaga

SEQ ID NO: 3950796 - DNA, 22 bp, Homo sapiens
atctttctttacctgagaccag

SEQ ID NO: 3950797 - DNA, 19 bp, Homo sapiens
atctttgaatggtcttctg

SEQ ID NO: 3950798 - DNA, 14 bp, Homo sapiens
atcttttaatatgc

SEQ ID NO: 3950799 - DNA, 20 bp, Homo sapiens
atgaaaaacacggcagctgt

SEQ ID NO: 3950800 - DNA, 14 bp, Homo sapiens
atgaaaagaggaac

SEQ ID NO: 3950801 - DNA, 22 bp, Homo sapiens
atgaaaatcagttatattcttt

SEQ ID NO: 3950802 - DNA, 14 bp, Homo sapiens
atgaaaattgtatg

SEQ ID NO: 3950803 - DNA, 15 bp, Homo sapiens
atgaaacacttctca

SEQ ID NO: 3950804 - DNA, 16 bp, Homo sapiens
atgaaacacttctcat

SEQ ID NO: 3950805 - DNA, 14 bp, Homo sapiens
atgaaaccaaagcc

SEQ ID NO: 3950806 - DNA, 19 bp, Homo sapiens
atgaaagatggctgtgcct

SEQ ID NO: 3950807 - DNA, 23 bp, Homo sapiens
atgaaagatggctgtgcctctgc

SEQ ID NO: 3950808 - DNA, 20 bp, Homo sapiens
atgaaatacacaagtaaaca

SEQ ID NO: 3950809 - DNA, 14 bp, Homo sapiens
atgaaattgagaag

SEQ ID NO: 3950810 - DNA, 19 bp, Homo sapiens
atgaaattgagaagggaaa

SEQ ID NO: 3950811 - DNA, 22 bp, Homo sapiens
atgaaattttctagactttctg

SEQ ID NO: 3950812 - DNA, 16 bp, Homo sapiens
atatccacatctttaa

SEQ ID NO: 3950813 - DNA, 16 bp, Homo sapiens
atatccagctgagtga

SEQ ID NO: 3950814 - DNA, 22 bp, Homo sapiens
atatccttctagatcatacaca

SEQ ID NO: 3950815 - DNA, 20 bp, Homo sapiens
atatcggaggtggtggagga

SEQ ID NO: 3950816 - DNA, 23 bp, Homo sapiens
atatcggaggtggtggaggagga

SEQ ID NO: 3950817 - DNA, 17 bp, Homo sapiens
atatctaatttatacaa

SEQ ID NO: 3950818 - DNA, 21 bp, Homo sapiens
atatctacctgccctctctca

SEQ ID NO: 3950819 - DNA, 19 bp, Homo sapiens
atatgacaatcctgaagaa

SEQ ID NO: 3950820 - DNA, 13 bp, Homo sapiens
atatgagtataca

SEQ ID NO: 3950821 - DNA, 14 bp, Homo sapiens
atatgagtatacaa

SEQ ID NO: 3950822 - DNA, 17 bp, Homo sapiens
atatgagtatacaatat

SEQ ID NO: 3950823 - DNA, 18 bp, Homo sapiens
atatgagtatacaatata

SEQ ID NO: 3950824 - DNA, 13 bp, Homo sapiens
atatgatctaata

SEQ ID NO: 3950825 - DNA, 12 bp, Homo sapiens
atatgatttata

SEQ ID NO: 3950826 - DNA, 16 bp, Homo sapiens
atatgattttatttga

SEQ ID NO: 3950827 - DNA, 16 bp, Homo sapiens
atatgattttttaaaa

SEQ ID NO: 3950828 - DNA, 14 bp, Homo sapiens
atatgcaaagcact

SEQ ID NO: 3950829 - DNA, 19 bp, Homo sapiens
atatgcacacacagatgca

SEQ ID NO: 3950830 - DNA, 21 bp, Homo sapiens
atatgcataatcagcgccctg

SEQ ID NO: 3950831 - DNA, 16 bp, Homo sapiens
atatgccttatgtaat

SEQ ID NO: 3950832 - DNA, 12 bp, Homo sapiens
atatggaacctt

SEQ ID NO: 3950833 - DNA, 13 bp, Homo sapiens
atatggaaccttc

SEQ ID NO: 3950834 - DNA, 18 bp, Homo sapiens
atatggcaagaaagctgg

SEQ ID NO: 3950835 - DNA, 15 bp, Homo sapiens
atatggctataaata

SEQ ID NO: 3950836 - DNA, 16 bp, Homo sapiens
atatgtaaaataaaat

SEQ ID NO: 3950837 - DNA, 17 bp, Homo sapiens
atatgtagcagaaaggc

SEQ ID NO: 3950838 - DNA, 17 bp, Homo sapiens
atatgtaggtgtctgca

SEQ ID NO: 3950839 - DNA, 14 bp, Homo sapiens
atatgtatatgtat

SEQ ID NO: 3950840 - DNA, 15 bp, Homo sapiens
atatgtatatgtata

SEQ ID NO: 3950841 - DNA, 18 bp, Homo sapiens
atatgtatatgtatatat

SEQ ID NO: 3950842 - DNA, 19 bp, Homo sapiens
atatgtatgtctaattgag

SEQ ID NO: 3950843 - DNA, 20 bp, Homo sapiens
atatgtctcgctagtgatgt

SEQ ID NO: 3950844 - DNA, 21 bp, Homo sapiens
atatgtctcgctagtgatgtt

SEQ ID NO: 3950845 - DNA, 22 bp, Homo sapiens
atatgtctgcttctgtccagga

SEQ ID NO: 3950846 - DNA, 14 bp, Homo sapiens
atatgtctgtgtgt

SEQ ID NO: 3950847 - DNA, 11 bp, Homo sapiens
atatgtgcagt

SEQ ID NO: 3950848 - DNA, 16 bp, Homo sapiens
atatgtgtatatatac

SEQ ID NO: 3950849 - DNA, 18 bp, Homo sapiens
atatgtgtatatatacat

SEQ ID NO: 3950850 - DNA, 21 bp, Homo sapiens
atatgtgtatatatacataca

SEQ ID NO: 3950851 - DNA, 12 bp, Homo sapiens
atatgtgtgtgt

SEQ ID NO: 3950852 - DNA, 17 bp, Homo sapiens
atatgttaatttgttat

SEQ ID NO: 3950853 - DNA, 17 bp, Homo sapiens
atatgttgagtgttcat

SEQ ID NO: 3950854 - DNA, 11 bp, Homo sapiens
atatgttgtaa

SEQ ID NO: 3950855 - DNA, 13 bp, Homo sapiens
atatgtttgtgcc

SEQ ID NO: 3950856 - DNA, 23 bp, Homo sapiens
atattaaaaatatggaacttcta

SEQ ID NO: 3950857 - DNA, 13 bp, Homo sapiens
atattaaagtgtt

SEQ ID NO: 3950858 - DNA, 19 bp, Homo sapiens
atattaccaaaaaagtatt

SEQ ID NO: 3950859 - DNA, 15 bp, Homo sapiens
atattacctcaaatt

SEQ ID NO: 3950860 - DNA, 14 bp, Homo sapiens
atattataaataaa

SEQ ID NO: 3950861 - DNA, 15 bp, Homo sapiens
atattataaataaat

SEQ ID NO: 3950862 - DNA, 22 bp, Homo sapiens
atattataataatgttctctgg

SEQ ID NO: 3950863 - DNA, 17 bp, Homo sapiens
atattatggtgtaatgc

SEQ ID NO: 3950864 - DNA, 21 bp, Homo sapiens
atattatggtgtaatgcacaa

SEQ ID NO: 3950865 - DNA, 23 bp, Homo sapiens
atattatggtgtaatgcacaatt

SEQ ID NO: 3950866 - DNA, 11 bp, Homo sapiens
atattattggg

SEQ ID NO: 3950867 - DNA, 12 bp, Homo sapiens
atattattgggg

SEQ ID NO: 3950868 - DNA, 18 bp, Homo sapiens
atattcatgcttcttcct

SEQ ID NO: 3950869 - DNA, 14 bp, Homo sapiens
atattcatgtaata

SEQ ID NO: 3950870 - DNA, 16 bp, Homo sapiens
atattcatgtaataaa

SEQ ID NO: 3950871 - DNA, 17 bp, Homo sapiens
atattcatgtaataaat

SEQ ID NO: 3950872 - DNA, 21 bp, Homo sapiens
atattccgggtgccattccca

SEQ ID NO: 3950873 - DNA, 21 bp, Homo sapiens
atattcctgcatttgtgaaat

SEQ ID NO: 3950874 - DNA, 20 bp, Homo sapiens
atattctggaaaaaaaatat

SEQ ID NO: 3950875 - DNA, 22 bp, Homo sapiens
atattctggaaaaaaaatatat

SEQ ID NO: 3950876 - DNA, 20 bp, Homo sapiens
atattgtatattctggaaaa

SEQ ID NO: 3950877 - DNA, 12 bp, Homo sapiens
atattgtatgta

SEQ ID NO: 3950878 - DNA, 22 bp, Homo sapiens
atattgtcagagttctgctcta

SEQ ID NO: 3950879 - DNA, 12 bp, Homo sapiens
atattgtcagat

SEQ ID NO: 3950880 - DNA, 17 bp, Homo sapiens
atattgtcagatatttt

SEQ ID NO: 3950881 - DNA, 12 bp, Homo sapiens
atatttaaacag

SEQ ID NO: 3950882 - DNA, 22 bp, Homo sapiens
atatttaaaggggagatactct

SEQ ID NO: 3950883 - DNA, 13 bp, Homo sapiens
atatttaagtata

SEQ ID NO: 3950884 - DNA, 15 bp, Homo sapiens
atatttaagtttgtt

SEQ ID NO: 3950885 - DNA, 17 bp, Homo sapiens
atatttaatacctttgg

SEQ ID NO: 3950886 - DNA, 19 bp, Homo sapiens
atatttagattgttaaaat

SEQ ID NO: 3950887 - DNA, 14 bp, Homo sapiens
atatttaggcaaga

SEQ ID NO: 3950888 - DNA, 14 bp, Homo sapiens
atatttatactcta

SEQ ID NO: 3950889 - DNA, 15 bp, Homo sapiens
atatttatagtcaca

SEQ ID NO: 3950890 - DNA, 18 bp, Homo sapiens
atatttatgcttaaaata

SEQ ID NO: 3950891 - DNA, 19 bp, Homo sapiens
atatttatggggggagaac

SEQ ID NO: 3950892 - DNA, 21 bp, Homo sapiens
atatttatgtctatttaagcc

SEQ ID NO: 3950893 - DNA, 21 bp, Homo sapiens
atatttattttctttctgtaa

SEQ ID NO: 3950894 - DNA, 12 bp, Homo sapiens
atatttgaaatt

SEQ ID NO: 3950895 - DNA, 17 bp, Homo sapiens
atatttgaatatcatta

SEQ ID NO: 3950896 - DNA, 23 bp, Homo sapiens
atatttggcgatgaggtaattct

SEQ ID NO: 3950897 - DNA, 16 bp, Homo sapiens
atatttgtgtatgtgt

SEQ ID NO: 3950898 - DNA, 12 bp, Homo sapiens
atattttaactt

SEQ ID NO: 3950899 - DNA, 17 bp, Homo sapiens
atattttatcttgttct

SEQ ID NO: 3950900 - DNA, 20 bp, Homo sapiens
atattttcaacgcagccctg

SEQ ID NO: 3950901 - DNA, 23 bp, Homo sapiens
atattttcatgacttttccatgt

SEQ ID NO: 3950902 - DNA, 18 bp, Homo sapiens
atattttcattaaaagct

SEQ ID NO: 3950903 - DNA, 22 bp, Homo sapiens
atattttcctcccagttctaca

SEQ ID NO: 3950904 - DNA, 13 bp, Homo sapiens
atattttgtattt

SEQ ID NO: 3950905 - DNA, 13 bp, Homo sapiens
atatttttataga

SEQ ID NO: 3950906 - DNA, 19 bp, Homo sapiens
atatttttatagacaaata

SEQ ID NO: 3950907 - DNA, 21 bp, Homo sapiens
atatttttcaaccagcatttt

SEQ ID NO: 3950908 - DNA, 18 bp, Homo sapiens
atatttttggttgtcaat

SEQ ID NO: 3950909 - DNA, 22 bp, Homo sapiens
atatttttgtacgttatatatt

SEQ ID NO: 3950910 - DNA, 23 bp, Homo sapiens
atatttttgtacgttatatattg

SEQ ID NO: 3950911 - DNA, 11 bp, Homo sapiens
atcaaaaataa

SEQ ID NO: 3950912 - DNA, 14 bp, Homo sapiens
atcaaaaataaact

SEQ ID NO: 3950913 - DNA, 22 bp, Homo sapiens
atcaaaaataaactagtttcca

SEQ ID NO: 3950914 - DNA, 20 bp, Homo sapiens
atcaaaacatatcaattcaa

SEQ ID NO: 3950915 - DNA, 12 bp, Homo sapiens
atcaaaagacag

SEQ ID NO: 3950916 - DNA, 16 bp, Homo sapiens
atcaaaagctgcttga

SEQ ID NO: 3950917 - DNA, 21 bp, Homo sapiens
atcaaaatccctatttaattt

SEQ ID NO: 3950918 - DNA, 23 bp, Homo sapiens
atcaaagtaaaaaattaaagccc

SEQ ID NO: 3950919 - DNA, 15 bp, Homo sapiens
atcaaatatgcaaag

SEQ ID NO: 3950920 - DNA, 20 bp, Homo sapiens
atcaaatatgcaaagcactg

SEQ ID NO: 3950921 - DNA, 18 bp, Homo sapiens
atcaacaagagttgtctt

SEQ ID NO: 3950922 - DNA, 19 bp, Homo sapiens
atcaaccccagactcaaac

SEQ ID NO: 3950923 - DNA, 15 bp, Homo sapiens
atcaagaaagtgttg

SEQ ID NO: 3950924 - DNA, 22 bp, Homo sapiens
atcaagatgagagaactggagg

SEQ ID NO: 3950925 - DNA, 20 bp, Homo sapiens
atcaagcatgcaataatgtg

SEQ ID NO: 3950926 - DNA, 16 bp, Homo sapiens
atcaagctagaaggcc

SEQ ID NO: 3950927 - DNA, 20 bp, Homo sapiens
atcaagctagaaggccacat

SEQ ID NO: 3950928 - DNA, 19 bp, Homo sapiens
atcaatcatctgtgtgaaa

SEQ ID NO: 3950929 - DNA, 14 bp, Homo sapiens
atcaatcctgcccc

SEQ ID NO: 3950930 - DNA, 20 bp, Homo sapiens
atcaatcctgcccccagcca

SEQ ID NO: 3950931 - DNA, 22 bp, Homo sapiens
atcaatccttcttatgtttgct

SEQ ID NO: 3950932 - DNA, 15 bp, Homo sapiens
atcaattaattctta

SEQ ID NO: 3950933 - DNA, 15 bp, Homo sapiens
atcaattcaacacat

SEQ ID NO: 3950934 - DNA, 23 bp, Homo sapiens
atcaattcaacacattacttgca

SEQ ID NO: 3950935 - DNA, 24 bp, Homo sapiens
atcaattcaacacattacttgcac

SEQ ID NO: 3950936 - DNA, 19 bp, Homo sapiens
atcaatttaaaatcattca

SEQ ID NO: 3950937 - DNA, 13 bp, Homo sapiens
atcaatttttata

SEQ ID NO: 3950938 - DNA, 16 bp, Homo sapiens
atcaatttttatacat

SEQ ID NO: 3950939 - DNA, 16 bp, Homo sapiens
atcacaacaagaaatt

SEQ ID NO: 3950940 - DNA, 16 bp, Homo sapiens
atcacaagcaataatt

SEQ ID NO: 3950941 - DNA, 17 bp, Homo sapiens
atcacaagcaataatta

SEQ ID NO: 3950942 - DNA, 20 bp, Homo sapiens
atcacaagcaataattagga

SEQ ID NO: 3950943 - DNA, 15 bp, Homo sapiens
atcacacctctgggc

SEQ ID NO: 3950944 - DNA, 16 bp, Homo sapiens
atcacacctctgggct

SEQ ID NO: 3950945 - DNA, 14 bp, Homo sapiens
atcacagaggcttc

SEQ ID NO: 3950946 - DNA, 15 bp, Homo sapiens
atcacagaggcttct

SEQ ID NO: 3950947 - DNA, 20 bp, Homo sapiens
atcacagatgggtattaaac

SEQ ID NO: 3950948 - DNA, 22 bp, Homo sapiens
atcacagatgggtattaaactt

SEQ ID NO: 3950949 - DNA, 21 bp, Homo sapiens
atcacagggccccagaaggca

SEQ ID NO: 3950950 - DNA, 17 bp, Homo sapiens
atcacatacaatttgca

SEQ ID NO: 3950951 - DNA, 20 bp, Homo sapiens
atcacatacaatttgcactg

SEQ ID NO: 3950952 - DNA, 18 bp, Homo sapiens
atcacatcaagcatgcaa

SEQ ID NO: 3950953 - DNA, 21 bp, Homo sapiens
atcaccagcccggcctgctcc

SEQ ID NO: 3950954 - DNA, 21 bp, Homo sapiens
atcaccatgtaacaaccagag

SEQ ID NO: 3950955 - DNA, 15 bp, Homo sapiens
atcacccaggctgga

SEQ ID NO: 3950956 - DNA, 18 bp, Homo sapiens
atcacccagtcctggcca

SEQ ID NO: 3950957 - DNA, 20 bp, Homo sapiens
atcaccgagagtagccgaga

SEQ ID NO: 3950958 - DNA, 20 bp, Homo sapiens
atcacctctggctttgtctc

SEQ ID NO: 3950959 - DNA, 12 bp, Homo sapiens
atcacctggagg

SEQ ID NO: 3950960 - DNA, 14 bp, Homo sapiens
atcactccctggat

SEQ ID NO: 3950961 - DNA, 17 bp, Homo sapiens
atcactggagcaccagg

SEQ ID NO: 3950962 - DNA, 13 bp, Homo sapiens
atcactggatgaa

SEQ ID NO: 3950963 - DNA, 16 bp, Homo sapiens
atcactggcaatgaaa

SEQ ID NO: 3950964 - DNA, 23 bp, Homo sapiens
atcactggcaatgaaaaattctc

SEQ ID NO: 3950965 - DNA, 18 bp, Homo sapiens
atcactgtagtctaagac

SEQ ID NO: 3950966 - DNA, 23 bp, Homo sapiens
atcacttggggtcaccaccctcc

SEQ ID NO: 3950967 - DNA, 16 bp, Homo sapiens
atcacttgtaaataaa

SEQ ID NO: 3950968 - DNA, 18 bp, Homo sapiens
atcacttgtaaataaata

SEQ ID NO: 3950969 - DNA, 14 bp, Homo sapiens
atcacttgtacaaa

SEQ ID NO: 3950970 - DNA, 16 bp, Homo sapiens
atcacttgtacaaaat

SEQ ID NO: 3950971 - DNA, 18 bp, Homo sapiens
atcacttgtacaaaataa

SEQ ID NO: 3950972 - DNA, 14 bp, Homo sapiens
atcacttttcagtg

SEQ ID NO: 3950973 - DNA, 15 bp, Homo sapiens
atcagaaaagggaag

SEQ ID NO: 3950974 - DNA, 23 bp, Homo sapiens
atcagaaaagtagaattatatct

SEQ ID NO: 3950975 - DNA, 19 bp, Homo sapiens
atcagaaagggagggctct

SEQ ID NO: 3950976 - DNA, 22 bp, Homo sapiens
atcagaaagggagggctctgag

SEQ ID NO: 3950977 - DNA, 13 bp, Homo sapiens
atcagaacagcag

SEQ ID NO: 3950978 - DNA, 14 bp, Homo sapiens
atcagaacagcaga

SEQ ID NO: 3950979 - DNA, 14 bp, Homo sapiens
atcagaagataact

SEQ ID NO: 3950980 - DNA, 20 bp, Homo sapiens
atcagaaggctggggccagt

SEQ ID NO: 3950981 - DNA, 23 bp, Homo sapiens
atcagaaggctggggccagtgta

SEQ ID NO: 3950982 - DNA, 12 bp, Homo sapiens
atcagacctctg

SEQ ID NO: 3950983 - DNA, 12 bp, Homo sapiens
atcagcaccatg

SEQ ID NO: 3950984 - DNA, 12 bp, Homo sapiens
atcagcactgaa

SEQ ID NO: 3950985 - DNA, 15 bp, Homo sapiens
atcagcgtggccttg

SEQ ID NO: 3950986 - DNA, 16 bp, Homo sapiens
atcagcgtggccttgt

SEQ ID NO: 3950987 - DNA, 21 bp, Homo sapiens
atcagctacttaagagaaatg

SEQ ID NO: 3950988 - DNA, 19 bp, Homo sapiens
atcagcttttaataaaatt

SEQ ID NO: 3950989 - DNA, 17 bp, Homo sapiens
atcaggaagagaaggag

SEQ ID NO: 3950990 - DNA, 16 bp, Homo sapiens
atcaggcacaggcagg

SEQ ID NO: 3950991 - DNA, 19 bp, Homo sapiens
atcaggcacaggcaggaag

SEQ ID NO: 3950992 - DNA, 21 bp, Homo sapiens
atcaggcacaggcaggaagag

SEQ ID NO: 3950993 - DNA, 13 bp, Homo sapiens
atcaggcactggt

SEQ ID NO: 3950994 - DNA, 15 bp, Homo sapiens
atcaggctatgtatg

SEQ ID NO: 3950995 - DNA, 18 bp, Homo sapiens
atcaggcttggaatgaat

SEQ ID NO: 3950996 - DNA, 22 bp, Homo sapiens
atcagggcaggcttgccaccgg

SEQ ID NO: 3950997 - DNA, 15 bp, Homo sapiens
atcagtattaatact

SEQ ID NO: 3950998 - DNA, 17 bp, Homo sapiens
atcagtattaatactaa

SEQ ID NO: 3950999 - DNA, 16 bp, Homo sapiens
atcagtgcttaatgtg

SEQ ID NO: 3951000 - DNA, 16 bp, Homo sapiens
atcagttactcagccc

SEQ ID NO: 3951001 - DNA, 17 bp, Homo sapiens
atcagttttatccacag

SEQ ID NO: 3951002 - DNA, 16 bp, Homo sapiens
atcataggtatttcaa

SEQ ID NO: 3951003 - DNA, 19 bp, Homo sapiens
atcatatgacatgccaccc

SEQ ID NO: 3951004 - DNA, 12 bp, Homo sapiens
atcatcctcctt

SEQ ID NO: 3951005 - DNA, 20 bp, Homo sapiens
atcatcgaaaattcatttca

SEQ ID NO: 3951006 - DNA, 16 bp, Homo sapiens
atcatgaaacacttct

SEQ ID NO: 3951007 - DNA, 20 bp, Homo sapiens
atcatgcaagtgctatgcca

SEQ ID NO: 3951008 - DNA, 15 bp, Homo sapiens
atcatgcctctgagg

SEQ ID NO: 3951009 - DNA, 17 bp, Homo sapiens
atcatgcctctgaggcc

SEQ ID NO: 3951010 - DNA, 14 bp, Homo sapiens
atcatgctttaaag

SEQ ID NO: 3951011 - DNA, 17 bp, Homo sapiens
atcatgctttaaagtgt

SEQ ID NO: 3951012 - DNA, 19 bp, Homo sapiens
atcatgggaaaagaccagg

SEQ ID NO: 3951013 - DNA, 19 bp, Homo sapiens
atcatgttaatagacagta

SEQ ID NO: 3951014 - DNA, 22 bp, Homo sapiens
atcattataactgaaggagaag

SEQ ID NO: 3951015 - DNA, 17 bp, Homo sapiens
atcattctttcccctca

SEQ ID NO: 3951016 - DNA, 23 bp, Homo sapiens
atcattctttcccctcagagctc

SEQ ID NO: 3951017 - DNA, 13 bp, Homo sapiens
atcattgtagaaa

SEQ ID NO: 3951018 - DNA, 13 bp, Homo sapiens
atcatttgctttt

SEQ ID NO: 3951019 - DNA, 19 bp, Homo sapiens
atcattttgcctcttttct

SEQ ID NO: 3951020 - DNA, 11 bp, Homo sapiens
atccaaagtaa

SEQ ID NO: 3951021 - DNA, 14 bp, Homo sapiens
atccaaggagaaac

SEQ ID NO: 3951022 - DNA, 19 bp, Homo sapiens
atccaaggagaaacagaga

SEQ ID NO: 3951023 - DNA, 23 bp, Homo sapiens
atccaatctgctcagcaggccct

SEQ ID NO: 3951024 - DNA, 15 bp, Homo sapiens
atccacacacagagg

SEQ ID NO: 3951025 - DNA, 20 bp, Homo sapiens
atccacagactccctcccct

SEQ ID NO: 3951026 - DNA, 21 bp, Homo sapiens
atccacagactccctcccctg

SEQ ID NO: 3951027 - DNA, 17 bp, Homo sapiens
atccacagccaacaaac

SEQ ID NO: 3951028 - DNA, 21 bp, Homo sapiens
atccacagccaacaaacatag

SEQ ID NO: 3951029 - DNA, 19 bp, Homo sapiens
atccaccactttaacctta

SEQ ID NO: 3951030 - DNA, 13 bp, Homo sapiens
atccacccagccc

SEQ ID NO: 3951031 - DNA, 13 bp, Homo sapiens
atccacccagtgc

SEQ ID NO: 3951032 - DNA, 14 bp, Homo sapiens
atccacccagtgct

SEQ ID NO: 3951033 - DNA, 15 bp, Homo sapiens
atccacccagtgctg

SEQ ID NO: 3951034 - DNA, 18 bp, Homo sapiens
atccacccagtgctgcca

SEQ ID NO: 3951035 - DNA, 19 bp, Homo sapiens
atccacccagtgctgccat

SEQ ID NO: 3951036 - DNA, 21 bp, Homo sapiens
atccaccctatccctgtacag

SEQ ID NO: 3951037 - DNA, 22 bp, Homo sapiens
atccaccctatccctgtacaga

SEQ ID NO: 3951038 - DNA, 18 bp, Homo sapiens
atccaccctcaaatgtca

SEQ ID NO: 3951039 - DNA, 12 bp, Homo sapiens
atccactttgca

SEQ ID NO: 3951040 - DNA, 14 bp, Homo sapiens
atccagaaagaaaa

SEQ ID NO: 3951041 - DNA, 23 bp, Homo sapiens
atccagaactgaggtcactgggt

SEQ ID NO: 3951042 - DNA, 14 bp, Homo sapiens
atccagctgagtga

SEQ ID NO: 3951043 - DNA, 16 bp, Homo sapiens
atccaggtgggagaga

SEQ ID NO: 3951044 - DNA, 18 bp, Homo sapiens
atccagttgcaataaaat

SEQ ID NO: 3951045 - DNA, 22 bp, Homo sapiens
atccagttgcaataaaatagta

SEQ ID NO: 3951046 - DNA, 16 bp, Homo sapiens
atccataaggtgcagt

SEQ ID NO: 3951047 - DNA, 13 bp, Homo sapiens
atccatcctgcga

SEQ ID NO: 3951048 - DNA, 16 bp, Homo sapiens
atccatgtttgtaaaa

SEQ ID NO: 3951049 - DNA, 22 bp, Homo sapiens
atccattcctcagggacagaga

SEQ ID NO: 3951050 - DNA, 18 bp, Homo sapiens
atccatttggacaaaatg

SEQ ID NO: 3951051 - DNA, 18 bp, Homo sapiens
atcccaagcgtcccgtcc

SEQ ID NO: 3951052 - DNA, 19 bp, Homo sapiens
atcccaattcatttcatct

SEQ ID NO: 3951053 - DNA, 15 bp, Homo sapiens
atcccacagtggcac

SEQ ID NO: 3951054 - DNA, 14 bp, Homo sapiens
atcccacatgatct

SEQ ID NO: 3951055 - DNA, 17 bp, Homo sapiens
atcccacttcactgtga

SEQ ID NO: 3951056 - DNA, 22 bp, Homo sapiens
atcccactttctatagcagatt

SEQ ID NO: 3951057 - DNA, 15 bp, Homo sapiens
atcccagacccctct

SEQ ID NO: 3951058 - DNA, 20 bp, Homo sapiens
atcccagagcttcccaggat

SEQ ID NO: 3951059 - DNA, 21 bp, Homo sapiens
atcccagccctacccttgtta

SEQ ID NO: 3951060 - DNA, 18 bp, Homo sapiens
atcccagctactcaggag

SEQ ID NO: 3951061 - DNA, 23 bp, Homo sapiens
atcccaggaggggcctctgaaat

SEQ ID NO: 3951062 - DNA, 19 bp, Homo sapiens
atcccaggggaccacacct

SEQ ID NO: 3951063 - DNA, 20 bp, Homo sapiens
atcccatctaagctgcagct

SEQ ID NO: 3951064 - DNA, 16 bp, Homo sapiens
atccccaagctggcag

SEQ ID NO: 3951065 - DNA, 22 bp, Homo sapiens
atccccggctgcttccttctgc

SEQ ID NO: 3951066 - DNA, 16 bp, Homo sapiens
atcccctcgtcctgtc

SEQ ID NO: 3951067 - DNA, 17 bp, Homo sapiens
atcccctcgtcctgtcc

SEQ ID NO: 3951068 - DNA, 21 bp, Homo sapiens
atcccctcgtcctgtcccaga

SEQ ID NO: 3951069 - DNA, 12 bp, Homo sapiens
atcccctttcct

SEQ ID NO: 3951070 - DNA, 13 bp, Homo sapiens
atcccctttcctc

SEQ ID NO: 3951071 - DNA, 14 bp, Homo sapiens
atcccctttcctcc

SEQ ID NO: 3951072 - DNA, 12 bp, Homo sapiens
atccctccatcc

SEQ ID NO: 3951073 - DNA, 17 bp, Homo sapiens
atccctccatccggctc

SEQ ID NO: 3951074 - DNA, 18 bp, Homo sapiens
atccctcggaagccgtct

SEQ ID NO: 3951075 - DNA, 19 bp, Homo sapiens
atccctcggaagccgtctg

SEQ ID NO: 3951076 - DNA, 15 bp, Homo sapiens
atccctgggcccctc

SEQ ID NO: 3951077 - DNA, 16 bp, Homo sapiens
atccctgggcccctcc

SEQ ID NO: 3951078 - DNA, 17 bp, Homo sapiens
atccctgggcccctcca

SEQ ID NO: 3951079 - DNA, 21 bp, Homo sapiens
atccctgggcccctccacgcc

SEQ ID NO: 3951080 - DNA, 14 bp, Homo sapiens
atccctgggcctgc

SEQ ID NO: 3951081 - DNA, 22 bp, Homo sapiens
atccctgggcctgctgctgaga

SEQ ID NO: 3951082 - DNA, 15 bp, Homo sapiens
atccctgtttaatat

SEQ ID NO: 3951083 - DNA, 17 bp, Homo sapiens
atccctgtttaatattt

SEQ ID NO: 3951084 - DNA, 15 bp, Homo sapiens
atcccttcctcccca

SEQ ID NO: 3951085 - DNA, 17 bp, Homo sapiens
atcccttcctccccagt

SEQ ID NO: 3951086 - DNA, 13 bp, Homo sapiens
atccgcagcccag

SEQ ID NO: 3951087 - DNA, 12 bp, Homo sapiens
atccgctgccac

SEQ ID NO: 3951088 - DNA, 14 bp, Homo sapiens
atccgggacgcttc

SEQ ID NO: 3951089 - DNA, 21 bp, Homo sapiens
tttaaaccagcagaaaagtgc

SEQ ID NO: 3951090 - DNA, 23 bp, Homo sapiens
tttaaaccagcagaaaagtgctt

SEQ ID NO: 3951091 - DNA, 13 bp, Homo sapiens
tttaaagacttaa

SEQ ID NO: 3951092 - DNA, 20 bp, Homo sapiens
tttaaagttttatatgcata

SEQ ID NO: 3951093 - DNA, 12 bp, Homo sapiens
tttaaatcaaaa

SEQ ID NO: 3951094 - DNA, 18 bp, Homo sapiens
tttaaatgttgaaatctt

SEQ ID NO: 3951095 - DNA, 19 bp, Homo sapiens
tttaaattatactgtagct

SEQ ID NO: 3951096 - DNA, 21 bp, Homo sapiens
tttaaattcacaatagaaact

SEQ ID NO: 3951097 - DNA, 20 bp, Homo sapiens
tttaaatttttgtgaaccaa

SEQ ID NO: 3951098 - DNA, 19 bp, Homo sapiens
tttaacaaaacaagaaaga

SEQ ID NO: 3951099 - DNA, 19 bp, Homo sapiens
tttaacaactaatcaagag

SEQ ID NO: 3951100 - DNA, 23 bp, Homo sapiens
tttaacaatttcctttatattta

SEQ ID NO: 3951101 - DNA, 17 bp, Homo sapiens
tttaacagaaccagagg

SEQ ID NO: 3951102 - DNA, 19 bp, Homo sapiens
tttaactaatttaaaccag

SEQ ID NO: 3951103 - DNA, 13 bp, Homo sapiens
tttaagtatatag

SEQ ID NO: 3951104 - DNA, 10 bp, Homo sapiens
tttaagtcct

SEQ ID NO: 3951105 - DNA, 17 bp, Homo sapiens
tttaatacctttggaaa

SEQ ID NO: 3951106 - DNA, 19 bp, Homo sapiens
tttaatactcacctcctcc

SEQ ID NO: 3951107 - DNA, 15 bp, Homo sapiens
tttaatgacttttta

SEQ ID NO: 3951108 - DNA, 14 bp, Homo sapiens
tttaatgtacaagt

SEQ ID NO: 3951109 - DNA, 12 bp, Homo sapiens
tttaatgtttga

SEQ ID NO: 3951110 - DNA, 16 bp, Homo sapiens
tttaatgtttgattta

SEQ ID NO: 3951111 - DNA, 15 bp, Homo sapiens
tgcattgaatatatt

SEQ ID NO: 3951112 - DNA, 15 bp, Homo sapiens
tgcatttataaatgt

SEQ ID NO: 3951113 - DNA, 16 bp, Homo sapiens
tgcatttataaatgtg

SEQ ID NO: 3951114 - DNA, 14 bp, Homo sapiens
tgcatttcctgaca

SEQ ID NO: 3951115 - DNA, 24 bp, Homo sapiens
tgcatttctggaccctccacttca

SEQ ID NO: 3951116 - DNA, 18 bp, Homo sapiens
tgcatttgagagaagcca

SEQ ID NO: 3951117 - DNA, 23 bp, Homo sapiens
tgcatttgagagaagccacgctg

SEQ ID NO: 3951118 - DNA, 20 bp, Homo sapiens
tgccaaagcaaaagaagtaa

SEQ ID NO: 3951119 - DNA, 19 bp, Homo sapiens
tgccaacaccttcttggct

SEQ ID NO: 3951120 - DNA, 19 bp, Homo sapiens
tgccaacatacccttcttt

SEQ ID NO: 3951121 - DNA, 22 bp, Homo sapiens
tgccaacatacccttctttaaa

SEQ ID NO: 3951122 - DNA, 18 bp, Homo sapiens
tgccaactaagccctcga

SEQ ID NO: 3951123 - DNA, 15 bp, Homo sapiens
tgccaactggtcact

SEQ ID NO: 3951124 - DNA, 16 bp, Homo sapiens
tgccaactggtcactg

SEQ ID NO: 3951125 - DNA, 18 bp, Homo sapiens
tgccaactggtcactgtg

SEQ ID NO: 3951126 - DNA, 14 bp, Homo sapiens
tgccaagcactcga

SEQ ID NO: 3951127 - DNA, 22 bp, Homo sapiens
tgccaagcttgtgagagctggt

SEQ ID NO: 3951128 - DNA, 16 bp, Homo sapiens
tgccaagctttcttct

SEQ ID NO: 3951129 - DNA, 16 bp, Homo sapiens
tgccacaatgcctctc

SEQ ID NO: 3951130 - DNA, 17 bp, Homo sapiens
tgccacaatgcctctcc

SEQ ID NO: 3951131 - DNA, 17 bp, Homo sapiens
tgatttttttgttgttg

SEQ ID NO: 3951132 - DNA, 21 bp, Homo sapiens
tgcaaaagaagtttctggagc

SEQ ID NO: 3951133 - DNA, 14 bp, Homo sapiens
tgcaaacactgtgt

SEQ ID NO: 3951134 - DNA, 17 bp, Homo sapiens
tgcaaactttattttca

SEQ ID NO: 3951135 - DNA, 20 bp, Homo sapiens
tgcaaagtaaaaaaatatga

SEQ ID NO: 3951136 - DNA, 14 bp, Homo sapiens
tgcaaagtgccctc

SEQ ID NO: 3951137 - DNA, 13 bp, Homo sapiens
tgcaacctcacta

SEQ ID NO: 3951138 - DNA, 22 bp, Homo sapiens
tgcaagagacagagcccccaag

SEQ ID NO: 3951139 - DNA, 23 bp, Homo sapiens
tgcaagagacagagcccccaagc

SEQ ID NO: 3951140 - DNA, 17 bp, Homo sapiens
tgcaagagactctggcc

SEQ ID NO: 3951141 - DNA, 19 bp, Homo sapiens
tgcaagagactctggcctc

SEQ ID NO: 3951142 - DNA, 14 bp, Homo sapiens
tgcaagagccttgg

SEQ ID NO: 3951143 - DNA, 23 bp, Homo sapiens
tgcaagagccttggtgtccacct

SEQ ID NO: 3951144 - DNA, 17 bp, Homo sapiens
tgcaagatttaacacta

SEQ ID NO: 3951145 - DNA, 16 bp, Homo sapiens
tgcaagcagcctcctg

SEQ ID NO: 3951146 - DNA, 16 bp, Homo sapiens
tgcaagcagggctctg

SEQ ID NO: 3951147 - DNA, 13 bp, Homo sapiens
tgcaagccccagg

SEQ ID NO: 3951148 - DNA, 14 bp, Homo sapiens
tgcaagccccaggg

SEQ ID NO: 3951149 - DNA, 18 bp, Homo sapiens
tgcaagccccagggcctg

SEQ ID NO: 3951150 - DNA, 16 bp, Homo sapiens
tgagaaagactattca

SEQ ID NO: 3951151 - DNA, 18 bp, Homo sapiens
tgagaaagactattcaaa

SEQ ID NO: 3951152 - DNA, 20 bp, Homo sapiens
tgagaacaagtcacagctgc

SEQ ID NO: 3951153 - DNA, 23 bp, Homo sapiens
tgagaacaagtcacagctgcagc

SEQ ID NO: 3951154 - DNA, 21 bp, Homo sapiens
tgagaacccttcctttcccaa

SEQ ID NO: 3951155 - DNA, 18 bp, Homo sapiens
tgagaagaagctgaggat

SEQ ID NO: 3951156 - DNA, 15 bp, Homo sapiens
tgagaagagggcctg

SEQ ID NO: 3951157 - DNA, 20 bp, Homo sapiens
tgagaagagggcctgtggga

SEQ ID NO: 3951158 - DNA, 22 bp, Homo sapiens
tgagaaggagtcagaaactgtt

SEQ ID NO: 3951159 - DNA, 16 bp, Homo sapiens
tgagaatcaaaactct

SEQ ID NO: 3951160 - DNA, 16 bp, Homo sapiens
tgagaatcctgcctct

SEQ ID NO: 3951161 - DNA, 23 bp, Homo sapiens
tgagaatctatatttaacaagat

SEQ ID NO: 3951162 - DNA, 22 bp, Homo sapiens
tgagaatgcccaactcttcatt

SEQ ID NO: 3951163 - DNA, 20 bp, Homo sapiens
tgagaattattcctttccta

SEQ ID NO: 3951164 - DNA, 19 bp, Homo sapiens
tgagacaagccctggcaac

SEQ ID NO: 3951165 - DNA, 12 bp, Homo sapiens
tgagaccacctc

SEQ ID NO: 3951166 - DNA, 19 bp, Homo sapiens
tgagaccacctctcaatat

SEQ ID NO: 3951167 - DNA, 12 bp, Homo sapiens
tgagacctcagc

SEQ ID NO: 3951168 - DNA, 18 bp, Homo sapiens
tgtgcaccttacattcct

SEQ ID NO: 3951169 - DNA, 21 bp, Homo sapiens
tgtgcaccttaccaactttct

SEQ ID NO: 3951170 - DNA, 15 bp, Homo sapiens
tgtgcagcagcccag

SEQ ID NO: 3951171 - DNA, 16 bp, Homo sapiens
tgtgcagcagcccagc

SEQ ID NO: 3951172 - DNA, 20 bp, Homo sapiens
tgtgcagcagcccagcttcc

SEQ ID NO: 3951173 - DNA, 22 bp, Homo sapiens
tgtgcagcagcccagcttcctg

SEQ ID NO: 3951174 - DNA, 21 bp, Homo sapiens
tgtgcagtcccgtggagggta

SEQ ID NO: 3951175 - DNA, 12 bp, Homo sapiens
tgtgcatgtgtg

SEQ ID NO: 3951176 - DNA, 18 bp, Homo sapiens
tgtgcatgtgtgtataag

SEQ ID NO: 3951177 - DNA, 17 bp, Homo sapiens
tgtgcatgtgtgtgtct

SEQ ID NO: 3951178 - DNA, 21 bp, Homo sapiens
tgtgcatgtgtgtgtctgtct

SEQ ID NO: 3951179 - DNA, 13 bp, Homo sapiens
tgtgccaacctga

SEQ ID NO: 3951180 - DNA, 14 bp, Homo sapiens
tgtgccagagcctg

SEQ ID NO: 3951181 - DNA, 15 bp, Homo sapiens
tgtgccagagcctgg

SEQ ID NO: 3951182 - DNA, 18 bp, Homo sapiens
tgtgccagagcctggggc

SEQ ID NO: 3951183 - DNA, 14 bp, Homo sapiens
tgtgccagctcagg

SEQ ID NO: 3951184 - DNA, 22 bp, Homo sapiens
tgtgccatagagtttaacacaa

SEQ ID NO: 3951185 - DNA, 17 bp, Homo sapiens
tgtgcccacatcccagg

SEQ ID NO: 3951186 - DNA, 21 bp, Homo sapiens
tgtgcccacatcccaggcttc

SEQ ID NO: 3951187 - DNA, 15 bp, Homo sapiens
tgtgccctgccttca

SEQ ID NO: 3951188 - DNA, 20 bp, Homo sapiens
tgtgcctcgctccccactct

SEQ ID NO: 3951189 - DNA, 21 bp, Homo sapiens
tgtgcctcgctccccactctg

SEQ ID NO: 3951190 - DNA, 22 bp, Homo sapiens
tgtgcctgccctggagggaggc

SEQ ID NO: 3951191 - DNA, 13 bp, Homo sapiens
tgtgcctgctaga

SEQ ID NO: 3951192 - DNA, 20 bp, Homo sapiens
tgtgcctgctagagcaaccc

SEQ ID NO: 3951193 - DNA, 18 bp, Homo sapiens
tgtgccttaaaaggagag

SEQ ID NO: 3951194 - DNA, 16 bp, Homo sapiens
tgtgcgtgcgtgtgtg

SEQ ID NO: 3951195 - DNA, 15 bp, Homo sapiens
tgtgctactttgcct

SEQ ID NO: 3951196 - DNA, 15 bp, Homo sapiens
tgtgctataaatcct

SEQ ID NO: 3951197 - DNA, 19 bp, Homo sapiens
tgtgctgaattctgcaatg

SEQ ID NO: 3951198 - DNA, 23 bp, Homo sapiens
tgtgctgagaatagtgtctgatt

SEQ ID NO: 3951199 - DNA, 20 bp, Homo sapiens
tgtgctgaggactccctcca

SEQ ID NO: 3951200 - DNA, 17 bp, Homo sapiens
tgtgctgtgcctgctag

SEQ ID NO: 3951201 - DNA, 12 bp, Homo sapiens
tgtgctgtgggc

SEQ ID NO: 3951202 - DNA, 14 bp, Homo sapiens
tgtgctgtgggcag

SEQ ID NO: 3951203 - DNA, 16 bp, Homo sapiens
tgtgctgtgggcagca

SEQ ID NO: 3951204 - DNA, 15 bp, Homo sapiens
tgtgcttacagtgac

SEQ ID NO: 3951205 - DNA, 16 bp, Homo sapiens
tgtgcttacagtgact

SEQ ID NO: 3951206 - DNA, 12 bp, Homo sapiens
tgtgcttcccta

SEQ ID NO: 3951207 - DNA, 19 bp, Homo sapiens
tgtgcttccctaggctgag

SEQ ID NO: 3951208 - DNA, 17 bp, Homo sapiens
tgtggaaaatgaaaatt

SEQ ID NO: 3951209 - DNA, 21 bp, Homo sapiens
tgtggaatggattatagagta

SEQ ID NO: 3951210 - DNA, 22 bp, Homo sapiens
tgtggaatggattatagagtat

SEQ ID NO: 3951211 - DNA, 16 bp, Homo sapiens
tgtggactttgttcac

SEQ ID NO: 3951212 - DNA, 12 bp, Homo sapiens
tgtggaggcctg

SEQ ID NO: 3951213 - DNA, 13 bp, Homo sapiens
tgtggaggcctga

SEQ ID NO: 3951214 - DNA, 21 bp, Homo sapiens
tgtggaggtacactcttatag

SEQ ID NO: 3951215 - DNA, 17 bp, Homo sapiens
tgtggataagggagagt

SEQ ID NO: 3951216 - DNA, 19 bp, Homo sapiens
tgtggatgctccagggcag

SEQ ID NO: 3951217 - DNA, 19 bp, Homo sapiens
tgtggatgtgtaaatggag

SEQ ID NO: 3951218 - DNA, 18 bp, Homo sapiens
tgtggattccagcatttg

SEQ ID NO: 3951219 - DNA, 20 bp, Homo sapiens
tgtggcagaccgggggccag

SEQ ID NO: 3951220 - DNA, 15 bp, Homo sapiens
tgtggccagagctgg

SEQ ID NO: 3951221 - DNA, 20 bp, Homo sapiens
tgtggccagggtgagagctg

SEQ ID NO: 3951222 - DNA, 17 bp, Homo sapiens
tgtggccccaggtgcca

SEQ ID NO: 3951223 - DNA, 20 bp, Homo sapiens
tgtggccctggcctgctggg

SEQ ID NO: 3951224 - DNA, 23 bp, Homo sapiens
tgtggcctcacttccctgggaac

SEQ ID NO: 3951225 - DNA, 12 bp, Homo sapiens
tgtggcctcagc

SEQ ID NO: 3951226 - DNA, 17 bp, Homo sapiens
tgtggcctcagccctca

SEQ ID NO: 3951227 - DNA, 13 bp, Homo sapiens
tgtggcctgtgtc

SEQ ID NO: 3951228 - DNA, 21 bp, Homo sapiens
tgtggctcctgggggttcttt

SEQ ID NO: 3951229 - DNA, 12 bp, Homo sapiens
tgtgggagcctc

SEQ ID NO: 3951230 - DNA, 21 bp, Homo sapiens
tgtgggagggagcagacagga

SEQ ID NO: 3951231 - DNA, 15 bp, Homo sapiens
tgtgggcagcaccct

SEQ ID NO: 3951232 - DNA, 17 bp, Homo sapiens
tgtgggcagcaccctcc

SEQ ID NO: 3951233 - DNA, 23 bp, Homo sapiens
tgtggggaaccaattgctttgtc

SEQ ID NO: 3951234 - DNA, 15 bp, Homo sapiens
tgtgggtacatgtga

SEQ ID NO: 3951235 - DNA, 17 bp, Homo sapiens
tgtgggtgatcagaagg

SEQ ID NO: 3951236 - DNA, 22 bp, Homo sapiens
tgtggtgggttctttggaagga

SEQ ID NO: 3951237 - DNA, 13 bp, Homo sapiens
tgtggtgtaattt

SEQ ID NO: 3951238 - DNA, 21 bp, Homo sapiens
tgtggttcctaagcctgttgc

SEQ ID NO: 3951239 - DNA, 23 bp, Homo sapiens
tgtggttcctaagcctgttgctg

SEQ ID NO: 3951240 - DNA, 9 bp, Homo sapiens
tgtgtaaat

SEQ ID NO: 3951241 - DNA, 10 bp, Homo sapiens
tgtgtaaatg

SEQ ID NO: 3951242 - DNA, 14 bp, Homo sapiens
tgtgtaataagaaa

SEQ ID NO: 3951243 - DNA, 15 bp, Homo sapiens
tgtgtaataagaaag

SEQ ID NO: 3951244 - DNA, 18 bp, Homo sapiens
tgtgtaatagaaaactga

SEQ ID NO: 3951245 - DNA, 21 bp, Homo sapiens
tgtgtaatagaaaactgaaaa

SEQ ID NO: 3951246 - DNA, 17 bp, Homo sapiens
tgtgtagctttgctctt

SEQ ID NO: 3951247 - DNA, 15 bp, Homo sapiens
tgtgtatatatacat

SEQ ID NO: 3951248 - DNA, 18 bp, Homo sapiens
tgtgtatatatgtgtata

SEQ ID NO: 3951249 - DNA, 18 bp, Homo sapiens
tgtgtatgtatacacaca

SEQ ID NO: 3951250 - DNA, 16 bp, Homo sapiens
tgtgtatgtgtattta

SEQ ID NO: 3951251 - DNA, 15 bp, Homo sapiens
tgtgtattctggctg

SEQ ID NO: 3951252 - DNA, 14 bp, Homo sapiens
tgtgtcacagctct

SEQ ID NO: 3951253 - DNA, 17 bp, Homo sapiens
tgtgtcacagctctgta

SEQ ID NO: 3951254 - DNA, 13 bp, Homo sapiens
tgtgtccagcagc

SEQ ID NO: 3951255 - DNA, 18 bp, Homo sapiens
tgtgtccttgcacctgca

SEQ ID NO: 3951256 - DNA, 16 bp, Homo sapiens
tgtgtctcgtctcctg

SEQ ID NO: 3951257 - DNA, 18 bp, Homo sapiens
tgtgtgaattctgcaact

SEQ ID NO: 3951258 - DNA, 17 bp, Homo sapiens
tgtgtgatgaactttct

SEQ ID NO: 3951259 - DNA, 17 bp, Homo sapiens
tgtgtgcaccttaccaa

SEQ ID NO: 3951260 - DNA, 12 bp, Homo sapiens
tgtgtgcatgta

SEQ ID NO: 3951261 - DNA, 14 bp, Homo sapiens
tgtgtgcatgtgag

SEQ ID NO: 3951262 - DNA, 24 bp, Homo sapiens
tgtgtgccatagagtttaacacaa

SEQ ID NO: 3951263 - DNA, 22 bp, Homo sapiens
tgtgtggagctcgctaaagtca

SEQ ID NO: 3951264 - DNA, 20 bp, Homo sapiens
tgtgtgggtctggggaggga

SEQ ID NO: 3951265 - DNA, 16 bp, Homo sapiens
tgtgtggtatatttgt

SEQ ID NO: 3951266 - DNA, 16 bp, Homo sapiens
tgtgtggtgtgtgtgc

SEQ ID NO: 3951267 - DNA, 18 bp, Homo sapiens
tgtgtgtatgtatacaca

SEQ ID NO: 3951268 - DNA, 16 bp, Homo sapiens
tgtgtgtctcacccct

SEQ ID NO: 3951269 - DNA, 21 bp, Homo sapiens
tgtgtgtctgtctttgtggga

SEQ ID NO: 3951270 - DNA, 14 bp, Homo sapiens
tgtgtgtgtgcatg

SEQ ID NO: 3951271 - DNA, 11 bp, Homo sapiens
tgtgtgtgtgt

SEQ ID NO: 3951272 - DNA, 12 bp, Homo sapiens
tgtgtgtgtgtg

SEQ ID NO: 3951273 - DNA, 13 bp, Homo sapiens
tgtgtgtgtgtgc

SEQ ID NO: 3951274 - DNA, 13 bp, Homo sapiens
tgtgtgtgtgtgt

SEQ ID NO: 3951275 - DNA, 15 bp, Homo sapiens
tgtgtgtgtgtgtgc

SEQ ID NO: 3951276 - DNA, 23 bp, Homo sapiens
tgtgtgttctgtaatggaactga

SEQ ID NO: 3951277 - DNA, 16 bp, Homo sapiens
tgtgtgtttaaataaa

SEQ ID NO: 3951278 - DNA, 20 bp, Homo sapiens
tgtgttaaacatgctaaata

SEQ ID NO: 3951279 - DNA, 13 bp, Homo sapiens
tgtgttgaacaca

SEQ ID NO: 3951280 - DNA, 20 bp, Homo sapiens
tgtgttgtacaataccagat

SEQ ID NO: 3951281 - DNA, 15 bp, Homo sapiens
tgtgtttaaataaag

SEQ ID NO: 3951282 - DNA, 18 bp, Homo sapiens
tgtgtttaaataaagtat

SEQ ID NO: 3951283 - DNA, 17 bp, Homo sapiens
tgtgtttatgtgagctg

SEQ ID NO: 3951284 - DNA, 21 bp, Homo sapiens
tgtgtttccagatcgatcctg

SEQ ID NO: 3951285 - DNA, 21 bp, Homo sapiens
tgtgtttttgctatcacacag

SEQ ID NO: 3951286 - DNA, 12 bp, Homo sapiens
tgttaaaataac

SEQ ID NO: 3951287 - DNA, 17 bp, Homo sapiens
tgttaaaatagacaact

SEQ ID NO: 3951288 - DNA, 18 bp, Homo sapiens
tgttaaaatgtacactgg

SEQ ID NO: 3951289 - DNA, 21 bp, Homo sapiens
tgttaattactatattttaga

SEQ ID NO: 3951290 - DNA, 20 bp, Homo sapiens
tgttaattcagcactgattt

SEQ ID NO: 3951291 - DNA, 16 bp, Homo sapiens
tgttaatttgttatgt

SEQ ID NO: 3951292 - DNA, 17 bp, Homo sapiens
tgttaatttgttatgta

SEQ ID NO: 3951293 - DNA, 17 bp, Homo sapiens
tgttacataacaagaaa

SEQ ID NO: 3951294 - DNA, 22 bp, Homo sapiens
tgttacctttcccatgctgaat

SEQ ID NO: 3951295 - DNA, 17 bp, Homo sapiens
tgttactgttgcactga

SEQ ID NO: 3951296 - DNA, 13 bp, Homo sapiens
tgttactttggaa

SEQ ID NO: 3951297 - DNA, 21 bp, Homo sapiens
tgttagcccaaggttaaaaag

SEQ ID NO: 3951298 - DNA, 21 bp, Homo sapiens
tgttaggaggctgcatgctct

SEQ ID NO: 3951299 - DNA, 18 bp, Homo sapiens
tgttagtgtgtgtgcatg

SEQ ID NO: 3951300 - DNA, 20 bp, Homo sapiens
tgttagtgtgtgtgcatgtg

SEQ ID NO: 3951301 - DNA, 14 bp, Homo sapiens
tgttatccacaagc

SEQ ID NO: 3951302 - DNA, 22 bp, Homo sapiens
tgttatcctgctagctgtagaa

SEQ ID NO: 3951303 - DNA, 12 bp, Homo sapiens
tgttatgctatt

SEQ ID NO: 3951304 - DNA, 21 bp, Homo sapiens
tgttattgcactatgaaaatc

SEQ ID NO: 3951305 - DNA, 14 bp, Homo sapiens
tgttattttcagta

SEQ ID NO: 3951306 - DNA, 16 bp, Homo sapiens
tgttcacagccagact

SEQ ID NO: 3951307 - DNA, 15 bp, Homo sapiens
tgttcaccttatgta

SEQ ID NO: 3951308 - DNA, 17 bp, Homo sapiens
tgttcaccttatgtatt

SEQ ID NO: 3951309 - DNA, 16 bp, Homo sapiens
tgttcacttttcctcc

SEQ ID NO: 3951310 - DNA, 23 bp, Homo sapiens
tgttcatgagtggatggatggac

SEQ ID NO: 3951311 - DNA, 16 bp, Homo sapiens
tgttccagctgcctgg

SEQ ID NO: 3951312 - DNA, 22 bp, Homo sapiens
tgttcccaagagcatcatgcct

SEQ ID NO: 3951313 - DNA, 16 bp, Homo sapiens
tgttcccattcttgca

SEQ ID NO: 3951314 - DNA, 12 bp, Homo sapiens
tgttccctgcac

SEQ ID NO: 3951315 - DNA, 23 bp, Homo sapiens
tgtttggggtgtttcaaaagtgg

SEQ ID NO: 3951316 - DNA, 23 bp, Homo sapiens
tgtttgtagccaatacatggtgt

SEQ ID NO: 3951317 - DNA, 15 bp, Homo sapiens
tgtttgtctggattg

SEQ ID NO: 3951318 - DNA, 22 bp, Homo sapiens
tgttttaaatacgcactacatg

SEQ ID NO: 3951319 - DNA, 22 bp, Homo sapiens
tgttttaaatttatttcaaaaa

SEQ ID NO: 3951320 - DNA, 21 bp, Homo sapiens
tgttttacaagaattgtccat

SEQ ID NO: 3951321 - DNA, 11 bp, Homo sapiens
tgttttccaca

SEQ ID NO: 3951322 - DNA, 23 bp, Homo sapiens
tgttttctaaagttgttcacata

SEQ ID NO: 3951323 - DNA, 12 bp, Homo sapiens
tgttttcttcaa

SEQ ID NO: 3951324 - DNA, 17 bp, Homo sapiens
tgttttgacggatgatt

SEQ ID NO: 3951325 - DNA, 22 bp, Homo sapiens
tgttttgcacgtcttgctattt

SEQ ID NO: 3951326 - DNA, 13 bp, Homo sapiens
tgttttgcactga

SEQ ID NO: 3951327 - DNA, 15 bp, Homo sapiens
tgttttgcactgaca

SEQ ID NO: 3951328 - DNA, 18 bp, Homo sapiens
tgttttggtgcctgcctc

SEQ ID NO: 3951329 - DNA, 15 bp, Homo sapiens
tgttttgtacaatta

SEQ ID NO: 3951330 - DNA, 22 bp, Homo sapiens
tgtttttcaatctcatctgata

SEQ ID NO: 3951331 - DNA, 19 bp, Homo sapiens
tgttttttgaaaacatggt

SEQ ID NO: 3951332 - DNA, 18 bp, Homo sapiens
tgttttttttttccactt

SEQ ID NO: 3951333 - DNA, 10 bp, Homo sapiens
ttaaaaaagc

SEQ ID NO: 3951334 - DNA, 12 bp, Homo sapiens
ttaaaaaataaa

SEQ ID NO: 3951335 - DNA, 22 bp, Homo sapiens
ttaaaaaataaaaaaatacagt

SEQ ID NO: 3951336 - DNA, 12 bp, Homo sapiens
ttaaaaaatgaa

SEQ ID NO: 3951337 - DNA, 16 bp, Homo sapiens
ttaaaaaatgaaaata

SEQ ID NO: 3951338 - DNA, 14 bp, Homo sapiens
ttaaaaacaggaaa

SEQ ID NO: 3951339 - DNA, 22 bp, Homo sapiens
ttaaaaatatggaacttctaat

SEQ ID NO: 3951340 - DNA, 14 bp, Homo sapiens
ttaaaacatgcacg

SEQ ID NO: 3951341 - DNA, 13 bp, Homo sapiens
ttaaaaccatgca

SEQ ID NO: 3951342 - DNA, 16 bp, Homo sapiens
ttaaaaccatgcagct

SEQ ID NO: 3951343 - DNA, 20 bp, Homo sapiens
ttaaaaccatgcagcttcat

SEQ ID NO: 3951344 - DNA, 23 bp, Homo sapiens
ttaaaaccatgcagcttcatcaa

SEQ ID NO: 3951345 - DNA, 18 bp, Homo sapiens
ttaaaacctagaacttca

SEQ ID NO: 3951346 - DNA, 15 bp, Homo sapiens
ttaaaactatccaat

SEQ ID NO: 3951347 - DNA, 22 bp, Homo sapiens
ttaaaactatccaattaaaatt

SEQ ID NO: 3951348 - DNA, 14 bp, Homo sapiens
ttaaaagaagactg

SEQ ID NO: 3951349 - DNA, 18 bp, Homo sapiens
ttaaaagaagactggaag

SEQ ID NO: 3951350 - DNA, 21 bp, Homo sapiens
ttaaaagaatattttaacttc

SEQ ID NO: 3951351 - DNA, 22 bp, Homo sapiens
ttaaaagaatattttaacttcc

SEQ ID NO: 3951352 - DNA, 23 bp, Homo sapiens
ttaaaagacatttttatttagtt

SEQ ID NO: 3951353 - DNA, 18 bp, Homo sapiens
ttaaaagatgaaaatatt

SEQ ID NO: 3951354 - DNA, 15 bp, Homo sapiens
ttaaaataactagtg

SEQ ID NO: 3951355 - DNA, 13 bp, Homo sapiens
ttaaaatatatat

SEQ ID NO: 3951356 - DNA, 20 bp, Homo sapiens
ttaaaatatgtatgtctaat

SEQ ID NO: 3951357 - DNA, 12 bp, Homo sapiens
ttaaaatatttt

SEQ ID NO: 3951358 - DNA, 15 bp, Homo sapiens
ttaaaatcattcaat

SEQ ID NO: 3951359 - DNA, 13 bp, Homo sapiens
ttaaaatctggaa

SEQ ID NO: 3951360 - DNA, 15 bp, Homo sapiens
ttaaaatctggaaat

SEQ ID NO: 3951361 - DNA, 16 bp, Homo sapiens
ttaaaatgattgtaaa

SEQ ID NO: 3951362 - DNA, 23 bp, Homo sapiens
ttaaacagtgagcctgaattttg

SEQ ID NO: 3951363 - DNA, 15 bp, Homo sapiens
ttaaaccagcagaaa

SEQ ID NO: 3951364 - DNA, 18 bp, Homo sapiens
ttaaaccagcagaaaagt

SEQ ID NO: 3951365 - DNA, 21 bp, Homo sapiens
ttaaaccagtttagatttcaa

SEQ ID NO: 3951366 - DNA, 16 bp, Homo sapiens
ttaaacgagataatgt

SEQ ID NO: 3951367 - DNA, 16 bp, Homo sapiens
ttaaagagcatggaaa

SEQ ID NO: 3951368 - DNA, 12 bp, Homo sapiens
ttaaagatgtgt

SEQ ID NO: 3951369 - DNA, 18 bp, Homo sapiens
ttaaagcaacattttatt

SEQ ID NO: 3951370 - DNA, 17 bp, Homo sapiens
ttaaagctgcctgtagt

SEQ ID NO: 3951371 - DNA, 12 bp, Homo sapiens
ttaaaggaagga

SEQ ID NO: 3951372 - DNA, 18 bp, Homo sapiens
ttaaaggcaccatctaat

SEQ ID NO: 3951373 - DNA, 21 bp, Homo sapiens
ttaaaggggcagaaaaactct

SEQ ID NO: 3951374 - DNA, 16 bp, Homo sapiens
ttaaaggtagagatgt

SEQ ID NO: 3951375 - DNA, 13 bp, Homo sapiens
ttaaagtatatat

SEQ ID NO: 3951376 - DNA, 17 bp, Homo sapiens
ttaaataaagtatcatg

SEQ ID NO: 3951377 - DNA, 17 bp, Homo sapiens
ttaaatacagacactaa

SEQ ID NO: 3951378 - DNA, 19 bp, Homo sapiens
ttaaatcaaaagctgcttg

SEQ ID NO: 3951379 - DNA, 22 bp, Homo sapiens
ttaaatggtgggaaccctcccc

SEQ ID NO: 3951380 - DNA, 17 bp, Homo sapiens
ttaaatgttgaaatctt

SEQ ID NO: 3951381 - DNA, 19 bp, Homo sapiens
ttaaattgcttttgttgtg

SEQ ID NO: 3951382 - DNA, 18 bp, Homo sapiens
ttaaattttaagcttgaa

SEQ ID NO: 3951383 - DNA, 16 bp, Homo sapiens
ttaaattttaaggtag

SEQ ID NO: 3951384 - DNA, 16 bp, Homo sapiens
ttaaatttttgtcatt

SEQ ID NO: 3951385 - DNA, 20 bp, Homo sapiens
ttaacaaaacaagaaagaaa

SEQ ID NO: 3951386 - DNA, 18 bp, Homo sapiens
ttaacaaaatattctgta

SEQ ID NO: 3951387 - DNA, 16 bp, Homo sapiens
ttaacacaagtcctgt

SEQ ID NO: 3951388 - DNA, 16 bp, Homo sapiens
ttaacagaaccagagg

SEQ ID NO: 3951389 - DNA, 17 bp, Homo sapiens
ttaacatctattataaa

SEQ ID NO: 3951390 - DNA, 17 bp, Homo sapiens
ttaaccagtacttctaa

SEQ ID NO: 3951391 - DNA, 16 bp, Homo sapiens
ttaaccctctcttccc

SEQ ID NO: 3951392 - DNA, 18 bp, Homo sapiens
ttaacctgaattattcca

SEQ ID NO: 3951393 - DNA, 19 bp, Homo sapiens
ttaacggctccaggatttt

SEQ ID NO: 3951394 - DNA, 17 bp, Homo sapiens
ttaacgggcatgtatta

SEQ ID NO: 3951395 - DNA, 18 bp, Homo sapiens
ttaacgggcatgtattat

SEQ ID NO: 3951396 - DNA, 15 bp, Homo sapiens
ttaactaatttaaac

SEQ ID NO: 3951397 - DNA, 16 bp, Homo sapiens
ttaactaatttaaacc

SEQ ID NO: 3951398 - DNA, 19 bp, Homo sapiens
ttaactaatttaaaccagc

SEQ ID NO: 3951399 - DNA, 15 bp, Homo sapiens
ttaactatgtgatgt

SEQ ID NO: 3951400 - DNA, 16 bp, Homo sapiens
ttaactatgtgatgtt

SEQ ID NO: 3951401 - DNA, 19 bp, Homo sapiens
ttaactatgtgatgttaac

SEQ ID NO: 3951402 - DNA, 15 bp, Homo sapiens
ttacctttcccatgc

SEQ ID NO: 3951403 - DNA, 18 bp, Homo sapiens
ttaccttttctgttgtac

SEQ ID NO: 3951404 - DNA, 15 bp, Homo sapiens
ttacgtgagccaggt

SEQ ID NO: 3951405 - DNA, 12 bp, Homo sapiens
ttactaaaagaa

SEQ ID NO: 3951406 - DNA, 15 bp, Homo sapiens
ttactaaattgtata

SEQ ID NO: 3951407 - DNA, 19 bp, Homo sapiens
ttactaaattgtatacatt

SEQ ID NO: 3951408 - DNA, 17 bp, Homo sapiens
ttactaagccacaagaa

SEQ ID NO: 3951409 - DNA, 14 bp, Homo sapiens
ttactcagccctgg

SEQ ID NO: 3951410 - DNA, 18 bp, Homo sapiens
ttactcccttcctggcct

SEQ ID NO: 3951411 - DNA, 22 bp, Homo sapiens
ttactcctttgcattccatgat

SEQ ID NO: 3951412 - DNA, 21 bp, Homo sapiens
ttactctatgccccaaatata

SEQ ID NO: 3951413 - DNA, 16 bp, Homo sapiens
ttactctgagcccagg

SEQ ID NO: 3951414 - DNA, 17 bp, Homo sapiens
ttactctgagcccaggc

SEQ ID NO: 3951415 - DNA, 22 bp, Homo sapiens
ttactctgcggtggtgccagag

SEQ ID NO: 3951416 - DNA, 23 bp, Homo sapiens
ttactctgcggtggtgccagagg

SEQ ID NO: 3951417 - DNA, 21 bp, Homo sapiens
ttactgcatggggaaagagat

SEQ ID NO: 3951418 - DNA, 12 bp, Homo sapiens
ttactgcctttg

SEQ ID NO: 3951419 - DNA, 23 bp, Homo sapiens
ttactgtctggttttaacaattt

SEQ ID NO: 3951420 - DNA, 12 bp, Homo sapiens
ttacttgaactt

SEQ ID NO: 3951421 - DNA, 14 bp, Homo sapiens
ttacttgacctcct

SEQ ID NO: 3951422 - DNA, 13 bp, Homo sapiens
ttacttgcacaag

SEQ ID NO: 3951423 - DNA, 19 bp, Homo sapiens
ttacttgcattgaatatat

SEQ ID NO: 3951424 - DNA, 13 bp, Homo sapiens
ttactttattaga

SEQ ID NO: 3951425 - DNA, 18 bp, Homo sapiens
ttacttttgtcttcctca

SEQ ID NO: 3951426 - DNA, 20 bp, Homo sapiens
ttacttttgttctgtatttt

SEQ ID NO: 3951427 - DNA, 18 bp, Homo sapiens
ttagaaaccttaatatgt

SEQ ID NO: 3951428 - DNA, 13 bp, Homo sapiens
ttagaaagttatt

SEQ ID NO: 3951429 - DNA, 19 bp, Homo sapiens
ttagaaatcattgtagaaa

SEQ ID NO: 3951430 - DNA, 20 bp, Homo sapiens
ttagaacaggcaagtgaaga

SEQ ID NO: 3951431 - DNA, 22 bp, Homo sapiens
ttagaacaggcaagtgaagaaa

SEQ ID NO: 3951432 - DNA, 13 bp, Homo sapiens
ttagaacctttct

SEQ ID NO: 3951433 - DNA, 15 bp, Homo sapiens
ttagaataaaattgt

SEQ ID NO: 3951434 - DNA, 13 bp, Homo sapiens
ttagaatgaaaat

SEQ ID NO: 3951435 - DNA, 21 bp, Homo sapiens
ttagaatgattccctcttgct

SEQ ID NO: 3951436 - DNA, 19 bp, Homo sapiens
ttagagaatatatttttga

SEQ ID NO: 3951437 - DNA, 17 bp, Homo sapiens
ttagaggaaaaaaatga

SEQ ID NO: 3951438 - DNA, 19 bp, Homo sapiens
ttagaggaaaaaaatgact

SEQ ID NO: 3951439 - DNA, 20 bp, Homo sapiens
ttagatcccatgtcacctca

SEQ ID NO: 3951440 - DNA, 13 bp, Homo sapiens
ttagattccagga

SEQ ID NO: 3951441 - DNA, 15 bp, Homo sapiens
ttagattccaggatc

SEQ ID NO: 3951442 - DNA, 20 bp, Homo sapiens
ttagcacccttctgctgtat

SEQ ID NO: 3951443 - DNA, 16 bp, Homo sapiens
ttagcagtttgctttg

SEQ ID NO: 3951444 - DNA, 14 bp, Homo sapiens
ttagccccataatt

SEQ ID NO: 3951445 - DNA, 17 bp, Homo sapiens
ttagccttgtgccctgc

SEQ ID NO: 3951446 - DNA, 18 bp, Homo sapiens
ttagccttgtgccctgcc

SEQ ID NO: 3951447 - DNA, 14 bp, Homo sapiens
ttagctagaatgca

SEQ ID NO: 3951448 - DNA, 10 bp, Homo sapiens
ttagctgagc

SEQ ID NO: 3951449 - DNA, 13 bp, Homo sapiens
ttagctgcagaac

SEQ ID NO: 3951450 - DNA, 15 bp, Homo sapiens
ttagctggacatgct

SEQ ID NO: 3951451 - DNA, 17 bp, Homo sapiens
ttagctgtctgctcaga

SEQ ID NO: 3951452 - DNA, 15 bp, Homo sapiens
ttagctgtgtgaaat

SEQ ID NO: 3951453 - DNA, 16 bp, Homo sapiens
ttagctgtgtgaaata

SEQ ID NO: 3951454 - DNA, 11 bp, Homo sapiens
ttaggaaataa

SEQ ID NO: 3951455 - DNA, 12 bp, Homo sapiens
ttaggaaataaa

SEQ ID NO: 3951456 - DNA, 19 bp, Homo sapiens
ttaggaggctgcatgctct

SEQ ID NO: 3951457 - DNA, 20 bp, Homo sapiens
ttaggaggctgcatgctctg

SEQ ID NO: 3951458 - DNA, 22 bp, Homo sapiens
ttaggataaagaatatttacaa

SEQ ID NO: 3951459 - DNA, 20 bp, Homo sapiens
ttaggatctatgcaattttt

SEQ ID NO: 3951460 - DNA, 21 bp, Homo sapiens
ttaggatttaacagtcattta

SEQ ID NO: 3951461 - DNA, 15 bp, Homo sapiens
ttaggcatgcctaat

SEQ ID NO: 3951462 - DNA, 16 bp, Homo sapiens
ttaggcattatttaat

SEQ ID NO: 3951463 - DNA, 20 bp, Homo sapiens
ttaggcattatttaatgttt

SEQ ID NO: 3951464 - DNA, 18 bp, Homo sapiens
ttaggcttaccttggtca

SEQ ID NO: 3951465 - DNA, 15 bp, Homo sapiens
ttagggccaggcagg

SEQ ID NO: 3951466 - DNA, 13 bp, Homo sapiens
ttaggtgccaggc

SEQ ID NO: 3951467 - DNA, 21 bp, Homo sapiens
ttaggtttccttttattctgt

SEQ ID NO: 3951468 - DNA, 21 bp, Homo sapiens
ttagtaataaaacccagcatg

SEQ ID NO: 3951469 - DNA, 21 bp, Homo sapiens
ttagtaatagtccaatatttg

SEQ ID NO: 3951470 - DNA, 22 bp, Homo sapiens
ttagtacagtagcttaaataaa

SEQ ID NO: 3951471 - DNA, 23 bp, Homo sapiens
ttagtacagtagcttaaataaat

SEQ ID NO: 3951472 - DNA, 21 bp, Homo sapiens
ttagtatggttctcagatctt

SEQ ID NO: 3951473 - DNA, 16 bp, Homo sapiens
ttagtgattgtgtctg

SEQ ID NO: 3951474 - DNA, 19 bp, Homo sapiens
ttagtggggtaattctgct

SEQ ID NO: 3951475 - DNA, 14 bp, Homo sapiens
ttagtgtgtgtgca

SEQ ID NO: 3951476 - DNA, 17 bp, Homo sapiens
ttagtgtgtgtgcatgt

SEQ ID NO: 3951477 - DNA, 17 bp, Homo sapiens
ttagttaggtgtgccaa

SEQ ID NO: 3951478 - DNA, 13 bp, Homo sapiens
ttagttatagttt

SEQ ID NO: 3951479 - DNA, 15 bp, Homo sapiens
ttagttatagtttca

SEQ ID NO: 3951480 - DNA, 13 bp, Homo sapiens
ttagttgaaaaat

SEQ ID NO: 3951481 - DNA, 19 bp, Homo sapiens
ttagttgaaaaatctagtt

SEQ ID NO: 3951482 - DNA, 15 bp, Homo sapiens
ttagtttgttttaca

SEQ ID NO: 3951483 - DNA, 14 bp, Homo sapiens
ttagttttctttgt

SEQ ID NO: 3951484 - DNA, 21 bp, Homo sapiens
ttagttttctttgtaaaggtc

SEQ ID NO: 3951485 - DNA, 23 bp, Homo sapiens
ttataaaagaataaaattgcact

SEQ ID NO: 3951486 - DNA, 17 bp, Homo sapiens
ttataaaattagaaagc

SEQ ID NO: 3951487 - DNA, 11 bp, Homo sapiens
ttataaatgtg

SEQ ID NO: 3951488 - DNA, 12 bp, Homo sapiens
ttataaatgtgt

SEQ ID NO: 3951489 - DNA, 15 bp, Homo sapiens
ttatttttgtccctg

SEQ ID NO: 3951490 - DNA, 23 bp, Homo sapiens
ttatttttgtccctgctcctccc

SEQ ID NO: 3951491 - DNA, 17 bp, Homo sapiens
ttatttttgtgtttcta

SEQ ID NO: 3951492 - DNA, 20 bp, Homo sapiens
ttattttttctacacagtaa

SEQ ID NO: 3951493 - DNA, 20 bp, Homo sapiens
ttatttttttaagctgtaaa

SEQ ID NO: 3951494 - DNA, 14 bp, Homo sapiens
ttcaaaaaaacact

SEQ ID NO: 3951495 - DNA, 22 bp, Homo sapiens
ttcaaaacaaccatcctgctca

SEQ ID NO: 3951496 - DNA, 19 bp, Homo sapiens
ttcaaaagacatgttgtaa

SEQ ID NO: 3951497 - DNA, 15 bp, Homo sapiens
ttcaaacaagaatgt

SEQ ID NO: 3951498 - DNA, 15 bp, Homo sapiens
ttcaaaccatttaat

SEQ ID NO: 3951499 - DNA, 19 bp, Homo sapiens
ttcaaactgagtaaattgg

SEQ ID NO: 3951500 - DNA, 22 bp, Homo sapiens
ttcaaagctttttccagaggct

SEQ ID NO: 3951501 - DNA, 13 bp, Homo sapiens
ttcaaatgcattt

SEQ ID NO: 3951502 - DNA, 14 bp, Homo sapiens
ttcaaatgcatttt

SEQ ID NO: 3951503 - DNA, 17 bp, Homo sapiens
ttcaaccagcattttac

SEQ ID NO: 3951504 - DNA, 20 bp, Homo sapiens
ttcaaccagcattttactac

SEQ ID NO: 3951505 - DNA, 14 bp, Homo sapiens
ttcaacgcagccct

SEQ ID NO: 3951506 - DNA, 19 bp, Homo sapiens
ttcaacgcagccctgcttt

SEQ ID NO: 3951507 - DNA, 13 bp, Homo sapiens
ttcaactccagaa

SEQ ID NO: 3951508 - DNA, 14 bp, Homo sapiens
ttcaactccagaag

SEQ ID NO: 3951509 - DNA, 16 bp, Homo sapiens
tgctagctgtagaaat

SEQ ID NO: 3951510 - DNA, 18 bp, Homo sapiens
tgctaggcgagtgccagg

SEQ ID NO: 3951511 - DNA, 19 bp, Homo sapiens
tgctaggggatgaggggct

SEQ ID NO: 3951512 - DNA, 14 bp, Homo sapiens
tgctatcacacagt

SEQ ID NO: 3951513 - DNA, 15 bp, Homo sapiens
tgctatgacatgcaa

SEQ ID NO: 3951514 - DNA, 17 bp, Homo sapiens
tgctattatgtaacatc

SEQ ID NO: 3951515 - DNA, 22 bp, Homo sapiens
tgctattatgtaacatccagaa

SEQ ID NO: 3951516 - DNA, 13 bp, Homo sapiens
tgctattctgtgt

SEQ ID NO: 3951517 - DNA, 14 bp, Homo sapiens
tgctattgaaatta

SEQ ID NO: 3951518 - DNA, 17 bp, Homo sapiens
tgctattgaaattactg

SEQ ID NO: 3951519 - DNA, 22 bp, Homo sapiens
tgctatttctggcctcagcagg

SEQ ID NO: 3951520 - DNA, 19 bp, Homo sapiens
tgctatttgagcatgcaca

SEQ ID NO: 3951521 - DNA, 21 bp, Homo sapiens
tgctatttgagcatgcacagc

SEQ ID NO: 3951522 - DNA, 18 bp, Homo sapiens
tgctcaaatctattcaga

SEQ ID NO: 3951523 - DNA, 14 bp, Homo sapiens
tgctcaagaagaca

SEQ ID NO: 3951524 - DNA, 22 bp, Homo sapiens
tgctcaagaagacatggagact

SEQ ID NO: 3951525 - DNA, 13 bp, Homo sapiens
tgctcacagtctc

SEQ ID NO: 3951526 - DNA, 21 bp, Homo sapiens
tgctcacgactcttcctgcaa

SEQ ID NO: 3951527 - DNA, 16 bp, Homo sapiens
tgctcacgctcccccg

SEQ ID NO: 3951528 - DNA, 17 bp, Homo sapiens
tgctcaggtgcaagtgc

SEQ ID NO: 3951529 - DNA, 12 bp, Homo sapiens
tgctcagtgcct

SEQ ID NO: 3951530 - DNA, 19 bp, Homo sapiens
tgctcataacatctttgaa

SEQ ID NO: 3951531 - DNA, 10 bp, Homo sapiens
tgctccagag

SEQ ID NO: 3951532 - DNA, 13 bp, Homo sapiens
tgctccagggtct

SEQ ID NO: 3951533 - DNA, 18 bp, Homo sapiens
tgctccagggtcttgggc

SEQ ID NO: 3951534 - DNA, 23 bp, Homo sapiens
tgctccagggtcttgggctactg

SEQ ID NO: 3951535 - DNA, 13 bp, Homo sapiens
tgctcccagcagc

SEQ ID NO: 3951536 - DNA, 14 bp, Homo sapiens
tgctcccagcagcc

SEQ ID NO: 3951537 - DNA, 15 bp, Homo sapiens
tgctcccagcagccc

SEQ ID NO: 3951538 - DNA, 21 bp, Homo sapiens
tgctcccatctcctgatttct

SEQ ID NO: 3951539 - DNA, 12 bp, Homo sapiens
tgctcctccagg

SEQ ID NO: 3951540 - DNA, 11 bp, Homo sapiens
tgctcctctcc

SEQ ID NO: 3951541 - DNA, 14 bp, Homo sapiens
tgctcctctccagg

SEQ ID NO: 3951542 - DNA, 13 bp, Homo sapiens
tgctcgcagcctg

SEQ ID NO: 3951543 - DNA, 19 bp, Homo sapiens
tgctcggggtgcacaggag

SEQ ID NO: 3951544 - DNA, 20 bp, Homo sapiens
tgctcggggtgcacaggagg

SEQ ID NO: 3951545 - DNA, 16 bp, Homo sapiens
tgctcgtgtgatttcc

SEQ ID NO: 3951546 - DNA, 12 bp, Homo sapiens
tgctctagccag

SEQ ID NO: 3951547 - DNA, 13 bp, Homo sapiens
tgctctagccagg

SEQ ID NO: 3951548 - DNA, 14 bp, Homo sapiens
tgctctagctggca

SEQ ID NO: 3951549 - DNA, 18 bp, Homo sapiens
tgctctagtcttgctttg

SEQ ID NO: 3951550 - DNA, 21 bp, Homo sapiens
tgctctagtcttgctttgctg

SEQ ID NO: 3951551 - DNA, 14 bp, Homo sapiens
tgctctcatcagaa

SEQ ID NO: 3951552 - DNA, 15 bp, Homo sapiens
tgctctcccctgccc

SEQ ID NO: 3951553 - DNA, 12 bp, Homo sapiens
tgctctcctttc

SEQ ID NO: 3951554 - DNA, 14 bp, Homo sapiens
tgctctctgcagcc

SEQ ID NO: 3951555 - DNA, 20 bp, Homo sapiens
tgctctctgcagccagccca

SEQ ID NO: 3951556 - DNA, 13 bp, Homo sapiens
tgctctcttcagg

SEQ ID NO: 3951557 - DNA, 17 bp, Homo sapiens
tgctctgaggcttccag

SEQ ID NO: 3951558 - DNA, 18 bp, Homo sapiens
tgctctgaggcttccaga

SEQ ID NO: 3951559 - DNA, 18 bp, Homo sapiens
tgctctgatgcatcagaa

SEQ ID NO: 3951560 - DNA, 14 bp, Homo sapiens
tgctctgcccactg

SEQ ID NO: 3951561 - DNA, 13 bp, Homo sapiens
tgctctgcccctt

SEQ ID NO: 3951562 - DNA, 23 bp, Homo sapiens
tgctctggaaaatgtgacccaga

SEQ ID NO: 3951563 - DNA, 21 bp, Homo sapiens
tgctctggcggcttcctgtcc

SEQ ID NO: 3951564 - DNA, 15 bp, Homo sapiens
tgctcttagctgtct

SEQ ID NO: 3951565 - DNA, 15 bp, Homo sapiens
tgctcttccaaagct

SEQ ID NO: 3951566 - DNA, 12 bp, Homo sapiens
tgctcttggaaa

SEQ ID NO: 3951567 - DNA, 18 bp, Homo sapiens
tgctcttggaaagctgat

SEQ ID NO: 3951568 - DNA, 22 bp, Homo sapiens
tgctcttttggtggggagcact

SEQ ID NO: 3951569 - DNA, 17 bp, Homo sapiens
tgctgaagttctgagcc

SEQ ID NO: 3951570 - DNA, 13 bp, Homo sapiens
tgctgaattattt

SEQ ID NO: 3951571 - DNA, 17 bp, Homo sapiens
tgcttccttctgcaccc

SEQ ID NO: 3951572 - DNA, 16 bp, Homo sapiens
tgcttctctacagact

SEQ ID NO: 3951573 - DNA, 12 bp, Homo sapiens
tgcttctcttaa

SEQ ID NO: 3951574 - DNA, 22 bp, Homo sapiens
tgcttctcttgggaactccact

SEQ ID NO: 3951575 - DNA, 14 bp, Homo sapiens
tgcttctgcagcaa

SEQ ID NO: 3951576 - DNA, 21 bp, Homo sapiens
tgcttctgtccaggacatgat

SEQ ID NO: 3951577 - DNA, 22 bp, Homo sapiens
tgcttcttcaagcacctgcaga

SEQ ID NO: 3951578 - DNA, 16 bp, Homo sapiens
tgcttgactatcacat

SEQ ID NO: 3951579 - DNA, 14 bp, Homo sapiens
tgcttgccgagcct

SEQ ID NO: 3951580 - DNA, 14 bp, Homo sapiens
tgcttgggttcctt

SEQ ID NO: 3951581 - DNA, 19 bp, Homo sapiens
tgcttggtggggctcgtgg

SEQ ID NO: 3951582 - DNA, 17 bp, Homo sapiens
tgcttgtccctgcccag

SEQ ID NO: 3951583 - DNA, 20 bp, Homo sapiens
tgcttgtcctgctctcttca

SEQ ID NO: 3951584 - DNA, 17 bp, Homo sapiens
tgctttaaagtacctgt

SEQ ID NO: 3951585 - DNA, 17 bp, Homo sapiens
tgctttaaagtgtaata

SEQ ID NO: 3951586 - DNA, 18 bp, Homo sapiens
tgctttatttatggctta

SEQ ID NO: 3951587 - DNA, 20 bp, Homo sapiens
tgctttccccgggggaggaa

SEQ ID NO: 3951588 - DNA, 12 bp, Homo sapiens
tgctttccctcc

SEQ ID NO: 3951589 - DNA, 16 bp, Homo sapiens
tgctttccctccccaa

SEQ ID NO: 3951590 - DNA, 22 bp, Homo sapiens
tgctttcctaaagtctctgctg

SEQ ID NO: 3951591 - DNA, 18 bp, Homo sapiens
tgctttgactcacctgtt

SEQ ID NO: 3951592 - DNA, 17 bp, Homo sapiens
tgctttgggctgccctg

SEQ ID NO: 3951593 - DNA, 15 bp, Homo sapiens
tgctttgggctttgc

SEQ ID NO: 3951594 - DNA, 19 bp, Homo sapiens
tgctttgtcatccatgcgt

SEQ ID NO: 3951595 - DNA, 22 bp, Homo sapiens
tgctttgttattaatattgtgc

SEQ ID NO: 3951596 - DNA, 15 bp, Homo sapiens
tgctttgttttctaa

SEQ ID NO: 3951597 - DNA, 12 bp, Homo sapiens
tgcttttccagg

SEQ ID NO: 3951598 - DNA, 19 bp, Homo sapiens
tggaaaaaaaatatatata

SEQ ID NO: 3951599 - DNA, 15 bp, Homo sapiens
tggaaaaaagagaaa

SEQ ID NO: 3951600 - DNA, 16 bp, Homo sapiens
tggaaaaagaaagaaa

SEQ ID NO: 3951601 - DNA, 19 bp, Homo sapiens
tggaaaagaatacagaaag

SEQ ID NO: 3951602 - DNA, 18 bp, Homo sapiens
tggaaaagaatccctgca

SEQ ID NO: 3951603 - DNA, 13 bp, Homo sapiens
tggaaaagcccag

SEQ ID NO: 3951604 - DNA, 21 bp, Homo sapiens
tggaaaagcccagtgacctga

SEQ ID NO: 3951605 - DNA, 16 bp, Homo sapiens
tggaaaataaattata

SEQ ID NO: 3951606 - DNA, 17 bp, Homo sapiens
tggaaaatgtcctgtgg

SEQ ID NO: 3951607 - DNA, 14 bp, Homo sapiens
tggaaacaggacca

SEQ ID NO: 3951608 - DNA, 14 bp, Homo sapiens
tggaaacagggcag

SEQ ID NO: 3951609 - DNA, 23 bp, Homo sapiens
tggaaacatttacaataaatatt

SEQ ID NO: 3951610 - DNA, 12 bp, Homo sapiens
tggaaagagacc

SEQ ID NO: 3951611 - DNA, 16 bp, Homo sapiens
tggaaaggtttcaaga

SEQ ID NO: 3951612 - DNA, 23 bp, Homo sapiens
tggaaaggtttcaagacttgata

SEQ ID NO: 3951613 - DNA, 23 bp, Homo sapiens
tggaaataaacctggagatgatg

SEQ ID NO: 3951614 - DNA, 23 bp, Homo sapiens
tggaaatattcatgcttcttcct

SEQ ID NO: 3951615 - DNA, 13 bp, Homo sapiens
tggaaattttgtc

SEQ ID NO: 3951616 - DNA, 20 bp, Homo sapiens
tggaacagtcacccttctgg

SEQ ID NO: 3951617 - DNA, 19 bp, Homo sapiens
tggaaccagggaggagagg

SEQ ID NO: 3951618 - DNA, 13 bp, Homo sapiens
tggaaccttccct

SEQ ID NO: 3951619 - DNA, 13 bp, Homo sapiens
tggaactgacccc

SEQ ID NO: 3951620 - DNA, 13 bp, Homo sapiens
tggaacttctaat

SEQ ID NO: 3951621 - DNA, 16 bp, Homo sapiens
tggaacttctaatata

SEQ ID NO: 3951622 - DNA, 21 bp, Homo sapiens
tggaacttctaatatattttt

SEQ ID NO: 3951623 - DNA, 17 bp, Homo sapiens
tggaagaaattcctgta

SEQ ID NO: 3951624 - DNA, 17 bp, Homo sapiens
tggaagaaatttaggaa

SEQ ID NO: 3951625 - DNA, 16 bp, Homo sapiens
tggaagagaaatctca

SEQ ID NO: 3951626 - DNA, 12 bp, Homo sapiens
tggaagagaggc

SEQ ID NO: 3951627 - DNA, 14 bp, Homo sapiens
tggaagagaggcac

SEQ ID NO: 3951628 - DNA, 17 bp, Homo sapiens
tggaagagaggcacctg

SEQ ID NO: 3951629 - DNA, 12 bp, Homo sapiens
tggaagagcagc

SEQ ID NO: 3951630 - DNA, 13 bp, Homo sapiens
tggaagagcagcc

SEQ ID NO: 3951631 - DNA, 14 bp, Homo sapiens
tggaagagcagcct

SEQ ID NO: 3951632 - DNA, 15 bp, Homo sapiens
tggaagagcagcctg

SEQ ID NO: 3951633 - DNA, 22 bp, Homo sapiens
tggaagatttaccttttctgtt

SEQ ID NO: 3951634 - DNA, 19 bp, Homo sapiens
tggaagcatgtaggagaat

SEQ ID NO: 3951635 - DNA, 17 bp, Homo sapiens
tggaagccctccttcca

SEQ ID NO: 3951636 - DNA, 19 bp, Homo sapiens
tggaagccctccttccacg

SEQ ID NO: 3951637 - DNA, 14 bp, Homo sapiens
tggaagctgagcag

SEQ ID NO: 3951638 - DNA, 17 bp, Homo sapiens
tggaagctgagcaggcc

SEQ ID NO: 3951639 - DNA, 17 bp, Homo sapiens
tggaagctgccctgccc

SEQ ID NO: 3951640 - DNA, 18 bp, Homo sapiens
tggaagctgccctgccca

SEQ ID NO: 3951641 - DNA, 15 bp, Homo sapiens
tggaaggcagggaca

SEQ ID NO: 3951642 - DNA, 16 bp, Homo sapiens
tggaaggcagggcaga

SEQ ID NO: 3951643 - DNA, 17 bp, Homo sapiens
tggaaggcagggcagag

SEQ ID NO: 3951644 - DNA, 17 bp, Homo sapiens
tggaagtggcagtgaaa

SEQ ID NO: 3951645 - DNA, 17 bp, Homo sapiens
tggaagtgttcaagaaa

SEQ ID NO: 3951646 - DNA, 14 bp, Homo sapiens
tggaatacagtgtt

SEQ ID NO: 3951647 - DNA, 20 bp, Homo sapiens
tggaatactaaaaatcatga

SEQ ID NO: 3951648 - DNA, 13 bp, Homo sapiens
tggaatataaaga

SEQ ID NO: 3951649 - DNA, 20 bp, Homo sapiens
tggaatcaaggaatcctgag

SEQ ID NO: 3951650 - DNA, 19 bp, Homo sapiens
tggaatcaatttcccagaa

SEQ ID NO: 3951651 - DNA, 20 bp, Homo sapiens
tggaatcacctggagggctt

SEQ ID NO: 3951652 - DNA, 13 bp, Homo sapiens
tggaatcactgta

SEQ ID NO: 3951653 - DNA, 12 bp, Homo sapiens
tggaatctggag

SEQ ID NO: 3951654 - DNA, 15 bp, Homo sapiens
tggaatctggagagc

SEQ ID NO: 3951655 - DNA, 22 bp, Homo sapiens
tggaatgactataaacattaaa

SEQ ID NO: 3951656 - DNA, 23 bp, Homo sapiens
tggaatgtggcccctgaacaaga

SEQ ID NO: 3951657 - DNA, 17 bp, Homo sapiens
tggaattcagcaccctg

SEQ ID NO: 3951658 - DNA, 19 bp, Homo sapiens
tggccaagctgaggtgccc

SEQ ID NO: 3951659 - DNA, 21 bp, Homo sapiens
tggccaagctgaggtgcccag

SEQ ID NO: 3951660 - DNA, 22 bp, Homo sapiens
tggccaagctgaggtgcccagg

SEQ ID NO: 3951661 - DNA, 16 bp, Homo sapiens
tggccaagggggtgga

SEQ ID NO: 3951662 - DNA, 22 bp, Homo sapiens
tggccacaccacagcaagccgg

SEQ ID NO: 3951663 - DNA, 18 bp, Homo sapiens
tggccacccaacagcacc

SEQ ID NO: 3951664 - DNA, 20 bp, Homo sapiens
tggccacccaacagcaccaa

SEQ ID NO: 3951665 - DNA, 17 bp, Homo sapiens
tggccaccccgtgccac

SEQ ID NO: 3951666 - DNA, 20 bp, Homo sapiens
tggccactccagacccctgg

SEQ ID NO: 3951667 - DNA, 22 bp, Homo sapiens
tggccactccagacccctggct

SEQ ID NO: 3951668 - DNA, 22 bp, Homo sapiens
tggccactttaagagagaaatc

SEQ ID NO: 3951669 - DNA, 18 bp, Homo sapiens
tggccagagagggcccag

SEQ ID NO: 3951670 - DNA, 21 bp, Homo sapiens
tggccagagagggcccagctg

SEQ ID NO: 3951671 - DNA, 22 bp, Homo sapiens
tggccagagagggcccagctgt

SEQ ID NO: 3951672 - DNA, 14 bp, Homo sapiens
tggccagcaccctc

SEQ ID NO: 3951673 - DNA, 20 bp, Homo sapiens
tggccagcaccctctcctgg

SEQ ID NO: 3951674 - DNA, 20 bp, Homo sapiens
tggccaggctggtctcgaac

SEQ ID NO: 3951675 - DNA, 12 bp, Homo sapiens
tggccagggtga

SEQ ID NO: 3951676 - DNA, 17 bp, Homo sapiens
tggccagggtgagagct

SEQ ID NO: 3951677 - DNA, 16 bp, Homo sapiens
tggccaggtggccact

SEQ ID NO: 3951678 - DNA, 19 bp, Homo sapiens
tggccaggtggccactcca

SEQ ID NO: 3951679 - DNA, 15 bp, Homo sapiens
tggccagtcctagag

SEQ ID NO: 3951680 - DNA, 14 bp, Homo sapiens
tggccatccctggg

SEQ ID NO: 3951681 - DNA, 21 bp, Homo sapiens
tggccatccctgggcccctcc

SEQ ID NO: 3951682 - DNA, 22 bp, Homo sapiens
tggccatccctgggcccctcca

SEQ ID NO: 3951683 - DNA, 18 bp, Homo sapiens
tggccattttcttgcctg

SEQ ID NO: 3951684 - DNA, 18 bp, Homo sapiens
tggcccagagctggaaca

SEQ ID NO: 3951685 - DNA, 22 bp, Homo sapiens
tggcccatagaaacatgacact

SEQ ID NO: 3951686 - DNA, 24 bp, Homo sapiens
tggcccatagaaacatgacactga

SEQ ID NO: 3951687 - DNA, 15 bp, Homo sapiens
tggccccaggtgcca

SEQ ID NO: 3951688 - DNA, 23 bp, Homo sapiens
tggccccatgtctctcagaattc

SEQ ID NO: 3951689 - DNA, 12 bp, Homo sapiens
tggcccccctcc

SEQ ID NO: 3951690 - DNA, 17 bp, Homo sapiens
tggcccccctccaggca

SEQ ID NO: 3951691 - DNA, 21 bp, Homo sapiens
tggccccctgtgccagctcag

SEQ ID NO: 3951692 - DNA, 21 bp, Homo sapiens
tggccccgggctctggccacc

SEQ ID NO: 3951693 - DNA, 22 bp, Homo sapiens
tggccccgggctctggccaccc

SEQ ID NO: 3951694 - DNA, 12 bp, Homo sapiens
tggcccctcacc

SEQ ID NO: 3951695 - DNA, 20 bp, Homo sapiens
tggcccctgaacaagaattg

SEQ ID NO: 3951696 - DNA, 16 bp, Homo sapiens
tggcccgacagcctgg

SEQ ID NO: 3951697 - DNA, 17 bp, Homo sapiens
tggcccgacagcctggc

SEQ ID NO: 3951698 - DNA, 18 bp, Homo sapiens
tggccctgcaaaaatata

SEQ ID NO: 3951699 - DNA, 18 bp, Homo sapiens
tggccctgccctctcctt

SEQ ID NO: 3951700 - DNA, 21 bp, Homo sapiens
tggccctgccctctccttcct

SEQ ID NO: 3951701 - DNA, 11 bp, Homo sapiens
tggccctgcct

SEQ ID NO: 3951702 - DNA, 13 bp, Homo sapiens
tggccctggcctg

SEQ ID NO: 3951703 - DNA, 16 bp, Homo sapiens
tggccctggcctgctg

SEQ ID NO: 3951704 - DNA, 19 bp, Homo sapiens
tggccctgtgactatggct

SEQ ID NO: 3951705 - DNA, 18 bp, Homo sapiens
tggcccttcctggacagc

SEQ ID NO: 3951706 - DNA, 21 bp, Homo sapiens
tggccgacggcggcggccctc

SEQ ID NO: 3951707 - DNA, 17 bp, Homo sapiens
tggccgcaagcgcaggg

SEQ ID NO: 3951708 - DNA, 18 bp, Homo sapiens
tggccgcaagcgcaggga

SEQ ID NO: 3951709 - DNA, 20 bp, Homo sapiens
tggccgcaagcgcagggagg

SEQ ID NO: 3951710 - DNA, 22 bp, Homo sapiens
tggccgcaagcgcagggaggat

SEQ ID NO: 3951711 - DNA, 19 bp, Homo sapiens
tggccggcaaccccagttc

SEQ ID NO: 3951712 - DNA, 21 bp, Homo sapiens
tggcctattatattaaaatat

SEQ ID NO: 3951713 - DNA, 20 bp, Homo sapiens
tggcctcactggctggggca

SEQ ID NO: 3951714 - DNA, 16 bp, Homo sapiens
tggcctcacttccctg

SEQ ID NO: 3951715 - DNA, 18 bp, Homo sapiens
tggcctcacttccctggg

SEQ ID NO: 3951716 - DNA, 19 bp, Homo sapiens
tggcctcacttccctggga

SEQ ID NO: 3951717 - DNA, 20 bp, Homo sapiens
tggcctcacttccctgggaa

SEQ ID NO: 3951718 - DNA, 22 bp, Homo sapiens
tggcctcacttccctgggaact

SEQ ID NO: 3951719 - DNA, 17 bp, Homo sapiens
tggcctcagcaggaacc

SEQ ID NO: 3951720 - DNA, 16 bp, Homo sapiens
tggcctcagccctcag

SEQ ID NO: 3951721 - DNA, 18 bp, Homo sapiens
tggcctcccaataaagct

SEQ ID NO: 3951722 - DNA, 20 bp, Homo sapiens
tggcctcccaataaagctgg

SEQ ID NO: 3951723 - DNA, 22 bp, Homo sapiens
tggcctcccaataaagctggac

SEQ ID NO: 3951724 - DNA, 14 bp, Homo sapiens
tggcctcctgcctc

SEQ ID NO: 3951725 - DNA, 15 bp, Homo sapiens
tggcctcctgcctct

SEQ ID NO: 3951726 - DNA, 21 bp, Homo sapiens
tggcctcctgcctctactggg

SEQ ID NO: 3951727 - DNA, 20 bp, Homo sapiens
tggcctcgcctgggcccagg

SEQ ID NO: 3951728 - DNA, 23 bp, Homo sapiens
tggcctcgggacacctgccctgc

SEQ ID NO: 3951729 - DNA, 13 bp, Homo sapiens
tggcctctagaac

SEQ ID NO: 3951730 - DNA, 23 bp, Homo sapiens
tggcctctagaacacccactggc

SEQ ID NO: 3951731 - DNA, 12 bp, Homo sapiens
tggcctgctggg

SEQ ID NO: 3951732 - DNA, 21 bp, Homo sapiens
tggcctggatctccccactct

SEQ ID NO: 3951733 - DNA, 16 bp, Homo sapiens
tggcctgggcgacaga

SEQ ID NO: 3951734 - DNA, 20 bp, Homo sapiens
tggcctgtgtccagcagctg

SEQ ID NO: 3951735 - DNA, 22 bp, Homo sapiens
tggcctgtgtccagcagctgcg

SEQ ID NO: 3951736 - DNA, 13 bp, Homo sapiens
tggccttgcccgc

SEQ ID NO: 3951737 - DNA, 16 bp, Homo sapiens
tggccttgtcaggacc

SEQ ID NO: 3951738 - DNA, 19 bp, Homo sapiens
tggccttgtcaggacccag

SEQ ID NO: 3951739 - DNA, 14 bp, Homo sapiens
tggccttgttctgt

SEQ ID NO: 3951740 - DNA, 16 bp, Homo sapiens
tggcgagaggagagga

SEQ ID NO: 3951741 - DNA, 14 bp, Homo sapiens
tggcgcaagcctgt

SEQ ID NO: 3951742 - DNA, 18 bp, Homo sapiens
tggcgcgggaggcaccag

SEQ ID NO: 3951743 - DNA, 20 bp, Homo sapiens
tggcgcgggaggcaccagct

SEQ ID NO: 3951744 - DNA, 20 bp, Homo sapiens
tgggagcctgcaaactcact

SEQ ID NO: 3951745 - DNA, 20 bp, Homo sapiens
tgggagctggttagaaatgc

SEQ ID NO: 3951746 - DNA, 12 bp, Homo sapiens
tgggaggaaaag

SEQ ID NO: 3951747 - DNA, 18 bp, Homo sapiens
tgggaggctgaggcagga

SEQ ID NO: 3951748 - DNA, 18 bp, Homo sapiens
tgggagggagcagacagg

SEQ ID NO: 3951749 - DNA, 16 bp, Homo sapiens
tgggagggagggagag

SEQ ID NO: 3951750 - DNA, 20 bp, Homo sapiens
tgggaggtctccactgagga

SEQ ID NO: 3951751 - DNA, 19 bp, Homo sapiens
tgggaggtgagaccacctc

SEQ ID NO: 3951752 - DNA, 23 bp, Homo sapiens
tgggagtcaggacctccggggag

SEQ ID NO: 3951753 - DNA, 16 bp, Homo sapiens
tgggataacagaggca

SEQ ID NO: 3951754 - DNA, 15 bp, Homo sapiens
tgggatatgacaagc

SEQ ID NO: 3951755 - DNA, 18 bp, Homo sapiens
tgggatggaccctcgcag

SEQ ID NO: 3951756 - DNA, 20 bp, Homo sapiens
tgggatgttaagcaaaggaa

SEQ ID NO: 3951757 - DNA, 20 bp, Homo sapiens
tgggattcccaccaaggtct

SEQ ID NO: 3951758 - DNA, 15 bp, Homo sapiens
tgggatttcttcgct

SEQ ID NO: 3951759 - DNA, 18 bp, Homo sapiens
tgggatttcttcgctgct

SEQ ID NO: 3951760 - DNA, 18 bp, Homo sapiens
tgggcaaacccttctctt

SEQ ID NO: 3951761 - DNA, 19 bp, Homo sapiens
tgggcaatgatggcaattt

SEQ ID NO: 3951762 - DNA, 19 bp, Homo sapiens
tgggcacccacctccaccc

SEQ ID NO: 3951763 - DNA, 15 bp, Homo sapiens
tgggcacccccagcc

SEQ ID NO: 3951764 - DNA, 16 bp, Homo sapiens
tgggcacccccagcct

SEQ ID NO: 3951765 - DNA, 17 bp, Homo sapiens
tgggcacccccagcctg

SEQ ID NO: 3951766 - DNA, 20 bp, Homo sapiens
tgggcacccccagcctgggc

SEQ ID NO: 3951767 - DNA, 24 bp, Homo sapiens
tgggcacctctagtgctactgcta

SEQ ID NO: 3951768 - DNA, 15 bp, Homo sapiens
tgggcactgggatga

SEQ ID NO: 3951769 - DNA, 14 bp, Homo sapiens
tgggcactggtatt

SEQ ID NO: 3951770 - DNA, 15 bp, Homo sapiens
tgggcagaagggaga

SEQ ID NO: 3951771 - DNA, 13 bp, Homo sapiens
tgggcagaggctg

SEQ ID NO: 3951772 - DNA, 15 bp, Homo sapiens
tgggcagcaccctcc

SEQ ID NO: 3951773 - DNA, 18 bp, Homo sapiens
tgggcagcaccctccccc

SEQ ID NO: 3951774 - DNA, 19 bp, Homo sapiens
tgggcagctgattttgtca

SEQ ID NO: 3951775 - DNA, 15 bp, Homo sapiens
tgggcagtgcctcct

SEQ ID NO: 3951776 - DNA, 18 bp, Homo sapiens
tgggcatccacccagtgc

SEQ ID NO: 3951777 - DNA, 19 bp, Homo sapiens
tgggcatccacccagtgct

SEQ ID NO: 3951778 - DNA, 20 bp, Homo sapiens
tgggcatccacccagtgctg

SEQ ID NO: 3951779 - DNA, 22 bp, Homo sapiens
tgggcatctcgtgccagggcag

SEQ ID NO: 3951780 - DNA, 13 bp, Homo sapiens
tgggcattgggct

SEQ ID NO: 3951781 - DNA, 17 bp, Homo sapiens
tgggcattgggctgaca

SEQ ID NO: 3951782 - DNA, 18 bp, Homo sapiens
tgggcattgggctgacac

SEQ ID NO: 3951783 - DNA, 17 bp, Homo sapiens
tgggccaaaagggcagc

SEQ ID NO: 3951784 - DNA, 21 bp, Homo sapiens
tgggccaaaagggcagccagg

SEQ ID NO: 3951785 - DNA, 22 bp, Homo sapiens
tgggccaaaagggcagccaggg

SEQ ID NO: 3951786 - DNA, 21 bp, Homo sapiens
tgggccaattaaaatatatat

SEQ ID NO: 3951787 - DNA, 22 bp, Homo sapiens
tgggccaattaaaatatatata

SEQ ID NO: 3951788 - DNA, 14 bp, Homo sapiens
tgggccactctccc

SEQ ID NO: 3951789 - DNA, 15 bp, Homo sapiens
tgggccactctcccc

SEQ ID NO: 3951790 - DNA, 16 bp, Homo sapiens
tgggccagcctcagct

SEQ ID NO: 3951791 - DNA, 21 bp, Homo sapiens
tgggccagcctcagctcagcc

SEQ ID NO: 3951792 - DNA, 23 bp, Homo sapiens
tgggccagcctcagctcagcctc

SEQ ID NO: 3951793 - DNA, 17 bp, Homo sapiens
tgggccaggacaggccc

SEQ ID NO: 3951794 - DNA, 17 bp, Homo sapiens
tgggccaggagctcagc

SEQ ID NO: 3951795 - DNA, 10 bp, Homo sapiens
tgggccaggg

SEQ ID NO: 3951796 - DNA, 21 bp, Homo sapiens
tgggcccataatagttagccc

SEQ ID NO: 3951797 - DNA, 22 bp, Homo sapiens
tgggcccataatagttagccct

SEQ ID NO: 3951798 - DNA, 23 bp, Homo sapiens
tgggccccaccacctaggccact

SEQ ID NO: 3951799 - DNA, 14 bp, Homo sapiens
tgggccccacctac

SEQ ID NO: 3951800 - DNA, 20 bp, Homo sapiens
tgggccccatgctctgcccc

SEQ ID NO: 3951801 - DNA, 18 bp, Homo sapiens
tgggcccctccacgcctc

SEQ ID NO: 3951802 - DNA, 13 bp, Homo sapiens
tgggccctggggc

SEQ ID NO: 3951803 - DNA, 22 bp, Homo sapiens
tgggccctggggcctgtactgc

SEQ ID NO: 3951804 - DNA, 13 bp, Homo sapiens
tgggcctgctgcg

SEQ ID NO: 3951805 - DNA, 16 bp, Homo sapiens
tgggcctgctgctgag

SEQ ID NO: 3951806 - DNA, 22 bp, Homo sapiens
tgggcctgcttttccaggatcc

SEQ ID NO: 3951807 - DNA, 14 bp, Homo sapiens
tgggcctggcctga

SEQ ID NO: 3951808 - DNA, 16 bp, Homo sapiens
tgggcctggcctgagc

SEQ ID NO: 3951809 - DNA, 17 bp, Homo sapiens
tgggcctggcctgagct

SEQ ID NO: 3951810 - DNA, 23 bp, Homo sapiens
tgggcctggcctgagctggggcc

SEQ ID NO: 3951811 - DNA, 17 bp, Homo sapiens
tgggcctgggcctgctt

SEQ ID NO: 3951812 - DNA, 14 bp, Homo sapiens
tgggcctgtccccc

SEQ ID NO: 3951813 - DNA, 17 bp, Homo sapiens
tgggcctgtgcagcagc

SEQ ID NO: 3951814 - DNA, 18 bp, Homo sapiens
tgggcctgtgcagcagcc

SEQ ID NO: 3951815 - DNA, 19 bp, Homo sapiens
tgggcctgtgcagcagccc

SEQ ID NO: 3951816 - DNA, 22 bp, Homo sapiens
tgggcctgtgcagcagcccagc

SEQ ID NO: 3951817 - DNA, 14 bp, Homo sapiens
tgggccttgctttg

SEQ ID NO: 3951818 - DNA, 14 bp, Homo sapiens
tgggcctttcctgt

SEQ ID NO: 3951819 - DNA, 19 bp, Homo sapiens
tgggcctttcctgtgccaa

SEQ ID NO: 3951820 - DNA, 16 bp, Homo sapiens
tgggctactggcagct

SEQ ID NO: 3951821 - DNA, 19 bp, Homo sapiens
tgggctactggcagctcct

SEQ ID NO: 3951822 - DNA, 19 bp, Homo sapiens
tgggctagtgtgagtggca

SEQ ID NO: 3951823 - DNA, 22 bp, Homo sapiens
tgggctagtgtgagtggcagcc

SEQ ID NO: 3951824 - DNA, 22 bp, Homo sapiens
tgggctcaagcagtcctcccac

SEQ ID NO: 3951825 - DNA, 11 bp, Homo sapiens
tgggctcctgg

SEQ ID NO: 3951826 - DNA, 19 bp, Homo sapiens
tgggctcctggaaccaatc

SEQ ID NO: 3951827 - DNA, 15 bp, Homo sapiens
tgggctcctggctgc

SEQ ID NO: 3951828 - DNA, 16 bp, Homo sapiens
tgggctctccacctca

SEQ ID NO: 3951829 - DNA, 19 bp, Homo sapiens
tgggctctccacctcagcc

SEQ ID NO: 3951830 - DNA, 14 bp, Homo sapiens
tgggttttgtctct

SEQ ID NO: 3951831 - DNA, 15 bp, Homo sapiens
tggtaagctctggct

SEQ ID NO: 3951832 - DNA, 23 bp, Homo sapiens
tggtaagtaccacatctacaatt

SEQ ID NO: 3951833 - DNA, 14 bp, Homo sapiens
tggtacagcagggt

SEQ ID NO: 3951834 - DNA, 20 bp, Homo sapiens
tggtagaattggagagtaaa

SEQ ID NO: 3951835 - DNA, 17 bp, Homo sapiens
tggtagaccaaaataaa

SEQ ID NO: 3951836 - DNA, 19 bp, Homo sapiens
tggtagcagataaagacag

SEQ ID NO: 3951837 - DNA, 17 bp, Homo sapiens
tggtagcttttcccttc

SEQ ID NO: 3951838 - DNA, 20 bp, Homo sapiens
tggtagcttttcccttcttt

SEQ ID NO: 3951839 - DNA, 21 bp, Homo sapiens
tggtagcttttcccttctttt

SEQ ID NO: 3951840 - DNA, 15 bp, Homo sapiens
tggtaggcttatcaa

SEQ ID NO: 3951841 - DNA, 18 bp, Homo sapiens
tggtatatttgtgtatgt

SEQ ID NO: 3951842 - DNA, 19 bp, Homo sapiens
tggtcacaggactctgcct

SEQ ID NO: 3951843 - DNA, 14 bp, Homo sapiens
tggtcagctcacac

SEQ ID NO: 3951844 - DNA, 21 bp, Homo sapiens
tggtcagttgtacgtaatgta

SEQ ID NO: 3951845 - DNA, 19 bp, Homo sapiens
tggtccactcagggctgcc

SEQ ID NO: 3951846 - DNA, 14 bp, Homo sapiens
tggtccagcctggt

SEQ ID NO: 3951847 - DNA, 15 bp, Homo sapiens
tggtccagcttgctc

SEQ ID NO: 3951848 - DNA, 15 bp, Homo sapiens
tggtcccacatccct

SEQ ID NO: 3951849 - DNA, 20 bp, Homo sapiens
tggtcccacatccctgggcc

SEQ ID NO: 3951850 - DNA, 23 bp, Homo sapiens
tggtcccacatccctgggcctgc

SEQ ID NO: 3951851 - DNA, 23 bp, Homo sapiens
tggtccctcgtccacaggggcag

SEQ ID NO: 3951852 - DNA, 16 bp, Homo sapiens
tggtcctccatttcaa

SEQ ID NO: 3951853 - DNA, 18 bp, Homo sapiens
tggtctaaaaataaacca

SEQ ID NO: 3951854 - DNA, 14 bp, Homo sapiens
tgaaattcccccac

SEQ ID NO: 3951855 - DNA, 22 bp, Homo sapiens
tgaaattcccccacttgggagc

SEQ ID NO: 3951856 - DNA, 23 bp, Homo sapiens
tgaaattgtttaagtgttgtaaa

SEQ ID NO: 3951857 - DNA, 21 bp, Homo sapiens
tgaaatttattagttaatata

SEQ ID NO: 3951858 - DNA, 22 bp, Homo sapiens
tgaaatttattagttaatatat

SEQ ID NO: 3951859 - DNA, 23 bp, Homo sapiens
tgaaatttcccacaccccagcgc

SEQ ID NO: 3951860 - DNA, 18 bp, Homo sapiens
tgaaatttgtttctgttt

SEQ ID NO: 3951861 - DNA, 20 bp, Homo sapiens
tgaaattttctagactttct

SEQ ID NO: 3951862 - DNA, 11 bp, Homo sapiens
tgaacaagaat

SEQ ID NO: 3951863 - DNA, 12 bp, Homo sapiens
tgaacaagaatt

SEQ ID NO: 3951864 - DNA, 13 bp, Homo sapiens
tgaacaattctct

SEQ ID NO: 3951865 - DNA, 13 bp, Homo sapiens
tgaacacaattga

SEQ ID NO: 3951866 - DNA, 23 bp, Homo sapiens
tgaacacaattgatacttcaggt

SEQ ID NO: 3951867 - DNA, 16 bp, Homo sapiens
tgaacacagctgctga

SEQ ID NO: 3951868 - DNA, 17 bp, Homo sapiens
tgaacacatactagaaa

SEQ ID NO: 3951869 - DNA, 14 bp, Homo sapiens
tgaacacatcagct

SEQ ID NO: 3951870 - DNA, 16 bp, Homo sapiens
tgaacaccactttgtc

SEQ ID NO: 3951871 - DNA, 20 bp, Homo sapiens
tgaacatttgctttgttttc

SEQ ID NO: 3951872 - DNA, 22 bp, Homo sapiens
tgaacccaggacaagcatggtc

SEQ ID NO: 3951873 - DNA, 12 bp, Homo sapiens
tgaacccaggag

SEQ ID NO: 3951874 - DNA, 15 bp, Homo sapiens
tgaaccccatgggct

SEQ ID NO: 3951875 - DNA, 16 bp, Homo sapiens
tgaaccccatgggctt

SEQ ID NO: 3951876 - DNA, 17 bp, Homo sapiens
tgaacccttgtgcttgg

SEQ ID NO: 3951877 - DNA, 14 bp, Homo sapiens
tgaacctatccttc

SEQ ID NO: 3951878 - DNA, 12 bp, Homo sapiens
tgaacctcagtt

SEQ ID NO: 3951879 - DNA, 15 bp, Homo sapiens
tgaacctcagtttcc

SEQ ID NO: 3951880 - DNA, 12 bp, Homo sapiens
tgaacctggagg

SEQ ID NO: 3951881 - DNA, 13 bp, Homo sapiens
tgaactggttcat

SEQ ID NO: 3951882 - DNA, 23 bp, Homo sapiens
tgaacttacacttggagcccgtg

SEQ ID NO: 3951883 - DNA, 21 bp, Homo sapiens
tgaacttatttacacatagtt

SEQ ID NO: 3951884 - DNA, 22 bp, Homo sapiens
tgaacttgaggacacatgtcca

SEQ ID NO: 3951885 - DNA, 13 bp, Homo sapiens
tgaagaaatggaa

SEQ ID NO: 3951886 - DNA, 15 bp, Homo sapiens
tgaagaacagtaact

SEQ ID NO: 3951887 - DNA, 21 bp, Homo sapiens
tgaagacaaaccactgtacat

SEQ ID NO: 3951888 - DNA, 20 bp, Homo sapiens
tgaagaccacatccacacac

SEQ ID NO: 3951889 - DNA, 20 bp, Homo sapiens
tgaagacccagtgtaaagaa

SEQ ID NO: 3951890 - DNA, 13 bp, Homo sapiens
tgaagagaagctg

SEQ ID NO: 3951891 - DNA, 14 bp, Homo sapiens
tgaagagaagctga

SEQ ID NO: 3951892 - DNA, 17 bp, Homo sapiens
tgaagagaagctgagaa

SEQ ID NO: 3951893 - DNA, 21 bp, Homo sapiens
tgaagagatttcaacaagaat

SEQ ID NO: 3951894 - DNA, 17 bp, Homo sapiens
tgaagagatttcaacat

SEQ ID NO: 3951895 - DNA, 18 bp, Homo sapiens
tgaagaggcaagagacag

SEQ ID NO: 3951896 - DNA, 21 bp, Homo sapiens
tgaagaggcaagagacagaat

SEQ ID NO: 3951897 - DNA, 16 bp, Homo sapiens
tgaagaggtgagagta

SEQ ID NO: 3951898 - DNA, 21 bp, Homo sapiens
tgaagcagtgcctcgaggcac

SEQ ID NO: 3951899 - DNA, 16 bp, Homo sapiens
tgaagccagtatttct

SEQ ID NO: 3951900 - DNA, 19 bp, Homo sapiens
tgaagcccaataaacctct

SEQ ID NO: 3951901 - DNA, 18 bp, Homo sapiens
tgaagccccttgtcctct

SEQ ID NO: 3951902 - DNA, 13 bp, Homo sapiens
tgaagcctctgcc

SEQ ID NO: 3951903 - DNA, 20 bp, Homo sapiens
tgaagcctctgccctgcctc

SEQ ID NO: 3951904 - DNA, 17 bp, Homo sapiens
tgaaggaatagccagag

SEQ ID NO: 3951905 - DNA, 20 bp, Homo sapiens
tgaaggaatagccagagagg

SEQ ID NO: 3951906 - DNA, 14 bp, Homo sapiens
tgaaggagaaagga

SEQ ID NO: 3951907 - DNA, 16 bp, Homo sapiens
tgaaggagagcccttc

SEQ ID NO: 3951908 - DNA, 20 bp, Homo sapiens
tgaaggagattttccttcct

SEQ ID NO: 3951909 - DNA, 19 bp, Homo sapiens
tgaaggcgtgcaaggggct

SEQ ID NO: 3951910 - DNA, 22 bp, Homo sapiens
tgaagggaaaggatattttctt

SEQ ID NO: 3951911 - DNA, 14 bp, Homo sapiens
tgaagggcccgaga

SEQ ID NO: 3951912 - DNA, 19 bp, Homo sapiens
tgaaggggcacaccactgc

SEQ ID NO: 3951913 - DNA, 16 bp, Homo sapiens
tgaagggtgacatccc

SEQ ID NO: 3951914 - DNA, 22 bp, Homo sapiens
tgaaggtcactcttcctgcaag

SEQ ID NO: 3951915 - DNA, 17 bp, Homo sapiens
tgaagtatttctcactc

SEQ ID NO: 3951916 - DNA, 14 bp, Homo sapiens
tgaagtcactgcac

SEQ ID NO: 3951917 - DNA, 16 bp, Homo sapiens
tgaagtgtgtttcctt

SEQ ID NO: 3951918 - DNA, 22 bp, Homo sapiens
tgaagttacacaattaattgtc

SEQ ID NO: 3951919 - DNA, 20 bp, Homo sapiens
tgaagttcatggtgatcagt

SEQ ID NO: 3951920 - DNA, 13 bp, Homo sapiens
tgaagttctgagc

SEQ ID NO: 3951921 - DNA, 14 bp, Homo sapiens
tgaagttctgagcc

SEQ ID NO: 3951922 - DNA, 18 bp, Homo sapiens
tgaagtttgaacttcata

SEQ ID NO: 3951923 - DNA, 18 bp, Homo sapiens
tgaagttttatacactgg

SEQ ID NO: 3951924 - DNA, 14 bp, Homo sapiens
tgaataaaaaccct

SEQ ID NO: 3951925 - DNA, 18 bp, Homo sapiens
tgaataaacttcagcacc

SEQ ID NO: 3951926 - DNA, 18 bp, Homo sapiens
tgaataatggaatctata

SEQ ID NO: 3951927 - DNA, 23 bp, Homo sapiens
tgaataattttctggcactggtt

SEQ ID NO: 3951928 - DNA, 17 bp, Homo sapiens
tgaatacccccagagac

SEQ ID NO: 3951929 - DNA, 19 bp, Homo sapiens
tgaatacccccagagacct

SEQ ID NO: 3951930 - DNA, 14 bp, Homo sapiens
tgaatactctcaca

SEQ ID NO: 3951931 - DNA, 17 bp, Homo sapiens
tgaatagtctgtgtgca

SEQ ID NO: 3951932 - DNA, 18 bp, Homo sapiens
tgaatatattataatctt

SEQ ID NO: 3951933 - DNA, 20 bp, Homo sapiens
tgaatatctgccccagtagt

SEQ ID NO: 3951934 - DNA, 21 bp, Homo sapiens
tgaatatggactcagttttct

SEQ ID NO: 3951935 - DNA, 21 bp, Homo sapiens
tgaatattttcattaaaagct

SEQ ID NO: 3951936 - DNA, 13 bp, Homo sapiens
tgaatcaaagaca

SEQ ID NO: 3951937 - DNA, 18 bp, Homo sapiens
tgaatcagaccctacccc

SEQ ID NO: 3951938 - DNA, 13 bp, Homo sapiens
tgaatctgcaggg

SEQ ID NO: 3951939 - DNA, 21 bp, Homo sapiens
tgaatctgttactgaaatgag

SEQ ID NO: 3951940 - DNA, 13 bp, Homo sapiens
tgaatcttaattt

SEQ ID NO: 3951941 - DNA, 12 bp, Homo sapiens
tgaatgcttttt

SEQ ID NO: 3951942 - DNA, 18 bp, Homo sapiens
tgaatgctttttgaatgt

SEQ ID NO: 3951943 - DNA, 19 bp, Homo sapiens
tgaatgctttttgaatgtt

SEQ ID NO: 3951944 - DNA, 23 bp, Homo sapiens
tgaatgctttttgaatgttattt

SEQ ID NO: 3951945 - DNA, 15 bp, Homo sapiens
tgaatggtccagggt

SEQ ID NO: 3951946 - DNA, 22 bp, Homo sapiens
tgaatggttccatgcctgaggg

SEQ ID NO: 3951947 - DNA, 23 bp, Homo sapiens
tgaatggttccatgcctgagggt

SEQ ID NO: 3951948 - DNA, 14 bp, Homo sapiens
tgaatgttatttgt

SEQ ID NO: 3951949 - DNA, 23 bp, Homo sapiens
tgaatgttatttgttattttcag

SEQ ID NO: 3951950 - DNA, 18 bp, Homo sapiens
tgaatgtttatgttctca

SEQ ID NO: 3951951 - DNA, 19 bp, Homo sapiens
tgaatgtttattccttgat

SEQ ID NO: 3951952 - DNA, 19 bp, Homo sapiens
tgaattaagttattgattt

SEQ ID NO: 3951953 - DNA, 19 bp, Homo sapiens
tgaattattttgttgtgat

SEQ ID NO: 3951954 - DNA, 11 bp, Homo sapiens
tgaattcctgg

SEQ ID NO: 3951955 - DNA, 14 bp, Homo sapiens
tgaattctgtgaag

SEQ ID NO: 3951956 - DNA, 17 bp, Homo sapiens
tgaattcttatgcttat

SEQ ID NO: 3951957 - DNA, 16 bp, Homo sapiens
tgaattgcctgcagag

SEQ ID NO: 3951958 - DNA, 21 bp, Homo sapiens
tccctttcccatgatccagaa

SEQ ID NO: 3951959 - DNA, 17 bp, Homo sapiens
tccctttctcttcttcc

SEQ ID NO: 3951960 - DNA, 18 bp, Homo sapiens
tccgaaaccagttaagaa

SEQ ID NO: 3951961 - DNA, 15 bp, Homo sapiens
tccgcaccagctgct

SEQ ID NO: 3951962 - DNA, 16 bp, Homo sapiens
tccgcaccagctgctc

SEQ ID NO: 3951963 - DNA, 23 bp, Homo sapiens
tccgcaccagctgctctgcccct

SEQ ID NO: 3951964 - DNA, 15 bp, Homo sapiens
tccgccattccaagt

SEQ ID NO: 3951965 - DNA, 13 bp, Homo sapiens
tccgcctctgtcc

SEQ ID NO: 3951966 - DNA, 14 bp, Homo sapiens
tccgctgccaccac

SEQ ID NO: 3951967 - DNA, 21 bp, Homo sapiens
tccgctgtcgccccaggccct

SEQ ID NO: 3951968 - DNA, 17 bp, Homo sapiens
tccggaaatgaaggaat

SEQ ID NO: 3951969 - DNA, 18 bp, Homo sapiens
tccggagaattgcctcta

SEQ ID NO: 3951970 - DNA, 21 bp, Homo sapiens
tccggaggggttgcgggggag

SEQ ID NO: 3951971 - DNA, 16 bp, Homo sapiens
tccgggacgcttccag

SEQ ID NO: 3951972 - DNA, 21 bp, Homo sapiens
tccgggacgcttccagaccac

SEQ ID NO: 3951973 - DNA, 16 bp, Homo sapiens
tccggggtctgtgctg

SEQ ID NO: 3951974 - DNA, 20 bp, Homo sapiens
tccggggtctgtgctgtgcc

SEQ ID NO: 3951975 - DNA, 15 bp, Homo sapiens
tccgggtgtggcctc

SEQ ID NO: 3951976 - DNA, 15 bp, Homo sapiens
tccgtagttccctga

SEQ ID NO: 3951977 - DNA, 22 bp, Homo sapiens
tccgtcacatatacaaaagcaa

SEQ ID NO: 3951978 - DNA, 13 bp, Homo sapiens
tccgtcaggagag

SEQ ID NO: 3951979 - DNA, 13 bp, Homo sapiens
tccgtccacccag

SEQ ID NO: 3951980 - DNA, 17 bp, Homo sapiens
tccgtcccaaacagagg

SEQ ID NO: 3951981 - DNA, 17 bp, Homo sapiens
tccgtctccctaaaata

SEQ ID NO: 3951982 - DNA, 12 bp, Homo sapiens
tccgtgctgggc

SEQ ID NO: 3951983 - DNA, 13 bp, Homo sapiens
tccgtgctgggct

SEQ ID NO: 3951984 - DNA, 18 bp, Homo sapiens
tcctaaaaataagcttta

SEQ ID NO: 3951985 - DNA, 20 bp, Homo sapiens
tcctaaaaataagctttatt

SEQ ID NO: 3951986 - DNA, 17 bp, Homo sapiens
tcctaaaagtggttttt

SEQ ID NO: 3951987 - DNA, 19 bp, Homo sapiens
tcctaaacccccgctccag

SEQ ID NO: 3951988 - DNA, 21 bp, Homo sapiens
tcctaaacccccgctccagat

SEQ ID NO: 3951989 - DNA, 13 bp, Homo sapiens
tcctaactgagaa

SEQ ID NO: 3951990 - DNA, 17 bp, Homo sapiens
tcctaagcagctgggac

SEQ ID NO: 3951991 - DNA, 22 bp, Homo sapiens
tcctaagtgggaagtgaagccc

SEQ ID NO: 3951992 - DNA, 23 bp, Homo sapiens
tcctaagtgggaagtgaagcccc

SEQ ID NO: 3951993 - DNA, 13 bp, Homo sapiens
tcctacaaaatgg

SEQ ID NO: 3951994 - DNA, 16 bp, Homo sapiens
tcctacagatagtcaa

SEQ ID NO: 3951995 - DNA, 16 bp, Homo sapiens
tcctaccaaatataaa

SEQ ID NO: 3951996 - DNA, 15 bp, Homo sapiens
tcctaccaatgcatg

SEQ ID NO: 3951997 - DNA, 16 bp, Homo sapiens
tcctaccaatgcatgc

SEQ ID NO: 3951998 - DNA, 21 bp, Homo sapiens
tcctaccccacctcatgcctg

SEQ ID NO: 3951999 - DNA, 16 bp, Homo sapiens
tcctacctgctgctgc

SEQ ID NO: 3952000 - DNA, 18 bp, Homo sapiens
tcctacctgctgctgcta

SEQ ID NO: 3952001 - DNA, 23 bp, Homo sapiens
tcctagaaccaagcttcagagcc

SEQ ID NO: 3952002 - DNA, 22 bp, Homo sapiens
tcctagagctcctgtccctacc

SEQ ID NO: 3952003 - DNA, 14 bp, Homo sapiens
tcctagaggacctg

SEQ ID NO: 3952004 - DNA, 13 bp, Homo sapiens
tcctaggagaagc

SEQ ID NO: 3952005 - DNA, 16 bp, Homo sapiens
tcctaggccccagagc

SEQ ID NO: 3952006 - DNA, 15 bp, Homo sapiens
tcctaggtgctggat

SEQ ID NO: 3952007 - DNA, 23 bp, Homo sapiens
tcctagtgaaagaggcagcttga

SEQ ID NO: 3952008 - DNA, 18 bp, Homo sapiens
tcctagtttgacctcaca

SEQ ID NO: 3952009 - DNA, 21 bp, Homo sapiens
tcctagtttgacctcacagtg

SEQ ID NO: 3952010 - DNA, 23 bp, Homo sapiens
tcctagtttgacctcacagtgac

SEQ ID NO: 3952011 - DNA, 23 bp, Homo sapiens
tcctataccatatgtctgcttct

SEQ ID NO: 3952012 - DNA, 12 bp, Homo sapiens
tcctatgtgtga

SEQ ID NO: 3952013 - DNA, 15 bp, Homo sapiens
tcctattatgtgttc

SEQ ID NO: 3952014 - DNA, 20 bp, Homo sapiens
tcctattctcaccaggaagg

SEQ ID NO: 3952015 - DNA, 21 bp, Homo sapiens
tcctatttatgaaaaccatat

SEQ ID NO: 3952016 - DNA, 20 bp, Homo sapiens
tcctattttaaaaccatgca

SEQ ID NO: 3952017 - DNA, 15 bp, Homo sapiens
tcctatttttcagaa

SEQ ID NO: 3952018 - DNA, 15 bp, Homo sapiens
tcctcacagcctctc

SEQ ID NO: 3952019 - DNA, 16 bp, Homo sapiens
tcctcacagcctctcc

SEQ ID NO: 3952020 - DNA, 18 bp, Homo sapiens
tcctcacagcctctccct

SEQ ID NO: 3952021 - DNA, 19 bp, Homo sapiens
tcctcacagcctctccctt

SEQ ID NO: 3952022 - DNA, 14 bp, Homo sapiens
tcctcacaggagca

SEQ ID NO: 3952023 - DNA, 14 bp, Homo sapiens
tcttcctctgctga

SEQ ID NO: 3952024 - DNA, 16 bp, Homo sapiens
tcttcctgattcccca

SEQ ID NO: 3952025 - DNA, 18 bp, Homo sapiens
tcttcctgcaaggactac

SEQ ID NO: 3952026 - DNA, 13 bp, Homo sapiens
tcttcctgctgct

SEQ ID NO: 3952027 - DNA, 14 bp, Homo sapiens
tcttcctgctgctg

SEQ ID NO: 3952028 - DNA, 16 bp, Homo sapiens
tcttctacaaccagag

SEQ ID NO: 3952029 - DNA, 14 bp, Homo sapiens
tcttctatttaaaa

SEQ ID NO: 3952030 - DNA, 15 bp, Homo sapiens
tcttctattttattc

SEQ ID NO: 3952031 - DNA, 13 bp, Homo sapiens
tcttctccactgg

SEQ ID NO: 3952032 - DNA, 12 bp, Homo sapiens
tcttctccatct

SEQ ID NO: 3952033 - DNA, 15 bp, Homo sapiens
tcttctcttcctgta

SEQ ID NO: 3952034 - DNA, 17 bp, Homo sapiens
tcttctgccagcctccc

SEQ ID NO: 3952035 - DNA, 17 bp, Homo sapiens
tcttctggagtctccag

SEQ ID NO: 3952036 - DNA, 11 bp, Homo sapiens
tcttctggctt

SEQ ID NO: 3952037 - DNA, 13 bp, Homo sapiens
tcttctgttctca

SEQ ID NO: 3952038 - DNA, 14 bp, Homo sapiens
tcttctgttctcaa

SEQ ID NO: 3952039 - DNA, 12 bp, Homo sapiens
tcttcttatgca

SEQ ID NO: 3952040 - DNA, 13 bp, Homo sapiens
tcatcaattttta

SEQ ID NO: 3952041 - DNA, 18 bp, Homo sapiens
tcatcaatttttatacat

SEQ ID NO: 3952042 - DNA, 20 bp, Homo sapiens
tcatcacccagtcctggcca

SEQ ID NO: 3952043 - DNA, 20 bp, Homo sapiens
tcatcactccctggatgtgt

SEQ ID NO: 3952044 - DNA, 22 bp, Homo sapiens
tcatcactggatgaagattctc

SEQ ID NO: 3952045 - DNA, 20 bp, Homo sapiens
tcatcatgttggccaggctg

SEQ ID NO: 3952046 - DNA, 14 bp, Homo sapiens
tcatcattccttga

SEQ ID NO: 3952047 - DNA, 21 bp, Homo sapiens
tcatccagtttgttctccggg

SEQ ID NO: 3952048 - DNA, 20 bp, Homo sapiens
tcatccataaagcaagctca

SEQ ID NO: 3952049 - DNA, 13 bp, Homo sapiens
tcatcccagctgc

SEQ ID NO: 3952050 - DNA, 22 bp, Homo sapiens
tcatcccatctaagctgcagct

SEQ ID NO: 3952051 - DNA, 20 bp, Homo sapiens
tcatcccctcgtcctgtccc

SEQ ID NO: 3952052 - DNA, 13 bp, Homo sapiens
tcatccccttgtg

SEQ ID NO: 3952053 - DNA, 18 bp, Homo sapiens
tcatccccttgtgtcaga

SEQ ID NO: 3952054 - DNA, 14 bp, Homo sapiens
tccatgcctgaggg

SEQ ID NO: 3952055 - DNA, 21 bp, Homo sapiens
tccatgcctgagggtggagac

SEQ ID NO: 3952056 - DNA, 12 bp, Homo sapiens
tccatggaggag

SEQ ID NO: 3952057 - DNA, 20 bp, Homo sapiens
tccatggaggaggtgtccca

SEQ ID NO: 3952058 - DNA, 22 bp, Homo sapiens
tccatggaggaggtgtcccaag

SEQ ID NO: 3952059 - DNA, 23 bp, Homo sapiens
tccatggaggaggtgtcccaagc

SEQ ID NO: 3952060 - DNA, 16 bp, Homo sapiens
tccatggcaccagccc

SEQ ID NO: 3952061 - DNA, 17 bp, Homo sapiens
tccatggcaccagcccc

SEQ ID NO: 3952062 - DNA, 18 bp, Homo sapiens
tccatggcaccagccccc

SEQ ID NO: 3952063 - DNA, 12 bp, Homo sapiens
tccatggccacc

SEQ ID NO: 3952064 - DNA, 13 bp, Homo sapiens
tccatggccaccc

SEQ ID NO: 3952065 - DNA, 22 bp, Homo sapiens
tccatggggaagtgctccccac

SEQ ID NO: 3952066 - DNA, 16 bp, Homo sapiens
tccatgtcgcctctgc

SEQ ID NO: 3952067 - DNA, 17 bp, Homo sapiens
tccatgtcgcctctgca

SEQ ID NO: 3952068 - DNA, 18 bp, Homo sapiens
tccatgtggccccaggtg

SEQ ID NO: 3952069 - DNA, 20 bp, Homo sapiens
tccatgtggccccaggtgcc

SEQ ID NO: 3952070 - DNA, 19 bp, Homo sapiens
tccatgttaaaatagacaa

SEQ ID NO: 3952071 - DNA, 19 bp, Homo sapiens
tccatgtttgtaaaactac

SEQ ID NO: 3952072 - DNA, 12 bp, Homo sapiens
tccattcctcag

SEQ ID NO: 3952073 - DNA, 13 bp, Homo sapiens
tccattcctcagg

SEQ ID NO: 3952074 - DNA, 14 bp, Homo sapiens
tccattcctcaggg

SEQ ID NO: 3952075 - DNA, 19 bp, Homo sapiens
tccatttcacacaggtcct

SEQ ID NO: 3952076 - DNA, 20 bp, Homo sapiens
tccatttctcaatcagtgca

SEQ ID NO: 3952077 - DNA, 15 bp, Homo sapiens
tcccaaaatactaca

SEQ ID NO: 3952078 - DNA, 22 bp, Homo sapiens
tcccaaattccctggacctctg

SEQ ID NO: 3952079 - DNA, 22 bp, Homo sapiens
tcccaacctcaatgccctgcca

SEQ ID NO: 3952080 - DNA, 13 bp, Homo sapiens
tcccaagaaatgc

SEQ ID NO: 3952081 - DNA, 22 bp, Homo sapiens
tcccaaggagctgatttccagg

SEQ ID NO: 3952082 - DNA, 15 bp, Homo sapiens
tcccaataaaagtga

SEQ ID NO: 3952083 - DNA, 17 bp, Homo sapiens
tcccaataaaagtgact

SEQ ID NO: 3952084 - DNA, 13 bp, Homo sapiens
tcccaataaagct

SEQ ID NO: 3952085 - DNA, 14 bp, Homo sapiens
tcccaataaagctg

SEQ ID NO: 3952086 - DNA, 15 bp, Homo sapiens
tcccaatcagcactg

SEQ ID NO: 3952087 - DNA, 14 bp, Homo sapiens
tcccaatgcacatc

SEQ ID NO: 3952088 - DNA, 22 bp, Homo sapiens
tcccaatgcacatccattccca

SEQ ID NO: 3952089 - DNA, 12 bp, Homo sapiens
tcccaattcatt

SEQ ID NO: 3952090 - DNA, 17 bp, Homo sapiens
tcccacaggcccttcct

SEQ ID NO: 3952091 - DNA, 18 bp, Homo sapiens
tcccacatccctgggcct

SEQ ID NO: 3952092 - DNA, 21 bp, Homo sapiens
tcccacatccctgggcctgct

SEQ ID NO: 3952093 - DNA, 19 bp, Homo sapiens
tcccacattcggaccctgc

SEQ ID NO: 3952094 - DNA, 16 bp, Homo sapiens
tcccaccaactctgca

SEQ ID NO: 3952095 - DNA, 18 bp, Homo sapiens
tcccaccaactctgcact

SEQ ID NO: 3952096 - DNA, 23 bp, Homo sapiens
tcccaccaactctgcactccatg

SEQ ID NO: 3952097 - DNA, 15 bp, Homo sapiens
tcccaccaccctgag

SEQ ID NO: 3952098 - DNA, 22 bp, Homo sapiens
tcccaccccacccccttcagtg

SEQ ID NO: 3952099 - DNA, 15 bp, Homo sapiens
tcccaccccactcca

SEQ ID NO: 3952100 - DNA, 16 bp, Homo sapiens
tcccaccccactccag

SEQ ID NO: 3952101 - DNA, 19 bp, Homo sapiens
tcccaccccactccagccc

SEQ ID NO: 3952102 - DNA, 17 bp, Homo sapiens
tcccaccccggcctcca

SEQ ID NO: 3952103 - DNA, 18 bp, Homo sapiens
tcccaccgggagcctccc

SEQ ID NO: 3952104 - DNA, 22 bp, Homo sapiens
tcccacctcttctcttcctgta

SEQ ID NO: 3952105 - DNA, 20 bp, Homo sapiens
tcccactaagctttctcctt

SEQ ID NO: 3952106 - DNA, 22 bp, Homo sapiens
tcccactaagctttctcctttg

SEQ ID NO: 3952107 - DNA, 23 bp, Homo sapiens
tcccactcatgttgttcccacac

SEQ ID NO: 3952108 - DNA, 13 bp, Homo sapiens
tcccactggaaca

SEQ ID NO: 3952109 - DNA, 16 bp, Homo sapiens
tcccacttcactgtga

SEQ ID NO: 3952110 - DNA, 12 bp, Homo sapiens
tcccacttgtca

SEQ ID NO: 3952111 - DNA, 12 bp, Homo sapiens
tcccagaaatta

SEQ ID NO: 3952112 - DNA, 18 bp, Homo sapiens
tcccagaaccacactgtt

SEQ ID NO: 3952113 - DNA, 13 bp, Homo sapiens
tcccagaagggag

SEQ ID NO: 3952114 - DNA, 18 bp, Homo sapiens
tcccagagacaggaaaat

SEQ ID NO: 3952115 - DNA, 20 bp, Homo sapiens
tcccagagcttattggccac

SEQ ID NO: 3952116 - DNA, 19 bp, Homo sapiens
tcccagagcttcccaggat

SEQ ID NO: 3952117 - DNA, 23 bp, Homo sapiens
tcccagaggttatctgcctggcc

SEQ ID NO: 3952118 - DNA, 14 bp, Homo sapiens
tcccagagtcagag

SEQ ID NO: 3952119 - DNA, 17 bp, Homo sapiens
tcccagagtcagaggag

SEQ ID NO: 3952120 - DNA, 16 bp, Homo sapiens
tcccagatcctctgct

SEQ ID NO: 3952121 - DNA, 23 bp, Homo sapiens
tcccagcactttgggaggccaag

SEQ ID NO: 3952122 - DNA, 12 bp, Homo sapiens
tcccccagcctc

SEQ ID NO: 3952123 - DNA, 15 bp, Homo sapiens
tcccccatgtggctg

SEQ ID NO: 3952124 - DNA, 18 bp, Homo sapiens
tccccccactgcaggccc

SEQ ID NO: 3952125 - DNA, 14 bp, Homo sapiens
tcccccccagtgca

SEQ ID NO: 3952126 - DNA, 18 bp, Homo sapiens
tcccccgacactgctgca

SEQ ID NO: 3952127 - DNA, 19 bp, Homo sapiens
tcccccgacactgctgcac

SEQ ID NO: 3952128 - DNA, 22 bp, Homo sapiens
tcccccgacactgctgcaccag

SEQ ID NO: 3952129 - DNA, 12 bp, Homo sapiens
tccccctgcctt

SEQ ID NO: 3952130 - DNA, 17 bp, Homo sapiens
tccccctgcctttgaaa

SEQ ID NO: 3952131 - DNA, 12 bp, Homo sapiens
tccccggcctca

SEQ ID NO: 3952132 - DNA, 15 bp, Homo sapiens
tccccgggggaggaa

SEQ ID NO: 3952133 - DNA, 18 bp, Homo sapiens
tcccctatccacccagcc

SEQ ID NO: 3952134 - DNA, 14 bp, Homo sapiens
tcccctcactctgt

SEQ ID NO: 3952135 - DNA, 18 bp, Homo sapiens
tcccctcactctgtcagc

SEQ ID NO: 3952136 - DNA, 20 bp, Homo sapiens
tcccctcagagctcttatgt

SEQ ID NO: 3952137 - DNA, 17 bp, Homo sapiens
tcccctctccctgggga

SEQ ID NO: 3952138 - DNA, 13 bp, Homo sapiens
tcccctctgccct

SEQ ID NO: 3952139 - DNA, 19 bp, Homo sapiens
tcccctctgccctgtatat

SEQ ID NO: 3952140 - DNA, 19 bp, Homo sapiens
tcccctctgtcatcactcc

SEQ ID NO: 3952141 - DNA, 14 bp, Homo sapiens
tcccctgaaaaact

SEQ ID NO: 3952142 - DNA, 23 bp, Homo sapiens
tcccctgcccccagaccttttat

SEQ ID NO: 3952143 - DNA, 22 bp, Homo sapiens
tcccctgcccccatcccacatg

SEQ ID NO: 3952144 - DNA, 12 bp, Homo sapiens
tcccctgccctg

SEQ ID NO: 3952145 - DNA, 20 bp, Homo sapiens
tcccctgctactcctgtgct

SEQ ID NO: 3952146 - DNA, 21 bp, Homo sapiens
tcccctgggcatcttctggct

SEQ ID NO: 3952147 - DNA, 14 bp, Homo sapiens
tcccctgggcctgg

SEQ ID NO: 3952148 - DNA, 15 bp, Homo sapiens
tcccctgtcccacca

SEQ ID NO: 3952149 - DNA, 16 bp, Homo sapiens
tcccctgtcccaccaa

SEQ ID NO: 3952150 - DNA, 20 bp, Homo sapiens
tcccctgtcccaccaactct

SEQ ID NO: 3952151 - DNA, 18 bp, Homo sapiens
tcccctgtcttctctcaa

SEQ ID NO: 3952152 - DNA, 17 bp, Homo sapiens
tcccctgtggtcttgga

SEQ ID NO: 3952153 - DNA, 16 bp, Homo sapiens
tcccgccgcccgaccc

SEQ ID NO: 3952154 - DNA, 18 bp, Homo sapiens
tcccgcgggcctggacac

SEQ ID NO: 3952155 - DNA, 16 bp, Homo sapiens
tcccgctcagccctcc

SEQ ID NO: 3952156 - DNA, 22 bp, Homo sapiens
tcccggagcacagccctgggag

SEQ ID NO: 3952157 - DNA, 15 bp, Homo sapiens
tcccggttcaccttg

SEQ ID NO: 3952158 - DNA, 16 bp, Homo sapiens
tcccggttcaccttgc

SEQ ID NO: 3952159 - DNA, 23 bp, Homo sapiens
tcccgtgaaagaattatttttgt

SEQ ID NO: 3952160 - DNA, 15 bp, Homo sapiens
tccctaaggaatctg

SEQ ID NO: 3952161 - DNA, 15 bp, Homo sapiens
tccctaatcctccaa

SEQ ID NO: 3952162 - DNA, 12 bp, Homo sapiens
tccctacccact

SEQ ID NO: 3952163 - DNA, 14 bp, Homo sapiens
tccctacccactct

SEQ ID NO: 3952164 - DNA, 22 bp, Homo sapiens
tccctaccgagtctcttctcca

SEQ ID NO: 3952165 - DNA, 17 bp, Homo sapiens
tccctactcccctgggc

SEQ ID NO: 3952166 - DNA, 23 bp, Homo sapiens
tccctagatctttctattccaaa

SEQ ID NO: 3952167 - DNA, 15 bp, Homo sapiens
tccctatcaaaacat

SEQ ID NO: 3952168 - DNA, 22 bp, Homo sapiens
tccctatcaaaacatatcaatt

SEQ ID NO: 3952169 - DNA, 16 bp, Homo sapiens
tccctcagtgccctca

SEQ ID NO: 3952170 - DNA, 23 bp, Homo sapiens
tccctcattccaccttcccatgc

SEQ ID NO: 3952171 - DNA, 15 bp, Homo sapiens
tccctccatccggct

SEQ ID NO: 3952172 - DNA, 14 bp, Homo sapiens
tccctcctctggcc

SEQ ID NO: 3952173 - DNA, 13 bp, Homo sapiens
tccctcctggagc

SEQ ID NO: 3952174 - DNA, 18 bp, Homo sapiens
tccctccttcccttctct

SEQ ID NO: 3952175 - DNA, 24 bp, Homo sapiens
tccctcggaagccgtctgactcca

SEQ ID NO: 3952176 - DNA, 18 bp, Homo sapiens
tccctcggagctgccagc

SEQ ID NO: 3952177 - DNA, 18 bp, Homo sapiens
tccctcgtccacaggggc

SEQ ID NO: 3952178 - DNA, 12 bp, Homo sapiens
tccctctcccag

SEQ ID NO: 3952179 - DNA, 21 bp, Homo sapiens
tccctctcccaggccccatga

SEQ ID NO: 3952180 - DNA, 13 bp, Homo sapiens
tccctctcctgcc

SEQ ID NO: 3952181 - DNA, 22 bp, Homo sapiens
tccctctgagaattccaaggag

SEQ ID NO: 3952182 - DNA, 17 bp, Homo sapiens
tccctctggccctgcct

SEQ ID NO: 3952183 - DNA, 18 bp, Homo sapiens
tccctctggccctgcctt

SEQ ID NO: 3952184 - DNA, 16 bp, Homo sapiens
tccctcttccttcccc

SEQ ID NO: 3952185 - DNA, 11 bp, Homo sapiens
tccctctttcc

SEQ ID NO: 3952186 - DNA, 17 bp, Homo sapiens
tccctctttccccacct

SEQ ID NO: 3952187 - DNA, 20 bp, Homo sapiens
tccctctttctacattctca

SEQ ID NO: 3952188 - DNA, 15 bp, Homo sapiens
tccctgaaaacccag

SEQ ID NO: 3952189 - DNA, 16 bp, Homo sapiens
tccctgaaaacccaga

SEQ ID NO: 3952190 - DNA, 20 bp, Homo sapiens
tccctgaaaacccagagagg

SEQ ID NO: 3952191 - DNA, 15 bp, Homo sapiens
tccctgaaccatccc

SEQ ID NO: 3952192 - DNA, 20 bp, Homo sapiens
tccctgaacctcagtttcct

SEQ ID NO: 3952193 - DNA, 17 bp, Homo sapiens
tccctgactccctgtgg

SEQ ID NO: 3952194 - DNA, 17 bp, Homo sapiens
tccctgagtcaccagga

SEQ ID NO: 3952195 - DNA, 23 bp, Homo sapiens
  misc_feature (14)..(14): n is a, c, g or t
tccctgcacctgcnttgtccctg

SEQ ID NO: 3952196 - DNA, 19 bp, Homo sapiens
tccctgcatccaatctgct

SEQ ID NO: 3952197 - DNA, 14 bp, Homo sapiens
tccctgcatttctg

SEQ ID NO: 3952198 - DNA, 17 bp, Homo sapiens
tccctgcatttctgagt

SEQ ID NO: 3952199 - DNA, 14 bp, Homo sapiens
tccctgccgcctca

SEQ ID NO: 3952200 - DNA, 22 bp, Homo sapiens
tccctgctaccaaggcccagct

SEQ ID NO: 3952201 - DNA, 23 bp, Homo sapiens
tccctgctaccaaggcccagcta

SEQ ID NO: 3952202 - DNA, 18 bp, Homo sapiens
tccctggcatgtcagagc

SEQ ID NO: 3952203 - DNA, 15 bp, Homo sapiens
tccctggctctcaga

SEQ ID NO: 3952204 - DNA, 18 bp, Homo sapiens
tccctggctctcagaagg

SEQ ID NO: 3952205 - DNA, 19 bp, Homo sapiens
tccctggctctcagaaggt

SEQ ID NO: 3952206 - DNA, 22 bp, Homo sapiens
tccctggcttgtaactccacca

SEQ ID NO: 3952207 - DNA, 18 bp, Homo sapiens
tccctgggaactcatcct

SEQ ID NO: 3952208 - DNA, 19 bp, Homo sapiens
tccctgggcccctccacgc

SEQ ID NO: 3952209 - DNA, 17 bp, Homo sapiens
tcattttaggcctcctc

SEQ ID NO: 3952210 - DNA, 14 bp, Homo sapiens
tcattttagtgact

SEQ ID NO: 3952211 - DNA, 16 bp, Homo sapiens
tcatttttttaacaca

SEQ ID NO: 3952212 - DNA, 13 bp, Homo sapiens
tccaaactcctgc

SEQ ID NO: 3952213 - DNA, 15 bp, Homo sapiens
tccaaactcctgcct

SEQ ID NO: 3952214 - DNA, 13 bp, Homo sapiens
tccaaagagaaaa

SEQ ID NO: 3952215 - DNA, 16 bp, Homo sapiens
tccaaagccccacctt

SEQ ID NO: 3952216 - DNA, 23 bp, Homo sapiens
tccaaaggaatctccagttttca

SEQ ID NO: 3952217 - DNA, 21 bp, Homo sapiens
tccaaaggggctgctggggca

SEQ ID NO: 3952218 - DNA, 19 bp, Homo sapiens
tccaaatattattcaagtg

SEQ ID NO: 3952219 - DNA, 22 bp, Homo sapiens
tccaaatattattcaagtgcct

SEQ ID NO: 3952220 - DNA, 19 bp, Homo sapiens
tccaaatgattttcatcaa

SEQ ID NO: 3952221 - DNA, 22 bp, Homo sapiens
tccaaatgtgatcaactgttca

SEQ ID NO: 3952222 - DNA, 17 bp, Homo sapiens
tccaacaataaagagct

SEQ ID NO: 3952223 - DNA, 18 bp, Homo sapiens
tccaacaataaagagctc

SEQ ID NO: 3952224 - DNA, 19 bp, Homo sapiens
tccaacaataaagagctca

SEQ ID NO: 3952225 - DNA, 12 bp, Homo sapiens
tccaacagcttg

SEQ ID NO: 3952226 - DNA, 14 bp, Homo sapiens
tccaaccccagctg

SEQ ID NO: 3952227 - DNA, 18 bp, Homo sapiens
tccaaccccagctggcct

SEQ ID NO: 3952228 - DNA, 20 bp, Homo sapiens
tccaaccccagctggcctct

SEQ ID NO: 3952229 - DNA, 20 bp, Homo sapiens
tccaacctaacccctttcct

SEQ ID NO: 3952230 - DNA, 23 bp, Homo sapiens
tccaacctaacccctttcctgcg

SEQ ID NO: 3952231 - DNA, 20 bp, Homo sapiens
tccaacgttaaaagacagtg

SEQ ID NO: 3952232 - DNA, 15 bp, Homo sapiens
tccaagatttcagaa

SEQ ID NO: 3952233 - DNA, 22 bp, Homo sapiens
tccaagcgaggtcaacagagaa

SEQ ID NO: 3952234 - DNA, 22 bp, Homo sapiens
tccaaggagaaacagagacagg

SEQ ID NO: 3952235 - DNA, 23 bp, Homo sapiens
tccaaggagaaacagagacaggc

SEQ ID NO: 3952236 - DNA, 21 bp, Homo sapiens
tccaaggagttccatgaagac

SEQ ID NO: 3952237 - DNA, 21 bp, Homo sapiens
tccaagggtatgggaagccat

SEQ ID NO: 3952238 - DNA, 22 bp, Homo sapiens
tccaagtcttcagcgagaccct

SEQ ID NO: 3952239 - DNA, 15 bp, Homo sapiens
tccaagtgccaatat

SEQ ID NO: 3952240 - DNA, 20 bp, Homo sapiens
tccaagttcctgcactccag

SEQ ID NO: 3952241 - DNA, 11 bp, Homo sapiens
tccaatatttg

SEQ ID NO: 3952242 - DNA, 18 bp, Homo sapiens
tccaatggagttcagaga

SEQ ID NO: 3952243 - DNA, 20 bp, Homo sapiens
tccaatggctgtaaactata

SEQ ID NO: 3952244 - DNA, 22 bp, Homo sapiens
tccaattttctggaatacatga

SEQ ID NO: 3952245 - DNA, 16 bp, Homo sapiens
tccacaaagccgtgcc

SEQ ID NO: 3952246 - DNA, 23 bp, Homo sapiens
tccacaaagccgtgcctttctct

SEQ ID NO: 3952247 - DNA, 20 bp, Homo sapiens
tccacaagattcccagagac

SEQ ID NO: 3952248 - DNA, 21 bp, Homo sapiens
tccacaagattcccagagaca

SEQ ID NO: 3952249 - DNA, 19 bp, Homo sapiens
tccacacacagaggaagag

SEQ ID NO: 3952250 - DNA, 22 bp, Homo sapiens
tccacacacagaggaagagcag

SEQ ID NO: 3952251 - DNA, 15 bp, Homo sapiens
tccacacacgcagga

SEQ ID NO: 3952252 - DNA, 23 bp, Homo sapiens
tccacaccatcaccctctgggca

SEQ ID NO: 3952253 - DNA, 21 bp, Homo sapiens
tccacactgtcagagctgttg

SEQ ID NO: 3952254 - DNA, 16 bp, Homo sapiens
tccacaggggcaggcc

SEQ ID NO: 3952255 - DNA, 18 bp, Homo sapiens
tccacagtctcccattct

SEQ ID NO: 3952256 - DNA, 20 bp, Homo sapiens
tccacagtgcccagctaatt

SEQ ID NO: 3952257 - DNA, 13 bp, Homo sapiens
tccacagtgctgc

SEQ ID NO: 3952258 - DNA, 14 bp, Homo sapiens
tccacatcttctca

SEQ ID NO: 3952259 - DNA, 15 bp, Homo sapiens
tccacatcttctcag

SEQ ID NO: 3952260 - DNA, 13 bp, Homo sapiens
tccaccaatctct

SEQ ID NO: 3952261 - DNA, 17 bp, Homo sapiens
tccaccacccaaaagtc

SEQ ID NO: 3952262 - DNA, 17 bp, Homo sapiens
tccaccattcacatttg

SEQ ID NO: 3952263 - DNA, 17 bp, Homo sapiens
tccacccaccttggcct

SEQ ID NO: 3952264 - DNA, 14 bp, Homo sapiens
tccacccaggctgc

SEQ ID NO: 3952265 - DNA, 21 bp, Homo sapiens
tccacccaggctgcactgcag

SEQ ID NO: 3952266 - DNA, 24 bp, Homo sapiens
tccacccaggctgcactgcagtga

SEQ ID NO: 3952267 - DNA, 13 bp, Homo sapiens
tccacccagtgct

SEQ ID NO: 3952268 - DNA, 17 bp, Homo sapiens
tccacccagtgctgcca

SEQ ID NO: 3952269 - DNA, 24 bp, Homo sapiens
tccacccattcccccatgtggctg

SEQ ID NO: 3952270 - DNA, 20 bp, Homo sapiens
tccaccccactggatcttca

SEQ ID NO: 3952271 - DNA, 22 bp, Homo sapiens
tccacccccgccacggccaccc

SEQ ID NO: 3952272 - DNA, 23 bp, Homo sapiens
tccacccccgccacggccaccct

SEQ ID NO: 3952273 - DNA, 21 bp, Homo sapiens
tccaccccctccagctccagt

SEQ ID NO: 3952274 - DNA, 14 bp, Homo sapiens
tccaccctatccct

SEQ ID NO: 3952275 - DNA, 18 bp, Homo sapiens
tccaccgcagaaggaagg

SEQ ID NO: 3952276 - DNA, 13 bp, Homo sapiens
tccaccgctgcct

SEQ ID NO: 3952277 - DNA, 19 bp, Homo sapiens
tatgctggccagcaccctc

SEQ ID NO: 3952278 - DNA, 22 bp, Homo sapiens
tatgctggccagcaccctctcc

SEQ ID NO: 3952279 - DNA, 20 bp, Homo sapiens
tatggaaccttccctccaaa

SEQ ID NO: 3952280 - DNA, 20 bp, Homo sapiens
tatggaacttctaatatatt

SEQ ID NO: 3952281 - DNA, 24 bp, Homo sapiens
tatggaatacagtgttattttctt

SEQ ID NO: 3952282 - DNA, 14 bp, Homo sapiens
tatggagagccctg

SEQ ID NO: 3952283 - DNA, 15 bp, Homo sapiens
tatggagagccctgg

SEQ ID NO: 3952284 - DNA, 16 bp, Homo sapiens
tatggagagccctggg

SEQ ID NO: 3952285 - DNA, 19 bp, Homo sapiens
tatggaggctttgcataga

SEQ ID NO: 3952286 - DNA, 19 bp, Homo sapiens
tatggcatatttatattgt

SEQ ID NO: 3952287 - DNA, 15 bp, Homo sapiens
tatggcatgatttat

SEQ ID NO: 3952288 - DNA, 20 bp, Homo sapiens
tatggggctgaacggggaga

SEQ ID NO: 3952289 - DNA, 20 bp, Homo sapiens
tatggtataatggttgactg

SEQ ID NO: 3952290 - DNA, 16 bp, Homo sapiens
tatggtatgctggcca

SEQ ID NO: 3952291 - DNA, 13 bp, Homo sapiens
tatggtgtaatgc

SEQ ID NO: 3952292 - DNA, 16 bp, Homo sapiens
tatggtgtgttcctaa

SEQ ID NO: 3952293 - DNA, 20 bp, Homo sapiens
tatggttcccaataaaagtg

SEQ ID NO: 3952294 - DNA, 17 bp, Homo sapiens
tatggtttctgcgtgct

SEQ ID NO: 3952295 - DNA, 19 bp, Homo sapiens
tatgtaaactgcattagaa

SEQ ID NO: 3952296 - DNA, 14 bp, Homo sapiens
tatgtaaagtatgt

SEQ ID NO: 3952297 - DNA, 20 bp, Homo sapiens
tatgtaaagtatgtaaacag

SEQ ID NO: 3952298 - DNA, 17 bp, Homo sapiens
tatgtaacatccagaag

SEQ ID NO: 3952299 - DNA, 21 bp, Homo sapiens
tatgtaattattttctttttg

SEQ ID NO: 3952300 - DNA, 21 bp, Homo sapiens
tatgtactgttattgaaaata

SEQ ID NO: 3952301 - DNA, 21 bp, Homo sapiens
tatgtagcccggccagggcct

SEQ ID NO: 3952302 - DNA, 13 bp, Homo sapiens
tatgtatacacac

SEQ ID NO: 3952303 - DNA, 16 bp, Homo sapiens
tatgtatatagatgtg

SEQ ID NO: 3952304 - DNA, 14 bp, Homo sapiens
tatgtatatatata

SEQ ID NO: 3952305 - DNA, 16 bp, Homo sapiens
tatgtatatgtatata

SEQ ID NO: 3952306 - DNA, 17 bp, Homo sapiens
tatgtatatgtatatat

SEQ ID NO: 3952307 - DNA, 16 bp, Homo sapiens
tatgtatgtttacata

SEQ ID NO: 3952308 - DNA, 19 bp, Homo sapiens
tatgtattaagccaaacat

SEQ ID NO: 3952309 - DNA, 15 bp, Homo sapiens
tatgtcatcatacat

SEQ ID NO: 3952310 - DNA, 19 bp, Homo sapiens
tatgtccagctagccaact

SEQ ID NO: 3952311 - DNA, 15 bp, Homo sapiens
tatgtcccttgctgt

SEQ ID NO: 3952312 - DNA, 13 bp, Homo sapiens
tatgtcctaagga

SEQ ID NO: 3952313 - DNA, 14 bp, Homo sapiens
tatgtctaattgag

SEQ ID NO: 3952314 - DNA, 13 bp, Homo sapiens
tatgtctatttaa

SEQ ID NO: 3952315 - DNA, 19 bp, Homo sapiens
tatgtctcgctagtgatgt

SEQ ID NO: 3952316 - DNA, 12 bp, Homo sapiens
tatgtctgtgtg

SEQ ID NO: 3952317 - DNA, 16 bp, Homo sapiens
tatgtgacagacattt

SEQ ID NO: 3952318 - DNA, 20 bp, Homo sapiens
tatgtgatatctgaacacat

SEQ ID NO: 3952319 - DNA, 19 bp, Homo sapiens
tatgtgcacatgtgtctgt

SEQ ID NO: 3952320 - DNA, 19 bp, Homo sapiens
tatgtggtttccacgatga

SEQ ID NO: 3952321 - DNA, 22 bp, Homo sapiens
tatgtgtatttgtatgtactgt

SEQ ID NO: 3952322 - DNA, 17 bp, Homo sapiens
tatgtgtcacagctctg

SEQ ID NO: 3952323 - DNA, 13 bp, Homo sapiens
tatgtgtgcatgt

SEQ ID NO: 3952324 - DNA, 17 bp, Homo sapiens
tatgtgtgcatgtgtgt

SEQ ID NO: 3952325 - DNA, 14 bp, Homo sapiens
tatgtgtgggtaca

SEQ ID NO: 3952326 - DNA, 14 bp, Homo sapiens
tatgtgtgtttaaa

SEQ ID NO: 3952327 - DNA, 15 bp, Homo sapiens
tatgttaagttactt

SEQ ID NO: 3952328 - DNA, 14 bp, Homo sapiens
tatgttgtaataaa

SEQ ID NO: 3952329 - DNA, 19 bp, Homo sapiens
tatgtttgctttaatgtgt

SEQ ID NO: 3952330 - DNA, 20 bp, Homo sapiens
tattaaaaatatggaacttc

SEQ ID NO: 3952331 - DNA, 18 bp, Homo sapiens
tattaaaatgattgtaaa

SEQ ID NO: 3952332 - DNA, 13 bp, Homo sapiens
tattaaatacaga

SEQ ID NO: 3952333 - DNA, 21 bp, Homo sapiens
tattaaatacagacactaagt

SEQ ID NO: 3952334 - DNA, 22 bp, Homo sapiens
tattaaatgtatatgtcattta

SEQ ID NO: 3952335 - DNA, 22 bp, Homo sapiens
tattaagtctgggatgtagaac

SEQ ID NO: 3952336 - DNA, 17 bp, Homo sapiens
tattaataccaaatatt

SEQ ID NO: 3952337 - DNA, 23 bp, Homo sapiens
tattactgtctggttttaacaat

SEQ ID NO: 3952338 - DNA, 14 bp, Homo sapiens
tattacttgttgca

SEQ ID NO: 3952339 - DNA, 14 bp, Homo sapiens
tattagctgtaaat

SEQ ID NO: 3952340 - DNA, 15 bp, Homo sapiens
tattagttaatatta

SEQ ID NO: 3952341 - DNA, 15 bp, Homo sapiens
tattataaaaccatg

SEQ ID NO: 3952342 - DNA, 12 bp, Homo sapiens
tattataaataa

SEQ ID NO: 3952343 - DNA, 19 bp, Homo sapiens
tattataaatccaaagtaa

SEQ ID NO: 3952344 - DNA, 15 bp, Homo sapiens
tcaaatgaacacgtg

SEQ ID NO: 3952345 - DNA, 19 bp, Homo sapiens
tcaaatgacccaaagacca

SEQ ID NO: 3952346 - DNA, 17 bp, Homo sapiens
tcaaatgctaaatgcaa

SEQ ID NO: 3952347 - DNA, 15 bp, Homo sapiens
tcaaatgggtgatat

SEQ ID NO: 3952348 - DNA, 23 bp, Homo sapiens
tcaaattaatctttctttacctg

SEQ ID NO: 3952349 - DNA, 12 bp, Homo sapiens
tcaaatttcaca

SEQ ID NO: 3952350 - DNA, 14 bp, Homo sapiens
tcaacaataaaaca

SEQ ID NO: 3952351 - DNA, 22 bp, Homo sapiens
tcaacacacaacagcagatggc

SEQ ID NO: 3952352 - DNA, 17 bp, Homo sapiens
tcaacacccgccccccc

SEQ ID NO: 3952353 - DNA, 16 bp, Homo sapiens
tcaacactcttcttga

SEQ ID NO: 3952354 - DNA, 21 bp, Homo sapiens
tcaacactcttcttgagcaga

SEQ ID NO: 3952355 - DNA, 12 bp, Homo sapiens
tcaacagagaag

SEQ ID NO: 3952356 - DNA, 19 bp, Homo sapiens
tcaacagagaaggcaggaa

SEQ ID NO: 3952357 - DNA, 22 bp, Homo sapiens
tcaacagagaaggcaggaatgt

SEQ ID NO: 3952358 - DNA, 15 bp, Homo sapiens
tcaacatcttctctc

SEQ ID NO: 3952359 - DNA, 18 bp, Homo sapiens
tcaaccagcattttacta

SEQ ID NO: 3952360 - DNA, 21 bp, Homo sapiens
tcaaccagcattttactactt

SEQ ID NO: 3952361 - DNA, 23 bp, Homo sapiens
agctaatctgtagggctggacct

SEQ ID NO: 3952362 - DNA, 13 bp, Homo sapiens
agctaatgaaatt

SEQ ID NO: 3952363 - DNA, 17 bp, Homo sapiens
agctaatgaaattgaga

SEQ ID NO: 3952364 - DNA, 13 bp, Homo sapiens
agctacattcctc

SEQ ID NO: 3952365 - DNA, 19 bp, Homo sapiens
agctacccaaaagagaaaa

SEQ ID NO: 3952366 - DNA, 19 bp, Homo sapiens
agctacctgtgtggacagg

SEQ ID NO: 3952367 - DNA, 15 bp, Homo sapiens
agctactcaggaggc

SEQ ID NO: 3952368 - DNA, 18 bp, Homo sapiens
agctactcaggaggctga

SEQ ID NO: 3952369 - DNA, 17 bp, Homo sapiens
agctactctgtccaggc

SEQ ID NO: 3952370 - DNA, 18 bp, Homo sapiens
agctactctgtccaggcc

SEQ ID NO: 3952371 - DNA, 16 bp, Homo sapiens
agctactgatttttgt

SEQ ID NO: 3952372 - DNA, 17 bp, Homo sapiens
agctacttaagagaaat

SEQ ID NO: 3952373 - DNA, 21 bp, Homo sapiens
agctacttaagagaaatggca

SEQ ID NO: 3952374 - DNA, 16 bp, Homo sapiens
agctagaacctggaga

SEQ ID NO: 3952375 - DNA, 15 bp, Homo sapiens
agctagactggagtg

SEQ ID NO: 3952376 - DNA, 17 bp, Homo sapiens
agctagactggagtgag

SEQ ID NO: 3952377 - DNA, 21 bp, Homo sapiens
agctagactggagtgaggctt

SEQ ID NO: 3952378 - DNA, 13 bp, Homo sapiens
agctaggaatgaa

SEQ ID NO: 3952379 - DNA, 15 bp, Homo sapiens
agctaggactgagga

SEQ ID NO: 3952380 - DNA, 16 bp, Homo sapiens
agctaggagcaaagcc

SEQ ID NO: 3952381 - DNA, 20 bp, Homo sapiens
agctaggagcaaagcctgtt

SEQ ID NO: 3952382 - DNA, 17 bp, Homo sapiens
agctagtgacccacatg

SEQ ID NO: 3952383 - DNA, 18 bp, Homo sapiens
agctagtgacccacatgc

SEQ ID NO: 3952384 - DNA, 21 bp, Homo sapiens
agctagtgacccacatgccat

SEQ ID NO: 3952385 - DNA, 19 bp, Homo sapiens
agctagtggcttcaaaata

SEQ ID NO: 3952386 - DNA, 18 bp, Homo sapiens
agctatctgtcatctctc

SEQ ID NO: 3952387 - DNA, 13 bp, Homo sapiens
agctatggtgagg

SEQ ID NO: 3952388 - DNA, 15 bp, Homo sapiens
agctattactgtctg

SEQ ID NO: 3952389 - DNA, 21 bp, Homo sapiens
agctattactgtctggtttta

SEQ ID NO: 3952390 - DNA, 14 bp, Homo sapiens
agctattgatgttt

SEQ ID NO: 3952391 - DNA, 14 bp, Homo sapiens
agctattgcatgta

SEQ ID NO: 3952392 - DNA, 23 bp, Homo sapiens
agctcaagtcttccctgatcaag

SEQ ID NO: 3952393 - DNA, 16 bp, Homo sapiens
agctcacaagcccagg

SEQ ID NO: 3952394 - DNA, 20 bp, Homo sapiens
agctcacagttcctcgccct

SEQ ID NO: 3952395 - DNA, 21 bp, Homo sapiens
agctcagaatagatctgatgg

SEQ ID NO: 3952396 - DNA, 17 bp, Homo sapiens
agctcagacccccactc

SEQ ID NO: 3952397 - DNA, 20 bp, Homo sapiens
agctcagacccccactctca

SEQ ID NO: 3952398 - DNA, 21 bp, Homo sapiens
agctcagcctccccctgctgc

SEQ ID NO: 3952399 - DNA, 22 bp, Homo sapiens
agctcagcctccccctgctgct

SEQ ID NO: 3952400 - DNA, 21 bp, Homo sapiens
agctcagctactgatttttgt

SEQ ID NO: 3952401 - DNA, 22 bp, Homo sapiens
agctcaggaggcgaataaatgt

SEQ ID NO: 3952402 - DNA, 14 bp, Homo sapiens
agctcatattttgt

SEQ ID NO: 3952403 - DNA, 18 bp, Homo sapiens
agctcatattttgtatat

SEQ ID NO: 3952404 - DNA, 16 bp, Homo sapiens
agctcccagatgctgg

SEQ ID NO: 3952405 - DNA, 17 bp, Homo sapiens
agctcccatagcgctgg

SEQ ID NO: 3952406 - DNA, 21 bp, Homo sapiens
agctcccatagcgctggctca

SEQ ID NO: 3952407 - DNA, 22 bp, Homo sapiens
agctcccatagcgctggctcag

SEQ ID NO: 3952408 - DNA, 17 bp, Homo sapiens
agctcccctcggagaag

SEQ ID NO: 3952409 - DNA, 12 bp, Homo sapiens
agctcccttccc

SEQ ID NO: 3952410 - DNA, 18 bp, Homo sapiens
agctcccttcccctgcct

SEQ ID NO: 3952411 - DNA, 21 bp, Homo sapiens
agctcccttcccctgcctggt

SEQ ID NO: 3952412 - DNA, 15 bp, Homo sapiens
agctccgtggagcag

SEQ ID NO: 3952413 - DNA, 13 bp, Homo sapiens
agctcctctcctt

SEQ ID NO: 3952414 - DNA, 18 bp, Homo sapiens
agctcctctccttgggct

SEQ ID NO: 3952415 - DNA, 23 bp, Homo sapiens
agctcctctccttgggctcctgg

SEQ ID NO: 3952416 - DNA, 15 bp, Homo sapiens
agctcctctgctgct

SEQ ID NO: 3952417 - DNA, 13 bp, Homo sapiens
agctcctcttcct

SEQ ID NO: 3952418 - DNA, 15 bp, Homo sapiens
agctcctgtccctac

SEQ ID NO: 3952419 - DNA, 19 bp, Homo sapiens
agctccttttgtccccagg

SEQ ID NO: 3952420 - DNA, 19 bp, Homo sapiens
agctctagttttcagcctt

SEQ ID NO: 3952421 - DNA, 20 bp, Homo sapiens
agctctagttttcagccttg

SEQ ID NO: 3952422 - DNA, 23 bp, Homo sapiens
agctctgaacaaacactgaatca

SEQ ID NO: 3952423 - DNA, 23 bp, Homo sapiens
agctctgaatctgataggaaaag

SEQ ID NO: 3952424 - DNA, 17 bp, Homo sapiens
agctctgagaggccctg

SEQ ID NO: 3952425 - DNA, 17 bp, Homo sapiens
agctctggaccagcctg

SEQ ID NO: 3952426 - DNA, 15 bp, Homo sapiens
agctctgtggcctgt

SEQ ID NO: 3952427 - DNA, 16 bp, Homo sapiens
agctctgtggcctgtg

SEQ ID NO: 3952428 - DNA, 18 bp, Homo sapiens
agctctgtggcctgtgtc

SEQ ID NO: 3952429 - DNA, 16 bp, Homo sapiens
agctcttaactacagt

SEQ ID NO: 3952430 - DNA, 15 bp, Homo sapiens
agctcttcactcagc

SEQ ID NO: 3952431 - DNA, 19 bp, Homo sapiens
agctcttcactcagccaca

SEQ ID NO: 3952432 - DNA, 19 bp, Homo sapiens
agctcttcggtttctgagc

SEQ ID NO: 3952433 - DNA, 12 bp, Homo sapiens
agctcttctatt

SEQ ID NO: 3952434 - DNA, 16 bp, Homo sapiens
agctcttctatttaaa

SEQ ID NO: 3952435 - DNA, 22 bp, Homo sapiens
agctcttctatttaaaaaataa

SEQ ID NO: 3952436 - DNA, 20 bp, Homo sapiens
agctcttggaagagctcttc

SEQ ID NO: 3952437 - DNA, 15 bp, Homo sapiens
agctctttcttcttt

SEQ ID NO: 3952438 - DNA, 12 bp, Homo sapiens
agctgaagaaaa

SEQ ID NO: 3952439 - DNA, 20 bp, Homo sapiens
agctgaagtgaaggagaaag

SEQ ID NO: 3952440 - DNA, 13 bp, Homo sapiens
agctgagaagaag

SEQ ID NO: 3952441 - DNA, 18 bp, Homo sapiens
agctgagaccctcgccac

SEQ ID NO: 3952442 - DNA, 22 bp, Homo sapiens
agctgagagccctgctgtggga

SEQ ID NO: 3952443 - DNA, 13 bp, Homo sapiens
agctgagcaggcc

SEQ ID NO: 3952444 - DNA, 18 bp, Homo sapiens
agctgagcaggcccgaca

SEQ ID NO: 3952445 - DNA, 23 bp, Homo sapiens
agctgaggggggccgtgcccagg

SEQ ID NO: 3952446 - DNA, 19 bp, Homo sapiens
agctgaggtgcccaggaga

SEQ ID NO: 3952447 - DNA, 15 bp, Homo sapiens
caggacacctgcccc

SEQ ID NO: 3952448 - DNA, 18 bp, Homo sapiens
caggacacctgccccagc

SEQ ID NO: 3952449 - DNA, 20 bp, Homo sapiens
caggacacctgccccagcgc

SEQ ID NO: 3952450 - DNA, 13 bp, Homo sapiens
caggacaggacca

SEQ ID NO: 3952451 - DNA, 12 bp, Homo sapiens
caggacaggccc

SEQ ID NO: 3952452 - DNA, 12 bp, Homo sapiens
caggaccacaaa

SEQ ID NO: 3952453 - DNA, 14 bp, Homo sapiens
caggaccaggacta

SEQ ID NO: 3952454 - DNA, 18 bp, Homo sapiens
caggaccagtcccagagc

SEQ ID NO: 3952455 - DNA, 13 bp, Homo sapiens
caggacccaggcc

SEQ ID NO: 3952456 - DNA, 16 bp, Homo sapiens
caggacccaggccctc

SEQ ID NO: 3952457 - DNA, 21 bp, Homo sapiens
caggacccaggccctccatgg

SEQ ID NO: 3952458 - DNA, 17 bp, Homo sapiens
caggacccaggccgcct

SEQ ID NO: 3952459 - DNA, 13 bp, Homo sapiens
caggacctccggg

SEQ ID NO: 3952460 - DNA, 20 bp, Homo sapiens
caggactaacactcagaagc

SEQ ID NO: 3952461 - DNA, 21 bp, Homo sapiens
caggactaacactcagaagcc

SEQ ID NO: 3952462 - DNA, 16 bp, Homo sapiens
caggactatagcccag

SEQ ID NO: 3952463 - DNA, 12 bp, Homo sapiens
caggactctgcc

SEQ ID NO: 3952464 - DNA, 20 bp, Homo sapiens
caggactctgccccttctgt

SEQ ID NO: 3952465 - DNA, 21 bp, Homo sapiens
caggactctgccccttctgtt

SEQ ID NO: 3952466 - DNA, 21 bp, Homo sapiens
caggactgaattgtccccagt

SEQ ID NO: 3952467 - DNA, 15 bp, Homo sapiens
caggactggctcacc

SEQ ID NO: 3952468 - DNA, 19 bp, Homo sapiens
caggacttaacggctccag

SEQ ID NO: 3952469 - DNA, 21 bp, Homo sapiens
caggacttaacggctccagga

SEQ ID NO: 3952470 - DNA, 23 bp, Homo sapiens
caggagacactgtgctataaatc

SEQ ID NO: 3952471 - DNA, 15 bp, Homo sapiens
caggagacaggaagg

SEQ ID NO: 3952472 - DNA, 14 bp, Homo sapiens
caggagagagatct

SEQ ID NO: 3952473 - DNA, 13 bp, Homo sapiens
caggagagccagc

SEQ ID NO: 3952474 - DNA, 16 bp, Homo sapiens
caggagagccagccct

SEQ ID NO: 3952475 - DNA, 17 bp, Homo sapiens
caggagagccagccctc

SEQ ID NO: 3952476 - DNA, 12 bp, Homo sapiens
caggagagggaa

SEQ ID NO: 3952477 - DNA, 18 bp, Homo sapiens
caggagcaaatgtttctg

SEQ ID NO: 3952478 - DNA, 18 bp, Homo sapiens
caggagcacaggcagctg

SEQ ID NO: 3952479 - DNA, 13 bp, Homo sapiens
caggagcagacag

SEQ ID NO: 3952480 - DNA, 17 bp, Homo sapiens
caggagcagacagagaa

SEQ ID NO: 3952481 - DNA, 14 bp, Homo sapiens
caggagcccagagg

SEQ ID NO: 3952482 - DNA, 11 bp, Homo sapiens
caggagcctgg

SEQ ID NO: 3952483 - DNA, 18 bp, Homo sapiens
caggagctgagtcacctc

SEQ ID NO: 3952484 - DNA, 14 bp, Homo sapiens
caggaggccctggt

SEQ ID NO: 3952485 - DNA, 13 bp, Homo sapiens
caggaggcctggc

SEQ ID NO: 3952486 - DNA, 17 bp, Homo sapiens
caggaggcctggccttg

SEQ ID NO: 3952487 - DNA, 15 bp, Homo sapiens
caggaggcgcagccc

SEQ ID NO: 3952488 - DNA, 20 bp, Homo sapiens
caggaggctgaggcagaaga

SEQ ID NO: 3952489 - DNA, 14 bp, Homo sapiens
caggaggctgcggc

SEQ ID NO: 3952490 - DNA, 21 bp, Homo sapiens
caggagggacaaaggagcctg

SEQ ID NO: 3952491 - DNA, 23 bp, Homo sapiens
caggagggacaaaggagcctgtg

SEQ ID NO: 3952492 - DNA, 17 bp, Homo sapiens
caggagggcaagggcca

SEQ ID NO: 3952493 - DNA, 15 bp, Homo sapiens
caggaggggcctctg

SEQ ID NO: 3952494 - DNA, 16 bp, Homo sapiens
caggagggtccccagc

SEQ ID NO: 3952495 - DNA, 19 bp, Homo sapiens
caggagggtccccagctgg

SEQ ID NO: 3952496 - DNA, 16 bp, Homo sapiens
caggagtagctgagct

SEQ ID NO: 3952497 - DNA, 17 bp, Homo sapiens
caggagtctgtgctctt

SEQ ID NO: 3952498 - DNA, 21 bp, Homo sapiens
caggagtggcagctgtcccct

SEQ ID NO: 3952499 - DNA, 17 bp, Homo sapiens
caggagttggagaccag

SEQ ID NO: 3952500 - DNA, 21 bp, Homo sapiens
caggagttggagaccaggcct

SEQ ID NO: 3952501 - DNA, 24 bp, Homo sapiens
caggagtttgagacaagccctggc

SEQ ID NO: 3952502 - DNA, 16 bp, Homo sapiens
tatactaaaaaatgtc

SEQ ID NO: 3952503 - DNA, 14 bp, Homo sapiens
tatacttcactcac

SEQ ID NO: 3952504 - DNA, 14 bp, Homo sapiens
tatagaaagctgtt

SEQ ID NO: 3952505 - DNA, 16 bp, Homo sapiens
tatagacaaataataa

SEQ ID NO: 3952506 - DNA, 13 bp, Homo sapiens
tatagacagcact

SEQ ID NO: 3952507 - DNA, 23 bp, Homo sapiens
tatagagaaaaactttcattttt

SEQ ID NO: 3952508 - DNA, 18 bp, Homo sapiens
tatagagagggggctctc

SEQ ID NO: 3952509 - DNA, 15 bp, Homo sapiens
tatagagatatgcag

SEQ ID NO: 3952510 - DNA, 21 bp, Homo sapiens
tatagagatatgcagaaggaa

SEQ ID NO: 3952511 - DNA, 19 bp, Homo sapiens
tatagagatatttttgtac

SEQ ID NO: 3952512 - DNA, 16 bp, Homo sapiens
tatagagttcatccca

SEQ ID NO: 3952513 - DNA, 17 bp, Homo sapiens
tatagagttcatcccag

SEQ ID NO: 3952514 - DNA, 11 bp, Homo sapiens
tatagatgtgc

SEQ ID NO: 3952515 - DNA, 13 bp, Homo sapiens
tatagcaatccat

SEQ ID NO: 3952516 - DNA, 22 bp, Homo sapiens
tatagcagcaaaaatataaaat

SEQ ID NO: 3952517 - DNA, 13 bp, Homo sapiens
tatagcccaggtc

SEQ ID NO: 3952518 - DNA, 20 bp, Homo sapiens
tatagctcttctatttaaaa

SEQ ID NO: 3952519 - DNA, 14 bp, Homo sapiens
tataggctggagaa

SEQ ID NO: 3952520 - DNA, 20 bp, Homo sapiens
tataggtgctacaaaaacac

SEQ ID NO: 3952521 - DNA, 21 bp, Homo sapiens
tataggtgctacaaaaacaca

SEQ ID NO: 3952522 - DNA, 22 bp, Homo sapiens
tataggttgtgcaaattaacag

SEQ ID NO: 3952523 - DNA, 18 bp, Homo sapiens
tatagtatatttatactc

SEQ ID NO: 3952524 - DNA, 22 bp, Homo sapiens
tatagtatgatttttacaataa

SEQ ID NO: 3952525 - DNA, 22 bp, Homo sapiens
tatagtttcagatatatatcat

SEQ ID NO: 3952526 - DNA, 18 bp, Homo sapiens
tatataaaaagaaaagat

SEQ ID NO: 3952527 - DNA, 14 bp, Homo sapiens
tatataaaaatata

SEQ ID NO: 3952528 - DNA, 15 bp, Homo sapiens
tatataaaaatatat

SEQ ID NO: 3952529 - DNA, 22 bp, Homo sapiens
tatatacaataacataatttgt

SEQ ID NO: 3952530 - DNA, 16 bp, Homo sapiens
tatatacacatacata

SEQ ID NO: 3952531 - DNA, 23 bp, Homo sapiens
tatatacatacacttgtataaat

SEQ ID NO: 3952532 - DNA, 16 bp, Homo sapiens
tatatacatatgtaga

SEQ ID NO: 3952533 - DNA, 14 bp, Homo sapiens
tatatacatattat

SEQ ID NO: 3952534 - DNA, 14 bp, Homo sapiens
tatatacatgtgtg

SEQ ID NO: 3952535 - DNA, 13 bp, Homo sapiens
tatatagatgtgc

SEQ ID NO: 3952536 - DNA, 14 bp, Homo sapiens
tatatagatgtgca

SEQ ID NO: 3952537 - DNA, 21 bp, Homo sapiens
tatatagcagcaaaaatataa

SEQ ID NO: 3952538 - DNA, 15 bp, Homo sapiens
tatatagtgctatat

SEQ ID NO: 3952539 - DNA, 11 bp, Homo sapiens
tatatataaat

SEQ ID NO: 3952540 - DNA, 14 bp, Homo sapiens
tatatatacatatg

SEQ ID NO: 3952541 - DNA, 16 bp, Homo sapiens
tatatatacatatgta

SEQ ID NO: 3952542 - DNA, 14 bp, Homo sapiens
tatatatataaaca

SEQ ID NO: 3952543 - DNA, 15 bp, Homo sapiens
tatatatatatagta

SEQ ID NO: 3952544 - DNA, 13 bp, Homo sapiens
tatatatatatgt

SEQ ID NO: 3952545 - DNA, 14 bp, Homo sapiens
tatatatatatgta

SEQ ID NO: 3952546 - DNA, 16 bp, Homo sapiens
tatatatatatgtata

SEQ ID NO: 3952547 - DNA, 15 bp, Homo sapiens
tatatatatgtatat

SEQ ID NO: 3952548 - DNA, 14 bp, Homo sapiens
tatatatatgtgtg

SEQ ID NO: 3952549 - DNA, 15 bp, Homo sapiens
tatatatcagttata

SEQ ID NO: 3952550 - DNA, 18 bp, Homo sapiens
tatatatctgataaaatt

SEQ ID NO: 3952551 - DNA, 19 bp, Homo sapiens
tatatatctgcttcagtgg

SEQ ID NO: 3952552 - DNA, 21 bp, Homo sapiens
tatatatctgcttcagtggag

SEQ ID NO: 3952553 - DNA, 14 bp, Homo sapiens
tatatatgccttat

SEQ ID NO: 3952554 - DNA, 16 bp, Homo sapiens
tatatatgtgtatata

SEQ ID NO: 3952555 - DNA, 19 bp, Homo sapiens
tatatatgtgtatatatac

SEQ ID NO: 3952556 - DNA, 20 bp, Homo sapiens
tatatatgtgtatatataca

SEQ ID NO: 3952557 - DNA, 21 bp, Homo sapiens
tatatatgtgtatatatacat

SEQ ID NO: 3952558 - DNA, 17 bp, Homo sapiens
tatatatgtgtgtttaa

SEQ ID NO: 3952559 - DNA, 12 bp, Homo sapiens
tatatattgtat

SEQ ID NO: 3952560 - DNA, 19 bp, Homo sapiens
tatatatttttcaaccagc

SEQ ID NO: 3952561 - DNA, 13 bp, Homo sapiens
tatatcagaaaag

SEQ ID NO: 3952562 - DNA, 18 bp, Homo sapiens
tatatcagaaaagggaag

SEQ ID NO: 3952563 - DNA, 14 bp, Homo sapiens
tatatcagaatctg

SEQ ID NO: 3952564 - DNA, 11 bp, Homo sapiens
tatatcagcct

SEQ ID NO: 3952565 - DNA, 23 bp, Homo sapiens
tatatcagcctgagtctcctgtg

SEQ ID NO: 3952566 - DNA, 14 bp, Homo sapiens
tatatcagttataa

SEQ ID NO: 3952567 - DNA, 14 bp, Homo sapiens
tatatctaatttat

SEQ ID NO: 3952568 - DNA, 16 bp, Homo sapiens
tatatcttatgttaaa

SEQ ID NO: 3952569 - DNA, 17 bp, Homo sapiens
tatatgatctaatacaa

SEQ ID NO: 3952570 - DNA, 15 bp, Homo sapiens
tatatgccttatgta

SEQ ID NO: 3952571 - DNA, 20 bp, Homo sapiens
tatatggcatatttatattg

SEQ ID NO: 3952572 - DNA, 16 bp, Homo sapiens
tatatggtctgtgtgt

SEQ ID NO: 3952573 - DNA, 13 bp, Homo sapiens
tatatgtatatat

SEQ ID NO: 3952574 - DNA, 14 bp, Homo sapiens
tatatgtatgtagt

SEQ ID NO: 3952575 - DNA, 12 bp, Homo sapiens
tatatgtattta

SEQ ID NO: 3952576 - DNA, 16 bp, Homo sapiens
tatatgtatttattgt

SEQ ID NO: 3952577 - DNA, 15 bp, Homo sapiens
tatatgtgtgtttaa

SEQ ID NO: 3952578 - DNA, 22 bp, Homo sapiens
tatatgtgtgtttaaataaagt

SEQ ID NO: 3952579 - DNA, 19 bp, Homo sapiens
tatattacctcaaattcct

SEQ ID NO: 3952580 - DNA, 21 bp, Homo sapiens
tatattacctcaaattcctaa

SEQ ID NO: 3952581 - DNA, 18 bp, Homo sapiens
tatattatggtgtaatgc

SEQ ID NO: 3952582 - DNA, 16 bp, Homo sapiens
tatattcatgtaataa

SEQ ID NO: 3952583 - DNA, 18 bp, Homo sapiens
tatattcatgtaataaat

SEQ ID NO: 3952584 - DNA, 17 bp, Homo sapiens
tatattggtaacatcct

SEQ ID NO: 3952585 - DNA, 21 bp, Homo sapiens
tatattgtatattctggaaaa

SEQ ID NO: 3952586 - DNA, 20 bp, Homo sapiens
tatatttaatttttacatga

SEQ ID NO: 3952587 - DNA, 17 bp, Homo sapiens
tatatttactaaaagaa

SEQ ID NO: 3952588 - DNA, 16 bp, Homo sapiens
tatatttagttatagt

SEQ ID NO: 3952589 - DNA, 19 bp, Homo sapiens
tgaataaacttcagcacca

SEQ ID NO: 3952590 - DNA, 14 bp, Homo sapiens
tgaataaagacacc

SEQ ID NO: 3952591 - DNA, 16 bp, Homo sapiens
tgaataaagacaccta

SEQ ID NO: 3952592 - DNA, 14 bp, Homo sapiens
tgaatacccccaga

SEQ ID NO: 3952593 - DNA, 16 bp, Homo sapiens
tgaatacccccagaga

SEQ ID NO: 3952594 - DNA, 13 bp, Homo sapiens
tgaatactctcac

SEQ ID NO: 3952595 - DNA, 16 bp, Homo sapiens
tgaatatatggtctgt

SEQ ID NO: 3952596 - DNA, 14 bp, Homo sapiens
tgaatattaatccc

SEQ ID NO: 3952597 - DNA, 19 bp, Homo sapiens
tgaatattttcattaaaag

SEQ ID NO: 3952598 - DNA, 13 bp, Homo sapiens
tgaatctgttact

SEQ ID NO: 3952599 - DNA, 15 bp, Homo sapiens
tgaatctgttactga

SEQ ID NO: 3952600 - DNA, 20 bp, Homo sapiens
tgaatcttgcacatatttga

SEQ ID NO: 3952601 - DNA, 15 bp, Homo sapiens
tgaatgacaacagaa

SEQ ID NO: 3952602 - DNA, 17 bp, Homo sapiens
tgaatgataagcaggaa

SEQ ID NO: 3952603 - DNA, 19 bp, Homo sapiens
tgaatgatgttttagaatg

SEQ ID NO: 3952604 - DNA, 19 bp, Homo sapiens
tgaatgatttccaaagaga

SEQ ID NO: 3952605 - DNA, 23 bp, Homo sapiens
tgaatgcccacaggcaaatgcat

SEQ ID NO: 3952606 - DNA, 14 bp, Homo sapiens
tgaatggtccaggg

SEQ ID NO: 3952607 - DNA, 14 bp, Homo sapiens
tgaatggtcttctg

SEQ ID NO: 3952608 - DNA, 19 bp, Homo sapiens
tgaatggttccatgcctga

SEQ ID NO: 3952609 - DNA, 20 bp, Homo sapiens
tgaatgtctaaggtcacaca

SEQ ID NO: 3952610 - DNA, 18 bp, Homo sapiens
tgaatgtctcagcgaggt

SEQ ID NO: 3952611 - DNA, 22 bp, Homo sapiens
tgaatgtttccaacctggagta

SEQ ID NO: 3952612 - DNA, 16 bp, Homo sapiens
tgaattaaaaaagctc

SEQ ID NO: 3952613 - DNA, 20 bp, Homo sapiens
tgaattattttgttgtgatt

SEQ ID NO: 3952614 - DNA, 21 bp, Homo sapiens
tgaattctctctaaaaataaa

SEQ ID NO: 3952615 - DNA, 19 bp, Homo sapiens
tgaattctgcaatgttttc

SEQ ID NO: 3952616 - DNA, 18 bp, Homo sapiens
tgaattgagctgcagaaa

SEQ ID NO: 3952617 - DNA, 19 bp, Homo sapiens
tgaatttagtgagatttac

SEQ ID NO: 3952618 - DNA, 20 bp, Homo sapiens
tgaatttcttcactgttgaa

SEQ ID NO: 3952619 - DNA, 18 bp, Homo sapiens
aaaatataaattaagact

SEQ ID NO: 3952620 - DNA, 17 bp, Homo sapiens
aaaatatacaaacatgt

SEQ ID NO: 3952621 - DNA, 22 bp, Homo sapiens
aaaatatatataaatatatatt

SEQ ID NO: 3952622 - DNA, 13 bp, Homo sapiens
aaaatatatatag

SEQ ID NO: 3952623 - DNA, 19 bp, Homo sapiens
aaaatatatatatatattt

SEQ ID NO: 3952624 - DNA, 14 bp, Homo sapiens
aaaatatatattgt

SEQ ID NO: 3952625 - DNA, 14 bp, Homo sapiens
aaaatatcctcagg

SEQ ID NO: 3952626 - DNA, 22 bp, Homo sapiens
aaaatatctgacatcttattta

SEQ ID NO: 3952627 - DNA, 12 bp, Homo sapiens
aaaatatgtatg

SEQ ID NO: 3952628 - DNA, 19 bp, Homo sapiens
aaaatattataacttaaaa

SEQ ID NO: 3952629 - DNA, 15 bp, Homo sapiens
aaaatattcctgcat

SEQ ID NO: 3952630 - DNA, 13 bp, Homo sapiens
aaaatattttata

SEQ ID NO: 3952631 - DNA, 17 bp, Homo sapiens
acaaaagtaccatagaa

SEQ ID NO: 3952632 - DNA, 16 bp, Homo sapiens
acaaaataatttaact

SEQ ID NO: 3952633 - DNA, 22 bp, Homo sapiens
acaaaatcacaagcaataatta

SEQ ID NO: 3952634 - DNA, 15 bp, Homo sapiens
acaaaatgataatca

SEQ ID NO: 3952635 - DNA, 11 bp, Homo sapiens
acaaaatgcaa

SEQ ID NO: 3952636 - DNA, 15 bp, Homo sapiens
acaaacaaataaata

SEQ ID NO: 3952637 - DNA, 13 bp, Homo sapiens
acaaacacctcct

SEQ ID NO: 3952638 - DNA, 15 bp, Homo sapiens
acaaaccacaactga

SEQ ID NO: 3952639 - DNA, 15 bp, Homo sapiens
acaaaccactgtaca

SEQ ID NO: 3952640 - DNA, 20 bp, Homo sapiens
acaaactatgatcacagtga

SEQ ID NO: 3952641 - DNA, 20 bp, Homo sapiens
acaaactgatgcgaaaactt

SEQ ID NO: 3952642 - DNA, 21 bp, Homo sapiens
acaaactgatgcgaaaacttg

SEQ ID NO: 3952643 - DNA, 18 bp, Homo sapiens
acaaagagaataaagact

SEQ ID NO: 3952644 - DNA, 20 bp, Homo sapiens
acaaagatgagctctgaaca

SEQ ID NO: 3952645 - DNA, 22 bp, Homo sapiens
acaaagatgtttgtcagatatg

SEQ ID NO: 3952646 - DNA, 23 bp, Homo sapiens
acaaagatgtttgtcagatatga

SEQ ID NO: 3952647 - DNA, 24 bp, Homo sapiens
acaaagatgtttgtcagatatgat

SEQ ID NO: 3952648 - DNA, 20 bp, Homo sapiens
acaaagcttctatcccagga

SEQ ID NO: 3952649 - DNA, 13 bp, Homo sapiens
acaaaggagcctg

SEQ ID NO: 3952650 - DNA, 14 bp, Homo sapiens
acaaaggggagaag

SEQ ID NO: 3952651 - DNA, 20 bp, Homo sapiens
acaaaggggagaagggccag

SEQ ID NO: 3952652 - DNA, 23 bp, Homo sapiens
acaaaggggagaagggccagccc

SEQ ID NO: 3952653 - DNA, 18 bp, Homo sapiens
acaaagttacaaattcaa

SEQ ID NO: 3952654 - DNA, 16 bp, Homo sapiens
acaaatactgcctagt

SEQ ID NO: 3952655 - DNA, 12 bp, Homo sapiens
acaaatatttat

SEQ ID NO: 3952656 - DNA, 23 bp, Homo sapiens
acaaatatttattttctttctgt

SEQ ID NO: 3952657 - DNA, 17 bp, Homo sapiens
acaaatcacacctctgg

SEQ ID NO: 3952658 - DNA, 23 bp, Homo sapiens
acaaatcaccatgtaacaaccag

SEQ ID NO: 3952659 - DNA, 18 bp, Homo sapiens
acaaatcttcaaggtgta

SEQ ID NO: 3952660 - DNA, 21 bp, Homo sapiens
acaaatcttcaaggtgtaaaa

SEQ ID NO: 3952661 - DNA, 16 bp, Homo sapiens
acaaatttttatttct

SEQ ID NO: 3952662 - DNA, 21 bp, Homo sapiens
acaaatttttatttctaaaat

SEQ ID NO: 3952663 - DNA, 15 bp, Homo sapiens
acaaatttttcctgc

SEQ ID NO: 3952664 - DNA, 22 bp, Homo sapiens
acaacaaaccaaaacagaacaa

SEQ ID NO: 3952665 - DNA, 13 bp, Homo sapiens
acaacaacaacaa

SEQ ID NO: 3952666 - DNA, 14 bp, Homo sapiens
acaacaacaataca

SEQ ID NO: 3952667 - DNA, 15 bp, Homo sapiens
acaacaacctggtca

SEQ ID NO: 3952668 - DNA, 12 bp, Homo sapiens
acaacaagaaca

SEQ ID NO: 3952669 - DNA, 18 bp, Homo sapiens
acaacaatggtttacatg

SEQ ID NO: 3952670 - DNA, 23 bp, Homo sapiens
acaacaatggtttacatgaacac

SEQ ID NO: 3952671 - DNA, 13 bp, Homo sapiens
acaacagaagctt

SEQ ID NO: 3952672 - DNA, 19 bp, Homo sapiens
acaacagaagcttcagaag

SEQ ID NO: 3952673 - DNA, 18 bp, Homo sapiens
acaacataaggagaatgt

SEQ ID NO: 3952674 - DNA, 13 bp, Homo sapiens
acaacatttattt

SEQ ID NO: 3952675 - DNA, 14 bp, Homo sapiens
acaaccattccaga

SEQ ID NO: 3952676 - DNA, 17 bp, Homo sapiens
acaactaatcaagagtg

SEQ ID NO: 3952677 - DNA, 18 bp, Homo sapiens
aattctcgggaaattatt

SEQ ID NO: 3952678 - DNA, 15 bp, Homo sapiens
aattcttatgcttat

SEQ ID NO: 3952679 - DNA, 19 bp, Homo sapiens
aattcttattttttaaaaa

SEQ ID NO: 3952680 - DNA, 23 bp, Homo sapiens
aattcttattttttaaaaagcta

SEQ ID NO: 3952681 - DNA, 18 bp, Homo sapiens
aattcttcaggtggaaaa

SEQ ID NO: 3952682 - DNA, 15 bp, Homo sapiens
aattcttggaatact

SEQ ID NO: 3952683 - DNA, 15 bp, Homo sapiens
aattcttgtatatta

SEQ ID NO: 3952684 - DNA, 20 bp, Homo sapiens
aattcttgtatattatggaa

SEQ ID NO: 3952685 - DNA, 12 bp, Homo sapiens
aattgaaatata

SEQ ID NO: 3952686 - DNA, 21 bp, Homo sapiens
aattgaagagatttcaacata

SEQ ID NO: 3952687 - DNA, 18 bp, Homo sapiens
aattgagctgcagaaacg

SEQ ID NO: 3952688 - DNA, 21 bp, Homo sapiens
aattgagtctcttttttattc

SEQ ID NO: 3952689 - DNA, 22 bp, Homo sapiens
aattgatcataggtatttcaaa

SEQ ID NO: 3952690 - DNA, 15 bp, Homo sapiens
aattgatttcaagac

SEQ ID NO: 3952691 - DNA, 12 bp, Homo sapiens
aattgcacaatt

SEQ ID NO: 3952692 - DNA, 15 bp, Homo sapiens
aattgcacaatttga

SEQ ID NO: 3952693 - DNA, 19 bp, Homo sapiens
aattgcctgcagagagaag

SEQ ID NO: 3952694 - DNA, 15 bp, Homo sapiens
aattgctattttatt

SEQ ID NO: 3952695 - DNA, 12 bp, Homo sapiens
aattgctccttg

SEQ ID NO: 3952696 - DNA, 21 bp, Homo sapiens
aattgcttacatttttacaat

SEQ ID NO: 3952697 - DNA, 17 bp, Homo sapiens
aattgcttttgttgtga

SEQ ID NO: 3952698 - DNA, 20 bp, Homo sapiens
aattggaagctgccctgccc

SEQ ID NO: 3952699 - DNA, 18 bp, Homo sapiens
aattggaccatcctattt

SEQ ID NO: 3952700 - DNA, 21 bp, Homo sapiens
aattgggagcttgggaatgga

SEQ ID NO: 3952701 - DNA, 16 bp, Homo sapiens
aattggtgataagtgg

SEQ ID NO: 3952702 - DNA, 17 bp, Homo sapiens
aattggtgataagtgga

SEQ ID NO: 3952703 - DNA, 20 bp, Homo sapiens
aattggtgataagtggaaaa

SEQ ID NO: 3952704 - DNA, 23 bp, Homo sapiens
aattgtatagagatatgcagaag

SEQ ID NO: 3952705 - DNA, 19 bp, Homo sapiens
aattgtcaaatgtcattat

SEQ ID NO: 3952706 - DNA, 16 bp, Homo sapiens
aattgtccatgtgctt

SEQ ID NO: 3952707 - DNA, 21 bp, Homo sapiens
aattgtgcgacttcacaaaat

SEQ ID NO: 3952708 - DNA, 19 bp, Homo sapiens
aattgttgattaatttgag

SEQ ID NO: 3952709 - DNA, 23 bp, Homo sapiens
aattgttgctaatcttcttatgc

SEQ ID NO: 3952710 - DNA, 15 bp, Homo sapiens
aattgtttaagtgtt

SEQ ID NO: 3952711 - DNA, 21 bp, Homo sapiens
aatttaaaccagcagaaaagt

SEQ ID NO: 3952712 - DNA, 14 bp, Homo sapiens
aatttaactaattt

SEQ ID NO: 3952713 - DNA, 15 bp, Homo sapiens
aatttaactaattta

SEQ ID NO: 3952714 - DNA, 16 bp, Homo sapiens
aatttaactaatttaa

SEQ ID NO: 3952715 - DNA, 19 bp, Homo sapiens
aatttaactaatttaaacc

SEQ ID NO: 3952716 - DNA, 14 bp, Homo sapiens
aatttaatgcatgt

SEQ ID NO: 3952717 - DNA, 12 bp, Homo sapiens
aatttaattcca

SEQ ID NO: 3952718 - DNA, 14 bp, Homo sapiens
aatttacatggcaa

SEQ ID NO: 3952719 - DNA, 13 bp, Homo sapiens
aatttatacaaaa

SEQ ID NO: 3952720 - DNA, 23 bp, Homo sapiens
aatttatcctgaaatttcagatt

SEQ ID NO: 3952721 - DNA, 17 bp, Homo sapiens
aatttattagttaatat

SEQ ID NO: 3952722 - DNA, 17 bp, Homo sapiens
aatttcaaaagacatgt

SEQ ID NO: 3952723 - DNA, 19 bp, Homo sapiens
aatttcaaaagtgatctgt

SEQ ID NO: 3952724 - DNA, 17 bp, Homo sapiens
aatttcaggcattttgt

SEQ ID NO: 3952725 - DNA, 14 bp, Homo sapiens
aatttcctatctgt

SEQ ID NO: 3952726 - DNA, 16 bp, Homo sapiens
aatttcctatctgtat

SEQ ID NO: 3952727 - DNA, 16 bp, Homo sapiens
aatttcctttatattt

SEQ ID NO: 3952728 - DNA, 21 bp, Homo sapiens
aatttcctttatatttagtga

SEQ ID NO: 3952729 - DNA, 19 bp, Homo sapiens
aatttctcccagtcattta

SEQ ID NO: 3952730 - DNA, 19 bp, Homo sapiens
aatttctttgtcattcaag

SEQ ID NO: 3952731 - DNA, 19 bp, Homo sapiens
aatttctttttttaaattg

SEQ ID NO: 3952732 - DNA, 23 bp, Homo sapiens
aatttgaaaacataatctgcaaa

SEQ ID NO: 3952733 - DNA, 16 bp, Homo sapiens
aatttgagcaattcat

SEQ ID NO: 3952734 - DNA, 17 bp, Homo sapiens
aatttgatacaaaatgc

SEQ ID NO: 3952735 - DNA, 19 bp, Homo sapiens
aatttggtgtggctgtatt

SEQ ID NO: 3952736 - DNA, 15 bp, Homo sapiens
aatttgtaattgctt

SEQ ID NO: 3952737 - DNA, 14 bp, Homo sapiens
aatttgtatatcat

SEQ ID NO: 3952738 - DNA, 15 bp, Homo sapiens
aatttgtatctgaag

SEQ ID NO: 3952739 - DNA, 20 bp, Homo sapiens
aatttgtatctgaaggagat

SEQ ID NO: 3952740 - DNA, 17 bp, Homo sapiens
aattttaaagtggttct

SEQ ID NO: 3952741 - DNA, 13 bp, Homo sapiens
aattttaatgcta

SEQ ID NO: 3952742 - DNA, 20 bp, Homo sapiens
aattttctagactttctgtt

SEQ ID NO: 3952743 - DNA, 12 bp, Homo sapiens
aattttgcattt

SEQ ID NO: 3952744 - DNA, 13 bp, Homo sapiens
aattttgttgctg

SEQ ID NO: 3952745 - DNA, 21 bp, Homo sapiens
aattttgtttcagaattttgt

SEQ ID NO: 3952746 - DNA, 22 bp, Homo sapiens
aattttgtttcagaattttgta

SEQ ID NO: 3952747 - DNA, 22 bp, Homo sapiens
aatttttaaagtatatatttat

SEQ ID NO: 3952748 - DNA, 13 bp, Homo sapiens
aatttttaatgac

SEQ ID NO: 3952749 - DNA, 15 bp, Homo sapiens
aatttttacatgacc

SEQ ID NO: 3952750 - DNA, 20 bp, Homo sapiens
aatttttatacatatcagaa

SEQ ID NO: 3952751 - DNA, 23 bp, Homo sapiens
aatttttatacatatcagaaaag

SEQ ID NO: 3952752 - DNA, 15 bp, Homo sapiens
aatttttatttttct

SEQ ID NO: 3952753 - DNA, 17 bp, Homo sapiens
aatttttatttttgaac

SEQ ID NO: 3952754 - DNA, 15 bp, Homo sapiens
aatttttttattact

SEQ ID NO: 3952755 - DNA, 17 bp, Homo sapiens
aatttttttattactga

SEQ ID NO: 3952756 - DNA, 17 bp, Homo sapiens
aattttttttaatgtac

SEQ ID NO: 3952757 - DNA, 19 bp, Homo sapiens
aattttttttaatgtacaa

SEQ ID NO: 3952758 - DNA, 19 bp, Homo sapiens
aatttttttttcctagccc

SEQ ID NO: 3952759 - DNA, 21 bp, Homo sapiens
acaaaaacagcctcacagaag

SEQ ID NO: 3952760 - DNA, 22 bp, Homo sapiens
acaaaaatgaaagcatgtctca

SEQ ID NO: 3952761 - DNA, 17 bp, Homo sapiens
acaaaacaaaacaacaa

SEQ ID NO: 3952762 - DNA, 15 bp, Homo sapiens
acaaaacaagaaaga

SEQ ID NO: 3952763 - DNA, 12 bp, Homo sapiens
acaatagctatt

SEQ ID NO: 3952764 - DNA, 18 bp, Homo sapiens
acaatagctattgcatgt

SEQ ID NO: 3952765 - DNA, 17 bp, Homo sapiens
acaatatataaaaatat

SEQ ID NO: 3952766 - DNA, 18 bp, Homo sapiens
acaatatataaaaatata

SEQ ID NO: 3952767 - DNA, 13 bp, Homo sapiens
acaatccactctc

SEQ ID NO: 3952768 - DNA, 14 bp, Homo sapiens
acaatccactctca

SEQ ID NO: 3952769 - DNA, 15 bp, Homo sapiens
acaatccactctcag

SEQ ID NO: 3952770 - DNA, 19 bp, Homo sapiens
acaatccactctcaggagg

SEQ ID NO: 3952771 - DNA, 12 bp, Homo sapiens
acaatctcaaat

SEQ ID NO: 3952772 - DNA, 16 bp, Homo sapiens
acaatctttccttgtc

SEQ ID NO: 3952773 - DNA, 15 bp, Homo sapiens
acaatgcctctccca

SEQ ID NO: 3952774 - DNA, 23 bp, Homo sapiens
acaatggagtgggagatcagcca

SEQ ID NO: 3952775 - DNA, 18 bp, Homo sapiens
acaattccaaaggaatct

SEQ ID NO: 3952776 - DNA, 17 bp, Homo sapiens
acaattgatacttcagg

SEQ ID NO: 3952777 - DNA, 18 bp, Homo sapiens
acaattgatacttcaggt

SEQ ID NO: 3952778 - DNA, 17 bp, Homo sapiens
acaatttagaaaacatt

SEQ ID NO: 3952779 - DNA, 23 bp, Homo sapiens
acaatttcctttatatttagtga

SEQ ID NO: 3952780 - DNA, 16 bp, Homo sapiens
acaatttgagcaattc

SEQ ID NO: 3952781 - DNA, 13 bp, Homo sapiens
acacaaaagccaa

SEQ ID NO: 3952782 - DNA, 13 bp, Homo sapiens
acacaagtaaaca

SEQ ID NO: 3952783 - DNA, 16 bp, Homo sapiens
acacaagtcctgtgaa

SEQ ID NO: 3952784 - DNA, 19 bp, Homo sapiens
acacaatctttccttgtct

SEQ ID NO: 3952785 - DNA, 22 bp, Homo sapiens
acacaatctttccttgtctctc

SEQ ID NO: 3952786 - DNA, 19 bp, Homo sapiens
acacaatgctattgaaatt

SEQ ID NO: 3952787 - DNA, 18 bp, Homo sapiens
acacaattgatacttcag

SEQ ID NO: 3952788 - DNA, 9 bp, Homo sapiens
acacacaca

SEQ ID NO: 3952789 - DNA, 10 bp, Homo sapiens
acacacacac

SEQ ID NO: 3952790 - DNA, 13 bp, Homo sapiens
acacacacacaca

SEQ ID NO: 3952791 - DNA, 16 bp, Homo sapiens
acacacacacacacac

SEQ ID NO: 3952792 - DNA, 16 bp, Homo sapiens
acacacacacacacat

SEQ ID NO: 3952793 - DNA, 16 bp, Homo sapiens
acacacacacacatac

SEQ ID NO: 3952794 - DNA, 12 bp, Homo sapiens
acacacacatac

SEQ ID NO: 3952795 - DNA, 16 bp, Homo sapiens
acacacagagatatgc

SEQ ID NO: 3952796 - DNA, 19 bp, Homo sapiens
acacacagatatacacatg

SEQ ID NO: 3952797 - DNA, 14 bp, Homo sapiens
acacacagatatgc

SEQ ID NO: 3952798 - DNA, 14 bp, Homo sapiens
acacacagatgcac

SEQ ID NO: 3952799 - DNA, 18 bp, Homo sapiens
acacacagcagcactgca

SEQ ID NO: 3952800 - DNA, 12 bp, Homo sapiens
acacacatagat

SEQ ID NO: 3952801 - DNA, 14 bp, Homo sapiens
acacacatatacat

SEQ ID NO: 3952802 - DNA, 16 bp, Homo sapiens
acacaccgatgtacac

SEQ ID NO: 3952803 - DNA, 13 bp, Homo sapiens
acacacctctgga

SEQ ID NO: 3952804 - DNA, 23 bp, Homo sapiens
acacacctctggatccctggagg

SEQ ID NO: 3952805 - DNA, 14 bp, Homo sapiens
acacacgcaggaac

SEQ ID NO: 3952806 - DNA, 16 bp, Homo sapiens
acacacgcaggaactc

SEQ ID NO: 3952807 - DNA, 23 bp, Homo sapiens
acacacggatgcacacacagatg

SEQ ID NO: 3952808 - DNA, 23 bp, Homo sapiens
acactctagtgacttcctggtga

SEQ ID NO: 3952809 - DNA, 15 bp, Homo sapiens
acactctctgtacaa

SEQ ID NO: 3952810 - DNA, 17 bp, Homo sapiens
acactctctgtacaaaa

SEQ ID NO: 3952811 - DNA, 13 bp, Homo sapiens
acactcttcttga

SEQ ID NO: 3952812 - DNA, 19 bp, Homo sapiens
acactgaagttaacagaga

SEQ ID NO: 3952813 - DNA, 11 bp, Homo sapiens
acactgctgca

SEQ ID NO: 3952814 - DNA, 13 bp, Homo sapiens
acactgctgcacc

SEQ ID NO: 3952815 - DNA, 18 bp, Homo sapiens
acactgggtagtagctaa

SEQ ID NO: 3952816 - DNA, 19 bp, Homo sapiens
acactgtaaatatccacag

SEQ ID NO: 3952817 - DNA, 18 bp, Homo sapiens
acacttatggggacagca

SEQ ID NO: 3952818 - DNA, 19 bp, Homo sapiens
acacttatggggacagcat

SEQ ID NO: 3952819 - DNA, 20 bp, Homo sapiens
acacttatggggacagcata

SEQ ID NO: 3952820 - DNA, 15 bp, Homo sapiens
acacttcaggctctt

SEQ ID NO: 3952821 - DNA, 23 bp, Homo sapiens
acacttctcaggacacaggcctg

SEQ ID NO: 3952822 - DNA, 14 bp, Homo sapiens
acacttctcatcat

SEQ ID NO: 3952823 - DNA, 19 bp, Homo sapiens
acacttctcatcatattgt

SEQ ID NO: 3952824 - DNA, 18 bp, Homo sapiens
acacttgccttcttcacc

SEQ ID NO: 3952825 - DNA, 20 bp, Homo sapiens
acacttgccttcttcaccca

SEQ ID NO: 3952826 - DNA, 17 bp, Homo sapiens
acacttggagcccgtgc

SEQ ID NO: 3952827 - DNA, 15 bp, Homo sapiens
acagaaacagagaga

SEQ ID NO: 3952828 - DNA, 22 bp, Homo sapiens
acagaaacagagagagacagag

SEQ ID NO: 3952829 - DNA, 18 bp, Homo sapiens
acagaaatactgctctga

SEQ ID NO: 3952830 - DNA, 17 bp, Homo sapiens
acagaaatatatataca

SEQ ID NO: 3952831 - DNA, 19 bp, Homo sapiens
acagaaatatatatacata

SEQ ID NO: 3952832 - DNA, 15 bp, Homo sapiens
acagaaccagagggt

SEQ ID NO: 3952833 - DNA, 19 bp, Homo sapiens
acagaaccagagggttgta

SEQ ID NO: 3952834 - DNA, 17 bp, Homo sapiens
acagaacccctacatga

SEQ ID NO: 3952835 - DNA, 13 bp, Homo sapiens
acagaagccagga

SEQ ID NO: 3952836 - DNA, 15 bp, Homo sapiens
acagaagccaggagc

SEQ ID NO: 3952837 - DNA, 14 bp, Homo sapiens
acagaagcttcaga

SEQ ID NO: 3952838 - DNA, 19 bp, Homo sapiens
acagaagcttcagaagttt

SEQ ID NO: 3952839 - DNA, 21 bp, Homo sapiens
acagaatacaagccactacct

SEQ ID NO: 3952840 - DNA, 16 bp, Homo sapiens
acagaatcttgtattt

SEQ ID NO: 3952841 - DNA, 18 bp, Homo sapiens
acagaatgctgttttaaa

SEQ ID NO: 3952842 - DNA, 18 bp, Homo sapiens
acagaatttttaatgact

SEQ ID NO: 3952843 - DNA, 20 bp, Homo sapiens
acagaatttttaatgacttt

SEQ ID NO: 3952844 - DNA, 11 bp, Homo sapiens
acagacaggag

SEQ ID NO: 3952845 - DNA, 15 bp, Homo sapiens
acagacaggagaaat

SEQ ID NO: 3952846 - DNA, 17 bp, Homo sapiens
acagacattaaacctgg

SEQ ID NO: 3952847 - DNA, 15 bp, Homo sapiens
acagacccacacatg

SEQ ID NO: 3952848 - DNA, 23 bp, Homo sapiens
acagactgcaagaggctcctgtc

SEQ ID NO: 3952849 - DNA, 16 bp, Homo sapiens
acagacttctggaagg

SEQ ID NO: 3952850 - DNA, 18 bp, Homo sapiens
acagacttctggaaggct

SEQ ID NO: 3952851 - DNA, 14 bp, Homo sapiens
acagactttagctt

SEQ ID NO: 3952852 - DNA, 18 bp, Homo sapiens
acatacgtgttaggaggc

SEQ ID NO: 3952853 - DNA, 24 bp, Homo sapiens
acatacgtgttaggaggctgcatg

SEQ ID NO: 3952854 - DNA, 12 bp, Homo sapiens
acatagaaagtt

SEQ ID NO: 3952855 - DNA, 14 bp, Homo sapiens
acatagatggacca

SEQ ID NO: 3952856 - DNA, 19 bp, Homo sapiens
acatagatgtatcattaat

SEQ ID NO: 3952857 - DNA, 20 bp, Homo sapiens
acatagattaatggcactga

SEQ ID NO: 3952858 - DNA, 21 bp, Homo sapiens
acatagctacccaaaagagaa

SEQ ID NO: 3952859 - DNA, 21 bp, Homo sapiens
acatagtaagaccccatctct

SEQ ID NO: 3952860 - DNA, 12 bp, Homo sapiens
acatagtcacaa

SEQ ID NO: 3952861 - DNA, 14 bp, Homo sapiens
acatagtcacaaaa

SEQ ID NO: 3952862 - DNA, 14 bp, Homo sapiens
acatatacatatat

SEQ ID NO: 3952863 - DNA, 15 bp, Homo sapiens
acatatacatatata

SEQ ID NO: 3952864 - DNA, 16 bp, Homo sapiens
acatatacatatatat

SEQ ID NO: 3952865 - DNA, 23 bp, Homo sapiens
acatatacctataatgtgtgtat

SEQ ID NO: 3952866 - DNA, 21 bp, Homo sapiens
acatatatatatacacataca

SEQ ID NO: 3952867 - DNA, 23 bp, Homo sapiens
acatatatatatacacatacata

SEQ ID NO: 3952868 - DNA, 16 bp, Homo sapiens
acatatatatctgata

SEQ ID NO: 3952869 - DNA, 13 bp, Homo sapiens
acatatatatgcc

SEQ ID NO: 3952870 - DNA, 17 bp, Homo sapiens
acatatcaattcaacac

SEQ ID NO: 3952871 - DNA, 12 bp, Homo sapiens
acatatcagaaa

SEQ ID NO: 3952872 - DNA, 16 bp, Homo sapiens
acatatgggtgctggc

SEQ ID NO: 3952873 - DNA, 18 bp, Homo sapiens
acatatgggtgctggcag

SEQ ID NO: 3952874 - DNA, 13 bp, Homo sapiens
acatatgtaaaat

SEQ ID NO: 3952875 - DNA, 23 bp, Homo sapiens
acatatgtagactatatacatgt

SEQ ID NO: 3952876 - DNA, 19 bp, Homo sapiens
acatattataaataaatgc

SEQ ID NO: 3952877 - DNA, 20 bp, Homo sapiens
acatcaaatttgccaccact

SEQ ID NO: 3952878 - DNA, 21 bp, Homo sapiens
acatcaccgacgcgtctcctg

SEQ ID NO: 3952879 - DNA, 20 bp, Homo sapiens
acatcacctttttgactttt

SEQ ID NO: 3952880 - DNA, 20 bp, Homo sapiens
acatccatgtttgtaaaact

SEQ ID NO: 3952881 - DNA, 13 bp, Homo sapiens
acatccctgggcc

SEQ ID NO: 3952882 - DNA, 16 bp, Homo sapiens
acatccctgggcctgc

SEQ ID NO: 3952883 - DNA, 20 bp, Homo sapiens
acatccctgggcctgctgct

SEQ ID NO: 3952884 - DNA, 16 bp, Homo sapiens
acatcctgctttccct

SEQ ID NO: 3952885 - DNA, 19 bp, Homo sapiens
acatctaatgtctcttcct

SEQ ID NO: 3952886 - DNA, 21 bp, Homo sapiens
acatctaatgtctcttcctct

SEQ ID NO: 3952887 - DNA, 20 bp, Homo sapiens
acatctcgagccccctggat

SEQ ID NO: 3952888 - DNA, 15 bp, Homo sapiens
acatctctgaaagca

SEQ ID NO: 3952889 - DNA, 13 bp, Homo sapiens
acatctctgcagt

SEQ ID NO: 3952890 - DNA, 15 bp, Homo sapiens
acatctgtcctgtga

SEQ ID NO: 3952891 - DNA, 13 bp, Homo sapiens
acatcttcagctc

SEQ ID NO: 3952892 - DNA, 15 bp, Homo sapiens
acatcttcagctccc

SEQ ID NO: 3952893 - DNA, 16 bp, Homo sapiens
acatcttcagctccca

SEQ ID NO: 3952894 - DNA, 18 bp, Homo sapiens
acatcttcagctcccata

SEQ ID NO: 3952895 - DNA, 22 bp, Homo sapiens
acatctttttcctccctttccc

SEQ ID NO: 3952896 - DNA, 20 bp, Homo sapiens
acatgaaaaacacggcagct

SEQ ID NO: 3952897 - DNA, 23 bp, Homo sapiens
acatgaacacagctgctgaagag

SEQ ID NO: 3952898 - DNA, 19 bp, Homo sapiens
acatgaagtgtgtttcctt

SEQ ID NO: 3952899 - DNA, 13 bp, Homo sapiens
acatgacactgac

SEQ ID NO: 3952900 - DNA, 11 bp, Homo sapiens
acatgacattt

SEQ ID NO: 3952901 - DNA, 17 bp, Homo sapiens
acatgaggagggtgccc

SEQ ID NO: 3952902 - DNA, 15 bp, Homo sapiens
acatgcacatttata

SEQ ID NO: 3952903 - DNA, 19 bp, Homo sapiens
acatgcactgacccttcca

SEQ ID NO: 3952904 - DNA, 17 bp, Homo sapiens
acatgcatcatcagcct

SEQ ID NO: 3952905 - DNA, 15 bp, Homo sapiens
acatgccaccctctc

SEQ ID NO: 3952906 - DNA, 18 bp, Homo sapiens
acatgccatttgtactga

SEQ ID NO: 3952907 - DNA, 16 bp, Homo sapiens
acatgctgtgctcttt

SEQ ID NO: 3952908 - DNA, 23 bp, Homo sapiens
acatgctgtgctctttgaagaga

SEQ ID NO: 3952909 - DNA, 13 bp, Homo sapiens
acatggacacaga

SEQ ID NO: 3952910 - DNA, 14 bp, Homo sapiens
acatggatgcacac

SEQ ID NO: 3952911 - DNA, 19 bp, Homo sapiens
acatggctatcctagagag

SEQ ID NO: 3952912 - DNA, 22 bp, Homo sapiens
acatggctatcctagagaggct

SEQ ID NO: 3952913 - DNA, 17 bp, Homo sapiens
acatggctttgctttgt

SEQ ID NO: 3952914 - DNA, 14 bp, Homo sapiens
acatggtctcctct

SEQ ID NO: 3952915 - DNA, 16 bp, Homo sapiens
acatgtactccagagg

SEQ ID NO: 3952916 - DNA, 13 bp, Homo sapiens
acatgtgcctgta

SEQ ID NO: 3952917 - DNA, 18 bp, Homo sapiens
acatgtgtagggaaagtt

SEQ ID NO: 3952918 - DNA, 12 bp, Homo sapiens
acatgtgtgtat

SEQ ID NO: 3952919 - DNA, 18 bp, Homo sapiens
acatgtgtgtatatatgt

SEQ ID NO: 3952920 - DNA, 14 bp, Homo sapiens
acatgttatatatt

SEQ ID NO: 3952921 - DNA, 19 bp, Homo sapiens
acatgttatccacaagcaa

SEQ ID NO: 3952922 - DNA, 21 bp, Homo sapiens
acatgttgtaaattaggaggc

SEQ ID NO: 3952923 - DNA, 16 bp, Homo sapiens
acatgtttaaattgta

SEQ ID NO: 3952924 - DNA, 17 bp, Homo sapiens
acatgtttaaattgtaa

SEQ ID NO: 3952925 - DNA, 18 bp, Homo sapiens
acattaaaagaagactgg

SEQ ID NO: 3952926 - DNA, 19 bp, Homo sapiens
acattaaaagaagactgga

SEQ ID NO: 3952927 - DNA, 21 bp, Homo sapiens
acattaaaagaagactggaag

SEQ ID NO: 3952928 - DNA, 16 bp, Homo sapiens
acattaaacactgtaa

SEQ ID NO: 3952929 - DNA, 18 bp, Homo sapiens
acattaaacactgtaatc

SEQ ID NO: 3952930 - DNA, 12 bp, Homo sapiens
acattaaatgtc

SEQ ID NO: 3952931 - DNA, 17 bp, Homo sapiens
acattaaatgtcttata

SEQ ID NO: 3952932 - DNA, 14 bp, Homo sapiens
acattaaattaaat

SEQ ID NO: 3952933 - DNA, 16 bp, Homo sapiens
acattaacatctatta

SEQ ID NO: 3952934 - DNA, 17 bp, Homo sapiens
acattaatcaccaaagt

SEQ ID NO: 3952935 - DNA, 17 bp, Homo sapiens
acattaatggtctaaaa

SEQ ID NO: 3952936 - DNA, 21 bp, Homo sapiens
acattaatgttaattcagcac

SEQ ID NO: 3952937 - DNA, 22 bp, Homo sapiens
acattagcagtttgctttgtat

SEQ ID NO: 3952938 - DNA, 13 bp, Homo sapiens
acattatgtgtgc

SEQ ID NO: 3952939 - DNA, 20 bp, Homo sapiens
acattatgtgtgcatgtgtg

SEQ ID NO: 3952940 - DNA, 16 bp, Homo sapiens
acattcctcagctgcc

SEQ ID NO: 3952941 - DNA, 17 bp, Homo sapiens
acattcctcagctgcca

SEQ ID NO: 3952942 - DNA, 22 bp, Homo sapiens
acattcctcagctgccaagcac

SEQ ID NO: 3952943 - DNA, 18 bp, Homo sapiens
acattccttgtcaccagc

SEQ ID NO: 3952944 - DNA, 22 bp, Homo sapiens
acattcgaggtgtcaccctgca

SEQ ID NO: 3952945 - DNA, 23 bp, Homo sapiens
acattcgaggtgtcaccctgcag

SEQ ID NO: 3952946 - DNA, 22 bp, Homo sapiens
acattctcctgtgcccctcaga

SEQ ID NO: 3952947 - DNA, 22 bp, Homo sapiens
acattcttaaaggaaaagtcaa

SEQ ID NO: 3952948 - DNA, 23 bp, Homo sapiens
acattcttaaaggaaaagtcaac

SEQ ID NO: 3952949 - DNA, 16 bp, Homo sapiens
acattgacttcttggt

SEQ ID NO: 3952950 - DNA, 12 bp, Homo sapiens
acattgcctcca

SEQ ID NO: 3952951 - DNA, 15 bp, Homo sapiens
acattgtctggatac

SEQ ID NO: 3952952 - DNA, 17 bp, Homo sapiens
acatttaatacagcagt

SEQ ID NO: 3952953 - DNA, 17 bp, Homo sapiens
acatttacaataaatat

SEQ ID NO: 3952954 - DNA, 15 bp, Homo sapiens
acatttatacatcac

SEQ ID NO: 3952955 - DNA, 15 bp, Homo sapiens
acatttccctgtgct

SEQ ID NO: 3952956 - DNA, 14 bp, Homo sapiens
acatttctctgagc

SEQ ID NO: 3952957 - DNA, 20 bp, Homo sapiens
acatttcttatgatttttaa

SEQ ID NO: 3952958 - DNA, 12 bp, Homo sapiens
acatttgatgta

SEQ ID NO: 3952959 - DNA, 16 bp, Homo sapiens
acatttgatgtacatg

SEQ ID NO: 3952960 - DNA, 15 bp, Homo sapiens
acatttgccttgctg

SEQ ID NO: 3952961 - DNA, 21 bp, Homo sapiens
acatttgctttgttttctaaa

SEQ ID NO: 3952962 - DNA, 19 bp, Homo sapiens
acatttgttcatgagtgga

SEQ ID NO: 3952963 - DNA, 20 bp, Homo sapiens
acatttgttcatgagtggat

SEQ ID NO: 3952964 - DNA, 21 bp, Homo sapiens
acattttgttatagaatactt

SEQ ID NO: 3952965 - DNA, 21 bp, Homo sapiens
acatttttatttagttgaaaa

SEQ ID NO: 3952966 - DNA, 22 bp, Homo sapiens
accaaaaaagtatttttttaag

SEQ ID NO: 3952967 - DNA, 21 bp, Homo sapiens
accaaaaaggctagtttattt

SEQ ID NO: 3952968 - DNA, 22 bp, Homo sapiens
accaaactgcacacacagctcc

SEQ ID NO: 3952969 - DNA, 17 bp, Homo sapiens
accaaagagactggagc

SEQ ID NO: 3952970 - DNA, 21 bp, Homo sapiens
accaaagagactggagcatct

SEQ ID NO: 3952971 - DNA, 22 bp, Homo sapiens
accaaagatatatacacaggat

SEQ ID NO: 3952972 - DNA, 20 bp, Homo sapiens
accaaagcaccttagctggc

SEQ ID NO: 3952973 - DNA, 20 bp, Homo sapiens
accaaaggaatcgtttcaaa

SEQ ID NO: 3952974 - DNA, 14 bp, Homo sapiens
accaaatattttag

SEQ ID NO: 3952975 - DNA, 15 bp, Homo sapiens
accaaatgatgccac

SEQ ID NO: 3952976 - DNA, 14 bp, Homo sapiens
accaacacgagcag

SEQ ID NO: 3952977 - DNA, 19 bp, Homo sapiens
accaacacgagcaggctac

SEQ ID NO: 3952978 - DNA, 23 bp, Homo sapiens
accaacaggctgttctgcactga

SEQ ID NO: 3952979 - DNA, 18 bp, Homo sapiens
accaacatcccattgccc

SEQ ID NO: 3952980 - DNA, 15 bp, Homo sapiens
accaaccaaccacaa

SEQ ID NO: 3952981 - DNA, 14 bp, Homo sapiens
accaaccctgtttc

SEQ ID NO: 3952982 - DNA, 13 bp, Homo sapiens
accaactttctgt

SEQ ID NO: 3952983 - DNA, 18 bp, Homo sapiens
accaactttctgtaaact

SEQ ID NO: 3952984 - DNA, 16 bp, Homo sapiens
accaagactctgaaat

SEQ ID NO: 3952985 - DNA, 20 bp, Homo sapiens
accaagagagaaagaagtag

SEQ ID NO: 3952986 - DNA, 16 bp, Homo sapiens
accaagatgggcacat

SEQ ID NO: 3952987 - DNA, 22 bp, Homo sapiens
accaagatgggcacatgaggag

SEQ ID NO: 3952988 - DNA, 21 bp, Homo sapiens
accaagccccttggccctctc

SEQ ID NO: 3952989 - DNA, 19 bp, Homo sapiens
accaagctcacagttcctc

SEQ ID NO: 3952990 - DNA, 15 bp, Homo sapiens
accaagcttcagagc

SEQ ID NO: 3952991 - DNA, 18 bp, Homo sapiens
accaagcttcagagccta

SEQ ID NO: 3952992 - DNA, 22 bp, Homo sapiens
accaagcttcagagcctagcca

SEQ ID NO: 3952993 - DNA, 23 bp, Homo sapiens
accaaggcagcctccagagccag

SEQ ID NO: 3952994 - DNA, 24 bp, Homo sapiens
accaaggcagcctccagagccagc

SEQ ID NO: 3952995 - DNA, 15 bp, Homo sapiens
accaaggcccagcta

SEQ ID NO: 3952996 - DNA, 13 bp, Homo sapiens
accaatcatttta

SEQ ID NO: 3952997 - DNA, 21 bp, Homo sapiens
accaatgattcataacaatgt

SEQ ID NO: 3952998 - DNA, 22 bp, Homo sapiens
accaatgattcataacaatgta

SEQ ID NO: 3952999 - DNA, 17 bp, Homo sapiens
accaatgcatgcagcca

SEQ ID NO: 3953000 - DNA, 18 bp, Homo sapiens
accaatgcttttatcaaa

SEQ ID NO: 3953001 - DNA, 19 bp, Homo sapiens
accaatgcttttatcaaac

SEQ ID NO: 3953002 - DNA, 14 bp, Homo sapiens
accacaaaaatgaa

SEQ ID NO: 3953003 - DNA, 13 bp, Homo sapiens
accacaactgaca

SEQ ID NO: 3953004 - DNA, 16 bp, Homo sapiens
accacaccgcagaagc

SEQ ID NO: 3953005 - DNA, 16 bp, Homo sapiens
accacacctccctgaa

SEQ ID NO: 3953006 - DNA, 15 bp, Homo sapiens
accacacgctgtctc

SEQ ID NO: 3953007 - DNA, 14 bp, Homo sapiens
accacacttcttga

SEQ ID NO: 3953008 - DNA, 18 bp, Homo sapiens
accacagcaattggctcc

SEQ ID NO: 3953009 - DNA, 21 bp, Homo sapiens
accacagcagctgaacagcca

SEQ ID NO: 3953010 - DNA, 21 bp, Homo sapiens
accacagcggaggagctccgc

SEQ ID NO: 3953011 - DNA, 15 bp, Homo sapiens
accacaggcccttgg

SEQ ID NO: 3953012 - DNA, 23 bp, Homo sapiens
accacatccacacacgcaggaac

SEQ ID NO: 3953013 - DNA, 16 bp, Homo sapiens
accacatctacaattt

SEQ ID NO: 3953014 - DNA, 15 bp, Homo sapiens
accaccccttcctgt

SEQ ID NO: 3953015 - DNA, 13 bp, Homo sapiens
accaccctgaggc

SEQ ID NO: 3953016 - DNA, 17 bp, Homo sapiens
accaccgaagaggaagc

SEQ ID NO: 3953017 - DNA, 15 bp, Homo sapiens
accacctctcaatat

SEQ ID NO: 3953018 - DNA, 12 bp, Homo sapiens
accacctgccag

SEQ ID NO: 3953019 - DNA, 13 bp, Homo sapiens
accacctgccagc

SEQ ID NO: 3953020 - DNA, 20 bp, Homo sapiens
accacctgccagccatcaca

SEQ ID NO: 3953021 - DNA, 13 bp, Homo sapiens
accaccttcccag

SEQ ID NO: 3953022 - DNA, 14 bp, Homo sapiens
accaccttcccagc

SEQ ID NO: 3953023 - DNA, 17 bp, Homo sapiens
accaccttcccagctct

SEQ ID NO: 3953024 - DNA, 19 bp, Homo sapiens
accaccttcccagctctcc

SEQ ID NO: 3953025 - DNA, 20 bp, Homo sapiens
accaccttcccagctctccc

SEQ ID NO: 3953026 - DNA, 20 bp, Homo sapiens
accacgatgtggccctggcc

SEQ ID NO: 3953027 - DNA, 21 bp, Homo sapiens
accacgatgtggccctggcct

SEQ ID NO: 3953028 - DNA, 21 bp, Homo sapiens
accacggacgtttccatcagg

SEQ ID NO: 3953029 - DNA, 20 bp, Homo sapiens
accacgggcctcagtttccc

SEQ ID NO: 3953030 - DNA, 18 bp, Homo sapiens
accacgtctgccaggccc

SEQ ID NO: 3953031 - DNA, 22 bp, Homo sapiens
accacgtctgccaggcccatct

SEQ ID NO: 3953032 - DNA, 13 bp, Homo sapiens
accactagagctg

SEQ ID NO: 3953033 - DNA, 12 bp, Homo sapiens
accactccattc

SEQ ID NO: 3953034 - DNA, 15 bp, Homo sapiens
accactctggcagcc

SEQ ID NO: 3953035 - DNA, 20 bp, Homo sapiens
accactctggcagccacact

SEQ ID NO: 3953036 - DNA, 14 bp, Homo sapiens
accactgccctgcc

SEQ ID NO: 3953037 - DNA, 20 bp, Homo sapiens
accactgccctgcctgccca

SEQ ID NO: 3953038 - DNA, 15 bp, Homo sapiens
accacttcttttata

SEQ ID NO: 3953039 - DNA, 13 bp, Homo sapiens
accacttggctgc

SEQ ID NO: 3953040 - DNA, 16 bp, Homo sapiens
accacttggctgctca

SEQ ID NO: 3953041 - DNA, 23 bp, Homo sapiens
accagaatcataattttcaagag

SEQ ID NO: 3953042 - DNA, 15 bp, Homo sapiens
accagagcagagagc

SEQ ID NO: 3953043 - DNA, 10 bp, Homo sapiens
accagagccc

SEQ ID NO: 3953044 - DNA, 14 bp, Homo sapiens
accagagccccaca

SEQ ID NO: 3953045 - DNA, 17 bp, Homo sapiens
accagagccccacacgg

SEQ ID NO: 3953046 - DNA, 20 bp, Homo sapiens
accagagccccacacggagg

SEQ ID NO: 3953047 - DNA, 15 bp, Homo sapiens
accagagccccccac

SEQ ID NO: 3953048 - DNA, 14 bp, Homo sapiens
accagaggctgcag

SEQ ID NO: 3953049 - DNA, 22 bp, Homo sapiens
accagaggctgcagaaggccaa

SEQ ID NO: 3953050 - DNA, 19 bp, Homo sapiens
accagcaacatctcgagcc

SEQ ID NO: 3953051 - DNA, 16 bp, Homo sapiens
accagcaactctgact

SEQ ID NO: 3953052 - DNA, 17 bp, Homo sapiens
accagcaatatgtaaat

SEQ ID NO: 3953053 - DNA, 13 bp, Homo sapiens
accagcattcatg

SEQ ID NO: 3953054 - DNA, 15 bp, Homo sapiens
accagcattttacta

SEQ ID NO: 3953055 - DNA, 16 bp, Homo sapiens
accagccccctggatg

SEQ ID NO: 3953056 - DNA, 17 bp, Homo sapiens
accagccccctggatgg

SEQ ID NO: 3953057 - DNA, 14 bp, Homo sapiens
accagcccggcctg

SEQ ID NO: 3953058 - DNA, 15 bp, Homo sapiens
accagcccggcctgc

SEQ ID NO: 3953059 - DNA, 21 bp, Homo sapiens
accagcccggcctgctcccag

SEQ ID NO: 3953060 - DNA, 16 bp, Homo sapiens
accagcccttccctgc

SEQ ID NO: 3953061 - DNA, 17 bp, Homo sapiens
accagcccttccctgct

SEQ ID NO: 3953062 - DNA, 19 bp, Homo sapiens
accagcctccatgctgcct

SEQ ID NO: 3953063 - DNA, 20 bp, Homo sapiens
accagcctgaccaacatggt

SEQ ID NO: 3953064 - DNA, 15 bp, Homo sapiens
accagctatctgtca

SEQ ID NO: 3953065 - DNA, 17 bp, Homo sapiens
accagctatctgtcatc

SEQ ID NO: 3953066 - DNA, 13 bp, Homo sapiens
accagctctgtgg

SEQ ID NO: 3953067 - DNA, 18 bp, Homo sapiens
accagctctgtggcctgt

SEQ ID NO: 3953068 - DNA, 20 bp, Homo sapiens
accagctgccaaaatcgtag

SEQ ID NO: 3953069 - DNA, 15 bp, Homo sapiens
accagctgctctgcc

SEQ ID NO: 3953070 - DNA, 19 bp, Homo sapiens
accagctgctctgcccctt

SEQ ID NO: 3953071 - DNA, 18 bp, Homo sapiens
accagcttctccaggctc

SEQ ID NO: 3953072 - DNA, 15 bp, Homo sapiens
accaggacaggacca

SEQ ID NO: 3953073 - DNA, 21 bp, Homo sapiens
accaggcacgaacccacctgc

SEQ ID NO: 3953074 - DNA, 19 bp, Homo sapiens
accagggtccgcaccagct

SEQ ID NO: 3953075 - DNA, 16 bp, Homo sapiens
accagtacttctaaga

SEQ ID NO: 3953076 - DNA, 17 bp, Homo sapiens
accagtacttctaagag

SEQ ID NO: 3953077 - DNA, 18 bp, Homo sapiens
accagtatggaagggagg

SEQ ID NO: 3953078 - DNA, 14 bp, Homo sapiens
accagtgaaccaaa

SEQ ID NO: 3953079 - DNA, 17 bp, Homo sapiens
accagtgaaccaaagag

SEQ ID NO: 3953080 - DNA, 18 bp, Homo sapiens
accagtgaaccaaagaga

SEQ ID NO: 3953081 - DNA, 20 bp, Homo sapiens
accagtgtcccctccactgt

SEQ ID NO: 3953082 - DNA, 16 bp, Homo sapiens
accagttaagaatgga

SEQ ID NO: 3953083 - DNA, 20 bp, Homo sapiens
accagttaagaatggaagaa

SEQ ID NO: 3953084 - DNA, 15 bp, Homo sapiens
accagttctggccag

SEQ ID NO: 3953085 - DNA, 22 bp, Homo sapiens
accagttctggccaggagctgg

SEQ ID NO: 3953086 - DNA, 23 bp, Homo sapiens
accagttctggccaggagctgga

SEQ ID NO: 3953087 - DNA, 18 bp, Homo sapiens
accagttgggagcactgg

SEQ ID NO: 3953088 - DNA, 20 bp, Homo sapiens
accagttgggagcactggag

SEQ ID NO: 3953089 - DNA, 21 bp, Homo sapiens
accataagggactgtgccaga

SEQ ID NO: 3953090 - DNA, 17 bp, Homo sapiens
accatactcatttctaa

SEQ ID NO: 3953091 - DNA, 14 bp, Homo sapiens
accatcaaatgctg

SEQ ID NO: 3953092 - DNA, 14 bp, Homo sapiens
accatcacacatgc

SEQ ID NO: 3953093 - DNA, 12 bp, Homo sapiens
accatcaccctc

SEQ ID NO: 3953094 - DNA, 10 bp, Homo sapiens
accatcactg

SEQ ID NO: 3953095 - DNA, 16 bp, Homo sapiens
accatcctatttaact

SEQ ID NO: 3953096 - DNA, 19 bp, Homo sapiens
accatcctggcccctccag

SEQ ID NO: 3953097 - DNA, 20 bp, Homo sapiens
accatgagaagagggcctgt

SEQ ID NO: 3953098 - DNA, 14 bp, Homo sapiens
accatgccaggcta

SEQ ID NO: 3953099 - DNA, 23 bp, Homo sapiens
accatgctgctttttggcacagt

SEQ ID NO: 3953100 - DNA, 21 bp, Homo sapiens
accatgctggcggcgcagagg

SEQ ID NO: 3953101 - DNA, 13 bp, Homo sapiens
accatggacacat

SEQ ID NO: 3953102 - DNA, 14 bp, Homo sapiens
accatggacacatt

SEQ ID NO: 3953103 - DNA, 15 bp, Homo sapiens
accatggaggcaggc

SEQ ID NO: 3953104 - DNA, 19 bp, Homo sapiens
accatgtaacaaccagaga

SEQ ID NO: 3953105 - DNA, 12 bp, Homo sapiens
accatgtttgag

SEQ ID NO: 3953106 - DNA, 14 bp, Homo sapiens
accattaagaaatg

SEQ ID NO: 3953107 - DNA, 14 bp, Homo sapiens
accattacatgttt

SEQ ID NO: 3953108 - DNA, 17 bp, Homo sapiens
accattacatgtttaaa

SEQ ID NO: 3953109 - DNA, 18 bp, Homo sapiens
accattacatgtttaaat

SEQ ID NO: 3953110 - DNA, 14 bp, Homo sapiens
accattcacatttg

SEQ ID NO: 3953111 - DNA, 22 bp, Homo sapiens
accattcacatttgatgtacat

SEQ ID NO: 3953112 - DNA, 15 bp, Homo sapiens
accattgacctcagc

SEQ ID NO: 3953113 - DNA, 15 bp, Homo sapiens
accattgtcttccaa

SEQ ID NO: 3953114 - DNA, 16 bp, Homo sapiens
accattgtcttccaac

SEQ ID NO: 3953115 - DNA, 18 bp, Homo sapiens
accattgtcttccaaccc

SEQ ID NO: 3953116 - DNA, 20 bp, Homo sapiens
accattgtcttccaacccca

SEQ ID NO: 3953117 - DNA, 11 bp, Homo sapiens
accatttcaga

SEQ ID NO: 3953118 - DNA, 14 bp, Homo sapiens
accatttcagagag

SEQ ID NO: 3953119 - DNA, 20 bp, Homo sapiens
accattttagttcctttatt

SEQ ID NO: 3953120 - DNA, 16 bp, Homo sapiens
acccaaataaatgtgt

SEQ ID NO: 3953121 - DNA, 21 bp, Homo sapiens
acccaaataaatgtgtaaatg

SEQ ID NO: 3953122 - DNA, 16 bp, Homo sapiens
acccaagaggtgggga

SEQ ID NO: 3953123 - DNA, 15 bp, Homo sapiens
acccaagcaaggcca

SEQ ID NO: 3953124 - DNA, 15 bp, Homo sapiens
acccaaggaggaaaa

SEQ ID NO: 3953125 - DNA, 16 bp, Homo sapiens
acccaatgctcctgga

SEQ ID NO: 3953126 - DNA, 21 bp, Homo sapiens
acccaatttaattccataatc

SEQ ID NO: 3953127 - DNA, 12 bp, Homo sapiens
acccacagcctc

SEQ ID NO: 3953128 - DNA, 14 bp, Homo sapiens
acccacccatcttc

SEQ ID NO: 3953129 - DNA, 17 bp, Homo sapiens
acccacccatcttcctg

SEQ ID NO: 3953130 - DNA, 21 bp, Homo sapiens
acccacccatcttcctgctgc

SEQ ID NO: 3953131 - DNA, 22 bp, Homo sapiens
acccacccatcttcctgctgct

SEQ ID NO: 3953132 - DNA, 23 bp, Homo sapiens
acccaccgggccactccttcctg

SEQ ID NO: 3953133 - DNA, 17 bp, Homo sapiens
acccacctgctgagaga

SEQ ID NO: 3953134 - DNA, 21 bp, Homo sapiens
acccacgtgagagaatctgcc

SEQ ID NO: 3953135 - DNA, 13 bp, Homo sapiens
acccactctttgc

SEQ ID NO: 3953136 - DNA, 16 bp, Homo sapiens
acccactgtccgcctc

SEQ ID NO: 3953137 - DNA, 19 bp, Homo sapiens
acccactgtccgcctctgc

SEQ ID NO: 3953138 - DNA, 15 bp, Homo sapiens
acccactgtgcttac

SEQ ID NO: 3953139 - DNA, 21 bp, Homo sapiens
acccagagggtagggcagcag

SEQ ID NO: 3953140 - DNA, 19 bp, Homo sapiens
acccagagtggagtctgag

SEQ ID NO: 3953141 - DNA, 11 bp, Homo sapiens
acccagcccat

SEQ ID NO: 3953142 - DNA, 14 bp, Homo sapiens
acccagcccattct

SEQ ID NO: 3953143 - DNA, 22 bp, Homo sapiens
acccagcccattctctctcctg

SEQ ID NO: 3953144 - DNA, 13 bp, Homo sapiens
acccagccctggg

SEQ ID NO: 3953145 - DNA, 14 bp, Homo sapiens
acccagccctgggg

SEQ ID NO: 3953146 - DNA, 20 bp, Homo sapiens
acccaggaggtggaggttgc

SEQ ID NO: 3953147 - DNA, 12 bp, Homo sapiens
acccaggccctc

SEQ ID NO: 3953148 - DNA, 14 bp, Homo sapiens
acccaggccctcca

SEQ ID NO: 3953149 - DNA, 20 bp, Homo sapiens
acccaggctctggagccaga

SEQ ID NO: 3953150 - DNA, 13 bp, Homo sapiens
acccaggctgcac

SEQ ID NO: 3953151 - DNA, 14 bp, Homo sapiens
acccaggctgcact

SEQ ID NO: 3953152 - DNA, 19 bp, Homo sapiens
acccaggctgcactgcagt

SEQ ID NO: 3953153 - DNA, 20 bp, Homo sapiens
acccaggctggagtacagtg

SEQ ID NO: 3953154 - DNA, 19 bp, Homo sapiens
acccagggctccctcctgg

SEQ ID NO: 3953155 - DNA, 22 bp, Homo sapiens
acccagggctccctcctggagc

SEQ ID NO: 3953156 - DNA, 18 bp, Homo sapiens
  misc_feature (7)..(7): n is a, c, g or t
acccagnagggcgtcgct

SEQ ID NO: 3953157 - DNA, 22 bp, Homo sapiens
acccagtcccagaaccacactg

SEQ ID NO: 3953158 - DNA, 13 bp, Homo sapiens
acccagtccctgg

SEQ ID NO: 3953159 - DNA, 14 bp, Homo sapiens
acccagtccctggg

SEQ ID NO: 3953160 - DNA, 22 bp, Homo sapiens
acccagtccgccaaacactcca

SEQ ID NO: 3953161 - DNA, 13 bp, Homo sapiens
acccagtcctggc

SEQ ID NO: 3953162 - DNA, 16 bp, Homo sapiens
acccagtgctgccatg

SEQ ID NO: 3953163 - DNA, 21 bp, Homo sapiens
acccagtgctgccatgccact

SEQ ID NO: 3953164 - DNA, 15 bp, Homo sapiens
acccagtgggacaga

SEQ ID NO: 3953165 - DNA, 15 bp, Homo sapiens
acccagtgtaaagaa

SEQ ID NO: 3953166 - DNA, 20 bp, Homo sapiens
acccagtgtaaagaataaat

SEQ ID NO: 3953167 - DNA, 21 bp, Homo sapiens
acccagtgtaaagaataaatg

SEQ ID NO: 3953168 - DNA, 23 bp, Homo sapiens
acccagtgtaaagaataaatgaa

SEQ ID NO: 3953169 - DNA, 19 bp, Homo sapiens
acccatcagaaggagaagg

SEQ ID NO: 3953170 - DNA, 17 bp, Homo sapiens
acccatcagacaggtaa

SEQ ID NO: 3953171 - DNA, 15 bp, Homo sapiens
acccatcttccccgg

SEQ ID NO: 3953172 - DNA, 16 bp, Homo sapiens
acccatcttccccgga

SEQ ID NO: 3953173 - DNA, 20 bp, Homo sapiens
acccatgatgagctcctctt

SEQ ID NO: 3953174 - DNA, 14 bp, Homo sapiens
acccatgtgccaag

SEQ ID NO: 3953175 - DNA, 19 bp, Homo sapiens
acccattaggcatgcctaa

SEQ ID NO: 3953176 - DNA, 20 bp, Homo sapiens
acccattcccccatgtggct

SEQ ID NO: 3953177 - DNA, 23 bp, Homo sapiens
acccattcccccatgtggctgaa

SEQ ID NO: 3953178 - DNA, 17 bp, Homo sapiens
acccattcctatttctt

SEQ ID NO: 3953179 - DNA, 20 bp, Homo sapiens
acccattttgagtgactcga

SEQ ID NO: 3953180 - DNA, 15 bp, Homo sapiens
accccaaagcccctt

SEQ ID NO: 3953181 - DNA, 21 bp, Homo sapiens
accccaagggacaaccccatc

SEQ ID NO: 3953182 - DNA, 19 bp, Homo sapiens
accccacattggacttcct

SEQ ID NO: 3953183 - DNA, 22 bp, Homo sapiens
accccaccacgatgtggccctg

SEQ ID NO: 3953184 - DNA, 21 bp, Homo sapiens
accccacccccttcagtgccc

SEQ ID NO: 3953185 - DNA, 18 bp, Homo sapiens
accccaccttgccaagct

SEQ ID NO: 3953186 - DNA, 15 bp, Homo sapiens
accccactccagccc

SEQ ID NO: 3953187 - DNA, 13 bp, Homo sapiens
accccagcggctg

SEQ ID NO: 3953188 - DNA, 21 bp, Homo sapiens
accccagctagggctggactc

SEQ ID NO: 3953189 - DNA, 12 bp, Homo sapiens
accccagctggc

SEQ ID NO: 3953190 - DNA, 13 bp, Homo sapiens
accccagctggcc

SEQ ID NO: 3953191 - DNA, 15 bp, Homo sapiens
accccagctggcctc

SEQ ID NO: 3953192 - DNA, 16 bp, Homo sapiens
accccagctggcctct

SEQ ID NO: 3953193 - DNA, 18 bp, Homo sapiens
accccaggcatcccatcc

SEQ ID NO: 3953194 - DNA, 21 bp, Homo sapiens
accccaggcatcccatccctt

SEQ ID NO: 3953195 - DNA, 11 bp, Homo sapiens
accccagggca

SEQ ID NO: 3953196 - DNA, 19 bp, Homo sapiens
acccttttcctccagacag

SEQ ID NO: 3953197 - DNA, 15 bp, Homo sapiens
accgaaggggaaaac

SEQ ID NO: 3953198 - DNA, 16 bp, Homo sapiens
accgacgcgtctcctg

SEQ ID NO: 3953199 - DNA, 18 bp, Homo sapiens
accgagacggctggacct

SEQ ID NO: 3953200 - DNA, 16 bp, Homo sapiens
accgagtctcttctcc

SEQ ID NO: 3953201 - DNA, 18 bp, Homo sapiens
accgagtctcttctccac

SEQ ID NO: 3953202 - DNA, 20 bp, Homo sapiens
accgagtctcttctccactg

SEQ ID NO: 3953203 - DNA, 21 bp, Homo sapiens
accgagtctcttctccactgg

SEQ ID NO: 3953204 - DNA, 14 bp, Homo sapiens
accgcagaaggaag

SEQ ID NO: 3953205 - DNA, 19 bp, Homo sapiens
accgcgcatctcttcctga

SEQ ID NO: 3953206 - DNA, 17 bp, Homo sapiens
accgcgtctaccctggg

SEQ ID NO: 3953207 - DNA, 18 bp, Homo sapiens
accgcgtctaccctggga

SEQ ID NO: 3953208 - DNA, 19 bp, Homo sapiens
accgcgtctaccctgggat

SEQ ID NO: 3953209 - DNA, 20 bp, Homo sapiens
accgctacaccactctggca

SEQ ID NO: 3953210 - DNA, 15 bp, Homo sapiens
accgcttcacccctg

SEQ ID NO: 3953211 - DNA, 19 bp, Homo sapiens
accgggagcctccccctca

SEQ ID NO: 3953212 - DNA, 20 bp, Homo sapiens
accgggagcctccccctcag

SEQ ID NO: 3953213 - DNA, 20 bp, Homo sapiens
accgggccactccttcctgc

SEQ ID NO: 3953214 - DNA, 15 bp, Homo sapiens
accgggccctccttg

SEQ ID NO: 3953215 - DNA, 21 bp, Homo sapiens
accgggctgggagctctgcag

SEQ ID NO: 3953216 - DNA, 13 bp, Homo sapiens
accgggggccaga

SEQ ID NO: 3953217 - DNA, 17 bp, Homo sapiens
accgggggccagacaca

SEQ ID NO: 3953218 - DNA, 18 bp, Homo sapiens
accgggggccagacacag

SEQ ID NO: 3953219 - DNA, 14 bp, Homo sapiens
accgggtgggcctg

SEQ ID NO: 3953220 - DNA, 17 bp, Homo sapiens
accgggtgggcctggcc

SEQ ID NO: 3953221 - DNA, 20 bp, Homo sapiens
accgggtgggcctggcctga

SEQ ID NO: 3953222 - DNA, 23 bp, Homo sapiens
accgtcatggcttaatgtttatt

SEQ ID NO: 3953223 - DNA, 12 bp, Homo sapiens
accgtccctcag

SEQ ID NO: 3953224 - DNA, 17 bp, Homo sapiens
accgtggaccttcctgc

SEQ ID NO: 3953225 - DNA, 14 bp, Homo sapiens
acctagaagggcta

SEQ ID NO: 3953226 - DNA, 13 bp, Homo sapiens
acctagacctggg

SEQ ID NO: 3953227 - DNA, 18 bp, Homo sapiens
acctaggccactcctcca

SEQ ID NO: 3953228 - DNA, 17 bp, Homo sapiens
acctataatgtgtgtat

SEQ ID NO: 3953229 - DNA, 12 bp, Homo sapiens
acctcaaactgg

SEQ ID NO: 3953230 - DNA, 14 bp, Homo sapiens
acctcaaactgggt

SEQ ID NO: 3953231 - DNA, 19 bp, Homo sapiens
acctcaatgccctgccatt

SEQ ID NO: 3953232 - DNA, 23 bp, Homo sapiens
acctcactatggtatgctggcca

SEQ ID NO: 3953233 - DNA, 13 bp, Homo sapiens
acctcactcctgt

SEQ ID NO: 3953234 - DNA, 19 bp, Homo sapiens
acctcagacaatccactct

SEQ ID NO: 3953235 - DNA, 16 bp, Homo sapiens
acctcagcctcccaga

SEQ ID NO: 3953236 - DNA, 17 bp, Homo sapiens
acctcagctgcacattc

SEQ ID NO: 3953237 - DNA, 16 bp, Homo sapiens
acctcagggacaacat

SEQ ID NO: 3953238 - DNA, 16 bp, Homo sapiens
acctcagtttcctcat

SEQ ID NO: 3953239 - DNA, 21 bp, Homo sapiens
acctcagtttcctcatctgca

SEQ ID NO: 3953240 - DNA, 23 bp, Homo sapiens
acctcatggtcatggacagatag

SEQ ID NO: 3953241 - DNA, 18 bp, Homo sapiens
acctccacccactgtccg

SEQ ID NO: 3953242 - DNA, 22 bp, Homo sapiens
acctccacccactgtccgcctc

SEQ ID NO: 3953243 - DNA, 20 bp, Homo sapiens
acctccacccccgccacggc

SEQ ID NO: 3953244 - DNA, 16 bp, Homo sapiens
acctcccaccccactc

SEQ ID NO: 3953245 - DNA, 21 bp, Homo sapiens
acctcccaccccactccagcc

SEQ ID NO: 3953246 - DNA, 22 bp, Homo sapiens
acctcccaccccactccagccc

SEQ ID NO: 3953247 - DNA, 20 bp, Homo sapiens
acctcccagccctatggatg

SEQ ID NO: 3953248 - DNA, 18 bp, Homo sapiens
acctccccccactgcagg

SEQ ID NO: 3953249 - DNA, 16 bp, Homo sapiens
acctccccctcttggt

SEQ ID NO: 3953250 - DNA, 14 bp, Homo sapiens
acctccctactccc

SEQ ID NO: 3953251 - DNA, 15 bp, Homo sapiens
acctccggggagagc

SEQ ID NO: 3953252 - DNA, 16 bp, Homo sapiens
acctccgtgctgggct

SEQ ID NO: 3953253 - DNA, 19 bp, Homo sapiens
acctcctagaggtgggcag

SEQ ID NO: 3953254 - DNA, 16 bp, Homo sapiens
acctcctatccttgga

SEQ ID NO: 3953255 - DNA, 17 bp, Homo sapiens
acctcctatccttggag

SEQ ID NO: 3953256 - DNA, 14 bp, Homo sapiens
acctcctattttaa

SEQ ID NO: 3953257 - DNA, 20 bp, Homo sapiens
acctcctgcccaggagagcc

SEQ ID NO: 3953258 - DNA, 18 bp, Homo sapiens
acctccttgctttgctgt

SEQ ID NO: 3953259 - DNA, 18 bp, Homo sapiens
acctcgtcctccccctgc

SEQ ID NO: 3953260 - DNA, 21 bp, Homo sapiens
acctcgtcctccccctgccag

SEQ ID NO: 3953261 - DNA, 21 bp, Homo sapiens
acctctagtgctactgctaga

SEQ ID NO: 3953262 - DNA, 13 bp, Homo sapiens
acctctccttgga

SEQ ID NO: 3953263 - DNA, 13 bp, Homo sapiens
acctctgaaggca

SEQ ID NO: 3953264 - DNA, 13 bp, Homo sapiens
acctctgcctcaa

SEQ ID NO: 3953265 - DNA, 15 bp, Homo sapiens
acctctgcctcaatg

SEQ ID NO: 3953266 - DNA, 14 bp, Homo sapiens
acctctgctctgag

SEQ ID NO: 3953267 - DNA, 17 bp, Homo sapiens
acctctggatccctgga

SEQ ID NO: 3953268 - DNA, 12 bp, Homo sapiens
acctctgggctt

SEQ ID NO: 3953269 - DNA, 23 bp, Homo sapiens
acctctgtaatttttcagctctc

SEQ ID NO: 3953270 - DNA, 21 bp, Homo sapiens
acctctgtgaggaaagcacac

SEQ ID NO: 3953271 - DNA, 14 bp, Homo sapiens
acctcttctgccag

SEQ ID NO: 3953272 - DNA, 22 bp, Homo sapiens
acctctttattttttgattgaa

SEQ ID NO: 3953273 - DNA, 21 bp, Homo sapiens
acctgaaccccatgggcttgg

SEQ ID NO: 3953274 - DNA, 20 bp, Homo sapiens
acctgaagggtgacatccca

SEQ ID NO: 3953275 - DNA, 23 bp, Homo sapiens
acctgaagggtgacatcccagga

SEQ ID NO: 3953276 - DNA, 16 bp, Homo sapiens
acctgacaatggcagc

SEQ ID NO: 3953277 - DNA, 22 bp, Homo sapiens
acctgacaatggcagctagact

SEQ ID NO: 3953278 - DNA, 16 bp, Homo sapiens
acctgacacaagagga

SEQ ID NO: 3953279 - DNA, 12 bp, Homo sapiens
acctgacagatg

SEQ ID NO: 3953280 - DNA, 19 bp, Homo sapiens
acctgaccaacatggagaa

SEQ ID NO: 3953281 - DNA, 15 bp, Homo sapiens
acctgaccagaatgc

SEQ ID NO: 3953282 - DNA, 16 bp, Homo sapiens
acctgaccggcacctg

SEQ ID NO: 3953283 - DNA, 19 bp, Homo sapiens
acctgacggacgtcctgct

SEQ ID NO: 3953284 - DNA, 12 bp, Homo sapiens
acctgagcctgc

SEQ ID NO: 3953285 - DNA, 19 bp, Homo sapiens
acctgagctagaagctgga

SEQ ID NO: 3953286 - DNA, 23 bp, Homo sapiens
acctgaggatgcaacaaatattt

SEQ ID NO: 3953287 - DNA, 19 bp, Homo sapiens
acctgaggctcctgtgcta

SEQ ID NO: 3953288 - DNA, 14 bp, Homo sapiens
acctgatcacctct

SEQ ID NO: 3953289 - DNA, 14 bp, Homo sapiens
acctgcaagcccca

SEQ ID NO: 3953290 - DNA, 15 bp, Homo sapiens
acctgcaagccccag

SEQ ID NO: 3953291 - DNA, 23 bp, Homo sapiens
acctgcaagccccagggcctggg

SEQ ID NO: 3953292 - DNA, 20 bp, Homo sapiens
acctgcacgtgatctgctgg

SEQ ID NO: 3953293 - DNA, 19 bp, Homo sapiens
acctgcatccgtagttccc

SEQ ID NO: 3953294 - DNA, 13 bp, Homo sapiens
acctgccacttcc

SEQ ID NO: 3953295 - DNA, 15 bp, Homo sapiens
acctgccacttccag

SEQ ID NO: 3953296 - DNA, 13 bp, Homo sapiens
acctgccagccat

SEQ ID NO: 3953297 - DNA, 13 bp, Homo sapiens
acctgcccaacct

SEQ ID NO: 3953298 - DNA, 11 bp, Homo sapiens
acctgccccag

SEQ ID NO: 3953299 - DNA, 13 bp, Homo sapiens
acctgccccagcg

SEQ ID NO: 3953300 - DNA, 15 bp, Homo sapiens
acctgccccagcgcg

SEQ ID NO: 3953301 - DNA, 20 bp, Homo sapiens
acctgccccagcgcggcttg

SEQ ID NO: 3953302 - DNA, 18 bp, Homo sapiens
acctgccctgccctgcca

SEQ ID NO: 3953303 - DNA, 18 bp, Homo sapiens
acctgccgacctcgtcct

SEQ ID NO: 3953304 - DNA, 17 bp, Homo sapiens
acctgcctatccatcct

SEQ ID NO: 3953305 - DNA, 18 bp, Homo sapiens
acctgcctatccatcctg

SEQ ID NO: 3953306 - DNA, 15 bp, Homo sapiens
acctgcctctcacac

SEQ ID NO: 3953307 - DNA, 16 bp, Homo sapiens
acctgcggctgctgtg

SEQ ID NO: 3953308 - DNA, 11 bp, Homo sapiens
acctgctgagc

SEQ ID NO: 3953309 - DNA, 13 bp, Homo sapiens
acctgctgagctc

SEQ ID NO: 3953310 - DNA, 14 bp, Homo sapiens
acctgctgagctct

SEQ ID NO: 3953311 - DNA, 17 bp, Homo sapiens
acctgctgagctctgag

SEQ ID NO: 3953312 - DNA, 19 bp, Homo sapiens
acctgctgagctctgagag

SEQ ID NO: 3953313 - DNA, 21 bp, Homo sapiens
acctgcttcatgctcagccct

SEQ ID NO: 3953314 - DNA, 21 bp, Homo sapiens
acctggaagggctagaacctg

SEQ ID NO: 3953315 - DNA, 22 bp, Homo sapiens
acctggagagccagaacctgga

SEQ ID NO: 3953316 - DNA, 22 bp, Homo sapiens
acctggaggggctagaacctag

SEQ ID NO: 3953317 - DNA, 23 bp, Homo sapiens
acctggcaagctagaacctggag

SEQ ID NO: 3953318 - DNA, 21 bp, Homo sapiens
acctggccccatgtctctcag

SEQ ID NO: 3953319 - DNA, 14 bp, Homo sapiens
acctggcctgctgg

SEQ ID NO: 3953320 - DNA, 15 bp, Homo sapiens
acctggcctgctggg

SEQ ID NO: 3953321 - DNA, 17 bp, Homo sapiens
acctggcctgctgggaa

SEQ ID NO: 3953322 - DNA, 11 bp, Homo sapiens
acctggccttc

SEQ ID NO: 3953323 - DNA, 18 bp, Homo sapiens
acctgggaaaacagagga

SEQ ID NO: 3953324 - DNA, 20 bp, Homo sapiens
acctgggaaaacagaggaat

SEQ ID NO: 3953325 - DNA, 13 bp, Homo sapiens
acctgggaagggg

SEQ ID NO: 3953326 - DNA, 19 bp, Homo sapiens
acctgggatatgacaagca

SEQ ID NO: 3953327 - DNA, 13 bp, Homo sapiens
acctgggccctgg

SEQ ID NO: 3953328 - DNA, 19 bp, Homo sapiens
acctgggccctggggcctg

SEQ ID NO: 3953329 - DNA, 18 bp, Homo sapiens
acctgggcctttcctgtg

SEQ ID NO: 3953330 - DNA, 23 bp, Homo sapiens
acctgggcgccaactgctgatca

SEQ ID NO: 3953331 - DNA, 21 bp, Homo sapiens
acctggtcacaggactctgcc

SEQ ID NO: 3953332 - DNA, 19 bp, Homo sapiens
acctgtaatcccagcactt

SEQ ID NO: 3953333 - DNA, 21 bp, Homo sapiens
acctgtagaacacccctgtgc

SEQ ID NO: 3953334 - DNA, 16 bp, Homo sapiens
acctgtagtgagaaac

SEQ ID NO: 3953335 - DNA, 19 bp, Homo sapiens
acctgtgtggacaggacta

SEQ ID NO: 3953336 - DNA, 16 bp, Homo sapiens
acctgtgttcattctt

SEQ ID NO: 3953337 - DNA, 20 bp, Homo sapiens
acctgttaaaatgtacactg

SEQ ID NO: 3953338 - DNA, 15 bp, Homo sapiens
acctgttgcacctca

SEQ ID NO: 3953339 - DNA, 18 bp, Homo sapiens
accttaatattattgggg

SEQ ID NO: 3953340 - DNA, 15 bp, Homo sapiens
accttacattcctag

SEQ ID NO: 3953341 - DNA, 20 bp, Homo sapiens
accttaccaactttctgtaa

SEQ ID NO: 3953342 - DNA, 19 bp, Homo sapiens
accttagattagctctgga

SEQ ID NO: 3953343 - DNA, 12 bp, Homo sapiens
accttatgtatt

SEQ ID NO: 3953344 - DNA, 17 bp, Homo sapiens
accttatgtattatttt

SEQ ID NO: 3953345 - DNA, 14 bp, Homo sapiens
accttcagaataag

SEQ ID NO: 3953346 - DNA, 17 bp, Homo sapiens
accttcccagctctccc

SEQ ID NO: 3953347 - DNA, 19 bp, Homo sapiens
accttcccagctctccctc

SEQ ID NO: 3953348 - DNA, 16 bp, Homo sapiens
accttccccagactca

SEQ ID NO: 3953349 - DNA, 15 bp, Homo sapiens
accttccctctttct

SEQ ID NO: 3953350 - DNA, 17 bp, Homo sapiens
accttctccccattctg

SEQ ID NO: 3953351 - DNA, 12 bp, Homo sapiens
accttctgtggc

SEQ ID NO: 3953352 - DNA, 16 bp, Homo sapiens
accttctgtggctcac

SEQ ID NO: 3953353 - DNA, 18 bp, Homo sapiens
accttcttggcttctggg

SEQ ID NO: 3953354 - DNA, 14 bp, Homo sapiens
accttgatttaaaa

SEQ ID NO: 3953355 - DNA, 10 bp, Homo sapiens
accttgcagc

SEQ ID NO: 3953356 - DNA, 19 bp, Homo sapiens
accttgcatctcattgctc

SEQ ID NO: 3953357 - DNA, 18 bp, Homo sapiens
accttgccgagagaggcg

SEQ ID NO: 3953358 - DNA, 17 bp, Homo sapiens
accttggactcctccca

SEQ ID NO: 3953359 - DNA, 17 bp, Homo sapiens
accttggagagacacag

SEQ ID NO: 3953360 - DNA, 18 bp, Homo sapiens
accttggtaaattgtaaa

SEQ ID NO: 3953361 - DNA, 13 bp, Homo sapiens
acctttacataat

SEQ ID NO: 3953362 - DNA, 23 bp, Homo sapiens
acctttcccatgctgaattattt

SEQ ID NO: 3953363 - DNA, 21 bp, Homo sapiens
acctttccgctgtcgccccag

SEQ ID NO: 3953364 - DNA, 18 bp, Homo sapiens
acctttgggatcagcctc

SEQ ID NO: 3953365 - DNA, 21 bp, Homo sapiens
acctttgggatcagcctccgc

SEQ ID NO: 3953366 - DNA, 14 bp, Homo sapiens
acctttggtgcaga

SEQ ID NO: 3953367 - DNA, 22 bp, Homo sapiens
acctttgttttgcactgacaag

SEQ ID NO: 3953368 - DNA, 16 bp, Homo sapiens
acaggcaggaagagag

SEQ ID NO: 3953369 - DNA, 17 bp, Homo sapiens
acaggcaggaagagaga

SEQ ID NO: 3953370 - DNA, 20 bp, Homo sapiens
acaggcatttcctgggtggc

SEQ ID NO: 3953371 - DNA, 12 bp, Homo sapiens
acaggcccttgg

SEQ ID NO: 3953372 - DNA, 23 bp, Homo sapiens
acaggcctgtgtagctgtgacct

SEQ ID NO: 3953373 - DNA, 20 bp, Homo sapiens
acaggctgttctgcactgaa

SEQ ID NO: 3953374 - DNA, 22 bp, Homo sapiens
acaggctgttctgcactgaaaa

SEQ ID NO: 3953375 - DNA, 15 bp, Homo sapiens
acagggaagagcaga

SEQ ID NO: 3953376 - DNA, 12 bp, Homo sapiens
acagggaaggca

SEQ ID NO: 3953377 - DNA, 17 bp, Homo sapiens
acagggaaggcaggcag

SEQ ID NO: 3953378 - DNA, 23 bp, Homo sapiens
acagggaaggcaggcagggctct

SEQ ID NO: 3953379 - DNA, 23 bp, Homo sapiens
acagggagcccctaggaaagcag

SEQ ID NO: 3953380 - DNA, 14 bp, Homo sapiens
acaggggcaggcct

SEQ ID NO: 3953381 - DNA, 19 bp, Homo sapiens
acaggggcggggcaggaat

SEQ ID NO: 3953382 - DNA, 18 bp, Homo sapiens
acagggtctcactatgtt

SEQ ID NO: 3953383 - DNA, 13 bp, Homo sapiens
acagggtcttgca

SEQ ID NO: 3953384 - DNA, 18 bp, Homo sapiens
acaggtaaactatcttgg

SEQ ID NO: 3953385 - DNA, 18 bp, Homo sapiens
acaggtatcaggcacagg

SEQ ID NO: 3953386 - DNA, 23 bp, Homo sapiens
acaggtcctgaaagtctgtgtcc

SEQ ID NO: 3953387 - DNA, 16 bp, Homo sapiens
acaggtggcaggacca

SEQ ID NO: 3953388 - DNA, 16 bp, Homo sapiens
acaggtgtggtgtaat

SEQ ID NO: 3953389 - DNA, 17 bp, Homo sapiens
acaggtgtggtgtaatt

SEQ ID NO: 3953390 - DNA, 21 bp, Homo sapiens
acaggtgtggtgtaatttata

SEQ ID NO: 3953391 - DNA, 14 bp, Homo sapiens
acaggtgtttatac

SEQ ID NO: 3953392 - DNA, 18 bp, Homo sapiens
acaggttcccagcagctg

SEQ ID NO: 3953393 - DNA, 22 bp, Homo sapiens
acaggtttggggagggggaaga

SEQ ID NO: 3953394 - DNA, 16 bp, Homo sapiens
acagtaaagtttaaaa

SEQ ID NO: 3953395 - DNA, 19 bp, Homo sapiens
acagtaaagtttaaaaaat

SEQ ID NO: 3953396 - DNA, 21 bp, Homo sapiens
acagtaaagtttaaaaaatac

SEQ ID NO: 3953397 - DNA, 14 bp, Homo sapiens
acagtaaataaatt

SEQ ID NO: 3953398 - DNA, 15 bp, Homo sapiens
acagtaaataaattg

SEQ ID NO: 3953399 - DNA, 23 bp, Homo sapiens
acagtaaataaattgtttgacca

SEQ ID NO: 3953400 - DNA, 14 bp, Homo sapiens
acagtaacacatct

SEQ ID NO: 3953401 - DNA, 17 bp, Homo sapiens
acagtagaggcatgaac

SEQ ID NO: 3953402 - DNA, 18 bp, Homo sapiens
acagtagcttaaataaat

SEQ ID NO: 3953403 - DNA, 14 bp, Homo sapiens
acagcctggcacag

SEQ ID NO: 3953404 - DNA, 20 bp, Homo sapiens
acagcctgggtgacggtcct

SEQ ID NO: 3953405 - DNA, 16 bp, Homo sapiens
acagcctggttttcac

SEQ ID NO: 3953406 - DNA, 22 bp, Homo sapiens
acagcctgtggcggtgcctggg

SEQ ID NO: 3953407 - DNA, 16 bp, Homo sapiens
acagcggcccctgcat

SEQ ID NO: 3953408 - DNA, 16 bp, Homo sapiens
acagcggggccccagg

SEQ ID NO: 3953409 - DNA, 21 bp, Homo sapiens
acagcgtccctagcagtgaac

SEQ ID NO: 3953410 - DNA, 23 bp, Homo sapiens
acagcgtccctagcagtgaacta

SEQ ID NO: 3953411 - DNA, 23 bp, Homo sapiens
acagctcaagtcttccctgatca

SEQ ID NO: 3953412 - DNA, 15 bp, Homo sapiens
acagctcacctctga

SEQ ID NO: 3953413 - DNA, 20 bp, Homo sapiens
acagctcacctctgaaggca

SEQ ID NO: 3953414 - DNA, 16 bp, Homo sapiens
acagctcccaccccac

SEQ ID NO: 3953415 - DNA, 18 bp, Homo sapiens
acagctcccaccccaccc

SEQ ID NO: 3953416 - DNA, 13 bp, Homo sapiens
acagctctagaca

SEQ ID NO: 3953417 - DNA, 14 bp, Homo sapiens
acagctgacagata

SEQ ID NO: 3953418 - DNA, 19 bp, Homo sapiens
acagctgagagacttttaa

SEQ ID NO: 3953419 - DNA, 14 bp, Homo sapiens
acagctgcagctgg

SEQ ID NO: 3953420 - DNA, 18 bp, Homo sapiens
acagctgcagctgggccc

SEQ ID NO: 3953421 - DNA, 16 bp, Homo sapiens
acagctgcctgcagta

SEQ ID NO: 3953422 - DNA, 15 bp, Homo sapiens
acagctgctgaagag

SEQ ID NO: 3953423 - DNA, 11 bp, Homo sapiens
acagctgcttg

SEQ ID NO: 3953424 - DNA, 18 bp, Homo sapiens
acagctgcttgtcctgct

SEQ ID NO: 3953425 - DNA, 15 bp, Homo sapiens
acagctgtccctgtc

SEQ ID NO: 3953426 - DNA, 16 bp, Homo sapiens
acagctgtccctgtca

SEQ ID NO: 3953427 - DNA, 13 bp, Homo sapiens
acagctgtgcctc

SEQ ID NO: 3953428 - DNA, 16 bp, Homo sapiens
acagctgtgcctcgct

SEQ ID NO: 3953429 - DNA, 15 bp, Homo sapiens
acagctgtttaagat

SEQ ID NO: 3953430 - DNA, 16 bp, Homo sapiens
acagcttgaccagacc

SEQ ID NO: 3953431 - DNA, 15 bp, Homo sapiens
acagctttacacaca

SEQ ID NO: 3953432 - DNA, 20 bp, Homo sapiens
acagctttcccctcattttt

SEQ ID NO: 3953433 - DNA, 14 bp, Homo sapiens
acaggaaaaaaaat

SEQ ID NO: 3953434 - DNA, 17 bp, Homo sapiens
acaggaaaatcctctgg

SEQ ID NO: 3953435 - DNA, 15 bp, Homo sapiens
acaggaaagccctcc

SEQ ID NO: 3953436 - DNA, 16 bp, Homo sapiens
acaggactaacactca

SEQ ID NO: 3953437 - DNA, 24 bp, Homo sapiens
acaggactaacactcagaagcctg

SEQ ID NO: 3953438 - DNA, 11 bp, Homo sapiens
acaggagaaat

SEQ ID NO: 3953439 - DNA, 19 bp, Homo sapiens
acaggagcagacagagaaa

SEQ ID NO: 3953440 - DNA, 22 bp, Homo sapiens
acaggagccccacccccatgca

SEQ ID NO: 3953441 - DNA, 14 bp, Homo sapiens
acaggagctacctg

SEQ ID NO: 3953442 - DNA, 18 bp, Homo sapiens
acaggagggcaagggcca

SEQ ID NO: 3953443 - DNA, 21 bp, Homo sapiens
acaggaggggcccacaatgga

SEQ ID NO: 3953444 - DNA, 20 bp, Homo sapiens
acaggagggggtcgtggaga

SEQ ID NO: 3953445 - DNA, 19 bp, Homo sapiens
acaggcaaaatccttgctt

SEQ ID NO: 3953446 - DNA, 14 bp, Homo sapiens
acaggcaaatgcat

SEQ ID NO: 3953447 - DNA, 13 bp, Homo sapiens
acaggcaattccg

SEQ ID NO: 3953448 - DNA, 19 bp, Homo sapiens
accttttgaagtagtttgt

SEQ ID NO: 3953449 - DNA, 17 bp, Homo sapiens
accttttgtatttaaaa

SEQ ID NO: 3953450 - DNA, 15 bp, Homo sapiens
acctttttttctctc

SEQ ID NO: 3953451 - DNA, 17 bp, Homo sapiens
acctttttttctctcct

SEQ ID NO: 3953452 - DNA, 20 bp, Homo sapiens
acgaacccactgtgcttaca

SEQ ID NO: 3953453 - DNA, 21 bp, Homo sapiens
acgaacccactgtgcttacag

SEQ ID NO: 3953454 - DNA, 23 bp, Homo sapiens
acgaaggggccccggggctggca

SEQ ID NO: 3953455 - DNA, 13 bp, Homo sapiens
acgactcttcctg

SEQ ID NO: 3953456 - DNA, 16 bp, Homo sapiens
acgactcttcctgcaa

SEQ ID NO: 3953457 - DNA, 19 bp, Homo sapiens
acgactgttgtacaagctc

SEQ ID NO: 3953458 - DNA, 16 bp, Homo sapiens
acgagcactggccaga

SEQ ID NO: 3953459 - DNA, 20 bp, Homo sapiens
acgagcaggctactgtcagc

SEQ ID NO: 3953460 - DNA, 18 bp, Homo sapiens
acgagtcacctgcaagcc

SEQ ID NO: 3953461 - DNA, 20 bp, Homo sapiens
acgagtcacctgcaagcccc

SEQ ID NO: 3953462 - DNA, 11 bp, Homo sapiens
acgatcttggc

SEQ ID NO: 3953463 - DNA, 14 bp, Homo sapiens
acgatgtggccctg

SEQ ID NO: 3953464 - DNA, 16 bp, Homo sapiens
acgatgtggccctggc

SEQ ID NO: 3953465 - DNA, 19 bp, Homo sapiens
acgatgtggccctggcctg

SEQ ID NO: 3953466 - DNA, 16 bp, Homo sapiens
accccagggcacagga

SEQ ID NO: 3953467 - DNA, 18 bp, Homo sapiens
accccagggcacaggagc

SEQ ID NO: 3953468 - DNA, 19 bp, Homo sapiens
accccagggcacaggagct

SEQ ID NO: 3953469 - DNA, 20 bp, Homo sapiens
accccagttctgctcctctc

SEQ ID NO: 3953470 - DNA, 22 bp, Homo sapiens
accccagttctgctcctctcca

SEQ ID NO: 3953471 - DNA, 18 bp, Homo sapiens
accccatttgctttcttt

SEQ ID NO: 3953472 - DNA, 22 bp, Homo sapiens
acccccactctcattccccagg

SEQ ID NO: 3953473 - DNA, 15 bp, Homo sapiens
acccccagagacctt

SEQ ID NO: 3953474 - DNA, 14 bp, Homo sapiens
acccccagctttgc

SEQ ID NO: 3953475 - DNA, 16 bp, Homo sapiens
acccccagctttgcta

SEQ ID NO: 3953476 - DNA, 17 bp, Homo sapiens
acccccagtgccacaga

SEQ ID NO: 3953477 - DNA, 18 bp, Homo sapiens
acccccagtgccacagag

SEQ ID NO: 3953478 - DNA, 14 bp, Homo sapiens
accccccaagctgt

SEQ ID NO: 3953479 - DNA, 15 bp, Homo sapiens
acccccgccacggcc

SEQ ID NO: 3953480 - DNA, 17 bp, Homo sapiens
acccccgctccagatct

SEQ ID NO: 3953481 - DNA, 17 bp, Homo sapiens
accccctcattcccctc

SEQ ID NO: 3953482 - DNA, 13 bp, Homo sapiens
accccctccagct

SEQ ID NO: 3953483 - DNA, 13 bp, Homo sapiens
accccctggccct

SEQ ID NO: 3953484 - DNA, 15 bp, Homo sapiens
accccctggccctgc

SEQ ID NO: 3953485 - DNA, 17 bp, Homo sapiens
accccctggccctgcct

SEQ ID NO: 3953486 - DNA, 18 bp, Homo sapiens
accccgaccacctgccca

SEQ ID NO: 3953487 - DNA, 18 bp, Homo sapiens
accccgcggtgctctggc

SEQ ID NO: 3953488 - DNA, 21 bp, Homo sapiens
accccgtgtccccggcctcag

SEQ ID NO: 3953489 - DNA, 11 bp, Homo sapiens
acccctaacct

SEQ ID NO: 3953490 - DNA, 16 bp, Homo sapiens
acccctaacctggctt

SEQ ID NO: 3953491 - DNA, 18 bp, Homo sapiens
acccctaacctggcttat

SEQ ID NO: 3953492 - DNA, 12 bp, Homo sapiens
acccctgcacca

SEQ ID NO: 3953493 - DNA, 12 bp, Homo sapiens
acccctgcactt

SEQ ID NO: 3953494 - DNA, 20 bp, Homo sapiens
acccctgcctgggttttcta

SEQ ID NO: 3953495 - DNA, 13 bp, Homo sapiens
acccctggccggc

SEQ ID NO: 3953496 - DNA, 18 bp, Homo sapiens
acccctgtacccagctcc

SEQ ID NO: 3953497 - DNA, 17 bp, Homo sapiens
acccctgtctctagcca

SEQ ID NO: 3953498 - DNA, 12 bp, Homo sapiens
accccttcctgt

SEQ ID NO: 3953499 - DNA, 15 bp, Homo sapiens
accccttcctttcct

SEQ ID NO: 3953500 - DNA, 22 bp, Homo sapiens
accccttcctttcctctgcagc

SEQ ID NO: 3953501 - DNA, 16 bp, Homo sapiens
accccttgaagccttt

SEQ ID NO: 3953502 - DNA, 14 bp, Homo sapiens
acccgagcccagct

SEQ ID NO: 3953503 - DNA, 18 bp, Homo sapiens
acccggaggggcctggca

SEQ ID NO: 3953504 - DNA, 16 bp, Homo sapiens
acccggcaccccctgc

SEQ ID NO: 3953505 - DNA, 19 bp, Homo sapiens
acccggcaccccctgcagc

SEQ ID NO: 3953506 - DNA, 14 bp, Homo sapiens
acccggcccagaga

SEQ ID NO: 3953507 - DNA, 15 bp, Homo sapiens
acccgtaggcagcct

SEQ ID NO: 3953508 - DNA, 19 bp, Homo sapiens
acccgtaggcagcctctct

SEQ ID NO: 3953509 - DNA, 21 bp, Homo sapiens
acccgtgccaagtccaggtcc

SEQ ID NO: 3953510 - DNA, 15 bp, Homo sapiens
accctaccccaccac

SEQ ID NO: 3953511 - DNA, 13 bp, Homo sapiens
accctacctgtgc

SEQ ID NO: 3953512 - DNA, 16 bp, Homo sapiens
accctacctgtgcctg

SEQ ID NO: 3953513 - DNA, 15 bp, Homo sapiens
accctcaaatgtcag

SEQ ID NO: 3953514 - DNA, 21 bp, Homo sapiens
accctcaaatgtcagagctat

SEQ ID NO: 3953515 - DNA, 23 bp, Homo sapiens
accctcccccaggaggtcgaccc

SEQ ID NO: 3953516 - DNA, 23 bp, Homo sapiens
accctccccgcaccccccaagct

SEQ ID NO: 3953517 - DNA, 23 bp, Homo sapiens
accctcccctgtcttctctcaaa

SEQ ID NO: 3953518 - DNA, 15 bp, Homo sapiens
accctccctacctga

SEQ ID NO: 3953519 - DNA, 15 bp, Homo sapiens
accctcgcagcaggt

SEQ ID NO: 3953520 - DNA, 23 bp, Homo sapiens
accctcgtggacacctgccctgc

SEQ ID NO: 3953521 - DNA, 14 bp, Homo sapiens
accctctcctgggg

SEQ ID NO: 3953522 - DNA, 15 bp, Homo sapiens
accctctcctggggg

SEQ ID NO: 3953523 - DNA, 20 bp, Homo sapiens
accctctcctgggggtggca

SEQ ID NO: 3953524 - DNA, 22 bp, Homo sapiens
accctctcctgggggtggcagg

SEQ ID NO: 3953525 - DNA, 23 bp, Homo sapiens
accctctcctgggggtggcaggc

SEQ ID NO: 3953526 - DNA, 13 bp, Homo sapiens
accctctcttccc

SEQ ID NO: 3953527 - DNA, 21 bp, Homo sapiens
accctctgaatggtccagggt

SEQ ID NO: 3953528 - DNA, 17 bp, Homo sapiens
accctgagactccagaa

SEQ ID NO: 3953529 - DNA, 14 bp, Homo sapiens
accctgcagagcta

SEQ ID NO: 3953530 - DNA, 21 bp, Homo sapiens
accctgcccacttcagcccag

SEQ ID NO: 3953531 - DNA, 20 bp, Homo sapiens
accctgcccatacccctgcc

SEQ ID NO: 3953532 - DNA, 21 bp, Homo sapiens
accctgcccttgtttggggca

SEQ ID NO: 3953533 - DNA, 23 bp, Homo sapiens
accctgctgggaccccagctagg

SEQ ID NO: 3953534 - DNA, 22 bp, Homo sapiens
accctggaattcagcaccctgg

SEQ ID NO: 3953535 - DNA, 15 bp, Homo sapiens
accctgttttccaca

SEQ ID NO: 3953536 - DNA, 19 bp, Homo sapiens
acccttagagattgcccca

SEQ ID NO: 3953537 - DNA, 13 bp, Homo sapiens
acccttccacctc

SEQ ID NO: 3953538 - DNA, 16 bp, Homo sapiens
acccttccagacatac

SEQ ID NO: 3953539 - DNA, 13 bp, Homo sapiens
acccttcccaatc

SEQ ID NO: 3953540 - DNA, 20 bp, Homo sapiens
acccttcccaatcagcactg

SEQ ID NO: 3953541 - DNA, 13 bp, Homo sapiens
acccttctgggca

SEQ ID NO: 3953542 - DNA, 17 bp, Homo sapiens
acccttctttaaatcaa

SEQ ID NO: 3953543 - DNA, 23 bp, Homo sapiens
acccttctttaaatcaaaagctg

SEQ ID NO: 3953544 - DNA, 14 bp, Homo sapiens
acccttctttcctc

SEQ ID NO: 3953545 - DNA, 18 bp, Homo sapiens
acccttctttcctcttcc

SEQ ID NO: 3953546 - DNA, 13 bp, Homo sapiens
acccttgctgctg

SEQ ID NO: 3953547 - DNA, 14 bp, Homo sapiens
acccttgctgctgc

SEQ ID NO: 3953548 - DNA, 15 bp, Homo sapiens
acccttggacttgag

SEQ ID NO: 3953549 - DNA, 17 bp, Homo sapiens
accctttccttccttcc

SEQ ID NO: 3953550 - DNA, 19 bp, Homo sapiens
accctttccttccttccct

SEQ ID NO: 3953551 - DNA, 23 bp, Homo sapiens
accctttccttccttccctggct

SEQ ID NO: 3953552 - DNA, 21 bp, Homo sapiens
actccctggatgtgtggggca

SEQ ID NO: 3953553 - DNA, 11 bp, Homo sapiens
actcccttcct

SEQ ID NO: 3953554 - DNA, 16 bp, Homo sapiens
actcccttcctggcct

SEQ ID NO: 3953555 - DNA, 20 bp, Homo sapiens
actcccttcctggcctcact

SEQ ID NO: 3953556 - DNA, 12 bp, Homo sapiens
actcctcccagg

SEQ ID NO: 3953557 - DNA, 18 bp, Homo sapiens
actcctcggtactcccat

SEQ ID NO: 3953558 - DNA, 21 bp, Homo sapiens
actcctctaagccactcttcc

SEQ ID NO: 3953559 - DNA, 13 bp, Homo sapiens
actcctctgtcca

SEQ ID NO: 3953560 - DNA, 16 bp, Homo sapiens
actcctcttatttgct

SEQ ID NO: 3953561 - DNA, 14 bp, Homo sapiens
actcctgccctgtt

SEQ ID NO: 3953562 - DNA, 12 bp, Homo sapiens
actcctgcctgt

SEQ ID NO: 3953563 - DNA, 15 bp, Homo sapiens
actcctgcctgtgtt

SEQ ID NO: 3953564 - DNA, 13 bp, Homo sapiens
actccttccagct

SEQ ID NO: 3953565 - DNA, 14 bp, Homo sapiens
actccttcctgccc

SEQ ID NO: 3953566 - DNA, 15 bp, Homo sapiens
actccttcctgcccc

SEQ ID NO: 3953567 - DNA, 15 bp, Homo sapiens
actcctttcctctga

SEQ ID NO: 3953568 - DNA, 20 bp, Homo sapiens
actcgagaccatcctggccc

SEQ ID NO: 3953569 - DNA, 13 bp, Homo sapiens
actcgcagtcgca

SEQ ID NO: 3953570 - DNA, 21 bp, Homo sapiens
actcgggaggctgaggcagga

SEQ ID NO: 3953571 - DNA, 13 bp, Homo sapiens
actcggtgtaaaa

SEQ ID NO: 3953572 - DNA, 18 bp, Homo sapiens
actcggtgtaaaaccatg

SEQ ID NO: 3953573 - DNA, 16 bp, Homo sapiens
actctaagctggagct

SEQ ID NO: 3953574 - DNA, 17 bp, Homo sapiens
actctacgccaaagtgc

SEQ ID NO: 3953575 - DNA, 22 bp, Homo sapiens
actctacgccaaagtgcagccc

SEQ ID NO: 3953576 - DNA, 21 bp, Homo sapiens
actctaggggtcaggctccat

SEQ ID NO: 3953577 - DNA, 22 bp, Homo sapiens
actctagtgacttcctggtgag

SEQ ID NO: 3953578 - DNA, 23 bp, Homo sapiens
actctagtgacttcctggtgagg

SEQ ID NO: 3953579 - DNA, 20 bp, Homo sapiens
actctatagttattgtttta

SEQ ID NO: 3953580 - DNA, 19 bp, Homo sapiens
actctatgccccaaatata

SEQ ID NO: 3953581 - DNA, 13 bp, Homo sapiens
actctcaggaggc

SEQ ID NO: 3953582 - DNA, 17 bp, Homo sapiens
actctcaggaggcgcag

SEQ ID NO: 3953583 - DNA, 22 bp, Homo sapiens
actctcaggaggcgcagcccga

SEQ ID NO: 3953584 - DNA, 24 bp, Homo sapiens
actctcaggaggcgcagcccgaag

SEQ ID NO: 3953585 - DNA, 18 bp, Homo sapiens
actctcaggatcaagaaa

SEQ ID NO: 3953586 - DNA, 14 bp, Homo sapiens
actctccaacctgg

SEQ ID NO: 3953587 - DNA, 14 bp, Homo sapiens
actctccccctttc

SEQ ID NO: 3953588 - DNA, 18 bp, Homo sapiens
actctccccctttcaagg

SEQ ID NO: 3953589 - DNA, 11 bp, Homo sapiens
actctcccctc

SEQ ID NO: 3953590 - DNA, 14 bp, Homo sapiens
actctcctctgcct

SEQ ID NO: 3953591 - DNA, 16 bp, Homo sapiens
actctcctctgcctca

SEQ ID NO: 3953592 - DNA, 19 bp, Homo sapiens
actctcggggcccttgggg

SEQ ID NO: 3953593 - DNA, 22 bp, Homo sapiens
actctcggggcccttggggcct

SEQ ID NO: 3953594 - DNA, 15 bp, Homo sapiens
actctctgctctagc

SEQ ID NO: 3953595 - DNA, 24 bp, Homo sapiens
actctctgctctagccaggagtct

SEQ ID NO: 3953596 - DNA, 15 bp, Homo sapiens
actctctgtacaaaa

SEQ ID NO: 3953597 - DNA, 16 bp, Homo sapiens
actctctgtacaaaaa

SEQ ID NO: 3953598 - DNA, 19 bp, Homo sapiens
actctgacaagggctgacc

SEQ ID NO: 3953599 - DNA, 20 bp, Homo sapiens
actctgacaagggctgacct

SEQ ID NO: 3953600 - DNA, 18 bp, Homo sapiens
actctgagcccaggccgt

SEQ ID NO: 3953601 - DNA, 19 bp, Homo sapiens
actctgcactccatggcca

SEQ ID NO: 3953602 - DNA, 22 bp, Homo sapiens
actctgcactccatggccaccc

SEQ ID NO: 3953603 - DNA, 13 bp, Homo sapiens
actctgctctgat

SEQ ID NO: 3953604 - DNA, 15 bp, Homo sapiens
actctgctctgatgc

SEQ ID NO: 3953605 - DNA, 16 bp, Homo sapiens
actctgctctgatgca

SEQ ID NO: 3953606 - DNA, 17 bp, Homo sapiens
actctggaagcccccca

SEQ ID NO: 3953607 - DNA, 18 bp, Homo sapiens
actctggaagccccccac

SEQ ID NO: 3953608 - DNA, 14 bp, Homo sapiens
actctggcagccac

SEQ ID NO: 3953609 - DNA, 11 bp, Homo sapiens
actctggcctc

SEQ ID NO: 3953610 - DNA, 15 bp, Homo sapiens
actctggcttccagg

SEQ ID NO: 3953611 - DNA, 19 bp, Homo sapiens
actctgggtccctcggagc

SEQ ID NO: 3953612 - DNA, 17 bp, Homo sapiens
actctggtggtgctttt

SEQ ID NO: 3953613 - DNA, 16 bp, Homo sapiens
actctgtcagatggga

SEQ ID NO: 3953614 - DNA, 16 bp, Homo sapiens
actctgtcagccagcc

SEQ ID NO: 3953615 - DNA, 13 bp, Homo sapiens
actctgtccaggc

SEQ ID NO: 3953616 - DNA, 14 bp, Homo sapiens
actctgtccaggcc

SEQ ID NO: 3953617 - DNA, 18 bp, Homo sapiens
actctgtccaggccactg

SEQ ID NO: 3953618 - DNA, 23 bp, Homo sapiens
actctgtccaggccactgtggcc

SEQ ID NO: 3953619 - DNA, 15 bp, Homo sapiens
actctgtgccagagc

SEQ ID NO: 3953620 - DNA, 15 bp, Homo sapiens
actcttatcattttt

SEQ ID NO: 3953621 - DNA, 16 bp, Homo sapiens
actcttatgaaatggg

SEQ ID NO: 3953622 - DNA, 20 bp, Homo sapiens
actcttcaaggtctgctttt

SEQ ID NO: 3953623 - DNA, 15 bp, Homo sapiens
actcttcctgcaagg

SEQ ID NO: 3953624 - DNA, 22 bp, Homo sapiens
actctttgacgggaggcctcag

SEQ ID NO: 3953625 - DNA, 18 bp, Homo sapiens
actctttgctacaataaa

SEQ ID NO: 3953626 - DNA, 19 bp, Homo sapiens
actctttgctacaataaat

SEQ ID NO: 3953627 - DNA, 15 bp, Homo sapiens
actgaaaactgtaaa

SEQ ID NO: 3953628 - DNA, 19 bp, Homo sapiens
actgaaaataccatcaggc

SEQ ID NO: 3953629 - DNA, 23 bp, Homo sapiens
actgaaaatctaatattaaaaat

SEQ ID NO: 3953630 - DNA, 13 bp, Homo sapiens
actgaaagtggtt

SEQ ID NO: 3953631 - DNA, 20 bp, Homo sapiens
actgaacatttgctttgttt

SEQ ID NO: 3953632 - DNA, 14 bp, Homo sapiens
actgaaggagaagg

SEQ ID NO: 3953633 - DNA, 13 bp, Homo sapiens
actgaaggggcac

SEQ ID NO: 3953634 - DNA, 15 bp, Homo sapiens
actgaatcatgttaa

SEQ ID NO: 3953635 - DNA, 23 bp, Homo sapiens
actgaatcatgttaatagacagt

SEQ ID NO: 3953636 - DNA, 16 bp, Homo sapiens
actgaatgctctgtgc

SEQ ID NO: 3953637 - DNA, 19 bp, Homo sapiens
actgaatgtttattccttg

SEQ ID NO: 3953638 - DNA, 21 bp, Homo sapiens
acgtaatgattatatgacaat

SEQ ID NO: 3953639 - DNA, 16 bp, Homo sapiens
acgtacaccatatgca

SEQ ID NO: 3953640 - DNA, 19 bp, Homo sapiens
acgtataaatatgaaatga

SEQ ID NO: 3953641 - DNA, 17 bp, Homo sapiens
acgtcaagtctccttcc

SEQ ID NO: 3953642 - DNA, 18 bp, Homo sapiens
acgtccagaatttttcat

SEQ ID NO: 3953643 - DNA, 13 bp, Homo sapiens
acgtccccctggg

SEQ ID NO: 3953644 - DNA, 19 bp, Homo sapiens
acgtcgtcttctgtatact

SEQ ID NO: 3953645 - DNA, 13 bp, Homo sapiens
acgtctgccaggc

SEQ ID NO: 3953646 - DNA, 16 bp, Homo sapiens
acgtctgccaggccca

SEQ ID NO: 3953647 - DNA, 17 bp, Homo sapiens
acgtctgccaggcccat

SEQ ID NO: 3953648 - DNA, 18 bp, Homo sapiens
acgtctgccaggcccatc

SEQ ID NO: 3953649 - DNA, 16 bp, Homo sapiens
acgtgaagccacagga

SEQ ID NO: 3953650 - DNA, 23 bp, Homo sapiens
acgtgagccaggtaatgagggac

SEQ ID NO: 3953651 - DNA, 13 bp, Homo sapiens
acgtgccaggccc

SEQ ID NO: 3953652 - DNA, 19 bp, Homo sapiens
acgtgccaggcccggggct

SEQ ID NO: 3953653 - DNA, 21 bp, Homo sapiens
acgtgccaggcccggggctgg

SEQ ID NO: 3953654 - DNA, 22 bp, Homo sapiens
acgtgctcttctgttctcaaat

SEQ ID NO: 3953655 - DNA, 16 bp, Homo sapiens
actattacttgaactt

SEQ ID NO: 3953656 - DNA, 21 bp, Homo sapiens
actattataatttaatgcatg

SEQ ID NO: 3953657 - DNA, 13 bp, Homo sapiens
actattcaagtat

SEQ ID NO: 3953658 - DNA, 16 bp, Homo sapiens
actattgtttaaaaac

SEQ ID NO: 3953659 - DNA, 20 bp, Homo sapiens
actattgtttaaaaacagga

SEQ ID NO: 3953660 - DNA, 22 bp, Homo sapiens
actatttctacacagtgggaac

SEQ ID NO: 3953661 - DNA, 15 bp, Homo sapiens
actcaaaaaggtgtg

SEQ ID NO: 3953662 - DNA, 17 bp, Homo sapiens
actcaaaatatttgtac

SEQ ID NO: 3953663 - DNA, 19 bp, Homo sapiens
actcaaaatatttgtacat

SEQ ID NO: 3953664 - DNA, 19 bp, Homo sapiens
actcaacaataaagactga

SEQ ID NO: 3953665 - DNA, 14 bp, Homo sapiens
actcacaagaagac

SEQ ID NO: 3953666 - DNA, 12 bp, Homo sapiens
actcacacaggc

SEQ ID NO: 3953667 - DNA, 20 bp, Homo sapiens
actcacacaggcatttcctg

SEQ ID NO: 3953668 - DNA, 23 bp, Homo sapiens
actcacacaggcatttcctgggt

SEQ ID NO: 3953669 - DNA, 21 bp, Homo sapiens
actcaccagggtccgcaccag

SEQ ID NO: 3953670 - DNA, 23 bp, Homo sapiens
actcaccagggtccgcaccagct

SEQ ID NO: 3953671 - DNA, 17 bp, Homo sapiens
actcaccagtgtcccct

SEQ ID NO: 3953672 - DNA, 19 bp, Homo sapiens
actcaccagtgtcccctcc

SEQ ID NO: 3953673 - DNA, 15 bp, Homo sapiens
actcaccatgtaaaa

SEQ ID NO: 3953674 - DNA, 17 bp, Homo sapiens
actcacccatgtgccaa

SEQ ID NO: 3953675 - DNA, 12 bp, Homo sapiens
actcacctcctc

SEQ ID NO: 3953676 - DNA, 13 bp, Homo sapiens
actcacctcctcc

SEQ ID NO: 3953677 - DNA, 12 bp, Homo sapiens
actcacctctct

SEQ ID NO: 3953678 - DNA, 17 bp, Homo sapiens
actcacctctctctaag

SEQ ID NO: 3953679 - DNA, 13 bp, Homo sapiens
actcacctctgcc

SEQ ID NO: 3953680 - DNA, 14 bp, Homo sapiens
actcacctctgcct

SEQ ID NO: 3953681 - DNA, 15 bp, Homo sapiens
actcacctctgcctc

SEQ ID NO: 3953682 - DNA, 16 bp, Homo sapiens
actcacctctgcctca

SEQ ID NO: 3953683 - DNA, 13 bp, Homo sapiens
actcactcattcc

SEQ ID NO: 3953684 - DNA, 16 bp, Homo sapiens
actcactccagcccaa

SEQ ID NO: 3953685 - DNA, 15 bp, Homo sapiens
actcactgctcaaga

SEQ ID NO: 3953686 - DNA, 14 bp, Homo sapiens
actcagaaattttt

SEQ ID NO: 3953687 - DNA, 17 bp, Homo sapiens
actcagaagcctggggg

SEQ ID NO: 3953688 - DNA, 11 bp, Homo sapiens
actcagagcag

SEQ ID NO: 3953689 - DNA, 14 bp, Homo sapiens
actcagcagccctc

SEQ ID NO: 3953690 - DNA, 19 bp, Homo sapiens
actcagcagccctcctcac

SEQ ID NO: 3953691 - DNA, 14 bp, Homo sapiens
actcagccacaccc

SEQ ID NO: 3953692 - DNA, 11 bp, Homo sapiens
actcagccctg

SEQ ID NO: 3953693 - DNA, 12 bp, Homo sapiens
actcagccctgg

SEQ ID NO: 3953694 - DNA, 13 bp, Homo sapiens
actcagccctggg

SEQ ID NO: 3953695 - DNA, 16 bp, Homo sapiens
actcagccctgggccc

SEQ ID NO: 3953696 - DNA, 21 bp, Homo sapiens
actcagccctgggccccacca

SEQ ID NO: 3953697 - DNA, 17 bp, Homo sapiens
actcagctctcctgctg

SEQ ID NO: 3953698 - DNA, 20 bp, Homo sapiens
actcagctctcctgctgcag

SEQ ID NO: 3953699 - DNA, 14 bp, Homo sapiens
actcaggaggctga

SEQ ID NO: 3953700 - DNA, 18 bp, Homo sapiens
actcaggatccagtccct

SEQ ID NO: 3953701 - DNA, 20 bp, Homo sapiens
actcagtctagtgaagatgt

SEQ ID NO: 3953702 - DNA, 22 bp, Homo sapiens
actcagttaaaatgtctgtttc

SEQ ID NO: 3953703 - DNA, 13 bp, Homo sapiens
actcagttttctt

SEQ ID NO: 3953704 - DNA, 20 bp, Homo sapiens
actcatattctgggctcctg

SEQ ID NO: 3953705 - DNA, 20 bp, Homo sapiens
actcatcctgtgtggggagg

SEQ ID NO: 3953706 - DNA, 23 bp, Homo sapiens
actcatcctgtgtggggaggcag

SEQ ID NO: 3953707 - DNA, 18 bp, Homo sapiens
actcatttctaaaagaat

SEQ ID NO: 3953708 - DNA, 13 bp, Homo sapiens
actccaagcttca

SEQ ID NO: 3953709 - DNA, 20 bp, Homo sapiens
actccaccaacccatcagaa

SEQ ID NO: 3953710 - DNA, 13 bp, Homo sapiens
actccaccaccca

SEQ ID NO: 3953711 - DNA, 22 bp, Homo sapiens
actccactctccttcgtgtctc

SEQ ID NO: 3953712 - DNA, 14 bp, Homo sapiens
actccagccctgtc

SEQ ID NO: 3953713 - DNA, 18 bp, Homo sapiens
actccagtgagctggaat

SEQ ID NO: 3953714 - DNA, 20 bp, Homo sapiens
actccagtgatgttcttcaa

SEQ ID NO: 3953715 - DNA, 21 bp, Homo sapiens
actccatacataacttgatat

SEQ ID NO: 3953716 - DNA, 13 bp, Homo sapiens
actccatggccac

SEQ ID NO: 3953717 - DNA, 22 bp, Homo sapiens
actccatggccaccccgtgcca

SEQ ID NO: 3953718 - DNA, 23 bp, Homo sapiens
actccatggccaccccgtgccac

SEQ ID NO: 3953719 - DNA, 12 bp, Homo sapiens
actccattccca

SEQ ID NO: 3953720 - DNA, 15 bp, Homo sapiens
actccccaggccagg

SEQ ID NO: 3953721 - DNA, 14 bp, Homo sapiens
actccccgcctgtc

SEQ ID NO: 3953722 - DNA, 16 bp, Homo sapiens
actccccgcctgtcct

SEQ ID NO: 3953723 - DNA, 14 bp, Homo sapiens
actcccctgatccc

SEQ ID NO: 3953724 - DNA, 14 bp, Homo sapiens
actccctccatgtg

SEQ ID NO: 3953725 - DNA, 14 bp, Homo sapiens
actccctcccctgc

SEQ ID NO: 3953726 - DNA, 20 bp, Homo sapiens
actccctgaacctcagtttc

SEQ ID NO: 3953727 - DNA, 23 bp, Homo sapiens
agaggaagatgaagagaagctga

SEQ ID NO: 3953728 - DNA, 14 bp, Homo sapiens
agaggaataagaat

SEQ ID NO: 3953729 - DNA, 23 bp, Homo sapiens
agaggaatcagacttcacactgc

SEQ ID NO: 3953730 - DNA, 20 bp, Homo sapiens
agaggaatctacctgtggtg

SEQ ID NO: 3953731 - DNA, 22 bp, Homo sapiens
agaggaatctacctgtggtgac

SEQ ID NO: 3953732 - DNA, 20 bp, Homo sapiens
agaggactgagactggcact

SEQ ID NO: 3953733 - DNA, 11 bp, Homo sapiens
agaggagaaga

SEQ ID NO: 3953734 - DNA, 15 bp, Homo sapiens
agaggagaccctgga

SEQ ID NO: 3953735 - DNA, 16 bp, Homo sapiens
agaggagaccctggaa

SEQ ID NO: 3953736 - DNA, 14 bp, Homo sapiens
agaggagggcatgg

SEQ ID NO: 3953737 - DNA, 19 bp, Homo sapiens
agaggagggcgtgactcac

SEQ ID NO: 3953738 - DNA, 16 bp, Homo sapiens
agaggcacctgctgga

SEQ ID NO: 3953739 - DNA, 13 bp, Homo sapiens
agaggcagaagaa

SEQ ID NO: 3953740 - DNA, 18 bp, Homo sapiens
agaggcagagaaagaaga

SEQ ID NO: 3953741 - DNA, 20 bp, Homo sapiens
agaggcagagaaagaagaga

SEQ ID NO: 3953742 - DNA, 21 bp, Homo sapiens
agaggcagagaaagaagagac

SEQ ID NO: 3953743 - DNA, 22 bp, Homo sapiens
agaggcagagaaagaagagaca

SEQ ID NO: 3953744 - DNA, 13 bp, Homo sapiens
agaggcagggagg

SEQ ID NO: 3953745 - DNA, 18 bp, Homo sapiens
agaggccaggaatctgcc

SEQ ID NO: 3953746 - DNA, 19 bp, Homo sapiens
agaggccaggaatctgcca

SEQ ID NO: 3953747 - DNA, 12 bp, Homo sapiens
agaggcccaggg

SEQ ID NO: 3953748 - DNA, 14 bp, Homo sapiens
agaggcccagggag

SEQ ID NO: 3953749 - DNA, 15 bp, Homo sapiens
agaggccctggatca

SEQ ID NO: 3953750 - DNA, 17 bp, Homo sapiens
agaggccctggatcagc

SEQ ID NO: 3953751 - DNA, 20 bp, Homo sapiens
agaggccctggatcagcgtg

SEQ ID NO: 3953752 - DNA, 21 bp, Homo sapiens
agaggccctggatcagcgtgg

SEQ ID NO: 3953753 - DNA, 14 bp, Homo sapiens
agaggccttttgtt

SEQ ID NO: 3953754 - DNA, 17 bp, Homo sapiens
agaggcgcgtctgcccc

SEQ ID NO: 3953755 - DNA, 18 bp, Homo sapiens
agaggcggaaaccttgca

SEQ ID NO: 3953756 - DNA, 21 bp, Homo sapiens
agaggcggaaaccttgcagca

SEQ ID NO: 3953757 - DNA, 23 bp, Homo sapiens
agaggcggaaaccttgcagcatt

SEQ ID NO: 3953758 - DNA, 19 bp, Homo sapiens
agaggctattattttcact

SEQ ID NO: 3953759 - DNA, 13 bp, Homo sapiens
agaggctgaggac

SEQ ID NO: 3953760 - DNA, 22 bp, Homo sapiens
agaggctgcagaaggccaagaa

SEQ ID NO: 3953761 - DNA, 17 bp, Homo sapiens
agagggaagagtgcatt

SEQ ID NO: 3953762 - DNA, 24 bp, Homo sapiens
agagggaggagaatgagcctcggc

SEQ ID NO: 3953763 - DNA, 18 bp, Homo sapiens
agagggcagtacctggga

SEQ ID NO: 3953764 - DNA, 18 bp, Homo sapiens
agagggccaagacttggc

SEQ ID NO: 3953765 - DNA, 14 bp, Homo sapiens
agagggccaagaga

SEQ ID NO: 3953766 - DNA, 18 bp, Homo sapiens
agagggccaagagagaca

SEQ ID NO: 3953767 - DNA, 14 bp, Homo sapiens
agagggcccagctg

SEQ ID NO: 3953768 - DNA, 15 bp, Homo sapiens
agagggcccagctgt

SEQ ID NO: 3953769 - DNA, 19 bp, Homo sapiens
agagggcctgtgggagcct

SEQ ID NO: 3953770 - DNA, 23 bp, Homo sapiens
agagggctgttggacagctgctt

SEQ ID NO: 3953771 - DNA, 16 bp, Homo sapiens
agaggggaagggccag

SEQ ID NO: 3953772 - DNA, 13 bp, Homo sapiens
agaggggcagccg

SEQ ID NO: 3953773 - DNA, 23 bp, Homo sapiens
agaggggcagccgctaggagaga

SEQ ID NO: 3953774 - DNA, 16 bp, Homo sapiens
agaggggcaggggagt

SEQ ID NO: 3953775 - DNA, 15 bp, Homo sapiens
agaggggtgcaccca

SEQ ID NO: 3953776 - DNA, 22 bp, Homo sapiens
agaggggtgctgctcctaaacc

SEQ ID NO: 3953777 - DNA, 18 bp, Homo sapiens
agagggtctggagaagca

SEQ ID NO: 3953778 - DNA, 18 bp, Homo sapiens
agaggtaaaagtgtgagc

SEQ ID NO: 3953779 - DNA, 22 bp, Homo sapiens
agaggtaaaagtgtgagcagtg

SEQ ID NO: 3953780 - DNA, 19 bp, Homo sapiens
agaggtagcgagctgctct

SEQ ID NO: 3953781 - DNA, 16 bp, Homo sapiens
agaggtccctgcttac

SEQ ID NO: 3953782 - DNA, 18 bp, Homo sapiens
agaggtccctgcttacct

SEQ ID NO: 3953783 - DNA, 21 bp, Homo sapiens
agaggtctgagccctggtgtg

SEQ ID NO: 3953784 - DNA, 22 bp, Homo sapiens
agaggtgacccaatgctcctgg

SEQ ID NO: 3953785 - DNA, 22 bp, Homo sapiens
agaggtgagaccaaaggatcca

SEQ ID NO: 3953786 - DNA, 13 bp, Homo sapiens
agaggtgagcaga

SEQ ID NO: 3953787 - DNA, 17 bp, Homo sapiens
agaggtggattcctggg

SEQ ID NO: 3953788 - DNA, 19 bp, Homo sapiens
agaggtggattcctgggca

SEQ ID NO: 3953789 - DNA, 22 bp, Homo sapiens
agaggtggattcctgggcaaga

SEQ ID NO: 3953790 - DNA, 18 bp, Homo sapiens
agaggtggccagagctgg

SEQ ID NO: 3953791 - DNA, 17 bp, Homo sapiens
agaggtgggcagctggg

SEQ ID NO: 3953792 - DNA, 20 bp, Homo sapiens
agaggtgggcagctgggccc

SEQ ID NO: 3953793 - DNA, 23 bp, Homo sapiens
agaggtggggagggagacagaga

SEQ ID NO: 3953794 - DNA, 16 bp, Homo sapiens
agaggttatctgcctg

SEQ ID NO: 3953795 - DNA, 20 bp, Homo sapiens
agaggttatctgcctggcct

SEQ ID NO: 3953796 - DNA, 21 bp, Homo sapiens
agaggttatctgcctggcctg

SEQ ID NO: 3953797 - DNA, 17 bp, Homo sapiens
agaggttctggggagga

SEQ ID NO: 3953798 - DNA, 19 bp, Homo sapiens
agaggttctggggaggaag

SEQ ID NO: 3953799 - DNA, 16 bp, Homo sapiens
agaggttttgttgttt

SEQ ID NO: 3953800 - DNA, 12 bp, Homo sapiens
agagtagcaagt

SEQ ID NO: 3953801 - DNA, 13 bp, Homo sapiens
agagtagccgaga

SEQ ID NO: 3953802 - DNA, 14 bp, Homo sapiens
agagtagtttttca

SEQ ID NO: 3953803 - DNA, 12 bp, Homo sapiens
agagtcctattt

SEQ ID NO: 3953804 - DNA, 13 bp, Homo sapiens
agagtctgagccc

SEQ ID NO: 3953805 - DNA, 19 bp, Homo sapiens
agagtctgagcccccggct

SEQ ID NO: 3953806 - DNA, 16 bp, Homo sapiens
agagtgactccaagaa

SEQ ID NO: 3953807 - DNA, 22 bp, Homo sapiens
agagtgagaatctggctcctgt

SEQ ID NO: 3953808 - DNA, 20 bp, Homo sapiens
agagtggactgaatgtgcct

SEQ ID NO: 3953809 - DNA, 13 bp, Homo sapiens
agagtggcccctc

SEQ ID NO: 3953810 - DNA, 19 bp, Homo sapiens
agagtggctcctcccggtg

SEQ ID NO: 3953811 - DNA, 18 bp, Homo sapiens
agagtgggctgcatctgg

SEQ ID NO: 3953812 - DNA, 17 bp, Homo sapiens
agagagtggctcctccc

SEQ ID NO: 3953813 - DNA, 14 bp, Homo sapiens
agagatatgcacac

SEQ ID NO: 3953814 - DNA, 20 bp, Homo sapiens
agagatatgcagaaggaagg

SEQ ID NO: 3953815 - DNA, 17 bp, Homo sapiens
agagatatggcagcgaa

SEQ ID NO: 3953816 - DNA, 14 bp, Homo sapiens
agagatcaggaaga

SEQ ID NO: 3953817 - DNA, 21 bp, Homo sapiens
agagatgcctccaccgctgcc

SEQ ID NO: 3953818 - DNA, 23 bp, Homo sapiens
agagatgcctccaccgctgccta

SEQ ID NO: 3953819 - DNA, 18 bp, Homo sapiens
agagattgccccagagcc

SEQ ID NO: 3953820 - DNA, 21 bp, Homo sapiens
agagatttcaacatatcattt

SEQ ID NO: 3953821 - DNA, 22 bp, Homo sapiens
agagattttgtcgggacagaga

SEQ ID NO: 3953822 - DNA, 18 bp, Homo sapiens
agagcaaaataattttaa

SEQ ID NO: 3953823 - DNA, 15 bp, Homo sapiens
agagcaacccctgta

SEQ ID NO: 3953824 - DNA, 21 bp, Homo sapiens
agagcaatgcccgtaatgctt

SEQ ID NO: 3953825 - DNA, 18 bp, Homo sapiens
agagcacctagtccagtg

SEQ ID NO: 3953826 - DNA, 19 bp, Homo sapiens
agagcacctagtccagtga

SEQ ID NO: 3953827 - DNA, 15 bp, Homo sapiens
agagcagaaataaaa

SEQ ID NO: 3953828 - DNA, 23 bp, Homo sapiens
agagcagaacggagccccaggcc

SEQ ID NO: 3953829 - DNA, 12 bp, Homo sapiens
agagcagcctga

SEQ ID NO: 3953830 - DNA, 16 bp, Homo sapiens
agagcagcctgatggc

SEQ ID NO: 3953831 - DNA, 16 bp, Homo sapiens
agagcagctggctctc

SEQ ID NO: 3953832 - DNA, 20 bp, Homo sapiens
agagcaggctcagactctgg

SEQ ID NO: 3953833 - DNA, 17 bp, Homo sapiens
agagcaggtgagatggg

SEQ ID NO: 3953834 - DNA, 13 bp, Homo sapiens
agagcatagggtc

SEQ ID NO: 3953835 - DNA, 18 bp, Homo sapiens
agagcatcatgcctctga

SEQ ID NO: 3953836 - DNA, 20 bp, Homo sapiens
agagcatcgtgacccttcag

SEQ ID NO: 3953837 - DNA, 19 bp, Homo sapiens
agagcattacgtgagccag

SEQ ID NO: 3953838 - DNA, 21 bp, Homo sapiens
agagcattacgtgagccaggt

SEQ ID NO: 3953839 - DNA, 17 bp, Homo sapiens
agagcattgcatggaca

SEQ ID NO: 3953840 - DNA, 16 bp, Homo sapiens
agagccactacctttg

SEQ ID NO: 3953841 - DNA, 14 bp, Homo sapiens
agagccagccctcc

SEQ ID NO: 3953842 - DNA, 16 bp, Homo sapiens
agagccagccctccct

SEQ ID NO: 3953843 - DNA, 12 bp, Homo sapiens
agagccagcctg

SEQ ID NO: 3953844 - DNA, 14 bp, Homo sapiens
agagccagcctggg

SEQ ID NO: 3953845 - DNA, 15 bp, Homo sapiens
agagccagcctggga

SEQ ID NO: 3953846 - DNA, 16 bp, Homo sapiens
agagccaggctctgcc

SEQ ID NO: 3953847 - DNA, 20 bp, Homo sapiens
agagccaggctctgcctgga

SEQ ID NO: 3953848 - DNA, 14 bp, Homo sapiens
agagccatgggcct

SEQ ID NO: 3953849 - DNA, 16 bp, Homo sapiens
agagccatgggcctgg

SEQ ID NO: 3953850 - DNA, 17 bp, Homo sapiens
agagccatgggcctggg

SEQ ID NO: 3953851 - DNA, 20 bp, Homo sapiens
agagccatgggcctgggcct

SEQ ID NO: 3953852 - DNA, 23 bp, Homo sapiens
agagccatgggcctgggcctgct

SEQ ID NO: 3953853 - DNA, 18 bp, Homo sapiens
agagcccaagtgccatcc

SEQ ID NO: 3953854 - DNA, 21 bp, Homo sapiens
agagcccagcagggcctcaaa

SEQ ID NO: 3953855 - DNA, 17 bp, Homo sapiens
agagccccacacggagg

SEQ ID NO: 3953856 - DNA, 13 bp, Homo sapiens
agagccccactcc

SEQ ID NO: 3953857 - DNA, 16 bp, Homo sapiens
agagcccccaagcctc

SEQ ID NO: 3953858 - DNA, 16 bp, Homo sapiens
agagccccccacaatg

SEQ ID NO: 3953859 - DNA, 14 bp, Homo sapiens
agagccctgctgtg

SEQ ID NO: 3953860 - DNA, 13 bp, Homo sapiens
agagccctgggac

SEQ ID NO: 3953861 - DNA, 23 bp, Homo sapiens
agagccgcaaatcaaccccagac

SEQ ID NO: 3953862 - DNA, 20 bp, Homo sapiens
agagccggggcactttcaga

SEQ ID NO: 3953863 - DNA, 16 bp, Homo sapiens
agagcctagccacctc

SEQ ID NO: 3953864 - DNA, 22 bp, Homo sapiens
agagcctagccacctcccaccc

SEQ ID NO: 3953865 - DNA, 13 bp, Homo sapiens
agagcctgctccc

SEQ ID NO: 3953866 - DNA, 14 bp, Homo sapiens
agagcctggagaag

SEQ ID NO: 3953867 - DNA, 10 bp, Homo sapiens
agagcctggg

SEQ ID NO: 3953868 - DNA, 16 bp, Homo sapiens
agagcctggggctcta

SEQ ID NO: 3953869 - DNA, 20 bp, Homo sapiens
agagccttggtgtccacctg

SEQ ID NO: 3953870 - DNA, 23 bp, Homo sapiens
agagccttggtgtccacctggcc

SEQ ID NO: 3953871 - DNA, 17 bp, Homo sapiens
agagctagaacatggag

SEQ ID NO: 3953872 - DNA, 18 bp, Homo sapiens
agagctagaacctggagg

SEQ ID NO: 3953873 - DNA, 15 bp, Homo sapiens
agagctatgttccct

SEQ ID NO: 3953874 - DNA, 19 bp, Homo sapiens
agagctcttcaagctgtcc

SEQ ID NO: 3953875 - DNA, 20 bp, Homo sapiens
agagctcttcggtttctgag

SEQ ID NO: 3953876 - DNA, 22 bp, Homo sapiens
agagctcttcggtttctgagca

SEQ ID NO: 3953877 - DNA, 23 bp, Homo sapiens
agagctgacccagagtggagtct

SEQ ID NO: 3953878 - DNA, 20 bp, Homo sapiens
agagctgatggagaaggaag

SEQ ID NO: 3953879 - DNA, 13 bp, Homo sapiens
agagctgctgtcc

SEQ ID NO: 3953880 - DNA, 15 bp, Homo sapiens
agagctgctgtcctt

SEQ ID NO: 3953881 - DNA, 19 bp, Homo sapiens
agagctgctgtccttttag

SEQ ID NO: 3953882 - DNA, 21 bp, Homo sapiens
agagctggaaggcagggcaga

SEQ ID NO: 3953883 - DNA, 16 bp, Homo sapiens
agagctgggaaacagg

SEQ ID NO: 3953884 - DNA, 18 bp, Homo sapiens
agagctgggaaacaggga

SEQ ID NO: 3953885 - DNA, 19 bp, Homo sapiens
agagctgggaaacagggag

SEQ ID NO: 3953886 - DNA, 22 bp, Homo sapiens
agagctgggaggcatggccctg

SEQ ID NO: 3953887 - DNA, 18 bp, Homo sapiens
agagctgttggcctcgcc

SEQ ID NO: 3953888 - DNA, 18 bp, Homo sapiens
agagcttagcctggagca

SEQ ID NO: 3953889 - DNA, 16 bp, Homo sapiens
agagcttattggccac

SEQ ID NO: 3953890 - DNA, 14 bp, Homo sapiens
agagcttcccagga

SEQ ID NO: 3953891 - DNA, 15 bp, Homo sapiens
agagcttcccaggat

SEQ ID NO: 3953892 - DNA, 15 bp, Homo sapiens
agagcttctggcact

SEQ ID NO: 3953893 - DNA, 17 bp, Homo sapiens
actgaattaagttattg

SEQ ID NO: 3953894 - DNA, 19 bp, Homo sapiens
actgaattttaaatgttca

SEQ ID NO: 3953895 - DNA, 12 bp, Homo sapiens
actgacaagatg

SEQ ID NO: 3953896 - DNA, 21 bp, Homo sapiens
actgacacaggaaaccaacac

SEQ ID NO: 3953897 - DNA, 13 bp, Homo sapiens
actgaccagcctc

SEQ ID NO: 3953898 - DNA, 23 bp, Homo sapiens
actgaccagcctccatgctgcct

SEQ ID NO: 3953899 - DNA, 15 bp, Homo sapiens
actgacccacagcct

SEQ ID NO: 3953900 - DNA, 15 bp, Homo sapiens
actgacccttccaga

SEQ ID NO: 3953901 - DNA, 13 bp, Homo sapiens
actgacttctaag

SEQ ID NO: 3953902 - DNA, 22 bp, Homo sapiens
agatgcgagcgctatcttcaca

SEQ ID NO: 3953903 - DNA, 15 bp, Homo sapiens
agatggaggccgagc

SEQ ID NO: 3953904 - DNA, 17 bp, Homo sapiens
agatggctgtgcctctg

SEQ ID NO: 3953905 - DNA, 18 bp, Homo sapiens
agatggctgtgcctctgc

SEQ ID NO: 3953906 - DNA, 21 bp, Homo sapiens
agatggctgtgcctctgcctg

SEQ ID NO: 3953907 - DNA, 23 bp, Homo sapiens
agatggctgtgcctctgcctgtc

SEQ ID NO: 3953908 - DNA, 15 bp, Homo sapiens
agatgggcacatgag

SEQ ID NO: 3953909 - DNA, 14 bp, Homo sapiens
agatggggtcttgc

SEQ ID NO: 3953910 - DNA, 17 bp, Homo sapiens
agatgggtattaaactt

SEQ ID NO: 3953911 - DNA, 19 bp, Homo sapiens
agatgggtctggctgagct

SEQ ID NO: 3953912 - DNA, 20 bp, Homo sapiens
agatggtaatctacagctca

SEQ ID NO: 3953913 - DNA, 23 bp, Homo sapiens
agatggtcacacagagatacgca

SEQ ID NO: 3953914 - DNA, 14 bp, Homo sapiens
agcaccctgggtgc

SEQ ID NO: 3953915 - DNA, 21 bp, Homo sapiens
agcacctgaaccccatgggct

SEQ ID NO: 3953916 - DNA, 20 bp, Homo sapiens
agcacctgcttcatgctcag

SEQ ID NO: 3953917 - DNA, 18 bp, Homo sapiens
agcacgattttgcacaaa

SEQ ID NO: 3953918 - DNA, 15 bp, Homo sapiens
agcacgggacaggag

SEQ ID NO: 3953919 - DNA, 16 bp, Homo sapiens
agcactcgagaccatc

SEQ ID NO: 3953920 - DNA, 20 bp, Homo sapiens
agcactcgagaccatcctgg

SEQ ID NO: 3953921 - DNA, 22 bp, Homo sapiens
agcactcgagaccatcctggcc

SEQ ID NO: 3953922 - DNA, 10 bp, Homo sapiens
agcactgaaa

SEQ ID NO: 3953923 - DNA, 22 bp, Homo sapiens
agcactgaaaataccatcaggc

SEQ ID NO: 3953924 - DNA, 16 bp, Homo sapiens
agcactgacttctaag

SEQ ID NO: 3953925 - DNA, 19 bp, Homo sapiens
agcactgacttctaagtaa

SEQ ID NO: 3953926 - DNA, 12 bp, Homo sapiens
agcactgccagg

SEQ ID NO: 3953927 - DNA, 17 bp, Homo sapiens
agcactgccaggaggga

SEQ ID NO: 3953928 - DNA, 22 bp, Homo sapiens
agcactgctaggcgagtgccag

SEQ ID NO: 3953929 - DNA, 22 bp, Homo sapiens
agcactggagtgcagggaggag

SEQ ID NO: 3953930 - DNA, 13 bp, Homo sapiens
agcactggccaga

SEQ ID NO: 3953931 - DNA, 19 bp, Homo sapiens
agcactggccagagagggc

SEQ ID NO: 3953932 - DNA, 20 bp, Homo sapiens
agcactggccagagagggcc

SEQ ID NO: 3953933 - DNA, 15 bp, Homo sapiens
agcacttgcgtcctg

SEQ ID NO: 3953934 - DNA, 17 bp, Homo sapiens
agcacttgcgtcctgca

SEQ ID NO: 3953935 - DNA, 20 bp, Homo sapiens
agcacttgttccttctgctt

SEQ ID NO: 3953936 - DNA, 22 bp, Homo sapiens
agcactttaaccctctcttccc

SEQ ID NO: 3953937 - DNA, 19 bp, Homo sapiens
agcactttgggaggccaag

SEQ ID NO: 3953938 - DNA, 21 bp, Homo sapiens
agcactttgggaggccgaggc

SEQ ID NO: 3953939 - DNA, 12 bp, Homo sapiens
agcagaaaagtg

SEQ ID NO: 3953940 - DNA, 15 bp, Homo sapiens
agcagaaaagtgctt

SEQ ID NO: 3953941 - DNA, 21 bp, Homo sapiens
agcagaagaaaaagttgcagt

SEQ ID NO: 3953942 - DNA, 14 bp, Homo sapiens
agcagacagagaaa

SEQ ID NO: 3953943 - DNA, 20 bp, Homo sapiens
agcagacgcagcagctggga

SEQ ID NO: 3953944 - DNA, 23 bp, Homo sapiens
agcagacgcagcagctgggaccc

SEQ ID NO: 3953945 - DNA, 15 bp, Homo sapiens
agcagagctctgccg

SEQ ID NO: 3953946 - DNA, 16 bp, Homo sapiens
agcagagcttcctcag

SEQ ID NO: 3953947 - DNA, 17 bp, Homo sapiens
agcagaggagtccaggg

SEQ ID NO: 3953948 - DNA, 17 bp, Homo sapiens
agcagagtataggatgg

SEQ ID NO: 3953949 - DNA, 19 bp, Homo sapiens
agcagagtataggatggat

SEQ ID NO: 3953950 - DNA, 14 bp, Homo sapiens
agcagagtgaggat

SEQ ID NO: 3953951 - DNA, 17 bp, Homo sapiens
agcagagtgaggatgtg

SEQ ID NO: 3953952 - DNA, 18 bp, Homo sapiens
agcagagtgaggatgtgt

SEQ ID NO: 3953953 - DNA, 20 bp, Homo sapiens
agcagagtgaggatgtgttt

SEQ ID NO: 3953954 - DNA, 18 bp, Homo sapiens
agcagataaagacagctg

SEQ ID NO: 3953955 - DNA, 19 bp, Homo sapiens
agcagatctgaaaggcaca

SEQ ID NO: 3953956 - DNA, 18 bp, Homo sapiens
agcagatggtcctccatt

SEQ ID NO: 3953957 - DNA, 15 bp, Homo sapiens
agcagcaaaaatata

SEQ ID NO: 3953958 - DNA, 20 bp, Homo sapiens
agcagcaaaaatataaaata

SEQ ID NO: 3953959 - DNA, 21 bp, Homo sapiens
agcagcattcagcacacccca

SEQ ID NO: 3953960 - DNA, 12 bp, Homo sapiens
agcagccagcca

SEQ ID NO: 3953961 - DNA, 15 bp, Homo sapiens
agcagccagccagtc

SEQ ID NO: 3953962 - DNA, 13 bp, Homo sapiens
agcagccagccct

SEQ ID NO: 3953963 - DNA, 14 bp, Homo sapiens
agcagccagccctg

SEQ ID NO: 3953964 - DNA, 15 bp, Homo sapiens
agcagccagccctgc

SEQ ID NO: 3953965 - DNA, 17 bp, Homo sapiens
agcagccagccctgcct

SEQ ID NO: 3953966 - DNA, 22 bp, Homo sapiens
agcagccagccctgcctggagg

SEQ ID NO: 3953967 - DNA, 12 bp, Homo sapiens
agcagcccaaat

SEQ ID NO: 3953968 - DNA, 17 bp, Homo sapiens
agcagcccatggcctct

SEQ ID NO: 3953969 - DNA, 18 bp, Homo sapiens
agcagccccccagcacta

SEQ ID NO: 3953970 - DNA, 23 bp, Homo sapiens
agcagcccctctttaacctcatc

SEQ ID NO: 3953971 - DNA, 18 bp, Homo sapiens
agcagccctcctcacccc

SEQ ID NO: 3953972 - DNA, 15 bp, Homo sapiens
agcagcctcctgggc

SEQ ID NO: 3953973 - DNA, 17 bp, Homo sapiens
agcagcctcctgggcag

SEQ ID NO: 3953974 - DNA, 11 bp, Homo sapiens
agcagctgagc

SEQ ID NO: 3953975 - DNA, 21 bp, Homo sapiens
agcagctgcgggtctgaagga

SEQ ID NO: 3953976 - DNA, 12 bp, Homo sapiens
agcagctgggcc

SEQ ID NO: 3953977 - DNA, 23 bp, Homo sapiens
agcagctgggccggccagccttg

SEQ ID NO: 3953978 - DNA, 14 bp, Homo sapiens
agcaggaacagaga

SEQ ID NO: 3953979 - DNA, 15 bp, Homo sapiens
agcaggaacagagac

SEQ ID NO: 3953980 - DNA, 19 bp, Homo sapiens
agcaggaacagagactctg

SEQ ID NO: 3953981 - DNA, 21 bp, Homo sapiens
agcaggaacagagactctgga

SEQ ID NO: 3953982 - DNA, 22 bp, Homo sapiens
agcaggaacctgtactgggtta

SEQ ID NO: 3953983 - DNA, 12 bp, Homo sapiens
agcaggcagagc

SEQ ID NO: 3953984 - DNA, 15 bp, Homo sapiens
agcaggcagagcggg

SEQ ID NO: 3953985 - DNA, 20 bp, Homo sapiens
agcaggcagagcggggaggt

SEQ ID NO: 3953986 - DNA, 18 bp, Homo sapiens
agccctacatcttcagct

SEQ ID NO: 3953987 - DNA, 23 bp, Homo sapiens
agccctacatcttcagctcccat

SEQ ID NO: 3953988 - DNA, 12 bp, Homo sapiens
agccctatggat

SEQ ID NO: 3953989 - DNA, 17 bp, Homo sapiens
agccctcagtcagttcc

SEQ ID NO: 3953990 - DNA, 23 bp, Homo sapiens
agccctcagtcagttcccggagc

SEQ ID NO: 3953991 - DNA, 17 bp, Homo sapiens
agccctccctgcccctc

SEQ ID NO: 3953992 - DNA, 21 bp, Homo sapiens
agccctccctggcatgtcaga

SEQ ID NO: 3953993 - DNA, 14 bp, Homo sapiens
agccctcctcaccc

SEQ ID NO: 3953994 - DNA, 11 bp, Homo sapiens
agccctccttc

SEQ ID NO: 3953995 - DNA, 13 bp, Homo sapiens
agccctccttcca

SEQ ID NO: 3953996 - DNA, 16 bp, Homo sapiens
agccctgccaggaggc

SEQ ID NO: 3953997 - DNA, 13 bp, Homo sapiens
agccctgcctgga

SEQ ID NO: 3953998 - DNA, 15 bp, Homo sapiens
agccctgcctggagg

SEQ ID NO: 3953999 - DNA, 16 bp, Homo sapiens
agccctgcctggagga

SEQ ID NO: 3954000 - DNA, 22 bp, Homo sapiens
agccctgcctggaggacctgag

SEQ ID NO: 3954001 - DNA, 20 bp, Homo sapiens
agccctgctgggcccatgtg

SEQ ID NO: 3954002 - DNA, 19 bp, Homo sapiens
agcctgccctcagcacaga

SEQ ID NO: 3954003 - DNA, 11 bp, Homo sapiens
agcctggagaa

SEQ ID NO: 3954004 - DNA, 14 bp, Homo sapiens
agcctggagaagct

SEQ ID NO: 3954005 - DNA, 19 bp, Homo sapiens
agcctggcacaggactgat

SEQ ID NO: 3954006 - DNA, 20 bp, Homo sapiens
agcctggcacagggcagtgg

SEQ ID NO: 3954007 - DNA, 17 bp, Homo sapiens
agcctggcccatagaaa

SEQ ID NO: 3954008 - DNA, 17 bp, Homo sapiens
agcctggcctcctgcct

SEQ ID NO: 3954009 - DNA, 18 bp, Homo sapiens
agcctggcctcctgcctc

SEQ ID NO: 3954010 - DNA, 19 bp, Homo sapiens
agcctggcctcctgcctct

SEQ ID NO: 3954011 - DNA, 20 bp, Homo sapiens
agcctggcctcctgcctcta

SEQ ID NO: 3954012 - DNA, 15 bp, Homo sapiens
agcctggcggggcag

SEQ ID NO: 3954013 - DNA, 22 bp, Homo sapiens
agcctggcggggcaggaggcct

SEQ ID NO: 3954014 - DNA, 19 bp, Homo sapiens
agcctgggactcccagtga

SEQ ID NO: 3954015 - DNA, 20 bp, Homo sapiens
agcctgggcctatggagagc

SEQ ID NO: 3954016 - DNA, 21 bp, Homo sapiens
agcctgggcctatggagagcc

SEQ ID NO: 3954017 - DNA, 13 bp, Homo sapiens
agcctggggctct

SEQ ID NO: 3954018 - DNA, 18 bp, Homo sapiens
agcctgggggcctggctg

SEQ ID NO: 3954019 - DNA, 19 bp, Homo sapiens
agcctgggggcctggctgg

SEQ ID NO: 3954020 - DNA, 20 bp, Homo sapiens
agcctgggggcctggctggc

SEQ ID NO: 3954021 - DNA, 23 bp, Homo sapiens
agcctgggggcctggctggctga

SEQ ID NO: 3954022 - DNA, 21 bp, Homo sapiens
agcctgggtgagaatcctgcc

SEQ ID NO: 3954023 - DNA, 21 bp, Homo sapiens
agcctggtttagcctggatgt

SEQ ID NO: 3954024 - DNA, 16 bp, Homo sapiens
agcctgtaatcccagc

SEQ ID NO: 3954025 - DNA, 18 bp, Homo sapiens
agcctgtaatcccagcta

SEQ ID NO: 3954026 - DNA, 12 bp, Homo sapiens
agcctgtcctgg

SEQ ID NO: 3954027 - DNA, 17 bp, Homo sapiens
agcctgtgaacccagga

SEQ ID NO: 3954028 - DNA, 23 bp, Homo sapiens
agcctgtgaataaaaaccctgta

SEQ ID NO: 3954029 - DNA, 22 bp, Homo sapiens
agcctgtgattaacttgcttag

SEQ ID NO: 3954030 - DNA, 22 bp, Homo sapiens
agcctgtggcggtgcctgggtg

SEQ ID NO: 3954031 - DNA, 17 bp, Homo sapiens
agcctgtgggagtagaa

SEQ ID NO: 3954032 - DNA, 16 bp, Homo sapiens
agcctgttcatggcag

SEQ ID NO: 3954033 - DNA, 22 bp, Homo sapiens
agcctgttggacccgctctgga

SEQ ID NO: 3954034 - DNA, 20 bp, Homo sapiens
agcctgttgttcccatctgc

SEQ ID NO: 3954035 - DNA, 16 bp, Homo sapiens
agccttaaatttttgt

SEQ ID NO: 3954036 - DNA, 16 bp, Homo sapiens
agccttgctcaggtgc

SEQ ID NO: 3954037 - DNA, 17 bp, Homo sapiens
agccttggtgtccacct

SEQ ID NO: 3954038 - DNA, 14 bp, Homo sapiens
agccttgtgccctg

SEQ ID NO: 3954039 - DNA, 17 bp, Homo sapiens
agccttgtgccctgccc

SEQ ID NO: 3954040 - DNA, 20 bp, Homo sapiens
agccttgtgccctgccccca

SEQ ID NO: 3954041 - DNA, 16 bp, Homo sapiens
agcgaatcatctcaaa

SEQ ID NO: 3954042 - DNA, 22 bp, Homo sapiens
agcgagacccttgcattagaaa

SEQ ID NO: 3954043 - DNA, 19 bp, Homo sapiens
agcgaggtcaacagagaag

SEQ ID NO: 3954044 - DNA, 20 bp, Homo sapiens
agcgattccctctcccaggc

SEQ ID NO: 3954045 - DNA, 21 bp, Homo sapiens
agcgattccctctcccaggcc

SEQ ID NO: 3954046 - DNA, 19 bp, Homo sapiens
agcgattcttgtgcctcag

SEQ ID NO: 3954047 - DNA, 20 bp, Homo sapiens
agcgcagggaggatgccaca

SEQ ID NO: 3954048 - DNA, 19 bp, Homo sapiens
agcgcaggtttagtttact

SEQ ID NO: 3954049 - DNA, 20 bp, Homo sapiens
agcgccctgcagaccctgcc

SEQ ID NO: 3954050 - DNA, 21 bp, Homo sapiens
agcgccctgcagaccctgccc

SEQ ID NO: 3954051 - DNA, 21 bp, Homo sapiens
agcgcctagtggggtctccct

SEQ ID NO: 3954052 - DNA, 15 bp, Homo sapiens
agcgcctgccctccc

SEQ ID NO: 3954053 - DNA, 18 bp, Homo sapiens
agcgcctgccctccctgg

SEQ ID NO: 3954054 - DNA, 14 bp, Homo sapiens
agcgcgtgcacagc

SEQ ID NO: 3954055 - DNA, 18 bp, Homo sapiens
agcgctatcttcacatag

SEQ ID NO: 3954056 - DNA, 17 bp, Homo sapiens
agcgctgccgcacccca

SEQ ID NO: 3954057 - DNA, 20 bp, Homo sapiens
agcgctgccgcaccccagag

SEQ ID NO: 3954058 - DNA, 13 bp, Homo sapiens
agcgctggctcag

SEQ ID NO: 3954059 - DNA, 18 bp, Homo sapiens
agcgctggctcaggaaga

SEQ ID NO: 3954060 - DNA, 16 bp, Homo sapiens
agcggctgagtcatga

SEQ ID NO: 3954061 - DNA, 21 bp, Homo sapiens
agcggctgagtcatgatctcc

SEQ ID NO: 3954062 - DNA, 15 bp, Homo sapiens
agcgggcctcttccc

SEQ ID NO: 3954063 - DNA, 17 bp, Homo sapiens
agcgggcctcttccctc

SEQ ID NO: 3954064 - DNA, 21 bp, Homo sapiens
agcggttgcttctggctcctc

SEQ ID NO: 3954065 - DNA, 18 bp, Homo sapiens
agcgtggccttgttctgt

SEQ ID NO: 3954066 - DNA, 11 bp, Homo sapiens
agctggctgtc

SEQ ID NO: 3954067 - DNA, 18 bp, Homo sapiens
agctgggaagctgtactc

SEQ ID NO: 3954068 - DNA, 14 bp, Homo sapiens
agctgggacccctc

SEQ ID NO: 3954069 - DNA, 13 bp, Homo sapiens
agctgggaggaaa

SEQ ID NO: 3954070 - DNA, 21 bp, Homo sapiens
agctgggaggcatggccctgg

SEQ ID NO: 3954071 - DNA, 16 bp, Homo sapiens
agctgggccccatgct

SEQ ID NO: 3954072 - DNA, 22 bp, Homo sapiens
agctggggcctggagaggggcc

SEQ ID NO: 3954073 - DNA, 23 bp, Homo sapiens
agctgggtacggtggcacgtgcc

SEQ ID NO: 3954074 - DNA, 18 bp, Homo sapiens
agctggtgctgcaaggaa

SEQ ID NO: 3954075 - DNA, 17 bp, Homo sapiens
agctgtaaatacatgtg

SEQ ID NO: 3954076 - DNA, 19 bp, Homo sapiens
agctgtaaatacatgtgtg

SEQ ID NO: 3954077 - DNA, 20 bp, Homo sapiens
agctgtaaatacatgtgtgg

SEQ ID NO: 3954078 - DNA, 17 bp, Homo sapiens
agctgtactcagagcag

SEQ ID NO: 3954079 - DNA, 19 bp, Homo sapiens
agctgtactcagagcagag

SEQ ID NO: 3954080 - DNA, 21 bp, Homo sapiens
agctgtactcagagcagagca

SEQ ID NO: 3954081 - DNA, 19 bp, Homo sapiens
agctgtagaaatgtatcct

SEQ ID NO: 3954082 - DNA, 16 bp, Homo sapiens
agctgtagccatggct

SEQ ID NO: 3954083 - DNA, 22 bp, Homo sapiens
agctgtagccatggctcaggca

SEQ ID NO: 3954084 - DNA, 20 bp, Homo sapiens
agctgtagtagccctttctg

SEQ ID NO: 3954085 - DNA, 19 bp, Homo sapiens
agctgtcccctctccctgg

SEQ ID NO: 3954086 - DNA, 14 bp, Homo sapiens
agctgtccctgtca

SEQ ID NO: 3954087 - DNA, 18 bp, Homo sapiens
agctgtccctgtcaccaa

SEQ ID NO: 3954088 - DNA, 22 bp, Homo sapiens
agctgtccctgtcaccaagctc

SEQ ID NO: 3954089 - DNA, 11 bp, Homo sapiens
agctgtctgct

SEQ ID NO: 3954090 - DNA, 20 bp, Homo sapiens
agctgtgaactcagagcccc

SEQ ID NO: 3954091 - DNA, 14 bp, Homo sapiens
agctgtgacctgct

SEQ ID NO: 3954092 - DNA, 16 bp, Homo sapiens
agctgtgacctgctga

SEQ ID NO: 3954093 - DNA, 14 bp, Homo sapiens
agggaagagggcag

SEQ ID NO: 3954094 - DNA, 17 bp, Homo sapiens
agggaagcaggcagagc

SEQ ID NO: 3954095 - DNA, 19 bp, Homo sapiens
agggaagcaggcagagcgg

SEQ ID NO: 3954096 - DNA, 13 bp, Homo sapiens
agggaagcaggga

SEQ ID NO: 3954097 - DNA, 18 bp, Homo sapiens
agggaaggaactctggct

SEQ ID NO: 3954098 - DNA, 16 bp, Homo sapiens
agggaaggcaggcagg

SEQ ID NO: 3954099 - DNA, 18 bp, Homo sapiens
agggaatgaacctggagg

SEQ ID NO: 3954100 - DNA, 19 bp, Homo sapiens
agggaatgttccctgcacc

SEQ ID NO: 3954101 - DNA, 19 bp, Homo sapiens
agggaattgattcaagatt

SEQ ID NO: 3954102 - DNA, 15 bp, Homo sapiens
agggacaaaggagcc

SEQ ID NO: 3954103 - DNA, 16 bp, Homo sapiens
agggacaaaggagcct

SEQ ID NO: 3954104 - DNA, 20 bp, Homo sapiens
agggacaaaggagcctgtga

SEQ ID NO: 3954105 - DNA, 17 bp, Homo sapiens
agggacaagggggagga

SEQ ID NO: 3954106 - DNA, 22 bp, Homo sapiens
agggacccgaagcccaggctga

SEQ ID NO: 3954107 - DNA, 15 bp, Homo sapiens
agggaccttgaaggg

SEQ ID NO: 3954108 - DNA, 15 bp, Homo sapiens
agggactggaaccag

SEQ ID NO: 3954109 - DNA, 16 bp, Homo sapiens
agggactgtcgctgct

SEQ ID NO: 3954110 - DNA, 17 bp, Homo sapiens
agggacttaaaaaactt

SEQ ID NO: 3954111 - DNA, 21 bp, Homo sapiens
agggacttcctctttctctcc

SEQ ID NO: 3954112 - DNA, 12 bp, Homo sapiens
agggagacagag

SEQ ID NO: 3954113 - DNA, 13 bp, Homo sapiens
agggagagaagat

SEQ ID NO: 3954114 - DNA, 14 bp, Homo sapiens
agggagagaagata

SEQ ID NO: 3954115 - DNA, 14 bp, Homo sapiens
agggagagcggggc

SEQ ID NO: 3954116 - DNA, 16 bp, Homo sapiens
agggagagcggggcag

SEQ ID NO: 3954117 - DNA, 14 bp, Homo sapiens
agggagcagacagg

SEQ ID NO: 3954118 - DNA, 18 bp, Homo sapiens
agggagccatcccttccc

SEQ ID NO: 3954119 - DNA, 20 bp, Homo sapiens
agggaggaggcagagaagaa

SEQ ID NO: 3954120 - DNA, 16 bp, Homo sapiens
agggaggatgccacag

SEQ ID NO: 3954121 - DNA, 18 bp, Homo sapiens
agggaggatgccacagcc

SEQ ID NO: 3954122 - DNA, 14 bp, Homo sapiens
agggaggccgaagc

SEQ ID NO: 3954123 - DNA, 12 bp, Homo sapiens
agggagggctct

SEQ ID NO: 3954124 - DNA, 13 bp, Homo sapiens
agggagggctctg

SEQ ID NO: 3954125 - DNA, 14 bp, Homo sapiens
agggagggctctga

SEQ ID NO: 3954126 - DNA, 12 bp, Homo sapiens
agggaggggact

SEQ ID NO: 3954127 - DNA, 18 bp, Homo sapiens
aggcatgcctctgatatg

SEQ ID NO: 3954128 - DNA, 14 bp, Homo sapiens
aggcatgctggcct

SEQ ID NO: 3954129 - DNA, 12 bp, Homo sapiens
aggcatggccct

SEQ ID NO: 3954130 - DNA, 15 bp, Homo sapiens
aggcatggccctggg

SEQ ID NO: 3954131 - DNA, 21 bp, Homo sapiens
aggcatggccctggggtccca

SEQ ID NO: 3954132 - DNA, 16 bp, Homo sapiens
aggcattatttaatgt

SEQ ID NO: 3954133 - DNA, 17 bp, Homo sapiens
aggcattatttaatgtt

SEQ ID NO: 3954134 - DNA, 20 bp, Homo sapiens
aggcatttcctgggtggcta

SEQ ID NO: 3954135 - DNA, 12 bp, Homo sapiens
aggcattttgtt

SEQ ID NO: 3954136 - DNA, 22 bp, Homo sapiens
aggccaaatgcacaagctcaga

SEQ ID NO: 3954137 - DNA, 17 bp, Homo sapiens
aggccaagctgaagtga

SEQ ID NO: 3954138 - DNA, 13 bp, Homo sapiens
aggccaaggcagg

SEQ ID NO: 3954139 - DNA, 13 bp, Homo sapiens
aggccaccaggat

SEQ ID NO: 3954140 - DNA, 13 bp, Homo sapiens
aggccactcctcc

SEQ ID NO: 3954141 - DNA, 14 bp, Homo sapiens
aggccactgtggcc

SEQ ID NO: 3954142 - DNA, 17 bp, Homo sapiens
aggccactgtggccaga

SEQ ID NO: 3954143 - DNA, 18 bp, Homo sapiens
aggccactgtggccagag

SEQ ID NO: 3954144 - DNA, 20 bp, Homo sapiens
aggccactgtggccagagct

SEQ ID NO: 3954145 - DNA, 22 bp, Homo sapiens
aggccactgtggccagagctgg

SEQ ID NO: 3954146 - DNA, 20 bp, Homo sapiens
aggccagaggtgctgtcagc

SEQ ID NO: 3954147 - DNA, 14 bp, Homo sapiens
aggccagcctggcc

SEQ ID NO: 3954148 - DNA, 17 bp, Homo sapiens
aggccagcctggcctcc

SEQ ID NO: 3954149 - DNA, 18 bp, Homo sapiens
aggccagcctggcctcct

SEQ ID NO: 3954150 - DNA, 19 bp, Homo sapiens
aggccagcctggcctcctg

SEQ ID NO: 3954151 - DNA, 23 bp, Homo sapiens
aggccagcctggcctcctgcctc

SEQ ID NO: 3954152 - DNA, 17 bp, Homo sapiens
aggccaggaatctgcca

SEQ ID NO: 3954153 - DNA, 14 bp, Homo sapiens
aggccaggccacca

SEQ ID NO: 3954154 - DNA, 19 bp, Homo sapiens
aggccaggccaccaggatg

SEQ ID NO: 3954155 - DNA, 14 bp, Homo sapiens
aggccagggaaagc

SEQ ID NO: 3954156 - DNA, 20 bp, Homo sapiens
aggcccaagagatgaagagt

SEQ ID NO: 3954157 - DNA, 14 bp, Homo sapiens
aggcccagcctgtc

SEQ ID NO: 3954158 - DNA, 21 bp, Homo sapiens
aggcccagctatggccccagg

SEQ ID NO: 3954159 - DNA, 20 bp, Homo sapiens
agctgtgacctgctgagctc

SEQ ID NO: 3954160 - DNA, 24 bp, Homo sapiens
agctgtgtccttgcacctgcatcc

SEQ ID NO: 3954161 - DNA, 19 bp, Homo sapiens
agctgttccacttctctag

SEQ ID NO: 3954162 - DNA, 22 bp, Homo sapiens
agctgtttatttattcactgta

SEQ ID NO: 3954163 - DNA, 12 bp, Homo sapiens
agcttaaataaa

SEQ ID NO: 3954164 - DNA, 13 bp, Homo sapiens
agcttaaataaat

SEQ ID NO: 3954165 - DNA, 17 bp, Homo sapiens
agcttaaataaattcaa

SEQ ID NO: 3954166 - DNA, 23 bp, Homo sapiens
agcttaaattgcttttgttgtga

SEQ ID NO: 3954167 - DNA, 20 bp, Homo sapiens
agcttattggccactgggtc

SEQ ID NO: 3954168 - DNA, 12 bp, Homo sapiens
agcttcaaagct

SEQ ID NO: 3954169 - DNA, 18 bp, Homo sapiens
agcttcaagtgatatatg

SEQ ID NO: 3954170 - DNA, 18 bp, Homo sapiens
agcttcagagcctagcca

SEQ ID NO: 3954171 - DNA, 20 bp, Homo sapiens
agcttcagagcctagccacc

SEQ ID NO: 3954172 - DNA, 23 bp, Homo sapiens
agcttcagagcctagccacctcc

SEQ ID NO: 3954173 - DNA, 20 bp, Homo sapiens
agcttcatcaatttttatac

SEQ ID NO: 3954174 - DNA, 15 bp, Homo sapiens
agcttcatgcctcag

SEQ ID NO: 3954175 - DNA, 18 bp, Homo sapiens
agcttcatgcctcagttt

SEQ ID NO: 3954176 - DNA, 21 bp, Homo sapiens
agcttcatgcctcagtttccc

SEQ ID NO: 3954177 - DNA, 23 bp, Homo sapiens
agcttccctcccgtgtgttctcc

SEQ ID NO: 3954178 - DNA, 17 bp, Homo sapiens
agcttctatcccaggag

SEQ ID NO: 3954179 - DNA, 15 bp, Homo sapiens
agcttctccaggctc

SEQ ID NO: 3954180 - DNA, 19 bp, Homo sapiens
agcttcttcatctttaaaa

SEQ ID NO: 3954181 - DNA, 17 bp, Homo sapiens
agcttgaaactgagatg

SEQ ID NO: 3954182 - DNA, 15 bp, Homo sapiens
agcttgagcctgaaa

SEQ ID NO: 3954183 - DNA, 12 bp, Homo sapiens
agcttgggaatg

SEQ ID NO: 3954184 - DNA, 16 bp, Homo sapiens
agcttgtatatacata

SEQ ID NO: 3954185 - DNA, 19 bp, Homo sapiens
agcttgtatatacatatta

SEQ ID NO: 3954186 - DNA, 22 bp, Homo sapiens
agcttgtatatacatattataa

SEQ ID NO: 3954187 - DNA, 17 bp, Homo sapiens
agcttgttccctgtctt

SEQ ID NO: 3954188 - DNA, 20 bp, Homo sapiens
agctttacacacacagatgt

SEQ ID NO: 3954189 - DNA, 14 bp, Homo sapiens
agctttaccagctg

SEQ ID NO: 3954190 - DNA, 16 bp, Homo sapiens
agctttaggggaccat

SEQ ID NO: 3954191 - DNA, 16 bp, Homo sapiens
agctttatctgtcaca

SEQ ID NO: 3954192 - DNA, 21 bp, Homo sapiens
agctttatctgtcacacaagg

SEQ ID NO: 3954193 - DNA, 12 bp, Homo sapiens
agctttcagagc

SEQ ID NO: 3954194 - DNA, 13 bp, Homo sapiens
agctttcagagcc

SEQ ID NO: 3954195 - DNA, 15 bp, Homo sapiens
agctttcagagccag

SEQ ID NO: 3954196 - DNA, 19 bp, Homo sapiens
agctttcagagccagtgaa

SEQ ID NO: 3954197 - DNA, 21 bp, Homo sapiens
agctttcttctacaaccagag

SEQ ID NO: 3954198 - DNA, 23 bp, Homo sapiens
agctttcttctacaaccagagcc

SEQ ID NO: 3954199 - DNA, 22 bp, Homo sapiens
agctttgaaggccgaaggcagt

SEQ ID NO: 3954200 - DNA, 18 bp, Homo sapiens
agctttgaatacccccag

SEQ ID NO: 3954201 - DNA, 22 bp, Homo sapiens
agctttgaatacccccagagac

SEQ ID NO: 3954202 - DNA, 18 bp, Homo sapiens
agctttgttttatatatt

SEQ ID NO: 3954203 - DNA, 17 bp, Homo sapiens
agcttttattgtataaa

SEQ ID NO: 3954204 - DNA, 12 bp, Homo sapiens
agcttttcaaac

SEQ ID NO: 3954205 - DNA, 16 bp, Homo sapiens
agcttttcaaacaaga

SEQ ID NO: 3954206 - DNA, 14 bp, Homo sapiens
aggaaaaaaaataa

SEQ ID NO: 3954207 - DNA, 18 bp, Homo sapiens
aggaaaaaaaataatgta

SEQ ID NO: 3954208 - DNA, 20 bp, Homo sapiens
aggaaaaccaagccgtggct

SEQ ID NO: 3954209 - DNA, 16 bp, Homo sapiens
aggaaaaggcctgggg

SEQ ID NO: 3954210 - DNA, 22 bp, Homo sapiens
aggaaaagtacatttaatacag

SEQ ID NO: 3954211 - DNA, 17 bp, Homo sapiens
aggaaaagtgcaatgcg

SEQ ID NO: 3954212 - DNA, 14 bp, Homo sapiens
aggaaaatcctctg

SEQ ID NO: 3954213 - DNA, 18 bp, Homo sapiens
aggaaaccaaaggaatcg

SEQ ID NO: 3954214 - DNA, 22 bp, Homo sapiens
aggaaacccaaggaacaagaga

SEQ ID NO: 3954215 - DNA, 23 bp, Homo sapiens
aggaaagccctcccccttcccct

SEQ ID NO: 3954216 - DNA, 22 bp, Homo sapiens
aggatctagaatgtgttttctg

SEQ ID NO: 3954217 - DNA, 22 bp, Homo sapiens
aggatctatgcaatttttaaac

SEQ ID NO: 3954218 - DNA, 20 bp, Homo sapiens
aggatctctcaggagcacag

SEQ ID NO: 3954219 - DNA, 22 bp, Homo sapiens
aggatctctcaggagcacaggc

SEQ ID NO: 3954220 - DNA, 16 bp, Homo sapiens
aggatgaaagtctgag

SEQ ID NO: 3954221 - DNA, 18 bp, Homo sapiens
aggatgccacagccccac

SEQ ID NO: 3954222 - DNA, 15 bp, Homo sapiens
aggatggagagaggg

SEQ ID NO: 3954223 - DNA, 16 bp, Homo sapiens
aggatggagagagggg

SEQ ID NO: 3954224 - DNA, 17 bp, Homo sapiens
aggatggagagagggga

SEQ ID NO: 3954225 - DNA, 17 bp, Homo sapiens
aggatggagccagctct

SEQ ID NO: 3954226 - DNA, 19 bp, Homo sapiens
aggatggattgcagtcccc

SEQ ID NO: 3954227 - DNA, 20 bp, Homo sapiens
aggatgtaaacagtgcctgc

SEQ ID NO: 3954228 - DNA, 14 bp, Homo sapiens
aggattcctctctc

SEQ ID NO: 3954229 - DNA, 13 bp, Homo sapiens
aggattgaagagc

SEQ ID NO: 3954230 - DNA, 16 bp, Homo sapiens
aggatttaacagtcat

SEQ ID NO: 3954231 - DNA, 18 bp, Homo sapiens
aggatttaacagtcattt

SEQ ID NO: 3954232 - DNA, 15 bp, Homo sapiens
aggatttcaagcctg

SEQ ID NO: 3954233 - DNA, 16 bp, Homo sapiens
aggcaaagcccctgga

SEQ ID NO: 3954234 - DNA, 12 bp, Homo sapiens
aggcaagagaaa

SEQ ID NO: 3954235 - DNA, 13 bp, Homo sapiens
aggcaagagacag

SEQ ID NO: 3954236 - DNA, 16 bp, Homo sapiens
aggcaagcccctcagc

SEQ ID NO: 3954237 - DNA, 17 bp, Homo sapiens
aggcaaggttatatgca

SEQ ID NO: 3954238 - DNA, 14 bp, Homo sapiens
aggcacacagcagc

SEQ ID NO: 3954239 - DNA, 21 bp, Homo sapiens
aggcacacagcagccccccag

SEQ ID NO: 3954240 - DNA, 23 bp, Homo sapiens
aggcacacagcagccccccagca

SEQ ID NO: 3954241 - DNA, 21 bp, Homo sapiens
aggcacaggcaggaagagaga

SEQ ID NO: 3954242 - DNA, 17 bp, Homo sapiens
aggcacaggtgtaaata

SEQ ID NO: 3954243 - DNA, 13 bp, Homo sapiens
aggcacatggagg

SEQ ID NO: 3954244 - DNA, 13 bp, Homo sapiens
aggcaccagctct

SEQ ID NO: 3954245 - DNA, 19 bp, Homo sapiens
aggcaccagctctgtggcc

SEQ ID NO: 3954246 - DNA, 21 bp, Homo sapiens
aggtaggcccttgtcctgcca

SEQ ID NO: 3954247 - DNA, 20 bp, Homo sapiens
aggtaggtggatcacctgag

SEQ ID NO: 3954248 - DNA, 15 bp, Homo sapiens
aggtatctccaggat

SEQ ID NO: 3954249 - DNA, 18 bp, Homo sapiens
aggtattaaagatgtgtt

SEQ ID NO: 3954250 - DNA, 14 bp, Homo sapiens
aggtatttcaaaac

SEQ ID NO: 3954251 - DNA, 19 bp, Homo sapiens
aggtcacattcaggaagat

SEQ ID NO: 3954252 - DNA, 15 bp, Homo sapiens
aggtcactgggttct

SEQ ID NO: 3954253 - DNA, 14 bp, Homo sapiens
aggtccaagggcca

SEQ ID NO: 3954254 - DNA, 15 bp, Homo sapiens
aggtccaagggccat

SEQ ID NO: 3954255 - DNA, 15 bp, Homo sapiens
aggtccagacccact

SEQ ID NO: 3954256 - DNA, 17 bp, Homo sapiens
aggtcctcctctctcta

SEQ ID NO: 3954257 - DNA, 20 bp, Homo sapiens
aggtcctgaaagtctgtgtc

SEQ ID NO: 3954258 - DNA, 18 bp, Homo sapiens
aggtcctgagcactgcca

SEQ ID NO: 3954259 - DNA, 19 bp, Homo sapiens
aggtcctgagcactgccag

SEQ ID NO: 3954260 - DNA, 20 bp, Homo sapiens
aggtcctgagcactgccagg

SEQ ID NO: 3954261 - DNA, 22 bp, Homo sapiens
aggtcctggcttctagatctgg

SEQ ID NO: 3954262 - DNA, 14 bp, Homo sapiens
aggtcctggtgggg

SEQ ID NO: 3954263 - DNA, 17 bp, Homo sapiens
aggtcctggtggggcag

SEQ ID NO: 3954264 - DNA, 15 bp, Homo sapiens
aggtctagactttct

SEQ ID NO: 3954265 - DNA, 19 bp, Homo sapiens
aggtctccactgaggatgt

SEQ ID NO: 3954266 - DNA, 21 bp, Homo sapiens
aggtctccactgaggatgtga

SEQ ID NO: 3954267 - DNA, 21 bp, Homo sapiens
aggtctccttactctgagccc

SEQ ID NO: 3954268 - DNA, 24 bp, Homo sapiens
aggtctccttactctgagcccagg

SEQ ID NO: 3954269 - DNA, 21 bp, Homo sapiens
aggtctgggagtgttctgttt

SEQ ID NO: 3954270 - DNA, 22 bp, Homo sapiens
aggtgaaatgggagatggtcag

SEQ ID NO: 3954271 - DNA, 23 bp, Homo sapiens
aggtgaacaccactttgtctctg

SEQ ID NO: 3954272 - DNA, 20 bp, Homo sapiens
aggtgagaccaaaggatcca

SEQ ID NO: 3954273 - DNA, 22 bp, Homo sapiens
aggtgagaccaaaggatccaga

SEQ ID NO: 3954274 - DNA, 15 bp, Homo sapiens
aggtgagcagaggag

SEQ ID NO: 3954275 - DNA, 14 bp, Homo sapiens
aggtgcaagagaca

SEQ ID NO: 3954276 - DNA, 15 bp, Homo sapiens
aggtgcaagagacag

SEQ ID NO: 3954277 - DNA, 16 bp, Homo sapiens
aggtgcaagagacaga

SEQ ID NO: 3954278 - DNA, 18 bp, Homo sapiens
aggtgcaagagacagagc

SEQ ID NO: 3954279 - DNA, 19 bp, Homo sapiens
aggtgcaagagacagagcc

SEQ ID NO: 3954280 - DNA, 20 bp, Homo sapiens
aggttgtctgaagtcactgc

SEQ ID NO: 3954281 - DNA, 18 bp, Homo sapiens
aggtttcaagacttgata

SEQ ID NO: 3954282 - DNA, 12 bp, Homo sapiens
aggtttcttgaa

SEQ ID NO: 3954283 - DNA, 16 bp, Homo sapiens
aggtttgccagtgaag

SEQ ID NO: 3954284 - DNA, 16 bp, Homo sapiens
aggtttggtgtgtgga

SEQ ID NO: 3954285 - DNA, 22 bp, Homo sapiens
aggtttggtgtgtggagatgca

SEQ ID NO: 3954286 - DNA, 15 bp, Homo sapiens
aggttttgtaaagat

SEQ ID NO: 3954287 - DNA, 22 bp, Homo sapiens
aggtttttttgtatagtaaagt

SEQ ID NO: 3954288 - DNA, 20 bp, Homo sapiens
agtaaaaccacagcagttga

SEQ ID NO: 3954289 - DNA, 13 bp, Homo sapiens
agtaaaagctaat

SEQ ID NO: 3954290 - DNA, 12 bp, Homo sapiens
agtaaactttct

SEQ ID NO: 3954291 - DNA, 16 bp, Homo sapiens
agtaaagtcaaggaga

SEQ ID NO: 3954292 - DNA, 12 bp, Homo sapiens
agtaaagtttaa

SEQ ID NO: 3954293 - DNA, 18 bp, Homo sapiens
agtaaagtttaaaaaata

SEQ ID NO: 3954294 - DNA, 21 bp, Homo sapiens
agtaaagtttaaaaaatacac

SEQ ID NO: 3954295 - DNA, 15 bp, Homo sapiens
agtaaataaattgtt

SEQ ID NO: 3954296 - DNA, 17 bp, Homo sapiens
agtaaatccacagccaa

SEQ ID NO: 3954297 - DNA, 15 bp, Homo sapiens
agtaacaaggtgtct

SEQ ID NO: 3954298 - DNA, 21 bp, Homo sapiens
agtaactactttttatactcc

SEQ ID NO: 3954299 - DNA, 14 bp, Homo sapiens
agtaacttttacaa

SEQ ID NO: 3954300 - DNA, 18 bp, Homo sapiens
agtaagatattatttaaa

SEQ ID NO: 3954301 - DNA, 22 bp, Homo sapiens
agtaatagtccaatatttggcg

SEQ ID NO: 3954302 - DNA, 14 bp, Homo sapiens
agtaatcaggcagc

SEQ ID NO: 3954303 - DNA, 18 bp, Homo sapiens
agtaatgggccaattaaa

SEQ ID NO: 3954304 - DNA, 22 bp, Homo sapiens
agtaatgggccaattaaaatat

SEQ ID NO: 3954305 - DNA, 19 bp, Homo sapiens
agtacagtagcttaaataa

SEQ ID NO: 3954306 - DNA, 21 bp, Homo sapiens
agtacagtagcttaaataaat

SEQ ID NO: 3954307 - DNA, 20 bp, Homo sapiens
agtacagtgaggagggtgga

SEQ ID NO: 3954308 - DNA, 17 bp, Homo sapiens
agtacatgaagagcagc

SEQ ID NO: 3954309 - DNA, 21 bp, Homo sapiens
agtacatttaatacagcagtg

SEQ ID NO: 3954310 - DNA, 17 bp, Homo sapiens
agtactcagtatagcat

SEQ ID NO: 3954311 - DNA, 13 bp, Homo sapiens
agtactctctgct

SEQ ID NO: 3954312 - DNA, 22 bp, Homo sapiens
agtactctctgctctagccagg

SEQ ID NO: 3954313 - DNA, 15 bp, Homo sapiens
agtactggcatggta

SEQ ID NO: 3954314 - DNA, 13 bp, Homo sapiens
agtacttctaaga

SEQ ID NO: 3954315 - DNA, 19 bp, Homo sapiens
agtagaagcctgcagcggc

SEQ ID NO: 3954316 - DNA, 14 bp, Homo sapiens
agtagaattatatc

SEQ ID NO: 3954317 - DNA, 20 bp, Homo sapiens
agtagaattatatctaattt

SEQ ID NO: 3954318 - DNA, 17 bp, Homo sapiens
agtagatggtgaaattt

SEQ ID NO: 3954319 - DNA, 20 bp, Homo sapiens
agtagcaagttctagagaag

SEQ ID NO: 3954320 - DNA, 22 bp, Homo sapiens
agtagcaagttctagagaagag

SEQ ID NO: 3954321 - DNA, 17 bp, Homo sapiens
agtagccctttctgtgt

SEQ ID NO: 3954322 - DNA, 20 bp, Homo sapiens
agtagccctttctgtgtgca

SEQ ID NO: 3954323 - DNA, 21 bp, Homo sapiens
agtagccctttctgtgtgcac

SEQ ID NO: 3954324 - DNA, 15 bp, Homo sapiens
agtagccgagagcct

SEQ ID NO: 3954325 - DNA, 19 bp, Homo sapiens
agtagctgagaggaagatg

SEQ ID NO: 3954326 - DNA, 11 bp, Homo sapiens
agtagctgagc

SEQ ID NO: 3954327 - DNA, 22 bp, Homo sapiens
agtagctgagctcacaaggcag

SEQ ID NO: 3954328 - DNA, 22 bp, Homo sapiens
agtagcttaaataaattcaaac

SEQ ID NO: 3954329 - DNA, 17 bp, Homo sapiens
agtaggtccaagggcca

SEQ ID NO: 3954330 - DNA, 17 bp, Homo sapiens
agtagtcaattagtaca

SEQ ID NO: 3954331 - DNA, 17 bp, Homo sapiens
agtagtcagaagcaggt

SEQ ID NO: 3954332 - DNA, 13 bp, Homo sapiens
agtagtctctgtg

SEQ ID NO: 3954333 - DNA, 17 bp, Homo sapiens
agtatacaatatataaa

SEQ ID NO: 3954334 - DNA, 21 bp, Homo sapiens
agtatacaatatataaaaata

SEQ ID NO: 3954335 - DNA, 17 bp, Homo sapiens
agtatacttttgtttca

SEQ ID NO: 3954336 - DNA, 15 bp, Homo sapiens
agtatatagtatatt

SEQ ID NO: 3954337 - DNA, 22 bp, Homo sapiens
agtatatctggacaagccaact

SEQ ID NO: 3954338 - DNA, 11 bp, Homo sapiens
agtatatttat

SEQ ID NO: 3954339 - DNA, 14 bp, Homo sapiens
agtatatttatact

SEQ ID NO: 3954340 - DNA, 13 bp, Homo sapiens
agtatatttctga

SEQ ID NO: 3954341 - DNA, 22 bp, Homo sapiens
agtatctcggacctttcagctg

SEQ ID NO: 3954342 - DNA, 23 bp, Homo sapiens
agtatctcggacctttcagctgt

SEQ ID NO: 3954343 - DNA, 21 bp, Homo sapiens
agtatgaatgatgttttagaa

SEQ ID NO: 3954344 - DNA, 14 bp, Homo sapiens
agtatggaagggag

SEQ ID NO: 3954345 - DNA, 21 bp, Homo sapiens
agtatggaagggaggggtcct

SEQ ID NO: 3954346 - DNA, 15 bp, Homo sapiens
agtatggttctcaga

SEQ ID NO: 3954347 - DNA, 21 bp, Homo sapiens
agtatgtaaagtatgtaaaca

SEQ ID NO: 3954348 - DNA, 14 bp, Homo sapiens
agtatgtaatcttt

SEQ ID NO: 3954349 - DNA, 17 bp, Homo sapiens
agtatgtgatatctgaa

SEQ ID NO: 3954350 - DNA, 15 bp, Homo sapiens
agtattcttgtcaaa

SEQ ID NO: 3954351 - DNA, 12 bp, Homo sapiens
agtattggggcc

SEQ ID NO: 3954352 - DNA, 23 bp, Homo sapiens
agtatttttttaagttagagaat

SEQ ID NO: 3954353 - DNA, 18 bp, Homo sapiens
agtcaaaaggtgcctgtg

SEQ ID NO: 3954354 - DNA, 17 bp, Homo sapiens
agtcaaaccataaactt

SEQ ID NO: 3954355 - DNA, 18 bp, Homo sapiens
agtcaaaccataaacttc

SEQ ID NO: 3954356 - DNA, 20 bp, Homo sapiens
agtcaaaccataaacttcat

SEQ ID NO: 3954357 - DNA, 19 bp, Homo sapiens
agtcaacaaccatgccagg

SEQ ID NO: 3954358 - DNA, 19 bp, Homo sapiens
agtcaagaaaaattattgt

SEQ ID NO: 3954359 - DNA, 18 bp, Homo sapiens
agtcaatcccctcattca

SEQ ID NO: 3954360 - DNA, 18 bp, Homo sapiens
agtcaattagtacagtag

SEQ ID NO: 3954361 - DNA, 13 bp, Homo sapiens
agtcacagctgca

SEQ ID NO: 3954362 - DNA, 18 bp, Homo sapiens
agtcacagctgcagctgg

SEQ ID NO: 3954363 - DNA, 22 bp, Homo sapiens
agtcacagctgcagctgggccc

SEQ ID NO: 3954364 - DNA, 23 bp, Homo sapiens
agtcacagctgcagctgggcccc

SEQ ID NO: 3954365 - DNA, 19 bp, Homo sapiens
agtcaccctacctgtgcct

SEQ ID NO: 3954366 - DNA, 16 bp, Homo sapiens
agttcaagaccagcct

SEQ ID NO: 3954367 - DNA, 17 bp, Homo sapiens
agttcaagaccagcctg

SEQ ID NO: 3954368 - DNA, 15 bp, Homo sapiens
agttcaagcctgtgg

SEQ ID NO: 3954369 - DNA, 21 bp, Homo sapiens
agttcaagcgattcttgtgcc

SEQ ID NO: 3954370 - DNA, 15 bp, Homo sapiens
agttcagccaccctg

SEQ ID NO: 3954371 - DNA, 12 bp, Homo sapiens
agttcagccaga

SEQ ID NO: 3954372 - DNA, 18 bp, Homo sapiens
agttcagggaagcaggca

SEQ ID NO: 3954373 - DNA, 20 bp, Homo sapiens
agttcagggaagcaggcaga

SEQ ID NO: 3954374 - DNA, 20 bp, Homo sapiens
agttcagttcctctttgcat

SEQ ID NO: 3954375 - DNA, 23 bp, Homo sapiens
agttcagttcctctttgcatgga

SEQ ID NO: 3954376 - DNA, 19 bp, Homo sapiens
agttcatcccagccccaat

SEQ ID NO: 3954377 - DNA, 21 bp, Homo sapiens
agttcatgagaatctatattt

SEQ ID NO: 3954378 - DNA, 22 bp, Homo sapiens
agttcatgtatgttcagaagaa

SEQ ID NO: 3954379 - DNA, 22 bp, Homo sapiens
agttccatgaagaccacatcca

SEQ ID NO: 3954380 - DNA, 23 bp, Homo sapiens
agttcccggagcacagccctggg

SEQ ID NO: 3954381 - DNA, 24 bp, Homo sapiens
agttccctgaaaacccagagagga

SEQ ID NO: 3954382 - DNA, 15 bp, Homo sapiens
agttcctcgccctgg

SEQ ID NO: 3954383 - DNA, 16 bp, Homo sapiens
agttcctcgccctggg

SEQ ID NO: 3954384 - DNA, 14 bp, Homo sapiens
agttcctgcactcc

SEQ ID NO: 3954385 - DNA, 15 bp, Homo sapiens
agttcctgcactcca

SEQ ID NO: 3954386 - DNA, 18 bp, Homo sapiens
agttcctgtggccaggag

SEQ ID NO: 3954387 - DNA, 20 bp, Homo sapiens
agttccttgatctgtatata

SEQ ID NO: 3954388 - DNA, 18 bp, Homo sapiens
agttcgcagccaccctga

SEQ ID NO: 3954389 - DNA, 21 bp, Homo sapiens
agttcgcagccaccctgagga

SEQ ID NO: 3954390 - DNA, 15 bp, Homo sapiens
agttctacaagcata

SEQ ID NO: 3954391 - DNA, 23 bp, Homo sapiens
agttctagtccttggtctgctgg

SEQ ID NO: 3954392 - DNA, 17 bp, Homo sapiens
agttctcaatcactgct

SEQ ID NO: 3954393 - DNA, 19 bp, Homo sapiens
agttctcctatcttctcca

SEQ ID NO: 3954394 - DNA, 17 bp, Homo sapiens
agttctctcgtaactgg

SEQ ID NO: 3954395 - DNA, 15 bp, Homo sapiens
agttctgctcctctc

SEQ ID NO: 3954396 - DNA, 17 bp, Homo sapiens
agttctgctcctctcca

SEQ ID NO: 3954397 - DNA, 19 bp, Homo sapiens
agttctgctcctctccagg

SEQ ID NO: 3954398 - DNA, 21 bp, Homo sapiens
agttctgctcctctccaggca

SEQ ID NO: 3954399 - DNA, 22 bp, Homo sapiens
agttcttgagtagatctgcttc

SEQ ID NO: 3954400 - DNA, 20 bp, Homo sapiens
agttcttgtgcatgtttact

SEQ ID NO: 3954401 - DNA, 21 bp, Homo sapiens
agttcttgtgcatgtttactt

SEQ ID NO: 3954402 - DNA, 14 bp, Homo sapiens
agttgaaaagactc

SEQ ID NO: 3954403 - DNA, 20 bp, Homo sapiens
agttgaaaagactccaaaga

SEQ ID NO: 3954404 - DNA, 22 bp, Homo sapiens
agttgaaaagactccaaagaaa

SEQ ID NO: 3954405 - DNA, 23 bp, Homo sapiens
agttgaccgttttcatcctggcc

SEQ ID NO: 3954406 - DNA, 15 bp, Homo sapiens
agttgacgcatcctg

SEQ ID NO: 3954407 - DNA, 15 bp, Homo sapiens
agttgattctgaatc

SEQ ID NO: 3954408 - DNA, 20 bp, Homo sapiens
agttgattctgaatctgaaa

SEQ ID NO: 3954409 - DNA, 15 bp, Homo sapiens
agttgcaataaaata

SEQ ID NO: 3954410 - DNA, 16 bp, Homo sapiens
agttgcaataaaatag

SEQ ID NO: 3954411 - DNA, 16 bp, Homo sapiens
agttgctcactcagga

SEQ ID NO: 3954412 - DNA, 14 bp, Homo sapiens
agttggaaatattc

SEQ ID NO: 3954413 - DNA, 17 bp, Homo sapiens
agttggacacactgtaa

SEQ ID NO: 3954414 - DNA, 21 bp, Homo sapiens
agttggcagagaaggcctctt

SEQ ID NO: 3954415 - DNA, 13 bp, Homo sapiens
agttgggagcact

SEQ ID NO: 3954416 - DNA, 18 bp, Homo sapiens
agttgtacgtaatgtatt

SEQ ID NO: 3954417 - DNA, 19 bp, Homo sapiens
agttgtctattctgagcct

SEQ ID NO: 3954418 - DNA, 20 bp, Homo sapiens
agttgtctattctgagcctt

SEQ ID NO: 3954419 - DNA, 21 bp, Homo sapiens
agttgtctattctgagccttg

SEQ ID NO: 3954420 - DNA, 15 bp, Homo sapiens
agttgtgccttttat

SEQ ID NO: 3954421 - DNA, 21 bp, Homo sapiens
agttgtgccttttatagctat

SEQ ID NO: 3954422 - DNA, 21 bp, Homo sapiens
agttgttcgccgcgtggaatg

SEQ ID NO: 3954423 - DNA, 16 bp, Homo sapiens
agtttaaaaaatacac

SEQ ID NO: 3954424 - DNA, 22 bp, Homo sapiens
agtttaacacaagtcctgtgaa

SEQ ID NO: 3954425 - DNA, 17 bp, Homo sapiens
agtttacaagtgtatat

SEQ ID NO: 3954426 - DNA, 23 bp, Homo sapiens
agtttacaagtgtatatcagaaa

SEQ ID NO: 3954427 - DNA, 13 bp, Homo sapiens
agtttacagtaaa

SEQ ID NO: 3954428 - DNA, 14 bp, Homo sapiens
agtttacagtaaat

SEQ ID NO: 3954429 - DNA, 22 bp, Homo sapiens
agtttacagtaaataaattgtt

SEQ ID NO: 3954430 - DNA, 20 bp, Homo sapiens
agtttactagcttttcaaac

SEQ ID NO: 3954431 - DNA, 20 bp, Homo sapiens
agtttagaagcgctcatctg

SEQ ID NO: 3954432 - DNA, 23 bp, Homo sapiens
agtttagatcccatgtcacctca

SEQ ID NO: 3954433 - DNA, 22 bp, Homo sapiens
agtttattgacaataatttcag

SEQ ID NO: 3954434 - DNA, 18 bp, Homo sapiens
agtttattggaagtgttc

SEQ ID NO: 3954435 - DNA, 18 bp, Homo sapiens
agtttattttttctacac

SEQ ID NO: 3954436 - DNA, 18 bp, Homo sapiens
agtttcagagaagttctg

SEQ ID NO: 3954437 - DNA, 23 bp, Homo sapiens
agtttcagatatatatcatattg

SEQ ID NO: 3954438 - DNA, 19 bp, Homo sapiens
agtttcagtaaataatgaa

SEQ ID NO: 3954439 - DNA, 21 bp, Homo sapiens
agtttcagtaaataatgaaaa

SEQ ID NO: 3954440 - DNA, 12 bp, Homo sapiens
agtttccagtgg

SEQ ID NO: 3954441 - DNA, 10 bp, Homo sapiens
agtttcccca

SEQ ID NO: 3954442 - DNA, 13 bp, Homo sapiens
agtttctcagctc

SEQ ID NO: 3954443 - DNA, 13 bp, Homo sapiens
agtttctttctgt

SEQ ID NO: 3954444 - DNA, 15 bp, Homo sapiens
agtttgaacttcata

SEQ ID NO: 3954445 - DNA, 19 bp, Homo sapiens
agtttgagacaagccctgg

SEQ ID NO: 3954446 - DNA, 17 bp, Homo sapiens
agtttgatcaaatctaa

SEQ ID NO: 3954447 - DNA, 20 bp, Homo sapiens
agtttgatgtcattaatgtg

SEQ ID NO: 3954448 - DNA, 13 bp, Homo sapiens
agtttgcagaaaa

SEQ ID NO: 3954449 - DNA, 13 bp, Homo sapiens
agtttgccagaag

SEQ ID NO: 3954450 - DNA, 17 bp, Homo sapiens
agtttggcaatagtttg

SEQ ID NO: 3954451 - DNA, 20 bp, Homo sapiens
agtggaatgcagggaagagg

SEQ ID NO: 3954452 - DNA, 13 bp, Homo sapiens
agtggacattcaa

SEQ ID NO: 3954453 - DNA, 13 bp, Homo sapiens
agtggaccaggac

SEQ ID NO: 3954454 - DNA, 14 bp, Homo sapiens
agtggaccaggaca

SEQ ID NO: 3954455 - DNA, 15 bp, Homo sapiens
agtggaccaggacag

SEQ ID NO: 3954456 - DNA, 18 bp, Homo sapiens
agtggactgaatgtgcct

SEQ ID NO: 3954457 - DNA, 23 bp, Homo sapiens
agtggagtctgagtctgagtcct

SEQ ID NO: 3954458 - DNA, 12 bp, Homo sapiens
agtggatctcaa

SEQ ID NO: 3954459 - DNA, 17 bp, Homo sapiens
agtggatgcattcctga

SEQ ID NO: 3954460 - DNA, 21 bp, Homo sapiens
agtggatggaggagaaataaa

SEQ ID NO: 3954461 - DNA, 15 bp, Homo sapiens
agtggcacggagaga

SEQ ID NO: 3954462 - DNA, 21 bp, Homo sapiens
agtggcagctgtcccctctcc

SEQ ID NO: 3954463 - DNA, 21 bp, Homo sapiens
agtggcccctgcccccaaagg

SEQ ID NO: 3954464 - DNA, 24 bp, Homo sapiens
agtggcttgtgattctgggatgga

SEQ ID NO: 3954465 - DNA, 19 bp, Homo sapiens
agtggcttttttcctcctg

SEQ ID NO: 3954466 - DNA, 21 bp, Homo sapiens
agtggcttttttcctcctgtg

SEQ ID NO: 3954467 - DNA, 18 bp, Homo sapiens
agtgggaagtgaagcccc

SEQ ID NO: 3954468 - DNA, 17 bp, Homo sapiens
agtgggagaaaacactt

SEQ ID NO: 3954469 - DNA, 19 bp, Homo sapiens
agtgggccaggacaggccc

SEQ ID NO: 3954470 - DNA, 21 bp, Homo sapiens
agtggggccagggtgggaggg

SEQ ID NO: 3954471 - DNA, 13 bp, Homo sapiens
agtggggctctgg

SEQ ID NO: 3954472 - DNA, 15 bp, Homo sapiens
agtgggggctgtgcc

SEQ ID NO: 3954473 - DNA, 18 bp, Homo sapiens
agtgggtggtggatctgt

SEQ ID NO: 3954474 - DNA, 22 bp, Homo sapiens
agtgggttttattgtccttcag

SEQ ID NO: 3954475 - DNA, 14 bp, Homo sapiens
agtggttgttgcca

SEQ ID NO: 3954476 - DNA, 14 bp, Homo sapiens
agtgtaaggcatag

SEQ ID NO: 3954477 - DNA, 19 bp, Homo sapiens
agtgtagcatcctaaagat

SEQ ID NO: 3954478 - DNA, 20 bp, Homo sapiens
agtgtatggaaataaatgta

SEQ ID NO: 3954479 - DNA, 20 bp, Homo sapiens
agtgtcatatgtaggtgtct

SEQ ID NO: 3954480 - DNA, 20 bp, Homo sapiens
agtgtcatcagaagataact

SEQ ID NO: 3954481 - DNA, 21 bp, Homo sapiens
agtgtccagaccattgtcttc

SEQ ID NO: 3954482 - DNA, 18 bp, Homo sapiens
agtgtccccaaagactac

SEQ ID NO: 3954483 - DNA, 14 bp, Homo sapiens
agtgtcccctccac

SEQ ID NO: 3954484 - DNA, 15 bp, Homo sapiens
agtgtcccctccact

SEQ ID NO: 3954485 - DNA, 21 bp, Homo sapiens
agtgtcccctccactgtcaca

SEQ ID NO: 3954486 - DNA, 16 bp, Homo sapiens
agtgtctggcacacag

SEQ ID NO: 3954487 - DNA, 20 bp, Homo sapiens
agtgtgaatatatggtctgt

SEQ ID NO: 3954488 - DNA, 21 bp, Homo sapiens
agtgtgagcagtgagttacag

SEQ ID NO: 3954489 - DNA, 14 bp, Homo sapiens
agtgtgagtggcag

SEQ ID NO: 3954490 - DNA, 13 bp, Homo sapiens
agtgtgcgtgtgt

SEQ ID NO: 3954491 - DNA, 17 bp, Homo sapiens
agtgtgggaagggagag

SEQ ID NO: 3954492 - DNA, 21 bp, Homo sapiens
agtgtggtagggacttaaaaa

SEQ ID NO: 3954493 - DNA, 11 bp, Homo sapiens
agtgtgtaaag

SEQ ID NO: 3954494 - DNA, 17 bp, Homo sapiens
agtgtgtccttggggca

SEQ ID NO: 3954495 - DNA, 12 bp, Homo sapiens
agtgtgtgtgca

SEQ ID NO: 3954496 - DNA, 15 bp, Homo sapiens
agtgtgtgtgcatgt

SEQ ID NO: 3954497 - DNA, 13 bp, Homo sapiens
agtgtgtgtgtct

SEQ ID NO: 3954498 - DNA, 18 bp, Homo sapiens
agtgttcattttagtgac

SEQ ID NO: 3954499 - DNA, 21 bp, Homo sapiens
agtgttcattttagtgactgt

SEQ ID NO: 3954500 - DNA, 18 bp, Homo sapiens
agtgttccctttcctact

SEQ ID NO: 3954501 - DNA, 20 bp, Homo sapiens
agtgttcctatttggggctt

SEQ ID NO: 3954502 - DNA, 23 bp, Homo sapiens
agtgttctgtgggcttggccttg

SEQ ID NO: 3954503 - DNA, 18 bp, Homo sapiens
agtgttgctcttggaaag

SEQ ID NO: 3954504 - DNA, 15 bp, Homo sapiens
agtgttggctgtgtg

SEQ ID NO: 3954505 - DNA, 16 bp, Homo sapiens
agtgttggctgtgtga

SEQ ID NO: 3954506 - DNA, 16 bp, Homo sapiens
agtgttttctcagaac

SEQ ID NO: 3954507 - DNA, 22 bp, Homo sapiens
agtgttttctcagaacagctga

SEQ ID NO: 3954508 - DNA, 22 bp, Homo sapiens
agttaaaagtgttgattacata

SEQ ID NO: 3954509 - DNA, 21 bp, Homo sapiens
agttaatatatcccagaaatt

SEQ ID NO: 3954510 - DNA, 19 bp, Homo sapiens
agttacacaattaattgtc

SEQ ID NO: 3954511 - DNA, 12 bp, Homo sapiens
agttactcagcc

SEQ ID NO: 3954512 - DNA, 14 bp, Homo sapiens
agttactcagccct

SEQ ID NO: 3954513 - DNA, 15 bp, Homo sapiens
agttactcagccctg

SEQ ID NO: 3954514 - DNA, 16 bp, Homo sapiens
agttactcagccctgg

SEQ ID NO: 3954515 - DNA, 17 bp, Homo sapiens
agttactcagccctggg

SEQ ID NO: 3954516 - DNA, 19 bp, Homo sapiens
agttactcagccctgggcc

SEQ ID NO: 3954517 - DNA, 19 bp, Homo sapiens
agttagaaatctccagtgt

SEQ ID NO: 3954518 - DNA, 19 bp, Homo sapiens
agttagagaatatattttt

SEQ ID NO: 3954519 - DNA, 14 bp, Homo sapiens
agttaggaaataaa

SEQ ID NO: 3954520 - DNA, 18 bp, Homo sapiens
agttaggggagaggaaaa

SEQ ID NO: 3954521 - DNA, 17 bp, Homo sapiens
agttaggtgtgccaaac

SEQ ID NO: 3954522 - DNA, 21 bp, Homo sapiens
agttataagtagcaggccaag

SEQ ID NO: 3954523 - DNA, 16 bp, Homo sapiens
agttatagtttcagat

SEQ ID NO: 3954524 - DNA, 14 bp, Homo sapiens
agttatattcttta

SEQ ID NO: 3954525 - DNA, 17 bp, Homo sapiens
agttatattgaatatat

SEQ ID NO: 3954526 - DNA, 22 bp, Homo sapiens
agttattaacgggcatgtatta

SEQ ID NO: 3954527 - DNA, 23 bp, Homo sapiens
agttattaacgggcatgtattat

SEQ ID NO: 3954528 - DNA, 17 bp, Homo sapiens
agttattgaatcttaat

SEQ ID NO: 3954529 - DNA, 21 bp, Homo sapiens
agttattgaatcttaattttt

SEQ ID NO: 3954530 - DNA, 12 bp, Homo sapiens
agttattgtaca

SEQ ID NO: 3954531 - DNA, 22 bp, Homo sapiens
agttatttatgcctctgtattt

SEQ ID NO: 3954532 - DNA, 12 bp, Homo sapiens
agttattttagg

SEQ ID NO: 3954533 - DNA, 13 bp, Homo sapiens
agttattttagga

SEQ ID NO: 3954534 - DNA, 16 bp, Homo sapiens
agttcaaatcctcacc

SEQ ID NO: 3954535 - DNA, 17 bp, Homo sapiens
agttcaaatcctcacca

SEQ ID NO: 3954536 - DNA, 20 bp, Homo sapiens
agttcaacctggtggcacca

SEQ ID NO: 3954537 - DNA, 17 bp, Homo sapiens
agtcacccttctgggca

SEQ ID NO: 3954538 - DNA, 20 bp, Homo sapiens
agtcacctcctccactcact

SEQ ID NO: 3954539 - DNA, 22 bp, Homo sapiens
agtcacctgcaagccccagggc

SEQ ID NO: 3954540 - DNA, 23 bp, Homo sapiens
agtcacctgcaagccccagggcc

SEQ ID NO: 3954541 - DNA, 21 bp, Homo sapiens
agtcagacatttggtatatta

SEQ ID NO: 3954542 - DNA, 17 bp, Homo sapiens
agtcagagagagtgttt

SEQ ID NO: 3954543 - DNA, 20 bp, Homo sapiens
agtcagaggagaagagacat

SEQ ID NO: 3954544 - DNA, 22 bp, Homo sapiens
agtcagggtgggaagaaagaat

SEQ ID NO: 3954545 - DNA, 21 bp, Homo sapiens
agtcagtaggtccaagggcca

SEQ ID NO: 3954546 - DNA, 16 bp, Homo sapiens
agtcatgatctccctg

SEQ ID NO: 3954547 - DNA, 19 bp, Homo sapiens
agtcattgggttttatcag

SEQ ID NO: 3954548 - DNA, 18 bp, Homo sapiens
agtcattgtcgctcagca

SEQ ID NO: 3954549 - DNA, 12 bp, Homo sapiens
agtccaacctgc

SEQ ID NO: 3954550 - DNA, 12 bp, Homo sapiens
agtccaatattt

SEQ ID NO: 3954551 - DNA, 20 bp, Homo sapiens
agtccagaataagtgctgtt

SEQ ID NO: 3954552 - DNA, 21 bp, Homo sapiens
agtccagatgccttcctgtct

SEQ ID NO: 3954553 - DNA, 14 bp, Homo sapiens
agtccagggcggga

SEQ ID NO: 3954554 - DNA, 13 bp, Homo sapiens
agtccaggtcctg

SEQ ID NO: 3954555 - DNA, 19 bp, Homo sapiens
agtccaggtcctggtgggg

SEQ ID NO: 3954556 - DNA, 13 bp, Homo sapiens
agtccccagccct

SEQ ID NO: 3954557 - DNA, 22 bp, Homo sapiens
agtccccatcagcaccatggag

SEQ ID NO: 3954558 - DNA, 23 bp, Homo sapiens
agtccccgtgccccgcctccccg

SEQ ID NO: 3954559 - DNA, 20 bp, Homo sapiens
agtcctagagctcctgtccc

SEQ ID NO: 3954560 - DNA, 13 bp, Homo sapiens
agtcctcacagcc

SEQ ID NO: 3954561 - DNA, 14 bp, Homo sapiens
agtcctcacagcct

SEQ ID NO: 3954562 - DNA, 21 bp, Homo sapiens
agtcctcacagcctctccctt

SEQ ID NO: 3954563 - DNA, 22 bp, Homo sapiens
agtcctctcttctctattcctg

SEQ ID NO: 3954564 - DNA, 18 bp, Homo sapiens
agtcctgcagaggattta

SEQ ID NO: 3954565 - DNA, 17 bp, Homo sapiens
agtcctgtctctgcctg

SEQ ID NO: 3954566 - DNA, 16 bp, Homo sapiens
agtcctgtgaatttct

SEQ ID NO: 3954567 - DNA, 16 bp, Homo sapiens
agtccttggtctgctg

SEQ ID NO: 3954568 - DNA, 21 bp, Homo sapiens
agtcgaattaatagcttttat

SEQ ID NO: 3954569 - DNA, 22 bp, Homo sapiens
agtcgtcatcacttttcagtga

SEQ ID NO: 3954570 - DNA, 17 bp, Homo sapiens
agtcgtccttactcctg

SEQ ID NO: 3954571 - DNA, 20 bp, Homo sapiens
agtcgtccttactcctgtgg

SEQ ID NO: 3954572 - DNA, 17 bp, Homo sapiens
agtctaaagtttacagt

SEQ ID NO: 3954573 - DNA, 18 bp, Homo sapiens
agtctaatctctaaatca

SEQ ID NO: 3954574 - DNA, 20 bp, Homo sapiens
agtctacgttctccagccca

SEQ ID NO: 3954575 - DNA, 16 bp, Homo sapiens
agtctaggagctggga

SEQ ID NO: 3954576 - DNA, 15 bp, Homo sapiens
agtctagtgaagatg

SEQ ID NO: 3954577 - DNA, 18 bp, Homo sapiens
agtctagtgaagatgttg

SEQ ID NO: 3954578 - DNA, 13 bp, Homo sapiens
agtctcaggaaat

SEQ ID NO: 3954579 - DNA, 22 bp, Homo sapiens
agtctcaggaaatcaaatatgc

SEQ ID NO: 3954580 - DNA, 13 bp, Homo sapiens
agtctcagtccag

SEQ ID NO: 3954581 - DNA, 16 bp, Homo sapiens
agtctcagtccagatg

SEQ ID NO: 3954582 - DNA, 20 bp, Homo sapiens
agtctcattctgttgcccag

SEQ ID NO: 3954583 - DNA, 14 bp, Homo sapiens
agtctctctctccc

SEQ ID NO: 3954584 - DNA, 15 bp, Homo sapiens
agtctctctctccct

SEQ ID NO: 3954585 - DNA, 23 bp, Homo sapiens
agtctctgtataatctatttaca

SEQ ID NO: 3954586 - DNA, 16 bp, Homo sapiens
agtctcttctccactg

SEQ ID NO: 3954587 - DNA, 18 bp, Homo sapiens
agtctcttctccactgga

SEQ ID NO: 3954588 - DNA, 19 bp, Homo sapiens
agtctcttctccactggat

SEQ ID NO: 3954589 - DNA, 18 bp, Homo sapiens
agtctcttttttattctg

SEQ ID NO: 3954590 - DNA, 17 bp, Homo sapiens
agtctgaacccttgtgc

SEQ ID NO: 3954591 - DNA, 18 bp, Homo sapiens
agtctgaacccttgtgct

SEQ ID NO: 3954592 - DNA, 19 bp, Homo sapiens
agtctgaacccttgtgctt

SEQ ID NO: 3954593 - DNA, 17 bp, Homo sapiens
agtctgagcccccggct

SEQ ID NO: 3954594 - DNA, 17 bp, Homo sapiens
agtctgaggtcctgagc

SEQ ID NO: 3954595 - DNA, 18 bp, Homo sapiens
agtctgaggtcctgagca

SEQ ID NO: 3954596 - DNA, 20 bp, Homo sapiens
agtctgaggtcctgagcact

SEQ ID NO: 3954597 - DNA, 22 bp, Homo sapiens
agtctgaggtcctgagcactgc

SEQ ID NO: 3954598 - DNA, 14 bp, Homo sapiens
agtctgagtctgag

SEQ ID NO: 3954599 - DNA, 23 bp, Homo sapiens
agtctgcgtctctgctttaaagt

SEQ ID NO: 3954600 - DNA, 17 bp, Homo sapiens
agtctgggatgtagaac

SEQ ID NO: 3954601 - DNA, 21 bp, Homo sapiens
agtctgggcaatgaaaccaaa

SEQ ID NO: 3954602 - DNA, 22 bp, Homo sapiens
agtctgtgtgatgaactttctc

SEQ ID NO: 3954603 - DNA, 17 bp, Homo sapiens
agtcttaaaataactta

SEQ ID NO: 3954604 - DNA, 17 bp, Homo sapiens
agtcttacttaaaaaaa

SEQ ID NO: 3954605 - DNA, 17 bp, Homo sapiens
agtcttcttcacccgct

SEQ ID NO: 3954606 - DNA, 14 bp, Homo sapiens
agtcttgcagctga

SEQ ID NO: 3954607 - DNA, 13 bp, Homo sapiens
agtcttgcctagg

SEQ ID NO: 3954608 - DNA, 20 bp, Homo sapiens
agtcttggcctgcctcccag

SEQ ID NO: 3954609 - DNA, 14 bp, Homo sapiens
agtctttaatccca

SEQ ID NO: 3954610 - DNA, 12 bp, Homo sapiens
agtcttttactc

SEQ ID NO: 3954611 - DNA, 16 bp, Homo sapiens
agtgaaagaggcagct

SEQ ID NO: 3954612 - DNA, 22 bp, Homo sapiens
agtgaaagaggcagcttgaaac

SEQ ID NO: 3954613 - DNA, 18 bp, Homo sapiens
agtgaaagggctatggca

SEQ ID NO: 3954614 - DNA, 19 bp, Homo sapiens
agtgaacaactatttataa

SEQ ID NO: 3954615 - DNA, 15 bp, Homo sapiens
agtgaaccaaagaga

SEQ ID NO: 3954616 - DNA, 22 bp, Homo sapiens
agtgaaccaaagagactggagc

SEQ ID NO: 3954617 - DNA, 23 bp, Homo sapiens
agtgaacctttaaagtaaaggcc

SEQ ID NO: 3954618 - DNA, 16 bp, Homo sapiens
agtgaagaaaagtgaa

SEQ ID NO: 3954619 - DNA, 23 bp, Homo sapiens
agtgaagaaaagtgaatgctcaa

SEQ ID NO: 3954620 - DNA, 18 bp, Homo sapiens
agtgaagccccttgtcct

SEQ ID NO: 3954621 - DNA, 20 bp, Homo sapiens
agtgaaggagaaaggagccg

SEQ ID NO: 3954622 - DNA, 19 bp, Homo sapiens
agtgaagttgcttcttcta

SEQ ID NO: 3954623 - DNA, 13 bp, Homo sapiens
agtgaataaactt

SEQ ID NO: 3954624 - DNA, 14 bp, Homo sapiens
agtgaataaacttc

SEQ ID NO: 3954625 - DNA, 19 bp, Homo sapiens
agtgaataaacttcagcac

SEQ ID NO: 3954626 - DNA, 20 bp, Homo sapiens
agtgaataaacttcagcacc

SEQ ID NO: 3954627 - DNA, 16 bp, Homo sapiens
agtgaatagctttcag

SEQ ID NO: 3954628 - DNA, 21 bp, Homo sapiens
agtgacaaattgtaactacac

SEQ ID NO: 3954629 - DNA, 17 bp, Homo sapiens
agtgacccacatgccat

SEQ ID NO: 3954630 - DNA, 15 bp, Homo sapiens
agtgacccagatatt

SEQ ID NO: 3954631 - DNA, 22 bp, Homo sapiens
agtgacccagatattgcactag

SEQ ID NO: 3954632 - DNA, 21 bp, Homo sapiens
agtgacccttcccaatcagca

SEQ ID NO: 3954633 - DNA, 20 bp, Homo sapiens
agtgacctgaccggcacctg

SEQ ID NO: 3954634 - DNA, 22 bp, Homo sapiens
agtgacctgaccggcacctgcg

SEQ ID NO: 3954635 - DNA, 14 bp, Homo sapiens
agtgactggcaggt

SEQ ID NO: 3954636 - DNA, 16 bp, Homo sapiens
agtgactgtaattaat

SEQ ID NO: 3954637 - DNA, 23 bp, Homo sapiens
agtgactgtcgtgtttacaaaag

SEQ ID NO: 3954638 - DNA, 13 bp, Homo sapiens
agtgagacacaga

SEQ ID NO: 3954639 - DNA, 14 bp, Homo sapiens
agtgagacacagag

SEQ ID NO: 3954640 - DNA, 12 bp, Homo sapiens
agtgagacagaa

SEQ ID NO: 3954641 - DNA, 13 bp, Homo sapiens
agtgagcagtaga

SEQ ID NO: 3954642 - DNA, 19 bp, Homo sapiens
agtgagccgcatcttctcc

SEQ ID NO: 3954643 - DNA, 21 bp, Homo sapiens
agtgagcctgaattttgttgc

SEQ ID NO: 3954644 - DNA, 12 bp, Homo sapiens
agtgagggctgg

SEQ ID NO: 3954645 - DNA, 13 bp, Homo sapiens
agtgagggctggg

SEQ ID NO: 3954646 - DNA, 19 bp, Homo sapiens
agtgagttgttgccctggg

SEQ ID NO: 3954647 - DNA, 19 bp, Homo sapiens
agtgataatttctggaatt

SEQ ID NO: 3954648 - DNA, 19 bp, Homo sapiens
agtgatctgtcccctctcc

SEQ ID NO: 3954649 - DNA, 19 bp, Homo sapiens
agtgatggcgcgggaggca

SEQ ID NO: 3954650 - DNA, 20 bp, Homo sapiens
agtgatggcgcgggaggcac

SEQ ID NO: 3954651 - DNA, 17 bp, Homo sapiens
agtgatgtttttatgat

SEQ ID NO: 3954652 - DNA, 15 bp, Homo sapiens
agtgcaaagtgccct

SEQ ID NO: 3954653 - DNA, 19 bp, Homo sapiens
agtgcaaatactccaagct

SEQ ID NO: 3954654 - DNA, 20 bp, Homo sapiens
agtgcaaatactccaagctt

SEQ ID NO: 3954655 - DNA, 15 bp, Homo sapiens
agtgcaacaaaatca

SEQ ID NO: 3954656 - DNA, 16 bp, Homo sapiens
agtgcaacaaaatcaa

SEQ ID NO: 3954657 - DNA, 16 bp, Homo sapiens
agtgcaaccacacacc

SEQ ID NO: 3954658 - DNA, 24 bp, Homo sapiens
agtgcaaccacacacctcaccaga

SEQ ID NO: 3954659 - DNA, 16 bp, Homo sapiens
agtgcacacagaaata

SEQ ID NO: 3954660 - DNA, 20 bp, Homo sapiens
agtgcacacagaaatatata

SEQ ID NO: 3954661 - DNA, 15 bp, Homo sapiens
agtgcagcccttcct

SEQ ID NO: 3954662 - DNA, 18 bp, Homo sapiens
agtgcagcccttcctcct

SEQ ID NO: 3954663 - DNA, 20 bp, Homo sapiens
agtgcagcccttcctcctga

SEQ ID NO: 3954664 - DNA, 21 bp, Homo sapiens
agtgcagcccttcctcctgaa

SEQ ID NO: 3954665 - DNA, 19 bp, Homo sapiens
agtgcagtagtaattgatt

SEQ ID NO: 3954666 - DNA, 14 bp, Homo sapiens
agtgcatctcagcc

SEQ ID NO: 3954667 - DNA, 15 bp, Homo sapiens
agtgcatctcagccc

SEQ ID NO: 3954668 - DNA, 17 bp, Homo sapiens
agtgcatctcagcccac

SEQ ID NO: 3954669 - DNA, 16 bp, Homo sapiens
agtgcatgctctctgc

SEQ ID NO: 3954670 - DNA, 15 bp, Homo sapiens
agtgcattttcccag

SEQ ID NO: 3954671 - DNA, 19 bp, Homo sapiens
agtgccaaggttgtcctgg

SEQ ID NO: 3954672 - DNA, 10 bp, Homo sapiens
agtgccacag

SEQ ID NO: 3954673 - DNA, 15 bp, Homo sapiens
agtgccacagagaag

SEQ ID NO: 3954674 - DNA, 19 bp, Homo sapiens
agtgccacttgacattcct

SEQ ID NO: 3954675 - DNA, 24 bp, Homo sapiens
agtgccaggactccccaggccagg

SEQ ID NO: 3954676 - DNA, 16 bp, Homo sapiens
agtgcccccacccagt

SEQ ID NO: 3954677 - DNA, 20 bp, Homo sapiens
agtgcccgcctaggagttga

SEQ ID NO: 3954678 - DNA, 11 bp, Homo sapiens
agtgccctcat

SEQ ID NO: 3954679 - DNA, 12 bp, Homo sapiens
agtgcctcctgg

SEQ ID NO: 3954680 - DNA, 15 bp, Homo sapiens
agtgcctcctgggac

SEQ ID NO: 3954681 - DNA, 19 bp, Homo sapiens
agtgccttacctcctgccc

SEQ ID NO: 3954682 - DNA, 20 bp, Homo sapiens
agtgccttacctcctgccca

SEQ ID NO: 3954683 - DNA, 18 bp, Homo sapiens
agtgcgctcttggtccct

SEQ ID NO: 3954684 - DNA, 19 bp, Homo sapiens
agtgcgctcttggtccctg

SEQ ID NO: 3954685 - DNA, 14 bp, Homo sapiens
agtgctactgctag

SEQ ID NO: 3954686 - DNA, 14 bp, Homo sapiens
agtgctatatatat

SEQ ID NO: 3954687 - DNA, 13 bp, Homo sapiens
agtgctattctgt

SEQ ID NO: 3954688 - DNA, 14 bp, Homo sapiens
agtgctattctgtg

SEQ ID NO: 3954689 - DNA, 23 bp, Homo sapiens
agtgctattctgtgttgaacaca

SEQ ID NO: 3954690 - DNA, 12 bp, Homo sapiens
agtgctgagacc

SEQ ID NO: 3954691 - DNA, 15 bp, Homo sapiens
agtgctgccatgcca

SEQ ID NO: 3954692 - DNA, 18 bp, Homo sapiens
agtgctgccatgccactg

SEQ ID NO: 3954693 - DNA, 19 bp, Homo sapiens
agtgctgccatgccactgc

SEQ ID NO: 3954694 - DNA, 22 bp, Homo sapiens
agtgctgccatgccactgccag

SEQ ID NO: 3954695 - DNA, 13 bp, Homo sapiens
agtgctgcttctc

SEQ ID NO: 3954696 - DNA, 19 bp, Homo sapiens
agtgctgcttctcttggga

SEQ ID NO: 3954697 - DNA, 21 bp, Homo sapiens
agtgctgtacccttccacctc

SEQ ID NO: 3954698 - DNA, 12 bp, Homo sapiens
agtgcttagaaa

SEQ ID NO: 3954699 - DNA, 14 bp, Homo sapiens
agtgcttctctaca

SEQ ID NO: 3954700 - DNA, 23 bp, Homo sapiens
agtgctttacatgctgtgctctt

SEQ ID NO: 3954701 - DNA, 14 bp, Homo sapiens
agtggaaaaaagag

SEQ ID NO: 3954702 - DNA, 14 bp, Homo sapiens
agtggaaattcagg

SEQ ID NO: 3954703 - DNA, 21 bp, Homo sapiens
agtggaacagtcacccttctg

SEQ ID NO: 3954704 - DNA, 23 bp, Homo sapiens
agtggaacagtcacccttctggg

SEQ ID NO: 3954705 - DNA, 13 bp, Homo sapiens
agtggaagagcag

SEQ ID NO: 3954706 - DNA, 24 bp, Homo sapiens
agtggaagagcagcctgatggcca

SEQ ID NO: 3954707 - DNA, 17 bp, Homo sapiens
agtggaatgcagggaag

SEQ ID NO: 3954708 - DNA, 15 bp, Homo sapiens
attcctgcatttgtg

SEQ ID NO: 3954709 - DNA, 19 bp, Homo sapiens
attcctggcatgacactct

SEQ ID NO: 3954710 - DNA, 21 bp, Homo sapiens
attcctggcatgacactctag

SEQ ID NO: 3954711 - DNA, 11 bp, Homo sapiens
attcctgggcc

SEQ ID NO: 3954712 - DNA, 16 bp, Homo sapiens
attcctgggcctgtcc

SEQ ID NO: 3954713 - DNA, 23 bp, Homo sapiens
attcctgtagcatcttctggagt

SEQ ID NO: 3954714 - DNA, 13 bp, Homo sapiens
attccttcactca

SEQ ID NO: 3954715 - DNA, 15 bp, Homo sapiens
attccttcccactca

SEQ ID NO: 3954716 - DNA, 21 bp, Homo sapiens
attccttgtcaccagcaacat

SEQ ID NO: 3954717 - DNA, 18 bp, Homo sapiens
attccttttgatggggag

SEQ ID NO: 3954718 - DNA, 17 bp, Homo sapiens
attctagccaaactatt

SEQ ID NO: 3954719 - DNA, 20 bp, Homo sapiens
attctaggcatcccagggga

SEQ ID NO: 3954720 - DNA, 21 bp, Homo sapiens
attctcaacctaccacccctt

SEQ ID NO: 3954721 - DNA, 16 bp, Homo sapiens
attctcactccaccac

SEQ ID NO: 3954722 - DNA, 12 bp, Homo sapiens
attctcatgtga

SEQ ID NO: 3954723 - DNA, 14 bp, Homo sapiens
attctccaaatgat

SEQ ID NO: 3954724 - DNA, 15 bp, Homo sapiens
attctccaaatgatt

SEQ ID NO: 3954725 - DNA, 16 bp, Homo sapiens
attctccaaatgattt

SEQ ID NO: 3954726 - DNA, 22 bp, Homo sapiens
attctccctaaggaatctgaaa

SEQ ID NO: 3954727 - DNA, 17 bp, Homo sapiens
attctcctcctccctcc

SEQ ID NO: 3954728 - DNA, 16 bp, Homo sapiens
attctctcctcagact

SEQ ID NO: 3954729 - DNA, 18 bp, Homo sapiens
attctctcctcagactgc

SEQ ID NO: 3954730 - DNA, 22 bp, Homo sapiens
attctctcctcagactgctcaa

SEQ ID NO: 3954731 - DNA, 12 bp, Homo sapiens
attctctctcct

SEQ ID NO: 3954732 - DNA, 14 bp, Homo sapiens
attctcttcactcc

SEQ ID NO: 3954733 - DNA, 15 bp, Homo sapiens
attctgaatctgaaa

SEQ ID NO: 3954734 - DNA, 14 bp, Homo sapiens
attctgacttcctc

SEQ ID NO: 3954735 - DNA, 13 bp, Homo sapiens
attctgattccac

SEQ ID NO: 3954736 - DNA, 22 bp, Homo sapiens
attctggatggatttgaagcaa

SEQ ID NO: 3954737 - DNA, 22 bp, Homo sapiens
attctggctgcaagggccagag

SEQ ID NO: 3954738 - DNA, 23 bp, Homo sapiens
attctggctgcaagggccagagt

SEQ ID NO: 3954739 - DNA, 22 bp, Homo sapiens
attctgggatggaccctcgcag

SEQ ID NO: 3954740 - DNA, 21 bp, Homo sapiens
attctgggctcctggaaccaa

SEQ ID NO: 3954741 - DNA, 17 bp, Homo sapiens
attctgtcatagaaagt

SEQ ID NO: 3954742 - DNA, 18 bp, Homo sapiens
attctgtcatagaaagtg

SEQ ID NO: 3954743 - DNA, 17 bp, Homo sapiens
attctgtgaagaatgaa

SEQ ID NO: 3954744 - DNA, 11 bp, Homo sapiens
attctgtgttg

SEQ ID NO: 3954745 - DNA, 14 bp, Homo sapiens
attctgtgttgaac

SEQ ID NO: 3954746 - DNA, 22 bp, Homo sapiens
attctgtgttgaacacaattga

SEQ ID NO: 3954747 - DNA, 22 bp, Homo sapiens
attctgttgcccaggctggcct

SEQ ID NO: 3954748 - DNA, 16 bp, Homo sapiens
attcttaaaggaaaag

SEQ ID NO: 3954749 - DNA, 22 bp, Homo sapiens
attcttaagggaacttccacat

SEQ ID NO: 3954750 - DNA, 18 bp, Homo sapiens
attcttaccgagaaaagg

SEQ ID NO: 3954751 - DNA, 20 bp, Homo sapiens
attcttccagtagttgaaca

SEQ ID NO: 3954752 - DNA, 23 bp, Homo sapiens
attcttccgtcacatatacaaaa

SEQ ID NO: 3954753 - DNA, 13 bp, Homo sapiens
attcttctgcagt

SEQ ID NO: 3954754 - DNA, 17 bp, Homo sapiens
attctttatttctgtca

SEQ ID NO: 3954755 - DNA, 15 bp, Homo sapiens
attgaaaaatcacca

SEQ ID NO: 3954756 - DNA, 14 bp, Homo sapiens
attgaaaatgaatg

SEQ ID NO: 3954757 - DNA, 15 bp, Homo sapiens
attgaagaaacagat

SEQ ID NO: 3954758 - DNA, 17 bp, Homo sapiens
attgaagaaacagatac

SEQ ID NO: 3954759 - DNA, 23 bp, Homo sapiens
attgaagagatttcaacatatca

SEQ ID NO: 3954760 - DNA, 16 bp, Homo sapiens
attgacaacattttat

SEQ ID NO: 3954761 - DNA, 18 bp, Homo sapiens
attgacaaggtagacatg

SEQ ID NO: 3954762 - DNA, 19 bp, Homo sapiens
attgacaaggtagacatgg

SEQ ID NO: 3954763 - DNA, 21 bp, Homo sapiens
attgacaaggtagacatggat

SEQ ID NO: 3954764 - DNA, 20 bp, Homo sapiens
attgacctcagctgcacatt

SEQ ID NO: 3954765 - DNA, 22 bp, Homo sapiens
attgactcaaatctccagtatt

SEQ ID NO: 3954766 - DNA, 23 bp, Homo sapiens
attgacttcttggtttggggaga

SEQ ID NO: 3954767 - DNA, 20 bp, Homo sapiens
attgagaagttttgtacaga

SEQ ID NO: 3954768 - DNA, 13 bp, Homo sapiens
attgagaatttta

SEQ ID NO: 3954769 - DNA, 21 bp, Homo sapiens
attgagaattttaaattataa

SEQ ID NO: 3954770 - DNA, 14 bp, Homo sapiens
attgatacttcagg

SEQ ID NO: 3954771 - DNA, 16 bp, Homo sapiens
attgatacttcaggtg

SEQ ID NO: 3954772 - DNA, 21 bp, Homo sapiens
attgatacttcaggtgctttt

SEQ ID NO: 3954773 - DNA, 15 bp, Homo sapiens
attgatcaaattcat

SEQ ID NO: 3954774 - DNA, 17 bp, Homo sapiens
attgatcaaattcattt

SEQ ID NO: 3954775 - DNA, 17 bp, Homo sapiens
attgatcttttcagtgt

SEQ ID NO: 3954776 - DNA, 16 bp, Homo sapiens
attgatgtttccagaa

SEQ ID NO: 3954777 - DNA, 21 bp, Homo sapiens
attgatgtttccagaaaatat

SEQ ID NO: 3954778 - DNA, 22 bp, Homo sapiens
attgatgtttccagaaaatata

SEQ ID NO: 3954779 - DNA, 18 bp, Homo sapiens
attgcaaagtgcgctcat

SEQ ID NO: 3954780 - DNA, 9 bp, Homo sapiens
attgcacaa

SEQ ID NO: 3954781 - DNA, 13 bp, Homo sapiens
attgcacaatttg

SEQ ID NO: 3954782 - DNA, 18 bp, Homo sapiens
attgcacaatttgagcaa

SEQ ID NO: 3954783 - DNA, 13 bp, Homo sapiens
attgcacttttaa

SEQ ID NO: 3954784 - DNA, 22 bp, Homo sapiens
attgcatcacctctgtaatttt

SEQ ID NO: 3954785 - DNA, 16 bp, Homo sapiens
attgcatgtaaaatgc

SEQ ID NO: 3954786 - DNA, 17 bp, Homo sapiens
attgcatgtaaaatgca

SEQ ID NO: 3954787 - DNA, 18 bp, Homo sapiens
attgcatgtaaaatgcag

SEQ ID NO: 3954788 - DNA, 17 bp, Homo sapiens
attgcatttcctgacag

SEQ ID NO: 3954789 - DNA, 18 bp, Homo sapiens
atttctaccatttcagag

SEQ ID NO: 3954790 - DNA, 17 bp, Homo sapiens
atttctactgtgactga

SEQ ID NO: 3954791 - DNA, 18 bp, Homo sapiens
atttctactgtgactgat

SEQ ID NO: 3954792 - DNA, 13 bp, Homo sapiens
atttctagcagag

SEQ ID NO: 3954793 - DNA, 16 bp, Homo sapiens
atttctagcagagtga

SEQ ID NO: 3954794 - DNA, 16 bp, Homo sapiens
atttctcaatcagtgc

SEQ ID NO: 3954795 - DNA, 14 bp, Homo sapiens
atttctctccccac

SEQ ID NO: 3954796 - DNA, 20 bp, Homo sapiens
atttctctccccactgaaaa

SEQ ID NO: 3954797 - DNA, 18 bp, Homo sapiens
atttctctgaacagaaaa

SEQ ID NO: 3954798 - DNA, 13 bp, Homo sapiens
atttctctgagca

SEQ ID NO: 3954799 - DNA, 13 bp, Homo sapiens
atttctgaaatga

SEQ ID NO: 3954800 - DNA, 15 bp, Homo sapiens
atttctgctcttcca

SEQ ID NO: 3954801 - DNA, 12 bp, Homo sapiens
atttctggcctc

SEQ ID NO: 3954802 - DNA, 16 bp, Homo sapiens
atttctggcctcagca

SEQ ID NO: 3954803 - DNA, 18 bp, Homo sapiens
atttctggcctcagcagg

SEQ ID NO: 3954804 - DNA, 23 bp, Homo sapiens
atttcttcgctgctctagctggc

SEQ ID NO: 3954805 - DNA, 16 bp, Homo sapiens
atttctttgtgataac

SEQ ID NO: 3954806 - DNA, 21 bp, Homo sapiens
atttctttgtgataacaaaga

SEQ ID NO: 3954807 - DNA, 16 bp, Homo sapiens
atttcttttaaagaag

SEQ ID NO: 3954808 - DNA, 17 bp, Homo sapiens
atttcttttaaagaagt

SEQ ID NO: 3954809 - DNA, 21 bp, Homo sapiens
atttcttttaaagaagtaaat

SEQ ID NO: 3954810 - DNA, 22 bp, Homo sapiens
atttgaaaacataatctgcaaa

SEQ ID NO: 3954811 - DNA, 18 bp, Homo sapiens
atttgaaattttatttag

SEQ ID NO: 3954812 - DNA, 22 bp, Homo sapiens
atttgaatatcattaaattgga

SEQ ID NO: 3954813 - DNA, 14 bp, Homo sapiens
atttgacagtgtgg

SEQ ID NO: 3954814 - DNA, 22 bp, Homo sapiens
atttgaggagcagcttcagttg

SEQ ID NO: 3954815 - DNA, 23 bp, Homo sapiens
atttgaggagcagcttcagttgt

SEQ ID NO: 3954816 - DNA, 15 bp, Homo sapiens
atttgataaactaaa

SEQ ID NO: 3954817 - DNA, 13 bp, Homo sapiens
atttgatacaaaa

SEQ ID NO: 3954818 - DNA, 16 bp, Homo sapiens
atttgatgtacatgtg

SEQ ID NO: 3954819 - DNA, 18 bp, Homo sapiens
atttgatgtacatgtgta

SEQ ID NO: 3954820 - DNA, 16 bp, Homo sapiens
atttgccagcacaggg

SEQ ID NO: 3954821 - DNA, 17 bp, Homo sapiens
atttgccattcctggaa

SEQ ID NO: 3954822 - DNA, 18 bp, Homo sapiens
atttgcctaattcctggc

SEQ ID NO: 3954823 - DNA, 20 bp, Homo sapiens
atttgcctaattcctggcat

SEQ ID NO: 3954824 - DNA, 17 bp, Homo sapiens
atttgccttctccctgg

SEQ ID NO: 3954825 - DNA, 17 bp, Homo sapiens
atttgctatcaaaataa

SEQ ID NO: 3954826 - DNA, 13 bp, Homo sapiens
atttggaaagaga

SEQ ID NO: 3954827 - DNA, 16 bp, Homo sapiens
atttggaaagagacca

SEQ ID NO: 3954828 - DNA, 16 bp, Homo sapiens
atttggaagagaggca

SEQ ID NO: 3954829 - DNA, 18 bp, Homo sapiens
atttggtttagaacataa

SEQ ID NO: 3954830 - DNA, 18 bp, Homo sapiens
atttgtaagttgtgtgca

SEQ ID NO: 3954831 - DNA, 14 bp, Homo sapiens
atttgtaagtttat

SEQ ID NO: 3954832 - DNA, 23 bp, Homo sapiens
atttgtaagtttatgtctaaaga

SEQ ID NO: 3954833 - DNA, 19 bp, Homo sapiens
atttgtaattgcttacatt

SEQ ID NO: 3954834 - DNA, 23 bp, Homo sapiens
atttgtaattgcttacattttta

SEQ ID NO: 3954835 - DNA, 16 bp, Homo sapiens
atttgtacaaatactg

SEQ ID NO: 3954836 - DNA, 13 bp, Homo sapiens
atttgtacagttc

SEQ ID NO: 3954837 - DNA, 15 bp, Homo sapiens
atttgtacagttcag

SEQ ID NO: 3954838 - DNA, 16 bp, Homo sapiens
atttgtacatatgtaa

SEQ ID NO: 3954839 - DNA, 21 bp, Homo sapiens
atttgtacatatgtaaaataa

SEQ ID NO: 3954840 - DNA, 15 bp, Homo sapiens
atttgtatatcatga

SEQ ID NO: 3954841 - DNA, 15 bp, Homo sapiens
atttgtatcacaaat

SEQ ID NO: 3954842 - DNA, 21 bp, Homo sapiens
atttgtatctgaaggagattt

SEQ ID NO: 3954843 - DNA, 11 bp, Homo sapiens
atttgtatttt

SEQ ID NO: 3954844 - DNA, 14 bp, Homo sapiens
atttgtattttaaa

SEQ ID NO: 3954845 - DNA, 22 bp, Homo sapiens
atttgtattttgcttaaaattt

SEQ ID NO: 3954846 - DNA, 21 bp, Homo sapiens
atttgtccaatggctgtaaac

SEQ ID NO: 3954847 - DNA, 15 bp, Homo sapiens
atttgtccaattctc

SEQ ID NO: 3954848 - DNA, 23 bp, Homo sapiens
atttgtgaaatgatggtgaaagt

SEQ ID NO: 3954849 - DNA, 16 bp, Homo sapiens
atttgtgtatgtgtat

SEQ ID NO: 3954850 - DNA, 16 bp, Homo sapiens
atttgttcacatgcat

SEQ ID NO: 3954851 - DNA, 14 bp, Homo sapiens
atttgttcccaaga

SEQ ID NO: 3954852 - DNA, 13 bp, Homo sapiens
atttgttggaatg

SEQ ID NO: 3954853 - DNA, 17 bp, Homo sapiens
atttgtttatatttaat

SEQ ID NO: 3954854 - DNA, 14 bp, Homo sapiens
attttaaaaaatga

SEQ ID NO: 3954855 - DNA, 17 bp, Homo sapiens
attttaaaaccatgcag

SEQ ID NO: 3954856 - DNA, 20 bp, Homo sapiens
attttaaaaccatgcagctt

SEQ ID NO: 3954857 - DNA, 22 bp, Homo sapiens
attttaaaagcaattatattgt

SEQ ID NO: 3954858 - DNA, 17 bp, Homo sapiens
attttaaacaaaataga

SEQ ID NO: 3954859 - DNA, 16 bp, Homo sapiens
attttaaattcacaat

SEQ ID NO: 3954860 - DNA, 16 bp, Homo sapiens
attttaatattttgta

SEQ ID NO: 3954861 - DNA, 14 bp, Homo sapiens
attttaatttatat

SEQ ID NO: 3954862 - DNA, 15 bp, Homo sapiens
attttacagagaatc

SEQ ID NO: 3954863 - DNA, 16 bp, Homo sapiens
attttactacttgtta

SEQ ID NO: 3954864 - DNA, 22 bp, Homo sapiens
attttactacttgttacctttc

SEQ ID NO: 3954865 - DNA, 23 bp, Homo sapiens
attttagagcataccagtactca

SEQ ID NO: 3954866 - DNA, 16 bp, Homo sapiens
attttagctgcagaac

SEQ ID NO: 3954867 - DNA, 19 bp, Homo sapiens
attttaggagacagtctca

SEQ ID NO: 3954868 - DNA, 17 bp, Homo sapiens
attttaggcagggattt

SEQ ID NO: 3954869 - DNA, 14 bp, Homo sapiens
attttaggcctcct

SEQ ID NO: 3954870 - DNA, 17 bp, Homo sapiens
attttaggcctcctctc

SEQ ID NO: 3954871 - DNA, 16 bp, Homo sapiens
attttagggctgtaga

SEQ ID NO: 3954872 - DNA, 14 bp, Homo sapiens
attttagtgactgt

SEQ ID NO: 3954873 - DNA, 12 bp, Homo sapiens
attttatacata

SEQ ID NO: 3954874 - DNA, 14 bp, Homo sapiens
attttatacatagt

SEQ ID NO: 3954875 - DNA, 17 bp, Homo sapiens
attttatacatagtcac

SEQ ID NO: 3954876 - DNA, 18 bp, Homo sapiens
ataaaaaccagaatcata

SEQ ID NO: 3954877 - DNA, 23 bp, Homo sapiens
ataaaaatatatatagtgctata

SEQ ID NO: 3954878 - DNA, 22 bp, Homo sapiens
ataaaacattatgctccagaaa

SEQ ID NO: 3954879 - DNA, 16 bp, Homo sapiens
ataaaacccagcatgt

SEQ ID NO: 3954880 - DNA, 16 bp, Homo sapiens
ataaaactaaatatat

SEQ ID NO: 3954881 - DNA, 18 bp, Homo sapiens
ataaaactcagttaaaat

SEQ ID NO: 3954882 - DNA, 19 bp, Homo sapiens
ataaaactcagttaaaatg

SEQ ID NO: 3954883 - DNA, 15 bp, Homo sapiens
ataaaagcataaatg

SEQ ID NO: 3954884 - DNA, 13 bp, Homo sapiens
ataaaagtgactc

SEQ ID NO: 3954885 - DNA, 22 bp, Homo sapiens
ataaaatactctagcctgggcc

SEQ ID NO: 3954886 - DNA, 17 bp, Homo sapiens
ataaaatgaaatgtctt

SEQ ID NO: 3954887 - DNA, 13 bp, Homo sapiens
ataaaattagaaa

SEQ ID NO: 3954888 - DNA, 19 bp, Homo sapiens
ataaaattatggtgaaatt

SEQ ID NO: 3954889 - DNA, 13 bp, Homo sapiens
ataaacattaaac

SEQ ID NO: 3954890 - DNA, 17 bp, Homo sapiens
ataaacattaaacactg

SEQ ID NO: 3954891 - DNA, 23 bp, Homo sapiens
ataaacattaagattgaggcctg

SEQ ID NO: 3954892 - DNA, 16 bp, Homo sapiens
ataaacctggagatga

SEQ ID NO: 3954893 - DNA, 17 bp, Homo sapiens
ataaacctggagatgat

SEQ ID NO: 3954894 - DNA, 19 bp, Homo sapiens
ataaacctggagatgatga

SEQ ID NO: 3954895 - DNA, 15 bp, Homo sapiens
ataaactagatctcc

SEQ ID NO: 3954896 - DNA, 14 bp, Homo sapiens
ataaactagtttcc

SEQ ID NO: 3954897 - DNA, 15 bp, Homo sapiens
ataaactagtttcca

SEQ ID NO: 3954898 - DNA, 18 bp, Homo sapiens
ataaactagtttccagtg

SEQ ID NO: 3954899 - DNA, 19 bp, Homo sapiens
ataaactagtttccagtgg

SEQ ID NO: 3954900 - DNA, 21 bp, Homo sapiens
ataaacttagaataaaattgt

SEQ ID NO: 3954901 - DNA, 12 bp, Homo sapiens
ataaacttcagc

SEQ ID NO: 3954902 - DNA, 15 bp, Homo sapiens
ataaacttcagcacc

SEQ ID NO: 3954903 - DNA, 16 bp, Homo sapiens
ataaacttcagcacca

SEQ ID NO: 3954904 - DNA, 15 bp, Homo sapiens
ataaacttgtgtatg

SEQ ID NO: 3954905 - DNA, 13 bp, Homo sapiens
ataaagacagctg

SEQ ID NO: 3954906 - DNA, 13 bp, Homo sapiens
ataaagagttaga

SEQ ID NO: 3954907 - DNA, 11 bp, Homo sapiens
ataaagatgat

SEQ ID NO: 3954908 - DNA, 14 bp, Homo sapiens
ataaagatgatcta

SEQ ID NO: 3954909 - DNA, 19 bp, Homo sapiens
ataaagatgatctactcag

SEQ ID NO: 3954910 - DNA, 15 bp, Homo sapiens
ataaagcaagctcaa

SEQ ID NO: 3954911 - DNA, 16 bp, Homo sapiens
ataaagcaagctcaac

SEQ ID NO: 3954912 - DNA, 15 bp, Homo sapiens
ataaagcagtagaca

SEQ ID NO: 3954913 - DNA, 20 bp, Homo sapiens
ataaagctggacaagaagct

SEQ ID NO: 3954914 - DNA, 18 bp, Homo sapiens
ataaaggaagtcaccaaa

SEQ ID NO: 3954915 - DNA, 19 bp, Homo sapiens
ataaaggaagtcaccaaaa

SEQ ID NO: 3954916 - DNA, 15 bp, Homo sapiens
ataaaggtctttgca

SEQ ID NO: 3954917 - DNA, 22 bp, Homo sapiens
ataaaggtctttgcacatgtga

SEQ ID NO: 3954918 - DNA, 16 bp, Homo sapiens
ataaaggttgacaata

SEQ ID NO: 3954919 - DNA, 22 bp, Homo sapiens
ataaaggttgacaataaatgtg

SEQ ID NO: 3954920 - DNA, 13 bp, Homo sapiens
ataaataaatgcc

SEQ ID NO: 3954921 - DNA, 14 bp, Homo sapiens
ataaataaatgcca

SEQ ID NO: 3954922 - DNA, 13 bp, Homo sapiens
ataaataataaag

SEQ ID NO: 3954923 - DNA, 20 bp, Homo sapiens
ataaatagatttgattattt

SEQ ID NO: 3954924 - DNA, 21 bp, Homo sapiens
ataaatatatatttttcaacc

SEQ ID NO: 3954925 - DNA, 21 bp, Homo sapiens
ataaatctgagcctaaatcta

SEQ ID NO: 3954926 - DNA, 13 bp, Homo sapiens
ataaatgcatgat

SEQ ID NO: 3954927 - DNA, 13 bp, Homo sapiens
ataaatggaaatc

SEQ ID NO: 3954928 - DNA, 15 bp, Homo sapiens
ataaatggaaatcat

SEQ ID NO: 3954929 - DNA, 21 bp, Homo sapiens
ataaatgtatatacacatata

SEQ ID NO: 3954930 - DNA, 21 bp, Homo sapiens
ataaatgtatcatagaaatgt

SEQ ID NO: 3954931 - DNA, 16 bp, Homo sapiens
ataaatgtgtaaatgt

SEQ ID NO: 3954932 - DNA, 19 bp, Homo sapiens
ataaatgtgtaaatgtgga

SEQ ID NO: 3954933 - DNA, 12 bp, Homo sapiens
ataaatgtgtgg

SEQ ID NO: 3954934 - DNA, 20 bp, Homo sapiens
ataaatgtttaaatataaat

SEQ ID NO: 3954935 - DNA, 13 bp, Homo sapiens
ataaattaagact

SEQ ID NO: 3954936 - DNA, 23 bp, Homo sapiens
ataaattatattaatttttgaaa

SEQ ID NO: 3954937 - DNA, 12 bp, Homo sapiens
ataaattcagat

SEQ ID NO: 3954938 - DNA, 14 bp, Homo sapiens
ataaattgaaatat

SEQ ID NO: 3954939 - DNA, 13 bp, Homo sapiens
ataaattgctcct

SEQ ID NO: 3954940 - DNA, 13 bp, Homo sapiens
ataaattgtttga

SEQ ID NO: 3954941 - DNA, 13 bp, Homo sapiens
ataacaagaaaat

SEQ ID NO: 3954942 - DNA, 14 bp, Homo sapiens
ataacaagatcttt

SEQ ID NO: 3954943 - DNA, 17 bp, Homo sapiens
attttattaaagcaaca

SEQ ID NO: 3954944 - DNA, 21 bp, Homo sapiens
attttattaaagcaacatttt

SEQ ID NO: 3954945 - DNA, 14 bp, Homo sapiens
attttatttgacaa

SEQ ID NO: 3954946 - DNA, 12 bp, Homo sapiens
attttatttgta

SEQ ID NO: 3954947 - DNA, 15 bp, Homo sapiens
attttatttgtattc

SEQ ID NO: 3954948 - DNA, 21 bp, Homo sapiens
attttccacaagattcccaga

SEQ ID NO: 3954949 - DNA, 23 bp, Homo sapiens
attttccacaagattcccagaga

SEQ ID NO: 3954950 - DNA, 20 bp, Homo sapiens
attttctagacttcagaaca

SEQ ID NO: 3954951 - DNA, 19 bp, Homo sapiens
attttctatagctcttcta

SEQ ID NO: 3954952 - DNA, 19 bp, Homo sapiens
attttctcctaggagaagc

SEQ ID NO: 3954953 - DNA, 22 bp, Homo sapiens
attttctggggctcctcacata

SEQ ID NO: 3954954 - DNA, 23 bp, Homo sapiens
attttctggggctcctcacatag

SEQ ID NO: 3954955 - DNA, 16 bp, Homo sapiens
attttcttgcctgagg

SEQ ID NO: 3954956 - DNA, 15 bp, Homo sapiens
attttctttgaaatt

SEQ ID NO: 3954957 - DNA, 23 bp, Homo sapiens
attttctttgtgtagctttgctc

SEQ ID NO: 3954958 - DNA, 21 bp, Homo sapiens
attttctttttgtaattagta

SEQ ID NO: 3954959 - DNA, 21 bp, Homo sapiens
attttgagtatctcggacctt

SEQ ID NO: 3954960 - DNA, 14 bp, Homo sapiens
attttgagtgactc

SEQ ID NO: 3954961 - DNA, 10 bp, Homo sapiens
attttgcaca

SEQ ID NO: 3954962 - DNA, 11 bp, Homo sapiens
attttgcacaa

SEQ ID NO: 3954963 - DNA, 12 bp, Homo sapiens
attttgcactgt

SEQ ID NO: 3954964 - DNA, 14 bp, Homo sapiens
attttgcttaaaat

SEQ ID NO: 3954965 - DNA, 17 bp, Homo sapiens
attttgtaaactcaaaa

SEQ ID NO: 3954966 - DNA, 18 bp, Homo sapiens
attttgtaacgaagacac

SEQ ID NO: 3954967 - DNA, 15 bp, Homo sapiens
attttgtacagaatt

SEQ ID NO: 3954968 - DNA, 18 bp, Homo sapiens
attttgtacagaattttt

SEQ ID NO: 3954969 - DNA, 15 bp, Homo sapiens
attttgtattttcaa

SEQ ID NO: 3954970 - DNA, 22 bp, Homo sapiens
attttgtattttcaactttata

SEQ ID NO: 3954971 - DNA, 21 bp, Homo sapiens
attttgtctcctacctgctgc

SEQ ID NO: 3954972 - DNA, 20 bp, Homo sapiens
attttgtggctttctttctt

SEQ ID NO: 3954973 - DNA, 16 bp, Homo sapiens
attttgttatagaata

SEQ ID NO: 3954974 - DNA, 18 bp, Homo sapiens
attttgttatagaatact

SEQ ID NO: 3954975 - DNA, 23 bp, Homo sapiens
attttgttgctgttttgatttgt

SEQ ID NO: 3954976 - DNA, 15 bp, Homo sapiens
attttgttgtgattt

SEQ ID NO: 3954977 - DNA, 22 bp, Homo sapiens
attttgttgtgattttgtacag

SEQ ID NO: 3954978 - DNA, 20 bp, Homo sapiens
attttgtttcagaattttgt

SEQ ID NO: 3954979 - DNA, 22 bp, Homo sapiens
attttgtttcagaattttgtat

SEQ ID NO: 3954980 - DNA, 20 bp, Homo sapiens
attttgtttgtaatcctgta

SEQ ID NO: 3954981 - DNA, 12 bp, Homo sapiens
atttttaaacta

SEQ ID NO: 3954982 - DNA, 14 bp, Homo sapiens
atttttacaataaa

SEQ ID NO: 3954983 - DNA, 15 bp, Homo sapiens
atttttacaataatt

SEQ ID NO: 3954984 - DNA, 13 bp, Homo sapiens
atttttatacata

SEQ ID NO: 3954985 - DNA, 19 bp, Homo sapiens
atttttatacatatcagaa

SEQ ID NO: 3954986 - DNA, 21 bp, Homo sapiens
atttttatacatatcagaaaa

SEQ ID NO: 3954987 - DNA, 23 bp, Homo sapiens
atttttatacatatcagaaaagt

SEQ ID NO: 3954988 - DNA, 12 bp, Homo sapiens
atttttcctgca

SEQ ID NO: 3954989 - DNA, 19 bp, Homo sapiens
atttttctcagtttgtata

SEQ ID NO: 3954990 - DNA, 18 bp, Homo sapiens
atttttcttaatcaagaa

SEQ ID NO: 3954991 - DNA, 21 bp, Homo sapiens
atttttgaaacccattaggca

SEQ ID NO: 3954992 - DNA, 15 bp, Homo sapiens
atttttgtaataaaa

SEQ ID NO: 3954993 - DNA, 20 bp, Homo sapiens
atttttgtacgttatatatt

SEQ ID NO: 3954994 - DNA, 14 bp, Homo sapiens
atttttgtccctgc

SEQ ID NO: 3954995 - DNA, 15 bp, Homo sapiens
atttttgtgtttcta

SEQ ID NO: 3954996 - DNA, 17 bp, Homo sapiens
atttttgtgtttctaaa

SEQ ID NO: 3954997 - DNA, 19 bp, Homo sapiens
attttttacagctgcctgc

SEQ ID NO: 3954998 - DNA, 13 bp, Homo sapiens
attttttattgtt

SEQ ID NO: 3954999 - DNA, 13 bp, Homo sapiens
attttttcagaaa

SEQ ID NO: 3955000 - DNA, 15 bp, Homo sapiens
attttttctacacag

SEQ ID NO: 3955001 - DNA, 18 bp, Homo sapiens
attttttgcatcagtatt

SEQ ID NO: 3955002 - DNA, 13 bp, Homo sapiens
atttttttaagct

SEQ ID NO: 3955003 - DNA, 22 bp, Homo sapiens
atttttttaagttagagaatat

SEQ ID NO: 3955004 - DNA, 15 bp, Homo sapiens
attttttttaatgta

SEQ ID NO: 3955005 - DNA, 23 bp, Homo sapiens
atttttttttttgtttctgagaa

SEQ ID NO: 3955006 - DNA, 14 bp, Homo sapiens
caaaaaaattaaat

SEQ ID NO: 3955007 - DNA, 19 bp, Homo sapiens
caaaaaagtatttttttaa

SEQ ID NO: 3955008 - DNA, 13 bp, Homo sapiens
caaaaacacagca

SEQ ID NO: 3955009 - DNA, 14 bp, Homo sapiens
caaaaacacagcaa

SEQ ID NO: 3955010 - DNA, 14 bp, Homo sapiens
caaaaacagcctca

SEQ ID NO: 3955011 - DNA, 22 bp, Homo sapiens
caaaaacagcctcacagaagaa

SEQ ID NO: 3955012 - DNA, 12 bp, Homo sapiens
caaaaataaact

SEQ ID NO: 3955013 - DNA, 13 bp, Homo sapiens
caaaaataaacta

SEQ ID NO: 3955014 - DNA, 22 bp, Homo sapiens
caaaaataaactagtttccagt

SEQ ID NO: 3955015 - DNA, 15 bp, Homo sapiens
caaaaatataaaata

SEQ ID NO: 3955016 - DNA, 19 bp, Homo sapiens
caaaaatgaaagcatgtct

SEQ ID NO: 3955017 - DNA, 21 bp, Homo sapiens
caaaaatggtggtttgtcata

SEQ ID NO: 3955018 - DNA, 16 bp, Homo sapiens
caaaacaagaaagaaa

SEQ ID NO: 3955019 - DNA, 15 bp, Homo sapiens
caaaacatatcaatt

SEQ ID NO: 3955020 - DNA, 22 bp, Homo sapiens
caaaaccatgcattcctaagaa

SEQ ID NO: 3955021 - DNA, 20 bp, Homo sapiens
caaaacctgcagttcctgag

SEQ ID NO: 3955022 - DNA, 22 bp, Homo sapiens
caaaacctttccccagacacat

SEQ ID NO: 3955023 - DNA, 17 bp, Homo sapiens
caaaactgcactgtcaa

SEQ ID NO: 3955024 - DNA, 14 bp, Homo sapiens
caagaatcctctgg

SEQ ID NO: 3955025 - DNA, 21 bp, Homo sapiens
caagaattggaagctgccctg

SEQ ID NO: 3955026 - DNA, 13 bp, Homo sapiens
caagaccagcctg

SEQ ID NO: 3955027 - DNA, 22 bp, Homo sapiens
caagacctgttggttagctgga

SEQ ID NO: 3955028 - DNA, 16 bp, Homo sapiens
caagactgttagccct

SEQ ID NO: 3955029 - DNA, 16 bp, Homo sapiens
caagactgttgctcaa

SEQ ID NO: 3955030 - DNA, 15 bp, Homo sapiens
caagacttggcaaca

SEQ ID NO: 3955031 - DNA, 13 bp, Homo sapiens
caagagaaaataa

SEQ ID NO: 3955032 - DNA, 15 bp, Homo sapiens
caagagacagagccc

SEQ ID NO: 3955033 - DNA, 19 bp, Homo sapiens
caagagacagagcccccaa

SEQ ID NO: 3955034 - DNA, 17 bp, Homo sapiens
caagagagaaagaagta

SEQ ID NO: 3955035 - DNA, 20 bp, Homo sapiens
caagagagacattgcctcca

SEQ ID NO: 3955036 - DNA, 15 bp, Homo sapiens
caaaagattgtttta

SEQ ID NO: 3955037 - DNA, 14 bp, Homo sapiens
caaaagcacccttg

SEQ ID NO: 3955038 - DNA, 15 bp, Homo sapiens
caaaagctgcttgac

SEQ ID NO: 3955039 - DNA, 22 bp, Homo sapiens
caaaagctgcttgactatcaca

SEQ ID NO: 3955040 - DNA, 18 bp, Homo sapiens
caaaagggcagccagggg

SEQ ID NO: 3955041 - DNA, 19 bp, Homo sapiens
caaaagggcagccaggggc

SEQ ID NO: 3955042 - DNA, 13 bp, Homo sapiens
caaaaggtgcctg

SEQ ID NO: 3955043 - DNA, 15 bp, Homo sapiens
caaaaggtgcctgtg

SEQ ID NO: 3955044 - DNA, 17 bp, Homo sapiens
caaaagttcgaaagaaa

SEQ ID NO: 3955045 - DNA, 11 bp, Homo sapiens
caaaataaatt

SEQ ID NO: 3955046 - DNA, 14 bp, Homo sapiens
caaaataaattgaa

SEQ ID NO: 3955047 - DNA, 20 bp, Homo sapiens
caaaataaggggcacctggg

SEQ ID NO: 3955048 - DNA, 18 bp, Homo sapiens
caaaataatttaactaat

SEQ ID NO: 3955049 - DNA, 13 bp, Homo sapiens
caaaatagagaat

SEQ ID NO: 3955050 - DNA, 16 bp, Homo sapiens
caaaatccttgcttat

SEQ ID NO: 3955051 - DNA, 23 bp, Homo sapiens
caaaattttataagcaaatttca

SEQ ID NO: 3955052 - DNA, 12 bp, Homo sapiens
caaacagagggc

SEQ ID NO: 3955053 - DNA, 15 bp, Homo sapiens
caaacagtctcagga

SEQ ID NO: 3955054 - DNA, 14 bp, Homo sapiens
caaacatgaagtgt

SEQ ID NO: 3955055 - DNA, 16 bp, Homo sapiens
caaacatgagtgaata

SEQ ID NO: 3955056 - DNA, 20 bp, Homo sapiens
caaaccaccctaaaatgaca

SEQ ID NO: 3955057 - DNA, 17 bp, Homo sapiens
caaaccaggactctgcc

SEQ ID NO: 3955058 - DNA, 15 bp, Homo sapiens
caaaccataaacttc

SEQ ID NO: 3955059 - DNA, 19 bp, Homo sapiens
caaaccatttaattcataa

SEQ ID NO: 3955060 - DNA, 13 bp, Homo sapiens
caaaccctgtggg

SEQ ID NO: 3955061 - DNA, 18 bp, Homo sapiens
caaactacagaataatgt

SEQ ID NO: 3955062 - DNA, 18 bp, Homo sapiens
caaactcactgctcaaga

SEQ ID NO: 3955063 - DNA, 12 bp, Homo sapiens
caaactcctgcc

SEQ ID NO: 3955064 - DNA, 14 bp, Homo sapiens
caaactcctgcctg

SEQ ID NO: 3955065 - DNA, 19 bp, Homo sapiens
caaactgatggaccgggtg

SEQ ID NO: 3955066 - DNA, 23 bp, Homo sapiens
caaactgatggaccgggtgggcc

SEQ ID NO: 3955067 - DNA, 17 bp, Homo sapiens
caaactggggcctccct

SEQ ID NO: 3955068 - DNA, 16 bp, Homo sapiens
caaactgtgccctgcc

SEQ ID NO: 3955069 - DNA, 20 bp, Homo sapiens
caaactgtgccctgccttca

SEQ ID NO: 3955070 - DNA, 18 bp, Homo sapiens
caaacttgtgctgagaat

SEQ ID NO: 3955071 - DNA, 14 bp, Homo sapiens
caaagaaatgtaag

SEQ ID NO: 3955072 - DNA, 16 bp, Homo sapiens
caaagaacaagaaatt

SEQ ID NO: 3955073 - DNA, 11 bp, Homo sapiens
caaagaacagt

SEQ ID NO: 3955074 - DNA, 15 bp, Homo sapiens
caaagaactgcccca

SEQ ID NO: 3955075 - DNA, 20 bp, Homo sapiens
caaagaactgccccatctcc

SEQ ID NO: 3955076 - DNA, 14 bp, Homo sapiens
caaagaaggcacag

SEQ ID NO: 3955077 - DNA, 21 bp, Homo sapiens
caaagagaaatcacaggggcg

SEQ ID NO: 3955078 - DNA, 14 bp, Homo sapiens
caaagagactggag

SEQ ID NO: 3955079 - DNA, 17 bp, Homo sapiens
caaagagactggagcat

SEQ ID NO: 3955080 - DNA, 13 bp, Homo sapiens
caaagagcctgga

SEQ ID NO: 3955081 - DNA, 15 bp, Homo sapiens
caaagagcctggaga

SEQ ID NO: 3955082 - DNA, 16 bp, Homo sapiens
caaagagcctggagaa

SEQ ID NO: 3955083 - DNA, 17 bp, Homo sapiens
caaagagcctggagaag

SEQ ID NO: 3955084 - DNA, 18 bp, Homo sapiens
caaagagcctggagaagc

SEQ ID NO: 3955085 - DNA, 16 bp, Homo sapiens
caaagaggtatttatc

SEQ ID NO: 3955086 - DNA, 22 bp, Homo sapiens
caaagagtgggctgcatctggg

SEQ ID NO: 3955087 - DNA, 16 bp, Homo sapiens
caaagatgtttgtcag

SEQ ID NO: 3955088 - DNA, 17 bp, Homo sapiens
caaagcaaaagaagtaa

SEQ ID NO: 3955089 - DNA, 18 bp, Homo sapiens
caaagcaaaagaagtaaa

SEQ ID NO: 3955090 - DNA, 12 bp, Homo sapiens
caaagcaccagc

SEQ ID NO: 3955091 - DNA, 22 bp, Homo sapiens
caaagccaacagtcaaaacaga

SEQ ID NO: 3955092 - DNA, 17 bp, Homo sapiens
caaagccgtgcctttct

SEQ ID NO: 3955093 - DNA, 20 bp, Homo sapiens
caaagcgagatcccatctct

SEQ ID NO: 3955094 - DNA, 20 bp, Homo sapiens
caaagctgaagaaaatgaag

SEQ ID NO: 3955095 - DNA, 20 bp, Homo sapiens
caaagcttctatcccaggag

SEQ ID NO: 3955096 - DNA, 16 bp, Homo sapiens
caaagctttttccaga

SEQ ID NO: 3955097 - DNA, 13 bp, Homo sapiens
caaaggaaaccaa

SEQ ID NO: 3955098 - DNA, 14 bp, Homo sapiens
caaaggaaaccaaa

SEQ ID NO: 3955099 - DNA, 16 bp, Homo sapiens
caaaggaaaccaaagg

SEQ ID NO: 3955100 - DNA, 20 bp, Homo sapiens
caaaggaaaccaaaggaatc

SEQ ID NO: 3955101 - DNA, 19 bp, Homo sapiens
caaaggacattatgtgtgc

SEQ ID NO: 3955102 - DNA, 20 bp, Homo sapiens
caaaggagacgggggagcag

SEQ ID NO: 3955103 - DNA, 12 bp, Homo sapiens
caaaggagcctg

SEQ ID NO: 3955104 - DNA, 13 bp, Homo sapiens
caaaggagcctgt

SEQ ID NO: 3955105 - DNA, 14 bp, Homo sapiens
caaaggagcctgtg

SEQ ID NO: 3955106 - DNA, 23 bp, Homo sapiens
caaaggcgcagtgcttctctaca

SEQ ID NO: 3955107 - DNA, 14 bp, Homo sapiens
caaagggctgaaag

SEQ ID NO: 3955108 - DNA, 21 bp, Homo sapiens
caaagggctgaaagccatttg

SEQ ID NO: 3955109 - DNA, 18 bp, Homo sapiens
caaaggggagaagggcca

SEQ ID NO: 3955110 - DNA, 14 bp, Homo sapiens
caaaggggctgctg

SEQ ID NO: 3955111 - DNA, 16 bp, Homo sapiens
caaaggggctgctggg

SEQ ID NO: 3955112 - DNA, 19 bp, Homo sapiens
caaaggggctgctggggca

SEQ ID NO: 3955113 - DNA, 20 bp, Homo sapiens
caaaggtctttttaaaccag

SEQ ID NO: 3955114 - DNA, 14 bp, Homo sapiens
caaaggtggctctc

SEQ ID NO: 3955115 - DNA, 15 bp, Homo sapiens
caaaggttgagatgt

SEQ ID NO: 3955116 - DNA, 18 bp, Homo sapiens
caaagtaaaacttgctgc

SEQ ID NO: 3955117 - DNA, 20 bp, Homo sapiens
caagctgaagtgaaggagaa

SEQ ID NO: 3955118 - DNA, 22 bp, Homo sapiens
caagctgaagtgaaggagaaag

SEQ ID NO: 3955119 - DNA, 17 bp, Homo sapiens
caagctgaggtgcccag

SEQ ID NO: 3955120 - DNA, 19 bp, Homo sapiens
caagctgaggtgcccagga

SEQ ID NO: 3955121 - DNA, 14 bp, Homo sapiens
caagctggaagcac

SEQ ID NO: 3955122 - DNA, 14 bp, Homo sapiens
caagcttcaagtga

SEQ ID NO: 3955123 - DNA, 22 bp, Homo sapiens
caagcttcagagcctagccacc

SEQ ID NO: 3955124 - DNA, 18 bp, Homo sapiens
caagcttgtatatacata

SEQ ID NO: 3955125 - DNA, 22 bp, Homo sapiens
caagcttgtatatacatattat

SEQ ID NO: 3955126 - DNA, 19 bp, Homo sapiens
caagctttcttctacaacc

SEQ ID NO: 3955127 - DNA, 24 bp, Homo sapiens
caaggaagggtgggaagcttgctg

SEQ ID NO: 3955128 - DNA, 16 bp, Homo sapiens
caaggacaacctgccc

SEQ ID NO: 3955129 - DNA, 17 bp, Homo sapiens
caaggacaacctgcccc

SEQ ID NO: 3955130 - DNA, 19 bp, Homo sapiens
caaggactcctgtctgtcc

SEQ ID NO: 3955131 - DNA, 12 bp, Homo sapiens
caaggactctgg

SEQ ID NO: 3955132 - DNA, 17 bp, Homo sapiens
caaggactctggcctct

SEQ ID NO: 3955133 - DNA, 20 bp, Homo sapiens
caatttttatacatatcaga

SEQ ID NO: 3955134 - DNA, 21 bp, Homo sapiens
caatttttatacatatcagaa

SEQ ID NO: 3955135 - DNA, 22 bp, Homo sapiens
caatttttcttatttcatttct

SEQ ID NO: 3955136 - DNA, 12 bp, Homo sapiens
cacaaaaatgaa

SEQ ID NO: 3955137 - DNA, 21 bp, Homo sapiens
cacaaaaatggtggtttgtca

SEQ ID NO: 3955138 - DNA, 18 bp, Homo sapiens
cacaaaagttagctgagc

SEQ ID NO: 3955139 - DNA, 14 bp, Homo sapiens
cacaaacacctcct

SEQ ID NO: 3955140 - DNA, 18 bp, Homo sapiens
cacaaaccacaactgaca

SEQ ID NO: 3955141 - DNA, 12 bp, Homo sapiens
cacaaaggggag

SEQ ID NO: 3955142 - DNA, 18 bp, Homo sapiens
cacaaatcaaagcaaggg

SEQ ID NO: 3955143 - DNA, 14 bp, Homo sapiens
cacaaatctatatt

SEQ ID NO: 3955144 - DNA, 20 bp, Homo sapiens
cacaaatctatattaaagtg

SEQ ID NO: 3955145 - DNA, 13 bp, Homo sapiens
cacaacatttatt

SEQ ID NO: 3955146 - DNA, 23 bp, Homo sapiens
cacaaccatctgtccctgcctca

SEQ ID NO: 3955147 - DNA, 18 bp, Homo sapiens
cacaaccttctgtggctc

SEQ ID NO: 3955148 - DNA, 13 bp, Homo sapiens
cacaactgacaca

SEQ ID NO: 3955149 - DNA, 18 bp, Homo sapiens
cacaactgacacaggaaa

SEQ ID NO: 3955150 - DNA, 12 bp, Homo sapiens
cacaagaaattt

SEQ ID NO: 3955151 - DNA, 15 bp, Homo sapiens
cacaagattcccaga

SEQ ID NO: 3955152 - DNA, 19 bp, Homo sapiens
cacaagattcccagagaca

SEQ ID NO: 3955153 - DNA, 14 bp, Homo sapiens
cacaagcaataatt

SEQ ID NO: 3955154 - DNA, 12 bp, Homo sapiens
cacaagccacag

SEQ ID NO: 3955155 - DNA, 15 bp, Homo sapiens
cacaagccacagaag

SEQ ID NO: 3955156 - DNA, 14 bp, Homo sapiens
cacaagcccaggct

SEQ ID NO: 3955157 - DNA, 17 bp, Homo sapiens
cacaagccttactcacc

SEQ ID NO: 3955158 - DNA, 21 bp, Homo sapiens
cacaagccttactcacctctc

SEQ ID NO: 3955159 - DNA, 22 bp, Homo sapiens
cacaagccttactcacctctct

SEQ ID NO: 3955160 - DNA, 14 bp, Homo sapiens
cacaagctggaagc

SEQ ID NO: 3955161 - DNA, 20 bp, Homo sapiens
cacaagcttgtatatacata

SEQ ID NO: 3955162 - DNA, 14 bp, Homo sapiens
cacaaggctgacca

SEQ ID NO: 3955163 - DNA, 21 bp, Homo sapiens
cacaataaggtcaatgccaga

SEQ ID NO: 3955164 - DNA, 11 bp, Homo sapiens
cacaatatttt

SEQ ID NO: 3955165 - DNA, 23 bp, Homo sapiens
cacaatctttccttgtctctcat

SEQ ID NO: 3955166 - DNA, 20 bp, Homo sapiens
cacaatgatgattaaacacc

SEQ ID NO: 3955167 - DNA, 21 bp, Homo sapiens
cacaatggctaattcccagag

SEQ ID NO: 3955168 - DNA, 22 bp, Homo sapiens
cacaattgatacttcaggtgct

SEQ ID NO: 3955169 - DNA, 12 bp, Homo sapiens
cacaatttagaa

SEQ ID NO: 3955170 - DNA, 13 bp, Homo sapiens
cacaatttagaaa

SEQ ID NO: 3955171 - DNA, 16 bp, Homo sapiens
cacaatttagaaaaca

SEQ ID NO: 3955172 - DNA, 18 bp, Homo sapiens
cacaatttgagcaattca

SEQ ID NO: 3955173 - DNA, 19 bp, Homo sapiens
cacaatttgagcaattcat

SEQ ID NO: 3955174 - DNA, 23 bp, Homo sapiens
cacaattttcaggtttcttaaaa

SEQ ID NO: 3955175 - DNA, 16 bp, Homo sapiens
cacacaaacacctcct

SEQ ID NO: 3955176 - DNA, 13 bp, Homo sapiens
cacacaaggctgg

SEQ ID NO: 3955177 - DNA, 16 bp, Homo sapiens
cacacaagtttgtgct

SEQ ID NO: 3955178 - DNA, 21 bp, Homo sapiens
cacacaagtttgtgctatcta

SEQ ID NO: 3955179 - DNA, 23 bp, Homo sapiens
cacacaatgctattgaaattact

SEQ ID NO: 3955180 - DNA, 10 bp, Homo sapiens
cacacacaca

SEQ ID NO: 3955181 - DNA, 11 bp, Homo sapiens
cacacacacac

SEQ ID NO: 3955182 - DNA, 12 bp, Homo sapiens
cacacacacaca

SEQ ID NO: 3955183 - DNA, 14 bp, Homo sapiens
cacacacacacaca

SEQ ID NO: 3955184 - DNA, 16 bp, Homo sapiens
cacacacacacacaca

SEQ ID NO: 3955185 - DNA, 14 bp, Homo sapiens
cacacacacacata

SEQ ID NO: 3955186 - DNA, 12 bp, Homo sapiens
cacacacacata

SEQ ID NO: 3955187 - DNA, 12 bp, Homo sapiens
cacacacagagg

SEQ ID NO: 3955188 - DNA, 17 bp, Homo sapiens
cacacacagatgcacac

SEQ ID NO: 3955189 - DNA, 16 bp, Homo sapiens
cacacagaaatatata

SEQ ID NO: 3955190 - DNA, 22 bp, Homo sapiens
cacacagaaatatatatacata

SEQ ID NO: 3955191 - DNA, 16 bp, Homo sapiens
cacacagagatatgca

SEQ ID NO: 3955192 - DNA, 22 bp, Homo sapiens
cacacagaggaagagcaggcac

SEQ ID NO: 3955193 - DNA, 19 bp, Homo sapiens
cacacagatgcacacacag

SEQ ID NO: 3955194 - DNA, 18 bp, Homo sapiens
cacacagatggtcacaca

SEQ ID NO: 3955195 - DNA, 12 bp, Homo sapiens
cacacagcagcc

SEQ ID NO: 3955196 - DNA, 20 bp, Homo sapiens
cacacaggcatttcctgggt

SEQ ID NO: 3955197 - DNA, 18 bp, Homo sapiens
cacaggcatttcctgggt

SEQ ID NO: 3955198 - DNA, 20 bp, Homo sapiens
cacaggcatttcctgggtgg

SEQ ID NO: 3955199 - DNA, 15 bp, Homo sapiens
cacaggcccttcctc

SEQ ID NO: 3955200 - DNA, 16 bp, Homo sapiens
cacaggcccttcctct

SEQ ID NO: 3955201 - DNA, 21 bp, Homo sapiens
cacaggcccttcctctccact

SEQ ID NO: 3955202 - DNA, 13 bp, Homo sapiens
cacaggcctgtgt

SEQ ID NO: 3955203 - DNA, 14 bp, Homo sapiens
cacagggccccaga

SEQ ID NO: 3955204 - DNA, 17 bp, Homo sapiens
cacaggggcaggcctgg

SEQ ID NO: 3955205 - DNA, 19 bp, Homo sapiens
cacaggggcaggcctggga

SEQ ID NO: 3955206 - DNA, 18 bp, Homo sapiens
cacaggggccccagatct

SEQ ID NO: 3955207 - DNA, 19 bp, Homo sapiens
cacaggggccccagatctg

SEQ ID NO: 3955208 - DNA, 23 bp, Homo sapiens
cacaggggccccagatctgcctg

SEQ ID NO: 3955209 - DNA, 14 bp, Homo sapiens
cacaggggcggggc

SEQ ID NO: 3955210 - DNA, 19 bp, Homo sapiens
cacaggggcggggcaggaa

SEQ ID NO: 3955211 - DNA, 23 bp, Homo sapiens
cacaggtcctgaaagtctgtgtc

SEQ ID NO: 3955212 - DNA, 16 bp, Homo sapiens
cacaggtgtggtgtaa

SEQ ID NO: 3955213 - DNA, 19 bp, Homo sapiens
cacaggtgtggtgtaattt

SEQ ID NO: 3955214 - DNA, 23 bp, Homo sapiens
cacaggttctgcgttacaacagt

SEQ ID NO: 3955215 - DNA, 20 bp, Homo sapiens
cacagtaaaaacttgtacta

SEQ ID NO: 3955216 - DNA, 22 bp, Homo sapiens
cacagtcaccttctcggcaact

SEQ ID NO: 3955217 - DNA, 13 bp, Homo sapiens
cacagtcctcaca

SEQ ID NO: 3955218 - DNA, 16 bp, Homo sapiens
cacagtcctcacagcc

SEQ ID NO: 3955219 - DNA, 23 bp, Homo sapiens
cacccatcctaccaatgcatgca

SEQ ID NO: 3955220 - DNA, 17 bp, Homo sapiens
cacccatcttcctgctg

SEQ ID NO: 3955221 - DNA, 18 bp, Homo sapiens
cacccatcttcctgctgc

SEQ ID NO: 3955222 - DNA, 19 bp, Homo sapiens
cacccatgaatcaaagaca

SEQ ID NO: 3955223 - DNA, 13 bp, Homo sapiens
cacccatgtgcca

SEQ ID NO: 3955224 - DNA, 18 bp, Homo sapiens
caccccaagggacaaccc

SEQ ID NO: 3955225 - DNA, 20 bp, Homo sapiens
caccccaagggacaacccca

SEQ ID NO: 3955226 - DNA, 22 bp, Homo sapiens
caccccacccccttcagtgccc

SEQ ID NO: 3955227 - DNA, 14 bp, Homo sapiens
caccccactggatc

SEQ ID NO: 3955228 - DNA, 19 bp, Homo sapiens
cacccccgctgggggtggg

SEQ ID NO: 3955229 - DNA, 12 bp, Homo sapiens
caccccctcatt

SEQ ID NO: 3955230 - DNA, 14 bp, Homo sapiens
caccccctcattcc

SEQ ID NO: 3955231 - DNA, 14 bp, Homo sapiens
caccccctccagct

SEQ ID NO: 3955232 - DNA, 19 bp, Homo sapiens
caccccctccagctccagt

SEQ ID NO: 3955233 - DNA, 15 bp, Homo sapiens
caccccctccccagg

SEQ ID NO: 3955234 - DNA, 22 bp, Homo sapiens
caccccgtctggggttcagccc

SEQ ID NO: 3955235 - DNA, 15 bp, Homo sapiens
cacccctaacctggc

SEQ ID NO: 3955236 - DNA, 18 bp, Homo sapiens
cacccctctcccccgccc

SEQ ID NO: 3955237 - DNA, 13 bp, Homo sapiens
cacccctgtctct

SEQ ID NO: 3955238 - DNA, 20 bp, Homo sapiens
caccccttatccaggactct

SEQ ID NO: 3955239 - DNA, 13 bp, Homo sapiens
caccccttcctgt

SEQ ID NO: 3955240 - DNA, 14 bp, Homo sapiens
caccccttcctgtc

SEQ ID NO: 3955241 - DNA, 22 bp, Homo sapiens
cacccgtaggcagcctctctgc

SEQ ID NO: 3955242 - DNA, 21 bp, Homo sapiens
cacccgtcttggggctcgccc

SEQ ID NO: 3955243 - DNA, 18 bp, Homo sapiens
cacccgttctgctggcct

SEQ ID NO: 3955244 - DNA, 18 bp, Homo sapiens
caccctatccctgtacag

SEQ ID NO: 3955245 - DNA, 14 bp, Homo sapiens
caccctattcccta

SEQ ID NO: 3955246 - DNA, 14 bp, Homo sapiens
caccctccacctct

SEQ ID NO: 3955247 - DNA, 11 bp, Homo sapiens
caccctccttc

SEQ ID NO: 3955248 - DNA, 13 bp, Homo sapiens
caccctccttccc

SEQ ID NO: 3955249 - DNA, 18 bp, Homo sapiens
cacattcggaccctgccc

SEQ ID NO: 3955250 - DNA, 17 bp, Homo sapiens
cacattcttaaaggaaa

SEQ ID NO: 3955251 - DNA, 18 bp, Homo sapiens
cacatttacctcgaggct

SEQ ID NO: 3955252 - DNA, 14 bp, Homo sapiens
cacatttatatata

SEQ ID NO: 3955253 - DNA, 21 bp, Homo sapiens
cacatttatatatatatgtat

SEQ ID NO: 3955254 - DNA, 13 bp, Homo sapiens
cacatttgatgta

SEQ ID NO: 3955255 - DNA, 20 bp, Homo sapiens
cacatttgatgtacatgtgt

SEQ ID NO: 3955256 - DNA, 22 bp, Homo sapiens
cacatttgttcatgagtggatg

SEQ ID NO: 3955257 - DNA, 14 bp, Homo sapiens
caccaacatcccat

SEQ ID NO: 3955258 - DNA, 13 bp, Homo sapiens
caccaaccctcag

SEQ ID NO: 3955259 - DNA, 14 bp, Homo sapiens
caccaagctgttcc

SEQ ID NO: 3955260 - DNA, 20 bp, Homo sapiens
caccaaggtcttcagccatc

SEQ ID NO: 3955261 - DNA, 21 bp, Homo sapiens
caccaaggtcttcagccatca

SEQ ID NO: 3955262 - DNA, 12 bp, Homo sapiens
caccaataaaaa

SEQ ID NO: 3955263 - DNA, 13 bp, Homo sapiens
caccaataaaaat

SEQ ID NO: 3955264 - DNA, 12 bp, Homo sapiens
caccaccctccc

SEQ ID NO: 3955265 - DNA, 22 bp, Homo sapiens
caccaccctcccctgtcttctc

SEQ ID NO: 3955266 - DNA, 22 bp, Homo sapiens
caccacctaggccactcctcca

SEQ ID NO: 3955267 - DNA, 18 bp, Homo sapiens
caccacctcactcctgtt

SEQ ID NO: 3955268 - DNA, 18 bp, Homo sapiens
caccaccttcccagctct

SEQ ID NO: 3955269 - DNA, 19 bp, Homo sapiens
caccaccttcccagctctc

SEQ ID NO: 3955270 - DNA, 21 bp, Homo sapiens
caccaccttcccagctctccc

SEQ ID NO: 3955271 - DNA, 19 bp, Homo sapiens
caccacgatgtggccctgg

SEQ ID NO: 3955272 - DNA, 21 bp, Homo sapiens
caccacgatgtggccctggcc

SEQ ID NO: 3955273 - DNA, 22 bp, Homo sapiens
caccacgatgtggccctggcct

SEQ ID NO: 3955274 - DNA, 13 bp, Homo sapiens
caccactagagct

SEQ ID NO: 3955275 - DNA, 14 bp, Homo sapiens
caccactagagctg

SEQ ID NO: 3955276 - DNA, 14 bp, Homo sapiens
caccactccattcc

SEQ ID NO: 3955277 - DNA, 14 bp, Homo sapiens
cacctggcctgctg

SEQ ID NO: 3955278 - DNA, 17 bp, Homo sapiens
cacctggcctgctggga

SEQ ID NO: 3955279 - DNA, 18 bp, Homo sapiens
cacctggcctgctgggaa

SEQ ID NO: 3955280 - DNA, 18 bp, Homo sapiens
cacctgggaaaacagagg

SEQ ID NO: 3955281 - DNA, 20 bp, Homo sapiens
cacctgggaaaacagaggaa

SEQ ID NO: 3955282 - DNA, 17 bp, Homo sapiens
cacctgggccctggggc

SEQ ID NO: 3955283 - DNA, 19 bp, Homo sapiens
cacctgggccctggggcct

SEQ ID NO: 3955284 - DNA, 12 bp, Homo sapiens
cacctgggcctt

SEQ ID NO: 3955285 - DNA, 19 bp, Homo sapiens
cacctgggcctttcctgtg

SEQ ID NO: 3955286 - DNA, 17 bp, Homo sapiens
cacctgtaatcccagca

SEQ ID NO: 3955287 - DNA, 22 bp, Homo sapiens
cacctgttaaaatgtacactgg

SEQ ID NO: 3955288 - DNA, 13 bp, Homo sapiens
caccttatgtatt

SEQ ID NO: 3955289 - DNA, 12 bp, Homo sapiens
caccttcccagc

SEQ ID NO: 3955290 - DNA, 13 bp, Homo sapiens
caccttcccagct

SEQ ID NO: 3955291 - DNA, 17 bp, Homo sapiens
caccttcccagctctcc

SEQ ID NO: 3955292 - DNA, 19 bp, Homo sapiens
caccttcccagctctccct

SEQ ID NO: 3955293 - DNA, 22 bp, Homo sapiens
caccttcccagctctccctctg

SEQ ID NO: 3955294 - DNA, 16 bp, Homo sapiens
caccttccccagactc

SEQ ID NO: 3955295 - DNA, 13 bp, Homo sapiens
caccttcttggct

SEQ ID NO: 3955296 - DNA, 15 bp, Homo sapiens
caccttcttggcttc

SEQ ID NO: 3955297 - DNA, 20 bp, Homo sapiens
caccttcttggcttctggga

SEQ ID NO: 3955298 - DNA, 23 bp, Homo sapiens
caccttgctcctccttctgctgc

SEQ ID NO: 3955299 - DNA, 18 bp, Homo sapiens
caccttggactcctccca

SEQ ID NO: 3955300 - DNA, 21 bp, Homo sapiens
caccttggactcctcccacaa

SEQ ID NO: 3955301 - DNA, 13 bp, Homo sapiens
caccttggagcct

SEQ ID NO: 3955302 - DNA, 14 bp, Homo sapiens
cacctttaagtcct

SEQ ID NO: 3955303 - DNA, 14 bp, Homo sapiens
cacctttgggatca

SEQ ID NO: 3955304 - DNA, 20 bp, Homo sapiens
cacctttgggatcagcctcc

SEQ ID NO: 3955305 - DNA, 16 bp, Homo sapiens
cacctttggtgcagag

SEQ ID NO: 3955306 - DNA, 19 bp, Homo sapiens
cacctttgttttgcactga

SEQ ID NO: 3955307 - DNA, 15 bp, Homo sapiens
caccttttgtattta

SEQ ID NO: 3955308 - DNA, 22 bp, Homo sapiens
cacgaatttgctggggaatctc

SEQ ID NO: 3955309 - DNA, 20 bp, Homo sapiens
cacgagtcacctgcaagccc

SEQ ID NO: 3955310 - DNA, 20 bp, Homo sapiens
cacgataaataatcggccca

SEQ ID NO: 3955311 - DNA, 15 bp, Homo sapiens
cacgatgaaaaactt

SEQ ID NO: 3955312 - DNA, 21 bp, Homo sapiens
cacgatgtcaaggactcctgt

SEQ ID NO: 3955313 - DNA, 17 bp, Homo sapiens
cacgcaagggcatcagg

SEQ ID NO: 3955314 - DNA, 18 bp, Homo sapiens
cacgcaagggcatcaggc

SEQ ID NO: 3955315 - DNA, 20 bp, Homo sapiens
cacgcaagggcatcaggcac

SEQ ID NO: 3955316 - DNA, 16 bp, Homo sapiens
cacgccaacagccccc

SEQ ID NO: 3955317 - DNA, 16 bp, Homo sapiens
cacgcctcctggccag

SEQ ID NO: 3955318 - DNA, 20 bp, Homo sapiens
cacgcctgtaatcccagcac

SEQ ID NO: 3955319 - DNA, 19 bp, Homo sapiens
cacgctcccccgcagtccc

SEQ ID NO: 3955320 - DNA, 14 bp, Homo sapiens
cacgctgtcctctc

SEQ ID NO: 3955321 - DNA, 17 bp, Homo sapiens
cacggacgtttccatca

SEQ ID NO: 3955322 - DNA, 21 bp, Homo sapiens
cacggaggcatctgcaccctc

SEQ ID NO: 3955323 - DNA, 23 bp, Homo sapiens
cacggatccatgtagcaggactg

SEQ ID NO: 3955324 - DNA, 21 bp, Homo sapiens
cacggcacctgggccctgggg

SEQ ID NO: 3955325 - DNA, 13 bp, Homo sapiens
cacggccaccctc

SEQ ID NO: 3955326 - DNA, 15 bp, Homo sapiens
cacggccaccctcct

SEQ ID NO: 3955327 - DNA, 17 bp, Homo sapiens
cacggccaccctccttc

SEQ ID NO: 3955328 - DNA, 13 bp, Homo sapiens
cacggcggcaggg

SEQ ID NO: 3955329 - DNA, 15 bp, Homo sapiens
cacggcggcagggtg

SEQ ID NO: 3955330 - DNA, 17 bp, Homo sapiens
cacggcgtttttttaca

SEQ ID NO: 3955331 - DNA, 18 bp, Homo sapiens
cacgggcctcagtttccc

SEQ ID NO: 3955332 - DNA, 14 bp, Homo sapiens
cacgggggcggcag

SEQ ID NO: 3955333 - DNA, 20 bp, Homo sapiens
cacggtgcgtggctgtggca

SEQ ID NO: 3955334 - DNA, 18 bp, Homo sapiens
cacgtatttatatttgga

SEQ ID NO: 3955335 - DNA, 19 bp, Homo sapiens
cacgtatttatatttggaa

SEQ ID NO: 3955336 - DNA, 22 bp, Homo sapiens
cacgtatttatatttggaaaga

SEQ ID NO: 3955337 - DNA, 16 bp, Homo sapiens
cacgtccagaattttt

SEQ ID NO: 3955338 - DNA, 17 bp, Homo sapiens
cacgtccccctggggct

SEQ ID NO: 3955339 - DNA, 12 bp, Homo sapiens
cacgtctgccag

SEQ ID NO: 3955340 - DNA, 13 bp, Homo sapiens
cacgtctgccagg

SEQ ID NO: 3955341 - DNA, 22 bp, Homo sapiens
cacgtctgccaggcccatctca

SEQ ID NO: 3955342 - DNA, 23 bp, Homo sapiens
cacgtgaaatatttaagtatata

SEQ ID NO: 3955343 - DNA, 20 bp, Homo sapiens
cacgtgagagaatctgcctg

SEQ ID NO: 3955344 - DNA, 13 bp, Homo sapiens
cacgtgccaggcc

SEQ ID NO: 3955345 - DNA, 14 bp, Homo sapiens
cacgtgccaggccc

SEQ ID NO: 3955346 - DNA, 15 bp, Homo sapiens
cacgtgccaggcccg

SEQ ID NO: 3955347 - DNA, 17 bp, Homo sapiens
cacgtgctcgcagcctg

SEQ ID NO: 3955348 - DNA, 20 bp, Homo sapiens
cacgtgctcgcagcctggcg

SEQ ID NO: 3955349 - DNA, 19 bp, Homo sapiens
cacgtgctcttctgttctc

SEQ ID NO: 3955350 - DNA, 13 bp, Homo sapiens
cactaaaaagtgg

SEQ ID NO: 3955351 - DNA, 15 bp, Homo sapiens
cactaaaaagtggct

SEQ ID NO: 3955352 - DNA, 22 bp, Homo sapiens
cactaaactttacccaaaaact

SEQ ID NO: 3955353 - DNA, 21 bp, Homo sapiens
cactacctttgtccaggcctg

SEQ ID NO: 3955354 - DNA, 20 bp, Homo sapiens
cactactgtgtagactcctg

SEQ ID NO: 3955355 - DNA, 23 bp, Homo sapiens
cactagagctgagagtctgaaag

SEQ ID NO: 3955356 - DNA, 13 bp, Homo sapiens
cactagagctggg

SEQ ID NO: 3955357 - DNA, 14 bp, Homo sapiens
cactagcctctcca

SEQ ID NO: 3955358 - DNA, 17 bp, Homo sapiens
cactagcctctccagga

SEQ ID NO: 3955359 - DNA, 17 bp, Homo sapiens
cactaggttcaattccc

SEQ ID NO: 3955360 - DNA, 12 bp, Homo sapiens
cactagttttgt

SEQ ID NO: 3955361 - DNA, 15 bp, Homo sapiens
cactatgctatttct

SEQ ID NO: 3955362 - DNA, 23 bp, Homo sapiens
cactatgctatttctggcctcag

SEQ ID NO: 3955363 - DNA, 19 bp, Homo sapiens
cactatggtatgctggcca

SEQ ID NO: 3955364 - DNA, 22 bp, Homo sapiens
cactatggtatgctggccagca

SEQ ID NO: 3955365 - DNA, 12 bp, Homo sapiens
cactattagaga

SEQ ID NO: 3955366 - DNA, 15 bp, Homo sapiens
cactattagagaaac

SEQ ID NO: 3955367 - DNA, 17 bp, Homo sapiens
cactattgcattgttca

SEQ ID NO: 3955368 - DNA, 21 bp, Homo sapiens
cactcaaaaaggtgtgtcaaa

SEQ ID NO: 3955369 - DNA, 14 bp, Homo sapiens
cactcaacaataaa

SEQ ID NO: 3955370 - DNA, 17 bp, Homo sapiens
cactcaatatgtgattt

SEQ ID NO: 3955371 - DNA, 12 bp, Homo sapiens
cactcaccaggg

SEQ ID NO: 3955372 - DNA, 22 bp, Homo sapiens
cactcaccagggtccgcaccag

SEQ ID NO: 3955373 - DNA, 18 bp, Homo sapiens
cactcaccagtgtcccct

SEQ ID NO: 3955374 - DNA, 21 bp, Homo sapiens
cactcaccagtgtcccctcca

SEQ ID NO: 3955375 - DNA, 13 bp, Homo sapiens
cactcactccagc

SEQ ID NO: 3955376 - DNA, 19 bp, Homo sapiens
cactcagaagcctgggggc

SEQ ID NO: 3955377 - DNA, 22 bp, Homo sapiens
cactcagaagcctgggggcctg

SEQ ID NO: 3955378 - DNA, 17 bp, Homo sapiens
cactcagccacacccca

SEQ ID NO: 3955379 - DNA, 21 bp, Homo sapiens
cactcagccgcagacaagtaa

SEQ ID NO: 3955380 - DNA, 13 bp, Homo sapiens
cactcagggctgc

SEQ ID NO: 3955381 - DNA, 14 bp, Homo sapiens
cactcagggctgcc

SEQ ID NO: 3955382 - DNA, 17 bp, Homo sapiens
cactcagggctgccact

SEQ ID NO: 3955383 - DNA, 20 bp, Homo sapiens
cactcatgttgttcccacac

SEQ ID NO: 3955384 - DNA, 22 bp, Homo sapiens
cactcatgttgttcccacacac

SEQ ID NO: 3955385 - DNA, 15 bp, Homo sapiens
cactccaccacccaa

SEQ ID NO: 3955386 - DNA, 16 bp, Homo sapiens
cactccacctccaccc

SEQ ID NO: 3955387 - DNA, 17 bp, Homo sapiens
cactccacctccaccca

SEQ ID NO: 3955388 - DNA, 16 bp, Homo sapiens
cactccagacccctgg

SEQ ID NO: 3955389 - DNA, 17 bp, Homo sapiens
cactccctaagaaaccc

SEQ ID NO: 3955390 - DNA, 12 bp, Homo sapiens
cactcctgctgt

SEQ ID NO: 3955391 - DNA, 20 bp, Homo sapiens
cactcctgtcccgccttcct

SEQ ID NO: 3955392 - DNA, 14 bp, Homo sapiens
cactccttcctgcc

SEQ ID NO: 3955393 - DNA, 16 bp, Homo sapiens
cactcgagaccatcct

SEQ ID NO: 3955394 - DNA, 15 bp, Homo sapiens
cactcgcagtcgcag

SEQ ID NO: 3955395 - DNA, 14 bp, Homo sapiens
cactctacttagca

SEQ ID NO: 3955396 - DNA, 17 bp, Homo sapiens
cactctcattccccagg

SEQ ID NO: 3955397 - DNA, 14 bp, Homo sapiens
cactctcccctccc

SEQ ID NO: 3955398 - DNA, 23 bp, Homo sapiens
cactctccttcgtgtctctccca

SEQ ID NO: 3955399 - DNA, 14 bp, Homo sapiens
cactctgctctgat

SEQ ID NO: 3955400 - DNA, 15 bp, Homo sapiens
cactctggcagccac

SEQ ID NO: 3955401 - DNA, 13 bp, Homo sapiens
cactctggcctca

SEQ ID NO: 3955402 - DNA, 16 bp, Homo sapiens
cactctgtcagccagc

SEQ ID NO: 3955403 - DNA, 21 bp, Homo sapiens
cactctgtcagccagccgccc

SEQ ID NO: 3955404 - DNA, 23 bp, Homo sapiens
cactctgtcagccagccgccctg

SEQ ID NO: 3955405 - DNA, 16 bp, Homo sapiens
cactctttgctacaat

SEQ ID NO: 3955406 - DNA, 17 bp, Homo sapiens
cactctttgctacaata

SEQ ID NO: 3955407 - DNA, 19 bp, Homo sapiens
cactgaatcatgttaatag

SEQ ID NO: 3955408 - DNA, 21 bp, Homo sapiens
cactgaatgcctcaatgtgac

SEQ ID NO: 3955409 - DNA, 22 bp, Homo sapiens
cactgaccttggagagacacag

SEQ ID NO: 3955410 - DNA, 20 bp, Homo sapiens
cactgactgggaccaggcac

SEQ ID NO: 3955411 - DNA, 15 bp, Homo sapiens
cactgacttctaagt

SEQ ID NO: 3955412 - DNA, 18 bp, Homo sapiens
cactgagacggcagagac

SEQ ID NO: 3955413 - DNA, 17 bp, Homo sapiens
cactgagatctgtttga

SEQ ID NO: 3955414 - DNA, 15 bp, Homo sapiens
cactgaggatgtgag

SEQ ID NO: 3955415 - DNA, 18 bp, Homo sapiens
cactgaggatgtgagcct

SEQ ID NO: 3955416 - DNA, 10 bp, Homo sapiens
cactgagggc

SEQ ID NO: 3955417 - DNA, 14 bp, Homo sapiens
cactgagggccaca

SEQ ID NO: 3955418 - DNA, 18 bp, Homo sapiens
cactgatttcacaacaga

SEQ ID NO: 3955419 - DNA, 19 bp, Homo sapiens
cactgatttcacaacagat

SEQ ID NO: 3955420 - DNA, 21 bp, Homo sapiens
cactgcaacctccacctcctg

SEQ ID NO: 3955421 - DNA, 20 bp, Homo sapiens
cactgcaagagccttggtgt

SEQ ID NO: 3955422 - DNA, 13 bp, Homo sapiens
cactgcactccgg

SEQ ID NO: 3955423 - DNA, 13 bp, Homo sapiens
cactgcaggcccc

SEQ ID NO: 3955424 - DNA, 13 bp, Homo sapiens
cactgcaggggcc

SEQ ID NO: 3955425 - DNA, 12 bp, Homo sapiens
cactgccaggag

SEQ ID NO: 3955426 - DNA, 13 bp, Homo sapiens
cactgccaggagg

SEQ ID NO: 3955427 - DNA, 22 bp, Homo sapiens
cactgccaggcacctggcctgc

SEQ ID NO: 3955428 - DNA, 23 bp, Homo sapiens
cactgccaggcacctggcctgct

SEQ ID NO: 3955429 - DNA, 12 bp, Homo sapiens
cactgccctgcc

SEQ ID NO: 3955430 - DNA, 13 bp, Homo sapiens
cactgccctgcct

SEQ ID NO: 3955431 - DNA, 16 bp, Homo sapiens
cactgccctgcctgcc

SEQ ID NO: 3955432 - DNA, 22 bp, Homo sapiens
cactgccttcgatacaccgggc

SEQ ID NO: 3955433 - DNA, 21 bp, Homo sapiens
cactgctaggcgagtgccagg

SEQ ID NO: 3955434 - DNA, 22 bp, Homo sapiens
cactgctaggcgagtgccagga

SEQ ID NO: 3955435 - DNA, 19 bp, Homo sapiens
cactgctcaagaagacatg

SEQ ID NO: 3955436 - DNA, 13 bp, Homo sapiens
cactgctgcacca

SEQ ID NO: 3955437 - DNA, 15 bp, Homo sapiens
cactgctgcaccaga

SEQ ID NO: 3955438 - DNA, 17 bp, Homo sapiens
cactgctgcccagcctc

SEQ ID NO: 3955439 - DNA, 13 bp, Homo sapiens
cactgctggctgc

SEQ ID NO: 3955440 - DNA, 14 bp, Homo sapiens
cactgctggctgcc

SEQ ID NO: 3955441 - DNA, 16 bp, Homo sapiens
cactggaacagcccat

SEQ ID NO: 3955442 - DNA, 20 bp, Homo sapiens
cactggaatcgatctgtact

SEQ ID NO: 3955443 - DNA, 16 bp, Homo sapiens
cactggaccactgggc

SEQ ID NO: 3955444 - DNA, 16 bp, Homo sapiens
cactggagcaccaggc

SEQ ID NO: 3955445 - DNA, 17 bp, Homo sapiens
cactggagtgcagggag

SEQ ID NO: 3955446 - DNA, 20 bp, Homo sapiens
cactggagtgcagggaggag

SEQ ID NO: 3955447 - DNA, 16 bp, Homo sapiens
cactggcaatgaaaaa

SEQ ID NO: 3955448 - DNA, 14 bp, Homo sapiens
cactggccacccaa

SEQ ID NO: 3955449 - DNA, 18 bp, Homo sapiens
caccctcgtggacacctg

SEQ ID NO: 3955450 - DNA, 23 bp, Homo sapiens
caccctcgtggacacctgccctg

SEQ ID NO: 3955451 - DNA, 13 bp, Homo sapiens
caccctctccatg

SEQ ID NO: 3955452 - DNA, 15 bp, Homo sapiens
caccctctccatgcc

SEQ ID NO: 3955453 - DNA, 18 bp, Homo sapiens
caccctgaatggttccat

SEQ ID NO: 3955454 - DNA, 15 bp, Homo sapiens
caccctgaggagtct

SEQ ID NO: 3955455 - DNA, 22 bp, Homo sapiens
caccctgaggagtctgaggtcc

SEQ ID NO: 3955456 - DNA, 11 bp, Homo sapiens
caccctgcaga

SEQ ID NO: 3955457 - DNA, 17 bp, Homo sapiens
caccctggcccgcccct

SEQ ID NO: 3955458 - DNA, 17 bp, Homo sapiens
caccctgggtgccattc

SEQ ID NO: 3955459 - DNA, 17 bp, Homo sapiens
caccctgtctaaaaaac

SEQ ID NO: 3955460 - DNA, 22 bp, Homo sapiens
cacccttcacataccctccccc

SEQ ID NO: 3955461 - DNA, 12 bp, Homo sapiens
cacccttctggg

SEQ ID NO: 3955462 - DNA, 16 bp, Homo sapiens
cacccttctttcctct

SEQ ID NO: 3955463 - DNA, 18 bp, Homo sapiens
cacccttctttcctcttc

SEQ ID NO: 3955464 - DNA, 18 bp, Homo sapiens
caccgagacggctggacc

SEQ ID NO: 3955465 - DNA, 21 bp, Homo sapiens
caccgagagtagccgagagcc

SEQ ID NO: 3955466 - DNA, 13 bp, Homo sapiens
caccgctgcctaa

SEQ ID NO: 3955467 - DNA, 19 bp, Homo sapiens
caccgctgcctaagtggct

SEQ ID NO: 3955468 - DNA, 13 bp, Homo sapiens
caccggcgctgca

SEQ ID NO: 3955469 - DNA, 14 bp, Homo sapiens
caccggcgctgcag

SEQ ID NO: 3955470 - DNA, 15 bp, Homo sapiens
caccggcgctgcagg

SEQ ID NO: 3955471 - DNA, 19 bp, Homo sapiens
caccgggagcctccccctc

SEQ ID NO: 3955472 - DNA, 21 bp, Homo sapiens
caccgggagcctccccctcag

SEQ ID NO: 3955473 - DNA, 14 bp, Homo sapiens
caccgggccactcc

SEQ ID NO: 3955474 - DNA, 21 bp, Homo sapiens
caccgggccactccttcctgc

SEQ ID NO: 3955475 - DNA, 15 bp, Homo sapiens
caccgggccctcctt

SEQ ID NO: 3955476 - DNA, 14 bp, Homo sapiens
caccgtccctcagt

SEQ ID NO: 3955477 - DNA, 15 bp, Homo sapiens
caccgtccctcagtg

SEQ ID NO: 3955478 - DNA, 19 bp, Homo sapiens
cacctaatcaggctgaggt

SEQ ID NO: 3955479 - DNA, 13 bp, Homo sapiens
cacctaccatgct

SEQ ID NO: 3955480 - DNA, 19 bp, Homo sapiens
cacctaccccccaaaaaaa

SEQ ID NO: 3955481 - DNA, 17 bp, Homo sapiens
cacctactactcaattg

SEQ ID NO: 3955482 - DNA, 17 bp, Homo sapiens
cacctactcacacaggc

SEQ ID NO: 3955483 - DNA, 15 bp, Homo sapiens
cacctagtccagtga

SEQ ID NO: 3955484 - DNA, 23 bp, Homo sapiens
  misc_feature (7)..(7): n is a, c, g or t
  misc_feature (14)..(14): n is a, c, g or t
cacctanccccccnacccccagt

SEQ ID NO: 3955485 - DNA, 14 bp, Homo sapiens
cacctcactcctgt

SEQ ID NO: 3955486 - DNA, 15 bp, Homo sapiens
cacctcactcctgtt

SEQ ID NO: 3955487 - DNA, 13 bp, Homo sapiens
cacctcagacaat

SEQ ID NO: 3955488 - DNA, 21 bp, Homo sapiens
cacctcagacaatccactctc

SEQ ID NO: 3955489 - DNA, 23 bp, Homo sapiens
cacctcatgcctggcccccctcc

SEQ ID NO: 3955490 - DNA, 15 bp, Homo sapiens
cacctcccaccccac

SEQ ID NO: 3955491 - DNA, 21 bp, Homo sapiens
cacctcccaccccactccagc

SEQ ID NO: 3955492 - DNA, 16 bp, Homo sapiens
cacctccccccactgc

SEQ ID NO: 3955493 - DNA, 20 bp, Homo sapiens
cacctcccctatccacccag

SEQ ID NO: 3955494 - DNA, 21 bp, Homo sapiens
cacctccctactcccctgggc

SEQ ID NO: 3955495 - DNA, 14 bp, Homo sapiens
cacctccctcccca

SEQ ID NO: 3955496 - DNA, 20 bp, Homo sapiens
cacctcctccactcactcca

SEQ ID NO: 3955497 - DNA, 23 bp, Homo sapiens
cacctcctccactcactccagcc

SEQ ID NO: 3955498 - DNA, 18 bp, Homo sapiens
cacctccttgctttgctg

SEQ ID NO: 3955499 - DNA, 12 bp, Homo sapiens
cacctctcttca

SEQ ID NO: 3955500 - DNA, 12 bp, Homo sapiens
cacctctgctgc

SEQ ID NO: 3955501 - DNA, 18 bp, Homo sapiens
cacctctggctttgtctc

SEQ ID NO: 3955502 - DNA, 14 bp, Homo sapiens
cacctcttcacccc

SEQ ID NO: 3955503 - DNA, 20 bp, Homo sapiens
cacctcttcaccccccactc

SEQ ID NO: 3955504 - DNA, 17 bp, Homo sapiens
cacctcttctcttcctg

SEQ ID NO: 3955505 - DNA, 22 bp, Homo sapiens
cacctgaaccccatgggcttgg

SEQ ID NO: 3955506 - DNA, 18 bp, Homo sapiens
cacctgacaatggcagct

SEQ ID NO: 3955507 - DNA, 19 bp, Homo sapiens
cacctgagtcaccctacct

SEQ ID NO: 3955508 - DNA, 15 bp, Homo sapiens
cacctgcaagcccca

SEQ ID NO: 3955509 - DNA, 22 bp, Homo sapiens
cacctgcaagccccagggcctg

SEQ ID NO: 3955510 - DNA, 14 bp, Homo sapiens
cacctgcacctccc

SEQ ID NO: 3955511 - DNA, 15 bp, Homo sapiens
cacctgcacctcccc

SEQ ID NO: 3955512 - DNA, 17 bp, Homo sapiens
cacctgcacctcccccc

SEQ ID NO: 3955513 - DNA, 22 bp, Homo sapiens
cacctgcacctccccccactgc

SEQ ID NO: 3955514 - DNA, 13 bp, Homo sapiens
cacctgcagattc

SEQ ID NO: 3955515 - DNA, 15 bp, Homo sapiens
cacctgcagattctg

SEQ ID NO: 3955516 - DNA, 19 bp, Homo sapiens
cacctgccaattctacatg

SEQ ID NO: 3955517 - DNA, 14 bp, Homo sapiens
cacctgccagccat

SEQ ID NO: 3955518 - DNA, 16 bp, Homo sapiens
cacctgccagccatca

SEQ ID NO: 3955519 - DNA, 17 bp, Homo sapiens
cacctgccagccatcac

SEQ ID NO: 3955520 - DNA, 18 bp, Homo sapiens
cacctgccagccatcaca

SEQ ID NO: 3955521 - DNA, 19 bp, Homo sapiens
cacctgcccaacctgctct

SEQ ID NO: 3955522 - DNA, 14 bp, Homo sapiens
cacctgccctgccc

SEQ ID NO: 3955523 - DNA, 17 bp, Homo sapiens
cacctgccctgccctgc

SEQ ID NO: 3955524 - DNA, 18 bp, Homo sapiens
cacctgccctgccctgcc

SEQ ID NO: 3955525 - DNA, 22 bp, Homo sapiens
cacctgccctgccctgccacct

SEQ ID NO: 3955526 - DNA, 23 bp, Homo sapiens
cacctgccctgccctgccacctg

SEQ ID NO: 3955527 - DNA, 17 bp, Homo sapiens
cacctgcctatccatcc

SEQ ID NO: 3955528 - DNA, 22 bp, Homo sapiens
cacctgcgagaggtccctgctt

SEQ ID NO: 3955529 - DNA, 10 bp, Homo sapiens
cacctgctgg

SEQ ID NO: 3955530 - DNA, 11 bp, Homo sapiens
cacctgctgga

SEQ ID NO: 3955531 - DNA, 14 bp, Homo sapiens
cacctggccccatg

SEQ ID NO: 3955532 - DNA, 15 bp, Homo sapiens
cacctggccccatgt

SEQ ID NO: 3955533 - DNA, 12 bp, Homo sapiens
cacctggcctgc

SEQ ID NO: 3955534 - DNA, 13 bp, Homo sapiens
cacctggcctgct

SEQ ID NO: 3955535 - DNA, 21 bp, Homo sapiens
cactggccagagagggcccag

SEQ ID NO: 3955536 - DNA, 23 bp, Homo sapiens
cactggccagagagggcccagct

SEQ ID NO: 3955537 - DNA, 21 bp, Homo sapiens
cactggccagtcctagagctc

SEQ ID NO: 3955538 - DNA, 18 bp, Homo sapiens
cactggctggggcagagg

SEQ ID NO: 3955539 - DNA, 20 bp, Homo sapiens
cactggctggggcagagggg

SEQ ID NO: 3955540 - DNA, 23 bp, Homo sapiens
cactggctggggcagaggggcag

SEQ ID NO: 3955541 - DNA, 22 bp, Homo sapiens
cactgggatgagccgctgtgag

SEQ ID NO: 3955542 - DNA, 21 bp, Homo sapiens
cactgggtctcactcctgagt

SEQ ID NO: 3955543 - DNA, 15 bp, Homo sapiens
cactgggtgtggccc

SEQ ID NO: 3955544 - DNA, 14 bp, Homo sapiens
cactggtggcatcg

SEQ ID NO: 3955545 - DNA, 22 bp, Homo sapiens
cactgtattttcattttaattt

SEQ ID NO: 3955546 - DNA, 16 bp, Homo sapiens
cactgtcaccctccac

SEQ ID NO: 3955547 - DNA, 14 bp, Homo sapiens
cactgtcagagctg

SEQ ID NO: 3955548 - DNA, 17 bp, Homo sapiens
cactgtcagagctgttg

SEQ ID NO: 3955549 - DNA, 15 bp, Homo sapiens
cactgtcctggctgc

SEQ ID NO: 3955550 - DNA, 20 bp, Homo sapiens
cactgtcctggctgctctca

SEQ ID NO: 3955551 - DNA, 22 bp, Homo sapiens
cactgtctcaactactcagctc

SEQ ID NO: 3955552 - DNA, 14 bp, Homo sapiens
cactgtgctataaa

SEQ ID NO: 3955553 - DNA, 18 bp, Homo sapiens
cactgtgcttacagtgac

SEQ ID NO: 3955554 - DNA, 17 bp, Homo sapiens
cactgtggccagagctg

SEQ ID NO: 3955555 - DNA, 21 bp, Homo sapiens
cactgtgggggctggtcctga

SEQ ID NO: 3955556 - DNA, 21 bp, Homo sapiens
cactgtgttggccaggctggt

SEQ ID NO: 3955557 - DNA, 21 bp, Homo sapiens
cactgttgaaaattattttaa

SEQ ID NO: 3955558 - DNA, 20 bp, Homo sapiens
cactgttgagttggacacac

SEQ ID NO: 3955559 - DNA, 17 bp, Homo sapiens
cacttagaaattgcatt

SEQ ID NO: 3955560 - DNA, 16 bp, Homo sapiens
cacttagcccaagagg

SEQ ID NO: 3955561 - DNA, 21 bp, Homo sapiens
cacttataagtgggagctaaa

SEQ ID NO: 3955562 - DNA, 21 bp, Homo sapiens
cacttcaagtgaccaccagga

SEQ ID NO: 3955563 - DNA, 12 bp, Homo sapiens
cacttcactgtg

SEQ ID NO: 3955564 - DNA, 13 bp, Homo sapiens
cacttcagcccag

SEQ ID NO: 3955565 - DNA, 14 bp, Homo sapiens
cacttcagcccagc

SEQ ID NO: 3955566 - DNA, 15 bp, Homo sapiens
cacttcaggctcttc

SEQ ID NO: 3955567 - DNA, 11 bp, Homo sapiens
cacttccctgg

SEQ ID NO: 3955568 - DNA, 18 bp, Homo sapiens
cacttccctgggaactca

SEQ ID NO: 3955569 - DNA, 17 bp, Homo sapiens
cacttctaaatgaagtg

SEQ ID NO: 3955570 - DNA, 21 bp, Homo sapiens
cacttctcacatcttatgcta

SEQ ID NO: 3955571 - DNA, 13 bp, Homo sapiens
cacttctcaggac

SEQ ID NO: 3955572 - DNA, 15 bp, Homo sapiens
cacttctcaggacac

SEQ ID NO: 3955573 - DNA, 19 bp, Homo sapiens
cacttctcatcatattgta

SEQ ID NO: 3955574 - DNA, 12 bp, Homo sapiens
cacttctctaga

SEQ ID NO: 3955575 - DNA, 18 bp, Homo sapiens
cacttcttaaaggcctgg

SEQ ID NO: 3955576 - DNA, 15 bp, Homo sapiens
cacttcttgaaacag

SEQ ID NO: 3955577 - DNA, 19 bp, Homo sapiens
cacttcttgaaacagcctg

SEQ ID NO: 3955578 - DNA, 15 bp, Homo sapiens
cacttcttttataac

SEQ ID NO: 3955579 - DNA, 15 bp, Homo sapiens
cacttgacattcctt

SEQ ID NO: 3955580 - DNA, 14 bp, Homo sapiens
cacttgattccttg

SEQ ID NO: 3955581 - DNA, 15 bp, Homo sapiens
cacttgcgtcctgca

SEQ ID NO: 3955582 - DNA, 11 bp, Homo sapiens
cacttgggagc

SEQ ID NO: 3955583 - DNA, 18 bp, Homo sapiens
cacttggtttttggctct

SEQ ID NO: 3955584 - DNA, 20 bp, Homo sapiens
cacttggtttttggctcttt

SEQ ID NO: 3955585 - DNA, 13 bp, Homo sapiens
cacttgtaaataa

SEQ ID NO: 3955586 - DNA, 17 bp, Homo sapiens
cacttgtaaataaatag

SEQ ID NO: 3955587 - DNA, 19 bp, Homo sapiens
cacttgtataaatgtatat

SEQ ID NO: 3955588 - DNA, 15 bp, Homo sapiens
cactttaaccctctc

SEQ ID NO: 3955589 - DNA, 20 bp, Homo sapiens
cactttaaccctctcttccc

SEQ ID NO: 3955590 - DNA, 17 bp, Homo sapiens
cactttcctacaaaatg

SEQ ID NO: 3955591 - DNA, 16 bp, Homo sapiens
cactttctatagcaga

SEQ ID NO: 3955592 - DNA, 14 bp, Homo sapiens
cactttgcacagct

SEQ ID NO: 3955593 - DNA, 20 bp, Homo sapiens
cactttggatttcatcagac

SEQ ID NO: 3955594 - DNA, 20 bp, Homo sapiens
cactttggcttctcctgtga

SEQ ID NO: 3955595 - DNA, 21 bp, Homo sapiens
cactttggcttctcctgtgac

SEQ ID NO: 3955596 - DNA, 14 bp, Homo sapiens
cagaaaaaaataaa

SEQ ID NO: 3955597 - DNA, 19 bp, Homo sapiens
cagaaaaactctgggaaat

SEQ ID NO: 3955598 - DNA, 17 bp, Homo sapiens
cagaaaacaaatcttca

SEQ ID NO: 3955599 - DNA, 15 bp, Homo sapiens
cagaaaagaaaacca

SEQ ID NO: 3955600 - DNA, 20 bp, Homo sapiens
cagaaaagaggagaccctgg

SEQ ID NO: 3955601 - DNA, 14 bp, Homo sapiens
cagaaaagcacctg

SEQ ID NO: 3955602 - DNA, 15 bp, Homo sapiens
cagaaaagcacctgc

SEQ ID NO: 3955603 - DNA, 17 bp, Homo sapiens
cagaaaagggaagttgt

SEQ ID NO: 3955604 - DNA, 14 bp, Homo sapiens
cagaaaagtagaat

SEQ ID NO: 3955605 - DNA, 16 bp, Homo sapiens
cagaaaatataaatgc

SEQ ID NO: 3955606 - DNA, 21 bp, Homo sapiens
cagaaaatataaatgcatgat

SEQ ID NO: 3955607 - DNA, 22 bp, Homo sapiens
cagaaacaggtgcatctgggga

SEQ ID NO: 3955608 - DNA, 20 bp, Homo sapiens
cagaaagtgaggaagcctaa

SEQ ID NO: 3955609 - DNA, 17 bp, Homo sapiens
cagaaatatatatacat

SEQ ID NO: 3955610 - DNA, 15 bp, Homo sapiens
cagaaatatgtggtt

SEQ ID NO: 3955611 - DNA, 22 bp, Homo sapiens
cagaacctcaagtctagaaacc

SEQ ID NO: 3955612 - DNA, 12 bp, Homo sapiens
cagaacctggag

SEQ ID NO: 3955613 - DNA, 23 bp, Homo sapiens
cagaactgaggtcactgggttct

SEQ ID NO: 3955614 - DNA, 21 bp, Homo sapiens
cagaagaaaaagttgcagtct

SEQ ID NO: 3955615 - DNA, 11 bp, Homo sapiens
cagaagaaaga

SEQ ID NO: 3955616 - DNA, 12 bp, Homo sapiens
cagaagaatatt

SEQ ID NO: 3955617 - DNA, 14 bp, Homo sapiens
cagaagaatattca

SEQ ID NO: 3955618 - DNA, 19 bp, Homo sapiens
cagaagaatattcaggact

SEQ ID NO: 3955619 - DNA, 20 bp, Homo sapiens
cagaagaatattcaggactt

SEQ ID NO: 3955620 - DNA, 19 bp, Homo sapiens
cagaagaattgaacccagg

SEQ ID NO: 3955621 - DNA, 13 bp, Homo sapiens
cagagacacctgc

SEQ ID NO: 3955622 - DNA, 15 bp, Homo sapiens
cagagacacctgcac

SEQ ID NO: 3955623 - DNA, 22 bp, Homo sapiens
cagagacacctgcacctccccc

SEQ ID NO: 3955624 - DNA, 21 bp, Homo sapiens
cagagacagaaacagagagag

SEQ ID NO: 3955625 - DNA, 15 bp, Homo sapiens
cagagacagagagag

SEQ ID NO: 3955626 - DNA, 23 bp, Homo sapiens
cagagacaggaaaatcctctggc

SEQ ID NO: 3955627 - DNA, 19 bp, Homo sapiens
cagagacaggcccaagaga

SEQ ID NO: 3955628 - DNA, 14 bp, Homo sapiens
cagagaccccagga

SEQ ID NO: 3955629 - DNA, 15 bp, Homo sapiens
cagagaccccaggat

SEQ ID NO: 3955630 - DNA, 17 bp, Homo sapiens
cagagaccccaggatcc

SEQ ID NO: 3955631 - DNA, 21 bp, Homo sapiens
cagagaccccttcctttcctc

SEQ ID NO: 3955632 - DNA, 22 bp, Homo sapiens
cagagaccccttcctttcctct

SEQ ID NO: 3955633 - DNA, 14 bp, Homo sapiens
cagagaccttttct

SEQ ID NO: 3955634 - DNA, 19 bp, Homo sapiens
cagagaccttttctctccc

SEQ ID NO: 3955635 - DNA, 20 bp, Homo sapiens
cagagaccttttctctccca

SEQ ID NO: 3955636 - DNA, 22 bp, Homo sapiens
cagagaccttttctctcccata

SEQ ID NO: 3955637 - DNA, 18 bp, Homo sapiens
cagagacgcaagggagaa

SEQ ID NO: 3955638 - DNA, 16 bp, Homo sapiens
cagagactctggaagc

SEQ ID NO: 3955639 - DNA, 18 bp, Homo sapiens
cagagactctggaagccc

SEQ ID NO: 3955640 - DNA, 21 bp, Homo sapiens
cagagactctggaagcccccc

SEQ ID NO: 3955641 - DNA, 18 bp, Homo sapiens
cagagacttggggaccag

SEQ ID NO: 3955642 - DNA, 15 bp, Homo sapiens
cagagagacagaccg

SEQ ID NO: 3955643 - DNA, 17 bp, Homo sapiens
cagagagagacagagac

SEQ ID NO: 3955644 - DNA, 21 bp, Homo sapiens
cagagagagactgagggagag

SEQ ID NO: 3955645 - DNA, 18 bp, Homo sapiens
cagagagaggatgcagag

SEQ ID NO: 3955646 - DNA, 20 bp, Homo sapiens
cagagagaggatgcagaggg

SEQ ID NO: 3955647 - DNA, 20 bp, Homo sapiens
cagagagcttagcctggagc

SEQ ID NO: 3955648 - DNA, 12 bp, Homo sapiens
cagagaggagca

SEQ ID NO: 3955649 - DNA, 14 bp, Homo sapiens
cagagaggagcacc

SEQ ID NO: 3955650 - DNA, 17 bp, Homo sapiens
cagagaggagcacctga

SEQ ID NO: 3955651 - DNA, 18 bp, Homo sapiens
cagagaggagttgccagg

SEQ ID NO: 3955652 - DNA, 13 bp, Homo sapiens
cagagaggccttt

SEQ ID NO: 3955653 - DNA, 13 bp, Homo sapiens
cagagagggccca

SEQ ID NO: 3955654 - DNA, 15 bp, Homo sapiens
cagagagggcccagc

SEQ ID NO: 3955655 - DNA, 16 bp, Homo sapiens
cagagagggcccagct

SEQ ID NO: 3955656 - DNA, 17 bp, Homo sapiens
cagagagggcccagctg

SEQ ID NO: 3955657 - DNA, 13 bp, Homo sapiens
cagagagtggctc

SEQ ID NO: 3955658 - DNA, 14 bp, Homo sapiens
cagagagtggctcc

SEQ ID NO: 3955659 - DNA, 18 bp, Homo sapiens
cagagagtggctcctccc

SEQ ID NO: 3955660 - DNA, 16 bp, Homo sapiens
cagagatctgggaggt

SEQ ID NO: 3955661 - DNA, 13 bp, Homo sapiens
cagagatgcctcc

SEQ ID NO: 3955662 - DNA, 18 bp, Homo sapiens
cagagatggaggccgagc

SEQ ID NO: 3955663 - DNA, 22 bp, Homo sapiens
cagagatggtaatctacagctc

SEQ ID NO: 3955664 - DNA, 14 bp, Homo sapiens
cagagcaaaataat

SEQ ID NO: 3955665 - DNA, 19 bp, Homo sapiens
cagagcaaatgagggaggg

SEQ ID NO: 3955666 - DNA, 12 bp, Homo sapiens
cagagcaggctc

SEQ ID NO: 3955667 - DNA, 13 bp, Homo sapiens
cagagcaggctca

SEQ ID NO: 3955668 - DNA, 21 bp, Homo sapiens
cagagcaggctcagactctgg

SEQ ID NO: 3955669 - DNA, 21 bp, Homo sapiens
cagagcattacgtgagccagg

SEQ ID NO: 3955670 - DNA, 12 bp, Homo sapiens
cagagccagcct

SEQ ID NO: 3955671 - DNA, 13 bp, Homo sapiens
cagagccagcctg

SEQ ID NO: 3955672 - DNA, 19 bp, Homo sapiens
cagagccagcctgggactc

SEQ ID NO: 3955673 - DNA, 19 bp, Homo sapiens
cagagccaggctctgcctg

SEQ ID NO: 3955674 - DNA, 11 bp, Homo sapiens
cagagccagtg

SEQ ID NO: 3955675 - DNA, 14 bp, Homo sapiens
cagagccatgggcc

SEQ ID NO: 3955676 - DNA, 16 bp, Homo sapiens
cagagccatgggcctg

SEQ ID NO: 3955677 - DNA, 19 bp, Homo sapiens
cagagccatgggcctgggc

SEQ ID NO: 3955678 - DNA, 20 bp, Homo sapiens
cagagccatgggcctgggcc

SEQ ID NO: 3955679 - DNA, 15 bp, Homo sapiens
cagagcccaagtgcc

SEQ ID NO: 3955680 - DNA, 16 bp, Homo sapiens
cagagccccacacgga

SEQ ID NO: 3955681 - DNA, 16 bp, Homo sapiens
cagagcccccaagcct

SEQ ID NO: 3955682 - DNA, 14 bp, Homo sapiens
cagagcccccaagg

SEQ ID NO: 3955683 - DNA, 23 bp, Homo sapiens
cagagccctgtgaggctgggtcc

SEQ ID NO: 3955684 - DNA, 17 bp, Homo sapiens
cagagccgcaaatcaac

SEQ ID NO: 3955685 - DNA, 23 bp, Homo sapiens
cagagccgcaaatcaaccccaga

SEQ ID NO: 3955686 - DNA, 19 bp, Homo sapiens
cagagccggggcactttca

SEQ ID NO: 3955687 - DNA, 14 bp, Homo sapiens
cagagcctagccac

SEQ ID NO: 3955688 - DNA, 22 bp, Homo sapiens
cagagcctagccacctcccacc

SEQ ID NO: 3955689 - DNA, 11 bp, Homo sapiens
cagagcctggg

SEQ ID NO: 3955690 - DNA, 19 bp, Homo sapiens
cagagcctggggtgttctc

SEQ ID NO: 3955691 - DNA, 20 bp, Homo sapiens
cagagcgagactccgtctca

SEQ ID NO: 3955692 - DNA, 13 bp, Homo sapiens
cagagcgggcctc

SEQ ID NO: 3955693 - DNA, 21 bp, Homo sapiens
cagagcgggcctcttccctca

SEQ ID NO: 3955694 - DNA, 13 bp, Homo sapiens
cagagcggggagg

SEQ ID NO: 3955695 - DNA, 16 bp, Homo sapiens
cagagcggggaggtgc

SEQ ID NO: 3955696 - DNA, 17 bp, Homo sapiens
cagagctcttcaagctg

SEQ ID NO: 3955697 - DNA, 22 bp, Homo sapiens
cagagctcttcaagctgtcccc

SEQ ID NO: 3955698 - DNA, 12 bp, Homo sapiens
cagagctgaccc

SEQ ID NO: 3955699 - DNA, 20 bp, Homo sapiens
cagagctgatggagaaggaa

SEQ ID NO: 3955700 - DNA, 13 bp, Homo sapiens
cagagctggaaca

SEQ ID NO: 3955701 - DNA, 16 bp, Homo sapiens
cagagctggaaggcag

SEQ ID NO: 3955702 - DNA, 18 bp, Homo sapiens
cagagctggaaggcaggg

SEQ ID NO: 3955703 - DNA, 20 bp, Homo sapiens
cagagctggaaggcagggca

SEQ ID NO: 3955704 - DNA, 20 bp, Homo sapiens
cagagctgggaggcatggcc

SEQ ID NO: 3955705 - DNA, 16 bp, Homo sapiens
cagagctgttggcctc

SEQ ID NO: 3955706 - DNA, 17 bp, Homo sapiens
cagagctgttggcctcg

SEQ ID NO: 3955707 - DNA, 20 bp, Homo sapiens
cagaagaattgaacccagga

SEQ ID NO: 3955708 - DNA, 22 bp, Homo sapiens
cagaagaattgaacccaggagg

SEQ ID NO: 3955709 - DNA, 21 bp, Homo sapiens
cagaagaccacaaaaattgac

SEQ ID NO: 3955710 - DNA, 16 bp, Homo sapiens
cagaagatgccctcca

SEQ ID NO: 3955711 - DNA, 16 bp, Homo sapiens
cagaagccaggagcaa

SEQ ID NO: 3955712 - DNA, 14 bp, Homo sapiens
cagaagcctggggg

SEQ ID NO: 3955713 - DNA, 15 bp, Homo sapiens
cagaaggagggcaga

SEQ ID NO: 3955714 - DNA, 18 bp, Homo sapiens
cagaaggagggcagagcc

SEQ ID NO: 3955715 - DNA, 21 bp, Homo sapiens
cagaaggagggcagagccatg

SEQ ID NO: 3955716 - DNA, 13 bp, Homo sapiens
cagaaggcaggga

SEQ ID NO: 3955717 - DNA, 15 bp, Homo sapiens
cagaagggagaagga

SEQ ID NO: 3955718 - DNA, 21 bp, Homo sapiens
cagaagtccctcccatctcta

SEQ ID NO: 3955719 - DNA, 19 bp, Homo sapiens
cagaagtttgtcaagtcaa

SEQ ID NO: 3955720 - DNA, 15 bp, Homo sapiens
cagaataagtgctgt

SEQ ID NO: 3955721 - DNA, 21 bp, Homo sapiens
cagaataagtgctgtttgaga

SEQ ID NO: 3955722 - DNA, 23 bp, Homo sapiens
cagaataagtgctgtttgagatg

SEQ ID NO: 3955723 - DNA, 15 bp, Homo sapiens
cagaataccttcttc

SEQ ID NO: 3955724 - DNA, 17 bp, Homo sapiens
cagaatcaacttgaagc

SEQ ID NO: 3955725 - DNA, 15 bp, Homo sapiens
cagaatcataatttt

SEQ ID NO: 3955726 - DNA, 13 bp, Homo sapiens
cagaatctgctgt

SEQ ID NO: 3955727 - DNA, 20 bp, Homo sapiens
cagaatctgctgttgccata

SEQ ID NO: 3955728 - DNA, 21 bp, Homo sapiens
cagaatgctaaagtttcctaa

SEQ ID NO: 3955729 - DNA, 15 bp, Homo sapiens
cagaatggaaagaaa

SEQ ID NO: 3955730 - DNA, 15 bp, Homo sapiens
cagaattaactccat

SEQ ID NO: 3955731 - DNA, 14 bp, Homo sapiens
cagaattttgtata

SEQ ID NO: 3955732 - DNA, 13 bp, Homo sapiens
cagaatttttaat

SEQ ID NO: 3955733 - DNA, 15 bp, Homo sapiens
cagaatttttaatga

SEQ ID NO: 3955734 - DNA, 18 bp, Homo sapiens
cagaatttttaatgactt

SEQ ID NO: 3955735 - DNA, 19 bp, Homo sapiens
cagaatttttaatgacttt

SEQ ID NO: 3955736 - DNA, 18 bp, Homo sapiens
cagacaaaaacagcctca

SEQ ID NO: 3955737 - DNA, 22 bp, Homo sapiens
cagacaaaaacagcctcacaga

SEQ ID NO: 3955738 - DNA, 16 bp, Homo sapiens
cagacaagagctgctg

SEQ ID NO: 3955739 - DNA, 21 bp, Homo sapiens
cagacaagagctgctgtcctt

SEQ ID NO: 3955740 - DNA, 23 bp, Homo sapiens
cagacaagcaacaggttttataa

SEQ ID NO: 3955741 - DNA, 19 bp, Homo sapiens
cagacaatccactctcagg

SEQ ID NO: 3955742 - DNA, 22 bp, Homo sapiens
cagacaatccactctcaggagg

SEQ ID NO: 3955743 - DNA, 12 bp, Homo sapiens
cagacactaagt

SEQ ID NO: 3955744 - DNA, 18 bp, Homo sapiens
cagacactaagttatagt

SEQ ID NO: 3955745 - DNA, 14 bp, Homo sapiens
cagacagagccctg

SEQ ID NO: 3955746 - DNA, 19 bp, Homo sapiens
cagacaggtaaatgggcag

SEQ ID NO: 3955747 - DNA, 22 bp, Homo sapiens
cagacatccatgtttgtaaaac

SEQ ID NO: 3955748 - DNA, 23 bp, Homo sapiens
cagacatccatgtttgtaaaact

SEQ ID NO: 3955749 - DNA, 16 bp, Homo sapiens
cagaccacctgccagc

SEQ ID NO: 3955750 - DNA, 15 bp, Homo sapiens
cagaccattgtcttc

SEQ ID NO: 3955751 - DNA, 23 bp, Homo sapiens
cagaccattgtcttccaacccca

SEQ ID NO: 3955752 - DNA, 14 bp, Homo sapiens
cagaccccagcggc

SEQ ID NO: 3955753 - DNA, 14 bp, Homo sapiens
cagacccccactct

SEQ ID NO: 3955754 - DNA, 16 bp, Homo sapiens
cagacccctggctttt

SEQ ID NO: 3955755 - DNA, 14 bp, Homo sapiens
cagacccctgtggc

SEQ ID NO: 3955756 - DNA, 17 bp, Homo sapiens
cagacccctgtggcaga

SEQ ID NO: 3955757 - DNA, 21 bp, Homo sapiens
cagacccctgtggcagaccgg

SEQ ID NO: 3955758 - DNA, 14 bp, Homo sapiens
cagaccgggggcca

SEQ ID NO: 3955759 - DNA, 20 bp, Homo sapiens
cagaccggggttcaagccat

SEQ ID NO: 3955760 - DNA, 22 bp, Homo sapiens
cagaccggggttcaagccatgg

SEQ ID NO: 3955761 - DNA, 23 bp, Homo sapiens
cagaccggggttcaagccatggc

SEQ ID NO: 3955762 - DNA, 19 bp, Homo sapiens
cagacctagacctgggcca

SEQ ID NO: 3955763 - DNA, 14 bp, Homo sapiens
cagacctctgatcc

SEQ ID NO: 3955764 - DNA, 20 bp, Homo sapiens
cagacgcagcagctgggacc

SEQ ID NO: 3955765 - DNA, 17 bp, Homo sapiens
cagacgctgccgctgcc

SEQ ID NO: 3955766 - DNA, 15 bp, Homo sapiens
cagacgtctcaagac

SEQ ID NO: 3955767 - DNA, 17 bp, Homo sapiens
cagactcaaactcaagg

SEQ ID NO: 3955768 - DNA, 14 bp, Homo sapiens
cagactcagctcca

SEQ ID NO: 3955769 - DNA, 15 bp, Homo sapiens
cagactcagctccag

SEQ ID NO: 3955770 - DNA, 14 bp, Homo sapiens
cagactcctcagat

SEQ ID NO: 3955771 - DNA, 17 bp, Homo sapiens
cagactcctttcctctg

SEQ ID NO: 3955772 - DNA, 21 bp, Homo sapiens
cagactctgggtccctcggag

SEQ ID NO: 3955773 - DNA, 14 bp, Homo sapiens
cagactgcttccaa

SEQ ID NO: 3955774 - DNA, 21 bp, Homo sapiens
cagacttccctgaatgtattg

SEQ ID NO: 3955775 - DNA, 14 bp, Homo sapiens
cagacttctggaag

SEQ ID NO: 3955776 - DNA, 21 bp, Homo sapiens
cagactttctacacctgttgc

SEQ ID NO: 3955777 - DNA, 15 bp, Homo sapiens
cagagaaagaagaga

SEQ ID NO: 3955778 - DNA, 19 bp, Homo sapiens
cagagaaagaagagacagg

SEQ ID NO: 3955779 - DNA, 16 bp, Homo sapiens
cagagaaatgtgaagg

SEQ ID NO: 3955780 - DNA, 20 bp, Homo sapiens
cagagaaatgtgaagggtgg

SEQ ID NO: 3955781 - DNA, 15 bp, Homo sapiens
cagagaaattctgtg

SEQ ID NO: 3955782 - DNA, 16 bp, Homo sapiens
cagagaaattctgtgg

SEQ ID NO: 3955783 - DNA, 18 bp, Homo sapiens
cagagaagaaagaacgga

SEQ ID NO: 3955784 - DNA, 15 bp, Homo sapiens
cagagaagataatgt

SEQ ID NO: 3955785 - DNA, 13 bp, Homo sapiens
cagagaaggcagg

SEQ ID NO: 3955786 - DNA, 20 bp, Homo sapiens
cagagaaggcaggaatgtgt

SEQ ID NO: 3955787 - DNA, 14 bp, Homo sapiens
cagagaaggcctct

SEQ ID NO: 3955788 - DNA, 18 bp, Homo sapiens
cagagaaggcctcttgtg

SEQ ID NO: 3955789 - DNA, 11 bp, Homo sapiens
cagagaagttc

SEQ ID NO: 3955790 - DNA, 18 bp, Homo sapiens
cagagaatatcaagatga

SEQ ID NO: 3955791 - DNA, 13 bp, Homo sapiens
cagagaatcaggg

SEQ ID NO: 3955792 - DNA, 13 bp, Homo sapiens
cagagaatttcta

SEQ ID NO: 3955793 - DNA, 21 bp, Homo sapiens
caggcaccccctggagagaag

SEQ ID NO: 3955794 - DNA, 16 bp, Homo sapiens
caggcacctggcctgc

SEQ ID NO: 3955795 - DNA, 18 bp, Homo sapiens
caggcacctggcctgctg

SEQ ID NO: 3955796 - DNA, 16 bp, Homo sapiens
caggcactgctgccca

SEQ ID NO: 3955797 - DNA, 14 bp, Homo sapiens
caggcactggtggc

SEQ ID NO: 3955798 - DNA, 17 bp, Homo sapiens
caggcactggtggcatc

SEQ ID NO: 3955799 - DNA, 13 bp, Homo sapiens
caggcaggaagag

SEQ ID NO: 3955800 - DNA, 18 bp, Homo sapiens
caggcaggaagagagaga

SEQ ID NO: 3955801 - DNA, 13 bp, Homo sapiens
caggcagggctct

SEQ ID NO: 3955802 - DNA, 16 bp, Homo sapiens
caggcagggctctcct

SEQ ID NO: 3955803 - DNA, 20 bp, Homo sapiens
caggcagggctctcctggct

SEQ ID NO: 3955804 - DNA, 21 bp, Homo sapiens
caggcagggctctcctggctt

SEQ ID NO: 3955805 - DNA, 14 bp, Homo sapiens
caggcatcccatcc

SEQ ID NO: 3955806 - DNA, 17 bp, Homo sapiens
caggcatcccatccctt

SEQ ID NO: 3955807 - DNA, 19 bp, Homo sapiens
caggcatttcctgggtggc

SEQ ID NO: 3955808 - DNA, 16 bp, Homo sapiens
caggccaccaggatgg

SEQ ID NO: 3955809 - DNA, 23 bp, Homo sapiens
caggccactgtggccagagctgg

SEQ ID NO: 3955810 - DNA, 15 bp, Homo sapiens
caggccacttgatga

SEQ ID NO: 3955811 - DNA, 15 bp, Homo sapiens
caggcccagagaagc

SEQ ID NO: 3955812 - DNA, 19 bp, Homo sapiens
caggcccatctcaggtgcc

SEQ ID NO: 3955813 - DNA, 20 bp, Homo sapiens
caggcccatctcaggtgcca

SEQ ID NO: 3955814 - DNA, 19 bp, Homo sapiens
caggcccccaggtgccagt

SEQ ID NO: 3955815 - DNA, 17 bp, Homo sapiens
caggccccgcttgtcca

SEQ ID NO: 3955816 - DNA, 22 bp, Homo sapiens
caggccccgcttgtccagcgcc

SEQ ID NO: 3955817 - DNA, 23 bp, Homo sapiens
caggccccgcttgtccagcgcct

SEQ ID NO: 3955818 - DNA, 13 bp, Homo sapiens
caggcccctgagg

SEQ ID NO: 3955819 - DNA, 16 bp, Homo sapiens
catagaaatacctcat

SEQ ID NO: 3955820 - DNA, 23 bp, Homo sapiens
catagaaatgtaacttttgtaag

SEQ ID NO: 3955821 - DNA, 15 bp, Homo sapiens
catagagtttaacac

SEQ ID NO: 3955822 - DNA, 18 bp, Homo sapiens
catagagtttaacacaag

SEQ ID NO: 3955823 - DNA, 15 bp, Homo sapiens
catagatggaccagt

SEQ ID NO: 3955824 - DNA, 21 bp, Homo sapiens
catagatgtatcattaatgta

SEQ ID NO: 3955825 - DNA, 17 bp, Homo sapiens
catagattccctgagca

SEQ ID NO: 3955826 - DNA, 23 bp, Homo sapiens
catagctggttatttctcccttg

SEQ ID NO: 3955827 - DNA, 18 bp, Homo sapiens
cataggaaaagtacattt

SEQ ID NO: 3955828 - DNA, 18 bp, Homo sapiens
cataggcggtcatgtgtg

SEQ ID NO: 3955829 - DNA, 16 bp, Homo sapiens
cataggtatttcaaaa

SEQ ID NO: 3955830 - DNA, 18 bp, Homo sapiens
catagtgatggttcccct

SEQ ID NO: 3955831 - DNA, 22 bp, Homo sapiens
catagtgatggttcccctgttc

SEQ ID NO: 3955832 - DNA, 18 bp, Homo sapiens
catagttatttacttgaa

SEQ ID NO: 3955833 - DNA, 22 bp, Homo sapiens
catatacctataatgtgtgtat

SEQ ID NO: 3955834 - DNA, 14 bp, Homo sapiens
catatatatataca

SEQ ID NO: 3955835 - DNA, 18 bp, Homo sapiens
catatatatatacacata

SEQ ID NO: 3955836 - DNA, 20 bp, Homo sapiens
catatatatatacacataca

SEQ ID NO: 3955837 - DNA, 17 bp, Homo sapiens
catatatgaggacttgt

SEQ ID NO: 3955838 - DNA, 20 bp, Homo sapiens
catatattcatgtaataaat

SEQ ID NO: 3955839 - DNA, 13 bp, Homo sapiens
catatcaattcaa

SEQ ID NO: 3955840 - DNA, 17 bp, Homo sapiens
catatcagaaaagtaga

SEQ ID NO: 3955841 - DNA, 19 bp, Homo sapiens
catatcagaaaagtagaat

SEQ ID NO: 3955842 - DNA, 17 bp, Homo sapiens
catatcagacctctgat

SEQ ID NO: 3955843 - DNA, 22 bp, Homo sapiens
cagggagcaatgggagggggct

SEQ ID NO: 3955844 - DNA, 15 bp, Homo sapiens
cagggagcatggctg

SEQ ID NO: 3955845 - DNA, 19 bp, Homo sapiens
cagggagcatggctgtgag

SEQ ID NO: 3955846 - DNA, 20 bp, Homo sapiens
cagggagcccctaggaaagc

SEQ ID NO: 3955847 - DNA, 12 bp, Homo sapiens
cagggaggagag

SEQ ID NO: 3955848 - DNA, 23 bp, Homo sapiens
cagggaggagaggggaagggcca

SEQ ID NO: 3955849 - DNA, 22 bp, Homo sapiens
cagggaggatgccacagcccca

SEQ ID NO: 3955850 - DNA, 12 bp, Homo sapiens
cagggaggccga

SEQ ID NO: 3955851 - DNA, 15 bp, Homo sapiens
cagggaggccgaagc

SEQ ID NO: 3955852 - DNA, 21 bp, Homo sapiens
cagggaggggactatttatga

SEQ ID NO: 3955853 - DNA, 19 bp, Homo sapiens
cagggatcttgcattccca

SEQ ID NO: 3955854 - DNA, 13 bp, Homo sapiens
cagggatggggga

SEQ ID NO: 3955855 - DNA, 20 bp, Homo sapiens
cagggcaaatgacatgcact

SEQ ID NO: 3955856 - DNA, 15 bp, Homo sapiens
cagggcacaggagct

SEQ ID NO: 3955857 - DNA, 16 bp, Homo sapiens
cagggcacaggagcta

SEQ ID NO: 3955858 - DNA, 18 bp, Homo sapiens
cagggcacaggagctacc

SEQ ID NO: 3955859 - DNA, 19 bp, Homo sapiens
cagggcacaggagctacct

SEQ ID NO: 3955860 - DNA, 12 bp, Homo sapiens
cagggcagcctc

SEQ ID NO: 3955861 - DNA, 22 bp, Homo sapiens
cagggcagtgacaagtggaggg

SEQ ID NO: 3955862 - DNA, 20 bp, Homo sapiens
cagggcatggccaggtggcc

SEQ ID NO: 3955863 - DNA, 17 bp, Homo sapiens
cagggcatggctgggaa

SEQ ID NO: 3955864 - DNA, 20 bp, Homo sapiens
cagggccacgtgccaggccc

SEQ ID NO: 3955865 - DNA, 14 bp, Homo sapiens
cagggccagaagga

SEQ ID NO: 3955866 - DNA, 16 bp, Homo sapiens
cagggccagaaggagg

SEQ ID NO: 3955867 - DNA, 11 bp, Homo sapiens
cagggcccctc

SEQ ID NO: 3955868 - DNA, 20 bp, Homo sapiens
cagggcccctccctctgccc

SEQ ID NO: 3955869 - DNA, 20 bp, Homo sapiens
cagggccggggaactggcca

SEQ ID NO: 3955870 - DNA, 24 bp, Homo sapiens
cagggccggggaactggccaagct

SEQ ID NO: 3955871 - DNA, 23 bp, Homo sapiens
cagggcctactgccacccgcttc

SEQ ID NO: 3955872 - DNA, 13 bp, Homo sapiens
cagggcctggggg

SEQ ID NO: 3955873 - DNA, 20 bp, Homo sapiens
cagggcctgggggcagtgac

SEQ ID NO: 3955874 - DNA, 21 bp, Homo sapiens
cagggcctgggggcagtgact

SEQ ID NO: 3955875 - DNA, 22 bp, Homo sapiens
cagggcctgggggcagtgactg

SEQ ID NO: 3955876 - DNA, 23 bp, Homo sapiens
cagggcctgggggcagtgactgg

SEQ ID NO: 3955877 - DNA, 15 bp, Homo sapiens
cagggcctggtgtga

SEQ ID NO: 3955878 - DNA, 15 bp, Homo sapiens
cagggccttgcccag

SEQ ID NO: 3955879 - DNA, 17 bp, Homo sapiens
cagggctaccctccccc

SEQ ID NO: 3955880 - DNA, 14 bp, Homo sapiens
cagggctctcctgg

SEQ ID NO: 3955881 - DNA, 17 bp, Homo sapiens
cagggctctcctggctt

SEQ ID NO: 3955882 - DNA, 18 bp, Homo sapiens
cagggctctttgatggac

SEQ ID NO: 3955883 - DNA, 14 bp, Homo sapiens
cagggctgccacta

SEQ ID NO: 3955884 - DNA, 23 bp, Homo sapiens
cagggctgccactaacctgtaga

SEQ ID NO: 3955885 - DNA, 22 bp, Homo sapiens
cagggctggagtgcgctcttgg

SEQ ID NO: 3955886 - DNA, 17 bp, Homo sapiens
caggggaccacacctcc

SEQ ID NO: 3955887 - DNA, 21 bp, Homo sapiens
caggggagagggtctggagaa

SEQ ID NO: 3955888 - DNA, 14 bp, Homo sapiens
caggggatcaaagt

SEQ ID NO: 3955889 - DNA, 20 bp, Homo sapiens
caggggcaaagaactgcccc

SEQ ID NO: 3955890 - DNA, 14 bp, Homo sapiens
caggggcaggcctg

SEQ ID NO: 3955891 - DNA, 16 bp, Homo sapiens
caggggcccacaggga

SEQ ID NO: 3955892 - DNA, 14 bp, Homo sapiens
caggggccccagat

SEQ ID NO: 3955893 - DNA, 14 bp, Homo sapiens
caggggcggggcag

SEQ ID NO: 3955894 - DNA, 13 bp, Homo sapiens
caggggctgctca

SEQ ID NO: 3955895 - DNA, 22 bp, Homo sapiens
cagggggcctttaaagacttaa

SEQ ID NO: 3955896 - DNA, 20 bp, Homo sapiens
caggggggttgtgaggcctg

SEQ ID NO: 3955897 - DNA, 18 bp, Homo sapiens
caggggtcgtcaccacct

SEQ ID NO: 3955898 - DNA, 17 bp, Homo sapiens
caggggtctccctggag

SEQ ID NO: 3955899 - DNA, 16 bp, Homo sapiens
caggggtgcctgtggg

SEQ ID NO: 3955900 - DNA, 15 bp, Homo sapiens
cagggtccgcaccag

SEQ ID NO: 3955901 - DNA, 19 bp, Homo sapiens
cagggtccgcaccagctgc

SEQ ID NO: 3955902 - DNA, 13 bp, Homo sapiens
cagggtcttgggc

SEQ ID NO: 3955903 - DNA, 19 bp, Homo sapiens
cagggtcttgggctactgg

SEQ ID NO: 3955904 - DNA, 20 bp, Homo sapiens
cagggtcttgggctactggc

SEQ ID NO: 3955905 - DNA, 22 bp, Homo sapiens
cagggtgagagctgctctggaa

SEQ ID NO: 3955906 - DNA, 12 bp, Homo sapiens
cagggtgaggtg

SEQ ID NO: 3955907 - DNA, 14 bp, Homo sapiens
cagggtgcatggct

SEQ ID NO: 3955908 - DNA, 20 bp, Homo sapiens
cagggtgggatggaggagaa

SEQ ID NO: 3955909 - DNA, 17 bp, Homo sapiens
cagggtgggccactctc

SEQ ID NO: 3955910 - DNA, 20 bp, Homo sapiens
cagggtgggccactctcccc

SEQ ID NO: 3955911 - DNA, 17 bp, Homo sapiens
cagggtttacccagtgg

SEQ ID NO: 3955912 - DNA, 18 bp, Homo sapiens
caggtaaatgggcagtgc

SEQ ID NO: 3955913 - DNA, 15 bp, Homo sapiens
caggtaatgagggac

SEQ ID NO: 3955914 - DNA, 21 bp, Homo sapiens
caggtacttcctcctgatggc

SEQ ID NO: 3955915 - DNA, 22 bp, Homo sapiens
caggtacttcctcctgatggcc

SEQ ID NO: 3955916 - DNA, 18 bp, Homo sapiens
caggtagatcgcttgagc

SEQ ID NO: 3955917 - DNA, 20 bp, Homo sapiens
caggtagatcgcttgagccc

SEQ ID NO: 3955918 - DNA, 12 bp, Homo sapiens
caggtaggccct

SEQ ID NO: 3955919 - DNA, 14 bp, Homo sapiens
caggtaggcccttg

SEQ ID NO: 3955920 - DNA, 16 bp, Homo sapiens
caggtagtactgggaa

SEQ ID NO: 3955921 - DNA, 20 bp, Homo sapiens
caggtatcaggcacaggcag

SEQ ID NO: 3955922 - DNA, 22 bp, Homo sapiens
caggtatctccaggattgaaga

SEQ ID NO: 3955923 - DNA, 20 bp, Homo sapiens
caggtcattcttaagatttc

SEQ ID NO: 3955924 - DNA, 17 bp, Homo sapiens
caggtccggaggggttg

SEQ ID NO: 3955925 - DNA, 20 bp, Homo sapiens
caggtcctcagagaatttct

SEQ ID NO: 3955926 - DNA, 12 bp, Homo sapiens
caggtcctgccc

SEQ ID NO: 3955927 - DNA, 21 bp, Homo sapiens
caggtcctgcccatgtgtccc

SEQ ID NO: 3955928 - DNA, 22 bp, Homo sapiens
caggtcctgcccatgtgtcccc

SEQ ID NO: 3955929 - DNA, 23 bp, Homo sapiens
caggtcctgcccatgtgtcccct

SEQ ID NO: 3955930 - DNA, 13 bp, Homo sapiens
caggtcctggtgg

SEQ ID NO: 3955931 - DNA, 20 bp, Homo sapiens
caggtcctggtggggcagct

SEQ ID NO: 3955932 - DNA, 15 bp, Homo sapiens
caggtctagactttc

SEQ ID NO: 3955933 - DNA, 18 bp, Homo sapiens
caggtctagactttctca

SEQ ID NO: 3955934 - DNA, 20 bp, Homo sapiens
caggtctcccacgtgggaga

SEQ ID NO: 3955935 - DNA, 21 bp, Homo sapiens
caggtctggggcttttagagc

SEQ ID NO: 3955936 - DNA, 15 bp, Homo sapiens
caggtgactggagcc

SEQ ID NO: 3955937 - DNA, 22 bp, Homo sapiens
caggtgcaagagacagagcccc

SEQ ID NO: 3955938 - DNA, 18 bp, Homo sapiens
caggtgcagatgggctgt

SEQ ID NO: 3955939 - DNA, 15 bp, Homo sapiens
caggtgccaccaata

SEQ ID NO: 3955940 - DNA, 18 bp, Homo sapiens
caggtgccaccaataaaa

SEQ ID NO: 3955941 - DNA, 13 bp, Homo sapiens
caggtgccactcc

SEQ ID NO: 3955942 - DNA, 18 bp, Homo sapiens
caggtgccactccctgag

SEQ ID NO: 3955943 - DNA, 19 bp, Homo sapiens
caggtgccactccctgagc

SEQ ID NO: 3955944 - DNA, 19 bp, Homo sapiens
caggtgccagttatggcta

SEQ ID NO: 3955945 - DNA, 15 bp, Homo sapiens
caggtgcctggacat

SEQ ID NO: 3955946 - DNA, 16 bp, Homo sapiens
caggtgcttttgatgt

SEQ ID NO: 3955947 - DNA, 20 bp, Homo sapiens
caggtgcttttgatgtgaaa

SEQ ID NO: 3955948 - DNA, 16 bp, Homo sapiens
caggtggcaggaccag

SEQ ID NO: 3955949 - DNA, 16 bp, Homo sapiens
caggtggccactccag

SEQ ID NO: 3955950 - DNA, 16 bp, Homo sapiens
caggtggctgacccag

SEQ ID NO: 3955951 - DNA, 19 bp, Homo sapiens
caggtggctgacccagtcc

SEQ ID NO: 3955952 - DNA, 22 bp, Homo sapiens
caggtggctgacccagtccctg

SEQ ID NO: 3955953 - DNA, 19 bp, Homo sapiens
caggtgtggtggctcatgg

SEQ ID NO: 3955954 - DNA, 21 bp, Homo sapiens
caggttcccagcagctgggcc

SEQ ID NO: 3955955 - DNA, 21 bp, Homo sapiens
caggttctgcgttacaacagt

SEQ ID NO: 3955956 - DNA, 18 bp, Homo sapiens
caggttcttgatgtcatg

SEQ ID NO: 3955957 - DNA, 22 bp, Homo sapiens
caggttgtctgaagtcactgca

SEQ ID NO: 3955958 - DNA, 23 bp, Homo sapiens
caggttgtctgaagtcactgcac

SEQ ID NO: 3955959 - DNA, 19 bp, Homo sapiens
caggttgttctgtataaaa

SEQ ID NO: 3955960 - DNA, 19 bp, Homo sapiens
cagtaaaaaaaaaaaatgg

SEQ ID NO: 3955961 - DNA, 18 bp, Homo sapiens
cagtaaaaacttgtacta

SEQ ID NO: 3955962 - DNA, 10 bp, Homo sapiens
cagtaaacat

SEQ ID NO: 3955963 - DNA, 14 bp, Homo sapiens
cagtaaagtttaaa

SEQ ID NO: 3955964 - DNA, 20 bp, Homo sapiens
cagtaaagtttaaaaaatac

SEQ ID NO: 3955965 - DNA, 17 bp, Homo sapiens
cagtaaatccacagcca

SEQ ID NO: 3955966 - DNA, 14 bp, Homo sapiens
cagtaacacatctt

SEQ ID NO: 3955967 - DNA, 17 bp, Homo sapiens
cagtaatttgaggacaa

SEQ ID NO: 3955968 - DNA, 23 bp, Homo sapiens
cagtacagagaaattctgtggtg

SEQ ID NO: 3955969 - DNA, 22 bp, Homo sapiens
cagtacctgggaaaggacccac

SEQ ID NO: 3955970 - DNA, 17 bp, Homo sapiens
cagtactcagtatagca

SEQ ID NO: 3955971 - DNA, 14 bp, Homo sapiens
cagtacttctaaga

SEQ ID NO: 3955972 - DNA, 16 bp, Homo sapiens
cagtagaggcatgaac

SEQ ID NO: 3955973 - DNA, 19 bp, Homo sapiens
cagtagccaagttatattg

SEQ ID NO: 3955974 - DNA, 20 bp, Homo sapiens
cagtagccaagttatattga

SEQ ID NO: 3955975 - DNA, 20 bp, Homo sapiens
cagtagctgtggtgaggtgg

SEQ ID NO: 3955976 - DNA, 18 bp, Homo sapiens
cagtagcttaaataaatt

SEQ ID NO: 3955977 - DNA, 19 bp, Homo sapiens
cagtagcttaaataaattc

SEQ ID NO: 3955978 - DNA, 16 bp, Homo sapiens
cagtaggagcaagaga

SEQ ID NO: 3955979 - DNA, 20 bp, Homo sapiens
cagtaggctttatgctgtgt

SEQ ID NO: 3955980 - DNA, 22 bp, Homo sapiens
cagtaggtaatgattatgtgtc

SEQ ID NO: 3955981 - DNA, 18 bp, Homo sapiens
cagtaggtccaagggcca

SEQ ID NO: 3955982 - DNA, 15 bp, Homo sapiens
cagtagtcagaagca

SEQ ID NO: 3955983 - DNA, 18 bp, Homo sapiens
cagtatagcattgaacat

SEQ ID NO: 3955984 - DNA, 13 bp, Homo sapiens
cagtatatttata

SEQ ID NO: 3955985 - DNA, 17 bp, Homo sapiens
cagtattctcagtgctc

SEQ ID NO: 3955986 - DNA, 13 bp, Homo sapiens
cagtattcttgtc

SEQ ID NO: 3955987 - DNA, 19 bp, Homo sapiens
cagtattgccacaatgcct

SEQ ID NO: 3955988 - DNA, 15 bp, Homo sapiens
cagtatttgtacaaa

SEQ ID NO: 3955989 - DNA, 12 bp, Homo sapiens
cagtattttatt

SEQ ID NO: 3955990 - DNA, 19 bp, Homo sapiens
cagtattttattaaagcaa

SEQ ID NO: 3955991 - DNA, 18 bp, Homo sapiens
cagtattttggagaaatt

SEQ ID NO: 3955992 - DNA, 19 bp, Homo sapiens
cagtattttggagaaatta

SEQ ID NO: 3955993 - DNA, 23 bp, Homo sapiens
cagtattttggagaaattattta

SEQ ID NO: 3955994 - DNA, 22 bp, Homo sapiens
cagtcactgtccctcaaatgac

SEQ ID NO: 3955995 - DNA, 22 bp, Homo sapiens
cagtcagttcccggagcacagc

SEQ ID NO: 3955996 - DNA, 21 bp, Homo sapiens
cagtcattgggttttatcagt

SEQ ID NO: 3955997 - DNA, 20 bp, Homo sapiens
cagtccagaataagtgctgt

SEQ ID NO: 3955998 - DNA, 21 bp, Homo sapiens
cagtccagaataagtgctgtt

SEQ ID NO: 3955999 - DNA, 16 bp, Homo sapiens
cagtccagatgccttc

SEQ ID NO: 3956000 - DNA, 18 bp, Homo sapiens
cagtccagatgccttcct

SEQ ID NO: 3956001 - DNA, 19 bp, Homo sapiens
cagtccagatgccttcctg

SEQ ID NO: 3956002 - DNA, 22 bp, Homo sapiens
cagtccagatgccttcctgtct

SEQ ID NO: 3956003 - DNA, 16 bp, Homo sapiens
cagtcccaatgcacat

SEQ ID NO: 3956004 - DNA, 19 bp, Homo sapiens
cagtccccagcccttctgc

SEQ ID NO: 3956005 - DNA, 17 bp, Homo sapiens
cagtcccgtggagggta

SEQ ID NO: 3956006 - DNA, 20 bp, Homo sapiens
cagtccgccaaacactccac

SEQ ID NO: 3956007 - DNA, 22 bp, Homo sapiens
cagtccgccaaacactccaccc

SEQ ID NO: 3956008 - DNA, 20 bp, Homo sapiens
cagtcctagagctcctgtcc

SEQ ID NO: 3956009 - DNA, 22 bp, Homo sapiens
cagtcctagagctcctgtccct

SEQ ID NO: 3956010 - DNA, 23 bp, Homo sapiens
cagtcctagagctcctgtcccta

SEQ ID NO: 3956011 - DNA, 17 bp, Homo sapiens
cagtcctcacagcctct

SEQ ID NO: 3956012 - DNA, 23 bp, Homo sapiens
cagtcctggccattttcttgcct

SEQ ID NO: 3956013 - DNA, 14 bp, Homo sapiens
cagtcgcaggatcc

SEQ ID NO: 3956014 - DNA, 23 bp, Homo sapiens
cagtcgcaggatccgctgccacc

SEQ ID NO: 3956015 - DNA, 14 bp, Homo sapiens
cagtctcagtccag

SEQ ID NO: 3956016 - DNA, 15 bp, Homo sapiens
cagtctcagtccaga

SEQ ID NO: 3956017 - DNA, 19 bp, Homo sapiens
cagtctcagtccagatgcc

SEQ ID NO: 3956018 - DNA, 23 bp, Homo sapiens
cagtctcagtccagatgccttcc

SEQ ID NO: 3956019 - DNA, 15 bp, Homo sapiens
cagtctcctgacatt

SEQ ID NO: 3956020 - DNA, 22 bp, Homo sapiens
cagtctcgggtggctagtcaga

SEQ ID NO: 3956021 - DNA, 18 bp, Homo sapiens
cagtcttcttcacccgct

SEQ ID NO: 3956022 - DNA, 16 bp, Homo sapiens
cagtcttgcctaggcc

SEQ ID NO: 3956023 - DNA, 22 bp, Homo sapiens
cagtgaaaaatatgttgagtgt

SEQ ID NO: 3956024 - DNA, 19 bp, Homo sapiens
cagtgaacacactcagcag

SEQ ID NO: 3956025 - DNA, 20 bp, Homo sapiens
cagtgaaccaaagagactgg

SEQ ID NO: 3956026 - DNA, 21 bp, Homo sapiens
cagtgaaccaaagagactgga

SEQ ID NO: 3956027 - DNA, 22 bp, Homo sapiens
cagtgaaggagccacgtgaatg

SEQ ID NO: 3956028 - DNA, 16 bp, Homo sapiens
cagtgacaagtggagg

SEQ ID NO: 3956029 - DNA, 17 bp, Homo sapiens
cagtgacaagtggaggg

SEQ ID NO: 3956030 - DNA, 18 bp, Homo sapiens
cagtgacaagtggagggg

SEQ ID NO: 3956031 - DNA, 19 bp, Homo sapiens
cagtgacaagtggaggggg

SEQ ID NO: 3956032 - DNA, 20 bp, Homo sapiens
cagtgacaagtggagggggt

SEQ ID NO: 3956033 - DNA, 24 bp, Homo sapiens
cagtgacccttcccaatcagcact

SEQ ID NO: 3956034 - DNA, 17 bp, Homo sapiens
cagtgactggcaggtgc

SEQ ID NO: 3956035 - DNA, 22 bp, Homo sapiens
cagtgactgtcgtgtttacaaa

SEQ ID NO: 3956036 - DNA, 23 bp, Homo sapiens
cagtgactgtcgtgtttacaaaa

SEQ ID NO: 3956037 - DNA, 18 bp, Homo sapiens
cagtgactttacaggagg

SEQ ID NO: 3956038 - DNA, 19 bp, Homo sapiens
cagtgactttacaggaggt

SEQ ID NO: 3956039 - DNA, 19 bp, Homo sapiens
cagtgactttttctgagct

SEQ ID NO: 3956040 - DNA, 14 bp, Homo sapiens
cagtgagaaaaagc

SEQ ID NO: 3956041 - DNA, 20 bp, Homo sapiens
cagtgagaaaaagctcctgt

SEQ ID NO: 3956042 - DNA, 14 bp, Homo sapiens
cagtgagacacaga

SEQ ID NO: 3956043 - DNA, 15 bp, Homo sapiens
cagtgaggagggtgg

SEQ ID NO: 3956044 - DNA, 18 bp, Homo sapiens
cagtgagggctgggccca

SEQ ID NO: 3956045 - DNA, 23 bp, Homo sapiens
cagtgagttacagcgagaggcag

SEQ ID NO: 3956046 - DNA, 23 bp, Homo sapiens
cagtgatacatgtactccagagg

SEQ ID NO: 3956047 - DNA, 21 bp, Homo sapiens
cagtgatggcgcgggaggcac

SEQ ID NO: 3956048 - DNA, 22 bp, Homo sapiens
cagtgatggcgcgggaggcacc

SEQ ID NO: 3956049 - DNA, 17 bp, Homo sapiens
cagtgatgggagagtag

SEQ ID NO: 3956050 - DNA, 15 bp, Homo sapiens
cagtgatgtgctgga

SEQ ID NO: 3956051 - DNA, 18 bp, Homo sapiens
cagtgatgtgctggagct

SEQ ID NO: 3956052 - DNA, 23 bp, Homo sapiens
cagtgcaagagactctggcctcc

SEQ ID NO: 3956053 - DNA, 24 bp, Homo sapiens
cagtgcaagagactctggcctcca

SEQ ID NO: 3956054 - DNA, 15 bp, Homo sapiens
cagtgcacacggatg

SEQ ID NO: 3956055 - DNA, 22 bp, Homo sapiens
cagtgcagtgatacatgtactc

SEQ ID NO: 3956056 - DNA, 12 bp, Homo sapiens
cagtgccacaga

SEQ ID NO: 3956057 - DNA, 15 bp, Homo sapiens
cagtgccacagagaa

SEQ ID NO: 3956058 - DNA, 16 bp, Homo sapiens
cagtgcccaccaacat

SEQ ID NO: 3956059 - DNA, 21 bp, Homo sapiens
cagtgcccaccaacatcccat

SEQ ID NO: 3956060 - DNA, 14 bp, Homo sapiens
cagtgcccatgcaa

SEQ ID NO: 3956061 - DNA, 17 bp, Homo sapiens
cagtgccctcattttat

SEQ ID NO: 3956062 - DNA, 11 bp, Homo sapiens
cagtgcctcct

SEQ ID NO: 3956063 - DNA, 13 bp, Homo sapiens
cagtgcctcctgg

SEQ ID NO: 3956064 - DNA, 17 bp, Homo sapiens
cagtgcctcgaggcacc

SEQ ID NO: 3956065 - DNA, 20 bp, Homo sapiens
cagtgcctcgaggcaccggc

SEQ ID NO: 3956066 - DNA, 10 bp, Homo sapiens
cagtgcctgc

SEQ ID NO: 3956067 - DNA, 12 bp, Homo sapiens
cagtgcctgctg

SEQ ID NO: 3956068 - DNA, 21 bp, Homo sapiens
cagtgccttacctcctgccca

SEQ ID NO: 3956069 - DNA, 23 bp, Homo sapiens
cagtgctattttgtgcccactgt

SEQ ID NO: 3956070 - DNA, 18 bp, Homo sapiens
cagtgctgattcagcctg

SEQ ID NO: 3956071 - DNA, 12 bp, Homo sapiens
cagtgctgccat

SEQ ID NO: 3956072 - DNA, 22 bp, Homo sapiens
cagtgctgccatgccactgcca

SEQ ID NO: 3956073 - DNA, 18 bp, Homo sapiens
cagtgcttaatgtgaact

SEQ ID NO: 3956074 - DNA, 12 bp, Homo sapiens
cagtgcttgtaa

SEQ ID NO: 3956075 - DNA, 18 bp, Homo sapiens
cagtggaaattcaggtga

SEQ ID NO: 3956076 - DNA, 18 bp, Homo sapiens
cagtggcacggagagaag

SEQ ID NO: 3956077 - DNA, 23 bp, Homo sapiens
cagtggcacggagagaaggccca

SEQ ID NO: 3956078 - DNA, 19 bp, Homo sapiens
cagtggccgcaagcgcagg

SEQ ID NO: 3956079 - DNA, 17 bp, Homo sapiens
cagtggcgagaggagag

SEQ ID NO: 3956080 - DNA, 19 bp, Homo sapiens
cagtggcgagaggagagga

SEQ ID NO: 3956081 - DNA, 13 bp, Homo sapiens
cagtggctgtcac

SEQ ID NO: 3956082 - DNA, 19 bp, Homo sapiens
cagtgggaacgtgactgcc

SEQ ID NO: 3956083 - DNA, 22 bp, Homo sapiens
cagtgggaactctgacaagggc

SEQ ID NO: 3956084 - DNA, 17 bp, Homo sapiens
cagtgggtggcacctcc

SEQ ID NO: 3956085 - DNA, 19 bp, Homo sapiens
cagtgggtggcacctcctg

SEQ ID NO: 3956086 - DNA, 15 bp, Homo sapiens
cagtggtaagctctg

SEQ ID NO: 3956087 - DNA, 14 bp, Homo sapiens
cagtggtgaagaaa

SEQ ID NO: 3956088 - DNA, 23 bp, Homo sapiens
cagtggtgaagaaaactccttta

SEQ ID NO: 3956089 - DNA, 15 bp, Homo sapiens
cagtgtcccctccac

SEQ ID NO: 3956090 - DNA, 17 bp, Homo sapiens
cagtgtcccctccactg

SEQ ID NO: 3956091 - DNA, 23 bp, Homo sapiens
cagtgtgcgttggaatcacctgg

SEQ ID NO: 3956092 - DNA, 13 bp, Homo sapiens
cagtgtggagagg

SEQ ID NO: 3956093 - DNA, 21 bp, Homo sapiens
cagtgtgtcgagtcaaaatgt

SEQ ID NO: 3956094 - DNA, 11 bp, Homo sapiens
cagtgtgtgtg

SEQ ID NO: 3956095 - DNA, 19 bp, Homo sapiens
cagtgttccccatctgggt

SEQ ID NO: 3956096 - DNA, 23 bp, Homo sapiens
cagtgttggctgtgtgacagaat

SEQ ID NO: 3956097 - DNA, 12 bp, Homo sapiens
cagttaaaatgt

SEQ ID NO: 3956098 - DNA, 20 bp, Homo sapiens
cagttaaggaccgtggccct

SEQ ID NO: 3956099 - DNA, 13 bp, Homo sapiens
cagttactcagcc

SEQ ID NO: 3956100 - DNA, 19 bp, Homo sapiens
cagttactcagccctgggc

SEQ ID NO: 3956101 - DNA, 12 bp, Homo sapiens
cagttataatta

SEQ ID NO: 3956102 - DNA, 15 bp, Homo sapiens
cagttatattcttta

SEQ ID NO: 3956103 - DNA, 19 bp, Homo sapiens
cagttatattctttaaatt

SEQ ID NO: 3956104 - DNA, 20 bp, Homo sapiens
cagttatggctataggtgct

SEQ ID NO: 3956105 - DNA, 14 bp, Homo sapiens
cagttatttatagt

SEQ ID NO: 3956106 - DNA, 15 bp, Homo sapiens
cagttcaaatcctca

SEQ ID NO: 3956107 - DNA, 16 bp, Homo sapiens
cagttcaacctggtgg

SEQ ID NO: 3956108 - DNA, 21 bp, Homo sapiens
cagttcaacctggtggcacca

SEQ ID NO: 3956109 - DNA, 14 bp, Homo sapiens
cagttcaagaaagc

SEQ ID NO: 3956110 - DNA, 17 bp, Homo sapiens
cagttcctctttgcatg

SEQ ID NO: 3956111 - DNA, 15 bp, Homo sapiens
cagttcgcagccacc

SEQ ID NO: 3956112 - DNA, 20 bp, Homo sapiens
cagttctacaagcatatttg

SEQ ID NO: 3956113 - DNA, 13 bp, Homo sapiens
cagttctgctcct

SEQ ID NO: 3956114 - DNA, 17 bp, Homo sapiens
cagttctgctcctctcc

SEQ ID NO: 3956115 - DNA, 21 bp, Homo sapiens
cagttctgctcctctccaggc

SEQ ID NO: 3956116 - DNA, 18 bp, Homo sapiens
cagttcttggacccctga

SEQ ID NO: 3956117 - DNA, 19 bp, Homo sapiens
cagttcttggacccctgaa

SEQ ID NO: 3956118 - DNA, 21 bp, Homo sapiens
cagttgaaaagactccaaaga

SEQ ID NO: 3956119 - DNA, 20 bp, Homo sapiens
cagttgaatgacaacagaag

SEQ ID NO: 3956120 - DNA, 21 bp, Homo sapiens
cagttgaatgacaacagaagc

SEQ ID NO: 3956121 - DNA, 16 bp, Homo sapiens
cagttgacagcaggtg

SEQ ID NO: 3956122 - DNA, 15 bp, Homo sapiens
cagttggcagagaag

SEQ ID NO: 3956123 - DNA, 22 bp, Homo sapiens
cagttggcagagaaggcctctt

SEQ ID NO: 3956124 - DNA, 18 bp, Homo sapiens
cagttgggagcactggag

SEQ ID NO: 3956125 - DNA, 20 bp, Homo sapiens
cagttgggagcactggagtg

SEQ ID NO: 3956126 - DNA, 14 bp, Homo sapiens
cagttgttttcccg

SEQ ID NO: 3956127 - DNA, 19 bp, Homo sapiens
cagtttagatttcaagaaa

SEQ ID NO: 3956128 - DNA, 18 bp, Homo sapiens
cagtttcccttctatgca

SEQ ID NO: 3956129 - DNA, 19 bp, Homo sapiens
cagtttcccttctatgcag

SEQ ID NO: 3956130 - DNA, 16 bp, Homo sapiens
cagtttctccatcagc

SEQ ID NO: 3956131 - DNA, 21 bp, Homo sapiens
cagtttgcagaaaagcacctg

SEQ ID NO: 3956132 - DNA, 14 bp, Homo sapiens
cagttttctgagaa

SEQ ID NO: 3956133 - DNA, 16 bp, Homo sapiens
cagttttgaaagaaaa

SEQ ID NO: 3956134 - DNA, 14 bp, Homo sapiens
cagtttttaagcta

SEQ ID NO: 3956135 - DNA, 9 bp, Homo sapiens
cataaaata

SEQ ID NO: 3956136 - DNA, 22 bp, Homo sapiens
cataaaccaatgagctgtatct

SEQ ID NO: 3956137 - DNA, 23 bp, Homo sapiens
cataaaccaatgagctgtatctg

SEQ ID NO: 3956138 - DNA, 20 bp, Homo sapiens
cataaagcaaatagacacag

SEQ ID NO: 3956139 - DNA, 13 bp, Homo sapiens
cataacaatgtat

SEQ ID NO: 3956140 - DNA, 20 bp, Homo sapiens
cataacagattttttttgga

SEQ ID NO: 3956141 - DNA, 14 bp, Homo sapiens
cataacatctttga

SEQ ID NO: 3956142 - DNA, 20 bp, Homo sapiens
cataacatctttgaaaagaa

SEQ ID NO: 3956143 - DNA, 23 bp, Homo sapiens
cataaccccaggcatcccatccc

SEQ ID NO: 3956144 - DNA, 15 bp, Homo sapiens
cataacttgctgaat

SEQ ID NO: 3956145 - DNA, 21 bp, Homo sapiens
cataacttgctgaatttcagg

SEQ ID NO: 3956146 - DNA, 11 bp, Homo sapiens
cataagaccat

SEQ ID NO: 3956147 - DNA, 21 bp, Homo sapiens
cataagaccataacagccaac

SEQ ID NO: 3956148 - DNA, 17 bp, Homo sapiens
cataagaccgtgtccca

SEQ ID NO: 3956149 - DNA, 11 bp, Homo sapiens
cataagattaa

SEQ ID NO: 3956150 - DNA, 20 bp, Homo sapiens
cataagattaaaggaaggaa

SEQ ID NO: 3956151 - DNA, 12 bp, Homo sapiens
cataaggcctgc

SEQ ID NO: 3956152 - DNA, 15 bp, Homo sapiens
cataaggcctgccct

SEQ ID NO: 3956153 - DNA, 19 bp, Homo sapiens
cataaggcctgccctccca

SEQ ID NO: 3956154 - DNA, 22 bp, Homo sapiens
cataatctggactcctctgtcc

SEQ ID NO: 3956155 - DNA, 19 bp, Homo sapiens
cataatgctcccatctcct

SEQ ID NO: 3956156 - DNA, 20 bp, Homo sapiens
cataatgctcccatctcctg

SEQ ID NO: 3956157 - DNA, 22 bp, Homo sapiens
cataattagaacaatagctatt

SEQ ID NO: 3956158 - DNA, 17 bp, Homo sapiens
cataattcttgtatatt

SEQ ID NO: 3956159 - DNA, 15 bp, Homo sapiens
cataatttgtacata

SEQ ID NO: 3956160 - DNA, 23 bp, Homo sapiens
cataatttgtacatatgtaaaat

SEQ ID NO: 3956161 - DNA, 18 bp, Homo sapiens
cataattttcaagagaag

SEQ ID NO: 3956162 - DNA, 14 bp, Homo sapiens
catacacatacata

SEQ ID NO: 3956163 - DNA, 18 bp, Homo sapiens
catacacttgtataaatg

SEQ ID NO: 3956164 - DNA, 19 bp, Homo sapiens
catacacttgtataaatgt

SEQ ID NO: 3956165 - DNA, 20 bp, Homo sapiens
catacacttgtataaatgta

SEQ ID NO: 3956166 - DNA, 11 bp, Homo sapiens
catacatacat

SEQ ID NO: 3956167 - DNA, 16 bp, Homo sapiens
catacatacatacata

SEQ ID NO: 3956168 - DNA, 13 bp, Homo sapiens
catacatatatat

SEQ ID NO: 3956169 - DNA, 16 bp, Homo sapiens
catacatatatatctg

SEQ ID NO: 3956170 - DNA, 17 bp, Homo sapiens
catacatatatatctga

SEQ ID NO: 3956171 - DNA, 22 bp, Homo sapiens
catacccctgcctgggttttct

SEQ ID NO: 3956172 - DNA, 23 bp, Homo sapiens
catacccctgcctgggttttcta

SEQ ID NO: 3956173 - DNA, 13 bp, Homo sapiens
cataccctccccc

SEQ ID NO: 3956174 - DNA, 16 bp, Homo sapiens
cataccgctggggaac

SEQ ID NO: 3956175 - DNA, 21 bp, Homo sapiens
cataccgctggggaacagagc

SEQ ID NO: 3956176 - DNA, 13 bp, Homo sapiens
catacctctgacc

SEQ ID NO: 3956177 - DNA, 17 bp, Homo sapiens
catacctctgaccaaca

SEQ ID NO: 3956178 - DNA, 22 bp, Homo sapiens
cataccttggactgactaccag

SEQ ID NO: 3956179 - DNA, 16 bp, Homo sapiens
catacgaaacacaaac

SEQ ID NO: 3956180 - DNA, 17 bp, Homo sapiens
catactgatccctttcc

SEQ ID NO: 3956181 - DNA, 17 bp, Homo sapiens
catacttttgagagggg

SEQ ID NO: 3956182 - DNA, 14 bp, Homo sapiens
catagaaacatgac

SEQ ID NO: 3956183 - DNA, 18 bp, Homo sapiens
catagaaacatgacactg

SEQ ID NO: 3956184 - DNA, 16 bp, Homo sapiens
catagaaactgaggag

SEQ ID NO: 3956185 - DNA, 20 bp, Homo sapiens
catccatagtgcactagcat

SEQ ID NO: 3956186 - DNA, 20 bp, Homo sapiens
catccatgtcctatgtgtga

SEQ ID NO: 3956187 - DNA, 12 bp, Homo sapiens
catccattccca

SEQ ID NO: 3956188 - DNA, 18 bp, Homo sapiens
catccattcccaagaaat

SEQ ID NO: 3956189 - DNA, 19 bp, Homo sapiens
catccattcctcagggaca

SEQ ID NO: 3956190 - DNA, 13 bp, Homo sapiens
catcccacagtgg

SEQ ID NO: 3956191 - DNA, 22 bp, Homo sapiens
catcccacattcggaccctgcc

SEQ ID NO: 3956192 - DNA, 19 bp, Homo sapiens
catcccaggaggggcctct

SEQ ID NO: 3956193 - DNA, 13 bp, Homo sapiens
catcccaggggac

SEQ ID NO: 3956194 - DNA, 13 bp, Homo sapiens
catcccatccctt

SEQ ID NO: 3956195 - DNA, 17 bp, Homo sapiens
catcccctcgtcctgtc

SEQ ID NO: 3956196 - DNA, 21 bp, Homo sapiens
catcccctcgtcctgtcccag

SEQ ID NO: 3956197 - DNA, 22 bp, Homo sapiens
catcccctcgtcctgtcccaga

SEQ ID NO: 3956198 - DNA, 21 bp, Homo sapiens
catccccttgtgtcagagaca

SEQ ID NO: 3956199 - DNA, 12 bp, Homo sapiens
catcccctttcc

SEQ ID NO: 3956200 - DNA, 13 bp, Homo sapiens
catcccctttcct

SEQ ID NO: 3956201 - DNA, 16 bp, Homo sapiens
catcccgtcttctcca

SEQ ID NO: 3956202 - DNA, 11 bp, Homo sapiens
catccctgggc

SEQ ID NO: 3956203 - DNA, 13 bp, Homo sapiens
catccctgggccc

SEQ ID NO: 3956204 - DNA, 17 bp, Homo sapiens
catccctgggcccctcc

SEQ ID NO: 3956205 - DNA, 13 bp, Homo sapiens
catccctgggcct

SEQ ID NO: 3956206 - DNA, 18 bp, Homo sapiens
catccctgggcctgctgc

SEQ ID NO: 3956207 - DNA, 21 bp, Homo sapiens
catccctgggcctgctgctga

SEQ ID NO: 3956208 - DNA, 14 bp, Homo sapiens
catgattttataca

SEQ ID NO: 3956209 - DNA, 21 bp, Homo sapiens
catgcacacaaacacctccta

SEQ ID NO: 3956210 - DNA, 13 bp, Homo sapiens
catgcacagctgc

SEQ ID NO: 3956211 - DNA, 19 bp, Homo sapiens
catgcacagctgcttgtcc

SEQ ID NO: 3956212 - DNA, 23 bp, Homo sapiens
catgcacagctgcttgtcctgct

SEQ ID NO: 3956213 - DNA, 17 bp, Homo sapiens
catgcagactcctcaga

SEQ ID NO: 3956214 - DNA, 22 bp, Homo sapiens
catgcagactcctcagatctga

SEQ ID NO: 3956215 - DNA, 17 bp, Homo sapiens
catgcagccactgtgct

SEQ ID NO: 3956216 - DNA, 13 bp, Homo sapiens
catgcagcttcat

SEQ ID NO: 3956217 - DNA, 18 bp, Homo sapiens
catgcagcttcatcaatt

SEQ ID NO: 3956218 - DNA, 20 bp, Homo sapiens
catgcagcttcatcaatttt

SEQ ID NO: 3956219 - DNA, 22 bp, Homo sapiens
catgcagcttcatcaattttta

SEQ ID NO: 3956220 - DNA, 15 bp, Homo sapiens
catgcatcatcagcc

SEQ ID NO: 3956221 - DNA, 13 bp, Homo sapiens
catgccaccctct

SEQ ID NO: 3956222 - DNA, 21 bp, Homo sapiens
catgccaccctctccatgccc

SEQ ID NO: 3956223 - DNA, 14 bp, Homo sapiens
catgccactgccag

SEQ ID NO: 3956224 - DNA, 18 bp, Homo sapiens
catgccactgccaggcac

SEQ ID NO: 3956225 - DNA, 19 bp, Homo sapiens
catgccactgccaggcacc

SEQ ID NO: 3956226 - DNA, 21 bp, Homo sapiens
catgccactgccaggcacctg

SEQ ID NO: 3956227 - DNA, 23 bp, Homo sapiens
catgccactgccaggcacctggc

SEQ ID NO: 3956228 - DNA, 10 bp, Homo sapiens
catgccatct

SEQ ID NO: 3956229 - DNA, 16 bp, Homo sapiens
catgccatctgttttc

SEQ ID NO: 3956230 - DNA, 12 bp, Homo sapiens
catgcccagaga

SEQ ID NO: 3956231 - DNA, 15 bp, Homo sapiens
catgcccagagaatc

SEQ ID NO: 3956232 - DNA, 14 bp, Homo sapiens
catgcctcagtttc

SEQ ID NO: 3956233 - DNA, 16 bp, Homo sapiens
catgcctcagtttccc

SEQ ID NO: 3956234 - DNA, 17 bp, Homo sapiens
catgcctcagtttcccc

SEQ ID NO: 3956235 - DNA, 15 bp, Homo sapiens
catgcctcatgccac

SEQ ID NO: 3956236 - DNA, 17 bp, Homo sapiens
catgcctcatgccacac

SEQ ID NO: 3956237 - DNA, 19 bp, Homo sapiens
catgcctcatgccacacct

SEQ ID NO: 3956238 - DNA, 19 bp, Homo sapiens
catgcctctgaggccagcc

SEQ ID NO: 3956239 - DNA, 23 bp, Homo sapiens
catgcctctgatatgggactgag

SEQ ID NO: 3956240 - DNA, 21 bp, Homo sapiens
catgcctggcccccctccagg

SEQ ID NO: 3956241 - DNA, 22 bp, Homo sapiens
catgcctggcccccctccaggc

SEQ ID NO: 3956242 - DNA, 13 bp, Homo sapiens
catgcgcaggctc

SEQ ID NO: 3956243 - DNA, 15 bp, Homo sapiens
catgcgtatatgtgc

SEQ ID NO: 3956244 - DNA, 20 bp, Homo sapiens
catgctcagccctgactggt

SEQ ID NO: 3956245 - DNA, 15 bp, Homo sapiens
catgctctctgcagc

SEQ ID NO: 3956246 - DNA, 19 bp, Homo sapiens
catgctctctgcagccagc

SEQ ID NO: 3956247 - DNA, 21 bp, Homo sapiens
catgctctctgcagccagccc

SEQ ID NO: 3956248 - DNA, 19 bp, Homo sapiens
catgctctgccccaagccc

SEQ ID NO: 3956249 - DNA, 11 bp, Homo sapiens
catgctctgga

SEQ ID NO: 3956250 - DNA, 16 bp, Homo sapiens
catgctctggaagcct

SEQ ID NO: 3956251 - DNA, 12 bp, Homo sapiens
catgctgcctcc

SEQ ID NO: 3956252 - DNA, 22 bp, Homo sapiens
catgctggcctcccaataaagc

SEQ ID NO: 3956253 - DNA, 23 bp, Homo sapiens
catgctggcctcccaataaagct

SEQ ID NO: 3956254 - DNA, 14 bp, Homo sapiens
catgcttcttcctt

SEQ ID NO: 3956255 - DNA, 23 bp, Homo sapiens
catgctttcctaaagtctctgct

SEQ ID NO: 3956256 - DNA, 14 bp, Homo sapiens
catggaaaagccca

SEQ ID NO: 3956257 - DNA, 20 bp, Homo sapiens
catggaaaatgtcctgtggt

SEQ ID NO: 3956258 - DNA, 19 bp, Homo sapiens
catggaatttgtaagttta

SEQ ID NO: 3956259 - DNA, 19 bp, Homo sapiens
catggacaatataaactga

SEQ ID NO: 3956260 - DNA, 20 bp, Homo sapiens
catggacaatataaactgaa

SEQ ID NO: 3956261 - DNA, 12 bp, Homo sapiens
catggacacaga

SEQ ID NO: 3956262 - DNA, 14 bp, Homo sapiens
catggacacccctt

SEQ ID NO: 3956263 - DNA, 22 bp, Homo sapiens
catggacaccccttatccagga

SEQ ID NO: 3956264 - DNA, 24 bp, Homo sapiens
catggactctgggtttcatatcca

SEQ ID NO: 3956265 - DNA, 16 bp, Homo sapiens
catggagaaaccctgt

SEQ ID NO: 3956266 - DNA, 15 bp, Homo sapiens
catggagagagactc

SEQ ID NO: 3956267 - DNA, 16 bp, Homo sapiens
catggagagagactca

SEQ ID NO: 3956268 - DNA, 14 bp, Homo sapiens
catggagagctaga

SEQ ID NO: 3956269 - DNA, 14 bp, Homo sapiens
catggagtgagcag

SEQ ID NO: 3956270 - DNA, 20 bp, Homo sapiens
catggatatccacgcagcag

SEQ ID NO: 3956271 - DNA, 20 bp, Homo sapiens
catggatgcacgcacatgcc

SEQ ID NO: 3956272 - DNA, 18 bp, Homo sapiens
cattataactgaaggaga

SEQ ID NO: 3956273 - DNA, 14 bp, Homo sapiens
cattatgcagctga

SEQ ID NO: 3956274 - DNA, 13 bp, Homo sapiens
cattatgtagaaa

SEQ ID NO: 3956275 - DNA, 17 bp, Homo sapiens
cattatgtgtgcatgtg

SEQ ID NO: 3956276 - DNA, 18 bp, Homo sapiens
cattatgtgtgcatgtgt

SEQ ID NO: 3956277 - DNA, 22 bp, Homo sapiens
cattatgtgtgcatgtgtgtat

SEQ ID NO: 3956278 - DNA, 20 bp, Homo sapiens
cattatgttagagaggtagc

SEQ ID NO: 3956279 - DNA, 17 bp, Homo sapiens
cattatttaatgtttga

SEQ ID NO: 3956280 - DNA, 23 bp, Homo sapiens
cattatttcaaccgcttgccata

SEQ ID NO: 3956281 - DNA, 15 bp, Homo sapiens
cattcaagcctgtga

SEQ ID NO: 3956282 - DNA, 16 bp, Homo sapiens
cattcaatacaagtgt

SEQ ID NO: 3956283 - DNA, 22 bp, Homo sapiens
cattcaccaaatgatgccactt

SEQ ID NO: 3956284 - DNA, 20 bp, Homo sapiens
cattcagcacaccccaaggg

SEQ ID NO: 3956285 - DNA, 20 bp, Homo sapiens
cattcaggaaaactgacaga

SEQ ID NO: 3956286 - DNA, 19 bp, Homo sapiens
cattcaggtgttctcttct

SEQ ID NO: 3956287 - DNA, 18 bp, Homo sapiens
cattcagtatataaaata

SEQ ID NO: 3956288 - DNA, 19 bp, Homo sapiens
cattcatccagttgcaata

SEQ ID NO: 3956289 - DNA, 20 bp, Homo sapiens
cattcatccagttgcaataa

SEQ ID NO: 3956290 - DNA, 22 bp, Homo sapiens
cattcatccagttgcaataaaa

SEQ ID NO: 3956291 - DNA, 22 bp, Homo sapiens
cattcatgccaaagcaaaagaa

SEQ ID NO: 3956292 - DNA, 16 bp, Homo sapiens
cattccaaagaacagc

SEQ ID NO: 3956293 - DNA, 18 bp, Homo sapiens
cattccaacaatggggtg

SEQ ID NO: 3956294 - DNA, 19 bp, Homo sapiens
cattccatgattttacaga

SEQ ID NO: 3956295 - DNA, 19 bp, Homo sapiens
cattcccccatgtggctga

SEQ ID NO: 3956296 - DNA, 16 bp, Homo sapiens
cattccctatcaaaac

SEQ ID NO: 3956297 - DNA, 11 bp, Homo sapiens
cattccctgag

SEQ ID NO: 3956298 - DNA, 17 bp, Homo sapiens
cattccctgagtcacca

SEQ ID NO: 3956299 - DNA, 21 bp, Homo sapiens
cattccctgagtcaccaggaa

SEQ ID NO: 3956300 - DNA, 14 bp, Homo sapiens
cattcctcagctgc

SEQ ID NO: 3956301 - DNA, 16 bp, Homo sapiens
cattcctcagctgcca

SEQ ID NO: 3956302 - DNA, 16 bp, Homo sapiens
cattcctcagggacag

SEQ ID NO: 3956303 - DNA, 12 bp, Homo sapiens
cattcctggccc

SEQ ID NO: 3956304 - DNA, 16 bp, Homo sapiens
cattccttgtcaccag

SEQ ID NO: 3956305 - DNA, 18 bp, Homo sapiens
cattccttgtcaccagca

SEQ ID NO: 3956306 - DNA, 15 bp, Homo sapiens
cattcgtctgtccca

SEQ ID NO: 3956307 - DNA, 23 bp, Homo sapiens
cattctcctgcctgtagcagtga

SEQ ID NO: 3956308 - DNA, 15 bp, Homo sapiens
cattctcctgtgccc

SEQ ID NO: 3956309 - DNA, 15 bp, Homo sapiens
cattctctctcctgt

SEQ ID NO: 3956310 - DNA, 20 bp, Homo sapiens
cattctctctcctgtccaac

SEQ ID NO: 3956311 - DNA, 15 bp, Homo sapiens
cattctgttgcccag

SEQ ID NO: 3956312 - DNA, 14 bp, Homo sapiens
cattcttaaaggaa

SEQ ID NO: 3956313 - DNA, 18 bp, Homo sapiens
cattcttcctagttttct

SEQ ID NO: 3956314 - DNA, 21 bp, Homo sapiens
cattctttcccctcagagctc

SEQ ID NO: 3956315 - DNA, 22 bp, Homo sapiens
cattctttcccctcagagctct

SEQ ID NO: 3956316 - DNA, 15 bp, Homo sapiens
cattgaacagcaaag

SEQ ID NO: 3956317 - DNA, 20 bp, Homo sapiens
cattgaacatttcttatgat

SEQ ID NO: 3956318 - DNA, 21 bp, Homo sapiens
cattgaacatttcttatgatt

SEQ ID NO: 3956319 - DNA, 12 bp, Homo sapiens
cattgccctggt

SEQ ID NO: 3956320 - DNA, 13 bp, Homo sapiens
cattgcctccacc

SEQ ID NO: 3956321 - DNA, 19 bp, Homo sapiens
cattggggggccgggcagg

SEQ ID NO: 3956322 - DNA, 16 bp, Homo sapiens
cattgggttttatcag

SEQ ID NO: 3956323 - DNA, 21 bp, Homo sapiens
cattgtaaatgtgcttttaaa

SEQ ID NO: 3956324 - DNA, 14 bp, Homo sapiens
cattgtagaaacac

SEQ ID NO: 3956325 - DNA, 15 bp, Homo sapiens
cattgtagagcttct

SEQ ID NO: 3956326 - DNA, 16 bp, Homo sapiens
cattgtagagcttctg

SEQ ID NO: 3956327 - DNA, 19 bp, Homo sapiens
cattgtagagcttctggca

SEQ ID NO: 3956328 - DNA, 23 bp, Homo sapiens
cattgtagagcttggtggctgag

SEQ ID NO: 3956329 - DNA, 16 bp, Homo sapiens
cattgtctcagtgctg

SEQ ID NO: 3956330 - DNA, 19 bp, Homo sapiens
cattgttattgtggaagat

SEQ ID NO: 3956331 - DNA, 21 bp, Homo sapiens
catttaaaaaaaaaatttgtt

SEQ ID NO: 3956332 - DNA, 12 bp, Homo sapiens
catttaaaatga

SEQ ID NO: 3956333 - DNA, 14 bp, Homo sapiens
catttaaaatgatt

SEQ ID NO: 3956334 - DNA, 16 bp, Homo sapiens
catttaaaatgattag

SEQ ID NO: 3956335 - DNA, 24 bp, Homo sapiens
catttaattcataattagaacaat

SEQ ID NO: 3956336 - DNA, 18 bp, Homo sapiens
catttacaataaatattc

SEQ ID NO: 3956337 - DNA, 19 bp, Homo sapiens
catttacaataaatattct

SEQ ID NO: 3956338 - DNA, 16 bp, Homo sapiens
catttacctcgaggct

SEQ ID NO: 3956339 - DNA, 15 bp, Homo sapiens
catttagttttatgg

SEQ ID NO: 3956340 - DNA, 14 bp, Homo sapiens
catttcaactccag

SEQ ID NO: 3956341 - DNA, 15 bp, Homo sapiens
catttcaactccaga

SEQ ID NO: 3956342 - DNA, 13 bp, Homo sapiens
catttcacattaa

SEQ ID NO: 3956343 - DNA, 15 bp, Homo sapiens
catttcacattaatg

SEQ ID NO: 3956344 - DNA, 15 bp, Homo sapiens
catttcactttaaag

SEQ ID NO: 3956345 - DNA, 19 bp, Homo sapiens
catttcataaggcctgccc

SEQ ID NO: 3956346 - DNA, 20 bp, Homo sapiens
catttcctgacagaaggact

SEQ ID NO: 3956347 - DNA, 12 bp, Homo sapiens
catttcctgggt

SEQ ID NO: 3956348 - DNA, 14 bp, Homo sapiens
catttctaaaagaa

SEQ ID NO: 3956349 - DNA, 13 bp, Homo sapiens
catttctaacata

SEQ ID NO: 3956350 - DNA, 20 bp, Homo sapiens
catttctaacatatgtatta

SEQ ID NO: 3956351 - DNA, 14 bp, Homo sapiens
catttctctgagca

SEQ ID NO: 3956352 - DNA, 19 bp, Homo sapiens
catttctctgagcagtcag

SEQ ID NO: 3956353 - DNA, 15 bp, Homo sapiens
catttgagagaagcc

SEQ ID NO: 3956354 - DNA, 16 bp, Homo sapiens
catttgagagaagcca

SEQ ID NO: 3956355 - DNA, 17 bp, Homo sapiens
catttgccattcctgga

SEQ ID NO: 3956356 - DNA, 13 bp, Homo sapiens
catttgctttttg

SEQ ID NO: 3956357 - DNA, 23 bp, Homo sapiens
catttggtatattacctcaaatt

SEQ ID NO: 3956358 - DNA, 20 bp, Homo sapiens
catttgttgtgactggcacc

SEQ ID NO: 3956359 - DNA, 15 bp, Homo sapiens
cattttaaaatctga

SEQ ID NO: 3956360 - DNA, 18 bp, Homo sapiens
cattttaatttatatttg

SEQ ID NO: 3956361 - DNA, 16 bp, Homo sapiens
cattttcaatgcacat

SEQ ID NO: 3956362 - DNA, 16 bp, Homo sapiens
cattttgaggccagag

SEQ ID NO: 3956363 - DNA, 20 bp, Homo sapiens
cattttgagtgactcgaggg

SEQ ID NO: 3956364 - DNA, 18 bp, Homo sapiens
cattttggaagttttcag

SEQ ID NO: 3956365 - DNA, 20 bp, Homo sapiens
cattttggaagttttcagga

SEQ ID NO: 3956366 - DNA, 19 bp, Homo sapiens
cattttgtaacaaatgaac

SEQ ID NO: 3956367 - DNA, 17 bp, Homo sapiens
catttttacaataaata

SEQ ID NO: 3956368 - DNA, 20 bp, Homo sapiens
catttttattcatgccatct

SEQ ID NO: 3956369 - DNA, 17 bp, Homo sapiens
catttttgatttatgca

SEQ ID NO: 3956370 - DNA, 17 bp, Homo sapiens
cattttttttttttgag

SEQ ID NO: 3956371 - DNA, 16 bp, Homo sapiens
ccaaaaaagtattttt

SEQ ID NO: 3956372 - DNA, 13 bp, Homo sapiens
ccaaaagggcagc

SEQ ID NO: 3956373 - DNA, 16 bp, Homo sapiens
ccaaaagggcagccag

SEQ ID NO: 3956374 - DNA, 22 bp, Homo sapiens
ccaaaagggcagccaggggctg

SEQ ID NO: 3956375 - DNA, 16 bp, Homo sapiens
ccaaaagtacttaccc

SEQ ID NO: 3956376 - DNA, 15 bp, Homo sapiens
ccaaacacactgtaa

SEQ ID NO: 3956377 - DNA, 13 bp, Homo sapiens
ccaaacagagggc

SEQ ID NO: 3956378 - DNA, 15 bp, Homo sapiens
ccaaactaccgttcc

SEQ ID NO: 3956379 - DNA, 20 bp, Homo sapiens
ccaaactgcacacacagctc

SEQ ID NO: 3956380 - DNA, 17 bp, Homo sapiens
ccaaagaaatgtaaggg

SEQ ID NO: 3956381 - DNA, 21 bp, Homo sapiens
ccaaagaattcctgaagccag

SEQ ID NO: 3956382 - DNA, 23 bp, Homo sapiens
ccaaagaattcctgaagccagat

SEQ ID NO: 3956383 - DNA, 17 bp, Homo sapiens
ccaaagagactggagca

SEQ ID NO: 3956384 - DNA, 20 bp, Homo sapiens
ccaaagagcctggagaagct

SEQ ID NO: 3956385 - DNA, 22 bp, Homo sapiens
ccaaagagcctggagaagctga

SEQ ID NO: 3956386 - DNA, 21 bp, Homo sapiens
ccaaagatatatacacaggat

SEQ ID NO: 3956387 - DNA, 15 bp, Homo sapiens
ccaaagcaaaagaag

SEQ ID NO: 3956388 - DNA, 14 bp, Homo sapiens
ccaaagcatggact

SEQ ID NO: 3956389 - DNA, 19 bp, Homo sapiens
ccaaagcattgcctgccag

SEQ ID NO: 3956390 - DNA, 15 bp, Homo sapiens
ccaaaggggctgctg

SEQ ID NO: 3956391 - DNA, 16 bp, Homo sapiens
ccaaaggggctgctgg

SEQ ID NO: 3956392 - DNA, 17 bp, Homo sapiens
ccaaagtgacctaccca

SEQ ID NO: 3956393 - DNA, 15 bp, Homo sapiens
ccaaagtgcagccct

SEQ ID NO: 3956394 - DNA, 19 bp, Homo sapiens
ccaaagtgcagcccttcct

SEQ ID NO: 3956395 - DNA, 20 bp, Homo sapiens
ccaaagtgcagcccttcctc

SEQ ID NO: 3956396 - DNA, 22 bp, Homo sapiens
ccaaagtgcagcccttcctcct

SEQ ID NO: 3956397 - DNA, 16 bp, Homo sapiens
ccaaataaatgtgtaa

SEQ ID NO: 3956398 - DNA, 17 bp, Homo sapiens
ccaaataaatgtgtaaa

SEQ ID NO: 3956399 - DNA, 13 bp, Homo sapiens
ccaaatattttag

SEQ ID NO: 3956400 - DNA, 16 bp, Homo sapiens
ccaaatccacaagcca

SEQ ID NO: 3956401 - DNA, 17 bp, Homo sapiens
ccaaatgcacaagctca

SEQ ID NO: 3956402 - DNA, 21 bp, Homo sapiens
ccaaatgcacaagctcagaat

SEQ ID NO: 3956403 - DNA, 17 bp, Homo sapiens
ccaaatgcatggtgcag

SEQ ID NO: 3956404 - DNA, 15 bp, Homo sapiens
ccaacaaacctgctt

SEQ ID NO: 3956405 - DNA, 14 bp, Homo sapiens
ccaacaatggggtg

SEQ ID NO: 3956406 - DNA, 18 bp, Homo sapiens
ccaacaatggggtgggcc

SEQ ID NO: 3956407 - DNA, 23 bp, Homo sapiens
ccaacaccttcttggcttctggg

SEQ ID NO: 3956408 - DNA, 14 bp, Homo sapiens
ccaacacgagcagg

SEQ ID NO: 3956409 - DNA, 21 bp, Homo sapiens
ccaacacgagcaggctactgt

SEQ ID NO: 3956410 - DNA, 11 bp, Homo sapiens
ccaacagcagc

SEQ ID NO: 3956411 - DNA, 16 bp, Homo sapiens
ccaacagcccccccct

SEQ ID NO: 3956412 - DNA, 22 bp, Homo sapiens
ccaacaggctgttctgcactga

SEQ ID NO: 3956413 - DNA, 15 bp, Homo sapiens
ccaacaggtggcagg

SEQ ID NO: 3956414 - DNA, 19 bp, Homo sapiens
ccaacaggtggcaggacca

SEQ ID NO: 3956415 - DNA, 12 bp, Homo sapiens
ccaacagtgagt

SEQ ID NO: 3956416 - DNA, 12 bp, Homo sapiens
ccaacagttcct

SEQ ID NO: 3956417 - DNA, 20 bp, Homo sapiens
ccaacatacccttctttaaa

SEQ ID NO: 3956418 - DNA, 17 bp, Homo sapiens
ccaacatcccattgccc

SEQ ID NO: 3956419 - DNA, 22 bp, Homo sapiens
ccaacatggagaaaccctgtct

SEQ ID NO: 3956420 - DNA, 14 bp, Homo sapiens
ccaaccacaaacca

SEQ ID NO: 3956421 - DNA, 14 bp, Homo sapiens
ccaacccatcagaa

SEQ ID NO: 3956422 - DNA, 18 bp, Homo sapiens
ccaaccccagctggcctc

SEQ ID NO: 3956423 - DNA, 15 bp, Homo sapiens
ccaacccgtggaggc

SEQ ID NO: 3956424 - DNA, 17 bp, Homo sapiens
ccaacccgtggaggctg

SEQ ID NO: 3956425 - DNA, 21 bp, Homo sapiens
ccaacccgtggaggctgctcg

SEQ ID NO: 3956426 - DNA, 15 bp, Homo sapiens
ccaaccctcagagcc

SEQ ID NO: 3956427 - DNA, 22 bp, Homo sapiens
ccaacctcaatgccctgccatt

SEQ ID NO: 3956428 - DNA, 16 bp, Homo sapiens
ccaacctgaccaacat

SEQ ID NO: 3956429 - DNA, 13 bp, Homo sapiens
ccaacctggacaa

SEQ ID NO: 3956430 - DNA, 14 bp, Homo sapiens
ccaacctggacaac

SEQ ID NO: 3956431 - DNA, 13 bp, Homo sapiens
ccaacgcacagga

SEQ ID NO: 3956432 - DNA, 15 bp, Homo sapiens
ccaactcctccttgc

SEQ ID NO: 3956433 - DNA, 19 bp, Homo sapiens
ccaactcctggaagctgtg

SEQ ID NO: 3956434 - DNA, 22 bp, Homo sapiens
ccaactcctggaagctgtgtcc

SEQ ID NO: 3956435 - DNA, 14 bp, Homo sapiens
ccaactccttccag

SEQ ID NO: 3956436 - DNA, 16 bp, Homo sapiens
ccaactctctcctgta

SEQ ID NO: 3956437 - DNA, 15 bp, Homo sapiens
ccaactcttcatttt

SEQ ID NO: 3956438 - DNA, 16 bp, Homo sapiens
ccaactggcttctgtg

SEQ ID NO: 3956439 - DNA, 17 bp, Homo sapiens
ccaactggcttctgtgc

SEQ ID NO: 3956440 - DNA, 13 bp, Homo sapiens
ccaacttggcttt

SEQ ID NO: 3956441 - DNA, 17 bp, Homo sapiens
ccaactttctgtaaact

SEQ ID NO: 3956442 - DNA, 11 bp, Homo sapiens
ccaagaaaaag

SEQ ID NO: 3956443 - DNA, 14 bp, Homo sapiens
ccaagaaaaagaaa

SEQ ID NO: 3956444 - DNA, 12 bp, Homo sapiens
ccaagaagggct

SEQ ID NO: 3956445 - DNA, 19 bp, Homo sapiens
ccaagaatagatgctgact

SEQ ID NO: 3956446 - DNA, 14 bp, Homo sapiens
catgggcctgctgc

SEQ ID NO: 3956447 - DNA, 12 bp, Homo sapiens
catgggcctggg

SEQ ID NO: 3956448 - DNA, 13 bp, Homo sapiens
catgggcctgggc

SEQ ID NO: 3956449 - DNA, 14 bp, Homo sapiens
catgggcctgggcc

SEQ ID NO: 3956450 - DNA, 15 bp, Homo sapiens
catgggcctgggcct

SEQ ID NO: 3956451 - DNA, 16 bp, Homo sapiens
catgggcctgggcctg

SEQ ID NO: 3956452 - DNA, 20 bp, Homo sapiens
catgggcttggacttcctgg

SEQ ID NO: 3956453 - DNA, 18 bp, Homo sapiens
catgggtgtgcccttggg

SEQ ID NO: 3956454 - DNA, 17 bp, Homo sapiens
catggtcagctcacacc

SEQ ID NO: 3956455 - DNA, 19 bp, Homo sapiens
catggtcccacatccctgg

SEQ ID NO: 3956456 - DNA, 23 bp, Homo sapiens
catggtcccacatccctgggcct

SEQ ID NO: 3956457 - DNA, 20 bp, Homo sapiens
catggtccggtgtccttttc

SEQ ID NO: 3956458 - DNA, 15 bp, Homo sapiens
catggtgacacacag

SEQ ID NO: 3956459 - DNA, 16 bp, Homo sapiens
catggtgacacacagc

SEQ ID NO: 3956460 - DNA, 21 bp, Homo sapiens
catggtgcagttgacagcagg

SEQ ID NO: 3956461 - DNA, 19 bp, Homo sapiens
catggtgcttgttaatgct

SEQ ID NO: 3956462 - DNA, 19 bp, Homo sapiens
catggtgctttcaggtctg

SEQ ID NO: 3956463 - DNA, 13 bp, Homo sapiens
catggtggaaggg

SEQ ID NO: 3956464 - DNA, 17 bp, Homo sapiens
catggtggcgcaagcct

SEQ ID NO: 3956465 - DNA, 14 bp, Homo sapiens
catggttccttccc

SEQ ID NO: 3956466 - DNA, 16 bp, Homo sapiens
catggttccttccctg

SEQ ID NO: 3956467 - DNA, 16 bp, Homo sapiens
catgtaaaagagtcat

SEQ ID NO: 3956468 - DNA, 14 bp, Homo sapiens
catgtaaaatgcag

SEQ ID NO: 3956469 - DNA, 22 bp, Homo sapiens
catgtaaaatgcagtccagaat

SEQ ID NO: 3956470 - DNA, 17 bp, Homo sapiens
catgtaaggaagggact

SEQ ID NO: 3956471 - DNA, 14 bp, Homo sapiens
catgtaataaatct

SEQ ID NO: 3956472 - DNA, 16 bp, Homo sapiens
catgtaataaatctga

SEQ ID NO: 3956473 - DNA, 23 bp, Homo sapiens
catgtacaaaatcgattggcttt

SEQ ID NO: 3956474 - DNA, 16 bp, Homo sapiens
catgtacttcctgtgt

SEQ ID NO: 3956475 - DNA, 21 bp, Homo sapiens
catgtacttcctgtgtactct

SEQ ID NO: 3956476 - DNA, 14 bp, Homo sapiens
catgtagcaggact

SEQ ID NO: 3956477 - DNA, 15 bp, Homo sapiens
catgtagctgagttt

SEQ ID NO: 3956478 - DNA, 12 bp, Homo sapiens
catgtatgtgtg

SEQ ID NO: 3956479 - DNA, 22 bp, Homo sapiens
catgtcaccgtggaccttcctg

SEQ ID NO: 3956480 - DNA, 17 bp, Homo sapiens
catgtcagagccaggct

SEQ ID NO: 3956481 - DNA, 18 bp, Homo sapiens
catgtcagagccaggctc

SEQ ID NO: 3956482 - DNA, 21 bp, Homo sapiens
catgtcagagccaggctctgc

SEQ ID NO: 3956483 - DNA, 22 bp, Homo sapiens
catgtccctaccgagtctcttc

SEQ ID NO: 3956484 - DNA, 15 bp, Homo sapiens
catgtcctatgtgtg

SEQ ID NO: 3956485 - DNA, 18 bp, Homo sapiens
catgtcgcctctgcattc

SEQ ID NO: 3956486 - DNA, 20 bp, Homo sapiens
catgtcgcctctgcattcag

SEQ ID NO: 3956487 - DNA, 17 bp, Homo sapiens
catgtctctcagaattc

SEQ ID NO: 3956488 - DNA, 16 bp, Homo sapiens
catgtgatccttttat

SEQ ID NO: 3956489 - DNA, 18 bp, Homo sapiens
catgtgatccttttatgt

SEQ ID NO: 3956490 - DNA, 14 bp, Homo sapiens
catgtggagtggac

SEQ ID NO: 3956491 - DNA, 18 bp, Homo sapiens
catgtggccccaggtgcc

SEQ ID NO: 3956492 - DNA, 14 bp, Homo sapiens
catgtggtatgagt

SEQ ID NO: 3956493 - DNA, 20 bp, Homo sapiens
catgtggtttatagagggcc

SEQ ID NO: 3956494 - DNA, 14 bp, Homo sapiens
catgtgtcccctca

SEQ ID NO: 3956495 - DNA, 12 bp, Homo sapiens
catgtgtgcctg

SEQ ID NO: 3956496 - DNA, 16 bp, Homo sapiens
catgtgtgctgtgctg

SEQ ID NO: 3956497 - DNA, 17 bp, Homo sapiens
catgtgtggatgtgtaa

SEQ ID NO: 3956498 - DNA, 12 bp, Homo sapiens
catgtgtgtata

SEQ ID NO: 3956499 - DNA, 15 bp, Homo sapiens
catgtgtgtatatat

SEQ ID NO: 3956500 - DNA, 16 bp, Homo sapiens
catgtgtgtatatatg

SEQ ID NO: 3956501 - DNA, 17 bp, Homo sapiens
catgtgtgtatatatgt

SEQ ID NO: 3956502 - DNA, 18 bp, Homo sapiens
catgtgtgtatatatgtg

SEQ ID NO: 3956503 - DNA, 11 bp, Homo sapiens
catgtgtgtgt

SEQ ID NO: 3956504 - DNA, 14 bp, Homo sapiens
catgttatatattt

SEQ ID NO: 3956505 - DNA, 21 bp, Homo sapiens
catgttcctcaaaagcaccct

SEQ ID NO: 3956506 - DNA, 19 bp, Homo sapiens
catgttgaagccactgcct

SEQ ID NO: 3956507 - DNA, 21 bp, Homo sapiens
catgttggatagtcagctgta

SEQ ID NO: 3956508 - DNA, 18 bp, Homo sapiens
catgttggccaggctggt

SEQ ID NO: 3956509 - DNA, 9 bp, Homo sapiens
catgtttac

SEQ ID NO: 3956510 - DNA, 21 bp, Homo sapiens
catgtttacttttcagggcat

SEQ ID NO: 3956511 - DNA, 18 bp, Homo sapiens
catgtttagattccagga

SEQ ID NO: 3956512 - DNA, 23 bp, Homo sapiens
ccaatgaaatacacaagtaaaca

SEQ ID NO: 3956513 - DNA, 19 bp, Homo sapiens
ccaatgcatagtttgttca

SEQ ID NO: 3956514 - DNA, 23 bp, Homo sapiens
ccaatgcatgcagccactgtgct

SEQ ID NO: 3956515 - DNA, 20 bp, Homo sapiens
ccaattaaaatatatataaa

SEQ ID NO: 3956516 - DNA, 21 bp, Homo sapiens
ccaattaaaatatatataaat

SEQ ID NO: 3956517 - DNA, 22 bp, Homo sapiens
ccaattaaaatatatataaata

SEQ ID NO: 3956518 - DNA, 21 bp, Homo sapiens
ccaattaaaattaaggtctgg

SEQ ID NO: 3956519 - DNA, 16 bp, Homo sapiens
ccaattatgcactggc

SEQ ID NO: 3956520 - DNA, 19 bp, Homo sapiens
ccaattatgcactggccac

SEQ ID NO: 3956521 - DNA, 14 bp, Homo sapiens
ccaattcatttcat

SEQ ID NO: 3956522 - DNA, 17 bp, Homo sapiens
ccaattcatttcatcta

SEQ ID NO: 3956523 - DNA, 13 bp, Homo sapiens
ccaattgtaaaaa

SEQ ID NO: 3956524 - DNA, 14 bp, Homo sapiens
ccaattgtaaaaaa

SEQ ID NO: 3956525 - DNA, 15 bp, Homo sapiens
ccaatttaattccat

SEQ ID NO: 3956526 - DNA, 13 bp, Homo sapiens
ccacaaaaattga

SEQ ID NO: 3956527 - DNA, 22 bp, Homo sapiens
ccacaaaatagagattaatttt

SEQ ID NO: 3956528 - DNA, 16 bp, Homo sapiens
ccacaaactgatttct

SEQ ID NO: 3956529 - DNA, 16 bp, Homo sapiens
ccacaaagccgtgcct

SEQ ID NO: 3956530 - DNA, 19 bp, Homo sapiens
ccacaaagccgtgcctttc

SEQ ID NO: 3956531 - DNA, 18 bp, Homo sapiens
ccacaaccctgttttata

SEQ ID NO: 3956532 - DNA, 14 bp, Homo sapiens
ccacaactgacaca

SEQ ID NO: 3956533 - DNA, 15 bp, Homo sapiens
ccacaactgacacag

SEQ ID NO: 3956534 - DNA, 16 bp, Homo sapiens
ccacaactgacacagg

SEQ ID NO: 3956535 - DNA, 16 bp, Homo sapiens
ccacaagaaatttgat

SEQ ID NO: 3956536 - DNA, 17 bp, Homo sapiens
ccacaagattcccagag

SEQ ID NO: 3956537 - DNA, 18 bp, Homo sapiens
ccacaagccttactcacc

SEQ ID NO: 3956538 - DNA, 20 bp, Homo sapiens
ccacaagccttactcacctc

SEQ ID NO: 3956539 - DNA, 22 bp, Homo sapiens
ccacaagccttactcacctctc

SEQ ID NO: 3956540 - DNA, 21 bp, Homo sapiens
ccacaatgatgattaaacacc

SEQ ID NO: 3956541 - DNA, 23 bp, Homo sapiens
ccacaatgatgattaaacacctg

SEQ ID NO: 3956542 - DNA, 19 bp, Homo sapiens
ccacaatggagtgggagat

SEQ ID NO: 3956543 - DNA, 12 bp, Homo sapiens
ccacacacagag

SEQ ID NO: 3956544 - DNA, 16 bp, Homo sapiens
ccacacacagaggaag

SEQ ID NO: 3956545 - DNA, 18 bp, Homo sapiens
ccacacacgcaggaactc

SEQ ID NO: 3956546 - DNA, 23 bp, Homo sapiens
ccacacacgcaggaactcccagc

SEQ ID NO: 3956547 - DNA, 20 bp, Homo sapiens
ccacaccatcaccctctggg

SEQ ID NO: 3956548 - DNA, 14 bp, Homo sapiens
ccacacctaaaact

SEQ ID NO: 3956549 - DNA, 20 bp, Homo sapiens
ccacacgtgctcgcagcctg

SEQ ID NO: 3956550 - DNA, 17 bp, Homo sapiens
ccacactattaccatga

SEQ ID NO: 3956551 - DNA, 18 bp, Homo sapiens
ccacacttctcaggacac

SEQ ID NO: 3956552 - DNA, 21 bp, Homo sapiens
ccacacttctcaggacacagg

SEQ ID NO: 3956553 - DNA, 23 bp, Homo sapiens
ccacacttcttgaaacagcctgg

SEQ ID NO: 3956554 - DNA, 18 bp, Homo sapiens
ccacagaagccaggagca

SEQ ID NO: 3956555 - DNA, 22 bp, Homo sapiens
ccacagaagccaggagcaaatg

SEQ ID NO: 3956556 - DNA, 17 bp, Homo sapiens
ccacagacagatcccat

SEQ ID NO: 3956557 - DNA, 17 bp, Homo sapiens
ccacagcacccaggctc

SEQ ID NO: 3956558 - DNA, 19 bp, Homo sapiens
ccacaggcccttcctctcc

SEQ ID NO: 3956559 - DNA, 22 bp, Homo sapiens
ccacaggcccttcctctccact

SEQ ID NO: 3956560 - DNA, 16 bp, Homo sapiens
ccacaggcccttgggg

SEQ ID NO: 3956561 - DNA, 16 bp, Homo sapiens
ccacagtcaaagaagg

SEQ ID NO: 3956562 - DNA, 14 bp, Homo sapiens
ccacagtctcccat

SEQ ID NO: 3956563 - DNA, 20 bp, Homo sapiens
ccacagttgctgctcctttg

SEQ ID NO: 3956564 - DNA, 19 bp, Homo sapiens
ccacatagtgatggttccc

SEQ ID NO: 3956565 - DNA, 22 bp, Homo sapiens
ccacatagtgatggttcccctg

SEQ ID NO: 3956566 - DNA, 22 bp, Homo sapiens
ccacatccacacacgcaggaac

SEQ ID NO: 3956567 - DNA, 14 bp, Homo sapiens
ccacatccctgggc

SEQ ID NO: 3956568 - DNA, 15 bp, Homo sapiens
ccacatccctgggcc

SEQ ID NO: 3956569 - DNA, 19 bp, Homo sapiens
ccacatccctgggcctgct

SEQ ID NO: 3956570 - DNA, 22 bp, Homo sapiens
ccacatccctgggcctgctgct

SEQ ID NO: 3956571 - DNA, 14 bp, Homo sapiens
ccacatgtcaccgt

SEQ ID NO: 3956572 - DNA, 21 bp, Homo sapiens
ccaccaacccatcagaaggag

SEQ ID NO: 3956573 - DNA, 17 bp, Homo sapiens
ccaccaactctgcactc

SEQ ID NO: 3956574 - DNA, 20 bp, Homo sapiens
ccaccaactctgcactccat

SEQ ID NO: 3956575 - DNA, 11 bp, Homo sapiens
ccaccaaggtc

SEQ ID NO: 3956576 - DNA, 17 bp, Homo sapiens
ccaccaaggtcttcagc

SEQ ID NO: 3956577 - DNA, 11 bp, Homo sapiens
ccaccaataaa

SEQ ID NO: 3956578 - DNA, 12 bp, Homo sapiens
ccaccaataaaa

SEQ ID NO: 3956579 - DNA, 21 bp, Homo sapiens
ccaccacctaggccactcctc

SEQ ID NO: 3956580 - DNA, 13 bp, Homo sapiens
ccaccacgtctgc

SEQ ID NO: 3956581 - DNA, 19 bp, Homo sapiens
ccaccacgtctgccaggcc

SEQ ID NO: 3956582 - DNA, 21 bp, Homo sapiens
ccaccacgtctgccaggccca

SEQ ID NO: 3956583 - DNA, 13 bp, Homo sapiens
ccaccattcacat

SEQ ID NO: 3956584 - DNA, 13 bp, Homo sapiens
ccacccagcccat

SEQ ID NO: 3956585 - DNA, 22 bp, Homo sapiens
ccacccagcccattctctctcc

SEQ ID NO: 3956586 - DNA, 17 bp, Homo sapiens
ccacccaggctgcactg

SEQ ID NO: 3956587 - DNA, 15 bp, Homo sapiens
ccacccagggctccc

SEQ ID NO: 3956588 - DNA, 14 bp, Homo sapiens
ccacccagtgctgc

SEQ ID NO: 3956589 - DNA, 15 bp, Homo sapiens
ccacccagtgctgcc

SEQ ID NO: 3956590 - DNA, 21 bp, Homo sapiens
ccacccagtgctgccatgcca

SEQ ID NO: 3956591 - DNA, 21 bp, Homo sapiens
ccacccatcctaccaatgcat

SEQ ID NO: 3956592 - DNA, 20 bp, Homo sapiens
ccacccatcttcctgctgct

SEQ ID NO: 3956593 - DNA, 14 bp, Homo sapiens
ccaccccaccccct

SEQ ID NO: 3956594 - DNA, 15 bp, Homo sapiens
ccaccccactccagc

SEQ ID NO: 3956595 - DNA, 17 bp, Homo sapiens
ccaccccactccagccc

SEQ ID NO: 3956596 - DNA, 18 bp, Homo sapiens
ccaccccactccagccct

SEQ ID NO: 3956597 - DNA, 18 bp, Homo sapiens
ccaccccatccagttcat

SEQ ID NO: 3956598 - DNA, 20 bp, Homo sapiens
ccactgcagtccgcagtctg

SEQ ID NO: 3956599 - DNA, 12 bp, Homo sapiens
ccactgccaggc

SEQ ID NO: 3956600 - DNA, 19 bp, Homo sapiens
ccactgccaggcacctggc

SEQ ID NO: 3956601 - DNA, 20 bp, Homo sapiens
ccactgccaggcacctggcc

SEQ ID NO: 3956602 - DNA, 18 bp, Homo sapiens
ccactgccctgcctgccc

SEQ ID NO: 3956603 - DNA, 21 bp, Homo sapiens
ccactgccctgcctgcccact

SEQ ID NO: 3956604 - DNA, 13 bp, Homo sapiens
ccactggccagtc

SEQ ID NO: 3956605 - DNA, 19 bp, Homo sapiens
ccactggccagtcctagag

SEQ ID NO: 3956606 - DNA, 22 bp, Homo sapiens
ccactggccagtcctagagctc

SEQ ID NO: 3956607 - DNA, 11 bp, Homo sapiens
ccactggctcc

SEQ ID NO: 3956608 - DNA, 18 bp, Homo sapiens
ccactgggtctcactcct

SEQ ID NO: 3956609 - DNA, 19 bp, Homo sapiens
ccactgggtctcactcctg

SEQ ID NO: 3956610 - DNA, 20 bp, Homo sapiens
ccactgggtctcactcctga

SEQ ID NO: 3956611 - DNA, 21 bp, Homo sapiens
ccactggttaaaataaagcct

SEQ ID NO: 3956612 - DNA, 19 bp, Homo sapiens
ccactgtgctgaattctgc

SEQ ID NO: 3956613 - DNA, 15 bp, Homo sapiens
ccactgtggccagag

SEQ ID NO: 3956614 - DNA, 18 bp, Homo sapiens
ccactgtggccagagctg

SEQ ID NO: 3956615 - DNA, 20 bp, Homo sapiens
ccactgtggccagagctgga

SEQ ID NO: 3956616 - DNA, 14 bp, Homo sapiens
ccactgtttgtcct

SEQ ID NO: 3956617 - DNA, 12 bp, Homo sapiens
ccacttacctag

SEQ ID NO: 3956618 - DNA, 17 bp, Homo sapiens
ccacttcaagtgaccac

SEQ ID NO: 3956619 - DNA, 13 bp, Homo sapiens
ccacttcactgtg

SEQ ID NO: 3956620 - DNA, 21 bp, Homo sapiens
ccacttgacattccttgtcac

SEQ ID NO: 3956621 - DNA, 13 bp, Homo sapiens
ccacttgggagct

SEQ ID NO: 3956622 - DNA, 16 bp, Homo sapiens
ccacttgggtcttccc

SEQ ID NO: 3956623 - DNA, 15 bp, Homo sapiens
ccacttgtcatccat

SEQ ID NO: 3956624 - DNA, 20 bp, Homo sapiens
ccactttgcacagctctccg

SEQ ID NO: 3956625 - DNA, 14 bp, Homo sapiens
ccactttggcttct

SEQ ID NO: 3956626 - DNA, 21 bp, Homo sapiens
ccactttggcttctcctgtga

SEQ ID NO: 3956627 - DNA, 22 bp, Homo sapiens
ccactttggcttctcctgtgac

SEQ ID NO: 3956628 - DNA, 16 bp, Homo sapiens
ccacttttattcattt

SEQ ID NO: 3956629 - DNA, 19 bp, Homo sapiens
ccagaaaaaaaaaaactta

SEQ ID NO: 3956630 - DNA, 12 bp, Homo sapiens
ccagaaaatata

SEQ ID NO: 3956631 - DNA, 18 bp, Homo sapiens
ccagaaaatataaatgca

SEQ ID NO: 3956632 - DNA, 23 bp, Homo sapiens
ccagaaactccttttgctgtctt

SEQ ID NO: 3956633 - DNA, 12 bp, Homo sapiens
ccagaaagaaaa

SEQ ID NO: 3956634 - DNA, 21 bp, Homo sapiens
ccagaaagtgaggaagcctaa

SEQ ID NO: 3956635 - DNA, 13 bp, Homo sapiens
ccagaaccacact

SEQ ID NO: 3956636 - DNA, 22 bp, Homo sapiens
ccagaactgaggtcactgggtt

SEQ ID NO: 3956637 - DNA, 16 bp, Homo sapiens
ccagaagaatattcag

SEQ ID NO: 3956638 - DNA, 17 bp, Homo sapiens
ccagaaggagggcagag

SEQ ID NO: 3956639 - DNA, 12 bp, Homo sapiens
ccagaaggcagg

SEQ ID NO: 3956640 - DNA, 20 bp, Homo sapiens
ccagaagggagttgctcact

SEQ ID NO: 3956641 - DNA, 21 bp, Homo sapiens
ccagaagggagttgctcactc

SEQ ID NO: 3956642 - DNA, 13 bp, Homo sapiens
ccagaataagtgc

SEQ ID NO: 3956643 - DNA, 17 bp, Homo sapiens
ccagaataagtgctgtt

SEQ ID NO: 3956644 - DNA, 14 bp, Homo sapiens
ccagaatctgctgt

SEQ ID NO: 3956645 - DNA, 23 bp, Homo sapiens
ccagaatggtctttctaatgtgt

SEQ ID NO: 3956646 - DNA, 21 bp, Homo sapiens
ccagaattcccagctgtctgt

SEQ ID NO: 3956647 - DNA, 20 bp, Homo sapiens
ccagaattgtgcaaatggaa

SEQ ID NO: 3956648 - DNA, 22 bp, Homo sapiens
ccagacacattctcctgtgccc

SEQ ID NO: 3956649 - DNA, 16 bp, Homo sapiens
ccagaccacctgccag

SEQ ID NO: 3956650 - DNA, 19 bp, Homo sapiens
ccagaccacctgccagcca

SEQ ID NO: 3956651 - DNA, 14 bp, Homo sapiens
ccagaccattgtct

SEQ ID NO: 3956652 - DNA, 14 bp, Homo sapiens
ccagacccctggct

SEQ ID NO: 3956653 - DNA, 15 bp, Homo sapiens
ccagacccctggctt

SEQ ID NO: 3956654 - DNA, 16 bp, Homo sapiens
ccagacccctggcttt

SEQ ID NO: 3956655 - DNA, 15 bp, Homo sapiens
ccagacccctgtggc

SEQ ID NO: 3956656 - DNA, 18 bp, Homo sapiens
ccagacccctgtggcaga

SEQ ID NO: 3956657 - DNA, 17 bp, Homo sapiens
ccagaccctgcctgagc

SEQ ID NO: 3956658 - DNA, 19 bp, Homo sapiens
ccagaccctgcctgagccc

SEQ ID NO: 3956659 - DNA, 17 bp, Homo sapiens
ccagacctagacctggg

SEQ ID NO: 3956660 - DNA, 18 bp, Homo sapiens
ccagacgctgccgctgcc

SEQ ID NO: 3956661 - DNA, 17 bp, Homo sapiens
ccagagaatcagggcag

SEQ ID NO: 3956662 - DNA, 16 bp, Homo sapiens
ccagagaattcttaga

SEQ ID NO: 3956663 - DNA, 16 bp, Homo sapiens
ccagagaccccttcct

SEQ ID NO: 3956664 - DNA, 17 bp, Homo sapiens
ccagagaccccttcctt

SEQ ID NO: 3956665 - DNA, 21 bp, Homo sapiens
ccagagaccccttcctttcct

SEQ ID NO: 3956666 - DNA, 15 bp, Homo sapiens
ccagagaccttttct

SEQ ID NO: 3956667 - DNA, 21 bp, Homo sapiens
ccagagaccttttctctccca

SEQ ID NO: 3956668 - DNA, 19 bp, Homo sapiens
ccagagacggaagcctttt

SEQ ID NO: 3956669 - DNA, 14 bp, Homo sapiens
ccagagagacagac

SEQ ID NO: 3956670 - DNA, 14 bp, Homo sapiens
ccagagaggagcac

SEQ ID NO: 3956671 - DNA, 17 bp, Homo sapiens
ccagagaggagcacctg

SEQ ID NO: 3956672 - DNA, 13 bp, Homo sapiens
ccagagagggccc

SEQ ID NO: 3956673 - DNA, 18 bp, Homo sapiens
ccagagagggcccagctg

SEQ ID NO: 3956674 - DNA, 20 bp, Homo sapiens
ccagagagggcccagctgta

SEQ ID NO: 3956675 - DNA, 23 bp, Homo sapiens
ccagagagggcccagctgtagcc

SEQ ID NO: 3956676 - DNA, 14 bp, Homo sapiens
ccagagagtggctc

SEQ ID NO: 3956677 - DNA, 22 bp, Homo sapiens
ccagagagtggctcctcccggt

SEQ ID NO: 3956678 - DNA, 14 bp, Homo sapiens
ccagagatgcctcc

SEQ ID NO: 3956679 - DNA, 16 bp, Homo sapiens
ccagagatgcctccac

SEQ ID NO: 3956680 - DNA, 17 bp, Homo sapiens
ccagagatgcctccacc

SEQ ID NO: 3956681 - DNA, 23 bp, Homo sapiens
ccagagatgcctccaccgctgcc

SEQ ID NO: 3956682 - DNA, 13 bp, Homo sapiens
ccagagcaaaata

SEQ ID NO: 3956683 - DNA, 22 bp, Homo sapiens
ccagagcattacgtgagccagg

SEQ ID NO: 3956684 - DNA, 20 bp, Homo sapiens
ccagttctgctcctctccag

SEQ ID NO: 3956685 - DNA, 21 bp, Homo sapiens
ccagttctgctcctctccagg

SEQ ID NO: 3956686 - DNA, 17 bp, Homo sapiens
ccagttgggagcactgg

SEQ ID NO: 3956687 - DNA, 21 bp, Homo sapiens
ccagccctccctgtcctcctc

SEQ ID NO: 3956688 - DNA, 22 bp, Homo sapiens
ccagccctccctgtcctcctcg

SEQ ID NO: 3956689 - DNA, 16 bp, Homo sapiens
ccagccctgccaggag

SEQ ID NO: 3956690 - DNA, 13 bp, Homo sapiens
ccagccctgcctg

SEQ ID NO: 3956691 - DNA, 15 bp, Homo sapiens
ccagccctgcctgga

SEQ ID NO: 3956692 - DNA, 13 bp, Homo sapiens
ccagccctggctc

SEQ ID NO: 3956693 - DNA, 21 bp, Homo sapiens
ccagccctggggtatgagctg

SEQ ID NO: 3956694 - DNA, 15 bp, Homo sapiens
ccagcccttccctgc

SEQ ID NO: 3956695 - DNA, 14 bp, Homo sapiens
ccagcccttctgcc

SEQ ID NO: 3956696 - DNA, 21 bp, Homo sapiens
ccagccggggcgagtggcacg

SEQ ID NO: 3956697 - DNA, 22 bp, Homo sapiens
ccagccggtacctgggaagggg

SEQ ID NO: 3956698 - DNA, 14 bp, Homo sapiens
ccagccggtgcctg

SEQ ID NO: 3956699 - DNA, 16 bp, Homo sapiens
ccagccggtgcctggc

SEQ ID NO: 3956700 - DNA, 11 bp, Homo sapiens
ccagcctcagc

SEQ ID NO: 3956701 - DNA, 16 bp, Homo sapiens
ccagcctcagctcagc

SEQ ID NO: 3956702 - DNA, 17 bp, Homo sapiens
ccagcctcagtgccact

SEQ ID NO: 3956703 - DNA, 15 bp, Homo sapiens
ccagcctccatgctg

SEQ ID NO: 3956704 - DNA, 12 bp, Homo sapiens
ccagcctggcct

SEQ ID NO: 3956705 - DNA, 15 bp, Homo sapiens
ccagcctggcctcct

SEQ ID NO: 3956706 - DNA, 18 bp, Homo sapiens
ccagcctggcctcctgcc

SEQ ID NO: 3956707 - DNA, 21 bp, Homo sapiens
ccagcctggcctcctgcctct

SEQ ID NO: 3956708 - DNA, 14 bp, Homo sapiens
ccagcctgggccta

SEQ ID NO: 3956709 - DNA, 14 bp, Homo sapiens
ccagcctgtcctgg

SEQ ID NO: 3956710 - DNA, 18 bp, Homo sapiens
ccagcctgtcctggtaca

SEQ ID NO: 3956711 - DNA, 15 bp, Homo sapiens
ccagcctgtgtgttc

SEQ ID NO: 3956712 - DNA, 14 bp, Homo sapiens
ccagcctgttggac

SEQ ID NO: 3956713 - DNA, 18 bp, Homo sapiens
ccagcgattccctctccc

SEQ ID NO: 3956714 - DNA, 19 bp, Homo sapiens
ccagcgattccctctccca

SEQ ID NO: 3956715 - DNA, 23 bp, Homo sapiens
ccagcgattccctctcccaggcc

SEQ ID NO: 3956716 - DNA, 22 bp, Homo sapiens
ccagcgcctgtgctgaggactc

SEQ ID NO: 3956717 - DNA, 22 bp, Homo sapiens
ccagcgcggcttggccgccatc

SEQ ID NO: 3956718 - DNA, 22 bp, Homo sapiens
ccagctaatctgtagggctgga

SEQ ID NO: 3956719 - DNA, 17 bp, Homo sapiens
ccagctacattcctcag

SEQ ID NO: 3956720 - DNA, 19 bp, Homo sapiens
ccagctacattcctcagct

SEQ ID NO: 3956721 - DNA, 21 bp, Homo sapiens
ccagctacattcctcagctgc

SEQ ID NO: 3956722 - DNA, 22 bp, Homo sapiens
ccagctacattcctcagctgcc

SEQ ID NO: 3956723 - DNA, 14 bp, Homo sapiens
ccagctactcagga

SEQ ID NO: 3956724 - DNA, 19 bp, Homo sapiens
ccagctactcaggaggctg

SEQ ID NO: 3956725 - DNA, 15 bp, Homo sapiens
ccagctactctgtcc

SEQ ID NO: 3956726 - DNA, 16 bp, Homo sapiens
ccagctactctgtcca

SEQ ID NO: 3956727 - DNA, 17 bp, Homo sapiens
ccagctactctgtccag

SEQ ID NO: 3956728 - DNA, 21 bp, Homo sapiens
ccagctactctgtccaggcca

SEQ ID NO: 3956729 - DNA, 20 bp, Homo sapiens
ccagctacttgggaggctga

SEQ ID NO: 3956730 - DNA, 20 bp, Homo sapiens
ccagctagccaactcctcct

SEQ ID NO: 3956731 - DNA, 21 bp, Homo sapiens
ccagctagccaactcctcctt

SEQ ID NO: 3956732 - DNA, 15 bp, Homo sapiens
ccagctcacaagccc

SEQ ID NO: 3956733 - DNA, 18 bp, Homo sapiens
ccagctcacaagcccagg

SEQ ID NO: 3956734 - DNA, 15 bp, Homo sapiens
ccagctcaggtgact

SEQ ID NO: 3956735 - DNA, 21 bp, Homo sapiens
ccagctcaggtgactggagcc

SEQ ID NO: 3956736 - DNA, 17 bp, Homo sapiens
ccagctcccttcttccc

SEQ ID NO: 3956737 - DNA, 18 bp, Homo sapiens
ccagctctccctctggcc

SEQ ID NO: 3956738 - DNA, 21 bp, Homo sapiens
ccagctctccctctggccctg

SEQ ID NO: 3956739 - DNA, 22 bp, Homo sapiens
ccagctctccctctggccctgc

SEQ ID NO: 3956740 - DNA, 14 bp, Homo sapiens
ccagctctctctac

SEQ ID NO: 3956741 - DNA, 14 bp, Homo sapiens
ccagctctgtggcc

SEQ ID NO: 3956742 - DNA, 18 bp, Homo sapiens
ccagctctgtggcctgtg

SEQ ID NO: 3956743 - DNA, 19 bp, Homo sapiens
ccagctctgtggcctgtgt

SEQ ID NO: 3956744 - DNA, 19 bp, Homo sapiens
ccagctgccgaccagagcc

SEQ ID NO: 3956745 - DNA, 13 bp, Homo sapiens
ccagctgccttcc

SEQ ID NO: 3956746 - DNA, 14 bp, Homo sapiens
ccagctgccttcct

SEQ ID NO: 3956747 - DNA, 12 bp, Homo sapiens
ccagctgctctg

SEQ ID NO: 3956748 - DNA, 16 bp, Homo sapiens
ccagctgctctgcccc

SEQ ID NO: 3956749 - DNA, 22 bp, Homo sapiens
ccagctgctctgccccttgggc

SEQ ID NO: 3956750 - DNA, 15 bp, Homo sapiens
ccagctgctgctctg

SEQ ID NO: 3956751 - DNA, 16 bp, Homo sapiens
ccagctggcctctaga

SEQ ID NO: 3956752 - DNA, 17 bp, Homo sapiens
ccagctggtgctgcaag

SEQ ID NO: 3956753 - DNA, 20 bp, Homo sapiens
ccagctggtgctgcaaggaa

SEQ ID NO: 3956754 - DNA, 15 bp, Homo sapiens
ccagctgtagccatg

SEQ ID NO: 3956755 - DNA, 18 bp, Homo sapiens
ccagctgtagccatggct

SEQ ID NO: 3956756 - DNA, 19 bp, Homo sapiens
ccagctgtagccatggctc

SEQ ID NO: 3956757 - DNA, 15 bp, Homo sapiens
ccagctgtcgcatct

SEQ ID NO: 3956758 - DNA, 19 bp, Homo sapiens
ccagctgtgttcacactgt

SEQ ID NO: 3956759 - DNA, 23 bp, Homo sapiens
ccagcttgctcttcagtgggaga

SEQ ID NO: 3956760 - DNA, 22 bp, Homo sapiens
ccaggaacacccgactcctcaa

SEQ ID NO: 3956761 - DNA, 17 bp, Homo sapiens
ccaggaaggcagctgct

SEQ ID NO: 3956762 - DNA, 14 bp, Homo sapiens
ccaggaatctgcca

SEQ ID NO: 3956763 - DNA, 19 bp, Homo sapiens
ccaggacacctgccccagc

SEQ ID NO: 3956764 - DNA, 22 bp, Homo sapiens
ccaggacacctgccccagcgcg

SEQ ID NO: 3956765 - DNA, 13 bp, Homo sapiens
ccaggacaggacc

SEQ ID NO: 3956766 - DNA, 14 bp, Homo sapiens
ccaggacaggcccg

SEQ ID NO: 3956767 - DNA, 20 bp, Homo sapiens
ccaggactatagcccaggtc

SEQ ID NO: 3956768 - DNA, 21 bp, Homo sapiens
ccaggactccccaggccaggc

SEQ ID NO: 3956769 - DNA, 12 bp, Homo sapiens
ccaggagaactg

SEQ ID NO: 3956770 - DNA, 13 bp, Homo sapiens
ccaggagagccag

SEQ ID NO: 3956771 - DNA, 17 bp, Homo sapiens
ccaggagagccagccct

SEQ ID NO: 3956772 - DNA, 20 bp, Homo sapiens
ccaggagagccagccctccc

SEQ ID NO: 3956773 - DNA, 12 bp, Homo sapiens
ccagtttcccac

SEQ ID NO: 3956774 - DNA, 14 bp, Homo sapiens
ccagtttcccacca

SEQ ID NO: 3956775 - DNA, 13 bp, Homo sapiens
ccagtttcccttc

SEQ ID NO: 3956776 - DNA, 16 bp, Homo sapiens
ccagtttctgcggcct

SEQ ID NO: 3956777 - DNA, 14 bp, Homo sapiens
ccagtttgcagaaa

SEQ ID NO: 3956778 - DNA, 15 bp, Homo sapiens
ccataaagcaagctc

SEQ ID NO: 3956779 - DNA, 17 bp, Homo sapiens
ccataaagcaagctcaa

SEQ ID NO: 3956780 - DNA, 21 bp, Homo sapiens
ccataaagcaagctcaacctt

SEQ ID NO: 3956781 - DNA, 17 bp, Homo sapiens
ccataatcaatctatca

SEQ ID NO: 3956782 - DNA, 14 bp, Homo sapiens
ccatacccctgcct

SEQ ID NO: 3956783 - DNA, 17 bp, Homo sapiens
ccatacccctgcctggg

SEQ ID NO: 3956784 - DNA, 15 bp, Homo sapiens
ccataccgctgggga

SEQ ID NO: 3956785 - DNA, 16 bp, Homo sapiens
ccatagaaacatgaca

SEQ ID NO: 3956786 - DNA, 17 bp, Homo sapiens
ccatagaaacatgacac

SEQ ID NO: 3956787 - DNA, 13 bp, Homo sapiens
ccatagagtttaa

SEQ ID NO: 3956788 - DNA, 20 bp, Homo sapiens
ccatagcgctggctcaggaa

SEQ ID NO: 3956789 - DNA, 22 bp, Homo sapiens
ccatagttatttacttgaaaga

SEQ ID NO: 3956790 - DNA, 19 bp, Homo sapiens
ccatatcagacctctgatc

SEQ ID NO: 3956791 - DNA, 19 bp, Homo sapiens
ccatatctccttcccctac

SEQ ID NO: 3956792 - DNA, 16 bp, Homo sapiens
ccatatgtctgcttct

SEQ ID NO: 3956793 - DNA, 17 bp, Homo sapiens
ccatatgtctgcttctg

SEQ ID NO: 3956794 - DNA, 19 bp, Homo sapiens
ccatatgtctgcttctgtc

SEQ ID NO: 3956795 - DNA, 16 bp, Homo sapiens
ccatattcacacctca

SEQ ID NO: 3956796 - DNA, 23 bp, Homo sapiens
ccatattttcacaggtgtggtgt

SEQ ID NO: 3956797 - DNA, 17 bp, Homo sapiens
ccatcactgagtggctt

SEQ ID NO: 3956798 - DNA, 17 bp, Homo sapiens
ccatcaggttccatccc

SEQ ID NO: 3956799 - DNA, 16 bp, Homo sapiens
ccatcatcccagctgc

SEQ ID NO: 3956800 - DNA, 16 bp, Homo sapiens
ccatccatcagctccc

SEQ ID NO: 3956801 - DNA, 17 bp, Homo sapiens
ccatccatcagctccct

SEQ ID NO: 3956802 - DNA, 13 bp, Homo sapiens
ccatcccctttcc

SEQ ID NO: 3956803 - DNA, 18 bp, Homo sapiens
ccatcccctttcctcccc

SEQ ID NO: 3956804 - DNA, 20 bp, Homo sapiens
ccatcccctttcctccccac

SEQ ID NO: 3956805 - DNA, 14 bp, Homo sapiens
ccatccctgggccc

SEQ ID NO: 3956806 - DNA, 18 bp, Homo sapiens
ccatccctgggcccctcc

SEQ ID NO: 3956807 - DNA, 20 bp, Homo sapiens
ccatccctgggcccctccac

SEQ ID NO: 3956808 - DNA, 13 bp, Homo sapiens
ccatccggctcct

SEQ ID NO: 3956809 - DNA, 18 bp, Homo sapiens
ccatccgggacgcttcca

SEQ ID NO: 3956810 - DNA, 20 bp, Homo sapiens
ccatccgggacgcttccaga

SEQ ID NO: 3956811 - DNA, 22 bp, Homo sapiens
ccatccgggacgcttccagacc

SEQ ID NO: 3956812 - DNA, 19 bp, Homo sapiens
ccatcctaccaatgcatgc

SEQ ID NO: 3956813 - DNA, 13 bp, Homo sapiens
ccatcctggcccc

SEQ ID NO: 3956814 - DNA, 21 bp, Homo sapiens
ccatctaagctgcagcttcct

SEQ ID NO: 3956815 - DNA, 12 bp, Homo sapiens
ccatctagagat

SEQ ID NO: 3956816 - DNA, 14 bp, Homo sapiens
ccatctcaggtgcc

SEQ ID NO: 3956817 - DNA, 14 bp, Homo sapiens
ccatctccccaggc

SEQ ID NO: 3956818 - DNA, 16 bp, Homo sapiens
ccatctccccaggcct

SEQ ID NO: 3956819 - DNA, 23 bp, Homo sapiens
ccatctccccaggcctccagcct

SEQ ID NO: 3956820 - DNA, 18 bp, Homo sapiens
ccatctctgattttcaaa

SEQ ID NO: 3956821 - DNA, 23 bp, Homo sapiens
ccatctctgattttcaaagcttt

SEQ ID NO: 3956822 - DNA, 13 bp, Homo sapiens
ccatctcttccta

SEQ ID NO: 3956823 - DNA, 18 bp, Homo sapiens
ccatctgggtccttgcac

SEQ ID NO: 3956824 - DNA, 14 bp, Homo sapiens
ccatctgtccctgc

SEQ ID NO: 3956825 - DNA, 14 bp, Homo sapiens
ccatcttcctgctg

SEQ ID NO: 3956826 - DNA, 15 bp, Homo sapiens
ccatcttcctgctgc

SEQ ID NO: 3956827 - DNA, 17 bp, Homo sapiens
ccatcttcctgctgctg

SEQ ID NO: 3956828 - DNA, 13 bp, Homo sapiens
ccatgatccagaa

SEQ ID NO: 3956829 - DNA, 20 bp, Homo sapiens
ccatgatcgagccactgcac

SEQ ID NO: 3956830 - DNA, 12 bp, Homo sapiens
ccatgatctgta

SEQ ID NO: 3956831 - DNA, 19 bp, Homo sapiens
ccatgatggtgctgacctc

SEQ ID NO: 3956832 - DNA, 15 bp, Homo sapiens
ccatgattttacaga

SEQ ID NO: 3956833 - DNA, 16 bp, Homo sapiens
ccatgccactgccagg

SEQ ID NO: 3956834 - DNA, 23 bp, Homo sapiens
ccatgccactgccaggcacctgg

SEQ ID NO: 3956835 - DNA, 13 bp, Homo sapiens
ccatgcccagaga

SEQ ID NO: 3956836 - DNA, 13 bp, Homo sapiens
ccatgcctcatgc

SEQ ID NO: 3956837 - DNA, 15 bp, Homo sapiens
ccatgcctcatgcca

SEQ ID NO: 3956838 - DNA, 12 bp, Homo sapiens
ccatgcctgagg

SEQ ID NO: 3956839 - DNA, 15 bp, Homo sapiens
ccatgcctgagggtg

SEQ ID NO: 3956840 - DNA, 16 bp, Homo sapiens
ccatgcctgagggtgg

SEQ ID NO: 3956841 - DNA, 20 bp, Homo sapiens
ccatgctgctttttggcaca

SEQ ID NO: 3956842 - DNA, 19 bp, Homo sapiens
ccatgctggcggcgcagag

SEQ ID NO: 3956843 - DNA, 22 bp, Homo sapiens
ccatggaggaggtgtcccaagc

SEQ ID NO: 3956844 - DNA, 14 bp, Homo sapiens
ccatggcaccagcc

SEQ ID NO: 3956845 - DNA, 21 bp, Homo sapiens
ccatggcaccagccccctgga

SEQ ID NO: 3956846 - DNA, 22 bp, Homo sapiens
ccatggcaccagccccctggat

SEQ ID NO: 3956847 - DNA, 12 bp, Homo sapiens
ccatggccaccc

SEQ ID NO: 3956848 - DNA, 14 bp, Homo sapiens
ccatggctcaggca

SEQ ID NO: 3956849 - DNA, 16 bp, Homo sapiens
ccatggctcaggcaag

SEQ ID NO: 3956850 - DNA, 21 bp, Homo sapiens
ccatgggaaatgtcaacaagt

SEQ ID NO: 3956851 - DNA, 12 bp, Homo sapiens
ccatgggcctgc

SEQ ID NO: 3956852 - DNA, 15 bp, Homo sapiens
ccatgggcctgctgc

SEQ ID NO: 3956853 - DNA, 20 bp, Homo sapiens
ccatgggcctgctgcgtcag

SEQ ID NO: 3956854 - DNA, 20 bp, Homo sapiens
ccatgggcctgggcctgctt

SEQ ID NO: 3956855 - DNA, 11 bp, Homo sapiens
ccatgggcttg

SEQ ID NO: 3956856 - DNA, 22 bp, Homo sapiens
ccatgggcttggacttcctggg

SEQ ID NO: 3956857 - DNA, 18 bp, Homo sapiens
ccatgtagttttaacaga

SEQ ID NO: 3956858 - DNA, 23 bp, Homo sapiens
ccatgtccaagtccaacctgcct

SEQ ID NO: 3956859 - DNA, 19 bp, Homo sapiens
ttggtaacatcctttctat

SEQ ID NO: 3956860 - DNA, 16 bp, Homo sapiens
ttggtatcaagaaagt

SEQ ID NO: 3956861 - DNA, 14 bp, Homo sapiens
ttggtctctatttc

SEQ ID NO: 3956862 - DNA, 14 bp, Homo sapiens
ttggtctgctggtg

SEQ ID NO: 3956863 - DNA, 15 bp, Homo sapiens
ttggtgactgtccca

SEQ ID NO: 3956864 - DNA, 14 bp, Homo sapiens
ttggtgataagtgg

SEQ ID NO: 3956865 - DNA, 15 bp, Homo sapiens
ttggtgataagtgga

SEQ ID NO: 3956866 - DNA, 17 bp, Homo sapiens
ttggtgataagtggaaa

SEQ ID NO: 3956867 - DNA, 13 bp, Homo sapiens
ttggtggctgagc

SEQ ID NO: 3956868 - DNA, 17 bp, Homo sapiens
ttggtgggctggcccag

SEQ ID NO: 3956869 - DNA, 20 bp, Homo sapiens
ttggtgtaaagccaacaccc

SEQ ID NO: 3956870 - DNA, 18 bp, Homo sapiens
ttggtgtaggtaaatcta

SEQ ID NO: 3956871 - DNA, 18 bp, Homo sapiens
ttggtgtggctgtattca

SEQ ID NO: 3956872 - DNA, 21 bp, Homo sapiens
ttggtgttacacagcccaaga

SEQ ID NO: 3956873 - DNA, 15 bp, Homo sapiens
ttggttggggtgggg

SEQ ID NO: 3956874 - DNA, 18 bp, Homo sapiens
ttggttggggtggggcag

SEQ ID NO: 3956875 - DNA, 22 bp, Homo sapiens
ttggttgtcaatattaaataca

SEQ ID NO: 3956876 - DNA, 16 bp, Homo sapiens
ttggtttaatttaaag

SEQ ID NO: 3956877 - DNA, 16 bp, Homo sapiens
ttggtttggggagaaa

SEQ ID NO: 3956878 - DNA, 14 bp, Homo sapiens
ttgtaaaaacaaaa

SEQ ID NO: 3956879 - DNA, 22 bp, Homo sapiens
ttgtaaaaattaaaagttatgg

SEQ ID NO: 3956880 - DNA, 22 bp, Homo sapiens
ttgtaaactcaaaatatttgta

SEQ ID NO: 3956881 - DNA, 15 bp, Homo sapiens
ttgtaaactgtatca

SEQ ID NO: 3956882 - DNA, 20 bp, Homo sapiens
ttgtaaaggtcagagtcaaa

SEQ ID NO: 3956883 - DNA, 11 bp, Homo sapiens
ttgtaaataaa

SEQ ID NO: 3956884 - DNA, 14 bp, Homo sapiens
ttgtaaataaaagt

SEQ ID NO: 3956885 - DNA, 15 bp, Homo sapiens
ttgtaaataaataga

SEQ ID NO: 3956886 - DNA, 14 bp, Homo sapiens
ttgtaaatacacca

SEQ ID NO: 3956887 - DNA, 12 bp, Homo sapiens
ttgtaaatattt

SEQ ID NO: 3956888 - DNA, 18 bp, Homo sapiens
ttgtaaatgaccaagaaa

SEQ ID NO: 3956889 - DNA, 11 bp, Homo sapiens
ttgtaaatgtg

SEQ ID NO: 3956890 - DNA, 14 bp, Homo sapiens
ttgtaaatgtgctt

SEQ ID NO: 3956891 - DNA, 18 bp, Homo sapiens
ttgtaaatgtgcttttaa

SEQ ID NO: 3956892 - DNA, 23 bp, Homo sapiens
ttgtaaattaatacttcatttgg

SEQ ID NO: 3956893 - DNA, 14 bp, Homo sapiens
ttgtaactccacca

SEQ ID NO: 3956894 - DNA, 15 bp, Homo sapiens
ttgtaacttcaaata

SEQ ID NO: 3956895 - DNA, 16 bp, Homo sapiens
ttgtaacttcaaatat

SEQ ID NO: 3956896 - DNA, 18 bp, Homo sapiens
ttgtaagacaaaggtttt

SEQ ID NO: 3956897 - DNA, 21 bp, Homo sapiens
ttgtaagacaaaggttttcct

SEQ ID NO: 3956898 - DNA, 14 bp, Homo sapiens
ttgtaatagtccat

SEQ ID NO: 3956899 - DNA, 20 bp, Homo sapiens
ttgttgttattttttgagaa

SEQ ID NO: 3956900 - DNA, 13 bp, Homo sapiens
ttgtttaaaaaca

SEQ ID NO: 3956901 - DNA, 18 bp, Homo sapiens
ttgtttaaaatcatttct

SEQ ID NO: 3956902 - DNA, 20 bp, Homo sapiens
ttgtttattctttttaaagt

SEQ ID NO: 3956903 - DNA, 11 bp, Homo sapiens
ttgtttcagaa

SEQ ID NO: 3956904 - DNA, 14 bp, Homo sapiens
ttgtttggcttcct

SEQ ID NO: 3956905 - DNA, 16 bp, Homo sapiens
ttgtttgggccactgc

SEQ ID NO: 3956906 - DNA, 17 bp, Homo sapiens
ttgtttggggcaggagt

SEQ ID NO: 3956907 - DNA, 18 bp, Homo sapiens
ttgttttcttctgtatgt

SEQ ID NO: 3956908 - DNA, 19 bp, Homo sapiens
ttgttttgacggatgattg

SEQ ID NO: 3956909 - DNA, 13 bp, Homo sapiens
ttgttttgtttta

SEQ ID NO: 3956910 - DNA, 14 bp, Homo sapiens
ttgttttgttttaa

SEQ ID NO: 3956911 - DNA, 22 bp, Homo sapiens
ttgtttttaacaactaatcaag

SEQ ID NO: 3956912 - DNA, 14 bp, Homo sapiens
tttaaaaaatacac

SEQ ID NO: 3956913 - DNA, 19 bp, Homo sapiens
tttaaaaaatgaaaataag

SEQ ID NO: 3956914 - DNA, 15 bp, Homo sapiens
tttaaaaacaggaaa

SEQ ID NO: 3956915 - DNA, 20 bp, Homo sapiens
tttaaaaaccaatcatttta

SEQ ID NO: 3956916 - DNA, 22 bp, Homo sapiens
tttaaaataaggataataatca

SEQ ID NO: 3956917 - DNA, 12 bp, Homo sapiens
tttaaaatctga

SEQ ID NO: 3956918 - DNA, 17 bp, Homo sapiens
tttaaaatgaaatgttt

SEQ ID NO: 3956919 - DNA, 23 bp, Homo sapiens
tttaaaattaaaaaaaagaagag

SEQ ID NO: 3956920 - DNA, 13 bp, Homo sapiens
tttaaacagcagt

SEQ ID NO: 3956921 - DNA, 13 bp, Homo sapiens
tttaaaccagcag

SEQ ID NO: 3956922 - DNA, 18 bp, Homo sapiens
tttaaaccagcagaaaag

SEQ ID NO: 3956923 - DNA, 22 bp, Homo sapiens
tttaaaccagcagaaaagtgct

SEQ ID NO: 3956924 - DNA, 15 bp, Homo sapiens
tttaaactagtaatg

SEQ ID NO: 3956925 - DNA, 17 bp, Homo sapiens
tttaaactgttctgtgt

SEQ ID NO: 3956926 - DNA, 12 bp, Homo sapiens
tttaaagaagta

SEQ ID NO: 3956927 - DNA, 14 bp, Homo sapiens
tttaaagaagtaaa

SEQ ID NO: 3956928 - DNA, 24 bp, Homo sapiens
tttaaagcttattaaaactcattt

SEQ ID NO: 3956929 - DNA, 16 bp, Homo sapiens
tttaaaggggcagaaa

SEQ ID NO: 3956930 - DNA, 17 bp, Homo sapiens
tttaaagtacctgtagt

SEQ ID NO: 3956931 - DNA, 20 bp, Homo sapiens
tttaaatacgcactacatgt

SEQ ID NO: 3956932 - DNA, 22 bp, Homo sapiens
tttaaatcaaactgtaaaactt

SEQ ID NO: 3956933 - DNA, 19 bp, Homo sapiens
tttaaatgtgcagtacaca

SEQ ID NO: 3956934 - DNA, 20 bp, Homo sapiens
tttaaattataacttaaaat

SEQ ID NO: 3956935 - DNA, 20 bp, Homo sapiens
tttaaattgtaaattttaga

SEQ ID NO: 3956936 - DNA, 12 bp, Homo sapiens
tttaaatttgaa

SEQ ID NO: 3956937 - DNA, 20 bp, Homo sapiens
tttaacaaaacaagaaagaa

SEQ ID NO: 3956938 - DNA, 14 bp, Homo sapiens
tttaacacataact

SEQ ID NO: 3956939 - DNA, 15 bp, Homo sapiens
tttaacagaaccaga

SEQ ID NO: 3956940 - DNA, 15 bp, Homo sapiens
tttaacagtcattta

SEQ ID NO: 3956941 - DNA, 18 bp, Homo sapiens
tttaaccctctcttccct

SEQ ID NO: 3956942 - DNA, 22 bp, Homo sapiens
tttaacgaatgaagatgtctaa

SEQ ID NO: 3956943 - DNA, 15 bp, Homo sapiens
tttaactaatttaaa

SEQ ID NO: 3956944 - DNA, 16 bp, Homo sapiens
tttaactaatttaaac

SEQ ID NO: 3956945 - DNA, 20 bp, Homo sapiens
tttaactaatttaaaccagc

SEQ ID NO: 3956946 - DNA, 22 bp, Homo sapiens
tttaactaatttaaaccagcag

SEQ ID NO: 3956947 - DNA, 21 bp, Homo sapiens
ttcttgcctactatgccagat

SEQ ID NO: 3956948 - DNA, 15 bp, Homo sapiens
ttcttggcttctggg

SEQ ID NO: 3956949 - DNA, 14 bp, Homo sapiens
ttcttgtcaaaaaa

SEQ ID NO: 3956950 - DNA, 13 bp, Homo sapiens
ttctttaaatcaa

SEQ ID NO: 3956951 - DNA, 15 bp, Homo sapiens
ttctttaaatcaaaa

SEQ ID NO: 3956952 - DNA, 17 bp, Homo sapiens
ttctttaaatcaaaagc

SEQ ID NO: 3956953 - DNA, 20 bp, Homo sapiens
ttctttaaatcaaaagctgc

SEQ ID NO: 3956954 - DNA, 21 bp, Homo sapiens
ttctttaagaattacaggttg

SEQ ID NO: 3956955 - DNA, 20 bp, Homo sapiens
ttctttacctgagaccagtt

SEQ ID NO: 3956956 - DNA, 14 bp, Homo sapiens
ttctttcaaagtgt

SEQ ID NO: 3956957 - DNA, 17 bp, Homo sapiens
ttctttccatgcagact

SEQ ID NO: 3956958 - DNA, 13 bp, Homo sapiens
ttctttcttcctc

SEQ ID NO: 3956959 - DNA, 15 bp, Homo sapiens
ttctttgtaaaggtc

SEQ ID NO: 3956960 - DNA, 16 bp, Homo sapiens
ttctttgtaaaggtca

SEQ ID NO: 3956961 - DNA, 14 bp, Homo sapiens
ttcttttaaagaag

SEQ ID NO: 3956962 - DNA, 22 bp, Homo sapiens
ttcttttgcccttcacagtgtt

SEQ ID NO: 3956963 - DNA, 14 bp, Homo sapiens
ttctttttctggaa

SEQ ID NO: 3956964 - DNA, 15 bp, Homo sapiens
ttctttttctgtctc

SEQ ID NO: 3956965 - DNA, 16 bp, Homo sapiens
ttctttttctgtctct

SEQ ID NO: 3956966 - DNA, 17 bp, Homo sapiens
ttctttttctgtctctc

SEQ ID NO: 3956967 - DNA, 15 bp, Homo sapiens
ttgaaaaatctagtt

SEQ ID NO: 3956968 - DNA, 19 bp, Homo sapiens
ttgaaaattattttaaaca

SEQ ID NO: 3956969 - DNA, 17 bp, Homo sapiens
ttgaaactagaagtcaa

SEQ ID NO: 3956970 - DNA, 14 bp, Homo sapiens
ttgaaagagatggc

SEQ ID NO: 3956971 - DNA, 21 bp, Homo sapiens
ttgaaagtgaataaacttcag

SEQ ID NO: 3956972 - DNA, 22 bp, Homo sapiens
ttgaaagtgaataaacttcagc

SEQ ID NO: 3956973 - DNA, 19 bp, Homo sapiens
ttgaaattatgtatgttta

SEQ ID NO: 3956974 - DNA, 15 bp, Homo sapiens
ttgaaattcccccac

SEQ ID NO: 3956975 - DNA, 12 bp, Homo sapiens
ttgaaattttaa

SEQ ID NO: 3956976 - DNA, 13 bp, Homo sapiens
ttgaacccaggag

SEQ ID NO: 3956977 - DNA, 21 bp, Homo sapiens
ttgaactgttctggcctcaga

SEQ ID NO: 3956978 - DNA, 18 bp, Homo sapiens
ttgaactttccaaaacct

SEQ ID NO: 3956979 - DNA, 19 bp, Homo sapiens
ttgaagaaacagataccat

SEQ ID NO: 3956980 - DNA, 13 bp, Homo sapiens
ttgaagccttttt

SEQ ID NO: 3956981 - DNA, 19 bp, Homo sapiens
ttgaagggtaaagaagttt

SEQ ID NO: 3956982 - DNA, 13 bp, Homo sapiens
ttgaatatattat

SEQ ID NO: 3956983 - DNA, 19 bp, Homo sapiens
ttgaatatattataatctt

SEQ ID NO: 3956984 - DNA, 14 bp, Homo sapiens
ttgaatatcattaa

SEQ ID NO: 3956985 - DNA, 18 bp, Homo sapiens
ttgaatctgttactgaaa

SEQ ID NO: 3956986 - DNA, 19 bp, Homo sapiens
ttgaatctgttactgaaat

SEQ ID NO: 3956987 - DNA, 17 bp, Homo sapiens
ttgaatgacaacagaag

SEQ ID NO: 3956988 - DNA, 15 bp, Homo sapiens
ttgaatgctttttga

SEQ ID NO: 3956989 - DNA, 17 bp, Homo sapiens
ttgaatgctttttgaat

SEQ ID NO: 3956990 - DNA, 16 bp, Homo sapiens
ttgaatggtgcagaaa

SEQ ID NO: 3956991 - DNA, 18 bp, Homo sapiens
ttgaatgtaagaacatga

SEQ ID NO: 3956992 - DNA, 18 bp, Homo sapiens
ttgcatttagttttatgg

SEQ ID NO: 3956993 - DNA, 16 bp, Homo sapiens
ttgccaactaagccct

SEQ ID NO: 3956994 - DNA, 17 bp, Homo sapiens
ttgccaagctttcttct

SEQ ID NO: 3956995 - DNA, 17 bp, Homo sapiens
ttgccacaatgcctctc

SEQ ID NO: 3956996 - DNA, 19 bp, Homo sapiens
ttgccacaatgcctctccc

SEQ ID NO: 3956997 - DNA, 22 bp, Homo sapiens
ttgccacaatgcctctcccacg

SEQ ID NO: 3956998 - DNA, 18 bp, Homo sapiens
ttgccaccactagagctg

SEQ ID NO: 3956999 - DNA, 14 bp, Homo sapiens
ttgccactgcctct

SEQ ID NO: 3957000 - DNA, 14 bp, Homo sapiens
ttgccactttggct

SEQ ID NO: 3957001 - DNA, 22 bp, Homo sapiens
ttgccactttggcttctcctgt

SEQ ID NO: 3957002 - DNA, 14 bp, Homo sapiens
ttgccagacttaaa

SEQ ID NO: 3957003 - DNA, 16 bp, Homo sapiens
ttgccaggcttaagga

SEQ ID NO: 3957004 - DNA, 17 bp, Homo sapiens
ttgccatgggcctgctg

SEQ ID NO: 3957005 - DNA, 17 bp, Homo sapiens
ttgcccaggctggcctg

SEQ ID NO: 3957006 - DNA, 13 bp, Homo sapiens
ttgccccagagcc

SEQ ID NO: 3957007 - DNA, 14 bp, Homo sapiens
ttgcccccatccct

SEQ ID NO: 3957008 - DNA, 15 bp, Homo sapiens
ttgcccgccagcctc

SEQ ID NO: 3957009 - DNA, 16 bp, Homo sapiens
ttgcccgccagcctca

SEQ ID NO: 3957010 - DNA, 18 bp, Homo sapiens
ttgcccttcacagtgttt

SEQ ID NO: 3957011 - DNA, 15 bp, Homo sapiens
ttgcccttgccctga

SEQ ID NO: 3957012 - DNA, 22 bp, Homo sapiens
ttgcctccacctctccttggaa

SEQ ID NO: 3957013 - DNA, 14 bp, Homo sapiens
ttgcctctctcagg

SEQ ID NO: 3957014 - DNA, 15 bp, Homo sapiens
ttgcctgcagagaga

SEQ ID NO: 3957015 - DNA, 19 bp, Homo sapiens
ttgcctgcagagagaagcc

SEQ ID NO: 3957016 - DNA, 19 bp, Homo sapiens
ttgcctggctgtggaggcc

SEQ ID NO: 3957017 - DNA, 22 bp, Homo sapiens
ttgcctggctgtggaggcctga

SEQ ID NO: 3957018 - DNA, 16 bp, Homo sapiens
ttgccttaaagaaagt

SEQ ID NO: 3957019 - DNA, 16 bp, Homo sapiens
ttgccttttaaaagaa

SEQ ID NO: 3957020 - DNA, 13 bp, Homo sapiens
ttgcgccactgca

SEQ ID NO: 3957021 - DNA, 19 bp, Homo sapiens
ttgctacaataaatgctga

SEQ ID NO: 3957022 - DNA, 19 bp, Homo sapiens
ttgctcaaatctattcaga

SEQ ID NO: 3957023 - DNA, 20 bp, Homo sapiens
ttgctcaccaagctgttcca

SEQ ID NO: 3957024 - DNA, 16 bp, Homo sapiens
ttgctcagtgcctcct

SEQ ID NO: 3957025 - DNA, 18 bp, Homo sapiens
ttgctcagtgcctcctgg

SEQ ID NO: 3957026 - DNA, 11 bp, Homo sapiens
ttgctcctcct

SEQ ID NO: 3957027 - DNA, 21 bp, Homo sapiens
ttgctctagtcttgctttgct

SEQ ID NO: 3957028 - DNA, 20 bp, Homo sapiens
ttgctctctggccttttcct

SEQ ID NO: 3957029 - DNA, 15 bp, Homo sapiens
ttgctctgcaggcac

SEQ ID NO: 3957030 - DNA, 17 bp, Homo sapiens
ttgctcttctttctgag

SEQ ID NO: 3957031 - DNA, 13 bp, Homo sapiens
ttgctcttggaaa

SEQ ID NO: 3957032 - DNA, 23 bp, Homo sapiens
ttgctgaaggctaaattcacagc

SEQ ID NO: 3957033 - DNA, 14 bp, Homo sapiens
ttgctgaatttcag

SEQ ID NO: 3957034 - DNA, 19 bp, Homo sapiens
ttctccagacccaccacac

SEQ ID NO: 3957035 - DNA, 13 bp, Homo sapiens
ttctccagccagc

SEQ ID NO: 3957036 - DNA, 14 bp, Homo sapiens
ttctccagccagca

SEQ ID NO: 3957037 - DNA, 15 bp, Homo sapiens
ttctccagcccacac

SEQ ID NO: 3957038 - DNA, 13 bp, Homo sapiens
ttctccatcagct

SEQ ID NO: 3957039 - DNA, 22 bp, Homo sapiens
ttctccctcacccccaggtgtt

SEQ ID NO: 3957040 - DNA, 15 bp, Homo sapiens
ttctccctgggaact

SEQ ID NO: 3957041 - DNA, 17 bp, Homo sapiens
ttctccggggtctgtgc

SEQ ID NO: 3957042 - DNA, 18 bp, Homo sapiens
ttctccggggtctgtgct

SEQ ID NO: 3957043 - DNA, 18 bp, Homo sapiens
ttctcctgacccagtccc

SEQ ID NO: 3957044 - DNA, 14 bp, Homo sapiens
ttctcctgtcagag

SEQ ID NO: 3957045 - DNA, 13 bp, Homo sapiens
ttctcctttttct

SEQ ID NO: 3957046 - DNA, 22 bp, Homo sapiens
ttctctattttgcctttaaatt

SEQ ID NO: 3957047 - DNA, 16 bp, Homo sapiens
ttctctccttccctct

SEQ ID NO: 3957048 - DNA, 20 bp, Homo sapiens
ttctctccttccctctttcc

SEQ ID NO: 3957049 - DNA, 23 bp, Homo sapiens
ttctctccttcttccctgtttta

SEQ ID NO: 3957050 - DNA, 16 bp, Homo sapiens
ttctctctaaaaataa

SEQ ID NO: 3957051 - DNA, 21 bp, Homo sapiens
ttctctgcttacccttcacct

SEQ ID NO: 3957052 - DNA, 14 bp, Homo sapiens
ttctctggctccag

SEQ ID NO: 3957053 - DNA, 16 bp, Homo sapiens
ttctctggctccagaa

SEQ ID NO: 3957054 - DNA, 13 bp, Homo sapiens
ttctcttcctgta

SEQ ID NO: 3957055 - DNA, 17 bp, Homo sapiens
ttctctttctttttctg

SEQ ID NO: 3957056 - DNA, 17 bp, Homo sapiens
ttctgaaacttcataaa

SEQ ID NO: 3957057 - DNA, 20 bp, Homo sapiens
ttctgaaatgacagaatgct

SEQ ID NO: 3957058 - DNA, 22 bp, Homo sapiens
ttctgaaatgacagaatgctgt

SEQ ID NO: 3957059 - DNA, 18 bp, Homo sapiens
ttctgaagctttaccagc

SEQ ID NO: 3957060 - DNA, 14 bp, Homo sapiens
ttctgaatctgaaa

SEQ ID NO: 3957061 - DNA, 14 bp, Homo sapiens
ttctgaattattat

SEQ ID NO: 3957062 - DNA, 23 bp, Homo sapiens
ttctgacaagataaaggaagtca

SEQ ID NO: 3957063 - DNA, 14 bp, Homo sapiens
ttctgaccatttca

SEQ ID NO: 3957064 - DNA, 12 bp, Homo sapiens
ttctgagaaaag

SEQ ID NO: 3957065 - DNA, 16 bp, Homo sapiens
ttctgagaaagactat

SEQ ID NO: 3957066 - DNA, 19 bp, Homo sapiens
ttctgagcttttcatggaa

SEQ ID NO: 3957067 - DNA, 16 bp, Homo sapiens
ttctgagtttcattct

SEQ ID NO: 3957068 - DNA, 18 bp, Homo sapiens
ttctgattcactattaga

SEQ ID NO: 3957069 - DNA, 15 bp, Homo sapiens
ttctgcaactagcca

SEQ ID NO: 3957070 - DNA, 17 bp, Homo sapiens
ttctgcaactagccaag

SEQ ID NO: 3957071 - DNA, 19 bp, Homo sapiens
ttctgcaactagccaaggc

SEQ ID NO: 3957072 - DNA, 15 bp, Homo sapiens
ttctgcagcaactcc

SEQ ID NO: 3957073 - DNA, 18 bp, Homo sapiens
ttctgccccagctttatc

SEQ ID NO: 3957074 - DNA, 18 bp, Homo sapiens
ttctgcgtgctttattta

SEQ ID NO: 3957075 - DNA, 13 bp, Homo sapiens
ttctgctcctctc

SEQ ID NO: 3957076 - DNA, 17 bp, Homo sapiens
ttctgctcctctccagg

SEQ ID NO: 3957077 - DNA, 18 bp, Homo sapiens
ttctgctcctctccaggc

SEQ ID NO: 3957078 - DNA, 14 bp, Homo sapiens
ttctgctggcctgg

SEQ ID NO: 3957079 - DNA, 10 bp, Homo sapiens
ttctggaaaa

SEQ ID NO: 3957080 - DNA, 20 bp, Homo sapiens
ttctggaaaaaaaatatata

SEQ ID NO: 3957081 - DNA, 14 bp, Homo sapiens
ttggcagagaggac

SEQ ID NO: 3957082 - DNA, 15 bp, Homo sapiens
ttggcatttgtgtta

SEQ ID NO: 3957083 - DNA, 22 bp, Homo sapiens
ttggccactgggtctcactcct

SEQ ID NO: 3957084 - DNA, 22 bp, Homo sapiens
ttggccgggtgcggtggctcac

SEQ ID NO: 3957085 - DNA, 22 bp, Homo sapiens
ttggcgatgaggtaattctccc

SEQ ID NO: 3957086 - DNA, 12 bp, Homo sapiens
ttggctcaggca

SEQ ID NO: 3957087 - DNA, 13 bp, Homo sapiens
ttggctcaggcag

SEQ ID NO: 3957088 - DNA, 11 bp, Homo sapiens
ttggctctttc

SEQ ID NO: 3957089 - DNA, 21 bp, Homo sapiens
ttggctggatgaaattttcta

SEQ ID NO: 3957090 - DNA, 20 bp, Homo sapiens
ttggctggttaattccataa

SEQ ID NO: 3957091 - DNA, 14 bp, Homo sapiens
ttggcttctcctgt

SEQ ID NO: 3957092 - DNA, 16 bp, Homo sapiens
ttggcttctcctgtga

SEQ ID NO: 3957093 - DNA, 19 bp, Homo sapiens
ttggcttctcctgtgaccc

SEQ ID NO: 3957094 - DNA, 17 bp, Homo sapiens
ttggctttaaacaccct

SEQ ID NO: 3957095 - DNA, 12 bp, Homo sapiens
ttgggagagtgc

SEQ ID NO: 3957096 - DNA, 15 bp, Homo sapiens
ttgggagcactggag

SEQ ID NO: 3957097 - DNA, 19 bp, Homo sapiens
ttgggagcttgggaatgga

SEQ ID NO: 3957098 - DNA, 17 bp, Homo sapiens
ttgggaggccaaggcag

SEQ ID NO: 3957099 - DNA, 19 bp, Homo sapiens
ttgggaggctgaggcagga

SEQ ID NO: 3957100 - DNA, 22 bp, Homo sapiens
ttgggaggttttattctgactt

SEQ ID NO: 3957101 - DNA, 22 bp, Homo sapiens
ttgggatttatatctatagtag

SEQ ID NO: 3957102 - DNA, 17 bp, Homo sapiens
ttgggcacccccagcct

SEQ ID NO: 3957103 - DNA, 19 bp, Homo sapiens
ttgggcacccccagcctgg

SEQ ID NO: 3957104 - DNA, 22 bp, Homo sapiens
ttgggcacccccagcctgggcc

SEQ ID NO: 3957105 - DNA, 16 bp, Homo sapiens
ttgggcatccacccag

SEQ ID NO: 3957106 - DNA, 23 bp, Homo sapiens
ttgggcatccacccagtgctgcc

SEQ ID NO: 3957107 - DNA, 11 bp, Homo sapiens
ttgggcctctt

SEQ ID NO: 3957108 - DNA, 17 bp, Homo sapiens
ttgggctactggcagct

SEQ ID NO: 3957109 - DNA, 20 bp, Homo sapiens
ttgggctttgcaggctctgg

SEQ ID NO: 3957110 - DNA, 18 bp, Homo sapiens
ttggggacagttggcaga

SEQ ID NO: 3957111 - DNA, 23 bp, Homo sapiens
ttggggagacggtgttgcagaga

SEQ ID NO: 3957112 - DNA, 13 bp, Homo sapiens
ttggggagcagag

SEQ ID NO: 3957113 - DNA, 20 bp, Homo sapiens
ttggggcaggagtagctgag

SEQ ID NO: 3957114 - DNA, 22 bp, Homo sapiens
ttggggcaggagtagctgagct

SEQ ID NO: 3957115 - DNA, 11 bp, Homo sapiens
ttggggcctgg

SEQ ID NO: 3957116 - DNA, 13 bp, Homo sapiens
ttggggcctggct

SEQ ID NO: 3957117 - DNA, 15 bp, Homo sapiens
ttggggcctggcttg

SEQ ID NO: 3957118 - DNA, 20 bp, Homo sapiens
ttgggggttggatgggaaga

SEQ ID NO: 3957119 - DNA, 15 bp, Homo sapiens
ttggggtcagccagg

SEQ ID NO: 3957120 - DNA, 15 bp, Homo sapiens
ttggggtcccaggga

SEQ ID NO: 3957121 - DNA, 16 bp, Homo sapiens
ttgggttaagtatgag

SEQ ID NO: 3957122 - DNA, 16 bp, Homo sapiens
ttgggttcatctgagc

SEQ ID NO: 3957123 - DNA, 14 bp, Homo sapiens
ttgggttttatcag

SEQ ID NO: 3957124 - DNA, 17 bp, Homo sapiens
ttttcaaccagcatttt

SEQ ID NO: 3957125 - DNA, 15 bp, Homo sapiens
ttttcaacttggaaa

SEQ ID NO: 3957126 - DNA, 15 bp, Homo sapiens
ttttcaataatgtga

SEQ ID NO: 3957127 - DNA, 19 bp, Homo sapiens
ttttcactgctggctgcct

SEQ ID NO: 3957128 - DNA, 16 bp, Homo sapiens
ttttcagaatgctctt

SEQ ID NO: 3957129 - DNA, 14 bp, Homo sapiens
ttttcagactcaga

SEQ ID NO: 3957130 - DNA, 16 bp, Homo sapiens
ttttcagcaactcaga

SEQ ID NO: 3957131 - DNA, 21 bp, Homo sapiens
ttttcatagattgagaagttt

SEQ ID NO: 3957132 - DNA, 19 bp, Homo sapiens
ttttcatcaatttaaaatc

SEQ ID NO: 3957133 - DNA, 18 bp, Homo sapiens
ttttcatcctggcctcct

SEQ ID NO: 3957134 - DNA, 21 bp, Homo sapiens
ttttcattcaggtatttgtaa

SEQ ID NO: 3957135 - DNA, 22 bp, Homo sapiens
ttttccacaagattcccagaga

SEQ ID NO: 3957136 - DNA, 23 bp, Homo sapiens
ttttccccggtcccttgagacct

SEQ ID NO: 3957137 - DNA, 14 bp, Homo sapiens
ttttcctaaaaata

SEQ ID NO: 3957138 - DNA, 24 bp, Homo sapiens
ttttcctcccagttctacaagcat

SEQ ID NO: 3957139 - DNA, 13 bp, Homo sapiens
ttttcctccctca

SEQ ID NO: 3957140 - DNA, 16 bp, Homo sapiens
ttttcctttgtcatca

SEQ ID NO: 3957141 - DNA, 21 bp, Homo sapiens
ttttcgcttgcttctgcagca

SEQ ID NO: 3957142 - DNA, 20 bp, Homo sapiens
ttttctaactgtaaatcact

SEQ ID NO: 3957143 - DNA, 21 bp, Homo sapiens
ttttctaactgtaaatcactt

SEQ ID NO: 3957144 - DNA, 23 bp, Homo sapiens
ttttctacctttttttctctcct

SEQ ID NO: 3957145 - DNA, 12 bp, Homo sapiens
ttttctagaaga

SEQ ID NO: 3957146 - DNA, 13 bp, Homo sapiens
ttttctagacttt

SEQ ID NO: 3957147 - DNA, 13 bp, Homo sapiens
ttttctcctccca

SEQ ID NO: 3957148 - DNA, 17 bp, Homo sapiens
ttttctgaataacattt

SEQ ID NO: 3957149 - DNA, 15 bp, Homo sapiens
ttttctgagaaagac

SEQ ID NO: 3957150 - DNA, 21 bp, Homo sapiens
ttttctggaatacatgaaata

SEQ ID NO: 3957151 - DNA, 17 bp, Homo sapiens
ttttctttctttttctg

SEQ ID NO: 3957152 - DNA, 17 bp, Homo sapiens
ttttctttgaatgcttt

SEQ ID NO: 3957153 - DNA, 15 bp, Homo sapiens
ttttctttgtaaagg

SEQ ID NO: 3957154 - DNA, 16 bp, Homo sapiens
ttttctttgtaaaggt

SEQ ID NO: 3957155 - DNA, 15 bp, Homo sapiens
ttttgaaagaaaaat

SEQ ID NO: 3957156 - DNA, 14 bp, Homo sapiens
ttttgaatgttatt

SEQ ID NO: 3957157 - DNA, 14 bp, Homo sapiens
ttttgaatttagtg

SEQ ID NO: 3957158 - DNA, 17 bp, Homo sapiens
ctctgtggcctgtgtcc

SEQ ID NO: 3957159 - DNA, 18 bp, Homo sapiens
ctctgtgtcctctcccct

SEQ ID NO: 3957160 - DNA, 20 bp, Homo sapiens
ctcttaaagctgcctgtagt

SEQ ID NO: 3957161 - DNA, 13 bp, Homo sapiens
ctcttagtgcccg

SEQ ID NO: 3957162 - DNA, 20 bp, Homo sapiens
ctcttagtgcccgcctagga

SEQ ID NO: 3957163 - DNA, 12 bp, Homo sapiens
ctcttatttgct

SEQ ID NO: 3957164 - DNA, 17 bp, Homo sapiens
ctcttcaccccccactc

SEQ ID NO: 3957165 - DNA, 17 bp, Homo sapiens
ctcttcactcagccaca

SEQ ID NO: 3957166 - DNA, 18 bp, Homo sapiens
ctcttcactcagccacac

SEQ ID NO: 3957167 - DNA, 20 bp, Homo sapiens
ctcttcactcagccacaccc

SEQ ID NO: 3957168 - DNA, 23 bp, Homo sapiens
ctcttcagcccctagtgctattc

SEQ ID NO: 3957169 - DNA, 18 bp, Homo sapiens
ctcttcagggtgagtgaa

SEQ ID NO: 3957170 - DNA, 17 bp, Homo sapiens
ctcttcattctttgaag

SEQ ID NO: 3957171 - DNA, 14 bp, Homo sapiens
ctcttccaaagctc

SEQ ID NO: 3957172 - DNA, 18 bp, Homo sapiens
ctcttccagaagatgccc

SEQ ID NO: 3957173 - DNA, 14 bp, Homo sapiens
ctcttccctcagtt

SEQ ID NO: 3957174 - DNA, 20 bp, Homo sapiens
ctcttccgtgacgtcactgg

SEQ ID NO: 3957175 - DNA, 19 bp, Homo sapiens
ctcttcctacccaaccact

SEQ ID NO: 3957176 - DNA, 20 bp, Homo sapiens
ctcttcctacccaaccactc

SEQ ID NO: 3957177 - DNA, 22 bp, Homo sapiens
ctcttcctcctggttcaagcga

SEQ ID NO: 3957178 - DNA, 12 bp, Homo sapiens
ctcttcctctgt

SEQ ID NO: 3957179 - DNA, 13 bp, Homo sapiens
ctcttcctggacc

SEQ ID NO: 3957180 - DNA, 17 bp, Homo sapiens
ctcttcggtttctgagc

SEQ ID NO: 3957181 - DNA, 18 bp, Homo sapiens
ctcttcggtttctgagca

SEQ ID NO: 3957182 - DNA, 19 bp, Homo sapiens
ctcttctattttgtaaact

SEQ ID NO: 3957183 - DNA, 13 bp, Homo sapiens
ctcttctcccccc

SEQ ID NO: 3957184 - DNA, 13 bp, Homo sapiens
ctcttctcctttc

SEQ ID NO: 3957185 - DNA, 15 bp, Homo sapiens
ctcttctcctttcac

SEQ ID NO: 3957186 - DNA, 16 bp, Homo sapiens
ctcttctcttcctgta

SEQ ID NO: 3957187 - DNA, 15 bp, Homo sapiens
ctcttctgttctcaa

SEQ ID NO: 3957188 - DNA, 21 bp, Homo sapiens
ctcttgcatcctcctcccaac

SEQ ID NO: 3957189 - DNA, 13 bp, Homo sapiens
ctcttgcctctct

SEQ ID NO: 3957190 - DNA, 15 bp, Homo sapiens
ctcttgcctctctca

SEQ ID NO: 3957191 - DNA, 17 bp, Homo sapiens
ctcttggacctctgctc

SEQ ID NO: 3957192 - DNA, 21 bp, Homo sapiens
ctcttggcattttcctcgcct

SEQ ID NO: 3957193 - DNA, 23 bp, Homo sapiens
ctcttgggaactccactctcctt

SEQ ID NO: 3957194 - DNA, 16 bp, Homo sapiens
ctctttactcccttcc

SEQ ID NO: 3957195 - DNA, 23 bp, Homo sapiens
ctctttactcccttcctggcctc

SEQ ID NO: 3957196 - DNA, 12 bp, Homo sapiens
ctctttcagaga

SEQ ID NO: 3957197 - DNA, 15 bp, Homo sapiens
ctctttccccacctc

SEQ ID NO: 3957198 - DNA, 15 bp, Homo sapiens
ctctttctccctcac

SEQ ID NO: 3957199 - DNA, 14 bp, Homo sapiens
ctctttgctacaat

SEQ ID NO: 3957200 - DNA, 17 bp, Homo sapiens
ctctttgctacaataaa

SEQ ID NO: 3957201 - DNA, 20 bp, Homo sapiens
ctctttgctacaataaatgc

SEQ ID NO: 3957202 - DNA, 17 bp, Homo sapiens
ctctttggggtcagcca

SEQ ID NO: 3957203 - DNA, 16 bp, Homo sapiens
ctcttttccctctcta

SEQ ID NO: 3957204 - DNA, 14 bp, Homo sapiens
ctcttttctctgtg

SEQ ID NO: 3957205 - DNA, 19 bp, Homo sapiens
ctcttttttcaactggctg

SEQ ID NO: 3957206 - DNA, 13 bp, Homo sapiens
ctgaaaaatgtca

SEQ ID NO: 3957207 - DNA, 14 bp, Homo sapiens
ctgaaaaatgtcag

SEQ ID NO: 3957208 - DNA, 17 bp, Homo sapiens
ctgaaaacgaaggggcc

SEQ ID NO: 3957209 - DNA, 20 bp, Homo sapiens
ctgaaaactgtaaatacaaa

SEQ ID NO: 3957210 - DNA, 19 bp, Homo sapiens
ctgaaaagactcagtgttc

SEQ ID NO: 3957211 - DNA, 21 bp, Homo sapiens
ctgaaacattcacacagggct

SEQ ID NO: 3957212 - DNA, 16 bp, Homo sapiens
ctgaaagacagaatgt

SEQ ID NO: 3957213 - DNA, 13 bp, Homo sapiens
ctgaaagcagcag

SEQ ID NO: 3957214 - DNA, 14 bp, Homo sapiens
ctgaaagcagcagc

SEQ ID NO: 3957215 - DNA, 15 bp, Homo sapiens
ctgaaagcagcagct

SEQ ID NO: 3957216 - DNA, 18 bp, Homo sapiens
ctgaaagcagcagctagg

SEQ ID NO: 3957217 - DNA, 22 bp, Homo sapiens
ctgaaagcagcagctaggactg

SEQ ID NO: 3957218 - DNA, 21 bp, Homo sapiens
ctgaaagccacgttccttact

SEQ ID NO: 3957219 - DNA, 14 bp, Homo sapiens
ctgaaagccagctg

SEQ ID NO: 3957220 - DNA, 17 bp, Homo sapiens
ctgaatgctctgtgcga

SEQ ID NO: 3957221 - DNA, 14 bp, Homo sapiens
ctgaatggtccagg

SEQ ID NO: 3957222 - DNA, 15 bp, Homo sapiens
ctgaatggtccaggg

SEQ ID NO: 3957223 - DNA, 16 bp, Homo sapiens
ctgaatggtccagggt

SEQ ID NO: 3957224 - DNA, 11 bp, Homo sapiens
ctgaatgtatt

SEQ ID NO: 3957225 - DNA, 14 bp, Homo sapiens
ctgaattaagttat

SEQ ID NO: 3957226 - DNA, 18 bp, Homo sapiens
ctgaattaagttattgat

SEQ ID NO: 3957227 - DNA, 20 bp, Homo sapiens
ctgacaagaagctcccagat

SEQ ID NO: 3957228 - DNA, 17 bp, Homo sapiens
ctgacaagataaaggaa

SEQ ID NO: 3957229 - DNA, 20 bp, Homo sapiens
ctgacaagatggaaaataaa

SEQ ID NO: 3957230 - DNA, 22 bp, Homo sapiens
ctgacaagggctgacctgcctc

SEQ ID NO: 3957231 - DNA, 18 bp, Homo sapiens
ctgacaatggcagctaga

SEQ ID NO: 3957232 - DNA, 19 bp, Homo sapiens
ctgacaccgtccctcagtg

SEQ ID NO: 3957233 - DNA, 15 bp, Homo sapiens
ctgacacctaccatg

SEQ ID NO: 3957234 - DNA, 18 bp, Homo sapiens
ctgacacctaccatgctg

SEQ ID NO: 3957235 - DNA, 20 bp, Homo sapiens
ctgacagccctgcggagacc

SEQ ID NO: 3957236 - DNA, 16 bp, Homo sapiens
ctgacaggttcccagc

SEQ ID NO: 3957237 - DNA, 21 bp, Homo sapiens
ctgacaggttcccagcagctg

SEQ ID NO: 3957238 - DNA, 13 bp, Homo sapiens
ctgacatggcttt

SEQ ID NO: 3957239 - DNA, 12 bp, Homo sapiens
ctgacatttcta

SEQ ID NO: 3957240 - DNA, 15 bp, Homo sapiens
ctgaccaacaggctg

SEQ ID NO: 3957241 - DNA, 18 bp, Homo sapiens
ctgaccaacaggctgttc

SEQ ID NO: 3957242 - DNA, 16 bp, Homo sapiens
ctgaccaacatggaga

SEQ ID NO: 3957243 - DNA, 23 bp, Homo sapiens
ctgaccacggacgtttccatcag

SEQ ID NO: 3957244 - DNA, 23 bp, Homo sapiens
ctgaccagcctccatgctgcctc

SEQ ID NO: 3957245 - DNA, 20 bp, Homo sapiens
ctgacccagagtggagtctg

SEQ ID NO: 3957246 - DNA, 15 bp, Homo sapiens
ctgaccccatcacct

SEQ ID NO: 3957247 - DNA, 18 bp, Homo sapiens
ctgaccctccaccgcaga

SEQ ID NO: 3957248 - DNA, 23 bp, Homo sapiens
ctgaccctccaccgcagaaggaa

SEQ ID NO: 3957249 - DNA, 15 bp, Homo sapiens
ctgacccttccagac

SEQ ID NO: 3957250 - DNA, 18 bp, Homo sapiens
ctgacccttccagacata

SEQ ID NO: 3957251 - DNA, 16 bp, Homo sapiens
ctgacctcaagtgatc

SEQ ID NO: 3957252 - DNA, 11 bp, Homo sapiens
ctgacctccca

SEQ ID NO: 3957253 - DNA, 14 bp, Homo sapiens
ctgacctcccagcc

SEQ ID NO: 3957254 - DNA, 18 bp, Homo sapiens
ctgacctcccagccctat

SEQ ID NO: 3957255 - DNA, 21 bp, Homo sapiens
ctgacctgaggctcctgtgct

SEQ ID NO: 3957256 - DNA, 14 bp, Homo sapiens
ctgacctgcctctc

SEQ ID NO: 3957257 - DNA, 22 bp, Homo sapiens
ctgacctgcctctcacacacat

SEQ ID NO: 3957258 - DNA, 19 bp, Homo sapiens
ctgacctgtttttgtgttt

SEQ ID NO: 3957259 - DNA, 20 bp, Homo sapiens
ctgaccttggagagacacag

SEQ ID NO: 3957260 - DNA, 14 bp, Homo sapiens
ctgacgccctgcgt

SEQ ID NO: 3957261 - DNA, 21 bp, Homo sapiens
ctgacgccctgcgttggagcc

SEQ ID NO: 3957262 - DNA, 13 bp, Homo sapiens
ctgactccagagt

SEQ ID NO: 3957263 - DNA, 21 bp, Homo sapiens
ctgactccagtgagctggaat

SEQ ID NO: 3957264 - DNA, 23 bp, Homo sapiens
ctgactccctgtgggggtggcca

SEQ ID NO: 3957265 - DNA, 15 bp, Homo sapiens
ctgacttctaagtaa

SEQ ID NO: 3957266 - DNA, 16 bp, Homo sapiens
ctgacttctaagtaaa

SEQ ID NO: 3957267 - DNA, 13 bp, Homo sapiens
ctgagaaaagaac

SEQ ID NO: 3957268 - DNA, 13 bp, Homo sapiens
ctgagaaagacta

SEQ ID NO: 3957269 - DNA, 15 bp, Homo sapiens
ctgagaaagactatt

SEQ ID NO: 3957270 - DNA, 12 bp, Homo sapiens
ctgagaagaagc

SEQ ID NO: 3957271 - DNA, 21 bp, Homo sapiens
ctgagaaggcgaggagagtgg

SEQ ID NO: 3957272 - DNA, 23 bp, Homo sapiens
ctgagaaggtttggtccagcctg

SEQ ID NO: 3957273 - DNA, 22 bp, Homo sapiens
ctgagaccagttgggagcactg

SEQ ID NO: 3957274 - DNA, 23 bp, Homo sapiens
ctgagaccagttgggagcactgg

SEQ ID NO: 3957275 - DNA, 16 bp, Homo sapiens
ctgagaccatttaaca

SEQ ID NO: 3957276 - DNA, 18 bp, Homo sapiens
ctgagacccgttcgcccc

SEQ ID NO: 3957277 - DNA, 20 bp, Homo sapiens
ctgagacctgacaagcactg

SEQ ID NO: 3957278 - DNA, 22 bp, Homo sapiens
ctgagactccagaatctgctgt

SEQ ID NO: 3957279 - DNA, 21 bp, Homo sapiens
ctgagactttcagtgcactgt

SEQ ID NO: 3957280 - DNA, 19 bp, Homo sapiens
ctgagagacccaaggagga

SEQ ID NO: 3957281 - DNA, 13 bp, Homo sapiens
ctgctctgcccct

SEQ ID NO: 3957282 - DNA, 17 bp, Homo sapiens
ctgctgaaggaataaat

SEQ ID NO: 3957283 - DNA, 18 bp, Homo sapiens
ctgctgaaggaataaatt

SEQ ID NO: 3957284 - DNA, 23 bp, Homo sapiens
ctgctgaatgatttccaaagaga

SEQ ID NO: 3957285 - DNA, 13 bp, Homo sapiens
ctgctgacctgtt

SEQ ID NO: 3957286 - DNA, 14 bp, Homo sapiens
ctgctgagaacctg

SEQ ID NO: 3957287 - DNA, 16 bp, Homo sapiens
ctgctgagaacctggc

SEQ ID NO: 3957288 - DNA, 22 bp, Homo sapiens
ctgctgagagacccaaggagga

SEQ ID NO: 3957289 - DNA, 12 bp, Homo sapiens
ctgctgagccac

SEQ ID NO: 3957290 - DNA, 13 bp, Homo sapiens
ctgctgagccact

SEQ ID NO: 3957291 - DNA, 22 bp, Homo sapiens
ctgctgagccactcgcagtcgc

SEQ ID NO: 3957292 - DNA, 14 bp, Homo sapiens
ctgctgagctctga

SEQ ID NO: 3957293 - DNA, 17 bp, Homo sapiens
ctgctgagctctgagag

SEQ ID NO: 3957294 - DNA, 18 bp, Homo sapiens
ctgctgagctctgagagg

SEQ ID NO: 3957295 - DNA, 13 bp, Homo sapiens
ctgctgcaaagtg

SEQ ID NO: 3957296 - DNA, 15 bp, Homo sapiens
ctgctgcaaagtgca

SEQ ID NO: 3957297 - DNA, 15 bp, Homo sapiens
ctgctgcaccagagt

SEQ ID NO: 3957298 - DNA, 18 bp, Homo sapiens
ctgctgcagcatgaaggc

SEQ ID NO: 3957299 - DNA, 14 bp, Homo sapiens
ctgctgccgcctcc

SEQ ID NO: 3957300 - DNA, 19 bp, Homo sapiens
ctgctgccgcctcccagcc

SEQ ID NO: 3957301 - DNA, 15 bp, Homo sapiens
ctgctgcctccctct

SEQ ID NO: 3957302 - DNA, 17 bp, Homo sapiens
ctgctgcggcgaccgcc

SEQ ID NO: 3957303 - DNA, 20 bp, Homo sapiens
ctgctgcgtcagaccagtac

SEQ ID NO: 3957304 - DNA, 14 bp, Homo sapiens
ctgctgctcatcca

SEQ ID NO: 3957305 - DNA, 11 bp, Homo sapiens
ctgctgctccc

SEQ ID NO: 3957306 - DNA, 20 bp, Homo sapiens
ctgctgctgagaacctggcc

SEQ ID NO: 3957307 - DNA, 20 bp, Homo sapiens
ctgctgctgtaactgctgag

SEQ ID NO: 3957308 - DNA, 16 bp, Homo sapiens
ctgctggcacctcaga

SEQ ID NO: 3957309 - DNA, 16 bp, Homo sapiens
ctgctggcctggccgg

SEQ ID NO: 3957310 - DNA, 20 bp, Homo sapiens
ctgctggcctggccggcaac

SEQ ID NO: 3957311 - DNA, 12 bp, Homo sapiens
ctgctggctgcc

SEQ ID NO: 3957312 - DNA, 15 bp, Homo sapiens
ctgctggctgcctta

SEQ ID NO: 3957313 - DNA, 20 bp, Homo sapiens
ctgctgggaaccccgcagcc

SEQ ID NO: 3957314 - DNA, 21 bp, Homo sapiens
ctgctgggaaccccgcagccc

SEQ ID NO: 3957315 - DNA, 17 bp, Homo sapiens
ctgctggggcatgtgtg

SEQ ID NO: 3957316 - DNA, 14 bp, Homo sapiens
ctgcctactcacga

SEQ ID NO: 3957317 - DNA, 18 bp, Homo sapiens
ctgcctatccatcctgcg

SEQ ID NO: 3957318 - DNA, 16 bp, Homo sapiens
ctgcctatttattggg

SEQ ID NO: 3957319 - DNA, 24 bp, Homo sapiens
ctgcctcaatgtgaatcagaccct

SEQ ID NO: 3957320 - DNA, 12 bp, Homo sapiens
ctgcctcccagc

SEQ ID NO: 3957321 - DNA, 22 bp, Homo sapiens
ctgcctcccagccctgccagga

SEQ ID NO: 3957322 - DNA, 15 bp, Homo sapiens
ctgcctcctcttcaa

SEQ ID NO: 3957323 - DNA, 22 bp, Homo sapiens
ctgcctctactgggaaggctac

SEQ ID NO: 3957324 - DNA, 15 bp, Homo sapiens
ctgcctctccccaaa

SEQ ID NO: 3957325 - DNA, 18 bp, Homo sapiens
ctgcctctctgctccaga

SEQ ID NO: 3957326 - DNA, 19 bp, Homo sapiens
ctgcctctctgctccagag

SEQ ID NO: 3957327 - DNA, 20 bp, Homo sapiens
ctgcctctctgctccagaga

SEQ ID NO: 3957328 - DNA, 17 bp, Homo sapiens
ctgcctctgccatgccc

SEQ ID NO: 3957329 - DNA, 19 bp, Homo sapiens
ctgcctgagcccaggagct

SEQ ID NO: 3957330 - DNA, 18 bp, Homo sapiens
ctgcctgataccctgctt

SEQ ID NO: 3957331 - DNA, 10 bp, Homo sapiens
ctgcctggag

SEQ ID NO: 3957332 - DNA, 17 bp, Homo sapiens
ctgcctggaggacctga

SEQ ID NO: 3957333 - DNA, 22 bp, Homo sapiens
ctgcctggaggacctgagcctg

SEQ ID NO: 3957334 - DNA, 16 bp, Homo sapiens
ctgcctggcctggctc

SEQ ID NO: 3957335 - DNA, 14 bp, Homo sapiens
ctgcctgggcctgt

SEQ ID NO: 3957336 - DNA, 16 bp, Homo sapiens
ctgcctgggcctgtgc

SEQ ID NO: 3957337 - DNA, 20 bp, Homo sapiens
ctgcctgggcctgtgcagca

SEQ ID NO: 3957338 - DNA, 21 bp, Homo sapiens
ctgcctgggcctgtgcagcag

SEQ ID NO: 3957339 - DNA, 22 bp, Homo sapiens
ctgcctgggcctgtgcagcagc

SEQ ID NO: 3957340 - DNA, 22 bp, Homo sapiens
ctgcctgggttttctaactgta

SEQ ID NO: 3957341 - DNA, 15 bp, Homo sapiens
ctgcctggtatgagt

SEQ ID NO: 3957342 - DNA, 15 bp, Homo sapiens
ctgcctgtagttagg

SEQ ID NO: 3957343 - DNA, 16 bp, Homo sapiens
ctgcctgtagttagga

SEQ ID NO: 3957344 - DNA, 19 bp, Homo sapiens
ctgcctgtagttaggaaat

SEQ ID NO: 3957345 - DNA, 20 bp, Homo sapiens
ctgcctgtagttaggaaata

SEQ ID NO: 3957346 - DNA, 21 bp, Homo sapiens
ctgcctgtagttaggaaataa

SEQ ID NO: 3957347 - DNA, 22 bp, Homo sapiens
ctgcctgtagttaggaaataaa

SEQ ID NO: 3957348 - DNA, 15 bp, Homo sapiens
ctgcctttggaagaa

SEQ ID NO: 3957349 - DNA, 19 bp, Homo sapiens
ctgccaggcgttggtgcca

SEQ ID NO: 3957350 - DNA, 23 bp, Homo sapiens
ctgccaggcgttggtgccacttc

SEQ ID NO: 3957351 - DNA, 13 bp, Homo sapiens
ctgccagtgcctt

SEQ ID NO: 3957352 - DNA, 23 bp, Homo sapiens
ctgccagtgccttacctcctgcc

SEQ ID NO: 3957353 - DNA, 15 bp, Homo sapiens
ctgccataccgctgg

SEQ ID NO: 3957354 - DNA, 18 bp, Homo sapiens
ctgccataccgctgggga

SEQ ID NO: 3957355 - DNA, 22 bp, Homo sapiens
ctgccataccgctggggaacag

SEQ ID NO: 3957356 - DNA, 13 bp, Homo sapiens
ctgccatgccact

SEQ ID NO: 3957357 - DNA, 24 bp, Homo sapiens
ctgccatgccactgccaggcacct

SEQ ID NO: 3957358 - DNA, 15 bp, Homo sapiens
ctgccatgcccagag

SEQ ID NO: 3957359 - DNA, 13 bp, Homo sapiens
ctgccatgcctca

SEQ ID NO: 3957360 - DNA, 23 bp, Homo sapiens
ctgccattaaatccgcaaacagc

SEQ ID NO: 3957361 - DNA, 21 bp, Homo sapiens
ctgcccaatgctttgggaggc

SEQ ID NO: 3957362 - DNA, 13 bp, Homo sapiens
ctgcccactgtga

SEQ ID NO: 3957363 - DNA, 17 bp, Homo sapiens
ctgcccacttcagccca

SEQ ID NO: 3957364 - DNA, 21 bp, Homo sapiens
ctgcccagaattcccagctgt

SEQ ID NO: 3957365 - DNA, 12 bp, Homo sapiens
ctgcccaggaga

SEQ ID NO: 3957366 - DNA, 18 bp, Homo sapiens
ctgcccaggcctgcctgt

SEQ ID NO: 3957367 - DNA, 15 bp, Homo sapiens
ctgcccatacccctg

SEQ ID NO: 3957368 - DNA, 20 bp, Homo sapiens
ctgcccatgtgtcccctcac

SEQ ID NO: 3957369 - DNA, 18 bp, Homo sapiens
ctgccccaactcctggaa

SEQ ID NO: 3957370 - DNA, 21 bp, Homo sapiens
ctgccccaactcctggaagct

SEQ ID NO: 3957371 - DNA, 21 bp, Homo sapiens
ctgccccaagcagccagccag

SEQ ID NO: 3957372 - DNA, 22 bp, Homo sapiens
ctgccccaagcagccagccagt

SEQ ID NO: 3957373 - DNA, 16 bp, Homo sapiens
ctgccccaagccccca

SEQ ID NO: 3957374 - DNA, 12 bp, Homo sapiens
ctgccccaaggg

SEQ ID NO: 3957375 - DNA, 17 bp, Homo sapiens
ctgccccaaggggccca

SEQ ID NO: 3957376 - DNA, 14 bp, Homo sapiens
ctgccccagcgcgg

SEQ ID NO: 3957377 - DNA, 17 bp, Homo sapiens
ctgccccagcgcggctt

SEQ ID NO: 3957378 - DNA, 18 bp, Homo sapiens
ctgagccctggtgtgttt

SEQ ID NO: 3957379 - DNA, 14 bp, Homo sapiens
ctgagcctgccgag

SEQ ID NO: 3957380 - DNA, 16 bp, Homo sapiens
ctgagcctgccgagca

SEQ ID NO: 3957381 - DNA, 19 bp, Homo sapiens
ctgagctagaagctggagg

SEQ ID NO: 3957382 - DNA, 14 bp, Homo sapiens
ctgagctcacaagg

SEQ ID NO: 3957383 - DNA, 19 bp, Homo sapiens
ctgagctcacaaggcagca

SEQ ID NO: 3957384 - DNA, 17 bp, Homo sapiens
ctgagctctgagaggcc

SEQ ID NO: 3957385 - DNA, 19 bp, Homo sapiens
ctgagctctgagaggccct

SEQ ID NO: 3957386 - DNA, 13 bp, Homo sapiens
ctgagctggggcc

SEQ ID NO: 3957387 - DNA, 18 bp, Homo sapiens
ctgagctggggcctggag

SEQ ID NO: 3957388 - DNA, 17 bp, Homo sapiens
ctgagcttagccttgtg

SEQ ID NO: 3957389 - DNA, 24 bp, Homo sapiens
ctgagcttagccttgtgccctgcc

SEQ ID NO: 3957390 - DNA, 14 bp, Homo sapiens
ctgagcttggccct

SEQ ID NO: 3957391 - DNA, 20 bp, Homo sapiens
ctgaggaagcacagcagcat

SEQ ID NO: 3957392 - DNA, 13 bp, Homo sapiens
ctgaggactccct

SEQ ID NO: 3957393 - DNA, 14 bp, Homo sapiens
ctgaggactggaga

SEQ ID NO: 3957394 - DNA, 22 bp, Homo sapiens
ctgaggacttaaaatattcctg

SEQ ID NO: 3957395 - DNA, 16 bp, Homo sapiens
ctgaggagtagctgag

SEQ ID NO: 3957396 - DNA, 21 bp, Homo sapiens
ctgaggagtagctgagaggaa

SEQ ID NO: 3957397 - DNA, 12 bp, Homo sapiens
ctgaggagtctg

SEQ ID NO: 3957398 - DNA, 18 bp, Homo sapiens
ctgaggagtctgaggtcc

SEQ ID NO: 3957399 - DNA, 19 bp, Homo sapiens
ctgaggagtctgaggtcct

SEQ ID NO: 3957400 - DNA, 20 bp, Homo sapiens
ctgaggagtctgaggtcctg

SEQ ID NO: 3957401 - DNA, 18 bp, Homo sapiens
ctgaggccccaggcccta

SEQ ID NO: 3957402 - DNA, 23 bp, Homo sapiens
ctgaggccccttaactcatctgt

SEQ ID NO: 3957403 - DNA, 14 bp, Homo sapiens
ctgaggcctcatcc

SEQ ID NO: 3957404 - DNA, 13 bp, Homo sapiens
ctgaggctcaaga

SEQ ID NO: 3957405 - DNA, 18 bp, Homo sapiens
ctgaggctcaagaggccc

SEQ ID NO: 3957406 - DNA, 23 bp, Homo sapiens
ctgaggctcaagaggcccaggga

SEQ ID NO: 3957407 - DNA, 22 bp, Homo sapiens
ctgaggctctgacccagtgaga

SEQ ID NO: 3957408 - DNA, 14 bp, Homo sapiens
ctgaggcttccaga

SEQ ID NO: 3957409 - DNA, 21 bp, Homo sapiens
ctgagggcattaaaaatagta

SEQ ID NO: 3957410 - DNA, 20 bp, Homo sapiens
ctgaggggggccgtgcccag

SEQ ID NO: 3957411 - DNA, 18 bp, Homo sapiens
ctgagggtccccacctgg

SEQ ID NO: 3957412 - DNA, 20 bp, Homo sapiens
ctgagggtccccacctggga

SEQ ID NO: 3957413 - DNA, 15 bp, Homo sapiens
ctgagggtggagact

SEQ ID NO: 3957414 - DNA, 20 bp, Homo sapiens
ctgagggtggagactaagcc

SEQ ID NO: 3957415 - DNA, 14 bp, Homo sapiens
ctgaggtcactggg

SEQ ID NO: 3957416 - DNA, 18 bp, Homo sapiens
ctgaggtcactgggttct

SEQ ID NO: 3957417 - DNA, 13 bp, Homo sapiens
ctgaggtcctgag

SEQ ID NO: 3957418 - DNA, 19 bp, Homo sapiens
ctgaggtcctgagcactgc

SEQ ID NO: 3957419 - DNA, 24 bp, Homo sapiens
ctgaggtcctgagcactgccagga

SEQ ID NO: 3957420 - DNA, 16 bp, Homo sapiens
ctgaggtgcccaggag

SEQ ID NO: 3957421 - DNA, 18 bp, Homo sapiens
ctgaggtgcccaggagaa

SEQ ID NO: 3957422 - DNA, 20 bp, Homo sapiens
ctgaggtgcccaggagaaga

SEQ ID NO: 3957423 - DNA, 19 bp, Homo sapiens
ctgagtaaattggaaacat

SEQ ID NO: 3957424 - DNA, 16 bp, Homo sapiens
ctgagtcaactggagc

SEQ ID NO: 3957425 - DNA, 15 bp, Homo sapiens
ctgagtcaccaggaa

SEQ ID NO: 3957426 - DNA, 22 bp, Homo sapiens
ctgagtcaccctacctgtgcct

SEQ ID NO: 3957427 - DNA, 18 bp, Homo sapiens
ctgagtcacctcctccac

SEQ ID NO: 3957428 - DNA, 19 bp, Homo sapiens
ctgagtcacctcctccact

SEQ ID NO: 3957429 - DNA, 22 bp, Homo sapiens
ctgagtcatgatctccctgccg

SEQ ID NO: 3957430 - DNA, 13 bp, Homo sapiens
ctgagtctcctgt

SEQ ID NO: 3957431 - DNA, 15 bp, Homo sapiens
ctgagtctcctgtgc

SEQ ID NO: 3957432 - DNA, 19 bp, Homo sapiens
ctgagtctgagtcctgtct

SEQ ID NO: 3957433 - DNA, 17 bp, Homo sapiens
ctgagtctgctatattt

SEQ ID NO: 3957434 - DNA, 14 bp, Homo sapiens
ctgagtcttggcct

SEQ ID NO: 3957435 - DNA, 13 bp, Homo sapiens
ctgagtgaaaaat

SEQ ID NO: 3957436 - DNA, 12 bp, Homo sapiens
ctgagtgagagg

SEQ ID NO: 3957437 - DNA, 23 bp, Homo sapiens
ctgagtggaatgcagggaagagg

SEQ ID NO: 3957438 - DNA, 17 bp, Homo sapiens
ctgcaccatcacacatg

SEQ ID NO: 3957439 - DNA, 12 bp, Homo sapiens
ctgcaccctgga

SEQ ID NO: 3957440 - DNA, 18 bp, Homo sapiens
ctgcacctccccccactg

SEQ ID NO: 3957441 - DNA, 21 bp, Homo sapiens
ctgcacgccaccgctgccttt

SEQ ID NO: 3957442 - DNA, 14 bp, Homo sapiens
ctgcactccagaat

SEQ ID NO: 3957443 - DNA, 11 bp, Homo sapiens
ctgcactccat

SEQ ID NO: 3957444 - DNA, 14 bp, Homo sapiens
ctgcactccatggc

SEQ ID NO: 3957445 - DNA, 16 bp, Homo sapiens
ctgcactccatggcca

SEQ ID NO: 3957446 - DNA, 14 bp, Homo sapiens
ctgcactgaaaagg

SEQ ID NO: 3957447 - DNA, 12 bp, Homo sapiens
ctgcactgcagt

SEQ ID NO: 3957448 - DNA, 14 bp, Homo sapiens
ctgcagaaggccaa

SEQ ID NO: 3957449 - DNA, 15 bp, Homo sapiens
ctgcagaaggccaag

SEQ ID NO: 3957450 - DNA, 16 bp, Homo sapiens
ctgcagaaggccaaga

SEQ ID NO: 3957451 - DNA, 16 bp, Homo sapiens
ctgcagaccctgccct

SEQ ID NO: 3957452 - DNA, 20 bp, Homo sapiens
ctgcagagcaggaaacatga

SEQ ID NO: 3957453 - DNA, 23 bp, Homo sapiens
ctgcagaggacagagctggctgt

SEQ ID NO: 3957454 - DNA, 19 bp, Homo sapiens
ctgcagaggaccacagtgg

SEQ ID NO: 3957455 - DNA, 15 bp, Homo sapiens
ctgcagattctgatt

SEQ ID NO: 3957456 - DNA, 12 bp, Homo sapiens
ctgcagcaactc

SEQ ID NO: 3957457 - DNA, 16 bp, Homo sapiens
ctgcagcaactcccac

SEQ ID NO: 3957458 - DNA, 15 bp, Homo sapiens
ctgcagcatgaaggc

SEQ ID NO: 3957459 - DNA, 20 bp, Homo sapiens
ctgcagcctcctcctgacca

SEQ ID NO: 3957460 - DNA, 22 bp, Homo sapiens
ctgcagctatgcgcaatgtggc

SEQ ID NO: 3957461 - DNA, 21 bp, Homo sapiens
ctgcagctctttcttctttga

SEQ ID NO: 3957462 - DNA, 22 bp, Homo sapiens
ctgcagctgctgaagttctgag

SEQ ID NO: 3957463 - DNA, 13 bp, Homo sapiens
ctgcagctgggcc

SEQ ID NO: 3957464 - DNA, 22 bp, Homo sapiens
ctgcagctgggccccatgctct

SEQ ID NO: 3957465 - DNA, 23 bp, Homo sapiens
ctgcagctgggccccatgctctg

SEQ ID NO: 3957466 - DNA, 20 bp, Homo sapiens
ctgggatggaccctcgcagc

SEQ ID NO: 3957467 - DNA, 14 bp, Homo sapiens
ctgggatgtagaac

SEQ ID NO: 3957468 - DNA, 23 bp, Homo sapiens
ctgggattcaggaaaaggcctgg

SEQ ID NO: 3957469 - DNA, 20 bp, Homo sapiens
ctgggattcccaccaaggtc

SEQ ID NO: 3957470 - DNA, 21 bp, Homo sapiens
ctgggatttcttcgctgctct

SEQ ID NO: 3957471 - DNA, 22 bp, Homo sapiens
ctgggcaaacccttctcttctc

SEQ ID NO: 3957472 - DNA, 13 bp, Homo sapiens
ctgggcagacctt

SEQ ID NO: 3957473 - DNA, 12 bp, Homo sapiens
ctgggcagctga

SEQ ID NO: 3957474 - DNA, 21 bp, Homo sapiens
ctgggcagtcgtaagggttgc

SEQ ID NO: 3957475 - DNA, 17 bp, Homo sapiens
ctgggcatcttctggct

SEQ ID NO: 3957476 - DNA, 23 bp, Homo sapiens
ctgggccaaaagggcagccaggg

SEQ ID NO: 3957477 - DNA, 12 bp, Homo sapiens
ctgggccagcct

SEQ ID NO: 3957478 - DNA, 13 bp, Homo sapiens
ctgggccagcctc

SEQ ID NO: 3957479 - DNA, 19 bp, Homo sapiens
ctgggccagcctcagctca

SEQ ID NO: 3957480 - DNA, 22 bp, Homo sapiens
ctgggccagcctcagctcagcc

SEQ ID NO: 3957481 - DNA, 14 bp, Homo sapiens
ctgggcccaggctc

SEQ ID NO: 3957482 - DNA, 14 bp, Homo sapiens
ctgggccccatgct

SEQ ID NO: 3957483 - DNA, 16 bp, Homo sapiens
ctgggccccatgctct

SEQ ID NO: 3957484 - DNA, 17 bp, Homo sapiens
ctgggccccatgctctg

SEQ ID NO: 3957485 - DNA, 22 bp, Homo sapiens
ctgggccccatgctctgcccca

SEQ ID NO: 3957486 - DNA, 22 bp, Homo sapiens
ctgggcccccactttcaccagt

SEQ ID NO: 3957487 - DNA, 14 bp, Homo sapiens
ctgggcccctccac

SEQ ID NO: 3957488 - DNA, 17 bp, Homo sapiens
ctgggcccctccacgcc

SEQ ID NO: 3957489 - DNA, 19 bp, Homo sapiens
ctgggcccctccacgcctc

SEQ ID NO: 3957490 - DNA, 22 bp, Homo sapiens
ctgggcccctccacgcctcctg

SEQ ID NO: 3957491 - DNA, 14 bp, Homo sapiens
ctgggcccctggga

SEQ ID NO: 3957492 - DNA, 21 bp, Homo sapiens
ctgggcctatggagagccctg

SEQ ID NO: 3957493 - DNA, 23 bp, Homo sapiens
ctgggcctatggagagccctggg

SEQ ID NO: 3957494 - DNA, 12 bp, Homo sapiens
ctgggcctgctg

SEQ ID NO: 3957495 - DNA, 20 bp, Homo sapiens
ctgggcctgctgctgagaac

SEQ ID NO: 3957496 - DNA, 13 bp, Homo sapiens
ctgggcctgtccc

SEQ ID NO: 3957497 - DNA, 14 bp, Homo sapiens
ctgggcctgtcccc

SEQ ID NO: 3957498 - DNA, 14 bp, Homo sapiens
ctgggcctgtgcag

SEQ ID NO: 3957499 - DNA, 19 bp, Homo sapiens
ctgggcctgtgcagcagcc

SEQ ID NO: 3957500 - DNA, 17 bp, Homo sapiens
ctgggcctttcctgtgc

SEQ ID NO: 3957501 - DNA, 23 bp, Homo sapiens
ctgggcctttcctgtgccaacct

SEQ ID NO: 3957502 - DNA, 23 bp, Homo sapiens
ctgggctagggagaatgcagaga

SEQ ID NO: 3957503 - DNA, 18 bp, Homo sapiens
ctgggctcagggctggag

SEQ ID NO: 3957504 - DNA, 20 bp, Homo sapiens
ctgggctcctggaaccaatc

SEQ ID NO: 3957505 - DNA, 17 bp, Homo sapiens
ctgggctctccacctca

SEQ ID NO: 3957506 - DNA, 19 bp, Homo sapiens
ctgggctctccacctcagc

SEQ ID NO: 3957507 - DNA, 22 bp, Homo sapiens
ctgggcttgtagaccactgtcc

SEQ ID NO: 3957508 - DNA, 22 bp, Homo sapiens
ctggggaacagagcgggcctct

SEQ ID NO: 3957509 - DNA, 20 bp, Homo sapiens
ctggggagaaataattgttg

SEQ ID NO: 3957510 - DNA, 15 bp, Homo sapiens
ctggggaggaagggc

SEQ ID NO: 3957511 - DNA, 18 bp, Homo sapiens
ctggggaggaagggccag

SEQ ID NO: 3957512 - DNA, 17 bp, Homo sapiens
ctggggatgtgggaggg

SEQ ID NO: 3957513 - DNA, 17 bp, Homo sapiens
ctggggcagaggggcag

SEQ ID NO: 3957514 - DNA, 24 bp, Homo sapiens
ctggggcagaggggcagccgctag

SEQ ID NO: 3957515 - DNA, 17 bp, Homo sapiens
ctggggcatgtgtgcct

SEQ ID NO: 3957516 - DNA, 22 bp, Homo sapiens
ctggggccagtgtaaggcatag

SEQ ID NO: 3957517 - DNA, 17 bp, Homo sapiens
ctggggccccgctggga

SEQ ID NO: 3957518 - DNA, 20 bp, Homo sapiens
ctggggccctgggcctcagt

SEQ ID NO: 3957519 - DNA, 16 bp, Homo sapiens
ctggggcctggagagg

SEQ ID NO: 3957520 - DNA, 23 bp, Homo sapiens
ctggggctcctttctccagccag

SEQ ID NO: 3957521 - DNA, 19 bp, Homo sapiens
ctggggctctaacgcctga

SEQ ID NO: 3957522 - DNA, 22 bp, Homo sapiens
ctggggctctaacgcctgagcc

SEQ ID NO: 3957523 - DNA, 16 bp, Homo sapiens
ctggggcttgcaagag

SEQ ID NO: 3957524 - DNA, 16 bp, Homo sapiens
ctgggggaagccctgg

SEQ ID NO: 3957525 - DNA, 16 bp, Homo sapiens
ctgggggaagggtggt

SEQ ID NO: 3957526 - DNA, 16 bp, Homo sapiens
ctgggggcagtgactg

SEQ ID NO: 3957527 - DNA, 14 bp, Homo sapiens
ctgggggccagctg

SEQ ID NO: 3957528 - DNA, 16 bp, Homo sapiens
ctgggggcctggctgg

SEQ ID NO: 3957529 - DNA, 17 bp, Homo sapiens
ctgggggtggcaggcac

SEQ ID NO: 3957530 - DNA, 19 bp, Homo sapiens
ctgggggtgggggcgggtg

SEQ ID NO: 3957531 - DNA, 16 bp, Homo sapiens
ctggggtacaggtttg

SEQ ID NO: 3957532 - DNA, 15 bp, Homo sapiens
ctggggttcagcccc

SEQ ID NO: 3957533 - DNA, 21 bp, Homo sapiens
ctggggttcagcccctcctct

SEQ ID NO: 3957534 - DNA, 22 bp, Homo sapiens
ctgggtaactgtcaagtcatga

SEQ ID NO: 3957535 - DNA, 20 bp, Homo sapiens
ctgggtccctcggagctgcc

SEQ ID NO: 3957536 - DNA, 18 bp, Homo sapiens
ctgggtcctgttccctac

SEQ ID NO: 3957537 - DNA, 20 bp, Homo sapiens
ctgggtgagaatcctgcctc

SEQ ID NO: 3957538 - DNA, 22 bp, Homo sapiens
ctgggtgagaatcctgcctctc

SEQ ID NO: 3957539 - DNA, 19 bp, Homo sapiens
ctgggtgccattcccagcg

SEQ ID NO: 3957540 - DNA, 23 bp, Homo sapiens
ctgggtggcctcgggacacctgc

SEQ ID NO: 3957541 - DNA, 23 bp, Homo sapiens
ctgggtgggatggatgctgggga

SEQ ID NO: 3957542 - DNA, 13 bp, Homo sapiens
ctgggtggggctg

SEQ ID NO: 3957543 - DNA, 18 bp, Homo sapiens
ctgggtggggctgctcct

SEQ ID NO: 3957544 - DNA, 20 bp, Homo sapiens
ctgggtggggctgctcctcc

SEQ ID NO: 3957545 - DNA, 15 bp, Homo sapiens
ctgggtgttgcattt

SEQ ID NO: 3957546 - DNA, 21 bp, Homo sapiens
ctgggttatttttgtccctgc

SEQ ID NO: 3957547 - DNA, 22 bp, Homo sapiens
ctgggttcattccccggccctc

SEQ ID NO: 3957548 - DNA, 14 bp, Homo sapiens
ctgggttctagaac

SEQ ID NO: 3957549 - DNA, 23 bp, Homo sapiens
ctgggtttattacatggcagtgt

SEQ ID NO: 3957550 - DNA, 23 bp, Homo sapiens
ctgggttttgtctctgcatctca

SEQ ID NO: 3957551 - DNA, 19 bp, Homo sapiens
ctggagaagctcacccaat

SEQ ID NO: 3957552 - DNA, 13 bp, Homo sapiens
ctggagaagctga

SEQ ID NO: 3957553 - DNA, 13 bp, Homo sapiens
ctggagagctaga

SEQ ID NO: 3957554 - DNA, 23 bp, Homo sapiens
ctggagagctagaacctggaggg

SEQ ID NO: 3957555 - DNA, 22 bp, Homo sapiens
ctggagaggggcctgggaaagg

SEQ ID NO: 3957556 - DNA, 21 bp, Homo sapiens
ctggagatcctaactgagaat

SEQ ID NO: 3957557 - DNA, 15 bp, Homo sapiens
ctggagatgatgatg

SEQ ID NO: 3957558 - DNA, 18 bp, Homo sapiens
ctggagcaagagagagct

SEQ ID NO: 3957559 - DNA, 14 bp, Homo sapiens
ctggagcaccaggc

SEQ ID NO: 3957560 - DNA, 17 bp, Homo sapiens
ctggagcatcccaggcg

SEQ ID NO: 3957561 - DNA, 17 bp, Homo sapiens
ctggagcatctgactca

SEQ ID NO: 3957562 - DNA, 22 bp, Homo sapiens
ctggagcatctgactcacaaga

SEQ ID NO: 3957563 - DNA, 12 bp, Homo sapiens
ctggagccagag

SEQ ID NO: 3957564 - DNA, 14 bp, Homo sapiens
ctggagctcttgga

SEQ ID NO: 3957565 - DNA, 16 bp, Homo sapiens
ctggagctcttggaag

SEQ ID NO: 3957566 - DNA, 22 bp, Homo sapiens
ctggagctcttggaagagctct

SEQ ID NO: 3957567 - DNA, 12 bp, Homo sapiens
ctggaggacaca

SEQ ID NO: 3957568 - DNA, 14 bp, Homo sapiens
ctggaggacctgag

SEQ ID NO: 3957569 - DNA, 15 bp, Homo sapiens
ctggaggacctgagc

SEQ ID NO: 3957570 - DNA, 18 bp, Homo sapiens
ctggaggacctgagcctg

SEQ ID NO: 3957571 - DNA, 19 bp, Homo sapiens
ctggaggactagaacctgg

SEQ ID NO: 3957572 - DNA, 20 bp, Homo sapiens
ctggaggactagaacctgga

SEQ ID NO: 3957573 - DNA, 21 bp, Homo sapiens
ctggaggactagaacctggag

SEQ ID NO: 3957574 - DNA, 18 bp, Homo sapiens
ctggaggatccctccatc

SEQ ID NO: 3957575 - DNA, 15 bp, Homo sapiens
ctggaggatgaccag

SEQ ID NO: 3957576 - DNA, 14 bp, Homo sapiens
ctggaggcagacag

SEQ ID NO: 3957577 - DNA, 12 bp, Homo sapiens
ctggaggcaggg

SEQ ID NO: 3957578 - DNA, 20 bp, Homo sapiens
ctggaggcagggccttgccc

SEQ ID NO: 3957579 - DNA, 19 bp, Homo sapiens
ctggagggaatgaacctgg

SEQ ID NO: 3957580 - DNA, 21 bp, Homo sapiens
ctggagggaatgaacctggag

SEQ ID NO: 3957581 - DNA, 23 bp, Homo sapiens
ctggagggaatgaacctggaggg

SEQ ID NO: 3957582 - DNA, 14 bp, Homo sapiens
ctggagggaggctc

SEQ ID NO: 3957583 - DNA, 15 bp, Homo sapiens
ctggagggatgccac

SEQ ID NO: 3957584 - DNA, 20 bp, Homo sapiens
ctggagggctagaacctaga

SEQ ID NO: 3957585 - DNA, 22 bp, Homo sapiens
ctggagggctggaatctggaga

SEQ ID NO: 3957586 - DNA, 21 bp, Homo sapiens
ctggaggtcacattcaggaag

SEQ ID NO: 3957587 - DNA, 18 bp, Homo sapiens
ctggagtgaggcttccag

SEQ ID NO: 3957588 - DNA, 23 bp, Homo sapiens
ctggagtgaggcttccaggctct

SEQ ID NO: 3957589 - DNA, 12 bp, Homo sapiens
ctggagtgcagg

SEQ ID NO: 3957590 - DNA, 16 bp, Homo sapiens
ctggagtgcagggagg

SEQ ID NO: 3957591 - DNA, 13 bp, Homo sapiens
ctggagtgcagtt

SEQ ID NO: 3957592 - DNA, 17 bp, Homo sapiens
ctggagtgcgctcttgg

SEQ ID NO: 3957593 - DNA, 19 bp, Homo sapiens
ctggagtgcgctcttggtc

SEQ ID NO: 3957594 - DNA, 23 bp, Homo sapiens
ctggagtgcgctcttggtccctg

SEQ ID NO: 3957595 - DNA, 16 bp, Homo sapiens
ctggagttacattaat

SEQ ID NO: 3957596 - DNA, 22 bp, Homo sapiens
ctggagttacattaatgttaat

SEQ ID NO: 3957597 - DNA, 17 bp, Homo sapiens
ctggatactatatgata

SEQ ID NO: 3957598 - DNA, 23 bp, Homo sapiens
ctggatactatatgataaagagg

SEQ ID NO: 3957599 - DNA, 13 bp, Homo sapiens
ctggatcagcgtg

SEQ ID NO: 3957600 - DNA, 17 bp, Homo sapiens
ctggatcagcgtggcct

SEQ ID NO: 3957601 - DNA, 22 bp, Homo sapiens
ctggatcctgctgtggcctcac

SEQ ID NO: 3957602 - DNA, 20 bp, Homo sapiens
ctggatctgggaccctttcc

SEQ ID NO: 3957603 - DNA, 21 bp, Homo sapiens
ctggatctgggaccctttcct

SEQ ID NO: 3957604 - DNA, 15 bp, Homo sapiens
ctggatgggcattgg

SEQ ID NO: 3957605 - DNA, 17 bp, Homo sapiens
ctggatgtcccctgtcc

SEQ ID NO: 3957606 - DNA, 22 bp, Homo sapiens
ctggatgtcccctgtcccacca

SEQ ID NO: 3957607 - DNA, 19 bp, Homo sapiens
ctggattaatgttttgtac

SEQ ID NO: 3957608 - DNA, 13 bp, Homo sapiens
ctggattccagag

SEQ ID NO: 3957609 - DNA, 21 bp, Homo sapiens
ctggattccagagcactgctc

SEQ ID NO: 3957610 - DNA, 18 bp, Homo sapiens
ctggcaaaggtggctctc

SEQ ID NO: 3957611 - DNA, 13 bp, Homo sapiens
ctggcaagcaggg

SEQ ID NO: 3957612 - DNA, 21 bp, Homo sapiens
ctggcacacagtaggtgctca

SEQ ID NO: 3957613 - DNA, 22 bp, Homo sapiens
ctggcacaggactgattctggg

SEQ ID NO: 3957614 - DNA, 16 bp, Homo sapiens
ctggcacagggcagtg

SEQ ID NO: 3957615 - DNA, 18 bp, Homo sapiens
ctggcacagttttctgag

SEQ ID NO: 3957616 - DNA, 19 bp, Homo sapiens
ctggcacagttttctgaga

SEQ ID NO: 3957617 - DNA, 23 bp, Homo sapiens
ctggcacttagcccaagaggtct

SEQ ID NO: 3957618 - DNA, 13 bp, Homo sapiens
ctggcagccgtgc

SEQ ID NO: 3957619 - DNA, 19 bp, Homo sapiens
ctggcagctcctctccttg

SEQ ID NO: 3957620 - DNA, 21 bp, Homo sapiens
ctggcagctcctctccttggg

SEQ ID NO: 3957621 - DNA, 21 bp, Homo sapiens
ctggcagctgagagccctgct

SEQ ID NO: 3957622 - DNA, 21 bp, Homo sapiens
ctggcaggaagtctctcccga

SEQ ID NO: 3957623 - DNA, 12 bp, Homo sapiens
ctggcaggtgca

SEQ ID NO: 3957624 - DNA, 22 bp, Homo sapiens
ctggcaggtgcagatgggctgt

SEQ ID NO: 3957625 - DNA, 16 bp, Homo sapiens
ctggcatgtcagagcc

SEQ ID NO: 3957626 - DNA, 23 bp, Homo sapiens
ctggcattaattattaataccaa

SEQ ID NO: 3957627 - DNA, 16 bp, Homo sapiens
ctggcattggtctgct

SEQ ID NO: 3957628 - DNA, 12 bp, Homo sapiens
ctggccacccaa

SEQ ID NO: 3957629 - DNA, 14 bp, Homo sapiens
ctggccaccctggc

SEQ ID NO: 3957630 - DNA, 16 bp, Homo sapiens
ctggccaccctggccc

SEQ ID NO: 3957631 - DNA, 11 bp, Homo sapiens
ctggccagaga

SEQ ID NO: 3957632 - DNA, 14 bp, Homo sapiens
ctggccagagaggg

SEQ ID NO: 3957633 - DNA, 14 bp, Homo sapiens
ctggccaggcatgg

SEQ ID NO: 3957634 - DNA, 17 bp, Homo sapiens
ctggccagtcctagagc

SEQ ID NO: 3957635 - DNA, 22 bp, Homo sapiens
ctggccagtcctagagctcctg

SEQ ID NO: 3957636 - DNA, 23 bp, Homo sapiens
ctggccattttcttgcctgaggc

SEQ ID NO: 3957637 - DNA, 21 bp, Homo sapiens
ctggcccagccaactgccccg

SEQ ID NO: 3957638 - DNA, 19 bp, Homo sapiens
ctggccccatgtctctcag

SEQ ID NO: 3957639 - DNA, 21 bp, Homo sapiens
ctggccccgggctctggccac

SEQ ID NO: 3957640 - DNA, 22 bp, Homo sapiens
ctggccccgggctctggccacc

SEQ ID NO: 3957641 - DNA, 22 bp, Homo sapiens
ctggcccctccagaccctgcct

SEQ ID NO: 3957642 - DNA, 23 bp, Homo sapiens
ctggcccctccagaccctgcctg

SEQ ID NO: 3957643 - DNA, 11 bp, Homo sapiens
ctggccctgcc

SEQ ID NO: 3957644 - DNA, 19 bp, Homo sapiens
ctggccggcccaggcctcc

SEQ ID NO: 3957645 - DNA, 17 bp, Homo sapiens
ctggccggggcccctca

SEQ ID NO: 3957646 - DNA, 14 bp, Homo sapiens
ctggcctcactggc

SEQ ID NO: 3957647 - DNA, 18 bp, Homo sapiens
ctggcctcactggctggg

SEQ ID NO: 3957648 - DNA, 22 bp, Homo sapiens
ctggcctcccaataaagctgga

SEQ ID NO: 3957649 - DNA, 23 bp, Homo sapiens
ctggcctcccaataaagctggac

SEQ ID NO: 3957650 - DNA, 13 bp, Homo sapiens
ctggcctcctgcc

SEQ ID NO: 3957651 - DNA, 16 bp, Homo sapiens
ctggcctcctgcctct

SEQ ID NO: 3957652 - DNA, 21 bp, Homo sapiens
ctggcctctagaacacccact

SEQ ID NO: 3957653 - DNA, 13 bp, Homo sapiens
ctggcctgagctg

SEQ ID NO: 3957654 - DNA, 14 bp, Homo sapiens
ctggcctgagctgg

SEQ ID NO: 3957655 - DNA, 14 bp, Homo sapiens
ctggcctgctggga

SEQ ID NO: 3957656 - DNA, 15 bp, Homo sapiens
ctggcctgctgggct

SEQ ID NO: 3957657 - DNA, 15 bp, Homo sapiens
ctggcctggatctcc

SEQ ID NO: 3957658 - DNA, 21 bp, Homo sapiens
ctggcctggatctccccactc

SEQ ID NO: 3957659 - DNA, 15 bp, Homo sapiens
ctggcctggccggca

SEQ ID NO: 3957660 - DNA, 14 bp, Homo sapiens
ctggcctggctccc

SEQ ID NO: 3957661 - DNA, 13 bp, Homo sapiens
ctggccttttcct

SEQ ID NO: 3957662 - DNA, 18 bp, Homo sapiens
ctggcggctactcagcag

SEQ ID NO: 3957663 - DNA, 22 bp, Homo sapiens
ctggcggctactcagcagccct

SEQ ID NO: 3957664 - DNA, 17 bp, Homo sapiens
ctggcggcttcctgtcc

SEQ ID NO: 3957665 - DNA, 18 bp, Homo sapiens
ctggcggcttcctgtcca

SEQ ID NO: 3957666 - DNA, 19 bp, Homo sapiens
ctggcggggcaggaggcct

SEQ ID NO: 3957667 - DNA, 17 bp, Homo sapiens
ctggctaactggaagca

SEQ ID NO: 3957668 - DNA, 23 bp, Homo sapiens
ctggctcacccctctcccccgcc

SEQ ID NO: 3957669 - DNA, 14 bp, Homo sapiens
ctggctcaggaaga

SEQ ID NO: 3957670 - DNA, 13 bp, Homo sapiens
ctggctccagaat

SEQ ID NO: 3957671 - DNA, 22 bp, Homo sapiens
ctggctccccacgagtcacctg

SEQ ID NO: 3957672 - DNA, 18 bp, Homo sapiens
ctggctctgcaatgggca

SEQ ID NO: 3957673 - DNA, 15 bp, Homo sapiens
ctggctgagggcagt

SEQ ID NO: 3957674 - DNA, 23 bp, Homo sapiens
ctggctgagtggaatgcagggaa

SEQ ID NO: 3957675 - DNA, 20 bp, Homo sapiens
ctggctgcaagggccagagt

SEQ ID NO: 3957676 - DNA, 14 bp, Homo sapiens
ctggctgccaggcg

SEQ ID NO: 3957677 - DNA, 14 bp, Homo sapiens
ctggctgccttaga

SEQ ID NO: 3957678 - DNA, 12 bp, Homo sapiens
ctggctgctctc

SEQ ID NO: 3957679 - DNA, 17 bp, Homo sapiens
ctggctggggcagaggg

SEQ ID NO: 3957680 - DNA, 17 bp, Homo sapiens
ctggctggtagagcagg

SEQ ID NO: 3957681 - DNA, 18 bp, Homo sapiens
ctggctggtagagcaggt

SEQ ID NO: 3957682 - DNA, 21 bp, Homo sapiens
ctggctgtggaggcctgatgc

SEQ ID NO: 3957683 - DNA, 23 bp, Homo sapiens
ctggctgtggaggcctgatgctg

SEQ ID NO: 3957684 - DNA, 22 bp, Homo sapiens
ctggcttattcccaactgctct

SEQ ID NO: 3957685 - DNA, 12 bp, Homo sapiens
ctggcttccagg

SEQ ID NO: 3957686 - DNA, 14 bp, Homo sapiens
ctggcttccaggta

SEQ ID NO: 3957687 - DNA, 21 bp, Homo sapiens
ctggcttcccatccccagcga

SEQ ID NO: 3957688 - DNA, 22 bp, Homo sapiens
ctggcttcccatccccagcgat

SEQ ID NO: 3957689 - DNA, 14 bp, Homo sapiens
ctggcttctgtgca

SEQ ID NO: 3957690 - DNA, 15 bp, Homo sapiens
ctggcttgctccagg

SEQ ID NO: 3957691 - DNA, 16 bp, Homo sapiens
ctggcttgctccaggg

SEQ ID NO: 3957692 - DNA, 19 bp, Homo sapiens
ctggcttgctccagggtct

SEQ ID NO: 3957693 - DNA, 14 bp, Homo sapiens
ctggcttgcttgcc

SEQ ID NO: 3957694 - DNA, 20 bp, Homo sapiens
ctggcttgtaactccaccaa

SEQ ID NO: 3957695 - DNA, 16 bp, Homo sapiens
ctggctttgccaagct

SEQ ID NO: 3957696 - DNA, 23 bp, Homo sapiens
ctggctttgccaagcttgtgaga

SEQ ID NO: 3957697 - DNA, 18 bp, Homo sapiens
ctggctttgtctctagcc

SEQ ID NO: 3957698 - DNA, 19 bp, Homo sapiens
ctggcttttcactgctggc

SEQ ID NO: 3957699 - DNA, 15 bp, Homo sapiens
ctggcttttcgcttg

SEQ ID NO: 3957700 - DNA, 23 bp, Homo sapiens
ctggcttttcgcttgcttctgca

SEQ ID NO: 3957701 - DNA, 14 bp, Homo sapiens
ctgggaaaggaaaa

SEQ ID NO: 3957702 - DNA, 17 bp, Homo sapiens
ctgggaaataagagaga

SEQ ID NO: 3957703 - DNA, 18 bp, Homo sapiens
ctgggaacccgactgtga

SEQ ID NO: 3957704 - DNA, 19 bp, Homo sapiens
ctgggaacccgactgtgaa

SEQ ID NO: 3957705 - DNA, 19 bp, Homo sapiens
ctgggaaggggtgccctct

SEQ ID NO: 3957706 - DNA, 21 bp, Homo sapiens
ctgggaaggggtgccctctgg

SEQ ID NO: 3957707 - DNA, 23 bp, Homo sapiens
ctgggaagtcgtccttactcctg

SEQ ID NO: 3957708 - DNA, 18 bp, Homo sapiens
ctgggaccaggcaccagg

SEQ ID NO: 3957709 - DNA, 17 bp, Homo sapiens
ctgggacccagctactc

SEQ ID NO: 3957710 - DNA, 23 bp, Homo sapiens
ctgggacccagctactctgtcca

SEQ ID NO: 3957711 - DNA, 23 bp, Homo sapiens
ctgggaccccagctagggctgga

SEQ ID NO: 3957712 - DNA, 18 bp, Homo sapiens
ctgggacccctcccaacc

SEQ ID NO: 3957713 - DNA, 15 bp, Homo sapiens
ctgggaccctttcct

SEQ ID NO: 3957714 - DNA, 19 bp, Homo sapiens
ctgggaccctttccttcct

SEQ ID NO: 3957715 - DNA, 20 bp, Homo sapiens
ctgggaccctttccttcctt

SEQ ID NO: 3957716 - DNA, 20 bp, Homo sapiens
ctgggaccgctacaccactc

SEQ ID NO: 3957717 - DNA, 22 bp, Homo sapiens
ctgggaccgctacaccactctg

SEQ ID NO: 3957718 - DNA, 13 bp, Homo sapiens
ctgggagctctgc

SEQ ID NO: 3957719 - DNA, 22 bp, Homo sapiens
ctgggaggaaaagaaaagaggg

SEQ ID NO: 3957720 - DNA, 22 bp, Homo sapiens
ctgggaggcggagagtacagtg

SEQ ID NO: 3957721 - DNA, 22 bp, Homo sapiens
ctgggatgagccgctgtgagcc

SEQ ID NO: 3957722 - DNA, 19 bp, Homo sapiens
cttaattaaaagaatattt

SEQ ID NO: 3957723 - DNA, 19 bp, Homo sapiens
cttacaggtatcaggcaca

SEQ ID NO: 3957724 - DNA, 13 bp, Homo sapiens
cttacagtggagt

SEQ ID NO: 3957725 - DNA, 21 bp, Homo sapiens
cttacattagcagtttgcttt

SEQ ID NO: 3957726 - DNA, 14 bp, Homo sapiens
cttacatttttaca

SEQ ID NO: 3957727 - DNA, 17 bp, Homo sapiens
cttacatttttacaata

SEQ ID NO: 3957728 - DNA, 22 bp, Homo sapiens
cttacatttttacaataaataa

SEQ ID NO: 3957729 - DNA, 17 bp, Homo sapiens
cttaccaactttctgta

SEQ ID NO: 3957730 - DNA, 19 bp, Homo sapiens
cttaccaactttctgtaaa

SEQ ID NO: 3957731 - DNA, 20 bp, Homo sapiens
cttaccacgttactgcatac

SEQ ID NO: 3957732 - DNA, 15 bp, Homo sapiens
cttaccgtagcctcc

SEQ ID NO: 3957733 - DNA, 19 bp, Homo sapiens
cttacctaaacagatataa

SEQ ID NO: 3957734 - DNA, 22 bp, Homo sapiens
cttacctaaacagatataaatg

SEQ ID NO: 3957735 - DNA, 13 bp, Homo sapiens
cttacctcctgcc

SEQ ID NO: 3957736 - DNA, 14 bp, Homo sapiens
cttacctcctgccc

SEQ ID NO: 3957737 - DNA, 16 bp, Homo sapiens
cttacctcctgcccag

SEQ ID NO: 3957738 - DNA, 18 bp, Homo sapiens
cttacctcctgcccagga

SEQ ID NO: 3957739 - DNA, 19 bp, Homo sapiens
cttacctcctgcccaggag

SEQ ID NO: 3957740 - DNA, 13 bp, Homo sapiens
cttacctgacaca

SEQ ID NO: 3957741 - DNA, 19 bp, Homo sapiens
cttacctgacacaagagga

SEQ ID NO: 3957742 - DNA, 12 bp, Homo sapiens
cttacctgacgg

SEQ ID NO: 3957743 - DNA, 18 bp, Homo sapiens
cttactacttcttggaaa

SEQ ID NO: 3957744 - DNA, 22 bp, Homo sapiens
cttactacttcttggaaaaaaa

SEQ ID NO: 3957745 - DNA, 13 bp, Homo sapiens
cttactcacctct

SEQ ID NO: 3957746 - DNA, 15 bp, Homo sapiens
cttactcacctctct

SEQ ID NO: 3957747 - DNA, 13 bp, Homo sapiens
cttactcctgtgg

SEQ ID NO: 3957748 - DNA, 14 bp, Homo sapiens
cttactcctgtggg

SEQ ID NO: 3957749 - DNA, 19 bp, Homo sapiens
cttactctgagcccaggcc

SEQ ID NO: 3957750 - DNA, 21 bp, Homo sapiens
cttactctgagcccaggccgt

SEQ ID NO: 3957751 - DNA, 20 bp, Homo sapiens
cttacttaagtcgggggtgg

SEQ ID NO: 3957752 - DNA, 19 bp, Homo sapiens
cttagaaatcattgtagaa

SEQ ID NO: 3957753 - DNA, 20 bp, Homo sapiens
cttagaaatcattgtagaaa

SEQ ID NO: 3957754 - DNA, 11 bp, Homo sapiens
cttagaataaa

SEQ ID NO: 3957755 - DNA, 19 bp, Homo sapiens
cttagacttcgactcagga

SEQ ID NO: 3957756 - DNA, 20 bp, Homo sapiens
cttagagattgccccagagc

SEQ ID NO: 3957757 - DNA, 22 bp, Homo sapiens
cttagagattgccccagagccc

SEQ ID NO: 3957758 - DNA, 16 bp, Homo sapiens
ctgtatatgttgtaat

SEQ ID NO: 3957759 - DNA, 15 bp, Homo sapiens
ctgtatcaaatctgt

SEQ ID NO: 3957760 - DNA, 14 bp, Homo sapiens
ctgtatctgtaatt

SEQ ID NO: 3957761 - DNA, 20 bp, Homo sapiens
ctgtatctgtaattaatatt

SEQ ID NO: 3957762 - DNA, 12 bp, Homo sapiens
ctgtatgtcaga

SEQ ID NO: 3957763 - DNA, 17 bp, Homo sapiens
ctgtattcagatcgtat

SEQ ID NO: 3957764 - DNA, 20 bp, Homo sapiens
ctgtattcagatcgtattaa

SEQ ID NO: 3957765 - DNA, 17 bp, Homo sapiens
ctgtatttgttcccaag

SEQ ID NO: 3957766 - DNA, 18 bp, Homo sapiens
ctgtatttgttcccaaga

SEQ ID NO: 3957767 - DNA, 19 bp, Homo sapiens
ctgtatttgttcccaagag

SEQ ID NO: 3957768 - DNA, 10 bp, Homo sapiens
ctgtattttc

SEQ ID NO: 3957769 - DNA, 20 bp, Homo sapiens
ctgtcaagtcatgatggaga

SEQ ID NO: 3957770 - DNA, 20 bp, Homo sapiens
ctgtcaatgattattttcat

SEQ ID NO: 3957771 - DNA, 14 bp, Homo sapiens
ctgtcaccaagctc

SEQ ID NO: 3957772 - DNA, 16 bp, Homo sapiens
ctgtcaccctccacct

SEQ ID NO: 3957773 - DNA, 18 bp, Homo sapiens
ctgtcaccctccacctct

SEQ ID NO: 3957774 - DNA, 19 bp, Homo sapiens
ctgtcagagctgttggcct

SEQ ID NO: 3957775 - DNA, 20 bp, Homo sapiens
ctgtcagagctgttggcctc

SEQ ID NO: 3957776 - DNA, 13 bp, Homo sapiens
ctgtcagaggcta

SEQ ID NO: 3957777 - DNA, 16 bp, Homo sapiens
ctgtcagccagccgcc

SEQ ID NO: 3957778 - DNA, 18 bp, Homo sapiens
ctgtcagccagccgccct

SEQ ID NO: 3957779 - DNA, 19 bp, Homo sapiens
ctgtcagccagccgccctg

SEQ ID NO: 3957780 - DNA, 22 bp, Homo sapiens
ctgtcagccagccgccctgggc

SEQ ID NO: 3957781 - DNA, 23 bp, Homo sapiens
ctgtcagccagccgccctgggct

SEQ ID NO: 3957782 - DNA, 17 bp, Homo sapiens
ctgtcagcgcaggttta

SEQ ID NO: 3957783 - DNA, 23 bp, Homo sapiens
ctgtcagctcccctcggagaaga

SEQ ID NO: 3957784 - DNA, 19 bp, Homo sapiens
ctgtcataagaatgaataa

SEQ ID NO: 3957785 - DNA, 17 bp, Homo sapiens
ctgtcatcactccctgg

SEQ ID NO: 3957786 - DNA, 21 bp, Homo sapiens
ctgtcatccgtttcagctgac

SEQ ID NO: 3957787 - DNA, 15 bp, Homo sapiens
ctgtcatctagcccc

SEQ ID NO: 3957788 - DNA, 16 bp, Homo sapiens
ctgtcatctagcccct

SEQ ID NO: 3957789 - DNA, 16 bp, Homo sapiens
ctgtcatctctctggg

SEQ ID NO: 3957790 - DNA, 18 bp, Homo sapiens
ctgtcatctctctggggc

SEQ ID NO: 3957791 - DNA, 16 bp, Homo sapiens
ctgtcatggaaaagcc

SEQ ID NO: 3957792 - DNA, 19 bp, Homo sapiens
ctgtcatggaaaagcccag

SEQ ID NO: 3957793 - DNA, 20 bp, Homo sapiens
ctgtcatggaaaagcccagt

SEQ ID NO: 3957794 - DNA, 22 bp, Homo sapiens
ctgtcatggtgtccagacagag

SEQ ID NO: 3957795 - DNA, 22 bp, Homo sapiens
ctgtcattcaggaccccaaccc

SEQ ID NO: 3957796 - DNA, 20 bp, Homo sapiens
ctgtccaacctaaccccttt

SEQ ID NO: 3957797 - DNA, 22 bp, Homo sapiens
ctgtccactctcggggcccttg

SEQ ID NO: 3957798 - DNA, 18 bp, Homo sapiens
ctgtccaggcactgctgc

SEQ ID NO: 3957799 - DNA, 12 bp, Homo sapiens
ctgtccaggcca

SEQ ID NO: 3957800 - DNA, 13 bp, Homo sapiens
ctgtccaggccac

SEQ ID NO: 3957801 - DNA, 21 bp, Homo sapiens
ctgtccaggccactgtggcca

SEQ ID NO: 3957802 - DNA, 21 bp, Homo sapiens
ctgtcccagagcttattggcc

SEQ ID NO: 3957803 - DNA, 12 bp, Homo sapiens
ctgtcccagagg

SEQ ID NO: 3957804 - DNA, 23 bp, Homo sapiens
ctgtccccctgagatcagagtcc

SEQ ID NO: 3957805 - DNA, 13 bp, Homo sapiens
ctgtcccctctcc

SEQ ID NO: 3957806 - DNA, 14 bp, Homo sapiens
ctgtcccctctccc

SEQ ID NO: 3957807 - DNA, 18 bp, Homo sapiens
ctgtcccctctgtcatca

SEQ ID NO: 3957808 - DNA, 16 bp, Homo sapiens
ctgtcccggttcacct

SEQ ID NO: 3957809 - DNA, 13 bp, Homo sapiens
ctgtccctaccca

SEQ ID NO: 3957810 - DNA, 22 bp, Homo sapiens
ctgtccctacccactctttgct

SEQ ID NO: 3957811 - DNA, 23 bp, Homo sapiens
ctgtccctacccactctttgcta

SEQ ID NO: 3957812 - DNA, 15 bp, Homo sapiens
ctgtccctcaaatga

SEQ ID NO: 3957813 - DNA, 23 bp, Homo sapiens
ctgtccctcaaatgacccaaaga

SEQ ID NO: 3957814 - DNA, 14 bp, Homo sapiens
ctgtccgcctctgc

SEQ ID NO: 3957815 - DNA, 16 bp, Homo sapiens
ctgtccgcctctgccc

SEQ ID NO: 3957816 - DNA, 18 bp, Homo sapiens
ctgtccgtttactccaag

SEQ ID NO: 3957817 - DNA, 23 bp, Homo sapiens
ctgtcctcaaaataaggggcacc

SEQ ID NO: 3957818 - DNA, 16 bp, Homo sapiens
ctgtcctcccatcccc

SEQ ID NO: 3957819 - DNA, 19 bp, Homo sapiens
ctgtcctcccatcccctgg

SEQ ID NO: 3957820 - DNA, 13 bp, Homo sapiens
ctgtcctctcgag

SEQ ID NO: 3957821 - DNA, 12 bp, Homo sapiens
ctgtcctgcctc

SEQ ID NO: 3957822 - DNA, 21 bp, Homo sapiens
ctgtcctggctgctctcatgc

SEQ ID NO: 3957823 - DNA, 14 bp, Homo sapiens
ctgtccttttagga

SEQ ID NO: 3957824 - DNA, 15 bp, Homo sapiens
ctgtccttttaggaa

SEQ ID NO: 3957825 - DNA, 19 bp, Homo sapiens
ctgtccttttaggaatatg

SEQ ID NO: 3957826 - DNA, 16 bp, Homo sapiens
ctgtcgcatctcagcg

SEQ ID NO: 3957827 - DNA, 18 bp, Homo sapiens
ctgtcgccccaggccctc

SEQ ID NO: 3957828 - DNA, 22 bp, Homo sapiens
ctgtcgccccaggccctccctg

SEQ ID NO: 3957829 - DNA, 14 bp, Homo sapiens
ctgtcgctgcttcg

SEQ ID NO: 3957830 - DNA, 13 bp, Homo sapiens
ctgtctaaaaaac

SEQ ID NO: 3957831 - DNA, 23 bp, Homo sapiens
ctgtctcaagagggcactggtgg

SEQ ID NO: 3957832 - DNA, 20 bp, Homo sapiens
ctgtctcaagctcttcctta

SEQ ID NO: 3957833 - DNA, 15 bp, Homo sapiens
ctgtctcgagcgccc

SEQ ID NO: 3957834 - DNA, 16 bp, Homo sapiens
ctgtctcgagcgccct

SEQ ID NO: 3957835 - DNA, 19 bp, Homo sapiens
ctgtctcgagcgccctgca

SEQ ID NO: 3957836 - DNA, 20 bp, Homo sapiens
ctgtctctagtttctttctg

SEQ ID NO: 3957837 - DNA, 11 bp, Homo sapiens
ctgtctctctt

SEQ ID NO: 3957838 - DNA, 15 bp, Homo sapiens
ctgtctctcttgctt

SEQ ID NO: 3957839 - DNA, 19 bp, Homo sapiens
ctgtctctcttgctttgtt

SEQ ID NO: 3957840 - DNA, 20 bp, Homo sapiens
ctgtctctcttgctttgttc

SEQ ID NO: 3957841 - DNA, 13 bp, Homo sapiens
ctgtctctgcctg

SEQ ID NO: 3957842 - DNA, 19 bp, Homo sapiens
ctgtctggtgtagctcctc

SEQ ID NO: 3957843 - DNA, 14 bp, Homo sapiens
ctgtctgtcctgga

SEQ ID NO: 3957844 - DNA, 18 bp, Homo sapiens
ctggtaatttgtatctga

SEQ ID NO: 3957845 - DNA, 14 bp, Homo sapiens
ctggtacagcaggg

SEQ ID NO: 3957846 - DNA, 15 bp, Homo sapiens
ctggtacagcagggt

SEQ ID NO: 3957847 - DNA, 22 bp, Homo sapiens
ctggtacagcagggtcttgctg

SEQ ID NO: 3957848 - DNA, 13 bp, Homo sapiens
ctggtagagcagg

SEQ ID NO: 3957849 - DNA, 18 bp, Homo sapiens
ctggtatgaacttgagga

SEQ ID NO: 3957850 - DNA, 17 bp, Homo sapiens
ctggtcaggtatttcag

SEQ ID NO: 3957851 - DNA, 19 bp, Homo sapiens
ctggtccagggcctgggaa

SEQ ID NO: 3957852 - DNA, 21 bp, Homo sapiens
ctggtcgtgaactcctgagct

SEQ ID NO: 3957853 - DNA, 19 bp, Homo sapiens
ctggtctcgaactcctgac

SEQ ID NO: 3957854 - DNA, 12 bp, Homo sapiens
ctggtctgaggg

SEQ ID NO: 3957855 - DNA, 15 bp, Homo sapiens
ctggtctttcctctg

SEQ ID NO: 3957856 - DNA, 14 bp, Homo sapiens
ctggtgaggcccag

SEQ ID NO: 3957857 - DNA, 18 bp, Homo sapiens
ctggtgaggcccagcctg

SEQ ID NO: 3957858 - DNA, 20 bp, Homo sapiens
ctggtgcagaggtgagcaga

SEQ ID NO: 3957859 - DNA, 23 bp, Homo sapiens
ctggtgcagaggtgagcagagga

SEQ ID NO: 3957860 - DNA, 17 bp, Homo sapiens
ctggtgcctatttattc

SEQ ID NO: 3957861 - DNA, 21 bp, Homo sapiens
ctggtgctataggctggagaa

SEQ ID NO: 3957862 - DNA, 14 bp, Homo sapiens
ctggtgctgcaagg

SEQ ID NO: 3957863 - DNA, 16 bp, Homo sapiens
ctggtgctgcaaggaa

SEQ ID NO: 3957864 - DNA, 12 bp, Homo sapiens
ctggtgctgcca

SEQ ID NO: 3957865 - DNA, 13 bp, Homo sapiens
ctggtgctgccac

SEQ ID NO: 3957866 - DNA, 16 bp, Homo sapiens
ctggtgctgtggccag

SEQ ID NO: 3957867 - DNA, 20 bp, Homo sapiens
ctggtgctgtggccagggtg

SEQ ID NO: 3957868 - DNA, 18 bp, Homo sapiens
ctggtggcaccagatgca

SEQ ID NO: 3957869 - DNA, 17 bp, Homo sapiens
ctggtggggcagctcct

SEQ ID NO: 3957870 - DNA, 15 bp, Homo sapiens
ctggtgtcaggcagg

SEQ ID NO: 3957871 - DNA, 20 bp, Homo sapiens
ctggttcaagagacactgct

SEQ ID NO: 3957872 - DNA, 19 bp, Homo sapiens
ctggttgctacattttcag

SEQ ID NO: 3957873 - DNA, 18 bp, Homo sapiens
ctgtaaacccctgggtaa

SEQ ID NO: 3957874 - DNA, 22 bp, Homo sapiens
ctgtaaacccctgggtaactgt

SEQ ID NO: 3957875 - DNA, 16 bp, Homo sapiens
ctgtaaactataaact

SEQ ID NO: 3957876 - DNA, 22 bp, Homo sapiens
ctgtaaactcaaaacttaacat

SEQ ID NO: 3957877 - DNA, 15 bp, Homo sapiens
ctgtaaatacatgtg

SEQ ID NO: 3957878 - DNA, 18 bp, Homo sapiens
ctgtaaatacatgtgtgg

SEQ ID NO: 3957879 - DNA, 19 bp, Homo sapiens
ctgtaaatatgtttgtgcc

SEQ ID NO: 3957880 - DNA, 15 bp, Homo sapiens
ctgtaaatcacttgt

SEQ ID NO: 3957881 - DNA, 21 bp, Homo sapiens
ctgtaacacaagccacagaag

SEQ ID NO: 3957882 - DNA, 15 bp, Homo sapiens
ctgtaacacagctga

SEQ ID NO: 3957883 - DNA, 14 bp, Homo sapiens
ctgtaactgctgag

SEQ ID NO: 3957884 - DNA, 17 bp, Homo sapiens
ctgtaactgctgagcca

SEQ ID NO: 3957885 - DNA, 20 bp, Homo sapiens
ctgtaagcattctgagctgg

SEQ ID NO: 3957886 - DNA, 23 bp, Homo sapiens
ctgtaagtttattttttctacac

SEQ ID NO: 3957887 - DNA, 19 bp, Homo sapiens
ctgtaatcagttatgccgt

SEQ ID NO: 3957888 - DNA, 13 bp, Homo sapiens
ctgtaatcccagc

SEQ ID NO: 3957889 - DNA, 14 bp, Homo sapiens
ctgtaatcccagct

SEQ ID NO: 3957890 - DNA, 19 bp, Homo sapiens
ctgtaattaagtaaaccaa

SEQ ID NO: 3957891 - DNA, 15 bp, Homo sapiens
ctgtaattaagtgca

SEQ ID NO: 3957892 - DNA, 16 bp, Homo sapiens
ctgtaattaagtgcaa

SEQ ID NO: 3957893 - DNA, 17 bp, Homo sapiens
ctgtaattaagtgcaat

SEQ ID NO: 3957894 - DNA, 18 bp, Homo sapiens
ctgtaattaagtgcaatt

SEQ ID NO: 3957895 - DNA, 23 bp, Homo sapiens
ctgtacccagctccttttgtccc

SEQ ID NO: 3957896 - DNA, 13 bp, Homo sapiens
ctgtacccttcca

SEQ ID NO: 3957897 - DNA, 21 bp, Homo sapiens
ctgtacccttccacctcctag

SEQ ID NO: 3957898 - DNA, 16 bp, Homo sapiens
ctgtactcagagcaga

SEQ ID NO: 3957899 - DNA, 16 bp, Homo sapiens
ctgtactcctcccagg

SEQ ID NO: 3957900 - DNA, 19 bp, Homo sapiens
ctgtactcctcccaggcgc

SEQ ID NO: 3957901 - DNA, 14 bp, Homo sapiens
ctgtactgcctgct

SEQ ID NO: 3957902 - DNA, 13 bp, Homo sapiens
ctgtagaaagaat

SEQ ID NO: 3957903 - DNA, 22 bp, Homo sapiens
ctgtagaaagaatgtgttgcct

SEQ ID NO: 3957904 - DNA, 19 bp, Homo sapiens
ctgtagaacacccctgtgc

SEQ ID NO: 3957905 - DNA, 21 bp, Homo sapiens
ctgtagagctagaacatggag

SEQ ID NO: 3957906 - DNA, 20 bp, Homo sapiens
ctgtagcagtgagaaaaagc

SEQ ID NO: 3957907 - DNA, 18 bp, Homo sapiens
ctgtagcatcttctggag

SEQ ID NO: 3957908 - DNA, 19 bp, Homo sapiens
ctgtagcatcttctggagt

SEQ ID NO: 3957909 - DNA, 12 bp, Homo sapiens
ctgtagccatgg

SEQ ID NO: 3957910 - DNA, 18 bp, Homo sapiens
ctgtagccatggctcagg

SEQ ID NO: 3957911 - DNA, 19 bp, Homo sapiens
ctgtagccatggctcaggc

SEQ ID NO: 3957912 - DNA, 19 bp, Homo sapiens
ctgtagctcccgagctact

SEQ ID NO: 3957913 - DNA, 15 bp, Homo sapiens
ctgtagctctgcctc

SEQ ID NO: 3957914 - DNA, 16 bp, Homo sapiens
ctgtagggctggacct

SEQ ID NO: 3957915 - DNA, 18 bp, Homo sapiens
ctgtagggctggacctat

SEQ ID NO: 3957916 - DNA, 22 bp, Homo sapiens
ctgtaggttgcttaaaagggac

SEQ ID NO: 3957917 - DNA, 13 bp, Homo sapiens
ctgtagtcacttt

SEQ ID NO: 3957918 - DNA, 17 bp, Homo sapiens
ctgtagtcccagccact

SEQ ID NO: 3957919 - DNA, 13 bp, Homo sapiens
ctgtagtgagaaa

SEQ ID NO: 3957920 - DNA, 18 bp, Homo sapiens
ctgtagtgagaaactgat

SEQ ID NO: 3957921 - DNA, 21 bp, Homo sapiens
ctgtagtgccccctctaaccc

SEQ ID NO: 3957922 - DNA, 18 bp, Homo sapiens
ctgtataaacattaaatg

SEQ ID NO: 3957923 - DNA, 21 bp, Homo sapiens
ctgtataaacattaaatgtct

SEQ ID NO: 3957924 - DNA, 17 bp, Homo sapiens
ctgtataatttaacagt

SEQ ID NO: 3957925 - DNA, 16 bp, Homo sapiens
ctgtatagacagcact

SEQ ID NO: 3957926 - DNA, 15 bp, Homo sapiens
ctgtatatacaataa

SEQ ID NO: 3957927 - DNA, 19 bp, Homo sapiens
ctgtatatacaataacata

SEQ ID NO: 3957928 - DNA, 16 bp, Homo sapiens
ctgtatatatatatgt

SEQ ID NO: 3957929 - DNA, 18 bp, Homo sapiens
ctgtatatatatatgtgt

SEQ ID NO: 3957930 - DNA, 13 bp, Homo sapiens
cttcacagtgttt

SEQ ID NO: 3957931 - DNA, 23 bp, Homo sapiens
cttcaccagcaactctgactctt

SEQ ID NO: 3957932 - DNA, 22 bp, Homo sapiens
cttcacccagctaatctgtagg

SEQ ID NO: 3957933 - DNA, 16 bp, Homo sapiens
cttcacccctgcactt

SEQ ID NO: 3957934 - DNA, 16 bp, Homo sapiens
cttcacccgctgcagc

SEQ ID NO: 3957935 - DNA, 22 bp, Homo sapiens
cttcacctgggcgccaactgct

SEQ ID NO: 3957936 - DNA, 16 bp, Homo sapiens
cttcacctttggtgca

SEQ ID NO: 3957937 - DNA, 13 bp, Homo sapiens
cttcactcagcca

SEQ ID NO: 3957938 - DNA, 14 bp, Homo sapiens
cttcactcagccac

SEQ ID NO: 3957939 - DNA, 15 bp, Homo sapiens
cttcactcagccaca

SEQ ID NO: 3957940 - DNA, 16 bp, Homo sapiens
cttcactcagccacac

SEQ ID NO: 3957941 - DNA, 15 bp, Homo sapiens
cttcactgttgaaaa

SEQ ID NO: 3957942 - DNA, 18 bp, Homo sapiens
cttcagaacatgctggat

SEQ ID NO: 3957943 - DNA, 17 bp, Homo sapiens
cttcagaagacactgca

SEQ ID NO: 3957944 - DNA, 14 bp, Homo sapiens
cttcagagcctagc

SEQ ID NO: 3957945 - DNA, 23 bp, Homo sapiens
cttcagagcctagccacctccca

SEQ ID NO: 3957946 - DNA, 15 bp, Homo sapiens
cttcagcgagaccct

SEQ ID NO: 3957947 - DNA, 11 bp, Homo sapiens
cttcagctccc

SEQ ID NO: 3957948 - DNA, 15 bp, Homo sapiens
cttcagctcccatag

SEQ ID NO: 3957949 - DNA, 14 bp, Homo sapiens
cttcagctttggtg

SEQ ID NO: 3957950 - DNA, 22 bp, Homo sapiens
cttcaggaggccctggtgtcag

SEQ ID NO: 3957951 - DNA, 14 bp, Homo sapiens
cttcaggctcttct

SEQ ID NO: 3957952 - DNA, 17 bp, Homo sapiens
cttcaggctcttctcct

SEQ ID NO: 3957953 - DNA, 22 bp, Homo sapiens
cttcaggctcttctcctttcac

SEQ ID NO: 3957954 - DNA, 18 bp, Homo sapiens
cttcagggccagaaggag

SEQ ID NO: 3957955 - DNA, 21 bp, Homo sapiens
cttcagggccagaaggagggc

SEQ ID NO: 3957956 - DNA, 16 bp, Homo sapiens
cttcaggtggaaaaac

SEQ ID NO: 3957957 - DNA, 16 bp, Homo sapiens
cttcaggttgttctgt

SEQ ID NO: 3957958 - DNA, 13 bp, Homo sapiens
cttcttcttcaga

SEQ ID NO: 3957959 - DNA, 17 bp, Homo sapiens
cttcttgaaacagcctg

SEQ ID NO: 3957960 - DNA, 14 bp, Homo sapiens
cttcttggaaaaaa

SEQ ID NO: 3957961 - DNA, 21 bp, Homo sapiens
cttcttggtttggggagaaat

SEQ ID NO: 3957962 - DNA, 11 bp, Homo sapiens
cttctttcctc

SEQ ID NO: 3957963 - DNA, 15 bp, Homo sapiens
cttctttctcttccc

SEQ ID NO: 3957964 - DNA, 15 bp, Homo sapiens
cttctttttattttc

SEQ ID NO: 3957965 - DNA, 18 bp, Homo sapiens
cttctttttctttgagaa

SEQ ID NO: 3957966 - DNA, 15 bp, Homo sapiens
cttgaaacagcctgg

SEQ ID NO: 3957967 - DNA, 17 bp, Homo sapiens
cttgaaataccagtgaa

SEQ ID NO: 3957968 - DNA, 22 bp, Homo sapiens
cttgaaataccagtgaaccaaa

SEQ ID NO: 3957969 - DNA, 22 bp, Homo sapiens
cttgaactgttctggcctcaga

SEQ ID NO: 3957970 - DNA, 15 bp, Homo sapiens
cttgaactttccaaa

SEQ ID NO: 3957971 - DNA, 16 bp, Homo sapiens
cttgaactttccaaaa

SEQ ID NO: 3957972 - DNA, 18 bp, Homo sapiens
cttgaagcacagagggct

SEQ ID NO: 3957973 - DNA, 16 bp, Homo sapiens
cttgaagggtaaagaa

SEQ ID NO: 3957974 - DNA, 16 bp, Homo sapiens
cttgacaacagactga

SEQ ID NO: 3957975 - DNA, 15 bp, Homo sapiens
cttgacacggtgaaa

SEQ ID NO: 3957976 - DNA, 22 bp, Homo sapiens
cttgacacggtgaaatccaggt

SEQ ID NO: 3957977 - DNA, 11 bp, Homo sapiens
cttgaccagac

SEQ ID NO: 3957978 - DNA, 13 bp, Homo sapiens
cttgaccagacct

SEQ ID NO: 3957979 - DNA, 21 bp, Homo sapiens
cttgactatcacatacaattt

SEQ ID NO: 3957980 - DNA, 22 bp, Homo sapiens
cttgactatcacatacaatttg

SEQ ID NO: 3957981 - DNA, 16 bp, Homo sapiens
cttgagacctcagcca

SEQ ID NO: 3957982 - DNA, 21 bp, Homo sapiens
cttgagagaaaaagtgcccct

SEQ ID NO: 3957983 - DNA, 15 bp, Homo sapiens
cttggggctcgcccc

SEQ ID NO: 3957984 - DNA, 24 bp, Homo sapiens
cttgggggatgactagaggcaggg

SEQ ID NO: 3957985 - DNA, 24 bp, Homo sapiens
cttggggggtgatgagggcagcag

SEQ ID NO: 3957986 - DNA, 17 bp, Homo sapiens
cttggggtaagccagag

SEQ ID NO: 3957987 - DNA, 19 bp, Homo sapiens
cttggggtaagccagagcc

SEQ ID NO: 3957988 - DNA, 20 bp, Homo sapiens
cttggggttttcagtatgaa

SEQ ID NO: 3957989 - DNA, 20 bp, Homo sapiens
cttggtctgatttcaggata

SEQ ID NO: 3957990 - DNA, 15 bp, Homo sapiens
cttggtggctgagct

SEQ ID NO: 3957991 - DNA, 15 bp, Homo sapiens
cttggtgtccacctg

SEQ ID NO: 3957992 - DNA, 21 bp, Homo sapiens
cttggttggctggcagctgag

SEQ ID NO: 3957993 - DNA, 12 bp, Homo sapiens
cttgtaaataca

SEQ ID NO: 3957994 - DNA, 14 bp, Homo sapiens
cttgtaactccacc

SEQ ID NO: 3957995 - DNA, 17 bp, Homo sapiens
cttgtaactccaccaac

SEQ ID NO: 3957996 - DNA, 13 bp, Homo sapiens
cttgtaccccatc

SEQ ID NO: 3957997 - DNA, 17 bp, Homo sapiens
cttgtagaaatctgtaa

SEQ ID NO: 3957998 - DNA, 21 bp, Homo sapiens
cttgtagaccactgtcctggc

SEQ ID NO: 3957999 - DNA, 15 bp, Homo sapiens
cttgtagccagccgg

SEQ ID NO: 3958000 - DNA, 23 bp, Homo sapiens
cttgtatatacatattataaata

SEQ ID NO: 3958001 - DNA, 21 bp, Homo sapiens
cttgtcactatgctatttctg

SEQ ID NO: 3958002 - DNA, 15 bp, Homo sapiens
cttgtcactggtaga

SEQ ID NO: 3958003 - DNA, 13 bp, Homo sapiens
cttgtcaggaccc

SEQ ID NO: 3958004 - DNA, 16 bp, Homo sapiens
cttgtcaggacccagg

SEQ ID NO: 3958005 - DNA, 22 bp, Homo sapiens
cttgtcaggacccaggccgcct

SEQ ID NO: 3958006 - DNA, 24 bp, Homo sapiens
cttgtccacagtctcccattctca

SEQ ID NO: 3958007 - DNA, 16 bp, Homo sapiens
cttgtcctatgtcaat

SEQ ID NO: 3958008 - DNA, 15 bp, Homo sapiens
cttgtcctgctctct

SEQ ID NO: 3958009 - DNA, 22 bp, Homo sapiens
cttgtctctcattctctttctt

SEQ ID NO: 3958010 - DNA, 13 bp, Homo sapiens
cttgtctgaggcc

SEQ ID NO: 3958011 - DNA, 14 bp, Homo sapiens
cttgtctgaggcct

SEQ ID NO: 3958012 - DNA, 14 bp, Homo sapiens
cttgtgagagctgg

SEQ ID NO: 3958013 - DNA, 21 bp, Homo sapiens
cttgtgattctgggatggacc

SEQ ID NO: 3958014 - DNA, 16 bp, Homo sapiens
cttgtgccctgccccc

SEQ ID NO: 3958015 - DNA, 13 bp, Homo sapiens
cttgtgcctcagc

SEQ ID NO: 3958016 - DNA, 23 bp, Homo sapiens
cttgtgctcacgctcccccgcag

SEQ ID NO: 3958017 - DNA, 22 bp, Homo sapiens
cttgtgcttggtggggctcgtg

SEQ ID NO: 3958018 - DNA, 10 bp, Homo sapiens
cttgtgtatg

SEQ ID NO: 3958019 - DNA, 18 bp, Homo sapiens
cttgtgtctctgtgcttt

SEQ ID NO: 3958020 - DNA, 21 bp, Homo sapiens
cttgtgtctctgtgcttttaa

SEQ ID NO: 3958021 - DNA, 18 bp, Homo sapiens
cttgttgtttttaagtcc

SEQ ID NO: 3958022 - DNA, 19 bp, Homo sapiens
cttgtttggggcaggagta

SEQ ID NO: 3958023 - DNA, 14 bp, Homo sapiens
cttgttttcagttt

SEQ ID NO: 3958024 - DNA, 21 bp, Homo sapiens
cttgttttttttttccactta

SEQ ID NO: 3958025 - DNA, 12 bp, Homo sapiens
ctttaaaaaagc

SEQ ID NO: 3958026 - DNA, 16 bp, Homo sapiens
ctttaaagacttaaga

SEQ ID NO: 3958027 - DNA, 18 bp, Homo sapiens
ctttaaagacttaagatt

SEQ ID NO: 3958028 - DNA, 20 bp, Homo sapiens
ctttaaagggatggcaagat

SEQ ID NO: 3958029 - DNA, 17 bp, Homo sapiens
ctttaaagtacctgtag

SEQ ID NO: 3958030 - DNA, 18 bp, Homo sapiens
ctttaaagtacctgtagt

SEQ ID NO: 3958031 - DNA, 12 bp, Homo sapiens
ctttaaatcaaa

SEQ ID NO: 3958032 - DNA, 18 bp, Homo sapiens
ctttaaatcaaaagctgc

SEQ ID NO: 3958033 - DNA, 21 bp, Homo sapiens
ctttaaatcaaaagctgcttg

SEQ ID NO: 3958034 - DNA, 18 bp, Homo sapiens
ctttaacaaaacaagaaa

SEQ ID NO: 3958035 - DNA, 20 bp, Homo sapiens
ctttaacaaaacaagaaaga

SEQ ID NO: 3958036 - DNA, 16 bp, Homo sapiens
ctttaagtattgtttt

SEQ ID NO: 3958037 - DNA, 20 bp, Homo sapiens
ctttaatactcacctcctcc

SEQ ID NO: 3958038 - DNA, 13 bp, Homo sapiens
ctttaatcccagt

SEQ ID NO: 3958039 - DNA, 20 bp, Homo sapiens
ctttaatgtgtattgaagaa

SEQ ID NO: 3958040 - DNA, 14 bp, Homo sapiens
ctttacacacacag

SEQ ID NO: 3958041 - DNA, 21 bp, Homo sapiens
ctttacaggtatttataatat

SEQ ID NO: 3958042 - DNA, 18 bp, Homo sapiens
ctttacataattgcaata

SEQ ID NO: 3958043 - DNA, 19 bp, Homo sapiens
ctttacatgcaatttatta

SEQ ID NO: 3958044 - DNA, 20 bp, Homo sapiens
ctttacatgctgtgctcttt

SEQ ID NO: 3958045 - DNA, 13 bp, Homo sapiens
ctttaccactatg

SEQ ID NO: 3958046 - DNA, 13 bp, Homo sapiens
gaaaggacccacc

SEQ ID NO: 3958047 - DNA, 21 bp, Homo sapiens
gaaaggaggcatgcctctgat

SEQ ID NO: 3958048 - DNA, 22 bp, Homo sapiens
gaaaggatgtaaacagtgcctg

SEQ ID NO: 3958049 - DNA, 19 bp, Homo sapiens
gaaaggattaagatacact

SEQ ID NO: 3958050 - DNA, 22 bp, Homo sapiens
gaaaggattaagatacactcct

SEQ ID NO: 3958051 - DNA, 19 bp, Homo sapiens
gaaagggagggctctgagg

SEQ ID NO: 3958052 - DNA, 18 bp, Homo sapiens
gaaaggttaccctgtaac

SEQ ID NO: 3958053 - DNA, 16 bp, Homo sapiens
gaaaggtttcaagact

SEQ ID NO: 3958054 - DNA, 14 bp, Homo sapiens
gaaagtatattttc

SEQ ID NO: 3958055 - DNA, 18 bp, Homo sapiens
gaaagtatgtgatatctg

SEQ ID NO: 3958056 - DNA, 22 bp, Homo sapiens
gaaagtcgaattaatagctttt

SEQ ID NO: 3958057 - DNA, 22 bp, Homo sapiens
gaaagtgaataaacttcagcac

SEQ ID NO: 3958058 - DNA, 21 bp, Homo sapiens
gaaagtgatatcccccagcct

SEQ ID NO: 3958059 - DNA, 20 bp, Homo sapiens
gaaagtgcaaagtgccctca

SEQ ID NO: 3958060 - DNA, 12 bp, Homo sapiens
gaaagtgcagaa

SEQ ID NO: 3958061 - DNA, 21 bp, Homo sapiens
gaaagtggccatgccaccctg

SEQ ID NO: 3958062 - DNA, 16 bp, Homo sapiens
gaaagtgtaaaataga

SEQ ID NO: 3958063 - DNA, 15 bp, Homo sapiens
gaaagttattgtgtt

SEQ ID NO: 3958064 - DNA, 22 bp, Homo sapiens
gaaagttattgtgttgccttag

SEQ ID NO: 3958065 - DNA, 14 bp, Homo sapiens
gaaagttcagccag

SEQ ID NO: 3958066 - DNA, 15 bp, Homo sapiens
gaaagttcagccaga

SEQ ID NO: 3958067 - DNA, 23 bp, Homo sapiens
gaaataaaaagcatgactatttc

SEQ ID NO: 3958068 - DNA, 18 bp, Homo sapiens
gaaataaaacctttcaaa

SEQ ID NO: 3958069 - DNA, 12 bp, Homo sapiens
gaaataaaatcc

SEQ ID NO: 3958070 - DNA, 18 bp, Homo sapiens
gaaataaacctggagatg

SEQ ID NO: 3958071 - DNA, 19 bp, Homo sapiens
gaaataaacctggagatga

SEQ ID NO: 3958072 - DNA, 22 bp, Homo sapiens
gaaataaacctggagatgatga

SEQ ID NO: 3958073 - DNA, 14 bp, Homo sapiens
gaaataaattggtg

SEQ ID NO: 3958074 - DNA, 24 bp, Homo sapiens
gaaataagaaacacaaatgtaaaa

SEQ ID NO: 3958075 - DNA, 19 bp, Homo sapiens
gaaatagacagtatattta

SEQ ID NO: 3958076 - DNA, 14 bp, Homo sapiens
gaaatatatataca

SEQ ID NO: 3958077 - DNA, 16 bp, Homo sapiens
gaaatatatatacata

SEQ ID NO: 3958078 - DNA, 19 bp, Homo sapiens
gaaatatatatacatatgt

SEQ ID NO: 3958079 - DNA, 21 bp, Homo sapiens
gaaatatcagttactcagccc

SEQ ID NO: 3958080 - DNA, 19 bp, Homo sapiens
gaaatatttaagtatatag

SEQ ID NO: 3958081 - DNA, 17 bp, Homo sapiens
gaaatcaaatatgcaaa

SEQ ID NO: 3958082 - DNA, 21 bp, Homo sapiens
gaaatcaaatatgcaaagcac

SEQ ID NO: 3958083 - DNA, 19 bp, Homo sapiens
gaaatccagtttcccacca

SEQ ID NO: 3958084 - DNA, 18 bp, Homo sapiens
gaaatccctgtttaatat

SEQ ID NO: 3958085 - DNA, 23 bp, Homo sapiens
gaaatccctgtttaatatttaaa

SEQ ID NO: 3958086 - DNA, 15 bp, Homo sapiens
gaaatcttaaaaacc

SEQ ID NO: 3958087 - DNA, 17 bp, Homo sapiens
gaaatgcaaaaatctct

SEQ ID NO: 3958088 - DNA, 17 bp, Homo sapiens
gaaattatttaataaaa

SEQ ID NO: 3958089 - DNA, 19 bp, Homo sapiens
gaaattcccccacttggga

SEQ ID NO: 3958090 - DNA, 21 bp, Homo sapiens
gaaatttattagttaatatat

SEQ ID NO: 3958091 - DNA, 19 bp, Homo sapiens
gaaatttatttccatctag

SEQ ID NO: 3958092 - DNA, 21 bp, Homo sapiens
gaaatttgatttctattcaag

SEQ ID NO: 3958093 - DNA, 20 bp, Homo sapiens
gaaattttctagactttctg

SEQ ID NO: 3958094 - DNA, 21 bp, Homo sapiens
gaaattttctagactttctgt

SEQ ID NO: 3958095 - DNA, 17 bp, Homo sapiens
gaaatttttatttttct

SEQ ID NO: 3958096 - DNA, 17 bp, Homo sapiens
gaacaaacactgaatca

SEQ ID NO: 3958097 - DNA, 21 bp, Homo sapiens
gaacaaagaacggcatgtgaa

SEQ ID NO: 3958098 - DNA, 22 bp, Homo sapiens
gaacaaatcacacctctgggct

SEQ ID NO: 3958099 - DNA, 18 bp, Homo sapiens
gaacaactatttataaac

SEQ ID NO: 3958100 - DNA, 19 bp, Homo sapiens
gaacaatagctattgcatg

SEQ ID NO: 3958101 - DNA, 22 bp, Homo sapiens
gaacaatagctattgcatgtaa

SEQ ID NO: 3958102 - DNA, 14 bp, Homo sapiens
gaacacactcagca

SEQ ID NO: 3958103 - DNA, 15 bp, Homo sapiens
gaacacactcagcag

SEQ ID NO: 3958104 - DNA, 17 bp, Homo sapiens
gaacacaggcaaaatcc

SEQ ID NO: 3958105 - DNA, 20 bp, Homo sapiens
gaacacagtttagtgcttta

SEQ ID NO: 3958106 - DNA, 18 bp, Homo sapiens
gaacacatactagaaagc

SEQ ID NO: 3958107 - DNA, 20 bp, Homo sapiens
gaacaccactttgtctctga

SEQ ID NO: 3958108 - DNA, 12 bp, Homo sapiens
gaacacccactg

SEQ ID NO: 3958109 - DNA, 13 bp, Homo sapiens
gaacacccactgg

SEQ ID NO: 3958110 - DNA, 22 bp, Homo sapiens
gaacacctttgttttgcactga

SEQ ID NO: 3958111 - DNA, 22 bp, Homo sapiens
gaacacgtccagaatttttcat

SEQ ID NO: 3958112 - DNA, 15 bp, Homo sapiens
gaacagacaggagaa

SEQ ID NO: 3958113 - DNA, 15 bp, Homo sapiens
gaacagagactctgg

SEQ ID NO: 3958114 - DNA, 19 bp, Homo sapiens
gaacagagactctggaagc

SEQ ID NO: 3958115 - DNA, 22 bp, Homo sapiens
gaacagccaaatgcatggtgca

SEQ ID NO: 3958116 - DNA, 17 bp, Homo sapiens
ctttgggaggccaaggc

SEQ ID NO: 3958117 - DNA, 15 bp, Homo sapiens
ctttgggctgccctg

SEQ ID NO: 3958118 - DNA, 19 bp, Homo sapiens
ctttgggctgccctggtgc

SEQ ID NO: 3958119 - DNA, 12 bp, Homo sapiens
ctttgggctttg

SEQ ID NO: 3958120 - DNA, 17 bp, Homo sapiens
ctttgggctttgcaggc

SEQ ID NO: 3958121 - DNA, 19 bp, Homo sapiens
ctttgggctttgcaggctc

SEQ ID NO: 3958122 - DNA, 21 bp, Homo sapiens
ctttgggctttgcaggctctg

SEQ ID NO: 3958123 - DNA, 23 bp, Homo sapiens
ctttgggctttgcaggctctggg

SEQ ID NO: 3958124 - DNA, 19 bp, Homo sapiens
ctttggggacagttggcag

SEQ ID NO: 3958125 - DNA, 20 bp, Homo sapiens
ctttggggacagttggcaga

SEQ ID NO: 3958126 - DNA, 22 bp, Homo sapiens
ctttggggacagttggcagaga

SEQ ID NO: 3958127 - DNA, 24 bp, Homo sapiens
ctttggggacagttggcagagaag

SEQ ID NO: 3958128 - DNA, 20 bp, Homo sapiens
ctttggtttaatttaaagcc

SEQ ID NO: 3958129 - DNA, 17 bp, Homo sapiens
ctttgtgataacaaaga

SEQ ID NO: 3958130 - DNA, 13 bp, Homo sapiens
ctttgtgcctttg

SEQ ID NO: 3958131 - DNA, 20 bp, Homo sapiens
ctttgtgggagggtaagaca

SEQ ID NO: 3958132 - DNA, 21 bp, Homo sapiens
ctttgtgggagggtaagacaa

SEQ ID NO: 3958133 - DNA, 16 bp, Homo sapiens
ctttgtgtagctttgc

SEQ ID NO: 3958134 - DNA, 15 bp, Homo sapiens
ctttgtttactaaag

SEQ ID NO: 3958135 - DNA, 15 bp, Homo sapiens
ctttgttttgcactg

SEQ ID NO: 3958136 - DNA, 17 bp, Homo sapiens
cttttaaagaagtaaat

SEQ ID NO: 3958137 - DNA, 14 bp, Homo sapiens
cttttaatcagaca

SEQ ID NO: 3958138 - DNA, 19 bp, Homo sapiens
cttttactcctttgcattc

SEQ ID NO: 3958139 - DNA, 22 bp, Homo sapiens
cttttaggaatatgttcaatgc

SEQ ID NO: 3958140 - DNA, 18 bp, Homo sapiens
cttttataccagagacct

SEQ ID NO: 3958141 - DNA, 17 bp, Homo sapiens
cttttatagctattact

SEQ ID NO: 3958142 - DNA, 18 bp, Homo sapiens
cttttatagctattactg

SEQ ID NO: 3958143 - DNA, 19 bp, Homo sapiens
cttttattgtataaactat

SEQ ID NO: 3958144 - DNA, 21 bp, Homo sapiens
cttttcaagttgagaacaaaa

SEQ ID NO: 3958145 - DNA, 21 bp, Homo sapiens
cttttcatctccagtgtgaat

SEQ ID NO: 3958146 - DNA, 22 bp, Homo sapiens
cttttccaggagttctgaagct

SEQ ID NO: 3958147 - DNA, 20 bp, Homo sapiens
cttttccaggatcctgcagg

SEQ ID NO: 3958148 - DNA, 21 bp, Homo sapiens
cttttccaggatcctgcagga

SEQ ID NO: 3958149 - DNA, 14 bp, Homo sapiens
cttttccctctcta

SEQ ID NO: 3958150 - DNA, 14 bp, Homo sapiens
cttttcccttcttt

SEQ ID NO: 3958151 - DNA, 19 bp, Homo sapiens
cttttcctattttcagccc

SEQ ID NO: 3958152 - DNA, 17 bp, Homo sapiens
cttttctaatctctttt

SEQ ID NO: 3958153 - DNA, 14 bp, Homo sapiens
cttttctcccatat

SEQ ID NO: 3958154 - DNA, 14 bp, Homo sapiens
cttttctctcccat

SEQ ID NO: 3958155 - DNA, 14 bp, Homo sapiens
cttttctgttgtac

SEQ ID NO: 3958156 - DNA, 14 bp, Homo sapiens
cttttcttccttct

SEQ ID NO: 3958157 - DNA, 19 bp, Homo sapiens
cttttctttattgctgtga

SEQ ID NO: 3958158 - DNA, 20 bp, Homo sapiens
cttttgaagtagtttgtata

SEQ ID NO: 3958159 - DNA, 15 bp, Homo sapiens
cttttgatggggaga

SEQ ID NO: 3958160 - DNA, 22 bp, Homo sapiens
cttttgcataagattaaaggaa

SEQ ID NO: 3958161 - DNA, 19 bp, Homo sapiens
cttttgccactttggcttc

SEQ ID NO: 3958162 - DNA, 15 bp, Homo sapiens
cttttgcctggctgt

SEQ ID NO: 3958163 - DNA, 15 bp, Homo sapiens
cttttgctgtctttc

SEQ ID NO: 3958164 - DNA, 18 bp, Homo sapiens
cttttgcttggcagagag

SEQ ID NO: 3958165 - DNA, 14 bp, Homo sapiens
cttttggccttgtg

SEQ ID NO: 3958166 - DNA, 20 bp, Homo sapiens
cttttgggggttggatggga

SEQ ID NO: 3958167 - DNA, 10 bp, Homo sapiens
cttttgtaag

SEQ ID NO: 3958168 - DNA, 13 bp, Homo sapiens
cttttgtaagaca

SEQ ID NO: 3958169 - DNA, 23 bp, Homo sapiens
cttttgtgtacagtgtgtaaagt

SEQ ID NO: 3958170 - DNA, 13 bp, Homo sapiens
cttttgttgtgac

SEQ ID NO: 3958171 - DNA, 14 bp, Homo sapiens
cttttgttgtgact

SEQ ID NO: 3958172 - DNA, 17 bp, Homo sapiens
cttttgttgtgactttt

SEQ ID NO: 3958173 - DNA, 19 bp, Homo sapiens
ctttttagggccaggcagg

SEQ ID NO: 3958174 - DNA, 17 bp, Homo sapiens
ctttttagtcttttact

SEQ ID NO: 3958175 - DNA, 13 bp, Homo sapiens
ctttttccagagg

SEQ ID NO: 3958176 - DNA, 12 bp, Homo sapiens
ctttttctttat

SEQ ID NO: 3958177 - DNA, 22 bp, Homo sapiens
ctttttgattacagtgtagctt

SEQ ID NO: 3958178 - DNA, 20 bp, Homo sapiens
cttttttgtgtttttaaaag

SEQ ID NO: 3958179 - DNA, 22 bp, Homo sapiens
gaaaaaaaagtttcagagaagt

SEQ ID NO: 3958180 - DNA, 15 bp, Homo sapiens
gaaaaaaaatatata

SEQ ID NO: 3958181 - DNA, 23 bp, Homo sapiens
gaaaaaaaatatatatatatatt

SEQ ID NO: 3958182 - DNA, 20 bp, Homo sapiens
gaaaaaaagtttgccagaag

SEQ ID NO: 3958183 - DNA, 17 bp, Homo sapiens
ctttcatccccaccttg

SEQ ID NO: 3958184 - DNA, 22 bp, Homo sapiens
ctttccaccctattccctaact

SEQ ID NO: 3958185 - DNA, 19 bp, Homo sapiens
ctttcccaccgccctccct

SEQ ID NO: 3958186 - DNA, 20 bp, Homo sapiens
ctttcccatgatccagaact

SEQ ID NO: 3958187 - DNA, 21 bp, Homo sapiens
ctttccccacctcttccttcc

SEQ ID NO: 3958188 - DNA, 14 bp, Homo sapiens
ctttccccagacac

SEQ ID NO: 3958189 - DNA, 17 bp, Homo sapiens
ctttccccagacacatt

SEQ ID NO: 3958190 - DNA, 18 bp, Homo sapiens
ctttccccgggggaggaa

SEQ ID NO: 3958191 - DNA, 17 bp, Homo sapiens
ctttcccctcagagctc

SEQ ID NO: 3958192 - DNA, 18 bp, Homo sapiens
ctttcccggactgcaagc

SEQ ID NO: 3958193 - DNA, 14 bp, Homo sapiens
ctttcccttccagt

SEQ ID NO: 3958194 - DNA, 15 bp, Homo sapiens
ctttcccttccagtt

SEQ ID NO: 3958195 - DNA, 17 bp, Homo sapiens
ctttcccttccagttcc

SEQ ID NO: 3958196 - DNA, 20 bp, Homo sapiens
ctttccgtctccctaaaata

SEQ ID NO: 3958197 - DNA, 20 bp, Homo sapiens
ctttcctaaagtctctgctg

SEQ ID NO: 3958198 - DNA, 22 bp, Homo sapiens
ctttcctaaagtctctgctgct

SEQ ID NO: 3958199 - DNA, 15 bp, Homo sapiens
ctttcctacaaaatg

SEQ ID NO: 3958200 - DNA, 16 bp, Homo sapiens
ctttcctctgcagcac

SEQ ID NO: 3958201 - DNA, 14 bp, Homo sapiens
ctttcctcttcccc

SEQ ID NO: 3958202 - DNA, 19 bp, Homo sapiens
ctttcctcttccccttgcc

SEQ ID NO: 3958203 - DNA, 23 bp, Homo sapiens
ctttcctgtatttgttcccaaga

SEQ ID NO: 3958204 - DNA, 12 bp, Homo sapiens
ctttccttgtct

SEQ ID NO: 3958205 - DNA, 13 bp, Homo sapiens
ctttccttgtctc

SEQ ID NO: 3958206 - DNA, 14 bp, Homo sapiens
ctttccttgtctct

SEQ ID NO: 3958207 - DNA, 16 bp, Homo sapiens
ctttccttgtctctca

SEQ ID NO: 3958208 - DNA, 20 bp, Homo sapiens
ctttccttgtctctcattct

SEQ ID NO: 3958209 - DNA, 16 bp, Homo sapiens
ctttccttttcttcct

SEQ ID NO: 3958210 - DNA, 20 bp, Homo sapiens
ctttccttttcttccttctt

SEQ ID NO: 3958211 - DNA, 22 bp, Homo sapiens
ctttcggggagaggctgaggac

SEQ ID NO: 3958212 - DNA, 23 bp, Homo sapiens
ctttctacattctcatctactca

SEQ ID NO: 3958213 - DNA, 13 bp, Homo sapiens
ctttctccagcca

SEQ ID NO: 3958214 - DNA, 19 bp, Homo sapiens
ctttctccagccagcaatg

SEQ ID NO: 3958215 - DNA, 18 bp, Homo sapiens
ctttctcccactgagttt

SEQ ID NO: 3958216 - DNA, 21 bp, Homo sapiens
ctttctcccccgacactgctg

SEQ ID NO: 3958217 - DNA, 22 bp, Homo sapiens
ctttctcccccgacactgctgc

SEQ ID NO: 3958218 - DNA, 20 bp, Homo sapiens
ctttctccggggtctgtgct

SEQ ID NO: 3958219 - DNA, 12 bp, Homo sapiens
ctttctcctttg

SEQ ID NO: 3958220 - DNA, 20 bp, Homo sapiens
ctttctcgtggtagaagcca

SEQ ID NO: 3958221 - DNA, 21 bp, Homo sapiens
ctttctctccttcttccctgt

SEQ ID NO: 3958222 - DNA, 18 bp, Homo sapiens
ctttctctggctccagaa

SEQ ID NO: 3958223 - DNA, 21 bp, Homo sapiens
ctttctcttccctccttccct

SEQ ID NO: 3958224 - DNA, 17 bp, Homo sapiens
ctttctggaccagatcc

SEQ ID NO: 3958225 - DNA, 18 bp, Homo sapiens
ctttctggaccagatcct

SEQ ID NO: 3958226 - DNA, 12 bp, Homo sapiens
ctttctgggagg

SEQ ID NO: 3958227 - DNA, 13 bp, Homo sapiens
ctttctgtaaact

SEQ ID NO: 3958228 - DNA, 12 bp, Homo sapiens
ctttctgtgtgc

SEQ ID NO: 3958229 - DNA, 15 bp, Homo sapiens
ctttctgtgtgcacc

SEQ ID NO: 3958230 - DNA, 15 bp, Homo sapiens
ctttctgttggtgta

SEQ ID NO: 3958231 - DNA, 21 bp, Homo sapiens
ctttcttctacaaccagagcc

SEQ ID NO: 3958232 - DNA, 16 bp, Homo sapiens
ctttctttcacaaaaa

SEQ ID NO: 3958233 - DNA, 18 bp, Homo sapiens
ctttctttttctggaaat

SEQ ID NO: 3958234 - DNA, 20 bp, Homo sapiens
ctttctttttctggaaattt

SEQ ID NO: 3958235 - DNA, 22 bp, Homo sapiens
ctttctttttctggaaattttg

SEQ ID NO: 3958236 - DNA, 21 bp, Homo sapiens
ctttctttttctgtctctctt

SEQ ID NO: 3958237 - DNA, 15 bp, Homo sapiens
ctttgaaattgttta

SEQ ID NO: 3958238 - DNA, 18 bp, Homo sapiens
ctttgaatacccccagag

SEQ ID NO: 3958239 - DNA, 21 bp, Homo sapiens
ctttgaatacccccagagacc

SEQ ID NO: 3958240 - DNA, 13 bp, Homo sapiens
ctttgaatgcttt

SEQ ID NO: 3958241 - DNA, 19 bp, Homo sapiens
ctttgaatttcctatctgt

SEQ ID NO: 3958242 - DNA, 16 bp, Homo sapiens
ctttgacatgaaaaga

SEQ ID NO: 3958243 - DNA, 20 bp, Homo sapiens
ctttgacgggaggcctcagt

SEQ ID NO: 3958244 - DNA, 19 bp, Homo sapiens
ctttgactcacctgttact

SEQ ID NO: 3958245 - DNA, 16 bp, Homo sapiens
ctttgagaaagaaata

SEQ ID NO: 3958246 - DNA, 19 bp, Homo sapiens
ctttgagaaaggattaaga

SEQ ID NO: 3958247 - DNA, 13 bp, Homo sapiens
ctttgagttatag

SEQ ID NO: 3958248 - DNA, 19 bp, Homo sapiens
ctgtgcccacatcccaggc

SEQ ID NO: 3958249 - DNA, 12 bp, Homo sapiens
ctgtgcccctca

SEQ ID NO: 3958250 - DNA, 19 bp, Homo sapiens
ctgtgcccctcagagaggc

SEQ ID NO: 3958251 - DNA, 20 bp, Homo sapiens
ctgtgcccctcagagaggca

SEQ ID NO: 3958252 - DNA, 16 bp, Homo sapiens
ctgtgccctgccttca

SEQ ID NO: 3958253 - DNA, 12 bp, Homo sapiens
ctgtgcctctgc

SEQ ID NO: 3958254 - DNA, 13 bp, Homo sapiens
ctgtgcctctgcc

SEQ ID NO: 3958255 - DNA, 17 bp, Homo sapiens
ctgtgcctctgcctgtc

SEQ ID NO: 3958256 - DNA, 11 bp, Homo sapiens
ctgtgcctgct

SEQ ID NO: 3958257 - DNA, 12 bp, Homo sapiens
ctgtgcctgcta

SEQ ID NO: 3958258 - DNA, 14 bp, Homo sapiens
ctgtgctactttgc

SEQ ID NO: 3958259 - DNA, 16 bp, Homo sapiens
ctgtgctactttgcct

SEQ ID NO: 3958260 - DNA, 17 bp, Homo sapiens
ctgtgctactttgcctt

SEQ ID NO: 3958261 - DNA, 20 bp, Homo sapiens
ctgtgctctggaggctgcag

SEQ ID NO: 3958262 - DNA, 18 bp, Homo sapiens
ctgtgctctttgaagaga

SEQ ID NO: 3958263 - DNA, 16 bp, Homo sapiens
ctgtgctcttttggtg

SEQ ID NO: 3958264 - DNA, 22 bp, Homo sapiens
ctgtgctcttttggtggggagc

SEQ ID NO: 3958265 - DNA, 13 bp, Homo sapiens
ctgtgctgccctg

SEQ ID NO: 3958266 - DNA, 19 bp, Homo sapiens
ctgtgctgtgcctgctaga

SEQ ID NO: 3958267 - DNA, 17 bp, Homo sapiens
ctgtgcttacagtgact

SEQ ID NO: 3958268 - DNA, 16 bp, Homo sapiens
ctgtgctttgactcac

SEQ ID NO: 3958269 - DNA, 21 bp, Homo sapiens
ctgtgctttgactcacctgtt

SEQ ID NO: 3958270 - DNA, 16 bp, Homo sapiens
ctgtggaggcctgatg

SEQ ID NO: 3958271 - DNA, 18 bp, Homo sapiens
ctgtggaggcctgatgct

SEQ ID NO: 3958272 - DNA, 22 bp, Homo sapiens
ctgtggaggcctgatgctgccc

SEQ ID NO: 3958273 - DNA, 23 bp, Homo sapiens
ctgtggcacagacttctggaagg

SEQ ID NO: 3958274 - DNA, 18 bp, Homo sapiens
ctgtggccagagctggaa

SEQ ID NO: 3958275 - DNA, 19 bp, Homo sapiens
ctgtggccagagctggaag

SEQ ID NO: 3958276 - DNA, 20 bp, Homo sapiens
ctgtggccagagctggaagg

SEQ ID NO: 3958277 - DNA, 23 bp, Homo sapiens
ctgtggccagagctggaaggcag

SEQ ID NO: 3958278 - DNA, 20 bp, Homo sapiens
ctgtggcctcacttccctgg

SEQ ID NO: 3958279 - DNA, 22 bp, Homo sapiens
ctgtggcctcacttccctggga

SEQ ID NO: 3958280 - DNA, 15 bp, Homo sapiens
ctgtggcctgtgtcc

SEQ ID NO: 3958281 - DNA, 22 bp, Homo sapiens
ctgtggcctgtgtccagcagct

SEQ ID NO: 3958282 - DNA, 12 bp, Homo sapiens
ctgtgggaagag

SEQ ID NO: 3958283 - DNA, 16 bp, Homo sapiens
ctgtgggagcctcgca

SEQ ID NO: 3958284 - DNA, 21 bp, Homo sapiens
ctgtgggagcctcgcaacccg

SEQ ID NO: 3958285 - DNA, 16 bp, Homo sapiens
ctgtgggcagcaccct

SEQ ID NO: 3958286 - DNA, 21 bp, Homo sapiens
ctgtgggcagcaccctccccc

SEQ ID NO: 3958287 - DNA, 19 bp, Homo sapiens
ctgtgggccaggagctcag

SEQ ID NO: 3958288 - DNA, 20 bp, Homo sapiens
ctgtgggggtggccatccct

SEQ ID NO: 3958289 - DNA, 23 bp, Homo sapiens
ctgtgggtgtagattacctgcca

SEQ ID NO: 3958290 - DNA, 14 bp, Homo sapiens
ctgtggtcatgtaa

SEQ ID NO: 3958291 - DNA, 16 bp, Homo sapiens
ctgtggtgacaggccc

SEQ ID NO: 3958292 - DNA, 15 bp, Homo sapiens
ctgtggtgactgaac

SEQ ID NO: 3958293 - DNA, 17 bp, Homo sapiens
ctgtggtgactgaacga

SEQ ID NO: 3958294 - DNA, 22 bp, Homo sapiens
ctgtggtgactgaacgagggat

SEQ ID NO: 3958295 - DNA, 17 bp, Homo sapiens
gactctgccccttctgt

SEQ ID NO: 3958296 - DNA, 12 bp, Homo sapiens
gactctgcctcc

SEQ ID NO: 3958297 - DNA, 16 bp, Homo sapiens
gactctgcctcctctt

SEQ ID NO: 3958298 - DNA, 19 bp, Homo sapiens
gactctggaagccccccac

SEQ ID NO: 3958299 - DNA, 12 bp, Homo sapiens
gactctggcctc

SEQ ID NO: 3958300 - DNA, 15 bp, Homo sapiens
gactctggcctccac

SEQ ID NO: 3958301 - DNA, 13 bp, Homo sapiens
gactctggcctct

SEQ ID NO: 3958302 - DNA, 18 bp, Homo sapiens
gactctgggtccctcgga

SEQ ID NO: 3958303 - DNA, 19 bp, Homo sapiens
gactctttttagggccagg

SEQ ID NO: 3958304 - DNA, 20 bp, Homo sapiens
gactctttttagggccaggc

SEQ ID NO: 3958305 - DNA, 12 bp, Homo sapiens
gactgaaagcag

SEQ ID NO: 3958306 - DNA, 15 bp, Homo sapiens
gactgaaagcagcag

SEQ ID NO: 3958307 - DNA, 23 bp, Homo sapiens
gactgaaggggcacaccactgcc

SEQ ID NO: 3958308 - DNA, 18 bp, Homo sapiens
gactgaattgtccccagt

SEQ ID NO: 3958309 - DNA, 17 bp, Homo sapiens
gactgaatttgggcctc

SEQ ID NO: 3958310 - DNA, 15 bp, Homo sapiens
gactgagacccgttc

SEQ ID NO: 3958311 - DNA, 23 bp, Homo sapiens
gactgagcctggcccatagaaac

SEQ ID NO: 3958312 - DNA, 12 bp, Homo sapiens
gactgagggaga

SEQ ID NO: 3958313 - DNA, 16 bp, Homo sapiens
gactgattctgggatg

SEQ ID NO: 3958314 - DNA, 18 bp, Homo sapiens
gactgcaagaggctcctg

SEQ ID NO: 3958315 - DNA, 18 bp, Homo sapiens
gactgcacagcggcccct

SEQ ID NO: 3958316 - DNA, 18 bp, Homo sapiens
gactgccccaactcctgg

SEQ ID NO: 3958317 - DNA, 21 bp, Homo sapiens
gactgctccccagccctggct

SEQ ID NO: 3958318 - DNA, 24 bp, Homo sapiens
gactgctccccagccctggctctg

SEQ ID NO: 3958319 - DNA, 22 bp, Homo sapiens
gactggagcccgagggcctgac

SEQ ID NO: 3958320 - DNA, 20 bp, Homo sapiens
gactggagtgaggcttccag

SEQ ID NO: 3958321 - DNA, 22 bp, Homo sapiens
gactggcacagttttctgagaa

SEQ ID NO: 3958322 - DNA, 14 bp, Homo sapiens
gactggctcacccc

SEQ ID NO: 3958323 - DNA, 19 bp, Homo sapiens
gactggctcacccctctcc

SEQ ID NO: 3958324 - DNA, 20 bp, Homo sapiens
gactggctcacccctctccc

SEQ ID NO: 3958325 - DNA, 16 bp, Homo sapiens
gactggggatgtggga

SEQ ID NO: 3958326 - DNA, 20 bp, Homo sapiens
gactggggatgtgggaggga

SEQ ID NO: 3958327 - DNA, 22 bp, Homo sapiens
gactgggggcacctgaccagaa

SEQ ID NO: 3958328 - DNA, 15 bp, Homo sapiens
gactggtcctgtgtg

SEQ ID NO: 3958329 - DNA, 16 bp, Homo sapiens
gactgtactcctccca

SEQ ID NO: 3958330 - DNA, 18 bp, Homo sapiens
gactgtactcctcccagg

SEQ ID NO: 3958331 - DNA, 22 bp, Homo sapiens
gactgtcaagtacaagcaagac

SEQ ID NO: 3958332 - DNA, 15 bp, Homo sapiens
gactgtcatagaaat

SEQ ID NO: 3958333 - DNA, 19 bp, Homo sapiens
gactgtcccaccgggagcc

SEQ ID NO: 3958334 - DNA, 23 bp, Homo sapiens
gactgtcccaccgggagcctccc

SEQ ID NO: 3958335 - DNA, 21 bp, Homo sapiens
gactgtctcaagagggcactg

SEQ ID NO: 3958336 - DNA, 12 bp, Homo sapiens
gacttcacaaaa

SEQ ID NO: 3958337 - DNA, 19 bp, Homo sapiens
gacttcagaacatgctgga

SEQ ID NO: 3958338 - DNA, 17 bp, Homo sapiens
gacttcaggttgttctg

SEQ ID NO: 3958339 - DNA, 12 bp, Homo sapiens
gacttcatccca

SEQ ID NO: 3958340 - DNA, 13 bp, Homo sapiens
gacttcatgttca

SEQ ID NO: 3958341 - DNA, 22 bp, Homo sapiens
gacttcctctttctctccttct

SEQ ID NO: 3958342 - DNA, 18 bp, Homo sapiens
gacttcctggggccccgc

SEQ ID NO: 3958343 - DNA, 23 bp, Homo sapiens
gacttcctggtgaggcccagcct

SEQ ID NO: 3958344 - DNA, 15 bp, Homo sapiens
gacttcgactcagga

SEQ ID NO: 3958345 - DNA, 13 bp, Homo sapiens
gacttctgcagct

SEQ ID NO: 3958346 - DNA, 13 bp, Homo sapiens
gacttctggaagg

SEQ ID NO: 3958347 - DNA, 17 bp, Homo sapiens
gacttctggaaggctgg

SEQ ID NO: 3958348 - DNA, 21 bp, Homo sapiens
gacttcttggtttggggagaa

SEQ ID NO: 3958349 - DNA, 22 bp, Homo sapiens
gacttcttggtttggggagaaa

SEQ ID NO: 3958350 - DNA, 23 bp, Homo sapiens
gacttcttggtttggggagaaat

SEQ ID NO: 3958351 - DNA, 17 bp, Homo sapiens
gacttgaagcacagagg

SEQ ID NO: 3958352 - DNA, 20 bp, Homo sapiens
gacttgaagcacagagggct

SEQ ID NO: 3958353 - DNA, 23 bp, Homo sapiens
gacttgacaacatcccacagtgg

SEQ ID NO: 3958354 - DNA, 17 bp, Homo sapiens
gacttggcaacagaagc

SEQ ID NO: 3958355 - DNA, 19 bp, Homo sapiens
gacttggcaacagaagcag

SEQ ID NO: 3958356 - DNA, 14 bp, Homo sapiens
gacttgggcacccc

SEQ ID NO: 3958357 - DNA, 15 bp, Homo sapiens
gacttggggaccaga

SEQ ID NO: 3958358 - DNA, 13 bp, Homo sapiens
gacttgtgtctct

SEQ ID NO: 3958359 - DNA, 23 bp, Homo sapiens
gactttacaggaggttgtggatg

SEQ ID NO: 3958360 - DNA, 19 bp, Homo sapiens
gactttctacacctgttgc

SEQ ID NO: 3958361 - DNA, 11 bp, Homo sapiens
gactttctgtt

SEQ ID NO: 3958362 - DNA, 22 bp, Homo sapiens
gactttgatgcatttccacact

SEQ ID NO: 3958363 - DNA, 12 bp, Homo sapiens
gactttgttcac

SEQ ID NO: 3958364 - DNA, 15 bp, Homo sapiens
gacttttccaagccc

SEQ ID NO: 3958365 - DNA, 22 bp, Homo sapiens
gacttttgggggttggatggga

SEQ ID NO: 3958366 - DNA, 17 bp, Homo sapiens
gactttttagccagtga

SEQ ID NO: 3958367 - DNA, 17 bp, Homo sapiens
gagaaaaaccaatgatt

SEQ ID NO: 3958368 - DNA, 10 bp, Homo sapiens
gagaaaaaga

SEQ ID NO: 3958369 - DNA, 15 bp, Homo sapiens
gagaaaaagaaatgc

SEQ ID NO: 3958370 - DNA, 19 bp, Homo sapiens
gagaaaaagctcctgtcct

SEQ ID NO: 3958371 - DNA, 16 bp, Homo sapiens
gagaaaacttatttga

SEQ ID NO: 3958372 - DNA, 12 bp, Homo sapiens
gagaaagaaata

SEQ ID NO: 3958373 - DNA, 16 bp, Homo sapiens
gagaaaggattaagat

SEQ ID NO: 3958374 - DNA, 23 bp, Homo sapiens
gagaaataaattttgtttcagaa

SEQ ID NO: 3958375 - DNA, 16 bp, Homo sapiens
gagaaatcacaggggc

SEQ ID NO: 3958376 - DNA, 17 bp, Homo sapiens
gagaaatgtgaagggtg

SEQ ID NO: 3958377 - DNA, 19 bp, Homo sapiens
gagaaatttttatttttga

SEQ ID NO: 3958378 - DNA, 20 bp, Homo sapiens
gagaacaagtcacagctgca

SEQ ID NO: 3958379 - DNA, 12 bp, Homo sapiens
gagaacctggcc

SEQ ID NO: 3958380 - DNA, 13 bp, Homo sapiens
gagaagaagctga

SEQ ID NO: 3958381 - DNA, 16 bp, Homo sapiens
gagagccagaacctgg

SEQ ID NO: 3958382 - DNA, 14 bp, Homo sapiens
gagagccctgctgt

SEQ ID NO: 3958383 - DNA, 16 bp, Homo sapiens
gagagcccttcatttg

SEQ ID NO: 3958384 - DNA, 19 bp, Homo sapiens
gagagctagaacctggagg

SEQ ID NO: 3958385 - DNA, 23 bp, Homo sapiens
gagaggaaaaacgatcgctgtga

SEQ ID NO: 3958386 - DNA, 17 bp, Homo sapiens
gagaggacaagatgggt

SEQ ID NO: 3958387 - DNA, 19 bp, Homo sapiens
gagaggagaaactgagaaa

SEQ ID NO: 3958388 - DNA, 12 bp, Homo sapiens
gagaggagcacc

SEQ ID NO: 3958389 - DNA, 16 bp, Homo sapiens
gagaggcacctgctgg

SEQ ID NO: 3958390 - DNA, 17 bp, Homo sapiens
gagaggcacctgctgga

SEQ ID NO: 3958391 - DNA, 14 bp, Homo sapiens
gagaggcagaggca

SEQ ID NO: 3958392 - DNA, 16 bp, Homo sapiens
gagaggcgcgtctgcc

SEQ ID NO: 3958393 - DNA, 12 bp, Homo sapiens
gagaggcggcct

SEQ ID NO: 3958394 - DNA, 15 bp, Homo sapiens
gagaggcggcctcgt

SEQ ID NO: 3958395 - DNA, 21 bp, Homo sapiens
gagagggcatgcgcacaaggc

SEQ ID NO: 3958396 - DNA, 20 bp, Homo sapiens
gagaggggcctgggaaagga

SEQ ID NO: 3958397 - DNA, 18 bp, Homo sapiens
gagagggtctggagaagc

SEQ ID NO: 3958398 - DNA, 16 bp, Homo sapiens
gagaggtagcgagctg

SEQ ID NO: 3958399 - DNA, 18 bp, Homo sapiens
gagaggtagcgagctgct

SEQ ID NO: 3958400 - DNA, 16 bp, Homo sapiens
gagaggtccctgctta

SEQ ID NO: 3958401 - DNA, 23 bp, Homo sapiens
gagaggtccctgcttacctgacg

SEQ ID NO: 3958402 - DNA, 22 bp, Homo sapiens
gagaggtggggagggagacaga

SEQ ID NO: 3958403 - DNA, 16 bp, Homo sapiens
gagaggttctggggag

SEQ ID NO: 3958404 - DNA, 20 bp, Homo sapiens
gagaggttctggggaggaag

SEQ ID NO: 3958405 - DNA, 17 bp, Homo sapiens
gagagtaatgaggcttg

SEQ ID NO: 3958406 - DNA, 16 bp, Homo sapiens
gagagtacagtgagcc

SEQ ID NO: 3958407 - DNA, 19 bp, Homo sapiens
gagagtacagtgagccaag

SEQ ID NO: 3958408 - DNA, 11 bp, Homo sapiens
gagagtaccat

SEQ ID NO: 3958409 - DNA, 17 bp, Homo sapiens
gagagtaccatgctggc

SEQ ID NO: 3958410 - DNA, 20 bp, Homo sapiens
gagagtagccgagagcctgc

SEQ ID NO: 3958411 - DNA, 21 bp, Homo sapiens
gagagtagccgagagcctgct

SEQ ID NO: 3958412 - DNA, 13 bp, Homo sapiens
gagagtggctcct

SEQ ID NO: 3958413 - DNA, 16 bp, Homo sapiens
gagagtggctcctccc

SEQ ID NO: 3958414 - DNA, 20 bp, Homo sapiens
gagagtgtgaaatagacatt

SEQ ID NO: 3958415 - DNA, 16 bp, Homo sapiens
gagatatggcagcgaa

SEQ ID NO: 3958416 - DNA, 22 bp, Homo sapiens
gagatatttacatgaattgcat

SEQ ID NO: 3958417 - DNA, 21 bp, Homo sapiens
gagatcgtgccgttactctcc

SEQ ID NO: 3958418 - DNA, 19 bp, Homo sapiens
gagatctagaaagtgggtt

SEQ ID NO: 3958419 - DNA, 13 bp, Homo sapiens
gagatgatgatga

SEQ ID NO: 3958420 - DNA, 14 bp, Homo sapiens
gagatgatgatgat

SEQ ID NO: 3958421 - DNA, 17 bp, Homo sapiens
gagatgatgatgatgat

SEQ ID NO: 3958422 - DNA, 17 bp, Homo sapiens
gagatgcatgcgcaggc

SEQ ID NO: 3958423 - DNA, 15 bp, Homo sapiens
gagattaattttaac

SEQ ID NO: 3958424 - DNA, 18 bp, Homo sapiens
gagattgccccagagccc

SEQ ID NO: 3958425 - DNA, 14 bp, Homo sapiens
gagatttcaacata

SEQ ID NO: 3958426 - DNA, 14 bp, Homo sapiens
gagatttgccagca

SEQ ID NO: 3958427 - DNA, 18 bp, Homo sapiens
gagatttgccagcacagg

SEQ ID NO: 3958428 - DNA, 22 bp, Homo sapiens
gagatttgccagcacaggggcc

SEQ ID NO: 3958429 - DNA, 12 bp, Homo sapiens
gagattttcctt

SEQ ID NO: 3958430 - DNA, 18 bp, Homo sapiens
gagattttgtcgggacag

SEQ ID NO: 3958431 - DNA, 12 bp, Homo sapiens
gagcaaaataat

SEQ ID NO: 3958432 - DNA, 12 bp, Homo sapiens
gagcaaagcctg

SEQ ID NO: 3958433 - DNA, 16 bp, Homo sapiens
gagcaaagtctaaagt

SEQ ID NO: 3958434 - DNA, 16 bp, Homo sapiens
gagcaaatgagggagg

SEQ ID NO: 3958435 - DNA, 17 bp, Homo sapiens
gagcaaatgagggaggg

SEQ ID NO: 3958436 - DNA, 14 bp, Homo sapiens
gagcaaatgtttct

SEQ ID NO: 3958437 - DNA, 16 bp, Homo sapiens
gagcaaatgtttctgc

SEQ ID NO: 3958438 - DNA, 20 bp, Homo sapiens
gagcaaccgtggcccttcct

SEQ ID NO: 3958439 - DNA, 13 bp, Homo sapiens
gagcaactctcca

SEQ ID NO: 3958440 - DNA, 15 bp, Homo sapiens
gagcaactctccact

SEQ ID NO: 3958441 - DNA, 18 bp, Homo sapiens
gagcaactctccactcca

SEQ ID NO: 3958442 - DNA, 19 bp, Homo sapiens
gagcaactctccactccat

SEQ ID NO: 3958443 - DNA, 12 bp, Homo sapiens
gagcaagagctg

SEQ ID NO: 3958444 - DNA, 13 bp, Homo sapiens
gagcaatgggagg

SEQ ID NO: 3958445 - DNA, 14 bp, Homo sapiens
gagcaatgggaggg

SEQ ID NO: 3958446 - DNA, 21 bp, Homo sapiens
gagcaatgggagggggctcca

SEQ ID NO: 3958447 - DNA, 21 bp, Homo sapiens
gagcacattcttaaaggaaaa

SEQ ID NO: 3958448 - DNA, 18 bp, Homo sapiens
gagcaccccctcattccc

SEQ ID NO: 3958449 - DNA, 13 bp, Homo sapiens
gagcacctgaacc

SEQ ID NO: 3958450 - DNA, 22 bp, Homo sapiens
gagcaccttaatattattgggg

SEQ ID NO: 3958451 - DNA, 19 bp, Homo sapiens
gagcactgccaggagggac

SEQ ID NO: 3958452 - DNA, 14 bp, Homo sapiens
gagcactggagtgc

SEQ ID NO: 3958453 - DNA, 16 bp, Homo sapiens
gagcactggccagaga

SEQ ID NO: 3958454 - DNA, 17 bp, Homo sapiens
gagcactggccagagag

SEQ ID NO: 3958455 - DNA, 18 bp, Homo sapiens
gagcacttgcgtcctgca

SEQ ID NO: 3958456 - DNA, 20 bp, Homo sapiens
gagcacttgcgtcctgcaga

SEQ ID NO: 3958457 - DNA, 12 bp, Homo sapiens
gagcagacagag

SEQ ID NO: 3958458 - DNA, 14 bp, Homo sapiens
gagcagacagagaa

SEQ ID NO: 3958459 - DNA, 14 bp, Homo sapiens
gagcagacaggagg

SEQ ID NO: 3958460 - DNA, 15 bp, Homo sapiens
gagcagcctgatggc

SEQ ID NO: 3958461 - DNA, 13 bp, Homo sapiens
gagcagctgagca

SEQ ID NO: 3958462 - DNA, 15 bp, Homo sapiens
gagcagctgagcagg

SEQ ID NO: 3958463 - DNA, 17 bp, Homo sapiens
gagcagctgagcagggc

SEQ ID NO: 3958464 - DNA, 15 bp, Homo sapiens
gagcagcttcagttg

SEQ ID NO: 3958465 - DNA, 12 bp, Homo sapiens
gagcaggaacag

SEQ ID NO: 3958466 - DNA, 13 bp, Homo sapiens
gagcaggaacaga

SEQ ID NO: 3958467 - DNA, 14 bp, Homo sapiens
gagcaggaacagag

SEQ ID NO: 3958468 - DNA, 21 bp, Homo sapiens
gagaagaggctggtgctgtgg

SEQ ID NO: 3958469 - DNA, 14 bp, Homo sapiens
gagaagagggcctg

SEQ ID NO: 3958470 - DNA, 17 bp, Homo sapiens
gagaagatgtgatttat

SEQ ID NO: 3958471 - DNA, 22 bp, Homo sapiens
gagaagcagcctcctaatttga

SEQ ID NO: 3958472 - DNA, 18 bp, Homo sapiens
gagaagcagtgagccgca

SEQ ID NO: 3958473 - DNA, 12 bp, Homo sapiens
gagaagctgaga

SEQ ID NO: 3958474 - DNA, 13 bp, Homo sapiens
gagaagctgagaa

SEQ ID NO: 3958475 - DNA, 23 bp, Homo sapiens
gagaagctgagaagaagctgagg

SEQ ID NO: 3958476 - DNA, 12 bp, Homo sapiens
gagaaggcagga

SEQ ID NO: 3958477 - DNA, 21 bp, Homo sapiens
gagaaggcccataccttctgg

SEQ ID NO: 3958478 - DNA, 17 bp, Homo sapiens
gagaagtttctggccct

SEQ ID NO: 3958479 - DNA, 17 bp, Homo sapiens
gagaagttttgtacaga

SEQ ID NO: 3958480 - DNA, 16 bp, Homo sapiens
gagaagttttgttttt

SEQ ID NO: 3958481 - DNA, 16 bp, Homo sapiens
gagaataaagacttca

SEQ ID NO: 3958482 - DNA, 12 bp, Homo sapiens
gagaatatatac

SEQ ID NO: 3958483 - DNA, 19 bp, Homo sapiens
gagaatcagggcaggcttg

SEQ ID NO: 3958484 - DNA, 15 bp, Homo sapiens
gagaatctatattta

SEQ ID NO: 3958485 - DNA, 22 bp, Homo sapiens
gagaatctatatttaacaagat

SEQ ID NO: 3958486 - DNA, 22 bp, Homo sapiens
gagaatctggctcctgtttcca

SEQ ID NO: 3958487 - DNA, 13 bp, Homo sapiens
gagaattgcctct

SEQ ID NO: 3958488 - DNA, 21 bp, Homo sapiens
gagaatttctaccatttcaga

SEQ ID NO: 3958489 - DNA, 17 bp, Homo sapiens
gagacaagaaatccctg

SEQ ID NO: 3958490 - DNA, 19 bp, Homo sapiens
gagacaagccctggcaaca

SEQ ID NO: 3958491 - DNA, 23 bp, Homo sapiens
gagacaccgcgcatctcttcctg

SEQ ID NO: 3958492 - DNA, 20 bp, Homo sapiens
gagacacctgcacctccccc

SEQ ID NO: 3958493 - DNA, 18 bp, Homo sapiens
gagacactcccagggaca

SEQ ID NO: 3958494 - DNA, 17 bp, Homo sapiens
gagacagaaacagagag

SEQ ID NO: 3958495 - DNA, 20 bp, Homo sapiens
gagacagaaacagagagaga

SEQ ID NO: 3958496 - DNA, 19 bp, Homo sapiens
gagacagaccccttggctt

SEQ ID NO: 3958497 - DNA, 15 bp, Homo sapiens
gagacagagagagac

SEQ ID NO: 3958498 - DNA, 18 bp, Homo sapiens
gagacagccacttggttt

SEQ ID NO: 3958499 - DNA, 16 bp, Homo sapiens
gagacagggtctcact

SEQ ID NO: 3958500 - DNA, 18 bp, Homo sapiens
gagacagtagaggcatga

SEQ ID NO: 3958501 - DNA, 18 bp, Homo sapiens
gagacagttatttatagt

SEQ ID NO: 3958502 - DNA, 16 bp, Homo sapiens
gagacagttcaagaaa

SEQ ID NO: 3958503 - DNA, 23 bp, Homo sapiens
gagacattgcctccacctctcct

SEQ ID NO: 3958504 - DNA, 15 bp, Homo sapiens
gagaccatcctggcc

SEQ ID NO: 3958505 - DNA, 14 bp, Homo sapiens
gagacccaaggagg

SEQ ID NO: 3958506 - DNA, 13 bp, Homo sapiens
gagaccccaggat

SEQ ID NO: 3958507 - DNA, 19 bp, Homo sapiens
gagaccccttcctttcctc

SEQ ID NO: 3958508 - DNA, 22 bp, Homo sapiens
gagaccctcgccacggggaggg

SEQ ID NO: 3958509 - DNA, 18 bp, Homo sapiens
gagaccctggaattcagc

SEQ ID NO: 3958510 - DNA, 22 bp, Homo sapiens
gagaccctggaattcagcaccc

SEQ ID NO: 3958511 - DNA, 17 bp, Homo sapiens
gagacccttgcattaga

SEQ ID NO: 3958512 - DNA, 21 bp, Homo sapiens
gagaccgcttcacccctgcac

SEQ ID NO: 3958513 - DNA, 15 bp, Homo sapiens
gagacctcagccatg

SEQ ID NO: 3958514 - DNA, 19 bp, Homo sapiens
gagacgcagccctgggggc

SEQ ID NO: 3958515 - DNA, 14 bp, Homo sapiens
gagacggcagagac

SEQ ID NO: 3958516 - DNA, 22 bp, Homo sapiens
gagacggcagagaccccaggat

SEQ ID NO: 3958517 - DNA, 19 bp, Homo sapiens
gagacggctggacctgcac

SEQ ID NO: 3958518 - DNA, 15 bp, Homo sapiens
gagacggtcgagcag

SEQ ID NO: 3958519 - DNA, 21 bp, Homo sapiens
gagacggtgctcgcttctcct

SEQ ID NO: 3958520 - DNA, 15 bp, Homo sapiens
gagacgtgtacatag

SEQ ID NO: 3958521 - DNA, 16 bp, Homo sapiens
gagactaagccctgtc

SEQ ID NO: 3958522 - DNA, 20 bp, Homo sapiens
gagactaatagagacacaga

SEQ ID NO: 3958523 - DNA, 17 bp, Homo sapiens
gagactccagaatctgc

SEQ ID NO: 3958524 - DNA, 19 bp, Homo sapiens
gagactctcttaggagcag

SEQ ID NO: 3958525 - DNA, 12 bp, Homo sapiens
gagactctggcc

SEQ ID NO: 3958526 - DNA, 15 bp, Homo sapiens
gagactgaaagcagc

SEQ ID NO: 3958527 - DNA, 20 bp, Homo sapiens
gagactgaaagcagcagcta

SEQ ID NO: 3958528 - DNA, 20 bp, Homo sapiens
gagactggagcatctgactc

SEQ ID NO: 3958529 - DNA, 23 bp, Homo sapiens
gagactggtcctgtgtgcagtga

SEQ ID NO: 3958530 - DNA, 23 bp, Homo sapiens
gagactgtctcaagagggcactg

SEQ ID NO: 3958531 - DNA, 23 bp, Homo sapiens
gagacttcaggttgttctgtata

SEQ ID NO: 3958532 - DNA, 20 bp, Homo sapiens
gagacttccaaacctgacag

SEQ ID NO: 3958533 - DNA, 14 bp, Homo sapiens
gagacttgctctct

SEQ ID NO: 3958534 - DNA, 20 bp, Homo sapiens
gagagaagccacgctgtcct

SEQ ID NO: 3958535 - DNA, 16 bp, Homo sapiens
gagagaatatttcaaa

SEQ ID NO: 3958536 - DNA, 18 bp, Homo sapiens
gagagacactcccaggga

SEQ ID NO: 3958537 - DNA, 19 bp, Homo sapiens
gagagacactcccagggac

SEQ ID NO: 3958538 - DNA, 15 bp, Homo sapiens
gagagacagagacag

SEQ ID NO: 3958539 - DNA, 15 bp, Homo sapiens
gagagacccaaggag

SEQ ID NO: 3958540 - DNA, 20 bp, Homo sapiens
gagagacccaaggaggaaaa

SEQ ID NO: 3958541 - DNA, 21 bp, Homo sapiens
gagagacgcagccctgggggc

SEQ ID NO: 3958542 - DNA, 16 bp, Homo sapiens
gagagacgtgtacata

SEQ ID NO: 3958543 - DNA, 20 bp, Homo sapiens
gagagacgtgtacatagtgt

SEQ ID NO: 3958544 - DNA, 16 bp, Homo sapiens
gagagactcaaagaga

SEQ ID NO: 3958545 - DNA, 19 bp, Homo sapiens
gagagagctcgctcttggg

SEQ ID NO: 3958546 - DNA, 21 bp, Homo sapiens
gagagagctcgctcttgggag

SEQ ID NO: 3958547 - DNA, 20 bp, Homo sapiens
gagagagtcttccaggtact

SEQ ID NO: 3958548 - DNA, 14 bp, Homo sapiens
gagggggctctcca

SEQ ID NO: 3958549 - DNA, 21 bp, Homo sapiens
gagggggtgtctggaagctga

SEQ ID NO: 3958550 - DNA, 20 bp, Homo sapiens
gaggggtgacagtggaggaa

SEQ ID NO: 3958551 - DNA, 18 bp, Homo sapiens
gaggggttgcgggggagc

SEQ ID NO: 3958552 - DNA, 19 bp, Homo sapiens
gagggtcaggactgtgact

SEQ ID NO: 3958553 - DNA, 14 bp, Homo sapiens
gagggtcagggcag

SEQ ID NO: 3958554 - DNA, 15 bp, Homo sapiens
gagggtcagggcagt

SEQ ID NO: 3958555 - DNA, 16 bp, Homo sapiens
gagggtcagggcagta

SEQ ID NO: 3958556 - DNA, 17 bp, Homo sapiens
gagggtccccagctggt

SEQ ID NO: 3958557 - DNA, 11 bp, Homo sapiens
gagggtgactg

SEQ ID NO: 3958558 - DNA, 20 bp, Homo sapiens
gagggtggagactaagccct

SEQ ID NO: 3958559 - DNA, 20 bp, Homo sapiens
gagggttgggttcatctgag

SEQ ID NO: 3958560 - DNA, 22 bp, Homo sapiens
gaggtaaaagtgtgagcagtga

SEQ ID NO: 3958561 - DNA, 18 bp, Homo sapiens
gaggtagagtttgaagga

SEQ ID NO: 3958562 - DNA, 19 bp, Homo sapiens
gaggtagagtttgaaggag

SEQ ID NO: 3958563 - DNA, 19 bp, Homo sapiens
gaggtcacattcaggaaga

SEQ ID NO: 3958564 - DNA, 21 bp, Homo sapiens
gaggtcacattcaggaagatg

SEQ ID NO: 3958565 - DNA, 12 bp, Homo sapiens
gaggtcctgagc

SEQ ID NO: 3958566 - DNA, 13 bp, Homo sapiens
gaggtcctgagca

SEQ ID NO: 3958567 - DNA, 16 bp, Homo sapiens
gaggtcctgagcactg

SEQ ID NO: 3958568 - DNA, 17 bp, Homo sapiens
gaggtcctgagcactgc

SEQ ID NO: 3958569 - DNA, 19 bp, Homo sapiens
gaggtcctgagcactgcca

SEQ ID NO: 3958570 - DNA, 22 bp, Homo sapiens
gaggtcctgagcactgccagga

SEQ ID NO: 3958571 - DNA, 13 bp, Homo sapiens
gaggtctgagccc

SEQ ID NO: 3958572 - DNA, 15 bp, Homo sapiens
gaggtctgagccctg

SEQ ID NO: 3958573 - DNA, 22 bp, Homo sapiens
gaggtgaccccagggcacagga

SEQ ID NO: 3958574 - DNA, 16 bp, Homo sapiens
gaggtgagaccacctc

SEQ ID NO: 3958575 - DNA, 12 bp, Homo sapiens
gaggtgagcaga

SEQ ID NO: 3958576 - DNA, 15 bp, Homo sapiens
gaggtgcccaggaga

SEQ ID NO: 3958577 - DNA, 16 bp, Homo sapiens
gaggtgcctgagctgg

SEQ ID NO: 3958578 - DNA, 17 bp, Homo sapiens
gaggtgcctgagctggg

SEQ ID NO: 3958579 - DNA, 20 bp, Homo sapiens
gaggtggaagccctccttcc

SEQ ID NO: 3958580 - DNA, 19 bp, Homo sapiens
gaggtggaggttgcagtga

SEQ ID NO: 3958581 - DNA, 15 bp, Homo sapiens
gaggtggattcctgg

SEQ ID NO: 3958582 - DNA, 21 bp, Homo sapiens
gaggtgggagacaaggaacca

SEQ ID NO: 3958583 - DNA, 22 bp, Homo sapiens
gaggtggtagaaccacttggct

SEQ ID NO: 3958584 - DNA, 17 bp, Homo sapiens
gaggtggtgccttctca

SEQ ID NO: 3958585 - DNA, 15 bp, Homo sapiens
gaggtggtggaggag

SEQ ID NO: 3958586 - DNA, 18 bp, Homo sapiens
gaggtggtggaggaggag

SEQ ID NO: 3958587 - DNA, 22 bp, Homo sapiens
gaggtgtcaccctgcagagcta

SEQ ID NO: 3958588 - DNA, 21 bp, Homo sapiens
gaggttaaaatataaattaag

SEQ ID NO: 3958589 - DNA, 14 bp, Homo sapiens
gaggttaaggtggg

SEQ ID NO: 3958590 - DNA, 17 bp, Homo sapiens
gaggttatctgcctggc

SEQ ID NO: 3958591 - DNA, 18 bp, Homo sapiens
gaggttatctgcctggcc

SEQ ID NO: 3958592 - DNA, 11 bp, Homo sapiens
gaggttcctcg

SEQ ID NO: 3958593 - DNA, 14 bp, Homo sapiens
gaggttctggggag

SEQ ID NO: 3958594 - DNA, 16 bp, Homo sapiens
gaggttctggggagga

SEQ ID NO: 3958595 - DNA, 18 bp, Homo sapiens
gaggttctggggaggaag

SEQ ID NO: 3958596 - DNA, 23 bp, Homo sapiens
gaggttttattctgacttcctct

SEQ ID NO: 3958597 - DNA, 16 bp, Homo sapiens
gagtaagatattattt

SEQ ID NO: 3958598 - DNA, 14 bp, Homo sapiens
gagtaatcaggcag

SEQ ID NO: 3958599 - DNA, 17 bp, Homo sapiens
gagtaatcaggcagcct

SEQ ID NO: 3958600 - DNA, 19 bp, Homo sapiens
gagtacagacgtctcaaga

SEQ ID NO: 3958601 - DNA, 15 bp, Homo sapiens
gagtacctcaaagga

SEQ ID NO: 3958602 - DNA, 14 bp, Homo sapiens
gagtagaaattgtt

SEQ ID NO: 3958603 - DNA, 19 bp, Homo sapiens
gagtagccgagagcctgct

SEQ ID NO: 3958604 - DNA, 12 bp, Homo sapiens
gagtagctgaga

SEQ ID NO: 3958605 - DNA, 16 bp, Homo sapiens
gagtagctgagaggaa

SEQ ID NO: 3958606 - DNA, 13 bp, Homo sapiens
gagtagctgagct

SEQ ID NO: 3958607 - DNA, 15 bp, Homo sapiens
gagtagtgcatttaa

SEQ ID NO: 3958608 - DNA, 18 bp, Homo sapiens
gagtatacaatatataaa

SEQ ID NO: 3958609 - DNA, 19 bp, Homo sapiens
gagtatacaatatataaaa

SEQ ID NO: 3958610 - DNA, 13 bp, Homo sapiens
gagtatactaaaa

SEQ ID NO: 3958611 - DNA, 20 bp, Homo sapiens
gagtcaaaagcctgggtgag

SEQ ID NO: 3958612 - DNA, 22 bp, Homo sapiens
gagtcaaaatttcaaaagtgat

SEQ ID NO: 3958613 - DNA, 14 bp, Homo sapiens
gagtcacctcctcc

SEQ ID NO: 3958614 - DNA, 15 bp, Homo sapiens
gagtcacctcctcca

SEQ ID NO: 3958615 - DNA, 15 bp, Homo sapiens
gagtcacctgcaagc

SEQ ID NO: 3958616 - DNA, 21 bp, Homo sapiens
gagtcacctgcaagccccagg

SEQ ID NO: 3958617 - DNA, 19 bp, Homo sapiens
gagtcatgatctccctgcc

SEQ ID NO: 3958618 - DNA, 15 bp, Homo sapiens
gagtccagggcggga

SEQ ID NO: 3958619 - DNA, 12 bp, Homo sapiens
gagtctgagccc

SEQ ID NO: 3958620 - DNA, 13 bp, Homo sapiens
gagtctgagcccc

SEQ ID NO: 3958621 - DNA, 14 bp, Homo sapiens
gagtctgaggtcct

SEQ ID NO: 3958622 - DNA, 17 bp, Homo sapiens
gagtgactccaagaaca

SEQ ID NO: 3958623 - DNA, 15 bp, Homo sapiens
gagtgactcggtgta

SEQ ID NO: 3958624 - DNA, 16 bp, Homo sapiens
gagtgactcggtgtaa

SEQ ID NO: 3958625 - DNA, 21 bp, Homo sapiens
gagtgactcggtgtaaaacca

SEQ ID NO: 3958626 - DNA, 23 bp, Homo sapiens
gagtgactcggtgtaaaaccatg

SEQ ID NO: 3958627 - DNA, 14 bp, Homo sapiens
gagtgagaatctgg

SEQ ID NO: 3958628 - DNA, 19 bp, Homo sapiens
gagtgaggcttccaggctc

SEQ ID NO: 3958629 - DNA, 20 bp, Homo sapiens
gagtgatgtagcgtaacaaa

SEQ ID NO: 3958630 - DNA, 22 bp, Homo sapiens
gagtgccaggactccccaggcc

SEQ ID NO: 3958631 - DNA, 23 bp, Homo sapiens
gagtgcgctcttggtccctggtc

SEQ ID NO: 3958632 - DNA, 14 bp, Homo sapiens
gagtggaatgcagg

SEQ ID NO: 3958633 - DNA, 16 bp, Homo sapiens
gagtggaatgcaggga

SEQ ID NO: 3958634 - DNA, 17 bp, Homo sapiens
gagtggaatgcagggaa

SEQ ID NO: 3958635 - DNA, 23 bp, Homo sapiens
gagtggagtctgagtctgagtcc

SEQ ID NO: 3958636 - DNA, 13 bp, Homo sapiens
gagtggatggatg

SEQ ID NO: 3958637 - DNA, 14 bp, Homo sapiens
gagtggatggatgg

SEQ ID NO: 3958638 - DNA, 12 bp, Homo sapiens
gagtggcagcca

SEQ ID NO: 3958639 - DNA, 16 bp, Homo sapiens
gagtggcagccatgcc

SEQ ID NO: 3958640 - DNA, 20 bp, Homo sapiens
gagtggcagctgtcccctct

SEQ ID NO: 3958641 - DNA, 21 bp, Homo sapiens
gagtggcagctgtcccctctc

SEQ ID NO: 3958642 - DNA, 21 bp, Homo sapiens
gagtggcttgtgattctggga

SEQ ID NO: 3958643 - DNA, 21 bp, Homo sapiens
gagtgggggctgtgccgtgaa

SEQ ID NO: 3958644 - DNA, 19 bp, Homo sapiens
gagtgtcttaattaaaaga

SEQ ID NO: 3958645 - DNA, 12 bp, Homo sapiens
gagtgtgggaag

SEQ ID NO: 3958646 - DNA, 20 bp, Homo sapiens
gagttacagcgagaggcaga

SEQ ID NO: 3958647 - DNA, 17 bp, Homo sapiens
gagttacattaatgtta

SEQ ID NO: 3958648 - DNA, 23 bp, Homo sapiens
gagttattttaattatcttttct

SEQ ID NO: 3958649 - DNA, 18 bp, Homo sapiens
gagttcaagaccagcctg

SEQ ID NO: 3958650 - DNA, 18 bp, Homo sapiens
gagttcaagcctgtggga

SEQ ID NO: 3958651 - DNA, 23 bp, Homo sapiens
gagttccaaataaggatttgttc

SEQ ID NO: 3958652 - DNA, 17 bp, Homo sapiens
gagttccatgaagacca

SEQ ID NO: 3958653 - DNA, 14 bp, Homo sapiens
gagttggctcaggc

SEQ ID NO: 3958654 - DNA, 16 bp, Homo sapiens
gagttgttttcagact

SEQ ID NO: 3958655 - DNA, 20 bp, Homo sapiens
gagtttaactttgggcccag

SEQ ID NO: 3958656 - DNA, 18 bp, Homo sapiens
gagtttcattctcctgcc

SEQ ID NO: 3958657 - DNA, 20 bp, Homo sapiens
gagtttcattctcctgcctg

SEQ ID NO: 3958658 - DNA, 15 bp, Homo sapiens
gagtttcgaggtaga

SEQ ID NO: 3958659 - DNA, 22 bp, Homo sapiens
gagtttgaaggaggtgagggat

SEQ ID NO: 3958660 - DNA, 20 bp, Homo sapiens
gagtttgagacaagccctgg

SEQ ID NO: 3958661 - DNA, 21 bp, Homo sapiens
gagtttgagacaagccctggc

SEQ ID NO: 3958662 - DNA, 12 bp, Homo sapiens
gagtttggtccc

SEQ ID NO: 3958663 - DNA, 13 bp, Homo sapiens
gagtttttagttt

SEQ ID NO: 3958664 - DNA, 21 bp, Homo sapiens
gataaacacagaggttttaaa

SEQ ID NO: 3958665 - DNA, 23 bp, Homo sapiens
gataaacacagaggttttaaaca

SEQ ID NO: 3958666 - DNA, 13 bp, Homo sapiens
gataaacattaaa

SEQ ID NO: 3958667 - DNA, 18 bp, Homo sapiens
gataaacattaaacactg

SEQ ID NO: 3958668 - DNA, 15 bp, Homo sapiens
gataaagatatcaat

SEQ ID NO: 3958669 - DNA, 18 bp, Homo sapiens
gataaataatcggcccac

SEQ ID NO: 3958670 - DNA, 16 bp, Homo sapiens
gataacaaaatcacaa

SEQ ID NO: 3958671 - DNA, 13 bp, Homo sapiens
gataacagaggca

SEQ ID NO: 3958672 - DNA, 12 bp, Homo sapiens
gataagtggaaa

SEQ ID NO: 3958673 - DNA, 14 bp, Homo sapiens
gataagtggaaaaa

SEQ ID NO: 3958674 - DNA, 19 bp, Homo sapiens
gataagtggaaaaaagaga

SEQ ID NO: 3958675 - DNA, 22 bp, Homo sapiens
gataagtggaaaaaagagaaaa

SEQ ID NO: 3958676 - DNA, 14 bp, Homo sapiens
gataatcagcctct

SEQ ID NO: 3958677 - DNA, 16 bp, Homo sapiens
gataatcagcctctta

SEQ ID NO: 3958678 - DNA, 15 bp, Homo sapiens
gataatgctgttgcc

SEQ ID NO: 3958679 - DNA, 22 bp, Homo sapiens
gatacactgaagttaacagaga

SEQ ID NO: 3958680 - DNA, 12 bp, Homo sapiens
gatacagaatga

SEQ ID NO: 3958681 - DNA, 20 bp, Homo sapiens
gatactaaaagttcttctcc

SEQ ID NO: 3958682 - DNA, 22 bp, Homo sapiens
gatactctccctgacatttcta

SEQ ID NO: 3958683 - DNA, 21 bp, Homo sapiens
gatactgactagtcatagaaa

SEQ ID NO: 3958684 - DNA, 21 bp, Homo sapiens
gatacttcaggtgcttttgat

SEQ ID NO: 3958685 - DNA, 22 bp, Homo sapiens
gatagaatatttacaataaaga

SEQ ID NO: 3958686 - DNA, 19 bp, Homo sapiens
gatagacagtgctgccctg

SEQ ID NO: 3958687 - DNA, 23 bp, Homo sapiens
gatagcatttttgatttatgcat

SEQ ID NO: 3958688 - DNA, 15 bp, Homo sapiens
gatataaatggctgg

SEQ ID NO: 3958689 - DNA, 23 bp, Homo sapiens
gatgagacttccaaacctgacag

SEQ ID NO: 3958690 - DNA, 15 bp, Homo sapiens
gatgagagtggctta

SEQ ID NO: 3958691 - DNA, 18 bp, Homo sapiens
gatgagagtggcttaaaa

SEQ ID NO: 3958692 - DNA, 13 bp, Homo sapiens
gatgagccgctgt

SEQ ID NO: 3958693 - DNA, 14 bp, Homo sapiens
gatgaggcctcttg

SEQ ID NO: 3958694 - DNA, 13 bp, Homo sapiens
gatgagggcagca

SEQ ID NO: 3958695 - DNA, 14 bp, Homo sapiens
gatgagggcagcag

SEQ ID NO: 3958696 - DNA, 16 bp, Homo sapiens
gatgagggcagcagcc

SEQ ID NO: 3958697 - DNA, 18 bp, Homo sapiens
gatgagggcagcagccag

SEQ ID NO: 3958698 - DNA, 18 bp, Homo sapiens
gatgaggtaattctccct

SEQ ID NO: 3958699 - DNA, 13 bp, Homo sapiens
gatgatcgtgcct

SEQ ID NO: 3958700 - DNA, 14 bp, Homo sapiens
gatgatgatgatga

SEQ ID NO: 3958701 - DNA, 17 bp, Homo sapiens
gatgatgatgatgatga

SEQ ID NO: 3958702 - DNA, 16 bp, Homo sapiens
gatgatgtctcttgta

SEQ ID NO: 3958703 - DNA, 18 bp, Homo sapiens
gatgcacggcggcagggt

SEQ ID NO: 3958704 - DNA, 22 bp, Homo sapiens
gatgcacggcggcagggtgggg

SEQ ID NO: 3958705 - DNA, 23 bp, Homo sapiens
gatgcacggcggcagggtggggg

SEQ ID NO: 3958706 - DNA, 11 bp, Homo sapiens
gatgcagaggg

SEQ ID NO: 3958707 - DNA, 13 bp, Homo sapiens
gcatcagaaagag

SEQ ID NO: 3958708 - DNA, 16 bp, Homo sapiens
gcatcagaaagggagg

SEQ ID NO: 3958709 - DNA, 21 bp, Homo sapiens
gcatcagaaagggagggctct

SEQ ID NO: 3958710 - DNA, 19 bp, Homo sapiens
gcatcaggcactggtggca

SEQ ID NO: 3958711 - DNA, 16 bp, Homo sapiens
gcatcatgcctctgag

SEQ ID NO: 3958712 - DNA, 18 bp, Homo sapiens
gcatcatgcctctgaggc

SEQ ID NO: 3958713 - DNA, 23 bp, Homo sapiens
gcatccacccagtgctgccatgc

SEQ ID NO: 3958714 - DNA, 24 bp, Homo sapiens
gcatccacccagtgctgccatgcc

SEQ ID NO: 3958715 - DNA, 14 bp, Homo sapiens
gcatccacgcacac

SEQ ID NO: 3958716 - DNA, 18 bp, Homo sapiens
gcatccacgcacacatgg

SEQ ID NO: 3958717 - DNA, 16 bp, Homo sapiens
gcatccagcctgtgtg

SEQ ID NO: 3958718 - DNA, 14 bp, Homo sapiens
gcatccattcctca

SEQ ID NO: 3958719 - DNA, 15 bp, Homo sapiens
gcatccattcctcag

SEQ ID NO: 3958720 - DNA, 18 bp, Homo sapiens
gcatccattcctcaggga

SEQ ID NO: 3958721 - DNA, 21 bp, Homo sapiens
gcatccattcctcagggacag

SEQ ID NO: 3958722 - DNA, 13 bp, Homo sapiens
gcatcccagggga

SEQ ID NO: 3958723 - DNA, 15 bp, Homo sapiens
gcatcccaggggacc

SEQ ID NO: 3958724 - DNA, 16 bp, Homo sapiens
gcatcccaggggacca

SEQ ID NO: 3958725 - DNA, 12 bp, Homo sapiens
gcatcccatccc

SEQ ID NO: 3958726 - DNA, 13 bp, Homo sapiens
gcatcccatccct

SEQ ID NO: 3958727 - DNA, 15 bp, Homo sapiens
gcatccgcagcccag

SEQ ID NO: 3958728 - DNA, 13 bp, Homo sapiens
gcatccggagaat

SEQ ID NO: 3958729 - DNA, 16 bp, Homo sapiens
gcatcctgcttcctag

SEQ ID NO: 3958730 - DNA, 15 bp, Homo sapiens
gcatcgtagaagaga

SEQ ID NO: 3958731 - DNA, 22 bp, Homo sapiens
gcactaaagtatgtaaagtatg

SEQ ID NO: 3958732 - DNA, 14 bp, Homo sapiens
gcactaaggccgtg

SEQ ID NO: 3958733 - DNA, 13 bp, Homo sapiens
gcactacatgtgg

SEQ ID NO: 3958734 - DNA, 22 bp, Homo sapiens
gcactagcattttcttgaacca

SEQ ID NO: 3958735 - DNA, 15 bp, Homo sapiens
gcactatgaaaatca

SEQ ID NO: 3958736 - DNA, 17 bp, Homo sapiens
gcactccatggccaccc

SEQ ID NO: 3958737 - DNA, 21 bp, Homo sapiens
gcactccctaagaaaccccag

SEQ ID NO: 3958738 - DNA, 20 bp, Homo sapiens
gcactcccttaggcattatt

SEQ ID NO: 3958739 - DNA, 20 bp, Homo sapiens
gcactcgagaccatcctggc

SEQ ID NO: 3958740 - DNA, 14 bp, Homo sapiens
gcactgaaaaggtt

SEQ ID NO: 3958741 - DNA, 14 bp, Homo sapiens
gcactgacccttcc

SEQ ID NO: 3958742 - DNA, 15 bp, Homo sapiens
gcactgacccttcca

SEQ ID NO: 3958743 - DNA, 15 bp, Homo sapiens
gcactgacttctaag

SEQ ID NO: 3958744 - DNA, 15 bp, Homo sapiens
gcactgagggccaca

SEQ ID NO: 3958745 - DNA, 19 bp, Homo sapiens
gcactgatttcacaacaga

SEQ ID NO: 3958746 - DNA, 16 bp, Homo sapiens
gcactgccaggaggga

SEQ ID NO: 3958747 - DNA, 17 bp, Homo sapiens
gcactgccaggagggac

SEQ ID NO: 3958748 - DNA, 21 bp, Homo sapiens
gcactgctaggcgagtgccag

SEQ ID NO: 3958749 - DNA, 16 bp, Homo sapiens
gcactggagtgcaggg

SEQ ID NO: 3958750 - DNA, 13 bp, Homo sapiens
gcactggccaccc

SEQ ID NO: 3958751 - DNA, 18 bp, Homo sapiens
gcactggccagagagggc

SEQ ID NO: 3958752 - DNA, 23 bp, Homo sapiens
gcactggccagagagggcccagc

SEQ ID NO: 3958753 - DNA, 19 bp, Homo sapiens
gcactggtggcccgacagc

SEQ ID NO: 3958754 - DNA, 18 bp, Homo sapiens
gcactgtggattatttca

SEQ ID NO: 3958755 - DNA, 23 bp, Homo sapiens
gcacttattatgaggctattaaa

SEQ ID NO: 3958756 - DNA, 16 bp, Homo sapiens
gcacttgcgtcctgca

SEQ ID NO: 3958757 - DNA, 18 bp, Homo sapiens
gcacttgcgtcctgcaga

SEQ ID NO: 3958758 - DNA, 20 bp, Homo sapiens
gcacttgcgtcctgcagagg

SEQ ID NO: 3958759 - DNA, 17 bp, Homo sapiens
gcacttgttccttctgc

SEQ ID NO: 3958760 - DNA, 17 bp, Homo sapiens
gcactttataaaagcaa

SEQ ID NO: 3958761 - DNA, 18 bp, Homo sapiens
gcactttttaaaaagtac

SEQ ID NO: 3958762 - DNA, 20 bp, Homo sapiens
gcagaaaaaaaaaaagaaac

SEQ ID NO: 3958763 - DNA, 14 bp, Homo sapiens
gcagaaaagaggag

SEQ ID NO: 3958764 - DNA, 16 bp, Homo sapiens
gcagaaaagaggagac

SEQ ID NO: 3958765 - DNA, 21 bp, Homo sapiens
gcagaaaagcacctgccgacc

SEQ ID NO: 3958766 - DNA, 12 bp, Homo sapiens
gcagaaaagtgc

SEQ ID NO: 3958767 - DNA, 15 bp, Homo sapiens
gcagaaaagtgctta

SEQ ID NO: 3958768 - DNA, 18 bp, Homo sapiens
gcagaaaagtgcttagaa

SEQ ID NO: 3958769 - DNA, 13 bp, Homo sapiens
gcagaaggaaggc

SEQ ID NO: 3958770 - DNA, 15 bp, Homo sapiens
gcagaaggaaggcag

SEQ ID NO: 3958771 - DNA, 16 bp, Homo sapiens
gcagaaggaaggcagg

SEQ ID NO: 3958772 - DNA, 15 bp, Homo sapiens
gcagaaggccaagaa

SEQ ID NO: 3958773 - DNA, 16 bp, Homo sapiens
gcagaaggggaagata

SEQ ID NO: 3958774 - DNA, 16 bp, Homo sapiens
gcagaagtcagcccga

SEQ ID NO: 3958775 - DNA, 13 bp, Homo sapiens
gcagacaagagct

SEQ ID NO: 3958776 - DNA, 16 bp, Homo sapiens
gcagacaagagctgct

SEQ ID NO: 3958777 - DNA, 14 bp, Homo sapiens
gcagacagagaaat

SEQ ID NO: 3958778 - DNA, 14 bp, Homo sapiens
gcagaccctgccct

SEQ ID NO: 3958779 - DNA, 16 bp, Homo sapiens
gcagaccgggggccag

SEQ ID NO: 3958780 - DNA, 17 bp, Homo sapiens
gcagaccgggggccaga

SEQ ID NO: 3958781 - DNA, 21 bp, Homo sapiens
gcagaccgggggccagacaca

SEQ ID NO: 3958782 - DNA, 17 bp, Homo sapiens
gcagaccgtgatttgga

SEQ ID NO: 3958783 - DNA, 18 bp, Homo sapiens
gcagagaaagaagagaca

SEQ ID NO: 3958784 - DNA, 23 bp, Homo sapiens
gcagagaaagaagagacaggagg

SEQ ID NO: 3958785 - DNA, 19 bp, Homo sapiens
gcagagacgcaagggagaa

SEQ ID NO: 3958786 - DNA, 22 bp, Homo sapiens
gcagagagcaggacaggagaca

SEQ ID NO: 3958787 - DNA, 17 bp, Homo sapiens
gcagagcaaatgaggga

SEQ ID NO: 3958788 - DNA, 18 bp, Homo sapiens
gcagagcaaatgagggag

SEQ ID NO: 3958789 - DNA, 19 bp, Homo sapiens
gcagagcaaatgagggagg

SEQ ID NO: 3958790 - DNA, 16 bp, Homo sapiens
gcagagccatgggcct

SEQ ID NO: 3958791 - DNA, 17 bp, Homo sapiens
gcagagccatgggcctg

SEQ ID NO: 3958792 - DNA, 19 bp, Homo sapiens
gcagagccatgggcctggg

SEQ ID NO: 3958793 - DNA, 14 bp, Homo sapiens
gcagaggaccacag

SEQ ID NO: 3958794 - DNA, 17 bp, Homo sapiens
gcagaggagtccagggc

SEQ ID NO: 3958795 - DNA, 14 bp, Homo sapiens
gcagaggcagacag

SEQ ID NO: 3958796 - DNA, 22 bp, Homo sapiens
gcagagggaatgttccctgcac

SEQ ID NO: 3958797 - DNA, 18 bp, Homo sapiens
gcagagggcagaggctgg

SEQ ID NO: 3958798 - DNA, 19 bp, Homo sapiens
gcagagggcagaggctgga

SEQ ID NO: 3958799 - DNA, 14 bp, Homo sapiens
gcagaggggcagcc

SEQ ID NO: 3958800 - DNA, 15 bp, Homo sapiens
gcagaggtggccaga

SEQ ID NO: 3958801 - DNA, 23 bp, Homo sapiens
gcagaggtggccagagctgggag

SEQ ID NO: 3958802 - DNA, 12 bp, Homo sapiens
gcagagtgagga

SEQ ID NO: 3958803 - DNA, 21 bp, Homo sapiens
gcagataaagacagctgacag

SEQ ID NO: 3958804 - DNA, 16 bp, Homo sapiens
gcagataatcagcctc

SEQ ID NO: 3958805 - DNA, 19 bp, Homo sapiens
gcagatagccagacacatg

SEQ ID NO: 3958806 - DNA, 15 bp, Homo sapiens
gcagatgtaggaggg

SEQ ID NO: 3958807 - DNA, 17 bp, Homo sapiens
gcagatgtaggagggac

SEQ ID NO: 3958808 - DNA, 19 bp, Homo sapiens
gcagatgtaggagggactg

SEQ ID NO: 3958809 - DNA, 15 bp, Homo sapiens
gcagattcctgggcc

SEQ ID NO: 3958810 - DNA, 20 bp, Homo sapiens
gcagatttagtgaaagctag

SEQ ID NO: 3958811 - DNA, 18 bp, Homo sapiens
gcagcaaaaatataaaat

SEQ ID NO: 3958812 - DNA, 11 bp, Homo sapiens
gcagcaactcc

SEQ ID NO: 3958813 - DNA, 17 bp, Homo sapiens
gcagcaaggcccgagca

SEQ ID NO: 3958814 - DNA, 12 bp, Homo sapiens
gcagcaccctcc

SEQ ID NO: 3958815 - DNA, 13 bp, Homo sapiens
gcagcaccctccc

SEQ ID NO: 3958816 - DNA, 15 bp, Homo sapiens
gcagcaccctccccc

SEQ ID NO: 3958817 - DNA, 20 bp, Homo sapiens
gcagcaccctcccccgcagc

SEQ ID NO: 3958818 - DNA, 16 bp, Homo sapiens
gcccatacccctgcct

SEQ ID NO: 3958819 - DNA, 24 bp, Homo sapiens
gcccatctcaggtgccactccctg

SEQ ID NO: 3958820 - DNA, 14 bp, Homo sapiens
gcccatggcctctg

SEQ ID NO: 3958821 - DNA, 14 bp, Homo sapiens
gcccatgtgtcccc

SEQ ID NO: 3958822 - DNA, 16 bp, Homo sapiens
gcccatgtgtcccctc

SEQ ID NO: 3958823 - DNA, 22 bp, Homo sapiens
gcccatgtgtcccctcactctg

SEQ ID NO: 3958824 - DNA, 14 bp, Homo sapiens
gcccattctctctc

SEQ ID NO: 3958825 - DNA, 15 bp, Homo sapiens
gcccattctctctcc

SEQ ID NO: 3958826 - DNA, 20 bp, Homo sapiens
gcccatttcaattctcaaaa

SEQ ID NO: 3958827 - DNA, 18 bp, Homo sapiens
gcccattttatctttgaa

SEQ ID NO: 3958828 - DNA, 12 bp, Homo sapiens
gccccaaatata

SEQ ID NO: 3958829 - DNA, 22 bp, Homo sapiens
gccccaacccgtggaggctgct

SEQ ID NO: 3958830 - DNA, 15 bp, Homo sapiens
gccccaactcctgga

SEQ ID NO: 3958831 - DNA, 17 bp, Homo sapiens
gccccaactcctggaag

SEQ ID NO: 3958832 - DNA, 18 bp, Homo sapiens
gccccaactcctggaagc

SEQ ID NO: 3958833 - DNA, 18 bp, Homo sapiens
gccccaactccttccagc

SEQ ID NO: 3958834 - DNA, 13 bp, Homo sapiens
gccccaagcagcc

SEQ ID NO: 3958835 - DNA, 21 bp, Homo sapiens
gccccaagcagccagccagtc

SEQ ID NO: 3958836 - DNA, 23 bp, Homo sapiens
gccccaagcagccagccagtctt

SEQ ID NO: 3958837 - DNA, 14 bp, Homo sapiens
gccccaaggggccc

SEQ ID NO: 3958838 - DNA, 15 bp, Homo sapiens
gccccaaggggccca

SEQ ID NO: 3958839 - DNA, 17 bp, Homo sapiens
gccccacagcacccagg

SEQ ID NO: 3958840 - DNA, 18 bp, Homo sapiens
gccccacagcacccaggc

SEQ ID NO: 3958841 - DNA, 20 bp, Homo sapiens
gccccacagcacccaggctc

SEQ ID NO: 3958842 - DNA, 18 bp, Homo sapiens
gccccaccacctaggcca

SEQ ID NO: 3958843 - DNA, 23 bp, Homo sapiens
gccccaccacctaggccactcct

SEQ ID NO: 3958844 - DNA, 21 bp, Homo sapiens
gccccaccctcgtggacacct

SEQ ID NO: 3958845 - DNA, 22 bp, Homo sapiens
gccccagactcctttcctctga

SEQ ID NO: 3958846 - DNA, 13 bp, Homo sapiens
gccccagagcccc

SEQ ID NO: 3958847 - DNA, 19 bp, Homo sapiens
gccccagaggcctctctct

SEQ ID NO: 3958848 - DNA, 21 bp, Homo sapiens
gccccagatctgcctgggcct

SEQ ID NO: 3958849 - DNA, 22 bp, Homo sapiens
gccccagatctgcctgggcctg

SEQ ID NO: 3958850 - DNA, 23 bp, Homo sapiens
gccccagatctgcctgggcctgt

SEQ ID NO: 3958851 - DNA, 15 bp, Homo sapiens
gcagccagccctgcc

SEQ ID NO: 3958852 - DNA, 19 bp, Homo sapiens
gcagccaggggctgctcat

SEQ ID NO: 3958853 - DNA, 21 bp, Homo sapiens
gcagccaggggctgctcatca

SEQ ID NO: 3958854 - DNA, 17 bp, Homo sapiens
gcagccatgcctcatgc

SEQ ID NO: 3958855 - DNA, 16 bp, Homo sapiens
gcagcccagcttcctg

SEQ ID NO: 3958856 - DNA, 20 bp, Homo sapiens
gcagcccagggtagggagaa

SEQ ID NO: 3958857 - DNA, 15 bp, Homo sapiens
gcagcccgtgaagca

SEQ ID NO: 3958858 - DNA, 24 bp, Homo sapiens
gcagccctaaggatctctcaggag

SEQ ID NO: 3958859 - DNA, 13 bp, Homo sapiens
gcagccctcctca

SEQ ID NO: 3958860 - DNA, 15 bp, Homo sapiens
gcagccctcctcacc

SEQ ID NO: 3958861 - DNA, 16 bp, Homo sapiens
gcagcccttcctcctg

SEQ ID NO: 3958862 - DNA, 17 bp, Homo sapiens
gcagccgccgggcaggc

SEQ ID NO: 3958863 - DNA, 17 bp, Homo sapiens
gcagccgctaggagaga

SEQ ID NO: 3958864 - DNA, 21 bp, Homo sapiens
gcagccgctaggagagactga

SEQ ID NO: 3958865 - DNA, 14 bp, Homo sapiens
gcagccgtgccttc

SEQ ID NO: 3958866 - DNA, 18 bp, Homo sapiens
gcagcctcctgggcagtc

SEQ ID NO: 3958867 - DNA, 12 bp, Homo sapiens
gcagcctgatgg

SEQ ID NO: 3958868 - DNA, 15 bp, Homo sapiens
gcagcctgatggcca

SEQ ID NO: 3958869 - DNA, 20 bp, Homo sapiens
gcagcctgatggccaagggg

SEQ ID NO: 3958870 - DNA, 20 bp, Homo sapiens
gcagcctggcggggcaggag

SEQ ID NO: 3958871 - DNA, 22 bp, Homo sapiens
gcagcgcagccgccgggcaggc

SEQ ID NO: 3958872 - DNA, 17 bp, Homo sapiens
gcagctaggactgagga

SEQ ID NO: 3958873 - DNA, 22 bp, Homo sapiens
gcagctatgcgcaatgtggcat

SEQ ID NO: 3958874 - DNA, 13 bp, Homo sapiens
gcagctcctctcc

SEQ ID NO: 3958875 - DNA, 14 bp, Homo sapiens
gcagctcctctcct

SEQ ID NO: 3958876 - DNA, 17 bp, Homo sapiens
gcagctctttcttcttt

SEQ ID NO: 3958877 - DNA, 14 bp, Homo sapiens
gcagctgagagccc

SEQ ID NO: 3958878 - DNA, 17 bp, Homo sapiens
gcagctgagagccctgc

SEQ ID NO: 3958879 - DNA, 21 bp, Homo sapiens
gcagctgagagccctgctgtg

SEQ ID NO: 3958880 - DNA, 23 bp, Homo sapiens
gcagctgagagccctgctgtggg

SEQ ID NO: 3958881 - DNA, 17 bp, Homo sapiens
gcagctgagcagggccg

SEQ ID NO: 3958882 - DNA, 20 bp, Homo sapiens
gcagctgagcagggccgggg

SEQ ID NO: 3958883 - DNA, 15 bp, Homo sapiens
gcagctgattttgtc

SEQ ID NO: 3958884 - DNA, 18 bp, Homo sapiens
gcagctggctctccacct

SEQ ID NO: 3958885 - DNA, 16 bp, Homo sapiens
gcagctgggacccctc

SEQ ID NO: 3958886 - DNA, 20 bp, Homo sapiens
gcagctgggacccctcccaa

SEQ ID NO: 3958887 - DNA, 12 bp, Homo sapiens
gcagctgggccc

SEQ ID NO: 3958888 - DNA, 20 bp, Homo sapiens
gcagctgggccccatgctct

SEQ ID NO: 3958889 - DNA, 19 bp, Homo sapiens
gcagctgggccggccagcc

SEQ ID NO: 3958890 - DNA, 20 bp, Homo sapiens
gcagctgggccggccagcct

SEQ ID NO: 3958891 - DNA, 22 bp, Homo sapiens
gcagctgggccggccagccttg

SEQ ID NO: 3958892 - DNA, 13 bp, Homo sapiens
gcagcttcagttg

SEQ ID NO: 3958893 - DNA, 17 bp, Homo sapiens
gcagcttcatcaatttt

SEQ ID NO: 3958894 - DNA, 14 bp, Homo sapiens
gcagcttcctgtca

SEQ ID NO: 3958895 - DNA, 15 bp, Homo sapiens
gcagcttgtagccag

SEQ ID NO: 3958896 - DNA, 20 bp, Homo sapiens
gcagcttgtagccagccggg

SEQ ID NO: 3958897 - DNA, 22 bp, Homo sapiens
gcagcttgtagccagccggggc

SEQ ID NO: 3958898 - DNA, 19 bp, Homo sapiens
gcaggaacagagactctgg

SEQ ID NO: 3958899 - DNA, 15 bp, Homo sapiens
gcaggaacgagcact

SEQ ID NO: 3958900 - DNA, 17 bp, Homo sapiens
gcaggaacgagcactgg

SEQ ID NO: 3958901 - DNA, 23 bp, Homo sapiens
gcaggaacgagcactggccagag

SEQ ID NO: 3958902 - DNA, 14 bp, Homo sapiens
gcaggaactcccag

SEQ ID NO: 3958903 - DNA, 15 bp, Homo sapiens
gcaggaactcccagc

SEQ ID NO: 3958904 - DNA, 13 bp, Homo sapiens
gcaggaagagaga

SEQ ID NO: 3958905 - DNA, 13 bp, Homo sapiens
gcaggaagtctct

SEQ ID NO: 3958906 - DNA, 17 bp, Homo sapiens
gcaggaatgtgtggcag

SEQ ID NO: 3958907 - DNA, 20 bp, Homo sapiens
gcaggacacatcccggcctc

SEQ ID NO: 3958908 - DNA, 22 bp, Homo sapiens
gcaggacacatcccggcctctt

SEQ ID NO: 3958909 - DNA, 15 bp, Homo sapiens
gcaggagcaggaaca

SEQ ID NO: 3958910 - DNA, 15 bp, Homo sapiens
gcaggagtagctgag

SEQ ID NO: 3958911 - DNA, 17 bp, Homo sapiens
gcaggagtagctgagct

SEQ ID NO: 3958912 - DNA, 12 bp, Homo sapiens
gcaggatctcag

SEQ ID NO: 3958913 - DNA, 19 bp, Homo sapiens
gcaggcacacagcagcccc

SEQ ID NO: 3958914 - DNA, 15 bp, Homo sapiens
gcaggcacatggagg

SEQ ID NO: 3958915 - DNA, 17 bp, Homo sapiens
gcaggcagagcggggag

SEQ ID NO: 3958916 - DNA, 18 bp, Homo sapiens
gcaggcagagcggggagg

SEQ ID NO: 3958917 - DNA, 12 bp, Homo sapiens
gcaggcagggct

SEQ ID NO: 3958918 - DNA, 16 bp, Homo sapiens
gcaggcagggctctcc

SEQ ID NO: 3958919 - DNA, 20 bp, Homo sapiens
gcaggcagggctctcctggc

SEQ ID NO: 3958920 - DNA, 12 bp, Homo sapiens
gcaggcatgccg

SEQ ID NO: 3958921 - DNA, 19 bp, Homo sapiens
gcaggcccgacagagagat

SEQ ID NO: 3958922 - DNA, 22 bp, Homo sapiens
gcaggcccgacagagagatgaa

SEQ ID NO: 3958923 - DNA, 12 bp, Homo sapiens
gcaggcctggga

SEQ ID NO: 3958924 - DNA, 14 bp, Homo sapiens
gcaggcctgggacc

SEQ ID NO: 3958925 - DNA, 15 bp, Homo sapiens
gcaggctaccccttc

SEQ ID NO: 3958926 - DNA, 15 bp, Homo sapiens
gcaggctactgtcag

SEQ ID NO: 3958927 - DNA, 23 bp, Homo sapiens
gcaggctccccctgcctttgaaa

SEQ ID NO: 3958928 - DNA, 11 bp, Homo sapiens
gcaggctctgg

SEQ ID NO: 3958929 - DNA, 12 bp, Homo sapiens
gcaggctctggg

SEQ ID NO: 3958930 - DNA, 13 bp, Homo sapiens
gcaggctctgggc

SEQ ID NO: 3958931 - DNA, 15 bp, Homo sapiens
gcaggctctgggctc

SEQ ID NO: 3958932 - DNA, 16 bp, Homo sapiens
gcaggctctgggctca

SEQ ID NO: 3958933 - DNA, 16 bp, Homo sapiens
gcagggaaagctccac

SEQ ID NO: 3958934 - DNA, 21 bp, Homo sapiens
gcagggaagtcttacttaaaa

SEQ ID NO: 3958935 - DNA, 14 bp, Homo sapiens
gcagggacaaagag

SEQ ID NO: 3958936 - DNA, 15 bp, Homo sapiens
gcagggacacccccc

SEQ ID NO: 3958937 - DNA, 14 bp, Homo sapiens
gccgaccagagccc

SEQ ID NO: 3958938 - DNA, 13 bp, Homo sapiens
gccgacctcgtcc

SEQ ID NO: 3958939 - DNA, 15 bp, Homo sapiens
gccgagagcctgctc

SEQ ID NO: 3958940 - DNA, 18 bp, Homo sapiens
gccgagattgcgccactg

SEQ ID NO: 3958941 - DNA, 20 bp, Homo sapiens
gccgagattgcgccactgca

SEQ ID NO: 3958942 - DNA, 19 bp, Homo sapiens
gccgagcctaatgaaaggg

SEQ ID NO: 3958943 - DNA, 15 bp, Homo sapiens
gccgcaccccagagt

SEQ ID NO: 3958944 - DNA, 23 bp, Homo sapiens
gccgcaccccagagtgtgggaag

SEQ ID NO: 3958945 - DNA, 15 bp, Homo sapiens
gccgcatcttctcca

SEQ ID NO: 3958946 - DNA, 17 bp, Homo sapiens
gccgcatcttctccatc

SEQ ID NO: 3958947 - DNA, 15 bp, Homo sapiens
gccgcattccctgag

SEQ ID NO: 3958948 - DNA, 16 bp, Homo sapiens
gccgcattccctgagt

SEQ ID NO: 3958949 - DNA, 23 bp, Homo sapiens
gccgccctgggctgtctgtcacc

SEQ ID NO: 3958950 - DNA, 17 bp, Homo sapiens
gccgcctcccagcctgg

SEQ ID NO: 3958951 - DNA, 17 bp, Homo sapiens
gccgctaggagagactg

SEQ ID NO: 3958952 - DNA, 15 bp, Homo sapiens
gccgctgttcaccca

SEQ ID NO: 3958953 - DNA, 17 bp, Homo sapiens
gccgctgttcacccaca

SEQ ID NO: 3958954 - DNA, 15 bp, Homo sapiens
gccggagccgcccac

SEQ ID NO: 3958955 - DNA, 20 bp, Homo sapiens
gccggcaaccccagttctgc

SEQ ID NO: 3958956 - DNA, 23 bp, Homo sapiens
gccggcaaccccagttctgctcc

SEQ ID NO: 3958957 - DNA, 18 bp, Homo sapiens
gccgggagaggactctgc

SEQ ID NO: 3958958 - DNA, 15 bp, Homo sapiens
gccgggcaggcctgc

SEQ ID NO: 3958959 - DNA, 18 bp, Homo sapiens
gccgggcaggtcctgccc

SEQ ID NO: 3958960 - DNA, 19 bp, Homo sapiens
gccgggcaggtcctgccca

SEQ ID NO: 3958961 - DNA, 12 bp, Homo sapiens
gccgggcctggg

SEQ ID NO: 3958962 - DNA, 17 bp, Homo sapiens
gccgggcggaaggggac

SEQ ID NO: 3958963 - DNA, 16 bp, Homo sapiens
gccggggaactggcca

SEQ ID NO: 3958964 - DNA, 23 bp, Homo sapiens
gccggggaactggccaagctgag

SEQ ID NO: 3958965 - DNA, 18 bp, Homo sapiens
gccgggttctagtctcct

SEQ ID NO: 3958966 - DNA, 14 bp, Homo sapiens
gccggtacctggga

SEQ ID NO: 3958967 - DNA, 16 bp, Homo sapiens
gccggtcacccaggct

SEQ ID NO: 3958968 - DNA, 17 bp, Homo sapiens
gccgtagagggtggccg

SEQ ID NO: 3958969 - DNA, 14 bp, Homo sapiens
gccgtccatggcac

SEQ ID NO: 3958970 - DNA, 16 bp, Homo sapiens
gccgtccatggcacca

SEQ ID NO: 3958971 - DNA, 17 bp, Homo sapiens
gccgtccatggcaccag

SEQ ID NO: 3958972 - DNA, 21 bp, Homo sapiens
gccgtccatggcaccagcccc

SEQ ID NO: 3958973 - DNA, 22 bp, Homo sapiens
gccgtccatggcaccagccccc

SEQ ID NO: 3958974 - DNA, 16 bp, Homo sapiens
gccgtctgactccaga

SEQ ID NO: 3958975 - DNA, 17 bp, Homo sapiens
gccgtctgactccagag

SEQ ID NO: 3958976 - DNA, 18 bp, Homo sapiens
gccgtctgactccagagt

SEQ ID NO: 3958977 - DNA, 21 bp, Homo sapiens
gccgtctgactccagagtctg

SEQ ID NO: 3958978 - DNA, 15 bp, Homo sapiens
gccgtgcccaggggc

SEQ ID NO: 3958979 - DNA, 15 bp, Homo sapiens
gccgtgccttcagct

SEQ ID NO: 3958980 - DNA, 11 bp, Homo sapiens
gccgtggcttc

SEQ ID NO: 3958981 - DNA, 22 bp, Homo sapiens
gccgtggcttcccgctcagccc

SEQ ID NO: 3958982 - DNA, 22 bp, Homo sapiens
gccgttccgtcccaaacagagg

SEQ ID NO: 3958983 - DNA, 14 bp, Homo sapiens
gcctaaaaatgcaa

SEQ ID NO: 3958984 - DNA, 16 bp, Homo sapiens
gcctaaaagtaaacat

SEQ ID NO: 3958985 - DNA, 13 bp, Homo sapiens
gcctaaatctaat

SEQ ID NO: 3958986 - DNA, 18 bp, Homo sapiens
gcctaatatttaggcaag

SEQ ID NO: 3958987 - DNA, 20 bp, Homo sapiens
gcctaatatttaggcaagag

SEQ ID NO: 3958988 - DNA, 20 bp, Homo sapiens
gcctagatccacacacagag

SEQ ID NO: 3958989 - DNA, 15 bp, Homo sapiens
gcctagccacctccc

SEQ ID NO: 3958990 - DNA, 21 bp, Homo sapiens
gcctaggagttgagtacagtg

SEQ ID NO: 3958991 - DNA, 19 bp, Homo sapiens
gcctaggccaaatgcacaa

SEQ ID NO: 3958992 - DNA, 21 bp, Homo sapiens
gcctaggccaaatgcacaagc

SEQ ID NO: 3958993 - DNA, 18 bp, Homo sapiens
gcctagtggggtctccct

SEQ ID NO: 3958994 - DNA, 15 bp, Homo sapiens
gcctatccatcctgc

SEQ ID NO: 3958995 - DNA, 14 bp, Homo sapiens
gcctatggagagcc

SEQ ID NO: 3958996 - DNA, 22 bp, Homo sapiens
gcctatggagagccctgggacc

SEQ ID NO: 3958997 - DNA, 19 bp, Homo sapiens
gcctatttattcattcagt

SEQ ID NO: 3958998 - DNA, 14 bp, Homo sapiens
gcctcactggctgg

SEQ ID NO: 3958999 - DNA, 18 bp, Homo sapiens
gcctcacttccctgggaa

SEQ ID NO: 3959000 - DNA, 16 bp, Homo sapiens
gcctcagaccaactct

SEQ ID NO: 3959001 - DNA, 22 bp, Homo sapiens
gcctcagcaggaacctgtactg

SEQ ID NO: 3959002 - DNA, 13 bp, Homo sapiens
gcctcagccctca

SEQ ID NO: 3959003 - DNA, 15 bp, Homo sapiens
gcctcagccctcaga

SEQ ID NO: 3959004 - DNA, 16 bp, Homo sapiens
gcctcagccctcagaa

SEQ ID NO: 3959005 - DNA, 12 bp, Homo sapiens
gcctcagctcag

SEQ ID NO: 3959006 - DNA, 15 bp, Homo sapiens
gcctcagctcagcct

SEQ ID NO: 3959007 - DNA, 19 bp, Homo sapiens
gcctcagctcagcctcccc

SEQ ID NO: 3959008 - DNA, 24 bp, Homo sapiens
gcctcagtgccacttgacattcct

SEQ ID NO: 3959009 - DNA, 22 bp, Homo sapiens
gcctcagttcaacctggtggca

SEQ ID NO: 3959010 - DNA, 13 bp, Homo sapiens
gcctcagtttccc

SEQ ID NO: 3959011 - DNA, 19 bp, Homo sapiens
gcctcagtttctccatcag

SEQ ID NO: 3959012 - DNA, 15 bp, Homo sapiens
gcctcatatttaaag

SEQ ID NO: 3959013 - DNA, 15 bp, Homo sapiens
gcctcatctccttta

SEQ ID NO: 3959014 - DNA, 13 bp, Homo sapiens
gcctcatgccaca

SEQ ID NO: 3959015 - DNA, 17 bp, Homo sapiens
gcctcatgccacacctt

SEQ ID NO: 3959016 - DNA, 18 bp, Homo sapiens
gcctcatgccacaccttc

SEQ ID NO: 3959017 - DNA, 18 bp, Homo sapiens
gcctccaccgctgcctaa

SEQ ID NO: 3959018 - DNA, 19 bp, Homo sapiens
gcctccactcccccacctg

SEQ ID NO: 3959019 - DNA, 12 bp, Homo sapiens
gcctccagagcc

SEQ ID NO: 3959020 - DNA, 16 bp, Homo sapiens
gcctccagagccagcc

SEQ ID NO: 3959021 - DNA, 20 bp, Homo sapiens
gcctccagagccagcctggg

SEQ ID NO: 3959022 - DNA, 20 bp, Homo sapiens
gcctccagcctctcccggct

SEQ ID NO: 3959023 - DNA, 16 bp, Homo sapiens
gccctccatgggctag

SEQ ID NO: 3959024 - DNA, 21 bp, Homo sapiens
gccctcccatgttgcatgcct

SEQ ID NO: 3959025 - DNA, 22 bp, Homo sapiens
gccctcccatgttgcatgccta

SEQ ID NO: 3959026 - DNA, 17 bp, Homo sapiens
gccctccccatcccatg

SEQ ID NO: 3959027 - DNA, 15 bp, Homo sapiens
gccctcccccttccc

SEQ ID NO: 3959028 - DNA, 19 bp, Homo sapiens
gccctccctgactccctgt

SEQ ID NO: 3959029 - DNA, 23 bp, Homo sapiens
gccctccctgactccctgtgggg

SEQ ID NO: 3959030 - DNA, 14 bp, Homo sapiens
gccctccctgtcct

SEQ ID NO: 3959031 - DNA, 10 bp, Homo sapiens
gccctccttc

SEQ ID NO: 3959032 - DNA, 19 bp, Homo sapiens
gccctcgaaccaaggcagc

SEQ ID NO: 3959033 - DNA, 23 bp, Homo sapiens
gccctcgaaccaaggcagcctcc

SEQ ID NO: 3959034 - DNA, 19 bp, Homo sapiens
gccctctcccatgcacaca

SEQ ID NO: 3959035 - DNA, 16 bp, Homo sapiens
gccctctccttcctta

SEQ ID NO: 3959036 - DNA, 13 bp, Homo sapiens
gccctctctcagt

SEQ ID NO: 3959037 - DNA, 22 bp, Homo sapiens
gccctctggatcctgctgtggc

SEQ ID NO: 3959038 - DNA, 17 bp, Homo sapiens
gccctgacctcccagcc

SEQ ID NO: 3959039 - DNA, 23 bp, Homo sapiens
gccctgagtggatctccaaggac

SEQ ID NO: 3959040 - DNA, 15 bp, Homo sapiens
gccctgcaaaaatat

SEQ ID NO: 3959041 - DNA, 16 bp, Homo sapiens
gccctgcacctgtgca

SEQ ID NO: 3959042 - DNA, 17 bp, Homo sapiens
gccctgcacctgtgcag

SEQ ID NO: 3959043 - DNA, 15 bp, Homo sapiens
gccctgcagaccctg

SEQ ID NO: 3959044 - DNA, 13 bp, Homo sapiens
gccctgccacctg

SEQ ID NO: 3959045 - DNA, 14 bp, Homo sapiens
gccctgccacctgt

SEQ ID NO: 3959046 - DNA, 16 bp, Homo sapiens
gccctgccacctgtct

SEQ ID NO: 3959047 - DNA, 18 bp, Homo sapiens
gccctgccacctgtctgt

SEQ ID NO: 3959048 - DNA, 17 bp, Homo sapiens
gccctgccaggaggctg

SEQ ID NO: 3959049 - DNA, 20 bp, Homo sapiens
gccctgcccccatctcccca

SEQ ID NO: 3959050 - DNA, 23 bp, Homo sapiens
gccctgcccccatctccccaggc

SEQ ID NO: 3959051 - DNA, 13 bp, Homo sapiens
gccctgccctgcc

SEQ ID NO: 3959052 - DNA, 17 bp, Homo sapiens
gccctgccctgccacct

SEQ ID NO: 3959053 - DNA, 20 bp, Homo sapiens
gccctgcctccctttctggg

SEQ ID NO: 3959054 - DNA, 13 bp, Homo sapiens
gccctgcctgccc

SEQ ID NO: 3959055 - DNA, 16 bp, Homo sapiens
gccctgcctgcccact

SEQ ID NO: 3959056 - DNA, 23 bp, Homo sapiens
gccctgcctggaggacctgagcc

SEQ ID NO: 3959057 - DNA, 12 bp, Homo sapiens
gccctgccttca

SEQ ID NO: 3959058 - DNA, 19 bp, Homo sapiens
gccctgccttcagctttgg

SEQ ID NO: 3959059 - DNA, 21 bp, Homo sapiens
gccctgcgttggagccactcc

SEQ ID NO: 3959060 - DNA, 14 bp, Homo sapiens
gccctgctctgggg

SEQ ID NO: 3959061 - DNA, 14 bp, Homo sapiens
gccctgctgtggga

SEQ ID NO: 3959062 - DNA, 16 bp, Homo sapiens
gccctgctttgggctg

SEQ ID NO: 3959063 - DNA, 18 bp, Homo sapiens
gccctggatcagcgtggc

SEQ ID NO: 3959064 - DNA, 19 bp, Homo sapiens
gccctggatcagcgtggcc

SEQ ID NO: 3959065 - DNA, 21 bp, Homo sapiens
gccctggatcagcgtggcctt

SEQ ID NO: 3959066 - DNA, 22 bp, Homo sapiens
gccctggatcagcgtggccttg

SEQ ID NO: 3959067 - DNA, 23 bp, Homo sapiens
gccctggatcagcgtggccttgt

SEQ ID NO: 3959068 - DNA, 20 bp, Homo sapiens
gccctggcccagagctggaa

SEQ ID NO: 3959069 - DNA, 12 bp, Homo sapiens
gccctggcctgc

SEQ ID NO: 3959070 - DNA, 12 bp, Homo sapiens
gccctggctctg

SEQ ID NO: 3959071 - DNA, 14 bp, Homo sapiens
gccctgggaccgct

SEQ ID NO: 3959072 - DNA, 18 bp, Homo sapiens
gccctgggccccaccacc

SEQ ID NO: 3959073 - DNA, 22 bp, Homo sapiens
gccctgggccccaccacctagg

SEQ ID NO: 3959074 - DNA, 12 bp, Homo sapiens
gccctgggcctc

SEQ ID NO: 3959075 - DNA, 14 bp, Homo sapiens
gccctgggcctcag

SEQ ID NO: 3959076 - DNA, 21 bp, Homo sapiens
gccctgggctgtctgtcacca

SEQ ID NO: 3959077 - DNA, 22 bp, Homo sapiens
gccctgggctgtctgtcaccag

SEQ ID NO: 3959078 - DNA, 23 bp, Homo sapiens
gccctgggctgtctgtcaccagc

SEQ ID NO: 3959079 - DNA, 18 bp, Homo sapiens
gccctggggcctgtactg

SEQ ID NO: 3959080 - DNA, 19 bp, Homo sapiens
gccctggggcctgtactgc

SEQ ID NO: 3959081 - DNA, 22 bp, Homo sapiens
gccctggggcctgtactgcctg

SEQ ID NO: 3959082 - DNA, 15 bp, Homo sapiens
gccctgggggccagc

SEQ ID NO: 3959083 - DNA, 16 bp, Homo sapiens
gccctgggggccagct

SEQ ID NO: 3959084 - DNA, 18 bp, Homo sapiens
gccctgggggccagctgg

SEQ ID NO: 3959085 - DNA, 11 bp, Homo sapiens
gccctggggta

SEQ ID NO: 3959086 - DNA, 21 bp, Homo sapiens
gccctgggtctaaggggttgg

SEQ ID NO: 3959087 - DNA, 17 bp, Homo sapiens
gccctggtgctgccaca

SEQ ID NO: 3959088 - DNA, 16 bp, Homo sapiens
gccctggtgtgtttcc

SEQ ID NO: 3959089 - DNA, 18 bp, Homo sapiens
gccctgtggattccagca

SEQ ID NO: 3959090 - DNA, 13 bp, Homo sapiens
gccctgttaaaag

SEQ ID NO: 3959091 - DNA, 21 bp, Homo sapiens
gcccttccatgtcgcctctgc

SEQ ID NO: 3959092 - DNA, 18 bp, Homo sapiens
gcccttcctctccactgc

SEQ ID NO: 3959093 - DNA, 13 bp, Homo sapiens
gcccttcctggac

SEQ ID NO: 3959094 - DNA, 17 bp, Homo sapiens
gcccttcgctgccagga

SEQ ID NO: 3959095 - DNA, 20 bp, Homo sapiens
gcccttgcccccatccctcg

SEQ ID NO: 3959096 - DNA, 14 bp, Homo sapiens
gcccttgccctgac

SEQ ID NO: 3959097 - DNA, 16 bp, Homo sapiens
gcccttgccctgacct

SEQ ID NO: 3959098 - DNA, 21 bp, Homo sapiens
gcccttgccctgacctcccag

SEQ ID NO: 3959099 - DNA, 13 bp, Homo sapiens
gcccttggggcct

SEQ ID NO: 3959100 - DNA, 19 bp, Homo sapiens
gcccttggggcctggcttg

SEQ ID NO: 3959101 - DNA, 20 bp, Homo sapiens
gcccttggggcctggcttgc

SEQ ID NO: 3959102 - DNA, 20 bp, Homo sapiens
gcccttggggttcccccaga

SEQ ID NO: 3959103 - DNA, 13 bp, Homo sapiens
gcccttgtcctgc

SEQ ID NO: 3959104 - DNA, 14 bp, Homo sapiens
gcccttgtcctgcc

SEQ ID NO: 3959105 - DNA, 16 bp, Homo sapiens
gcccttgtcctgccag

SEQ ID NO: 3959106 - DNA, 18 bp, Homo sapiens
gcccttgtttggggcagg

SEQ ID NO: 3959107 - DNA, 21 bp, Homo sapiens
gcccttgtttggggcaggagt

SEQ ID NO: 3959108 - DNA, 23 bp, Homo sapiens
gcccttgtttggggcaggagtag

SEQ ID NO: 3959109 - DNA, 13 bp, Homo sapiens
gcgccctgcagac

SEQ ID NO: 3959110 - DNA, 20 bp, Homo sapiens
gcgcctagtggggtctccct

SEQ ID NO: 3959111 - DNA, 21 bp, Homo sapiens
gcgcctgccctccctggggtc

SEQ ID NO: 3959112 - DNA, 16 bp, Homo sapiens
gcgcctgtagtcccag

SEQ ID NO: 3959113 - DNA, 14 bp, Homo sapiens
gcgcgggaggcacc

SEQ ID NO: 3959114 - DNA, 16 bp, Homo sapiens
gcgcgggaggcaccag

SEQ ID NO: 3959115 - DNA, 17 bp, Homo sapiens
gcgcgggaggcaccagc

SEQ ID NO: 3959116 - DNA, 14 bp, Homo sapiens
gcgcgggcggaggc

SEQ ID NO: 3959117 - DNA, 14 bp, Homo sapiens
gcgctatcttcaca

SEQ ID NO: 3959118 - DNA, 21 bp, Homo sapiens
gcgctcaggacccaggccctc

SEQ ID NO: 3959119 - DNA, 15 bp, Homo sapiens
gcgctcatctggctt

SEQ ID NO: 3959120 - DNA, 11 bp, Homo sapiens
gcgctgcaggt

SEQ ID NO: 3959121 - DNA, 16 bp, Homo sapiens
gcgctgccgcacccca

SEQ ID NO: 3959122 - DNA, 17 bp, Homo sapiens
gcgctgccgcaccccag

SEQ ID NO: 3959123 - DNA, 11 bp, Homo sapiens
gcgctggctca

SEQ ID NO: 3959124 - DNA, 15 bp, Homo sapiens
gcgctggctcaggaa

SEQ ID NO: 3959125 - DNA, 15 bp, Homo sapiens
gcggaaaccttgcag

SEQ ID NO: 3959126 - DNA, 13 bp, Homo sapiens
gcggaaggggacg

SEQ ID NO: 3959127 - DNA, 20 bp, Homo sapiens
gcggagagtacagtgagcca

SEQ ID NO: 3959128 - DNA, 16 bp, Homo sapiens
gcggagcttgcagtga

SEQ ID NO: 3959129 - DNA, 16 bp, Homo sapiens
gcggaggagagagagg

SEQ ID NO: 3959130 - DNA, 20 bp, Homo sapiens
gcggcacgccaacagccccc

SEQ ID NO: 3959131 - DNA, 13 bp, Homo sapiens
gcggcaggagcag

SEQ ID NO: 3959132 - DNA, 19 bp, Homo sapiens
gcggcccagaagtttccct

SEQ ID NO: 3959133 - DNA, 19 bp, Homo sapiens
gcggccctcaaaagcactt

SEQ ID NO: 3959134 - DNA, 17 bp, Homo sapiens
gcggccgcattccctga

SEQ ID NO: 3959135 - DNA, 22 bp, Homo sapiens
gcggcgaccgccgcagggacgg

SEQ ID NO: 3959136 - DNA, 13 bp, Homo sapiens
gcggcgcagaggg

SEQ ID NO: 3959137 - DNA, 17 bp, Homo sapiens
gcggctgctgtgtgcct

SEQ ID NO: 3959138 - DNA, 17 bp, Homo sapiens
gcggcttcctgtccact

SEQ ID NO: 3959139 - DNA, 19 bp, Homo sapiens
gcgggaccggtacagaaag

SEQ ID NO: 3959140 - DNA, 12 bp, Homo sapiens
gcgggaggcacc

SEQ ID NO: 3959141 - DNA, 13 bp, Homo sapiens
gcgggaggcacca

SEQ ID NO: 3959142 - DNA, 16 bp, Homo sapiens
gcgggccaccaagttc

SEQ ID NO: 3959143 - DNA, 20 bp, Homo sapiens
gcgggcgcctgtagtcccag

SEQ ID NO: 3959144 - DNA, 15 bp, Homo sapiens
gcgggcggaggcggc

SEQ ID NO: 3959145 - DNA, 15 bp, Homo sapiens
gcggggcaggaggcc

SEQ ID NO: 3959146 - DNA, 18 bp, Homo sapiens
gcggggcaggaggcctgg

SEQ ID NO: 3959147 - DNA, 16 bp, Homo sapiens
gcggggcccaccttag

SEQ ID NO: 3959148 - DNA, 18 bp, Homo sapiens
gcgggtagatgccggcag

SEQ ID NO: 3959149 - DNA, 16 bp, Homo sapiens
gcggtcatgtgtgcat

SEQ ID NO: 3959150 - DNA, 17 bp, Homo sapiens
gcggtcatgtgtgcatg

SEQ ID NO: 3959151 - DNA, 18 bp, Homo sapiens
gcggtcatgtgtgcatgt

SEQ ID NO: 3959152 - DNA, 14 bp, Homo sapiens
gcggtggaaggccc

SEQ ID NO: 3959153 - DNA, 19 bp, Homo sapiens
gcggtggctcttgcctgta

SEQ ID NO: 3959154 - DNA, 14 bp, Homo sapiens
gcggtggtgccaga

SEQ ID NO: 3959155 - DNA, 15 bp, Homo sapiens
gcggtggtgccagag

SEQ ID NO: 3959156 - DNA, 22 bp, Homo sapiens
gcgtagacttgacaacatccca

SEQ ID NO: 3959157 - DNA, 16 bp, Homo sapiens
gcgtcccaagcagccg

SEQ ID NO: 3959158 - DNA, 15 bp, Homo sapiens
gcgtcctgcagagga

SEQ ID NO: 3959159 - DNA, 11 bp, Homo sapiens
gcgtctcctgt

SEQ ID NO: 3959160 - DNA, 14 bp, Homo sapiens
gcgtgactcaccca

SEQ ID NO: 3959161 - DNA, 17 bp, Homo sapiens
gcgtgcaaggggctcag

SEQ ID NO: 3959162 - DNA, 23 bp, Homo sapiens
gcgtgcacagcgcgggcggaggc

SEQ ID NO: 3959163 - DNA, 18 bp, Homo sapiens
gcgtgcagggacaaagag

SEQ ID NO: 3959164 - DNA, 19 bp, Homo sapiens
gcgtgcagggacaaagagg

SEQ ID NO: 3959165 - DNA, 21 bp, Homo sapiens
gcgtgccctgacccctgcacc

SEQ ID NO: 3959166 - DNA, 21 bp, Homo sapiens
gcgtggccttgttctgtcacc

SEQ ID NO: 3959167 - DNA, 14 bp, Homo sapiens
gcgtggctgtggca

SEQ ID NO: 3959168 - DNA, 13 bp, Homo sapiens
gcgtgtgtacaca

SEQ ID NO: 3959169 - DNA, 16 bp, Homo sapiens
gcgtgtgtacacacgg

SEQ ID NO: 3959170 - DNA, 19 bp, Homo sapiens
gcgtgttagtgtgtgtgca

SEQ ID NO: 3959171 - DNA, 17 bp, Homo sapiens
gcgttggagccactcct

SEQ ID NO: 3959172 - DNA, 14 bp, Homo sapiens
gcgttggtgccact

SEQ ID NO: 3959173 - DNA, 16 bp, Homo sapiens
gctaacagggaaggca

SEQ ID NO: 3959174 - DNA, 15 bp, Homo sapiens
gctaactgtatgtgt

SEQ ID NO: 3959175 - DNA, 15 bp, Homo sapiens
gctaagaaatgctga

SEQ ID NO: 3959176 - DNA, 18 bp, Homo sapiens
gctaagagctagcgctgc

SEQ ID NO: 3959177 - DNA, 19 bp, Homo sapiens
gctaatctgtagggctgga

SEQ ID NO: 3959178 - DNA, 20 bp, Homo sapiens
gctaatctgtagggctggac

SEQ ID NO: 3959179 - DNA, 21 bp, Homo sapiens
gctaatctgtagggctggacc

SEQ ID NO: 3959180 - DNA, 16 bp, Homo sapiens
gctaatgaaattgaga

SEQ ID NO: 3959181 - DNA, 20 bp, Homo sapiens
gctaattcccagagtgtgaa

SEQ ID NO: 3959182 - DNA, 20 bp, Homo sapiens
gctaatttatcctgaaattt

SEQ ID NO: 3959183 - DNA, 18 bp, Homo sapiens
gctacaaaaacacagcaa

SEQ ID NO: 3959184 - DNA, 13 bp, Homo sapiens
gctacaataaatg

SEQ ID NO: 3959185 - DNA, 16 bp, Homo sapiens
gctacaccactctggc

SEQ ID NO: 3959186 - DNA, 21 bp, Homo sapiens
gctacactattgcattgttca

SEQ ID NO: 3959187 - DNA, 13 bp, Homo sapiens
gctacattcctca

SEQ ID NO: 3959188 - DNA, 17 bp, Homo sapiens
gctacattcctcagctg

SEQ ID NO: 3959189 - DNA, 20 bp, Homo sapiens
gctacattcctcagctgcca

SEQ ID NO: 3959190 - DNA, 15 bp, Homo sapiens
gctaccaaggcccag

SEQ ID NO: 3959191 - DNA, 18 bp, Homo sapiens
gctaccaaggcccagcta

SEQ ID NO: 3959192 - DNA, 15 bp, Homo sapiens
gctacccaaaagaga

SEQ ID NO: 3959193 - DNA, 16 bp, Homo sapiens
gctacccaaaagagaa

SEQ ID NO: 3959194 - DNA, 19 bp, Homo sapiens
gctacccaaaagagaaaaa

SEQ ID NO: 3959195 - DNA, 20 bp, Homo sapiens
gctactacccgagcccagct

SEQ ID NO: 3959196 - DNA, 17 bp, Homo sapiens
gcctgggttttctaact

SEQ ID NO: 3959197 - DNA, 19 bp, Homo sapiens
gcctgggttttctaactgt

SEQ ID NO: 3959198 - DNA, 14 bp, Homo sapiens
gcctggtttagcct

SEQ ID NO: 3959199 - DNA, 18 bp, Homo sapiens
gcctgtaatcccagcagt

SEQ ID NO: 3959200 - DNA, 16 bp, Homo sapiens
gcctgtaatcccagct

SEQ ID NO: 3959201 - DNA, 11 bp, Homo sapiens
gcctgtactgc

SEQ ID NO: 3959202 - DNA, 15 bp, Homo sapiens
gcctgtactgcctgc

SEQ ID NO: 3959203 - DNA, 17 bp, Homo sapiens
gcctgtactgcctgctt

SEQ ID NO: 3959204 - DNA, 19 bp, Homo sapiens
gcctgtagttaggaaataa

SEQ ID NO: 3959205 - DNA, 23 bp, Homo sapiens
gcctgtagttaggaaataaaacc

SEQ ID NO: 3959206 - DNA, 16 bp, Homo sapiens
gcctgtatagacagca

SEQ ID NO: 3959207 - DNA, 15 bp, Homo sapiens
gcctgtcctgcctct

SEQ ID NO: 3959208 - DNA, 21 bp, Homo sapiens
gcctgtcctggtacagcaggg

SEQ ID NO: 3959209 - DNA, 12 bp, Homo sapiens
gcctgtctcaag

SEQ ID NO: 3959210 - DNA, 19 bp, Homo sapiens
gcctgtgaacccaggacaa

SEQ ID NO: 3959211 - DNA, 18 bp, Homo sapiens
gcctgtgattaacttgct

SEQ ID NO: 3959212 - DNA, 21 bp, Homo sapiens
gcctgtgcagcagcccagctt

SEQ ID NO: 3959213 - DNA, 17 bp, Homo sapiens
gcctgtggccttgcccg

SEQ ID NO: 3959214 - DNA, 19 bp, Homo sapiens
gcctgtggcggtgcctggg

SEQ ID NO: 3959215 - DNA, 16 bp, Homo sapiens
gcctgtgggaagagaa

SEQ ID NO: 3959216 - DNA, 18 bp, Homo sapiens
gcctgtgggaagagaagg

SEQ ID NO: 3959217 - DNA, 22 bp, Homo sapiens
gcctgtgggggtccatttgggt

SEQ ID NO: 3959218 - DNA, 16 bp, Homo sapiens
gcctgtgtagctgtga

SEQ ID NO: 3959219 - DNA, 22 bp, Homo sapiens
gcctgtgtagctgtgacctgct

SEQ ID NO: 3959220 - DNA, 13 bp, Homo sapiens
gcctgtgtccagc

SEQ ID NO: 3959221 - DNA, 20 bp, Homo sapiens
gcctgtgtccagcagctgcg

SEQ ID NO: 3959222 - DNA, 16 bp, Homo sapiens
gcctgttcatggcaga

SEQ ID NO: 3959223 - DNA, 19 bp, Homo sapiens
gcctgttgctgaagtcatt

SEQ ID NO: 3959224 - DNA, 21 bp, Homo sapiens
gccttaaatttttgtcatttt

SEQ ID NO: 3959225 - DNA, 20 bp, Homo sapiens
gccttaatctggaaggcccc

SEQ ID NO: 3959226 - DNA, 18 bp, Homo sapiens
gccttacctcctgcccag

SEQ ID NO: 3959227 - DNA, 21 bp, Homo sapiens
gccttacctcctgcccaggag

SEQ ID NO: 3959228 - DNA, 22 bp, Homo sapiens
gccttacctcctgcccaggaga

SEQ ID NO: 3959229 - DNA, 17 bp, Homo sapiens
gccttagaacctttctt

SEQ ID NO: 3959230 - DNA, 13 bp, Homo sapiens
gccttagcacttc

SEQ ID NO: 3959231 - DNA, 18 bp, Homo sapiens
gccttccccttttgcctg

SEQ ID NO: 3959232 - DNA, 23 bp, Homo sapiens
gccttccccttttgcctggctgt

SEQ ID NO: 3959233 - DNA, 13 bp, Homo sapiens
gccttcctcctcc

SEQ ID NO: 3959234 - DNA, 15 bp, Homo sapiens
gccttcctcctccac

SEQ ID NO: 3959235 - DNA, 17 bp, Homo sapiens
gccttcctcctccacag

SEQ ID NO: 3959236 - DNA, 22 bp, Homo sapiens
gccttcctgtctttctggccct

SEQ ID NO: 3959237 - DNA, 22 bp, Homo sapiens
gccttcgatacaccgggcctgg

SEQ ID NO: 3959238 - DNA, 22 bp, Homo sapiens
gccttcgcggtggaaggcccga

SEQ ID NO: 3959239 - DNA, 17 bp, Homo sapiens
gccttcttcacccagct

SEQ ID NO: 3959240 - DNA, 21 bp, Homo sapiens
gccttgagagaaaaagtgccc

SEQ ID NO: 3959241 - DNA, 20 bp, Homo sapiens
gccttgcccagagatgcctc

SEQ ID NO: 3959242 - DNA, 17 bp, Homo sapiens
gccttgcccgccagcct

SEQ ID NO: 3959243 - DNA, 14 bp, Homo sapiens
gccttgctggacgg

SEQ ID NO: 3959244 - DNA, 22 bp, Homo sapiens
gccttgctttgggctttgcagg

SEQ ID NO: 3959245 - DNA, 19 bp, Homo sapiens
gccttggataatgctgttg

SEQ ID NO: 3959246 - DNA, 23 bp, Homo sapiens
gccttggataatgctgttgcctc

SEQ ID NO: 3959247 - DNA, 18 bp, Homo sapiens
gccttggtgtccacctgg

SEQ ID NO: 3959248 - DNA, 22 bp, Homo sapiens
gccttggtgtccacctggcccc

SEQ ID NO: 3959249 - DNA, 16 bp, Homo sapiens
gccttgtcaggaccca

SEQ ID NO: 3959250 - DNA, 21 bp, Homo sapiens
gccttgtcaggacccaggccg

SEQ ID NO: 3959251 - DNA, 16 bp, Homo sapiens
gccttgtgccctgccc

SEQ ID NO: 3959252 - DNA, 17 bp, Homo sapiens
gccttgtgccctgcccc

SEQ ID NO: 3959253 - DNA, 12 bp, Homo sapiens
gccttgtgtaca

SEQ ID NO: 3959254 - DNA, 22 bp, Homo sapiens
gccttgtgtcagagctgggagt

SEQ ID NO: 3959255 - DNA, 12 bp, Homo sapiens
gcctttcctgtg

SEQ ID NO: 3959256 - DNA, 20 bp, Homo sapiens
gcctttgaggcaaaggccag

SEQ ID NO: 3959257 - DNA, 12 bp, Homo sapiens
gcctttgccctg

SEQ ID NO: 3959258 - DNA, 19 bp, Homo sapiens
gcctttgggaggcagcatc

SEQ ID NO: 3959259 - DNA, 14 bp, Homo sapiens
gccttttaaaagaa

SEQ ID NO: 3959260 - DNA, 22 bp, Homo sapiens
gccttttcacgggaactctcca

SEQ ID NO: 3959261 - DNA, 15 bp, Homo sapiens
gcgaagtggctctca

SEQ ID NO: 3959262 - DNA, 14 bp, Homo sapiens
gcgaataaatgttc

SEQ ID NO: 3959263 - DNA, 21 bp, Homo sapiens
gcgaataaatgttcaaactgt

SEQ ID NO: 3959264 - DNA, 16 bp, Homo sapiens
gcgagaggcagagaaa

SEQ ID NO: 3959265 - DNA, 18 bp, Homo sapiens
gcgagaggtccctgctta

SEQ ID NO: 3959266 - DNA, 16 bp, Homo sapiens
gcgagcatcctggcca

SEQ ID NO: 3959267 - DNA, 13 bp, Homo sapiens
gcgagctgctctg

SEQ ID NO: 3959268 - DNA, 20 bp, Homo sapiens
gcgataaaactaaatatatg

SEQ ID NO: 3959269 - DNA, 19 bp, Homo sapiens
gcgattccctctcccaggc

SEQ ID NO: 3959270 - DNA, 23 bp, Homo sapiens
gcgcaagcctgtaatcccagcta

SEQ ID NO: 3959271 - DNA, 18 bp, Homo sapiens
gcgcacaaggctgaccaa

SEQ ID NO: 3959272 - DNA, 15 bp, Homo sapiens
gcgcagcccgaagcc

SEQ ID NO: 3959273 - DNA, 16 bp, Homo sapiens
gcgcagcccgaagccc

SEQ ID NO: 3959274 - DNA, 18 bp, Homo sapiens
gcgcagcccgaagcccag

SEQ ID NO: 3959275 - DNA, 19 bp, Homo sapiens
gcgcagggaggatgccaca

SEQ ID NO: 3959276 - DNA, 22 bp, Homo sapiens
gcgcagtgcttctctacagact

SEQ ID NO: 3959277 - DNA, 22 bp, Homo sapiens
gcgccactgagacggcagagac

SEQ ID NO: 3959278 - DNA, 18 bp, Homo sapiens
gcgccccaacccgtggag

SEQ ID NO: 3959279 - DNA, 13 bp, Homo sapiens
gcgccccttcccc

SEQ ID NO: 3959280 - DNA, 12 bp, Homo sapiens
gcgccctgcaga

SEQ ID NO: 3959281 - DNA, 23 bp, Homo sapiens
gcctccagcctctcccggctgcc

SEQ ID NO: 3959282 - DNA, 17 bp, Homo sapiens
gcctccattctgaccat

SEQ ID NO: 3959283 - DNA, 15 bp, Homo sapiens
gcctcccaataaagc

SEQ ID NO: 3959284 - DNA, 16 bp, Homo sapiens
gcctcccaataaagct

SEQ ID NO: 3959285 - DNA, 19 bp, Homo sapiens
gcctcccaataaagctgga

SEQ ID NO: 3959286 - DNA, 13 bp, Homo sapiens
gcctcccagcctg

SEQ ID NO: 3959287 - DNA, 20 bp, Homo sapiens
gcctccccacatatggcaca

SEQ ID NO: 3959288 - DNA, 21 bp, Homo sapiens
gcctccccacatatggcacaa

SEQ ID NO: 3959289 - DNA, 14 bp, Homo sapiens
gcctccccctgctg

SEQ ID NO: 3959290 - DNA, 15 bp, Homo sapiens
gcctccccctgctgc

SEQ ID NO: 3959291 - DNA, 18 bp, Homo sapiens
gcctccccgaaacaggct

SEQ ID NO: 3959292 - DNA, 13 bp, Homo sapiens
gcctccctcctcg

SEQ ID NO: 3959293 - DNA, 14 bp, Homo sapiens
gcctccctttctgg

SEQ ID NO: 3959294 - DNA, 15 bp, Homo sapiens
gcctccctttctggg

SEQ ID NO: 3959295 - DNA, 21 bp, Homo sapiens
gcctccgtcatgaatgccttc

SEQ ID NO: 3959296 - DNA, 18 bp, Homo sapiens
gcctcctaagcagctggg

SEQ ID NO: 3959297 - DNA, 18 bp, Homo sapiens
gcctcctcacccccagct

SEQ ID NO: 3959298 - DNA, 15 bp, Homo sapiens
gcctcctcctgacca

SEQ ID NO: 3959299 - DNA, 11 bp, Homo sapiens
gcctcctctgc

SEQ ID NO: 3959300 - DNA, 19 bp, Homo sapiens
gcctcctggccagacgctg

SEQ ID NO: 3959301 - DNA, 15 bp, Homo sapiens
gcctcgaggcaccgg

SEQ ID NO: 3959302 - DNA, 22 bp, Homo sapiens
gcctcgaggcaccggcgctgca

SEQ ID NO: 3959303 - DNA, 18 bp, Homo sapiens
gcctcgcaacccgtgcca

SEQ ID NO: 3959304 - DNA, 20 bp, Homo sapiens
gcctcgcaacccgtgccaag

SEQ ID NO: 3959305 - DNA, 23 bp, Homo sapiens
gcctcgcaacccgtgccaagtcc

SEQ ID NO: 3959306 - DNA, 14 bp, Homo sapiens
gcctcgcctgggcc

SEQ ID NO: 3959307 - DNA, 19 bp, Homo sapiens
gcctcgcctgggcccaggc

SEQ ID NO: 3959308 - DNA, 21 bp, Homo sapiens
gcctcgcctgggcccaggctc

SEQ ID NO: 3959309 - DNA, 23 bp, Homo sapiens
gcctcgcctgggcccaggctctg

SEQ ID NO: 3959310 - DNA, 15 bp, Homo sapiens
gcctcgtaccagcca

SEQ ID NO: 3959311 - DNA, 16 bp, Homo sapiens
gcctcgtaccagccag

SEQ ID NO: 3959312 - DNA, 17 bp, Homo sapiens
gcctcgtaccagccagg

SEQ ID NO: 3959313 - DNA, 19 bp, Homo sapiens
gcctcgtgccatgatctgt

SEQ ID NO: 3959314 - DNA, 17 bp, Homo sapiens
gcctctagaacacccac

SEQ ID NO: 3959315 - DNA, 23 bp, Homo sapiens
gcctctagaacacccactggcca

SEQ ID NO: 3959316 - DNA, 15 bp, Homo sapiens
gcctctcacacacat

SEQ ID NO: 3959317 - DNA, 13 bp, Homo sapiens
gcctctcccaccc

SEQ ID NO: 3959318 - DNA, 14 bp, Homo sapiens
gcctctcccacgat

SEQ ID NO: 3959319 - DNA, 13 bp, Homo sapiens
gcctctcccggct

SEQ ID NO: 3959320 - DNA, 17 bp, Homo sapiens
gcctctcccggctgcct

SEQ ID NO: 3959321 - DNA, 19 bp, Homo sapiens
gcctctcccggctgcctgc

SEQ ID NO: 3959322 - DNA, 20 bp, Homo sapiens
gcctctcccggctgcctgcc

SEQ ID NO: 3959323 - DNA, 23 bp, Homo sapiens
gcctctcccggctgcctgccgcc

SEQ ID NO: 3959324 - DNA, 20 bp, Homo sapiens
gcctctctcaggagtatctt

SEQ ID NO: 3959325 - DNA, 14 bp, Homo sapiens
gcctctctgctcca

SEQ ID NO: 3959326 - DNA, 16 bp, Homo sapiens
gcctctgaggccagcc

SEQ ID NO: 3959327 - DNA, 18 bp, Homo sapiens
gcctctgaggccagcctg

SEQ ID NO: 3959328 - DNA, 19 bp, Homo sapiens
gcctctgaggccagcctgg

SEQ ID NO: 3959329 - DNA, 23 bp, Homo sapiens
gcctctgaggccagcctggcctc

SEQ ID NO: 3959330 - DNA, 15 bp, Homo sapiens
gcctctgatatggga

SEQ ID NO: 3959331 - DNA, 15 bp, Homo sapiens
gcctctgcattcagg

SEQ ID NO: 3959332 - DNA, 20 bp, Homo sapiens
gcctctgccatgcccagaga

SEQ ID NO: 3959333 - DNA, 15 bp, Homo sapiens
gcctctgccccaagg

SEQ ID NO: 3959334 - DNA, 21 bp, Homo sapiens
gcctctgccccaaggggccca

SEQ ID NO: 3959335 - DNA, 15 bp, Homo sapiens
gcctctgcccgcaga

SEQ ID NO: 3959336 - DNA, 17 bp, Homo sapiens
gcctctgcccgcagagc

SEQ ID NO: 3959337 - DNA, 16 bp, Homo sapiens
gcctctgccctgcctc

SEQ ID NO: 3959338 - DNA, 12 bp, Homo sapiens
gcctctgcctgt

SEQ ID NO: 3959339 - DNA, 13 bp, Homo sapiens
gcctctgcctgtc

SEQ ID NO: 3959340 - DNA, 15 bp, Homo sapiens
gcctctgtcctcgct

SEQ ID NO: 3959341 - DNA, 18 bp, Homo sapiens
gcctctgtgtccttccct

SEQ ID NO: 3959342 - DNA, 12 bp, Homo sapiens
gcctcttcctcc

SEQ ID NO: 3959343 - DNA, 15 bp, Homo sapiens
gcctcttcttcttca

SEQ ID NO: 3959344 - DNA, 16 bp, Homo sapiens
gcctcttcttcttcag

SEQ ID NO: 3959345 - DNA, 20 bp, Homo sapiens
gcctcttcttcttcagaaga

SEQ ID NO: 3959346 - DNA, 21 bp, Homo sapiens
gcctcttcttcttcagaagac

SEQ ID NO: 3959347 - DNA, 17 bp, Homo sapiens
gcctcttggacctctgc

SEQ ID NO: 3959348 - DNA, 21 bp, Homo sapiens
gcctcttggacctctgctctg

SEQ ID NO: 3959349 - DNA, 17 bp, Homo sapiens
gcctcttggcagccctt

SEQ ID NO: 3959350 - DNA, 16 bp, Homo sapiens
gcctcttgttgcagag

SEQ ID NO: 3959351 - DNA, 18 bp, Homo sapiens
gcctcttttccctctcta

SEQ ID NO: 3959352 - DNA, 14 bp, Homo sapiens
gcctgaaccacagc

SEQ ID NO: 3959353 - DNA, 21 bp, Homo sapiens
gcctgaaggaggtgagagaag

SEQ ID NO: 3959354 - DNA, 23 bp, Homo sapiens
gcctgaccctacttcttttgctc

SEQ ID NO: 3959355 - DNA, 12 bp, Homo sapiens
gcctgagcccag

SEQ ID NO: 3959356 - DNA, 16 bp, Homo sapiens
gcctgagcccagggag

SEQ ID NO: 3959357 - DNA, 17 bp, Homo sapiens
gcctgagcccagggagg

SEQ ID NO: 3959358 - DNA, 23 bp, Homo sapiens
gcctgagctggggcctggagagg

SEQ ID NO: 3959359 - DNA, 22 bp, Homo sapiens
gcctgaggctcaagaggcccag

SEQ ID NO: 3959360 - DNA, 15 bp, Homo sapiens
gcctgagggtggaga

SEQ ID NO: 3959361 - DNA, 17 bp, Homo sapiens
gcctgagggtggagact

SEQ ID NO: 3959362 - DNA, 13 bp, Homo sapiens
gcctgagtctcct

SEQ ID NO: 3959363 - DNA, 16 bp, Homo sapiens
gcctgagtctcctgtg

SEQ ID NO: 3959364 - DNA, 15 bp, Homo sapiens
gcctgataagcttca

SEQ ID NO: 3959365 - DNA, 15 bp, Homo sapiens
gcctgataccctgct

SEQ ID NO: 3959366 - DNA, 16 bp, Homo sapiens
gcctgatgctgccccg

SEQ ID NO: 3959367 - DNA, 15 bp, Homo sapiens
gcctgatggccaagg

SEQ ID NO: 3959368 - DNA, 16 bp, Homo sapiens
gcctgatggccaaggg

SEQ ID NO: 3959369 - DNA, 16 bp, Homo sapiens
gcctgcagagagaagc

SEQ ID NO: 3959370 - DNA, 17 bp, Homo sapiens
gcctgcagagagaagcc

SEQ ID NO: 3959371 - DNA, 18 bp, Homo sapiens
gcctgcagcctcccccac

SEQ ID NO: 3959372 - DNA, 20 bp, Homo sapiens
gcctgcatcatgacaaagtt

SEQ ID NO: 3959373 - DNA, 19 bp, Homo sapiens
gcctgccataccgctgggg

SEQ ID NO: 3959374 - DNA, 18 bp, Homo sapiens
gcctgcccaatgctttgg

SEQ ID NO: 3959375 - DNA, 13 bp, Homo sapiens
gcctgccctccca

SEQ ID NO: 3959376 - DNA, 12 bp, Homo sapiens
gcctgccgagca

SEQ ID NO: 3959377 - DNA, 24 bp, Homo sapiens
gcctgcctcccagccctgccagga

SEQ ID NO: 3959378 - DNA, 17 bp, Homo sapiens
gcctgcctgataccctg

SEQ ID NO: 3959379 - DNA, 20 bp, Homo sapiens
gcctgcggccgggctgccct

SEQ ID NO: 3959380 - DNA, 21 bp, Homo sapiens
gcctgcggccgggctgccctt

SEQ ID NO: 3959381 - DNA, 17 bp, Homo sapiens
gcctgctagagcaaccc

SEQ ID NO: 3959382 - DNA, 23 bp, Homo sapiens
gcctgctagagcaacccctgtac

SEQ ID NO: 3959383 - DNA, 16 bp, Homo sapiens
gcctgctcccagcagc

SEQ ID NO: 3959384 - DNA, 20 bp, Homo sapiens
gcctgctcccagcagcccta

SEQ ID NO: 3959385 - DNA, 13 bp, Homo sapiens
gcctgctccccca

SEQ ID NO: 3959386 - DNA, 19 bp, Homo sapiens
gcctgctcccccaccccct

SEQ ID NO: 3959387 - DNA, 23 bp, Homo sapiens
gcctgctgaatgatttccaaaga

SEQ ID NO: 3959388 - DNA, 13 bp, Homo sapiens
gcctgctgctgag

SEQ ID NO: 3959389 - DNA, 19 bp, Homo sapiens
gcctgctgctgagaacctg

SEQ ID NO: 3959390 - DNA, 21 bp, Homo sapiens
gcctgctgctgagaacctggc

SEQ ID NO: 3959391 - DNA, 22 bp, Homo sapiens
gcctgctgctgagaacctggcc

SEQ ID NO: 3959392 - DNA, 23 bp, Homo sapiens
gcctgctgctgagaacctggcct

SEQ ID NO: 3959393 - DNA, 13 bp, Homo sapiens
gcctgctgggctc

SEQ ID NO: 3959394 - DNA, 18 bp, Homo sapiens
gcctgctgggctctccac

SEQ ID NO: 3959395 - DNA, 23 bp, Homo sapiens
gcctgctgggctctccacctcag

SEQ ID NO: 3959396 - DNA, 15 bp, Homo sapiens
gcctgcttttccagg

SEQ ID NO: 3959397 - DNA, 12 bp, Homo sapiens
gcctggaaccag

SEQ ID NO: 3959398 - DNA, 20 bp, Homo sapiens
gcctggacatttgccttgct

SEQ ID NO: 3959399 - DNA, 15 bp, Homo sapiens
gcctggagaagctga

SEQ ID NO: 3959400 - DNA, 13 bp, Homo sapiens
gcctggagagggg

SEQ ID NO: 3959401 - DNA, 14 bp, Homo sapiens
gcctggagatgact

SEQ ID NO: 3959402 - DNA, 14 bp, Homo sapiens
gcctggaggacctg

SEQ ID NO: 3959403 - DNA, 17 bp, Homo sapiens
gcctggaggacctgagc

SEQ ID NO: 3959404 - DNA, 19 bp, Homo sapiens
gcctggaggacctgagcct

SEQ ID NO: 3959405 - DNA, 18 bp, Homo sapiens
gcctggcacagggcagtg

SEQ ID NO: 3959406 - DNA, 12 bp, Homo sapiens
gcctggccaggc

SEQ ID NO: 3959407 - DNA, 13 bp, Homo sapiens
gcctggccaggca

SEQ ID NO: 3959408 - DNA, 15 bp, Homo sapiens
gcctggccaggcacc

SEQ ID NO: 3959409 - DNA, 17 bp, Homo sapiens
gcctggcccccctccag

SEQ ID NO: 3959410 - DNA, 18 bp, Homo sapiens
gcctggcccccctccagg

SEQ ID NO: 3959411 - DNA, 19 bp, Homo sapiens
gcctggcctcctgcctcta

SEQ ID NO: 3959412 - DNA, 22 bp, Homo sapiens
gcctggcctcctgcctctactg

SEQ ID NO: 3959413 - DNA, 11 bp, Homo sapiens
gcctggcctga

SEQ ID NO: 3959414 - DNA, 14 bp, Homo sapiens
gcctggcctgagct

SEQ ID NO: 3959415 - DNA, 17 bp, Homo sapiens
gcctggcctgagctggg

SEQ ID NO: 3959416 - DNA, 12 bp, Homo sapiens
gcctggcctggc

SEQ ID NO: 3959417 - DNA, 14 bp, Homo sapiens
gcctggcctggctc

SEQ ID NO: 3959418 - DNA, 16 bp, Homo sapiens
gcctggcggggcagga

SEQ ID NO: 3959419 - DNA, 20 bp, Homo sapiens
gcctggcggggcaggaggcc

SEQ ID NO: 3959420 - DNA, 21 bp, Homo sapiens
gcctggcggggcaggaggcct

SEQ ID NO: 3959421 - DNA, 23 bp, Homo sapiens
gcctggcggggcaggaggcctgg

SEQ ID NO: 3959422 - DNA, 17 bp, Homo sapiens
gcctggctggctgaggg

SEQ ID NO: 3959423 - DNA, 12 bp, Homo sapiens
gcctggctgtgg

SEQ ID NO: 3959424 - DNA, 14 bp, Homo sapiens
gcctggctgtggag

SEQ ID NO: 3959425 - DNA, 24 bp, Homo sapiens
gcctggctgtggaggcctgatgct

SEQ ID NO: 3959426 - DNA, 15 bp, Homo sapiens
gcctggcttgctcca

SEQ ID NO: 3959427 - DNA, 17 bp, Homo sapiens
gcctggcttgctccagg

SEQ ID NO: 3959428 - DNA, 14 bp, Homo sapiens
gcctgggaaaggaa

SEQ ID NO: 3959429 - DNA, 23 bp, Homo sapiens
gcctgggaaaggaaaaccaggga

SEQ ID NO: 3959430 - DNA, 16 bp, Homo sapiens
gcctgggaaatttcta

SEQ ID NO: 3959431 - DNA, 17 bp, Homo sapiens
gcctgggacccagctac

SEQ ID NO: 3959432 - DNA, 15 bp, Homo sapiens
gcctgggactcccag

SEQ ID NO: 3959433 - DNA, 13 bp, Homo sapiens
gcctgggcccagg

SEQ ID NO: 3959434 - DNA, 14 bp, Homo sapiens
gcctgggcccaggc

SEQ ID NO: 3959435 - DNA, 15 bp, Homo sapiens
gcctgggcccaggct

SEQ ID NO: 3959436 - DNA, 14 bp, Homo sapiens
gcctgggcctatgg

SEQ ID NO: 3959437 - DNA, 21 bp, Homo sapiens
gcctgggcctatggagagccc

SEQ ID NO: 3959438 - DNA, 22 bp, Homo sapiens
gcctgggcctatggagagccct

SEQ ID NO: 3959439 - DNA, 17 bp, Homo sapiens
gcctgggcctgcttttc

SEQ ID NO: 3959440 - DNA, 17 bp, Homo sapiens
gcctgggcctgtgcagc

SEQ ID NO: 3959441 - DNA, 23 bp, Homo sapiens
gcctgggcctgtgcagcagccca

SEQ ID NO: 3959442 - DNA, 22 bp, Homo sapiens
gcctggggctcctttctccagc

SEQ ID NO: 3959443 - DNA, 22 bp, Homo sapiens
gcctggggctctaacgcctgag

SEQ ID NO: 3959444 - DNA, 23 bp, Homo sapiens
gcctggggctctaacgcctgagc

SEQ ID NO: 3959445 - DNA, 22 bp, Homo sapiens
gcctgggggcagtgactggcag

SEQ ID NO: 3959446 - DNA, 13 bp, Homo sapiens
gcctgggggcctg

SEQ ID NO: 3959447 - DNA, 18 bp, Homo sapiens
gcctgggggcctggctgg

SEQ ID NO: 3959448 - DNA, 19 bp, Homo sapiens
gcctgggggcctggctggc

SEQ ID NO: 3959449 - DNA, 20 bp, Homo sapiens
gcctgggggcctggctggct

SEQ ID NO: 3959450 - DNA, 19 bp, Homo sapiens
gcctggggtgacccggcac

SEQ ID NO: 3959451 - DNA, 16 bp, Homo sapiens
gcctgggtggggctgc

SEQ ID NO: 3959452 - DNA, 24 bp, Homo sapiens
gcctgggtggggctgctcctccag

SEQ ID NO: 3959453 - DNA, 18 bp, Homo sapiens
gctaggcgagtgccagga

SEQ ID NO: 3959454 - DNA, 19 bp, Homo sapiens
gctaggcgagtgccaggac

SEQ ID NO: 3959455 - DNA, 21 bp, Homo sapiens
gctaggcgagtgccaggactc

SEQ ID NO: 3959456 - DNA, 14 bp, Homo sapiens
gctagtcagagaga

SEQ ID NO: 3959457 - DNA, 17 bp, Homo sapiens
gctagtgatgtttttat

SEQ ID NO: 3959458 - DNA, 18 bp, Homo sapiens
gctagtgtgagtggcagc

SEQ ID NO: 3959459 - DNA, 19 bp, Homo sapiens
gctataggctggagaagct

SEQ ID NO: 3959460 - DNA, 13 bp, Homo sapiens
gctataggtgcta

SEQ ID NO: 3959461 - DNA, 21 bp, Homo sapiens
gctataggtgctacaaaaaca

SEQ ID NO: 3959462 - DNA, 11 bp, Homo sapiens
gctatatatat

SEQ ID NO: 3959463 - DNA, 19 bp, Homo sapiens
gctatatgccttaagccaa

SEQ ID NO: 3959464 - DNA, 16 bp, Homo sapiens
gctatctctgtgtgca

SEQ ID NO: 3959465 - DNA, 20 bp, Homo sapiens
gctatctctgtgtgcacaaa

SEQ ID NO: 3959466 - DNA, 18 bp, Homo sapiens
gctatgattatgccactg

SEQ ID NO: 3959467 - DNA, 19 bp, Homo sapiens
gctatgcgcaatgtggcat

SEQ ID NO: 3959468 - DNA, 17 bp, Homo sapiens
gctatgttccctccagc

SEQ ID NO: 3959469 - DNA, 14 bp, Homo sapiens
gctattatgtaaca

SEQ ID NO: 3959470 - DNA, 17 bp, Homo sapiens
gctattattttcactgt

SEQ ID NO: 3959471 - DNA, 15 bp, Homo sapiens
gctattctgtgttga

SEQ ID NO: 3959472 - DNA, 20 bp, Homo sapiens
gctattctgtgttgaacaca

SEQ ID NO: 3959473 - DNA, 14 bp, Homo sapiens
gctattgagaaaga

SEQ ID NO: 3959474 - DNA, 19 bp, Homo sapiens
gctattgatgtttccagaa

SEQ ID NO: 3959475 - DNA, 15 bp, Homo sapiens
gctattgcatgtaaa

SEQ ID NO: 3959476 - DNA, 20 bp, Homo sapiens
gctattgcatgtaaaatgca

SEQ ID NO: 3959477 - DNA, 12 bp, Homo sapiens
gctattgttgtg

SEQ ID NO: 3959478 - DNA, 15 bp, Homo sapiens
gctattgttgtgggc

SEQ ID NO: 3959479 - DNA, 22 bp, Homo sapiens
gctattgttgtgggctttctcc

SEQ ID NO: 3959480 - DNA, 19 bp, Homo sapiens
gctatttctggcctcagca

SEQ ID NO: 3959481 - DNA, 13 bp, Homo sapiens
gctatttgttcag

SEQ ID NO: 3959482 - DNA, 14 bp, Homo sapiens
gctatttgttcaga

SEQ ID NO: 3959483 - DNA, 18 bp, Homo sapiens
gctcaagaatcctctggg

SEQ ID NO: 3959484 - DNA, 21 bp, Homo sapiens
gctcaagaatcctctggggtt

SEQ ID NO: 3959485 - DNA, 22 bp, Homo sapiens
gctcaagaatcctctggggttc

SEQ ID NO: 3959486 - DNA, 16 bp, Homo sapiens
gctcaagaggcccagg

SEQ ID NO: 3959487 - DNA, 18 bp, Homo sapiens
gctcaagaggcccaggga

SEQ ID NO: 3959488 - DNA, 19 bp, Homo sapiens
gctcaagcaggaagttcaa

SEQ ID NO: 3959489 - DNA, 16 bp, Homo sapiens
gctcaagcagtcctcc

SEQ ID NO: 3959490 - DNA, 14 bp, Homo sapiens
gctcacaaggcagc

SEQ ID NO: 3959491 - DNA, 22 bp, Homo sapiens
gctcacagtacaatgtttcaga

SEQ ID NO: 3959492 - DNA, 15 bp, Homo sapiens
gctcacagttcctcg

SEQ ID NO: 3959493 - DNA, 19 bp, Homo sapiens
gctcacagttcctcgccct

SEQ ID NO: 3959494 - DNA, 23 bp, Homo sapiens
gctcacgactcttcctgcaaagg

SEQ ID NO: 3959495 - DNA, 11 bp, Homo sapiens
gctcactcagg

SEQ ID NO: 3959496 - DNA, 20 bp, Homo sapiens
gctcagaatagatctgatgg

SEQ ID NO: 3959497 - DNA, 22 bp, Homo sapiens
gctcagacttgccaggctccct

SEQ ID NO: 3959498 - DNA, 15 bp, Homo sapiens
gctcagcaaggtgtg

SEQ ID NO: 3959499 - DNA, 20 bp, Homo sapiens
gctcagcaatagggtgcagt

SEQ ID NO: 3959500 - DNA, 14 bp, Homo sapiens
gctcagcaggccct

SEQ ID NO: 3959501 - DNA, 21 bp, Homo sapiens
gctcagccatcccgtcttctc

SEQ ID NO: 3959502 - DNA, 15 bp, Homo sapiens
gctcagccctccctg

SEQ ID NO: 3959503 - DNA, 17 bp, Homo sapiens
gctcagccctccctgcc

SEQ ID NO: 3959504 - DNA, 16 bp, Homo sapiens
gctcagccctgactgg

SEQ ID NO: 3959505 - DNA, 20 bp, Homo sapiens
gctcagcctccccctgctgc

SEQ ID NO: 3959506 - DNA, 23 bp, Homo sapiens
gctcagcctccccctgctgctca

SEQ ID NO: 3959507 - DNA, 13 bp, Homo sapiens
gctcaggacccag

SEQ ID NO: 3959508 - DNA, 13 bp, Homo sapiens
gctcaggaggcga

SEQ ID NO: 3959509 - DNA, 20 bp, Homo sapiens
gctcaggaggcgaataaatg

SEQ ID NO: 3959510 - DNA, 21 bp, Homo sapiens
gctcaggcaagcccctcagcc

SEQ ID NO: 3959511 - DNA, 22 bp, Homo sapiens
ggcaaccccagttctgctcctc

SEQ ID NO: 3959512 - DNA, 18 bp, Homo sapiens
ggcaagcccctcagccct

SEQ ID NO: 3959513 - DNA, 21 bp, Homo sapiens
ggcaagcccctcagcccttgc

SEQ ID NO: 3959514 - DNA, 22 bp, Homo sapiens
ggcaagcccctcagcccttgcc

SEQ ID NO: 3959515 - DNA, 20 bp, Homo sapiens
ggcaagctagaacctggagg

SEQ ID NO: 3959516 - DNA, 16 bp, Homo sapiens
ggcaaggtctccttac

SEQ ID NO: 3959517 - DNA, 19 bp, Homo sapiens
ggcaagtgatatcacctct

SEQ ID NO: 3959518 - DNA, 15 bp, Homo sapiens
ggcaatgatggcaat

SEQ ID NO: 3959519 - DNA, 14 bp, Homo sapiens
ggcaattttgtaac

SEQ ID NO: 3959520 - DNA, 15 bp, Homo sapiens
ggcacaaatgcacct

SEQ ID NO: 3959521 - DNA, 18 bp, Homo sapiens
ggcacacaatgctattga

SEQ ID NO: 3959522 - DNA, 16 bp, Homo sapiens
ggcacaccactgccct

SEQ ID NO: 3959523 - DNA, 18 bp, Homo sapiens
ggcacaccactgccctgc

SEQ ID NO: 3959524 - DNA, 19 bp, Homo sapiens
ggcacaccactgccctgcc

SEQ ID NO: 3959525 - DNA, 20 bp, Homo sapiens
ggcacaccactgccctgcct

SEQ ID NO: 3959526 - DNA, 21 bp, Homo sapiens
ggcacaccactgccctgcctg

SEQ ID NO: 3959527 - DNA, 22 bp, Homo sapiens
ggcacaccactgccctgcctgc

SEQ ID NO: 3959528 - DNA, 18 bp, Homo sapiens
ggcacagacttctggaag

SEQ ID NO: 3959529 - DNA, 13 bp, Homo sapiens
ggcacaggactga

SEQ ID NO: 3959530 - DNA, 12 bp, Homo sapiens
ggcacaggcagg

SEQ ID NO: 3959531 - DNA, 19 bp, Homo sapiens
ggcacaggcaggaagagag

SEQ ID NO: 3959532 - DNA, 21 bp, Homo sapiens
ggcacaggcaggaagagagag

SEQ ID NO: 3959533 - DNA, 23 bp, Homo sapiens
ggcacagttgtctattctgagcc

SEQ ID NO: 3959534 - DNA, 21 bp, Homo sapiens
ggcacagttttctgagaaaga

SEQ ID NO: 3959535 - DNA, 14 bp, Homo sapiens
ggcacatggaggag

SEQ ID NO: 3959536 - DNA, 24 bp, Homo sapiens
ggcaccactagggtcctggccctc

SEQ ID NO: 3959537 - DNA, 14 bp, Homo sapiens
ggcaccagccccct

SEQ ID NO: 3959538 - DNA, 17 bp, Homo sapiens
ggcaccagccccctgga

SEQ ID NO: 3959539 - DNA, 19 bp, Homo sapiens
ggcaccagccccctggatg

SEQ ID NO: 3959540 - DNA, 15 bp, Homo sapiens
ggcacccccagcctg

SEQ ID NO: 3959541 - DNA, 17 bp, Homo sapiens
ggcacccccagcctggg

SEQ ID NO: 3959542 - DNA, 18 bp, Homo sapiens
ggcacccccagcctgggc

SEQ ID NO: 3959543 - DNA, 21 bp, Homo sapiens
ggcacccccagcctgggccta

SEQ ID NO: 3959544 - DNA, 16 bp, Homo sapiens
ggcaccccctgcagct

SEQ ID NO: 3959545 - DNA, 19 bp, Homo sapiens
ggcaccccctgcagcttgt

SEQ ID NO: 3959546 - DNA, 16 bp, Homo sapiens
ggcaccccctggagag

SEQ ID NO: 3959547 - DNA, 13 bp, Homo sapiens
ggcaccggcgctg

SEQ ID NO: 3959548 - DNA, 14 bp, Homo sapiens
ggcaccggcgctgc

SEQ ID NO: 3959549 - DNA, 15 bp, Homo sapiens
ggcaccggcgctgca

SEQ ID NO: 3959550 - DNA, 19 bp, Homo sapiens
ggcaccggcgctgcaggta

SEQ ID NO: 3959551 - DNA, 12 bp, Homo sapiens
ggcacctgctgg

SEQ ID NO: 3959552 - DNA, 22 bp, Homo sapiens
ggcacctgggaaaacagaggaa

SEQ ID NO: 3959553 - DNA, 17 bp, Homo sapiens
ggcaccttagtggcttt

SEQ ID NO: 3959554 - DNA, 17 bp, Homo sapiens
ggcacgaacccacctgc

SEQ ID NO: 3959555 - DNA, 18 bp, Homo sapiens
ggcacgccaacagccccc

SEQ ID NO: 3959556 - DNA, 18 bp, Homo sapiens
ggcacggagagaaggccc

SEQ ID NO: 3959557 - DNA, 14 bp, Homo sapiens
ggcactgcaggggc

SEQ ID NO: 3959558 - DNA, 20 bp, Homo sapiens
ggcactgggatgagccgctg

SEQ ID NO: 3959559 - DNA, 13 bp, Homo sapiens
ggcactggtggca

SEQ ID NO: 3959560 - DNA, 16 bp, Homo sapiens
ggcactggtggcatcg

SEQ ID NO: 3959561 - DNA, 15 bp, Homo sapiens
ggcactggtggcccg

SEQ ID NO: 3959562 - DNA, 16 bp, Homo sapiens
ggcagaaaagaggaga

SEQ ID NO: 3959563 - DNA, 21 bp, Homo sapiens
ggcagaaaagaggagaccctg

SEQ ID NO: 3959564 - DNA, 22 bp, Homo sapiens
ggcagaaaagaggagaccctgg

SEQ ID NO: 3959565 - DNA, 14 bp, Homo sapiens
ggcagaaagtggcc

SEQ ID NO: 3959566 - DNA, 16 bp, Homo sapiens
ggcagaaagtggccat

SEQ ID NO: 3959567 - DNA, 17 bp, Homo sapiens
ggcagaagaattgaacc

SEQ ID NO: 3959568 - DNA, 15 bp, Homo sapiens
ggcagaagggagaag

SEQ ID NO: 3959569 - DNA, 14 bp, Homo sapiens
ggcagacaagagct

SEQ ID NO: 3959570 - DNA, 23 bp, Homo sapiens
ggcagacaggcgctggacagagg

SEQ ID NO: 3959571 - DNA, 18 bp, Homo sapiens
ggcagaccgggggccaga

SEQ ID NO: 3959572 - DNA, 17 bp, Homo sapiens
ggcagagaaagaagaga

SEQ ID NO: 3959573 - DNA, 15 bp, Homo sapiens
ggcagagaaggcctc

SEQ ID NO: 3959574 - DNA, 17 bp, Homo sapiens
ggcagagaaggcctctt

SEQ ID NO: 3959575 - DNA, 13 bp, Homo sapiens
ggcagagccatgg

SEQ ID NO: 3959576 - DNA, 14 bp, Homo sapiens
ggcagagccatggg

SEQ ID NO: 3959577 - DNA, 24 bp, Homo sapiens
ggcagagccatgggcctgggcctg

SEQ ID NO: 3959578 - DNA, 21 bp, Homo sapiens
ggcagaggctggaggcagggc

SEQ ID NO: 3959579 - DNA, 16 bp, Homo sapiens
ggcagagggcagaggc

SEQ ID NO: 3959580 - DNA, 19 bp, Homo sapiens
ggcagagggcagaggctgg

SEQ ID NO: 3959581 - DNA, 15 bp, Homo sapiens
ggcagataatcagcc

SEQ ID NO: 3959582 - DNA, 18 bp, Homo sapiens
ggcagataatcagcctct

SEQ ID NO: 3959583 - DNA, 20 bp, Homo sapiens
ggcagataatcagcctctta

SEQ ID NO: 3959584 - DNA, 20 bp, Homo sapiens
ggcagatgtaggagggactg

SEQ ID NO: 3959585 - DNA, 16 bp, Homo sapiens
ggcagcaaggcccgag

SEQ ID NO: 3959586 - DNA, 22 bp, Homo sapiens
ggcagcaaggcccgagcagctg

SEQ ID NO: 3959587 - DNA, 23 bp, Homo sapiens
ggcagcaaggcccgagcagctga

SEQ ID NO: 3959588 - DNA, 14 bp, Homo sapiens
ggcagcaccctccc

SEQ ID NO: 3959589 - DNA, 12 bp, Homo sapiens
ggcagcagccag

SEQ ID NO: 3959590 - DNA, 13 bp, Homo sapiens
ggcagcagccagc

SEQ ID NO: 3959591 - DNA, 15 bp, Homo sapiens
ggcagcagccagccc

SEQ ID NO: 3959592 - DNA, 16 bp, Homo sapiens
ggcagcagccagccct

SEQ ID NO: 3959593 - DNA, 19 bp, Homo sapiens
ggcagcagccagccctgcc

SEQ ID NO: 3959594 - DNA, 20 bp, Homo sapiens
ggcagcagccagccctgcct

SEQ ID NO: 3959595 - DNA, 21 bp, Homo sapiens
ggcagcagccagccctgcctg

SEQ ID NO: 3959596 - DNA, 19 bp, Homo sapiens
ggcagcagttccatgaaga

SEQ ID NO: 3959597 - DNA, 17 bp, Homo sapiens
gggaggcatggccctgg

SEQ ID NO: 3959598 - DNA, 20 bp, Homo sapiens
gggaggcttttggtggtccc

SEQ ID NO: 3959599 - DNA, 18 bp, Homo sapiens
gggagggctctgaggcgc

SEQ ID NO: 3959600 - DNA, 13 bp, Homo sapiens
gggagggggacgc

SEQ ID NO: 3959601 - DNA, 23 bp, Homo sapiens
gggagtagcatggactctgggtt

SEQ ID NO: 3959602 - DNA, 20 bp, Homo sapiens
gggagtgttctgtgggcttg

SEQ ID NO: 3959603 - DNA, 20 bp, Homo sapiens
gggagttgagtcacaagagg

SEQ ID NO: 3959604 - DNA, 20 bp, Homo sapiens
gggagttgctcactcaggac

SEQ ID NO: 3959605 - DNA, 13 bp, Homo sapiens
gggatcacaaggt

SEQ ID NO: 3959606 - DNA, 17 bp, Homo sapiens
gggatcccaggccaggg

SEQ ID NO: 3959607 - DNA, 20 bp, Homo sapiens
gggatctgcattccccgctg

SEQ ID NO: 3959608 - DNA, 20 bp, Homo sapiens
gggatgactaaaatatttat

SEQ ID NO: 3959609 - DNA, 18 bp, Homo sapiens
gggatggaccctcgcagc

SEQ ID NO: 3959610 - DNA, 15 bp, Homo sapiens
gggatggaggagaag

SEQ ID NO: 3959611 - DNA, 18 bp, Homo sapiens
gggatggaggagaagaat

SEQ ID NO: 3959612 - DNA, 20 bp, Homo sapiens
gggatgggggatgggccagg

SEQ ID NO: 3959613 - DNA, 21 bp, Homo sapiens
gggattcaggaaaaggcctgg

SEQ ID NO: 3959614 - DNA, 22 bp, Homo sapiens
gggattcaggaaaaggcctggg

SEQ ID NO: 3959615 - DNA, 20 bp, Homo sapiens
gggatttcttcgctgctcta

SEQ ID NO: 3959616 - DNA, 20 bp, Homo sapiens
gggcaaagaactgccccatc

SEQ ID NO: 3959617 - DNA, 11 bp, Homo sapiens
gggcacaccac

SEQ ID NO: 3959618 - DNA, 15 bp, Homo sapiens
gggcacaccactgcc

SEQ ID NO: 3959619 - DNA, 17 bp, Homo sapiens
gggcacaccactgccct

SEQ ID NO: 3959620 - DNA, 20 bp, Homo sapiens
gggcacaccactgccctgcc

SEQ ID NO: 3959621 - DNA, 13 bp, Homo sapiens
gggcacaggagct

SEQ ID NO: 3959622 - DNA, 12 bp, Homo sapiens
gggcacagtcat

SEQ ID NO: 3959623 - DNA, 14 bp, Homo sapiens
gggcacatgaggag

SEQ ID NO: 3959624 - DNA, 20 bp, Homo sapiens
gggcacatgaggagggtgcc

SEQ ID NO: 3959625 - DNA, 16 bp, Homo sapiens
gggcacccacctccac

SEQ ID NO: 3959626 - DNA, 19 bp, Homo sapiens
gggcacccccagcctgggc

SEQ ID NO: 3959627 - DNA, 15 bp, Homo sapiens
gggcacctctagtgc

SEQ ID NO: 3959628 - DNA, 22 bp, Homo sapiens
gggcacctgggaaaacagagga

SEQ ID NO: 3959629 - DNA, 13 bp, Homo sapiens
gggcactggtggc

SEQ ID NO: 3959630 - DNA, 14 bp, Homo sapiens
gggcagaagggaga

SEQ ID NO: 3959631 - DNA, 17 bp, Homo sapiens
gggcagaaggggaagat

SEQ ID NO: 3959632 - DNA, 14 bp, Homo sapiens
gggcagagccatgg

SEQ ID NO: 3959633 - DNA, 17 bp, Homo sapiens
gggcagagccatgggcc

SEQ ID NO: 3959634 - DNA, 18 bp, Homo sapiens
gggcagagccatgggcct

SEQ ID NO: 3959635 - DNA, 19 bp, Homo sapiens
gggcagagccatgggcctg

SEQ ID NO: 3959636 - DNA, 23 bp, Homo sapiens
gggcagaggctggaggcagggcc

SEQ ID NO: 3959637 - DNA, 20 bp, Homo sapiens
gggcagagggcagaggctgg

SEQ ID NO: 3959638 - DNA, 12 bp, Homo sapiens
gggcagcaccct

SEQ ID NO: 3959639 - DNA, 13 bp, Homo sapiens
gggcagcaccctc

SEQ ID NO: 3959640 - DNA, 19 bp, Homo sapiens
gggcagccaggggctgctc

SEQ ID NO: 3959641 - DNA, 18 bp, Homo sapiens
gggcagccgctaggagag

SEQ ID NO: 3959642 - DNA, 23 bp, Homo sapiens
gggcagccgctaggagagactga

SEQ ID NO: 3959643 - DNA, 14 bp, Homo sapiens
gggcagctcctctg

SEQ ID NO: 3959644 - DNA, 17 bp, Homo sapiens
gggcagctcctctgtct

SEQ ID NO: 3959645 - DNA, 13 bp, Homo sapiens
gggcagctgggcc

SEQ ID NO: 3959646 - DNA, 17 bp, Homo sapiens
gggcaggaggcctggcc

SEQ ID NO: 3959647 - DNA, 14 bp, Homo sapiens
gggcaggagtagct

SEQ ID NO: 3959648 - DNA, 19 bp, Homo sapiens
gggcaggagtagctgagct

SEQ ID NO: 3959649 - DNA, 20 bp, Homo sapiens
gggcaggagtagctgagctc

SEQ ID NO: 3959650 - DNA, 16 bp, Homo sapiens
gggcaggctacccctt

SEQ ID NO: 3959651 - DNA, 12 bp, Homo sapiens
gggcatcaggca

SEQ ID NO: 3959652 - DNA, 14 bp, Homo sapiens
gggcatcaggcact

SEQ ID NO: 3959653 - DNA, 16 bp, Homo sapiens
gggcatcaggcactgg

SEQ ID NO: 3959654 - DNA, 22 bp, Homo sapiens
gggcatctcgtgccagggcagg

SEQ ID NO: 3959655 - DNA, 17 bp, Homo sapiens
gggcatcttctggcttg

SEQ ID NO: 3959656 - DNA, 17 bp, Homo sapiens
gggcatggccaggtggc

SEQ ID NO: 3959657 - DNA, 20 bp, Homo sapiens
gggcatggccaggtggccac

SEQ ID NO: 3959658 - DNA, 19 bp, Homo sapiens
gggcatggttccttccctg

SEQ ID NO: 3959659 - DNA, 20 bp, Homo sapiens
gggcatgtgtgcctgtggca

SEQ ID NO: 3959660 - DNA, 14 bp, Homo sapiens
gggcattgggctga

SEQ ID NO: 3959661 - DNA, 14 bp, Homo sapiens
gggccaaaagggca

SEQ ID NO: 3959662 - DNA, 14 bp, Homo sapiens
gggccaagagagac

SEQ ID NO: 3959663 - DNA, 19 bp, Homo sapiens
ggcctgctgggctctccac

SEQ ID NO: 3959664 - DNA, 21 bp, Homo sapiens
ggcctgctgggctctccacct

SEQ ID NO: 3959665 - DNA, 22 bp, Homo sapiens
ggcctgctgggctctccacctc

SEQ ID NO: 3959666 - DNA, 23 bp, Homo sapiens
ggcctgctgggctctccacctca

SEQ ID NO: 3959667 - DNA, 17 bp, Homo sapiens
ggcctgcttttccagga

SEQ ID NO: 3959668 - DNA, 20 bp, Homo sapiens
ggcctgcttttccaggatcc

SEQ ID NO: 3959669 - DNA, 15 bp, Homo sapiens
ggcctggagaggggc

SEQ ID NO: 3959670 - DNA, 21 bp, Homo sapiens
ggcctggatctccccactcta

SEQ ID NO: 3959671 - DNA, 12 bp, Homo sapiens
ggcctggcctga

SEQ ID NO: 3959672 - DNA, 13 bp, Homo sapiens
ggcctggcctgag

SEQ ID NO: 3959673 - DNA, 15 bp, Homo sapiens
ggcctggctccccac

SEQ ID NO: 3959674 - DNA, 23 bp, Homo sapiens
ggcctggctccccacgagtcacc

SEQ ID NO: 3959675 - DNA, 12 bp, Homo sapiens
ggcctggctggc

SEQ ID NO: 3959676 - DNA, 14 bp, Homo sapiens
ggcctggctggctg

SEQ ID NO: 3959677 - DNA, 18 bp, Homo sapiens
ggcctggcttgctccagg

SEQ ID NO: 3959678 - DNA, 16 bp, Homo sapiens
ggcctgggaaaggaaa

SEQ ID NO: 3959679 - DNA, 23 bp, Homo sapiens
ggcctgggaaaggaaaaccaggg

SEQ ID NO: 3959680 - DNA, 15 bp, Homo sapiens
ggcctgggacccagc

SEQ ID NO: 3959681 - DNA, 16 bp, Homo sapiens
ggcctgggacccagct

SEQ ID NO: 3959682 - DNA, 22 bp, Homo sapiens
ggcctgggacccagctactctg

SEQ ID NO: 3959683 - DNA, 13 bp, Homo sapiens
ggcctgggcctgc

SEQ ID NO: 3959684 - DNA, 16 bp, Homo sapiens
ggcctggggctccttt

SEQ ID NO: 3959685 - DNA, 20 bp, Homo sapiens
ggcctgggggcagtgactgg

SEQ ID NO: 3959686 - DNA, 15 bp, Homo sapiens
ggcctggggtgaccc

SEQ ID NO: 3959687 - DNA, 14 bp, Homo sapiens
ggcctgtactgcct

SEQ ID NO: 3959688 - DNA, 22 bp, Homo sapiens
ggcctgtctcaagctcttcctt

SEQ ID NO: 3959689 - DNA, 20 bp, Homo sapiens
ggcctgtgaggtaactggga

SEQ ID NO: 3959690 - DNA, 19 bp, Homo sapiens
ggcctgtgcagcagcccag

SEQ ID NO: 3959691 - DNA, 15 bp, Homo sapiens
ggcctgtgtccagca

SEQ ID NO: 3959692 - DNA, 22 bp, Homo sapiens
ggcctgtgtgtgaaaggaagct

SEQ ID NO: 3959693 - DNA, 21 bp, Homo sapiens
ggccttccccttttgcctggc

SEQ ID NO: 3959694 - DNA, 15 bp, Homo sapiens
ggccttgcccagaga

SEQ ID NO: 3959695 - DNA, 21 bp, Homo sapiens
ggccttgtcaggacccaggcc

SEQ ID NO: 3959696 - DNA, 18 bp, Homo sapiens
ggccttgttctgtcacca

SEQ ID NO: 3959697 - DNA, 16 bp, Homo sapiens
ggcgaataaatgttca

SEQ ID NO: 3959698 - DNA, 20 bp, Homo sapiens
ggcgacagagcgagactccg

SEQ ID NO: 3959699 - DNA, 19 bp, Homo sapiens
ggcgataaaactaaatata

SEQ ID NO: 3959700 - DNA, 17 bp, Homo sapiens
ggcgatcaagtccagag

SEQ ID NO: 3959701 - DNA, 22 bp, Homo sapiens
ggcgcaagcctgtaatcccagc

SEQ ID NO: 3959702 - DNA, 13 bp, Homo sapiens
ggcgcagagggaa

SEQ ID NO: 3959703 - DNA, 20 bp, Homo sapiens
ggcgcagcccgaagcccagt

SEQ ID NO: 3959704 - DNA, 15 bp, Homo sapiens
ggcgccaccatcctg

SEQ ID NO: 3959705 - DNA, 20 bp, Homo sapiens
ggcgcccattcgtctgtccc

SEQ ID NO: 3959706 - DNA, 18 bp, Homo sapiens
ggcgccccaacccgtgga

SEQ ID NO: 3959707 - DNA, 16 bp, Homo sapiens
ggcgcgggaggcacca

SEQ ID NO: 3959708 - DNA, 19 bp, Homo sapiens
ggcgcggtggctcacgcct

SEQ ID NO: 3959709 - DNA, 21 bp, Homo sapiens
ggcgctcaggacccaggccct

SEQ ID NO: 3959710 - DNA, 12 bp, Homo sapiens
ggcgctgcaggt

SEQ ID NO: 3959711 - DNA, 17 bp, Homo sapiens
ggcggaaaccttgcagc

SEQ ID NO: 3959712 - DNA, 19 bp, Homo sapiens
ggcggaaaccttgcagcat

SEQ ID NO: 3959713 - DNA, 19 bp, Homo sapiens
ggcggagagtacagtgagc

SEQ ID NO: 3959714 - DNA, 13 bp, Homo sapiens
ggcggaggcggct

SEQ ID NO: 3959715 - DNA, 21 bp, Homo sapiens
ggcggaggttgcagtgagccg

SEQ ID NO: 3959716 - DNA, 17 bp, Homo sapiens
ggcggccatgatggtgc

SEQ ID NO: 3959717 - DNA, 22 bp, Homo sapiens
ggcggctactcagcagccctcc

SEQ ID NO: 3959718 - DNA, 16 bp, Homo sapiens
ggcgggagatggaccc

SEQ ID NO: 3959719 - DNA, 15 bp, Homo sapiens
ggcgggagtgggggc

SEQ ID NO: 3959720 - DNA, 12 bp, Homo sapiens
ggcggggcagga

SEQ ID NO: 3959721 - DNA, 20 bp, Homo sapiens
ggcgggggcccgaaagctga

SEQ ID NO: 3959722 - DNA, 18 bp, Homo sapiens
ggcggtcatgtgtgcatg

SEQ ID NO: 3959723 - DNA, 16 bp, Homo sapiens
ggcgtaatgggcctgc

SEQ ID NO: 3959724 - DNA, 15 bp, Homo sapiens
ggcgtgactcaccca

SEQ ID NO: 3959725 - DNA, 18 bp, Homo sapiens
ggcgtgcaaggggctcag

SEQ ID NO: 3959726 - DNA, 15 bp, Homo sapiens
ggcgttggtgccact

SEQ ID NO: 3959727 - DNA, 15 bp, Homo sapiens
ggctaattaaataaa

SEQ ID NO: 3959728 - DNA, 19 bp, Homo sapiens
ggctaattcccagagtgtg

SEQ ID NO: 3959729 - DNA, 16 bp, Homo sapiens
ggctactcagcagccc

SEQ ID NO: 3959730 - DNA, 13 bp, Homo sapiens
ggctactctgtgc

SEQ ID NO: 3959731 - DNA, 21 bp, Homo sapiens
ggctactctgtgccagagcct

SEQ ID NO: 3959732 - DNA, 15 bp, Homo sapiens
ggctactgcagcttt

SEQ ID NO: 3959733 - DNA, 23 bp, Homo sapiens
ggctactgcagctttacatgcaa

SEQ ID NO: 3959734 - DNA, 13 bp, Homo sapiens
ggctactggcagc

SEQ ID NO: 3959735 - DNA, 14 bp, Homo sapiens
ggctactggcagct

SEQ ID NO: 3959736 - DNA, 23 bp, Homo sapiens
ggctactggcagctcctctcctt

SEQ ID NO: 3959737 - DNA, 18 bp, Homo sapiens
ggctacttcggggctggg

SEQ ID NO: 3959738 - DNA, 16 bp, Homo sapiens
ggctagaacctggagg

SEQ ID NO: 3959739 - DNA, 15 bp, Homo sapiens
ggctagaactggaga

SEQ ID NO: 3959740 - DNA, 16 bp, Homo sapiens
ggctagaatctggaga

SEQ ID NO: 3959741 - DNA, 22 bp, Homo sapiens
ggctagaatctggagagctaga

SEQ ID NO: 3959742 - DNA, 16 bp, Homo sapiens
ggctcaagaggcccag

SEQ ID NO: 3959743 - DNA, 17 bp, Homo sapiens
ggctcaagaggcccagg

SEQ ID NO: 3959744 - DNA, 18 bp, Homo sapiens
ggctcaagaggcccaggg

SEQ ID NO: 3959745 - DNA, 21 bp, Homo sapiens
ggctcaagaggcccagggagc

SEQ ID NO: 3959746 - DNA, 23 bp, Homo sapiens
ggctcacgcctgtaatcccagca

SEQ ID NO: 3959747 - DNA, 22 bp, Homo sapiens
ggctcactgcaacctcttcctc

SEQ ID NO: 3959748 - DNA, 14 bp, Homo sapiens
ggctcagactctgg

SEQ ID NO: 3959749 - DNA, 13 bp, Homo sapiens
ggctgtgaggccc

SEQ ID NO: 3959750 - DNA, 13 bp, Homo sapiens
ggctgtgcctctg

SEQ ID NO: 3959751 - DNA, 17 bp, Homo sapiens
ggctgtggaggcctgat

SEQ ID NO: 3959752 - DNA, 22 bp, Homo sapiens
ggctgtggaggcctgatgctgc

SEQ ID NO: 3959753 - DNA, 13 bp, Homo sapiens
ggctgtggcacag

SEQ ID NO: 3959754 - DNA, 14 bp, Homo sapiens
ggctgtgtgacaga

SEQ ID NO: 3959755 - DNA, 19 bp, Homo sapiens
ggctgttctgcactgaaaa

SEQ ID NO: 3959756 - DNA, 20 bp, Homo sapiens
ggctgttggacagctgcttg

SEQ ID NO: 3959757 - DNA, 14 bp, Homo sapiens
ggcttaatgtttat

SEQ ID NO: 3959758 - DNA, 16 bp, Homo sapiens
ggcttaggtgccaggc

SEQ ID NO: 3959759 - DNA, 17 bp, Homo sapiens
ggcttcagcatatttat

SEQ ID NO: 3959760 - DNA, 20 bp, Homo sapiens
ggcttccagagagtcctctg

SEQ ID NO: 3959761 - DNA, 14 bp, Homo sapiens
ggcttccaggctct

SEQ ID NO: 3959762 - DNA, 18 bp, Homo sapiens
ggcttccaggctcttcct

SEQ ID NO: 3959763 - DNA, 17 bp, Homo sapiens
ggcttcccatccccagc

SEQ ID NO: 3959764 - DNA, 15 bp, Homo sapiens
ggcttcccgctcagc

SEQ ID NO: 3959765 - DNA, 22 bp, Homo sapiens
ggggtatttaccacagcagctg

SEQ ID NO: 3959766 - DNA, 15 bp, Homo sapiens
ggggtccatttgggt

SEQ ID NO: 3959767 - DNA, 18 bp, Homo sapiens
ggggtcgtggagagctag

SEQ ID NO: 3959768 - DNA, 14 bp, Homo sapiens
ggggtctgtgctgt

SEQ ID NO: 3959769 - DNA, 17 bp, Homo sapiens
ggggtctgtgctgtgcc

SEQ ID NO: 3959770 - DNA, 18 bp, Homo sapiens
ggggtctgtgctgtgcct

SEQ ID NO: 3959771 - DNA, 23 bp, Homo sapiens
ggggtgacccggcaccccctgca

SEQ ID NO: 3959772 - DNA, 23 bp, Homo sapiens
ggggtgatgagggcagcagccag

SEQ ID NO: 3959773 - DNA, 17 bp, Homo sapiens
ggggtgatttcagagag

SEQ ID NO: 3959774 - DNA, 12 bp, Homo sapiens
ggggtggggcag

SEQ ID NO: 3959775 - DNA, 17 bp, Homo sapiens
ggggtggggcaggatct

SEQ ID NO: 3959776 - DNA, 15 bp, Homo sapiens
ggggtgtctggaagc

SEQ ID NO: 3959777 - DNA, 17 bp, Homo sapiens
ggggttgtgaggcctgg

SEQ ID NO: 3959778 - DNA, 13 bp, Homo sapiens
gggtaaactgtgg

SEQ ID NO: 3959779 - DNA, 12 bp, Homo sapiens
gggtaagacaat

SEQ ID NO: 3959780 - DNA, 17 bp, Homo sapiens
gggtaagccagagcctg

SEQ ID NO: 3959781 - DNA, 18 bp, Homo sapiens
gggtaagccagagcctgg

SEQ ID NO: 3959782 - DNA, 21 bp, Homo sapiens
gggtaataaacttagaataaa

SEQ ID NO: 3959783 - DNA, 12 bp, Homo sapiens
gggtcagccagg

SEQ ID NO: 3959784 - DNA, 19 bp, Homo sapiens
gggtcagccagggccaggg

SEQ ID NO: 3959785 - DNA, 20 bp, Homo sapiens
gggtccacccagcaaagagt

SEQ ID NO: 3959786 - DNA, 11 bp, Homo sapiens
gggtccaggaa

SEQ ID NO: 3959787 - DNA, 16 bp, Homo sapiens
gggtccaggaaggcag

SEQ ID NO: 3959788 - DNA, 19 bp, Homo sapiens
gggtccaggaaggcagctg

SEQ ID NO: 3959789 - DNA, 20 bp, Homo sapiens
gggtccaggaaggcagctgc

SEQ ID NO: 3959790 - DNA, 21 bp, Homo sapiens
gggtccaggaaggcagctgct

SEQ ID NO: 3959791 - DNA, 22 bp, Homo sapiens
gggtccaggaaggcagctgctc

SEQ ID NO: 3959792 - DNA, 17 bp, Homo sapiens
gggtccgcaccagctgc

SEQ ID NO: 3959793 - DNA, 18 bp, Homo sapiens
gggtccgcaccagctgct

SEQ ID NO: 3959794 - DNA, 21 bp, Homo sapiens
gggtccgcaccagctgctctg

SEQ ID NO: 3959795 - DNA, 22 bp, Homo sapiens
gggtccgcaccagctgctctgc

SEQ ID NO: 3959796 - DNA, 19 bp, Homo sapiens
gggtcctgcaatctccagg

SEQ ID NO: 3959797 - DNA, 19 bp, Homo sapiens
gggtctccctctcctgcct

SEQ ID NO: 3959798 - DNA, 22 bp, Homo sapiens
gggtctgaaggaatagccagag

SEQ ID NO: 3959799 - DNA, 20 bp, Homo sapiens
gggtgactgaatttgggcct

SEQ ID NO: 3959800 - DNA, 21 bp, Homo sapiens
gggtgactgaatttgggcctc

SEQ ID NO: 3959801 - DNA, 19 bp, Homo sapiens
gggtgagaatcctgcctct

SEQ ID NO: 3959802 - DNA, 17 bp, Homo sapiens
gggtgatgagggcagca

SEQ ID NO: 3959803 - DNA, 13 bp, Homo sapiens
gggtgcacaggag

SEQ ID NO: 3959804 - DNA, 19 bp, Homo sapiens
gggtgcctatttattgggg

SEQ ID NO: 3959805 - DNA, 14 bp, Homo sapiens
gggtgcggcaggag

SEQ ID NO: 3959806 - DNA, 14 bp, Homo sapiens
gggtggagaagtgt

SEQ ID NO: 3959807 - DNA, 22 bp, Homo sapiens
gggtggaggaaggtgctgagct

SEQ ID NO: 3959808 - DNA, 17 bp, Homo sapiens
gggtggcacctcctgag

SEQ ID NO: 3959809 - DNA, 18 bp, Homo sapiens
gggtggcacctcctgaga

SEQ ID NO: 3959810 - DNA, 20 bp, Homo sapiens
gggtggcacctcctgagaag

SEQ ID NO: 3959811 - DNA, 22 bp, Homo sapiens
gggtggcaggcacacagcagcc

SEQ ID NO: 3959812 - DNA, 18 bp, Homo sapiens
gggtggccccctgtgcca

SEQ ID NO: 3959813 - DNA, 20 bp, Homo sapiens
gggtggccccctgtgccagc

SEQ ID NO: 3959814 - DNA, 18 bp, Homo sapiens
gggtggctagtcagagag

SEQ ID NO: 3959815 - DNA, 14 bp, Homo sapiens
gggtgggaagaaag

SEQ ID NO: 3959816 - DNA, 15 bp, Homo sapiens
gggtgggcctggcct

SEQ ID NO: 3959817 - DNA, 19 bp, Homo sapiens
gggtgggcctggcctgagc

SEQ ID NO: 3959818 - DNA, 20 bp, Homo sapiens
gggtgggcctggcctgagct

SEQ ID NO: 3959819 - DNA, 12 bp, Homo sapiens
gggtggggctgc

SEQ ID NO: 3959820 - DNA, 16 bp, Homo sapiens
gggtggtgggtgctgg

SEQ ID NO: 3959821 - DNA, 14 bp, Homo sapiens
gggtgtctggaagc

SEQ ID NO: 3959822 - DNA, 12 bp, Homo sapiens
gggtgtgccctt

SEQ ID NO: 3959823 - DNA, 17 bp, Homo sapiens
gggtgttaaggcagtga

SEQ ID NO: 3959824 - DNA, 22 bp, Homo sapiens
gggttatttttgtccctgctcc

SEQ ID NO: 3959825 - DNA, 23 bp, Homo sapiens
gggttatttttgtccctgctcct

SEQ ID NO: 3959826 - DNA, 17 bp, Homo sapiens
gggttcagcccctcctc

SEQ ID NO: 3959827 - DNA, 20 bp, Homo sapiens
gggttcagcccctcctctgc

SEQ ID NO: 3959828 - DNA, 21 bp, Homo sapiens
gggttcagcccctcctctgcc

SEQ ID NO: 3959829 - DNA, 16 bp, Homo sapiens
gggttctttcttcctc

SEQ ID NO: 3959830 - DNA, 17 bp, Homo sapiens
gggttctttcttcctct

SEQ ID NO: 3959831 - DNA, 13 bp, Homo sapiens
gggttgaaggcag

SEQ ID NO: 3959832 - DNA, 18 bp, Homo sapiens
gggttgaaggcagtctga

SEQ ID NO: 3959833 - DNA, 21 bp, Homo sapiens
gggttgcgggggagctggaaa

SEQ ID NO: 3959834 - DNA, 18 bp, Homo sapiens
gggttggatgggaagatg

SEQ ID NO: 3959835 - DNA, 21 bp, Homo sapiens
gggttgggttcatctgagcaa

SEQ ID NO: 3959836 - DNA, 14 bp, Homo sapiens
gggttgtgaggcct

SEQ ID NO: 3959837 - DNA, 21 bp, Homo sapiens
gggtttgagtcaaaagcctgg

SEQ ID NO: 3959838 - DNA, 13 bp, Homo sapiens
gggttttatcagt

SEQ ID NO: 3959839 - DNA, 21 bp, Homo sapiens
gggttttctaactgtaaatca

SEQ ID NO: 3959840 - DNA, 23 bp, Homo sapiens
ggtaaaagtgtgagcagtgagtt

SEQ ID NO: 3959841 - DNA, 22 bp, Homo sapiens
ggtaacatcctttctattgaaa

SEQ ID NO: 3959842 - DNA, 15 bp, Homo sapiens
ggtaagccagagcct

SEQ ID NO: 3959843 - DNA, 17 bp, Homo sapiens
ggtaagggagagggagg

SEQ ID NO: 3959844 - DNA, 13 bp, Homo sapiens
ggtaaggtgcctt

SEQ ID NO: 3959845 - DNA, 11 bp, Homo sapiens
ggtacagcagg

SEQ ID NO: 3959846 - DNA, 15 bp, Homo sapiens
ggtacatttccctgt

SEQ ID NO: 3959847 - DNA, 14 bp, Homo sapiens
ggtacgtctgggcc

SEQ ID NO: 3959848 - DNA, 14 bp, Homo sapiens
ggtacttcctcctg

SEQ ID NO: 3959849 - DNA, 15 bp, Homo sapiens
ggtacttcctcctga

SEQ ID NO: 3959850 - DNA, 23 bp, Homo sapiens
ggtagagtttgaaggaggtgagg

SEQ ID NO: 3959851 - DNA, 14 bp, Homo sapiens
ggtagcgagctgct

SEQ ID NO: 3959852 - DNA, 15 bp, Homo sapiens
ggtagcgagctgctc

SEQ ID NO: 3959853 - DNA, 19 bp, Homo sapiens
ggtagcgagctgctctgct

SEQ ID NO: 3959854 - DNA, 15 bp, Homo sapiens
ggtaggccaagctga

SEQ ID NO: 3959855 - DNA, 23 bp, Homo sapiens
ggtaggccaagctgaagtgaagg

SEQ ID NO: 3959856 - DNA, 11 bp, Homo sapiens
ggtaggccctt

SEQ ID NO: 3959857 - DNA, 20 bp, Homo sapiens
ggtaggcccttgtcctgcca

SEQ ID NO: 3959858 - DNA, 23 bp, Homo sapiens
ggtaggcccttgtcctgccagct

SEQ ID NO: 3959859 - DNA, 13 bp, Homo sapiens
ggtagtactggga

SEQ ID NO: 3959860 - DNA, 22 bp, Homo sapiens
ggtatatcattataactgaagg

SEQ ID NO: 3959861 - DNA, 15 bp, Homo sapiens
ggtatcaagaaagtc

SEQ ID NO: 3959862 - DNA, 14 bp, Homo sapiens
ggtatcaggcacag

SEQ ID NO: 3959863 - DNA, 22 bp, Homo sapiens
ggtatgaacttgaggacacatg

SEQ ID NO: 3959864 - DNA, 18 bp, Homo sapiens
ggtatgctggccagcacc

SEQ ID NO: 3959865 - DNA, 20 bp, Homo sapiens
ggtatgtagcccggccaggg

SEQ ID NO: 3959866 - DNA, 15 bp, Homo sapiens
ggtattaaagatgtg

SEQ ID NO: 3959867 - DNA, 14 bp, Homo sapiens
ggtattagaaagtg

SEQ ID NO: 3959868 - DNA, 15 bp, Homo sapiens
ggtattagcacctct

SEQ ID NO: 3959869 - DNA, 18 bp, Homo sapiens
ggtattccttttgtgtac

SEQ ID NO: 3959870 - DNA, 14 bp, Homo sapiens
ggtatttcctgcta

SEQ ID NO: 3959871 - DNA, 18 bp, Homo sapiens
ggtcacaggactctgcct

SEQ ID NO: 3959872 - DNA, 21 bp, Homo sapiens
ggtcacattcaggaagatgaa

SEQ ID NO: 3959873 - DNA, 13 bp, Homo sapiens
ggtcaccaccctc

SEQ ID NO: 3959874 - DNA, 15 bp, Homo sapiens
ggtcaccaccctccc

SEQ ID NO: 3959875 - DNA, 14 bp, Homo sapiens
ggtcaccatgaaac

SEQ ID NO: 3959876 - DNA, 14 bp, Homo sapiens
ggtcactgggttct

SEQ ID NO: 3959877 - DNA, 13 bp, Homo sapiens
ggtcatgtgtgca

SEQ ID NO: 3959878 - DNA, 16 bp, Homo sapiens
ggtccagaagtccctc

SEQ ID NO: 3959879 - DNA, 16 bp, Homo sapiens
ggtccaggaaggcagc

SEQ ID NO: 3959880 - DNA, 18 bp, Homo sapiens
ggtccaggaaggcagctg

SEQ ID NO: 3959881 - DNA, 19 bp, Homo sapiens
ggtccaggaaggcagctgc

SEQ ID NO: 3959882 - DNA, 21 bp, Homo sapiens
ggtccaggaaggcagctgctc

SEQ ID NO: 3959883 - DNA, 21 bp, Homo sapiens
ggtccagggttgatcacactc

SEQ ID NO: 3959884 - DNA, 23 bp, Homo sapiens
ggtcccacatccctgggcctgct

SEQ ID NO: 3959885 - DNA, 18 bp, Homo sapiens
ggtccccatcatcccagc

SEQ ID NO: 3959886 - DNA, 19 bp, Homo sapiens
ggtcccttgagacctcagc

SEQ ID NO: 3959887 - DNA, 21 bp, Homo sapiens
ggtcccttgagacctcagcca

SEQ ID NO: 3959888 - DNA, 18 bp, Homo sapiens
ggtccgattaatttatgg

SEQ ID NO: 3959889 - DNA, 14 bp, Homo sapiens
ggtccgcaccagct

SEQ ID NO: 3959890 - DNA, 17 bp, Homo sapiens
ggtccgcaccagctgct

SEQ ID NO: 3959891 - DNA, 20 bp, Homo sapiens
ggtcctccatttcaactcca

SEQ ID NO: 3959892 - DNA, 21 bp, Homo sapiens
ggtcctctgatacccagagca

SEQ ID NO: 3959893 - DNA, 20 bp, Homo sapiens
ggtcctgaaagtctgtgtcc

SEQ ID NO: 3959894 - DNA, 13 bp, Homo sapiens
ggtcctgagacct

SEQ ID NO: 3959895 - DNA, 16 bp, Homo sapiens
ggtcctgagcactgcc

SEQ ID NO: 3959896 - DNA, 19 bp, Homo sapiens
ggtcctgagcactgccagg

SEQ ID NO: 3959897 - DNA, 20 bp, Homo sapiens
ggtcctgagcactgccagga

SEQ ID NO: 3959898 - DNA, 17 bp, Homo sapiens
ggtcctgagggtcccca

SEQ ID NO: 3959899 - DNA, 20 bp, Homo sapiens
ggtcctgagtcttggcctgc

SEQ ID NO: 3959900 - DNA, 18 bp, Homo sapiens
ggtcctgcaatctccagg

SEQ ID NO: 3959901 - DNA, 14 bp, Homo sapiens
ggtcctggccctct

SEQ ID NO: 3959902 - DNA, 21 bp, Homo sapiens
ggtcctggtggggcagctcct

SEQ ID NO: 3959903 - DNA, 19 bp, Homo sapiens
ggtcctttaggcagcctgc

SEQ ID NO: 3959904 - DNA, 23 bp, Homo sapiens
ggtcggtttggtttgttgtaaat

SEQ ID NO: 3959905 - DNA, 17 bp, Homo sapiens
ggtcgtgaactcctgag

SEQ ID NO: 3959906 - DNA, 15 bp, Homo sapiens
ggtcgtggagagcta

SEQ ID NO: 3959907 - DNA, 20 bp, Homo sapiens
ggtcgtggagagctaggagc

SEQ ID NO: 3959908 - DNA, 15 bp, Homo sapiens
ggtctaaaaataaac

SEQ ID NO: 3959909 - DNA, 21 bp, Homo sapiens
ggtctcactatgttgcccagg

SEQ ID NO: 3959910 - DNA, 23 bp, Homo sapiens
ggtctcactcctgagtggggcca

SEQ ID NO: 3959911 - DNA, 20 bp, Homo sapiens
ggtctcctctgattatcagg

SEQ ID NO: 3959912 - DNA, 19 bp, Homo sapiens
ggtctccttactctgagcc

SEQ ID NO: 3959913 - DNA, 20 bp, Homo sapiens
ggtctccttactctgagccc

SEQ ID NO: 3959914 - DNA, 14 bp, Homo sapiens
ggtctctatttcat

SEQ ID NO: 3959915 - DNA, 22 bp, Homo sapiens
ggtctgagcaccccctcattcc

SEQ ID NO: 3959916 - DNA, 15 bp, Homo sapiens
ggtctgagccacagc

SEQ ID NO: 3959917 - DNA, 12 bp, Homo sapiens
ggtctgagccct

SEQ ID NO: 3959918 - DNA, 12 bp, Homo sapiens
ggtctgccacca

SEQ ID NO: 3959919 - DNA, 18 bp, Homo sapiens
ggtctgcttttgctgggg

SEQ ID NO: 3959920 - DNA, 14 bp, Homo sapiens
ggtcttcagccatc

SEQ ID NO: 3959921 - DNA, 22 bp, Homo sapiens
ggtcttggaagtgtgtggaagg

SEQ ID NO: 3959922 - DNA, 18 bp, Homo sapiens
ggtcttgggctactggca

SEQ ID NO: 3959923 - DNA, 12 bp, Homo sapiens
ggtgacacacag

SEQ ID NO: 3959924 - DNA, 20 bp, Homo sapiens
ggtgacatcccaggaggggc

SEQ ID NO: 3959925 - DNA, 20 bp, Homo sapiens
ggtgaccccagggcacagga

SEQ ID NO: 3959926 - DNA, 21 bp, Homo sapiens
ggtgaccccagggcacaggag

SEQ ID NO: 3959927 - DNA, 16 bp, Homo sapiens
ggtgactgaacgaggg

SEQ ID NO: 3959928 - DNA, 23 bp, Homo sapiens
ggtgactgcgatcttcagagcag

SEQ ID NO: 3959929 - DNA, 14 bp, Homo sapiens
ggtgagaccacctc

SEQ ID NO: 3959930 - DNA, 15 bp, Homo sapiens
ggtgagaccacctct

SEQ ID NO: 3959931 - DNA, 12 bp, Homo sapiens
ggtgagagctgc

SEQ ID NO: 3959932 - DNA, 12 bp, Homo sapiens
ggtgagggatgt

SEQ ID NO: 3959933 - DNA, 13 bp, Homo sapiens
ggtgagggatgtg

SEQ ID NO: 3959934 - DNA, 15 bp, Homo sapiens
ggtgataagtggaaa

SEQ ID NO: 3959935 - DNA, 16 bp, Homo sapiens
ggtgataagtggaaaa

SEQ ID NO: 3959936 - DNA, 16 bp, Homo sapiens
ggtgcaagagacagag

SEQ ID NO: 3959937 - DNA, 22 bp, Homo sapiens
gggcccagctgtagccatggct

SEQ ID NO: 3959938 - DNA, 17 bp, Homo sapiens
gggccccagatctgcct

SEQ ID NO: 3959939 - DNA, 18 bp, Homo sapiens
gggccccagatctgcctg

SEQ ID NO: 3959940 - DNA, 19 bp, Homo sapiens
gggccccagatctgcctgg

SEQ ID NO: 3959941 - DNA, 21 bp, Homo sapiens
gggccccagatctgcctgggc

SEQ ID NO: 3959942 - DNA, 13 bp, Homo sapiens
gggccccatgctc

SEQ ID NO: 3959943 - DNA, 16 bp, Homo sapiens
gggccccatgctctgc

SEQ ID NO: 3959944 - DNA, 17 bp, Homo sapiens
gggccccatgctctgcc

SEQ ID NO: 3959945 - DNA, 20 bp, Homo sapiens
gggccccatgctctgcccca

SEQ ID NO: 3959946 - DNA, 15 bp, Homo sapiens
gggcccccctccttg

SEQ ID NO: 3959947 - DNA, 18 bp, Homo sapiens
gggccccggggctggcaa

SEQ ID NO: 3959948 - DNA, 13 bp, Homo sapiens
gggcccctccctc

SEQ ID NO: 3959949 - DNA, 14 bp, Homo sapiens
gggcccctgggatg

SEQ ID NO: 3959950 - DNA, 19 bp, Homo sapiens
gggcccgaaagctgagacc

SEQ ID NO: 3959951 - DNA, 18 bp, Homo sapiens
gggccctgcacctgtgca

SEQ ID NO: 3959952 - DNA, 11 bp, Homo sapiens
gggccctgggc

SEQ ID NO: 3959953 - DNA, 15 bp, Homo sapiens
gggcccttggggcct

SEQ ID NO: 3959954 - DNA, 13 bp, Homo sapiens
gggccgggcaggt

SEQ ID NO: 3959955 - DNA, 20 bp, Homo sapiens
gggccgggtgaaaatgccag

SEQ ID NO: 3959956 - DNA, 14 bp, Homo sapiens
gggcctatggagag

SEQ ID NO: 3959957 - DNA, 18 bp, Homo sapiens
gggcctatggagagccct

SEQ ID NO: 3959958 - DNA, 12 bp, Homo sapiens
gggcctcagttt

SEQ ID NO: 3959959 - DNA, 21 bp, Homo sapiens
gggcctcctctccctgcacct

SEQ ID NO: 3959960 - DNA, 14 bp, Homo sapiens
gggcctctgaaatt

SEQ ID NO: 3959961 - DNA, 12 bp, Homo sapiens
gggcctcttccc

SEQ ID NO: 3959962 - DNA, 15 bp, Homo sapiens
gggcctgcccaatgc

SEQ ID NO: 3959963 - DNA, 12 bp, Homo sapiens
gggcctgctgct

SEQ ID NO: 3959964 - DNA, 15 bp, Homo sapiens
gggcctgctgctgag

SEQ ID NO: 3959965 - DNA, 20 bp, Homo sapiens
gggcctgctgctgagaacct

SEQ ID NO: 3959966 - DNA, 23 bp, Homo sapiens
gggcctgctgctgagaacctggc

SEQ ID NO: 3959967 - DNA, 18 bp, Homo sapiens
gggcctgcttttccagga

SEQ ID NO: 3959968 - DNA, 16 bp, Homo sapiens
gggcctggcctgagct

SEQ ID NO: 3959969 - DNA, 17 bp, Homo sapiens
gggcctggcctgagctg

SEQ ID NO: 3959970 - DNA, 22 bp, Homo sapiens
gggcctggcctgagctggggcc

SEQ ID NO: 3959971 - DNA, 14 bp, Homo sapiens
gggcctggctggct

SEQ ID NO: 3959972 - DNA, 18 bp, Homo sapiens
gggcctggctggctgagg

SEQ ID NO: 3959973 - DNA, 19 bp, Homo sapiens
gggcctggcttgctccagg

SEQ ID NO: 3959974 - DNA, 20 bp, Homo sapiens
gggcctggcttgctccaggg

SEQ ID NO: 3959975 - DNA, 21 bp, Homo sapiens
gggcctggcttgctccagggt

SEQ ID NO: 3959976 - DNA, 12 bp, Homo sapiens
gggcctgggcct

SEQ ID NO: 3959977 - DNA, 22 bp, Homo sapiens
gggcctgggggcagtgactggc

SEQ ID NO: 3959978 - DNA, 15 bp, Homo sapiens
gggcctgtactgcct

SEQ ID NO: 3959979 - DNA, 17 bp, Homo sapiens
gggcctgtactgcctgc

SEQ ID NO: 3959980 - DNA, 16 bp, Homo sapiens
gggcctgtcccccaag

SEQ ID NO: 3959981 - DNA, 12 bp, Homo sapiens
gggcctgtgcag

SEQ ID NO: 3959982 - DNA, 14 bp, Homo sapiens
gggcctgtgcagca

SEQ ID NO: 3959983 - DNA, 16 bp, Homo sapiens
gggcctgtgcagcagc

SEQ ID NO: 3959984 - DNA, 14 bp, Homo sapiens
gggccttgcccaga

SEQ ID NO: 3959985 - DNA, 16 bp, Homo sapiens
gggcctttcctgtgcc

SEQ ID NO: 3959986 - DNA, 18 bp, Homo sapiens
gggcgatcaagtccagag

SEQ ID NO: 3959987 - DNA, 19 bp, Homo sapiens
gggcgctcaggacccaggc

SEQ ID NO: 3959988 - DNA, 21 bp, Homo sapiens
gggcgctcaggacccaggccc

SEQ ID NO: 3959989 - DNA, 22 bp, Homo sapiens
gggcgctcaggacccaggccct

SEQ ID NO: 3959990 - DNA, 15 bp, Homo sapiens
gggcgggagtggggg

SEQ ID NO: 3959991 - DNA, 16 bp, Homo sapiens
gggcggggcaggaatg

SEQ ID NO: 3959992 - DNA, 14 bp, Homo sapiens
gggcgggggagcca

SEQ ID NO: 3959993 - DNA, 21 bp, Homo sapiens
gggcgtcgctggacaacccag

SEQ ID NO: 3959994 - DNA, 22 bp, Homo sapiens
gggctactggcagctcctctcc

SEQ ID NO: 3959995 - DNA, 17 bp, Homo sapiens
gggctagaacctggaga

SEQ ID NO: 3959996 - DNA, 17 bp, Homo sapiens
gggctagtgtgagtggc

SEQ ID NO: 3959997 - DNA, 14 bp, Homo sapiens
gggctatggcaagg

SEQ ID NO: 3959998 - DNA, 15 bp, Homo sapiens
gggctatggcaaggg

SEQ ID NO: 3959999 - DNA, 17 bp, Homo sapiens
gggctatggcaaggggg

SEQ ID NO: 3960000 - DNA, 13 bp, Homo sapiens
gggctatttctct

SEQ ID NO: 3960001 - DNA, 12 bp, Homo sapiens
ggcatttcctgg

SEQ ID NO: 3960002 - DNA, 18 bp, Homo sapiens
ggcatttcctgggtggct

SEQ ID NO: 3960003 - DNA, 14 bp, Homo sapiens
ggccaaaagggcag

SEQ ID NO: 3960004 - DNA, 18 bp, Homo sapiens
ggccaaaagggcagccag

SEQ ID NO: 3960005 - DNA, 23 bp, Homo sapiens
ggccaagacttggcaacagaagc

SEQ ID NO: 3960006 - DNA, 23 bp, Homo sapiens
ggccaagagagacattgcctcca

SEQ ID NO: 3960007 - DNA, 15 bp, Homo sapiens
ggccaagcaagaggt

SEQ ID NO: 3960008 - DNA, 23 bp, Homo sapiens
ggccaagctgaggtgcccaggag

SEQ ID NO: 3960009 - DNA, 13 bp, Homo sapiens
ggccaaggcaggt

SEQ ID NO: 3960010 - DNA, 15 bp, Homo sapiens
ggccaaggcaggtag

SEQ ID NO: 3960011 - DNA, 16 bp, Homo sapiens
ggccaattaaaatata

SEQ ID NO: 3960012 - DNA, 23 bp, Homo sapiens
ggccaattaaaatatatataaat

SEQ ID NO: 3960013 - DNA, 22 bp, Homo sapiens
ggccacaaatcaaagcaagggc

SEQ ID NO: 3960014 - DNA, 18 bp, Homo sapiens
ggtgtggtggctcatggc

SEQ ID NO: 3960015 - DNA, 12 bp, Homo sapiens
ggtgtgtctgct

SEQ ID NO: 3960016 - DNA, 20 bp, Homo sapiens
ggtgttgcagagacgcaagg

SEQ ID NO: 3960017 - DNA, 13 bp, Homo sapiens
ggtgtttaaagtc

SEQ ID NO: 3960018 - DNA, 19 bp, Homo sapiens
ggttaaaatataaattaag

SEQ ID NO: 3960019 - DNA, 16 bp, Homo sapiens
ggttaagccctgaggg

SEQ ID NO: 3960020 - DNA, 17 bp, Homo sapiens
ggttaatctttcctgat

SEQ ID NO: 3960021 - DNA, 16 bp, Homo sapiens
ggttaggatttaacag

SEQ ID NO: 3960022 - DNA, 16 bp, Homo sapiens
ggttatctgcctggcc

SEQ ID NO: 3960023 - DNA, 18 bp, Homo sapiens
ggttatctgcctggcctg

SEQ ID NO: 3960024 - DNA, 23 bp, Homo sapiens
ggttatctgcctggcctggctcc

SEQ ID NO: 3960025 - DNA, 16 bp, Homo sapiens
ggttcagcccctcctc

SEQ ID NO: 3960026 - DNA, 19 bp, Homo sapiens
ggttcagcccctcctctgc

SEQ ID NO: 3960027 - DNA, 22 bp, Homo sapiens
ggttcagcccctcctctgccac

SEQ ID NO: 3960028 - DNA, 15 bp, Homo sapiens
ggttcatctgagcaa

SEQ ID NO: 3960029 - DNA, 13 bp, Homo sapiens
ggttccatgcctg

SEQ ID NO: 3960030 - DNA, 15 bp, Homo sapiens
ggttccatgcctgag

SEQ ID NO: 3960031 - DNA, 16 bp, Homo sapiens
ggttcccaataaaagt

SEQ ID NO: 3960032 - DNA, 18 bp, Homo sapiens
ggttcccaataaaagtga

SEQ ID NO: 3960033 - DNA, 13 bp, Homo sapiens
ggttccctctgag

SEQ ID NO: 3960034 - DNA, 16 bp, Homo sapiens
ggttccctctgagaat

SEQ ID NO: 3960035 - DNA, 16 bp, Homo sapiens
ggttctttcttcctct

SEQ ID NO: 3960036 - DNA, 15 bp, Homo sapiens
ggttctttggaagga

SEQ ID NO: 3960037 - DNA, 16 bp, Homo sapiens
ggttgaaggcagtctg

SEQ ID NO: 3960038 - DNA, 11 bp, Homo sapiens
ggttgcagtga

SEQ ID NO: 3960039 - DNA, 18 bp, Homo sapiens
ggttgcgggggagctgga

SEQ ID NO: 3960040 - DNA, 20 bp, Homo sapiens
ggttgtaaatgctcgtgtga

SEQ ID NO: 3960041 - DNA, 10 bp, Homo sapiens
ggttgtcaat

SEQ ID NO: 3960042 - DNA, 13 bp, Homo sapiens
ggttgtcaatatt

SEQ ID NO: 3960043 - DNA, 21 bp, Homo sapiens
ggttgtgaggcctggccaggc

SEQ ID NO: 3960044 - DNA, 22 bp, Homo sapiens
ggttgttgccaactaagccctc

SEQ ID NO: 3960045 - DNA, 23 bp, Homo sapiens
ggtttctgacccaagaggtgggg

SEQ ID NO: 3960046 - DNA, 11 bp, Homo sapiens
ggtttgcagtt

SEQ ID NO: 3960047 - DNA, 20 bp, Homo sapiens
ggtttgccagtgaagacttc

SEQ ID NO: 3960048 - DNA, 16 bp, Homo sapiens
ggtttgttgtaaataa

SEQ ID NO: 3960049 - DNA, 19 bp, Homo sapiens
ggttttattgtccttcaga

SEQ ID NO: 3960050 - DNA, 17 bp, Homo sapiens
ggttttggagtcagtag

SEQ ID NO: 3960051 - DNA, 21 bp, Homo sapiens
ggtttttatttctcgggtgca

SEQ ID NO: 3960052 - DNA, 14 bp, Homo sapiens
gtaaaaccacagca

SEQ ID NO: 3960053 - DNA, 18 bp, Homo sapiens
gtaaaaccacagcagttg

SEQ ID NO: 3960054 - DNA, 15 bp, Homo sapiens
gtaaaagtgtgagca

SEQ ID NO: 3960055 - DNA, 20 bp, Homo sapiens
gtaaaatatctacctgccct

SEQ ID NO: 3960056 - DNA, 11 bp, Homo sapiens
gtaaaatgcag

SEQ ID NO: 3960057 - DNA, 18 bp, Homo sapiens
gtaaaatgcagtccagaa

SEQ ID NO: 3960058 - DNA, 19 bp, Homo sapiens
gtaaaatgcagtccagaat

SEQ ID NO: 3960059 - DNA, 16 bp, Homo sapiens
gtaaacaaaaatttca

SEQ ID NO: 3960060 - DNA, 13 bp, Homo sapiens
gtaaacagtgcct

SEQ ID NO: 3960061 - DNA, 20 bp, Homo sapiens
gtaaacagtgcctgctgaat

SEQ ID NO: 3960062 - DNA, 22 bp, Homo sapiens
gtaaactatcttggtgaatttt

SEQ ID NO: 3960063 - DNA, 15 bp, Homo sapiens
gtaaactcaaaactt

SEQ ID NO: 3960064 - DNA, 20 bp, Homo sapiens
gtaaactgtatcaaatctgt

SEQ ID NO: 3960065 - DNA, 14 bp, Homo sapiens
gtaaagaataaatg

SEQ ID NO: 3960066 - DNA, 17 bp, Homo sapiens
gtaaagcttaaattgct

SEQ ID NO: 3960067 - DNA, 21 bp, Homo sapiens
gtaaagtatgtaaacaggaga

SEQ ID NO: 3960068 - DNA, 17 bp, Homo sapiens
gtaaagtgataatttct

SEQ ID NO: 3960069 - DNA, 20 bp, Homo sapiens
gtaaagtttaaaaaatacac

SEQ ID NO: 3960070 - DNA, 20 bp, Homo sapiens
gtaaatacaaaataaaatta

SEQ ID NO: 3960071 - DNA, 22 bp, Homo sapiens
gtaaatacaaaataaaattatg

SEQ ID NO: 3960072 - DNA, 12 bp, Homo sapiens
gtaaatacacca

SEQ ID NO: 3960073 - DNA, 15 bp, Homo sapiens
gtaaatatgactcct

SEQ ID NO: 3960074 - DNA, 12 bp, Homo sapiens
gtaaatatttat

SEQ ID NO: 3960075 - DNA, 14 bp, Homo sapiens
gtaaatcacttgta

SEQ ID NO: 3960076 - DNA, 18 bp, Homo sapiens
gtaaatcacttgtaaata

SEQ ID NO: 3960077 - DNA, 19 bp, Homo sapiens
gtaaatcacttgtaaataa

SEQ ID NO: 3960078 - DNA, 21 bp, Homo sapiens
gtaaatgggcagtgcctcctg

SEQ ID NO: 3960079 - DNA, 15 bp, Homo sapiens
gtaaatgtggacaca

SEQ ID NO: 3960080 - DNA, 14 bp, Homo sapiens
gtaaattaggaggc

SEQ ID NO: 3960081 - DNA, 15 bp, Homo sapiens
gtaacaaccagagat

SEQ ID NO: 3960082 - DNA, 18 bp, Homo sapiens
gtaacatgccagcttcct

SEQ ID NO: 3960083 - DNA, 22 bp, Homo sapiens
gtaacatgtttacttttcaggg

SEQ ID NO: 3960084 - DNA, 14 bp, Homo sapiens
gtaacttttgtaag

SEQ ID NO: 3960085 - DNA, 15 bp, Homo sapiens
gtaagacaaaggttt

SEQ ID NO: 3960086 - DNA, 21 bp, Homo sapiens
gtaagcattctgagctgggct

SEQ ID NO: 3960087 - DNA, 12 bp, Homo sapiens
gtaagccagagc

SEQ ID NO: 3960088 - DNA, 15 bp, Homo sapiens
gtaagccagagcctg

SEQ ID NO: 3960089 - DNA, 20 bp, Homo sapiens
gtaagggagagggagggagc

SEQ ID NO: 3960090 - DNA, 16 bp, Homo sapiens
gtaagggtctgttgta

SEQ ID NO: 3960091 - DNA, 12 bp, Homo sapiens
gtaagtcttttt

SEQ ID NO: 3960092 - DNA, 14 bp, Homo sapiens
gtaataaaggtctt

SEQ ID NO: 3960093 - DNA, 19 bp, Homo sapiens
gtaatagaaaactgaaaat

SEQ ID NO: 3960094 - DNA, 19 bp, Homo sapiens
gtaatataatggaagagaa

SEQ ID NO: 3960095 - DNA, 20 bp, Homo sapiens
gtaatataatggaagagaaa

SEQ ID NO: 3960096 - DNA, 12 bp, Homo sapiens
gtaatatattgc

SEQ ID NO: 3960097 - DNA, 13 bp, Homo sapiens
gtaatcccagcag

SEQ ID NO: 3960098 - DNA, 23 bp, Homo sapiens
gtaatgcacaatttagaaaacat

SEQ ID NO: 3960099 - DNA, 20 bp, Homo sapiens
gtaatgggccaattaaaata

SEQ ID NO: 3960100 - DNA, 16 bp, Homo sapiens
gtaatgggcctgccca

SEQ ID NO: 3960101 - DNA, 18 bp, Homo sapiens
gtaatgtatttatatgtt

SEQ ID NO: 3960102 - DNA, 20 bp, Homo sapiens
gtaatgtcaccaccttccca

SEQ ID NO: 3960103 - DNA, 22 bp, Homo sapiens
gtaatgtcaccaccttcccagc

SEQ ID NO: 3960104 - DNA, 14 bp, Homo sapiens
gtaattctgcttct

SEQ ID NO: 3960105 - DNA, 17 bp, Homo sapiens
gtaattgcttacatttt

SEQ ID NO: 3960106 - DNA, 13 bp, Homo sapiens
gtaatttgtatct

SEQ ID NO: 3960107 - DNA, 14 bp, Homo sapiens
gtaatttgtatctg

SEQ ID NO: 3960108 - DNA, 15 bp, Homo sapiens
gtaatttgtatctga

SEQ ID NO: 3960109 - DNA, 21 bp, Homo sapiens
gtaatttgtatctgaaggaga

SEQ ID NO: 3960110 - DNA, 12 bp, Homo sapiens
gtacaaaaacaa

SEQ ID NO: 3960111 - DNA, 15 bp, Homo sapiens
gtacaaaagtaccat

SEQ ID NO: 3960112 - DNA, 16 bp, Homo sapiens
gtacaaaataaacaaa

SEQ ID NO: 3960113 - DNA, 15 bp, Homo sapiens
gtacaagctcaggag

SEQ ID NO: 3960114 - DNA, 15 bp, Homo sapiens
gtacagaatttttaa

SEQ ID NO: 3960115 - DNA, 21 bp, Homo sapiens
gtacagaatttttaatgactt

SEQ ID NO: 3960116 - DNA, 19 bp, Homo sapiens
gtacagacgtctcaagact

SEQ ID NO: 3960117 - DNA, 20 bp, Homo sapiens
gtacagagtggcccctcacc

SEQ ID NO: 3960118 - DNA, 12 bp, Homo sapiens
gtacagcagggt

SEQ ID NO: 3960119 - DNA, 20 bp, Homo sapiens
gtacagcagggtcttgctgt

SEQ ID NO: 3960120 - DNA, 20 bp, Homo sapiens
gtacagtagcttaaataaat

SEQ ID NO: 3960121 - DNA, 21 bp, Homo sapiens
gtacagtagcttaaataaatt

SEQ ID NO: 3960122 - DNA, 15 bp, Homo sapiens
gtacagtgaggaggg

SEQ ID NO: 3960123 - DNA, 17 bp, Homo sapiens
gtacagttatcagggat

SEQ ID NO: 3960124 - DNA, 14 bp, Homo sapiens
gtacagttcagttc

SEQ ID NO: 3960125 - DNA, 16 bp, Homo sapiens
gtacagttcagttcct

SEQ ID NO: 3960126 - DNA, 19 bp, Homo sapiens
gtacagttcagttcctctt

SEQ ID NO: 3960127 - DNA, 13 bp, Homo sapiens
gtacatgtgaggc

SEQ ID NO: 3960128 - DNA, 19 bp, Homo sapiens
gtaccaaatccacaagcca

SEQ ID NO: 3960129 - DNA, 13 bp, Homo sapiens
gtaccagccagga

SEQ ID NO: 3960130 - DNA, 17 bp, Homo sapiens
gtacccaggatgatttc

SEQ ID NO: 3960131 - DNA, 18 bp, Homo sapiens
gtaccctatagagagggg

SEQ ID NO: 3960132 - DNA, 23 bp, Homo sapiens
gtaccgccttgcacactcagaag

SEQ ID NO: 3960133 - DNA, 12 bp, Homo sapiens
gtacctgggaaa

SEQ ID NO: 3960134 - DNA, 21 bp, Homo sapiens
gtacctgggaaaggacccacc

SEQ ID NO: 3960135 - DNA, 18 bp, Homo sapiens
gtacgttatatattgtat

SEQ ID NO: 3960136 - DNA, 18 bp, Homo sapiens
gtactactgctgcaaagt

SEQ ID NO: 3960137 - DNA, 14 bp, Homo sapiens
gtactatctgtgaa

SEQ ID NO: 3960138 - DNA, 20 bp, Homo sapiens
gtactattgtttaaaaacag

SEQ ID NO: 3960139 - DNA, 17 bp, Homo sapiens
gtactcagagcagagca

SEQ ID NO: 3960140 - DNA, 14 bp, Homo sapiens
gtactcctcccagg

SEQ ID NO: 3960141 - DNA, 19 bp, Homo sapiens
gtactctctgctctagcca

SEQ ID NO: 3960142 - DNA, 14 bp, Homo sapiens
gtactgataaaata

SEQ ID NO: 3960143 - DNA, 16 bp, Homo sapiens
gtactgcctgcttggg

SEQ ID NO: 3960144 - DNA, 16 bp, Homo sapiens
gtactggcatggtacg

SEQ ID NO: 3960145 - DNA, 23 bp, Homo sapiens
gtactgggttatttttgtccctg

SEQ ID NO: 3960146 - DNA, 21 bp, Homo sapiens
gtactgtaattttgtttgtaa

SEQ ID NO: 3960147 - DNA, 14 bp, Homo sapiens
gtacttaactgtgt

SEQ ID NO: 3960148 - DNA, 15 bp, Homo sapiens
gtacttaataaattc

SEQ ID NO: 3960149 - DNA, 18 bp, Homo sapiens
gtacttcctcctgatggc

SEQ ID NO: 3960150 - DNA, 21 bp, Homo sapiens
gtacttcctcctgatggccaa

SEQ ID NO: 3960151 - DNA, 22 bp, Homo sapiens
gtagaagatggactctgaaaaa

SEQ ID NO: 3960152 - DNA, 15 bp, Homo sapiens
gtagaattatatcta

SEQ ID NO: 3960153 - DNA, 14 bp, Homo sapiens
gtagaccaaaataa

SEQ ID NO: 3960154 - DNA, 16 bp, Homo sapiens
gtagaccaaaataaaa

SEQ ID NO: 3960155 - DNA, 14 bp, Homo sapiens
gtatggaagggagg

SEQ ID NO: 3960156 - DNA, 15 bp, Homo sapiens
gtatggaagggaggg

SEQ ID NO: 3960157 - DNA, 17 bp, Homo sapiens
gtatggaagggaggggt

SEQ ID NO: 3960158 - DNA, 22 bp, Homo sapiens
gtatggaagggaggggtcctga

SEQ ID NO: 3960159 - DNA, 14 bp, Homo sapiens
gtatgtaaacagga

SEQ ID NO: 3960160 - DNA, 15 bp, Homo sapiens
gtatgtatacacaca

SEQ ID NO: 3960161 - DNA, 13 bp, Homo sapiens
gtatgtctccagt

SEQ ID NO: 3960162 - DNA, 17 bp, Homo sapiens
gtatgtgatatctgaac

SEQ ID NO: 3960163 - DNA, 16 bp, Homo sapiens
gtatgtgcacatgtgt

SEQ ID NO: 3960164 - DNA, 13 bp, Homo sapiens
gtatgtgtgggta

SEQ ID NO: 3960165 - DNA, 22 bp, Homo sapiens
gtatgtgtgtggtgtgtgtgct

SEQ ID NO: 3960166 - DNA, 15 bp, Homo sapiens
gtattaaagatgtgt

SEQ ID NO: 3960167 - DNA, 19 bp, Homo sapiens
gtattaagggcattttaaa

SEQ ID NO: 3960168 - DNA, 14 bp, Homo sapiens
gtattaatactaaa

SEQ ID NO: 3960169 - DNA, 15 bp, Homo sapiens
gtattaatactaaaa

SEQ ID NO: 3960170 - DNA, 16 bp, Homo sapiens
gtattaatactaaaat

SEQ ID NO: 3960171 - DNA, 19 bp, Homo sapiens
gtattaatactaaaatatg

SEQ ID NO: 3960172 - DNA, 16 bp, Homo sapiens
gtattatcacatcaag

SEQ ID NO: 3960173 - DNA, 10 bp, Homo sapiens
gtattcagat

SEQ ID NO: 3960174 - DNA, 16 bp, Homo sapiens
gtattccatgggatgt

SEQ ID NO: 3960175 - DNA, 18 bp, Homo sapiens
gtattccatgggatgtta

SEQ ID NO: 3960176 - DNA, 19 bp, Homo sapiens
gtattctaaagctttctga

SEQ ID NO: 3960177 - DNA, 23 bp, Homo sapiens
gtattgccacaatgcctctccca

SEQ ID NO: 3960178 - DNA, 23 bp, Homo sapiens
gtattgcgaatgtgcagaaagca

SEQ ID NO: 3960179 - DNA, 23 bp, Homo sapiens
gtattgtccatatcagacctctg

SEQ ID NO: 3960180 - DNA, 14 bp, Homo sapiens
gtatttatatttgg

SEQ ID NO: 3960181 - DNA, 18 bp, Homo sapiens
gtatttatatttggaaag

SEQ ID NO: 3960182 - DNA, 20 bp, Homo sapiens
gtatttatatttggaaagag

SEQ ID NO: 3960183 - DNA, 21 bp, Homo sapiens
gtatttatatttggaaagaga

SEQ ID NO: 3960184 - DNA, 12 bp, Homo sapiens
gtatttattgtc

SEQ ID NO: 3960185 - DNA, 13 bp, Homo sapiens
gtatttcctgcta

SEQ ID NO: 3960186 - DNA, 19 bp, Homo sapiens
gtctccctaaaataaaaac

SEQ ID NO: 3960187 - DNA, 14 bp, Homo sapiens
gtctccctctcctg

SEQ ID NO: 3960188 - DNA, 16 bp, Homo sapiens
gtctccctctcctgcc

SEQ ID NO: 3960189 - DNA, 17 bp, Homo sapiens
gtctccctctcctgcct

SEQ ID NO: 3960190 - DNA, 19 bp, Homo sapiens
gtctccctctcctgcctac

SEQ ID NO: 3960191 - DNA, 20 bp, Homo sapiens
gtctccctggatcagaacag

SEQ ID NO: 3960192 - DNA, 17 bp, Homo sapiens
gtctcctacctgctgct

SEQ ID NO: 3960193 - DNA, 18 bp, Homo sapiens
gtctcctacctgctgctg

SEQ ID NO: 3960194 - DNA, 20 bp, Homo sapiens
gtctcctctgattatcaggt

SEQ ID NO: 3960195 - DNA, 12 bp, Homo sapiens
gtctcctgacat

SEQ ID NO: 3960196 - DNA, 17 bp, Homo sapiens
gtctcctggtctgtgct

SEQ ID NO: 3960197 - DNA, 21 bp, Homo sapiens
gtctcctgtgcccacatccca

SEQ ID NO: 3960198 - DNA, 17 bp, Homo sapiens
gtctccttactctgagc

SEQ ID NO: 3960199 - DNA, 21 bp, Homo sapiens
gtctccttactctgagcccag

SEQ ID NO: 3960200 - DNA, 14 bp, Homo sapiens
gtctccttgcactt

SEQ ID NO: 3960201 - DNA, 23 bp, Homo sapiens
gtctcctttgcactgagggccac

SEQ ID NO: 3960202 - DNA, 14 bp, Homo sapiens
gtctcgagcgccct

SEQ ID NO: 3960203 - DNA, 15 bp, Homo sapiens
gtctcgagcgccctg

SEQ ID NO: 3960204 - DNA, 19 bp, Homo sapiens
gtctcgagcgccctgcaga

SEQ ID NO: 3960205 - DNA, 22 bp, Homo sapiens
gtctctaagccaactttaattg

SEQ ID NO: 3960206 - DNA, 14 bp, Homo sapiens
gtctctagccgggc

SEQ ID NO: 3960207 - DNA, 20 bp, Homo sapiens
gtctctagccgggccatgct

SEQ ID NO: 3960208 - DNA, 12 bp, Homo sapiens
gtctctcagaat

SEQ ID NO: 3960209 - DNA, 12 bp, Homo sapiens
gtctctcattct

SEQ ID NO: 3960210 - DNA, 20 bp, Homo sapiens
gtctctcccaccccggcctc

SEQ ID NO: 3960211 - DNA, 22 bp, Homo sapiens
gtctctcccaccccggcctcca

SEQ ID NO: 3960212 - DNA, 20 bp, Homo sapiens
gtctctcttgctttgttctt

SEQ ID NO: 3960213 - DNA, 20 bp, Homo sapiens
gtctctctttctccctcacc

SEQ ID NO: 3960214 - DNA, 22 bp, Homo sapiens
gtctctgctgcatttgtgtcat

SEQ ID NO: 3960215 - DNA, 14 bp, Homo sapiens
gtctcttctccact

SEQ ID NO: 3960216 - DNA, 15 bp, Homo sapiens
gtctcttctccactg

SEQ ID NO: 3960217 - DNA, 18 bp, Homo sapiens
gtctcttctccactggat

SEQ ID NO: 3960218 - DNA, 14 bp, Homo sapiens
gtctgaaaatgttg

SEQ ID NO: 3960219 - DNA, 19 bp, Homo sapiens
gtctgaacccttgtgcttg

SEQ ID NO: 3960220 - DNA, 19 bp, Homo sapiens
gtctgaaggaatagccaga

SEQ ID NO: 3960221 - DNA, 21 bp, Homo sapiens
gtctgaaggaatagccagaga

SEQ ID NO: 3960222 - DNA, 22 bp, Homo sapiens
gtctgaaggaatagccagagag

SEQ ID NO: 3960223 - DNA, 21 bp, Homo sapiens
gtctgactccagagtctgagc

SEQ ID NO: 3960224 - DNA, 15 bp, Homo sapiens
gtctgagcaccccct

SEQ ID NO: 3960225 - DNA, 12 bp, Homo sapiens
gtctgagccccc

SEQ ID NO: 3960226 - DNA, 14 bp, Homo sapiens
gtctgaggtcctga

SEQ ID NO: 3960227 - DNA, 18 bp, Homo sapiens
gtctgagtcctgtctctg

SEQ ID NO: 3960228 - DNA, 19 bp, Homo sapiens
gtctgagtcctgtctctgc

SEQ ID NO: 3960229 - DNA, 20 bp, Homo sapiens
gtctgattggctcacccaag

SEQ ID NO: 3960230 - DNA, 13 bp, Homo sapiens
gtctgccccaccc

SEQ ID NO: 3960231 - DNA, 15 bp, Homo sapiens
gtctgctatattttc

SEQ ID NO: 3960232 - DNA, 17 bp, Homo sapiens
gtctgctatattttcat

SEQ ID NO: 3960233 - DNA, 18 bp, Homo sapiens
gtctgctatattttcatg

SEQ ID NO: 3960234 - DNA, 23 bp, Homo sapiens
gtctgctcagacagaacccctac

SEQ ID NO: 3960235 - DNA, 17 bp, Homo sapiens
gtctgcttctgtccagg

SEQ ID NO: 3960236 - DNA, 15 bp, Homo sapiens
gtctggaagctgagc

SEQ ID NO: 3960237 - DNA, 18 bp, Homo sapiens
gtctggaagctgagcagg

SEQ ID NO: 3960238 - DNA, 14 bp, Homo sapiens
gtctggagaagcag

SEQ ID NO: 3960239 - DNA, 16 bp, Homo sapiens
gtctgggagtgttctg

SEQ ID NO: 3960240 - DNA, 17 bp, Homo sapiens
gtctgggagtgttctgt

SEQ ID NO: 3960241 - DNA, 21 bp, Homo sapiens
gtctgggagtgttctgtttcc

SEQ ID NO: 3960242 - DNA, 17 bp, Homo sapiens
gtctggggttcagcccc

SEQ ID NO: 3960243 - DNA, 21 bp, Homo sapiens
gtctggttttaacaatttcct

SEQ ID NO: 3960244 - DNA, 15 bp, Homo sapiens
gtctgtcccaccagc

SEQ ID NO: 3960245 - DNA, 16 bp, Homo sapiens
gtctgtctgtctgtcc

SEQ ID NO: 3960246 - DNA, 16 bp, Homo sapiens
gtctgtgctgtgcctg

SEQ ID NO: 3960247 - DNA, 17 bp, Homo sapiens
gtcttatatagcagcaa

SEQ ID NO: 3960248 - DNA, 13 bp, Homo sapiens
gtcttcacaacag

SEQ ID NO: 3960249 - DNA, 13 bp, Homo sapiens
gtcttccaacccc

SEQ ID NO: 3960250 - DNA, 20 bp, Homo sapiens
gtcttccaaccccagctggc

SEQ ID NO: 3960251 - DNA, 23 bp, Homo sapiens
gtcttccaaccccagctggcctc

SEQ ID NO: 3960252 - DNA, 17 bp, Homo sapiens
gtcttcttacttggaac

SEQ ID NO: 3960253 - DNA, 11 bp, Homo sapiens
gtcttcttggc

SEQ ID NO: 3960254 - DNA, 16 bp, Homo sapiens
gtcttcttgtgtcctg

SEQ ID NO: 3960255 - DNA, 14 bp, Homo sapiens
gtcttgcctaggcc

SEQ ID NO: 3960256 - DNA, 13 bp, Homo sapiens
gtcttgctttgct

SEQ ID NO: 3960257 - DNA, 16 bp, Homo sapiens
gtcttgctttgctgtc

SEQ ID NO: 3960258 - DNA, 17 bp, Homo sapiens
gtcttgctttgctgtct

SEQ ID NO: 3960259 - DNA, 22 bp, Homo sapiens
gtcttgggctactggcagctcc

SEQ ID NO: 3960260 - DNA, 22 bp, Homo sapiens
gtcttgtttgtagccaatacat

SEQ ID NO: 3960261 - DNA, 16 bp, Homo sapiens
gtctttaatcccagtt

SEQ ID NO: 3960262 - DNA, 19 bp, Homo sapiens
gtctttctctaaatatgat

SEQ ID NO: 3960263 - DNA, 13 bp, Homo sapiens
gtctttgcacatg

SEQ ID NO: 3960264 - DNA, 14 bp, Homo sapiens
gtctttgcacatgt

SEQ ID NO: 3960265 - DNA, 15 bp, Homo sapiens
gtctttgcacatgtg

SEQ ID NO: 3960266 - DNA, 20 bp, Homo sapiens
gtctttgtaatgtcaccacc

SEQ ID NO: 3960267 - DNA, 21 bp, Homo sapiens
gtctttgtaatgtcaccacct

SEQ ID NO: 3960268 - DNA, 22 bp, Homo sapiens
gtctttgtaatgtcaccacctt

SEQ ID NO: 3960269 - DNA, 23 bp, Homo sapiens
gtctttgtgggagggtaagacaa

SEQ ID NO: 3960270 - DNA, 20 bp, Homo sapiens
gtgaaacaattattgtacac

SEQ ID NO: 3960271 - DNA, 16 bp, Homo sapiens
gtgaaacttcctaagt

SEQ ID NO: 3960272 - DNA, 15 bp, Homo sapiens
gtgaaagaattattt

SEQ ID NO: 3960273 - DNA, 22 bp, Homo sapiens
gtgaaagaattatttttgtgtt

SEQ ID NO: 3960274 - DNA, 23 bp, Homo sapiens
gtgaaagtatgtgatatctgaac

SEQ ID NO: 3960275 - DNA, 18 bp, Homo sapiens
gtgaaagtgtaaaataga

SEQ ID NO: 3960276 - DNA, 15 bp, Homo sapiens
gtgaaagtgtaatac

SEQ ID NO: 3960277 - DNA, 18 bp, Homo sapiens
gtgaaattgatgccagtg

SEQ ID NO: 3960278 - DNA, 21 bp, Homo sapiens
gtgaaatttattagttaatat

SEQ ID NO: 3960279 - DNA, 15 bp, Homo sapiens
gtgaacacatcagct

SEQ ID NO: 3960280 - DNA, 23 bp, Homo sapiens
gtgaaccaaagagactggagcat

SEQ ID NO: 3960281 - DNA, 17 bp, Homo sapiens
gtgaacccaggacaagc

SEQ ID NO: 3960282 - DNA, 20 bp, Homo sapiens
gtgaactatttctacacagt

SEQ ID NO: 3960283 - DNA, 13 bp, Homo sapiens
gtgaactcctgag

SEQ ID NO: 3960284 - DNA, 15 bp, Homo sapiens
gtgaagaaatggaat

SEQ ID NO: 3960285 - DNA, 23 bp, Homo sapiens
gtgaagcagtgcctcgaggcacc

SEQ ID NO: 3960286 - DNA, 23 bp, Homo sapiens
gtgaagccccttgtcctctcccg

SEQ ID NO: 3960287 - DNA, 18 bp, Homo sapiens
gtgaaggagaaaggagcc

SEQ ID NO: 3960288 - DNA, 15 bp, Homo sapiens
gtgaataaaaaccct

SEQ ID NO: 3960289 - DNA, 13 bp, Homo sapiens
gtgaatgtctcag

SEQ ID NO: 3960290 - DNA, 20 bp, Homo sapiens
gtgacaaaattttataagca

SEQ ID NO: 3960291 - DNA, 21 bp, Homo sapiens
gtgacaaattgtaactacact

SEQ ID NO: 3960292 - DNA, 14 bp, Homo sapiens
gtgacaagtggagg

SEQ ID NO: 3960293 - DNA, 19 bp, Homo sapiens
gtgacaagtggagggggtg

SEQ ID NO: 3960294 - DNA, 11 bp, Homo sapiens
gtgacacacag

SEQ ID NO: 3960295 - DNA, 15 bp, Homo sapiens
gtgacaggaaagccc

SEQ ID NO: 3960296 - DNA, 18 bp, Homo sapiens
gtgacaggaaagccctcc

SEQ ID NO: 3960297 - DNA, 19 bp, Homo sapiens
gtgacaggaaagccctccc

SEQ ID NO: 3960298 - DNA, 18 bp, Homo sapiens
gtgaccacacgctgtctc

SEQ ID NO: 3960299 - DNA, 23 bp, Homo sapiens
gtgacccggcaccccctgcagct

SEQ ID NO: 3960300 - DNA, 21 bp, Homo sapiens
gtgaccctctgaatggtccag

SEQ ID NO: 3960301 - DNA, 14 bp, Homo sapiens
gtgacctgctgagc

SEQ ID NO: 3960302 - DNA, 15 bp, Homo sapiens
gtgacctgctgagct

SEQ ID NO: 3960303 - DNA, 18 bp, Homo sapiens
gtgacctgctgagctctg

SEQ ID NO: 3960304 - DNA, 19 bp, Homo sapiens
gtgacctgctgagctctga

SEQ ID NO: 3960305 - DNA, 20 bp, Homo sapiens
gtgacctgctgagctctgag

SEQ ID NO: 3960306 - DNA, 18 bp, Homo sapiens
gtgacgggagcctcctct

SEQ ID NO: 3960307 - DNA, 19 bp, Homo sapiens
gtgacgggagcctcctctg

SEQ ID NO: 3960308 - DNA, 19 bp, Homo sapiens
gtgacggtcccacactggt

SEQ ID NO: 3960309 - DNA, 22 bp, Homo sapiens
gtgacggtcccacactggtgac

SEQ ID NO: 3960310 - DNA, 15 bp, Homo sapiens
gtgactcacccaagc

SEQ ID NO: 3960311 - DNA, 21 bp, Homo sapiens
gtgactgaaggggcacaccac

SEQ ID NO: 3960312 - DNA, 16 bp, Homo sapiens
gtgactgccaaggtgt

SEQ ID NO: 3960313 - DNA, 23 bp, Homo sapiens
gtgactgccccaactcctggaag

SEQ ID NO: 3960314 - DNA, 12 bp, Homo sapiens
gtgactggcagg

SEQ ID NO: 3960315 - DNA, 15 bp, Homo sapiens
gtgactggcaggtgc

SEQ ID NO: 3960316 - DNA, 21 bp, Homo sapiens
gtgactgtcaagtacaagcaa

SEQ ID NO: 3960317 - DNA, 13 bp, Homo sapiens
gtgactgtcccac

SEQ ID NO: 3960318 - DNA, 21 bp, Homo sapiens
gtgactgtcccaccgggagcc

SEQ ID NO: 3960319 - DNA, 23 bp, Homo sapiens
gtgactgtcgtgtttacaaaagg

SEQ ID NO: 3960320 - DNA, 21 bp, Homo sapiens
gtgacttcctcgcctctccca

SEQ ID NO: 3960321 - DNA, 15 bp, Homo sapiens
gtgacttcctggtga

SEQ ID NO: 3960322 - DNA, 19 bp, Homo sapiens
gtgagaatcctgcctctcc

SEQ ID NO: 3960323 - DNA, 23 bp, Homo sapiens
gtgagagggcatgcgcacaaggc

SEQ ID NO: 3960324 - DNA, 16 bp, Homo sapiens
gtgagatcttacaggt

SEQ ID NO: 3960325 - DNA, 17 bp, Homo sapiens
gtgagcagaggagtcca

SEQ ID NO: 3960326 - DNA, 24 bp, Homo sapiens
gtgagccatgatcgagccactgca

SEQ ID NO: 3960327 - DNA, 18 bp, Homo sapiens
gtgagccgcatcttctcc

SEQ ID NO: 3960328 - DNA, 18 bp, Homo sapiens
gtgaggaaagcacacagt

SEQ ID NO: 3960329 - DNA, 17 bp, Homo sapiens
gtgaggcaggggcggag

SEQ ID NO: 3960330 - DNA, 14 bp, Homo sapiens
gtgaggcccagcct

SEQ ID NO: 3960331 - DNA, 16 bp, Homo sapiens
gtgaggcccagcctgt

SEQ ID NO: 3960332 - DNA, 20 bp, Homo sapiens
gtgaggccgggcgcagtggc

SEQ ID NO: 3960333 - DNA, 16 bp, Homo sapiens
gtgaggcctggccagg

SEQ ID NO: 3960334 - DNA, 18 bp, Homo sapiens
gtgaggcttccaggctct

SEQ ID NO: 3960335 - DNA, 13 bp, Homo sapiens
gtgagggctgggc

SEQ ID NO: 3960336 - DNA, 14 bp, Homo sapiens
gtgaggggaaggcc

SEQ ID NO: 3960337 - DNA, 20 bp, Homo sapiens
gtgaggtgggttttcttccc

SEQ ID NO: 3960338 - DNA, 17 bp, Homo sapiens
gtgagtgaatggcaaag

SEQ ID NO: 3960339 - DNA, 14 bp, Homo sapiens
gtgagtggcagcca

SEQ ID NO: 3960340 - DNA, 15 bp, Homo sapiens
gtgagtggcagccat

SEQ ID NO: 3960341 - DNA, 16 bp, Homo sapiens
gtgatacgtacagcca

SEQ ID NO: 3960342 - DNA, 14 bp, Homo sapiens
gtgatatatgtatt

SEQ ID NO: 3960343 - DNA, 21 bp, Homo sapiens
gtgatatcacctctcttcagc

SEQ ID NO: 3960344 - DNA, 15 bp, Homo sapiens
gtgatcaactgttca

SEQ ID NO: 3960345 - DNA, 20 bp, Homo sapiens
gtgatcagaaggctggggcc

SEQ ID NO: 3960346 - DNA, 23 bp, Homo sapiens
gtgatcagaaggctggggccagt

SEQ ID NO: 3960347 - DNA, 17 bp, Homo sapiens
gtgatccacccacctca

SEQ ID NO: 3960348 - DNA, 18 bp, Homo sapiens
gtgatccacccacctcag

SEQ ID NO: 3960349 - DNA, 14 bp, Homo sapiens
gtgatccttttatg

SEQ ID NO: 3960350 - DNA, 15 bp, Homo sapiens
gtgatctgctggcct

SEQ ID NO: 3960351 - DNA, 19 bp, Homo sapiens
gtgatctgtcccctctccc

SEQ ID NO: 3960352 - DNA, 14 bp, Homo sapiens
gtgatgaactttct

SEQ ID NO: 3960353 - DNA, 17 bp, Homo sapiens
gtgatgagggcagcagc

SEQ ID NO: 3960354 - DNA, 23 bp, Homo sapiens
gtgatgagggcagcagccagccc

SEQ ID NO: 3960355 - DNA, 16 bp, Homo sapiens
gtgatgctcaggcttg

SEQ ID NO: 3960356 - DNA, 23 bp, Homo sapiens
gtgatggagtgtgcgtgtgtgca

SEQ ID NO: 3960357 - DNA, 17 bp, Homo sapiens
ggtgcaagagacagagc

SEQ ID NO: 3960358 - DNA, 18 bp, Homo sapiens
ggtgcaagagacagagcc

SEQ ID NO: 3960359 - DNA, 17 bp, Homo sapiens
ggtgcactggccccacc

SEQ ID NO: 3960360 - DNA, 16 bp, Homo sapiens
ggtgcagagctgaaga

SEQ ID NO: 3960361 - DNA, 22 bp, Homo sapiens
ggtgcagaggtgagcagaggag

SEQ ID NO: 3960362 - DNA, 18 bp, Homo sapiens
ggtgcagttttccaggaa

SEQ ID NO: 3960363 - DNA, 22 bp, Homo sapiens
ggtgcatggcttggggagcaga

SEQ ID NO: 3960364 - DNA, 17 bp, Homo sapiens
ggtgccaccaataaaaa

SEQ ID NO: 3960365 - DNA, 13 bp, Homo sapiens
ggtgccactccct

SEQ ID NO: 3960366 - DNA, 17 bp, Homo sapiens
ggtgccactccctgagc

SEQ ID NO: 3960367 - DNA, 18 bp, Homo sapiens
ggtgccactccctgagct

SEQ ID NO: 3960368 - DNA, 22 bp, Homo sapiens
ggtgccacttcttaaaggcctg

SEQ ID NO: 3960369 - DNA, 15 bp, Homo sapiens
ggtgccagttatggc

SEQ ID NO: 3960370 - DNA, 15 bp, Homo sapiens
ggtgccatgtggagt

SEQ ID NO: 3960371 - DNA, 20 bp, Homo sapiens
ggtgcctatttattggggat

SEQ ID NO: 3960372 - DNA, 20 bp, Homo sapiens
ggtgcctcagagcaggctca

SEQ ID NO: 3960373 - DNA, 15 bp, Homo sapiens
ggtgcctgagctggg

SEQ ID NO: 3960374 - DNA, 21 bp, Homo sapiens
ggtgcctgtgaggcaggggcg

SEQ ID NO: 3960375 - DNA, 23 bp, Homo sapiens
ggtgccttcttattctcactcca

SEQ ID NO: 3960376 - DNA, 13 bp, Homo sapiens
ggtgcggcaggag

SEQ ID NO: 3960377 - DNA, 13 bp, Homo sapiens
ggtgcgtggctgt

SEQ ID NO: 3960378 - DNA, 19 bp, Homo sapiens
ggtgctacaaaaacacagc

SEQ ID NO: 3960379 - DNA, 23 bp, Homo sapiens
ggtgctacaaaaacacagcaagg

SEQ ID NO: 3960380 - DNA, 22 bp, Homo sapiens
ggtgctcacgactcttcctgca

SEQ ID NO: 3960381 - DNA, 10 bp, Homo sapiens
ggtgctctgg

SEQ ID NO: 3960382 - DNA, 12 bp, Homo sapiens
ggtgctgagctt

SEQ ID NO: 3960383 - DNA, 14 bp, Homo sapiens
ggtgctgcaaggaa

SEQ ID NO: 3960384 - DNA, 20 bp, Homo sapiens
ggtgctgcaaggaagggtgg

SEQ ID NO: 3960385 - DNA, 12 bp, Homo sapiens
ggtgctggagga

SEQ ID NO: 3960386 - DNA, 13 bp, Homo sapiens
ggtgctggaggat

SEQ ID NO: 3960387 - DNA, 16 bp, Homo sapiens
ggtgctgtggccaggg

SEQ ID NO: 3960388 - DNA, 19 bp, Homo sapiens
ggtggaagccctccttcca

SEQ ID NO: 3960389 - DNA, 19 bp, Homo sapiens
ggtggaaggcccgaggggc

SEQ ID NO: 3960390 - DNA, 17 bp, Homo sapiens
ggtggactgcgctggac

SEQ ID NO: 3960391 - DNA, 20 bp, Homo sapiens
ggtggaggttgcagtgagcc

SEQ ID NO: 3960392 - DNA, 21 bp, Homo sapiens
ggtggaggttgcagtgagcca

SEQ ID NO: 3960393 - DNA, 20 bp, Homo sapiens
ggtggaggttgcagtgagct

SEQ ID NO: 3960394 - DNA, 17 bp, Homo sapiens
ggtggatcacagaggct

SEQ ID NO: 3960395 - DNA, 19 bp, Homo sapiens
ggtggcaagggggcggggc

SEQ ID NO: 3960396 - DNA, 20 bp, Homo sapiens
ggtggcaagggggcggggcg

SEQ ID NO: 3960397 - DNA, 12 bp, Homo sapiens
ggtggcaccaga

SEQ ID NO: 3960398 - DNA, 16 bp, Homo sapiens
ggtggcagagtgagac

SEQ ID NO: 3960399 - DNA, 17 bp, Homo sapiens
ggtggcaggaccaggac

SEQ ID NO: 3960400 - DNA, 23 bp, Homo sapiens
ggtggcaggcacacagcagcccc

SEQ ID NO: 3960401 - DNA, 23 bp, Homo sapiens
ggtggccaatccaggtgggagag

SEQ ID NO: 3960402 - DNA, 16 bp, Homo sapiens
ggtggccatccctggg

SEQ ID NO: 3960403 - DNA, 21 bp, Homo sapiens
ggtggccatccctgggcccct

SEQ ID NO: 3960404 - DNA, 17 bp, Homo sapiens
ggtggccccctgtgcca

SEQ ID NO: 3960405 - DNA, 18 bp, Homo sapiens
ggtggccccctgtgccag

SEQ ID NO: 3960406 - DNA, 22 bp, Homo sapiens
ggtggccccctgtgccagctca

SEQ ID NO: 3960407 - DNA, 18 bp, Homo sapiens
ggtggctactctgtgcca

SEQ ID NO: 3960408 - DNA, 15 bp, Homo sapiens
ggtggctagtcagag

SEQ ID NO: 3960409 - DNA, 16 bp, Homo sapiens
ggtggctagtcagaga

SEQ ID NO: 3960410 - DNA, 19 bp, Homo sapiens
ggtggctgacccagtccct

SEQ ID NO: 3960411 - DNA, 22 bp, Homo sapiens
ggtggctgacccagtccctggg

SEQ ID NO: 3960412 - DNA, 13 bp, Homo sapiens
ggtggctgagctt

SEQ ID NO: 3960413 - DNA, 22 bp, Homo sapiens
ggtgggaaatggtatgagctga

SEQ ID NO: 3960414 - DNA, 15 bp, Homo sapiens
ggtgggaagaaagaa

SEQ ID NO: 3960415 - DNA, 17 bp, Homo sapiens
ggtgggaagcttgctgg

SEQ ID NO: 3960416 - DNA, 14 bp, Homo sapiens
ggtgggacagcccc

SEQ ID NO: 3960417 - DNA, 21 bp, Homo sapiens
ggtgggacagccccagggccc

SEQ ID NO: 3960418 - DNA, 18 bp, Homo sapiens
ggtgggcagctgggcccc

SEQ ID NO: 3960419 - DNA, 12 bp, Homo sapiens
ggtgggccactc

SEQ ID NO: 3960420 - DNA, 15 bp, Homo sapiens
ggtgggccactctcc

SEQ ID NO: 3960421 - DNA, 12 bp, Homo sapiens
ggtgggcctggc

SEQ ID NO: 3960422 - DNA, 15 bp, Homo sapiens
ggtgggcctggcctg

SEQ ID NO: 3960423 - DNA, 18 bp, Homo sapiens
ggtgggcctggcctgagc

SEQ ID NO: 3960424 - DNA, 19 bp, Homo sapiens
ggtgggcctggcctgagct

SEQ ID NO: 3960425 - DNA, 12 bp, Homo sapiens
ggtggggcagga

SEQ ID NO: 3960426 - DNA, 18 bp, Homo sapiens
ggtggggctgctcctcca

SEQ ID NO: 3960427 - DNA, 22 bp, Homo sapiens
ggtggggctgctcctccagggc

SEQ ID NO: 3960428 - DNA, 19 bp, Homo sapiens
ggtgggggagaggggagac

SEQ ID NO: 3960429 - DNA, 20 bp, Homo sapiens
ggtggggggatcacaaggtc

SEQ ID NO: 3960430 - DNA, 16 bp, Homo sapiens
ggtgggttttcttccc

SEQ ID NO: 3960431 - DNA, 12 bp, Homo sapiens
ggtggtggagga

SEQ ID NO: 3960432 - DNA, 17 bp, Homo sapiens
ggtgtaatgcacaattt

SEQ ID NO: 3960433 - DNA, 23 bp, Homo sapiens
ggtgtagctcctctgctgctccc

SEQ ID NO: 3960434 - DNA, 10 bp, Homo sapiens
ggtgtcagct

SEQ ID NO: 3960435 - DNA, 12 bp, Homo sapiens
ggtgtcaggcag

SEQ ID NO: 3960436 - DNA, 12 bp, Homo sapiens
ggtgtccctgcg

SEQ ID NO: 3960437 - DNA, 10 bp, Homo sapiens
ggtgtctttt

SEQ ID NO: 3960438 - DNA, 14 bp, Homo sapiens
ggtgtgaggctggg

SEQ ID NO: 3960439 - DNA, 14 bp, Homo sapiens
ggtgtgcctgccct

SEQ ID NO: 3960440 - DNA, 13 bp, Homo sapiens
ggtgtggcctcag

SEQ ID NO: 3960441 - DNA, 14 bp, Homo sapiens
ggtgtggcctcagc

SEQ ID NO: 3960442 - DNA, 15 bp, Homo sapiens
ggtgtggtggctcat

SEQ ID NO: 3960443 - DNA, 22 bp, Homo sapiens
gtcagccttgcatcaagggctt

SEQ ID NO: 3960444 - DNA, 21 bp, Homo sapiens
gtcagctcacaccctaataag

SEQ ID NO: 3960445 - DNA, 19 bp, Homo sapiens
gtcagctttcagagccagt

SEQ ID NO: 3960446 - DNA, 15 bp, Homo sapiens
gtcaggacccaggcc

SEQ ID NO: 3960447 - DNA, 23 bp, Homo sapiens
gtcaggacccaggccgcctgcca

SEQ ID NO: 3960448 - DNA, 15 bp, Homo sapiens
gtcaggacctccggg

SEQ ID NO: 3960449 - DNA, 22 bp, Homo sapiens
gtcaggagttcaagaccagcct

SEQ ID NO: 3960450 - DNA, 13 bp, Homo sapiens
gtcaggcctgtgt

SEQ ID NO: 3960451 - DNA, 15 bp, Homo sapiens
gtcaggcctgtgtgt

SEQ ID NO: 3960452 - DNA, 23 bp, Homo sapiens
gtcaggcctgtgtgtgaaaggaa

SEQ ID NO: 3960453 - DNA, 17 bp, Homo sapiens
gtcaggctccattagga

SEQ ID NO: 3960454 - DNA, 16 bp, Homo sapiens
gtcagtgtggagaggg

SEQ ID NO: 3960455 - DNA, 23 bp, Homo sapiens
gtcagttgtacgtaatgtattta

SEQ ID NO: 3960456 - DNA, 13 bp, Homo sapiens
gtcatagaaatta

SEQ ID NO: 3960457 - DNA, 14 bp, Homo sapiens
gtcatatattcatg

SEQ ID NO: 3960458 - DNA, 15 bp, Homo sapiens
gtcatatattcatgt

SEQ ID NO: 3960459 - DNA, 20 bp, Homo sapiens
gtcatatattcatgtaataa

SEQ ID NO: 3960460 - DNA, 22 bp, Homo sapiens
gtcatatattcatgtaataaat

SEQ ID NO: 3960461 - DNA, 19 bp, Homo sapiens
gtcatcactccctggatgt

SEQ ID NO: 3960462 - DNA, 21 bp, Homo sapiens
gtcatcattgtatatatgtgt

SEQ ID NO: 3960463 - DNA, 21 bp, Homo sapiens
gtcatcccctacactttggcc

SEQ ID NO: 3960464 - DNA, 19 bp, Homo sapiens
gtcatcggaggctgggccc

SEQ ID NO: 3960465 - DNA, 14 bp, Homo sapiens
gtcatctctctggg

SEQ ID NO: 3960466 - DNA, 14 bp, Homo sapiens
gtcatgatctccct

SEQ ID NO: 3960467 - DNA, 18 bp, Homo sapiens
gtcatgatctccctgccg

SEQ ID NO: 3960468 - DNA, 14 bp, Homo sapiens
gtcatggaaaagcc

SEQ ID NO: 3960469 - DNA, 20 bp, Homo sapiens
gtcatggaaaatgtcctgtg

SEQ ID NO: 3960470 - DNA, 14 bp, Homo sapiens
gtcatggacagata

SEQ ID NO: 3960471 - DNA, 19 bp, Homo sapiens
gtcatgtgtgcatgtgagc

SEQ ID NO: 3960472 - DNA, 20 bp, Homo sapiens
gtcatgtgtgcatgtgagca

SEQ ID NO: 3960473 - DNA, 23 bp, Homo sapiens
gtcatgttggtcaaaagctggat

SEQ ID NO: 3960474 - DNA, 15 bp, Homo sapiens
gtcattactaaccat

SEQ ID NO: 3960475 - DNA, 19 bp, Homo sapiens
gggctctccacctcagcct

SEQ ID NO: 3960476 - DNA, 13 bp, Homo sapiens
gggctctcctggc

SEQ ID NO: 3960477 - DNA, 11 bp, Homo sapiens
gggctctgagg

SEQ ID NO: 3960478 - DNA, 15 bp, Homo sapiens
gggctctgaggcgcc

SEQ ID NO: 3960479 - DNA, 13 bp, Homo sapiens
gggctctggccac

SEQ ID NO: 3960480 - DNA, 15 bp, Homo sapiens
gggctctggccaccc

SEQ ID NO: 3960481 - DNA, 18 bp, Homo sapiens
gggctgaacggggagaaa

SEQ ID NO: 3960482 - DNA, 15 bp, Homo sapiens
gggctgccctggtgc

SEQ ID NO: 3960483 - DNA, 22 bp, Homo sapiens
gggctgctcatcacccagtcct

SEQ ID NO: 3960484 - DNA, 23 bp, Homo sapiens
gggctgctcatcacccagtcctg

SEQ ID NO: 3960485 - DNA, 11 bp, Homo sapiens
gggctgctggg

SEQ ID NO: 3960486 - DNA, 12 bp, Homo sapiens
gggctgctgtga

SEQ ID NO: 3960487 - DNA, 18 bp, Homo sapiens
gggctggaatctggagag

SEQ ID NO: 3960488 - DNA, 20 bp, Homo sapiens
gggctggactctggcaccca

SEQ ID NO: 3960489 - DNA, 11 bp, Homo sapiens
gggctggccca

SEQ ID NO: 3960490 - DNA, 16 bp, Homo sapiens
gggctggcccagccaa

SEQ ID NO: 3960491 - DNA, 13 bp, Homo sapiens
gggctgggaagtc

SEQ ID NO: 3960492 - DNA, 13 bp, Homo sapiens
gggctgggcccac

SEQ ID NO: 3960493 - DNA, 15 bp, Homo sapiens
gggctggtccttctc

SEQ ID NO: 3960494 - DNA, 18 bp, Homo sapiens
gggcttcgcttccttagc

SEQ ID NO: 3960495 - DNA, 13 bp, Homo sapiens
gggcttctcctga

SEQ ID NO: 3960496 - DNA, 16 bp, Homo sapiens
gggcttgcaagaggag

SEQ ID NO: 3960497 - DNA, 16 bp, Homo sapiens
gggctttgcaggctct

SEQ ID NO: 3960498 - DNA, 17 bp, Homo sapiens
gggctttgcaggctctg

SEQ ID NO: 3960499 - DNA, 19 bp, Homo sapiens
gggctttgcaggctctggg

SEQ ID NO: 3960500 - DNA, 13 bp, Homo sapiens
ggggaagccctgg

SEQ ID NO: 3960501 - DNA, 13 bp, Homo sapiens
ggggaagggccag

SEQ ID NO: 3960502 - DNA, 19 bp, Homo sapiens
ggggaagtgctccccacac

SEQ ID NO: 3960503 - DNA, 23 bp, Homo sapiens
ggggaagtgctccccacacgtgc

SEQ ID NO: 3960504 - DNA, 11 bp, Homo sapiens
ggggacttgtg

SEQ ID NO: 3960505 - DNA, 15 bp, Homo sapiens
ggggacttgtgccag

SEQ ID NO: 3960506 - DNA, 19 bp, Homo sapiens
ggggagaacttacattgtg

SEQ ID NO: 3960507 - DNA, 15 bp, Homo sapiens
ggggagaagggccag

SEQ ID NO: 3960508 - DNA, 19 bp, Homo sapiens
ggggagcacttgcgtcctg

SEQ ID NO: 3960509 - DNA, 11 bp, Homo sapiens
ggggagcagag

SEQ ID NO: 3960510 - DNA, 20 bp, Homo sapiens
ggggaggaagggccaggaga

SEQ ID NO: 3960511 - DNA, 12 bp, Homo sapiens
ggggagggggac

SEQ ID NO: 3960512 - DNA, 23 bp, Homo sapiens
ggggatctgcattccccgctgcc

SEQ ID NO: 3960513 - DNA, 21 bp, Homo sapiens
ggggatgactagaggcaggga

SEQ ID NO: 3960514 - DNA, 14 bp, Homo sapiens
ggggcaagcctgta

SEQ ID NO: 3960515 - DNA, 15 bp, Homo sapiens
ggggcacaccactgc

SEQ ID NO: 3960516 - DNA, 18 bp, Homo sapiens
ggggcacaccactgccct

SEQ ID NO: 3960517 - DNA, 19 bp, Homo sapiens
ggggcacaccactgccctg

SEQ ID NO: 3960518 - DNA, 22 bp, Homo sapiens
ggggcacaccactgccctgcct

SEQ ID NO: 3960519 - DNA, 13 bp, Homo sapiens
ggggcacctggga

SEQ ID NO: 3960520 - DNA, 17 bp, Homo sapiens
ggggcactgcaggggcc

SEQ ID NO: 3960521 - DNA, 16 bp, Homo sapiens
ggggcagagggcagag

SEQ ID NO: 3960522 - DNA, 22 bp, Homo sapiens
ggggcagagggcagaggctgga

SEQ ID NO: 3960523 - DNA, 21 bp, Homo sapiens
ggggcaggagtagctgagctc

SEQ ID NO: 3960524 - DNA, 21 bp, Homo sapiens
ggggcaggggagtgccaaggt

SEQ ID NO: 3960525 - DNA, 18 bp, Homo sapiens
ggggcagtgactggcagg

SEQ ID NO: 3960526 - DNA, 18 bp, Homo sapiens
ggggcatggttccttccc

SEQ ID NO: 3960527 - DNA, 21 bp, Homo sapiens
ggggcatggttccttccctgg

SEQ ID NO: 3960528 - DNA, 12 bp, Homo sapiens
ggggccagctgg

SEQ ID NO: 3960529 - DNA, 17 bp, Homo sapiens
ggggccccagatctgcc

SEQ ID NO: 3960530 - DNA, 18 bp, Homo sapiens
ggggccccagatctgcct

SEQ ID NO: 3960531 - DNA, 21 bp, Homo sapiens
ggggccccagatctgcctggg

SEQ ID NO: 3960532 - DNA, 14 bp, Homo sapiens
ggggccccagggct

SEQ ID NO: 3960533 - DNA, 13 bp, Homo sapiens
ggggccctgggcc

SEQ ID NO: 3960534 - DNA, 20 bp, Homo sapiens
gtgatggcgcgggaggcacc

SEQ ID NO: 3960535 - DNA, 21 bp, Homo sapiens
gtgatgtcttcaataaattaa

SEQ ID NO: 3960536 - DNA, 13 bp, Homo sapiens
gtgatgtgctgga

SEQ ID NO: 3960537 - DNA, 23 bp, Homo sapiens
gtgatgttgtttgggagagtgca

SEQ ID NO: 3960538 - DNA, 24 bp, Homo sapiens
gtgatgttgtttgggagagtgcag

SEQ ID NO: 3960539 - DNA, 16 bp, Homo sapiens
gtgatgtttttatgat

SEQ ID NO: 3960540 - DNA, 19 bp, Homo sapiens
gtgattatttgttatttgt

SEQ ID NO: 3960541 - DNA, 23 bp, Homo sapiens
gtgattccttttgatggggagaa

SEQ ID NO: 3960542 - DNA, 13 bp, Homo sapiens
gtgattgtgtctg

SEQ ID NO: 3960543 - DNA, 18 bp, Homo sapiens
gtgatttagaactgtatg

SEQ ID NO: 3960544 - DNA, 12 bp, Homo sapiens
gtgcaagagaca

SEQ ID NO: 3960545 - DNA, 18 bp, Homo sapiens
gtgcaagagacagagccc

SEQ ID NO: 3960546 - DNA, 21 bp, Homo sapiens
gtgcaaggggctcagcaaggt

SEQ ID NO: 3960547 - DNA, 23 bp, Homo sapiens
gtgcaatttcccctctgtgtcct

SEQ ID NO: 3960548 - DNA, 11 bp, Homo sapiens
gtgcacacaga

SEQ ID NO: 3960549 - DNA, 22 bp, Homo sapiens
gtgcacacagaaatatatatac

SEQ ID NO: 3960550 - DNA, 21 bp, Homo sapiens
gtgcacagcgcgggcggaggc

SEQ ID NO: 3960551 - DNA, 12 bp, Homo sapiens
gtgcacaggagg

SEQ ID NO: 3960552 - DNA, 20 bp, Homo sapiens
gtgcacatatgggtgctggc

SEQ ID NO: 3960553 - DNA, 16 bp, Homo sapiens
gtgcacatgtgtctgt

SEQ ID NO: 3960554 - DNA, 18 bp, Homo sapiens
gtgcaccaccatgccagg

SEQ ID NO: 3960555 - DNA, 22 bp, Homo sapiens
gtgcacccactcaccagggtcc

SEQ ID NO: 3960556 - DNA, 17 bp, Homo sapiens
gtgcactccctaagaaa

SEQ ID NO: 3960557 - DNA, 18 bp, Homo sapiens
gtgcactggccccaccct

SEQ ID NO: 3960558 - DNA, 15 bp, Homo sapiens
gtgcagatgggctgt

SEQ ID NO: 3960559 - DNA, 13 bp, Homo sapiens
gtgcagcccttcc

SEQ ID NO: 3960560 - DNA, 18 bp, Homo sapiens
gtgcagcccttcctcctg

SEQ ID NO: 3960561 - DNA, 15 bp, Homo sapiens
gtgcagcttctgtcc

SEQ ID NO: 3960562 - DNA, 15 bp, Homo sapiens
gtgcagtacaggcaa

SEQ ID NO: 3960563 - DNA, 17 bp, Homo sapiens
gtgcagtcccgtggagg

SEQ ID NO: 3960564 - DNA, 19 bp, Homo sapiens
gtgcatccacgcacacatg

SEQ ID NO: 3960565 - DNA, 15 bp, Homo sapiens
gtgcatctcagccca

SEQ ID NO: 3960566 - DNA, 18 bp, Homo sapiens
gtgcatctcagcccacat

SEQ ID NO: 3960567 - DNA, 13 bp, Homo sapiens
gtgcatgctctct

SEQ ID NO: 3960568 - DNA, 15 bp, Homo sapiens
gtgcatgctctctgc

SEQ ID NO: 3960569 - DNA, 19 bp, Homo sapiens
gtgcatgctctctgcagcc

SEQ ID NO: 3960570 - DNA, 18 bp, Homo sapiens
gtgcatttgagagaagcc

SEQ ID NO: 3960571 - DNA, 22 bp, Homo sapiens
gtgccaaactaccgttcccaaa

SEQ ID NO: 3960572 - DNA, 23 bp, Homo sapiens
gtgccaacctgatgccccttccc

SEQ ID NO: 3960573 - DNA, 19 bp, Homo sapiens
gtgccaagtccaggtcctg

SEQ ID NO: 3960574 - DNA, 13 bp, Homo sapiens
gtgccacagagaa

SEQ ID NO: 3960575 - DNA, 21 bp, Homo sapiens
gtgccaccaataaaaatccta

SEQ ID NO: 3960576 - DNA, 13 bp, Homo sapiens
gtgccactccctg

SEQ ID NO: 3960577 - DNA, 18 bp, Homo sapiens
gtgccactccctgagctt

SEQ ID NO: 3960578 - DNA, 12 bp, Homo sapiens
gtgccagagcct

SEQ ID NO: 3960579 - DNA, 11 bp, Homo sapiens
gtgccagaggt

SEQ ID NO: 3960580 - DNA, 22 bp, Homo sapiens
gtgccagccgtgatgctcaggc

SEQ ID NO: 3960581 - DNA, 11 bp, Homo sapiens
gtgccagctca

SEQ ID NO: 3960582 - DNA, 17 bp, Homo sapiens
gtgccaggactccccag

SEQ ID NO: 3960583 - DNA, 18 bp, Homo sapiens
gtgccaggactccccagg

SEQ ID NO: 3960584 - DNA, 13 bp, Homo sapiens
gtgccaggcccgg

SEQ ID NO: 3960585 - DNA, 16 bp, Homo sapiens
gtgccagggcagcact

SEQ ID NO: 3960586 - DNA, 20 bp, Homo sapiens
gtgccagggcaggctacccc

SEQ ID NO: 3960587 - DNA, 23 bp, Homo sapiens
gtgccatagagtttaacacaagt

SEQ ID NO: 3960588 - DNA, 15 bp, Homo sapiens
gtgccatgtggagtg

SEQ ID NO: 3960589 - DNA, 13 bp, Homo sapiens
gtgccattcccag

SEQ ID NO: 3960590 - DNA, 14 bp, Homo sapiens
gtgccattcccagc

SEQ ID NO: 3960591 - DNA, 13 bp, Homo sapiens
gtgcccaggagaa

SEQ ID NO: 3960592 - DNA, 16 bp, Homo sapiens
gtgcccatgcaatggc

SEQ ID NO: 3960593 - DNA, 13 bp, Homo sapiens
gtgccccatgtcc

SEQ ID NO: 3960594 - DNA, 14 bp, Homo sapiens
gtgcccccatcttt

SEQ ID NO: 3960595 - DNA, 17 bp, Homo sapiens
gtgccccgcctccccga

SEQ ID NO: 3960596 - DNA, 19 bp, Homo sapiens
gtgcccctcagagaggcat

SEQ ID NO: 3960597 - DNA, 19 bp, Homo sapiens
gtgccctctggatcctgct

SEQ ID NO: 3960598 - DNA, 17 bp, Homo sapiens
gtgccctgacccctgca

SEQ ID NO: 3960599 - DNA, 12 bp, Homo sapiens
gtgccctgcccc

SEQ ID NO: 3960600 - DNA, 22 bp, Homo sapiens
gtgccctgcccccatctcccca

SEQ ID NO: 3960601 - DNA, 17 bp, Homo sapiens
gtgccgggagaggactc

SEQ ID NO: 3960602 - DNA, 20 bp, Homo sapiens
gtgccgggagaggactctgc

SEQ ID NO: 3960603 - DNA, 19 bp, Homo sapiens
gtgcctagttcctgtggcc

SEQ ID NO: 3960604 - DNA, 13 bp, Homo sapiens
gtgcctcctggcc

SEQ ID NO: 3960605 - DNA, 15 bp, Homo sapiens
gtgcctcgaggcacc

SEQ ID NO: 3960606 - DNA, 15 bp, Homo sapiens
gtgcctcgctcccca

SEQ ID NO: 3960607 - DNA, 19 bp, Homo sapiens
gtgcctcgctccccactct

SEQ ID NO: 3960608 - DNA, 15 bp, Homo sapiens
gtgcctcttgttgca

SEQ ID NO: 3960609 - DNA, 19 bp, Homo sapiens
gtgcctgctagagcaaccc

SEQ ID NO: 3960610 - DNA, 23 bp, Homo sapiens
gtgcctgggtggggctgctcctc

SEQ ID NO: 3960611 - DNA, 15 bp, Homo sapiens
gtgcctgtgaggcag

SEQ ID NO: 3960612 - DNA, 16 bp, Homo sapiens
gtgcctgtgaggcagg

SEQ ID NO: 3960613 - DNA, 12 bp, Homo sapiens
gtgcctgtggca

SEQ ID NO: 3960614 - DNA, 13 bp, Homo sapiens
gtgcctgtggggg

SEQ ID NO: 3960615 - DNA, 18 bp, Homo sapiens
gtgccttacctcctgccc

SEQ ID NO: 3960616 - DNA, 19 bp, Homo sapiens
gtgccttacctcctgccca

SEQ ID NO: 3960617 - DNA, 19 bp, Homo sapiens
gtgccttacttaagtcggg

SEQ ID NO: 3960618 - DNA, 20 bp, Homo sapiens
gtgccttcgcggtggaaggc

SEQ ID NO: 3960619 - DNA, 23 bp, Homo sapiens
gtgccttcttattctcactccac

SEQ ID NO: 3960620 - DNA, 21 bp, Homo sapiens
gtgcctttctctggctccaga

SEQ ID NO: 3960621 - DNA, 18 bp, Homo sapiens
gtgccttttatagctatt

SEQ ID NO: 3960622 - DNA, 15 bp, Homo sapiens
gtgcgacttcacaaa

SEQ ID NO: 3960623 - DNA, 13 bp, Homo sapiens
gtgcggcaggagc

SEQ ID NO: 3960624 - DNA, 16 bp, Homo sapiens
gtgcgtgcgtgtgtgt

SEQ ID NO: 3960625 - DNA, 13 bp, Homo sapiens
gtgcgtggctgtg

SEQ ID NO: 3960626 - DNA, 13 bp, Homo sapiens
gtgctaactgtat

SEQ ID NO: 3960627 - DNA, 21 bp, Homo sapiens
gtgctataggctggagaagct

SEQ ID NO: 3960628 - DNA, 13 bp, Homo sapiens
gtgctatatatat

SEQ ID NO: 3960629 - DNA, 14 bp, Homo sapiens
gtgctattctgtgt

SEQ ID NO: 3960630 - DNA, 15 bp, Homo sapiens
gtgctattctgtgtt

SEQ ID NO: 3960631 - DNA, 20 bp, Homo sapiens
gtgctcacgctcccccgcag

SEQ ID NO: 3960632 - DNA, 13 bp, Homo sapiens
gtgctccccacac

SEQ ID NO: 3960633 - DNA, 14 bp, Homo sapiens
gtgctcgcagcctg

SEQ ID NO: 3960634 - DNA, 23 bp, Homo sapiens
gtgctctggcggcttcctgtcca

SEQ ID NO: 3960635 - DNA, 24 bp, Homo sapiens
gtgctctggcggcttcctgtccac

SEQ ID NO: 3960636 - DNA, 15 bp, Homo sapiens
gtgctgacggaagcc

SEQ ID NO: 3960637 - DNA, 18 bp, Homo sapiens
gtgctgagcttagccttg

SEQ ID NO: 3960638 - DNA, 12 bp, Homo sapiens
gtgctgaggact

SEQ ID NO: 3960639 - DNA, 21 bp, Homo sapiens
gtgctgccacacttcaggctc

SEQ ID NO: 3960640 - DNA, 17 bp, Homo sapiens
gtgctgccatgccactg

SEQ ID NO: 3960641 - DNA, 23 bp, Homo sapiens
gtgctgccatgccactgccaggc

SEQ ID NO: 3960642 - DNA, 12 bp, Homo sapiens
gtgctgccctgc

SEQ ID NO: 3960643 - DNA, 14 bp, Homo sapiens
gtgctgccctgctc

SEQ ID NO: 3960644 - DNA, 19 bp, Homo sapiens
gtgctgccctgctctgggg

SEQ ID NO: 3960645 - DNA, 21 bp, Homo sapiens
gtgctggtctattttgatttt

SEQ ID NO: 3960646 - DNA, 15 bp, Homo sapiens
gtgctgtgcctgcta

SEQ ID NO: 3960647 - DNA, 16 bp, Homo sapiens
gtgctgtgcctgctag

SEQ ID NO: 3960648 - DNA, 18 bp, Homo sapiens
gtgctgtgcctgctagag

SEQ ID NO: 3960649 - DNA, 16 bp, Homo sapiens
gtgctgtggccagggt

SEQ ID NO: 3960650 - DNA, 15 bp, Homo sapiens
gtgctgtgggcagca

SEQ ID NO: 3960651 - DNA, 20 bp, Homo sapiens
gtgctgtgggcagcaccctc

SEQ ID NO: 3960652 - DNA, 18 bp, Homo sapiens
gtgctgtttgagatgtga

SEQ ID NO: 3960653 - DNA, 18 bp, Homo sapiens
gtgcttacagtgactgtc

SEQ ID NO: 3960654 - DNA, 14 bp, Homo sapiens
gtgcttagaaagtt

SEQ ID NO: 3960655 - DNA, 15 bp, Homo sapiens
gtgctttatttatgg

SEQ ID NO: 3960656 - DNA, 14 bp, Homo sapiens
gtggaaaaaagaga

SEQ ID NO: 3960657 - DNA, 15 bp, Homo sapiens
gtggaaaaaagagaa

SEQ ID NO: 3960658 - DNA, 13 bp, Homo sapiens
gtggaagagcagc

SEQ ID NO: 3960659 - DNA, 14 bp, Homo sapiens
gtggaagagcagcc

SEQ ID NO: 3960660 - DNA, 17 bp, Homo sapiens
gtggaagagcagcctga

SEQ ID NO: 3960661 - DNA, 13 bp, Homo sapiens
gtggaagccctcc

SEQ ID NO: 3960662 - DNA, 14 bp, Homo sapiens
gtggaagccctcct

SEQ ID NO: 3960663 - DNA, 16 bp, Homo sapiens
gtggaagccctccttc

SEQ ID NO: 3960664 - DNA, 17 bp, Homo sapiens
gtggaagccctccttcc

SEQ ID NO: 3960665 - DNA, 18 bp, Homo sapiens
gtggaaggcagggacaga

SEQ ID NO: 3960666 - DNA, 11 bp, Homo sapiens
gtggacacctg

SEQ ID NO: 3960667 - DNA, 17 bp, Homo sapiens
gtggacacctgccctgc

SEQ ID NO: 3960668 - DNA, 19 bp, Homo sapiens
gtggacacctgccctgccc

SEQ ID NO: 3960669 - DNA, 16 bp, Homo sapiens
gtggacatcatgaagc

SEQ ID NO: 3960670 - DNA, 13 bp, Homo sapiens
gtggaccttcctg

SEQ ID NO: 3960671 - DNA, 23 bp, Homo sapiens
gtggagaaataaaaatacctctt

SEQ ID NO: 3960672 - DNA, 15 bp, Homo sapiens
gtggaggaggcctgg

SEQ ID NO: 3960673 - DNA, 12 bp, Homo sapiens
gtggagggtagg

SEQ ID NO: 3960674 - DNA, 14 bp, Homo sapiens
gtggagggtagggg

SEQ ID NO: 3960675 - DNA, 19 bp, Homo sapiens
gtggaggttgcagtgagct

SEQ ID NO: 3960676 - DNA, 16 bp, Homo sapiens
gtggagtctcattctg

SEQ ID NO: 3960677 - DNA, 19 bp, Homo sapiens
gtggagttgacatttgaca

SEQ ID NO: 3960678 - DNA, 18 bp, Homo sapiens
gtggatctgtccaaggaa

SEQ ID NO: 3960679 - DNA, 17 bp, Homo sapiens
gtggatgctccagggca

SEQ ID NO: 3960680 - DNA, 19 bp, Homo sapiens
gtggatgctccagggcagc

SEQ ID NO: 3960681 - DNA, 21 bp, Homo sapiens
gtggatgctccagggcagcct

SEQ ID NO: 3960682 - DNA, 17 bp, Homo sapiens
gtggatggatggacaga

SEQ ID NO: 3960683 - DNA, 18 bp, Homo sapiens
gtggatggatggacagaa

SEQ ID NO: 3960684 - DNA, 13 bp, Homo sapiens
gtggattgagggt

SEQ ID NO: 3960685 - DNA, 13 bp, Homo sapiens
gtggcaaatataa

SEQ ID NO: 3960686 - DNA, 13 bp, Homo sapiens
gtggcaagggggc

SEQ ID NO: 3960687 - DNA, 22 bp, Homo sapiens
gtggcacagacttctggaaggc

SEQ ID NO: 3960688 - DNA, 15 bp, Homo sapiens
gtggcacctcctgag

SEQ ID NO: 3960689 - DNA, 16 bp, Homo sapiens
gtggcacctcctgaga

SEQ ID NO: 3960690 - DNA, 17 bp, Homo sapiens
gtggcacctcctgagaa

SEQ ID NO: 3960691 - DNA, 18 bp, Homo sapiens
gtggcacctcctgagaag

SEQ ID NO: 3960692 - DNA, 18 bp, Homo sapiens
gtggcagaccgggggcca

SEQ ID NO: 3960693 - DNA, 17 bp, Homo sapiens
gtggcagccatgcctca

SEQ ID NO: 3960694 - DNA, 20 bp, Homo sapiens
gtggcagccatgcctcatgc

SEQ ID NO: 3960695 - DNA, 21 bp, Homo sapiens
gtggccactccagacccctgg

SEQ ID NO: 3960696 - DNA, 12 bp, Homo sapiens
gtggccagagct

SEQ ID NO: 3960697 - DNA, 16 bp, Homo sapiens
gtggccatcagggtgg

SEQ ID NO: 3960698 - DNA, 19 bp, Homo sapiens
gtggccatccctgggcccc

SEQ ID NO: 3960699 - DNA, 22 bp, Homo sapiens
gtggccatccctgggcccctcc

SEQ ID NO: 3960700 - DNA, 17 bp, Homo sapiens
gtggccccaggtgccac

SEQ ID NO: 3960701 - DNA, 17 bp, Homo sapiens
gtggccccctgtgccag

SEQ ID NO: 3960702 - DNA, 20 bp, Homo sapiens
gtggccccctgtgccagctc

SEQ ID NO: 3960703 - DNA, 21 bp, Homo sapiens
gtggcccctcacctgggcctt

SEQ ID NO: 3960704 - DNA, 18 bp, Homo sapiens
gtggccctgccctctcct

SEQ ID NO: 3960705 - DNA, 21 bp, Homo sapiens
gtggccctgccctctccttcc

SEQ ID NO: 3960706 - DNA, 23 bp, Homo sapiens
gtggccctgccctctccttcctt

SEQ ID NO: 3960707 - DNA, 22 bp, Homo sapiens
taattaaataaatcattaatac

SEQ ID NO: 3960708 - DNA, 23 bp, Homo sapiens
taattactatattttagatgcaa

SEQ ID NO: 3960709 - DNA, 22 bp, Homo sapiens
taattagaacaatagctattgc

SEQ ID NO: 3960710 - DNA, 20 bp, Homo sapiens
taattaggatctatgcaatt

SEQ ID NO: 3960711 - DNA, 13 bp, Homo sapiens
taattagtaataa

SEQ ID NO: 3960712 - DNA, 18 bp, Homo sapiens
taattattaataccaaat

SEQ ID NO: 3960713 - DNA, 15 bp, Homo sapiens
taattattccactca

SEQ ID NO: 3960714 - DNA, 17 bp, Homo sapiens
taattcataattagaac

SEQ ID NO: 3960715 - DNA, 18 bp, Homo sapiens
gtcctttaggcagcctgc

SEQ ID NO: 3960716 - DNA, 21 bp, Homo sapiens
gtcctttaggcagcctgccgc

SEQ ID NO: 3960717 - DNA, 15 bp, Homo sapiens
gtcctttgagaaaga

SEQ ID NO: 3960718 - DNA, 21 bp, Homo sapiens
gtcctttgagaaagaaataat

SEQ ID NO: 3960719 - DNA, 17 bp, Homo sapiens
gtcgaattaatagcttt

SEQ ID NO: 3960720 - DNA, 14 bp, Homo sapiens
gtcgagagggctgt

SEQ ID NO: 3960721 - DNA, 17 bp, Homo sapiens
gtcgcaggatccgctgc

SEQ ID NO: 3960722 - DNA, 21 bp, Homo sapiens
gtcgcaggatccgctgccacc

SEQ ID NO: 3960723 - DNA, 13 bp, Homo sapiens
gtcgccccaggcc

SEQ ID NO: 3960724 - DNA, 23 bp, Homo sapiens
gtcgccccaggccctccctgact

SEQ ID NO: 3960725 - DNA, 22 bp, Homo sapiens
gtcgcgcgcagcgcgtgcacag

SEQ ID NO: 3960726 - DNA, 20 bp, Homo sapiens
gtcgctctgctggcctggcc

SEQ ID NO: 3960727 - DNA, 18 bp, Homo sapiens
gtcgctggacaacccaga

SEQ ID NO: 3960728 - DNA, 19 bp, Homo sapiens
gtcgctggacaacccagaa

SEQ ID NO: 3960729 - DNA, 15 bp, Homo sapiens
gtcgctgggctgtgg

SEQ ID NO: 3960730 - DNA, 15 bp, Homo sapiens
gtcggagtagaaatt

SEQ ID NO: 3960731 - DNA, 19 bp, Homo sapiens
gtcgtggagagctaggagc

SEQ ID NO: 3960732 - DNA, 20 bp, Homo sapiens
gtcgtggagagctaggagca

SEQ ID NO: 3960733 - DNA, 15 bp, Homo sapiens
gtcgtggcagataat

SEQ ID NO: 3960734 - DNA, 16 bp, Homo sapiens
gtcgtgtttacaaaag

SEQ ID NO: 3960735 - DNA, 13 bp, Homo sapiens
gtcgttgtgaggg

SEQ ID NO: 3960736 - DNA, 19 bp, Homo sapiens
gtcgttttcataacttgct

SEQ ID NO: 3960737 - DNA, 15 bp, Homo sapiens
gtctaaagtttacag

SEQ ID NO: 3960738 - DNA, 17 bp, Homo sapiens
gtctaaagtttacagta

SEQ ID NO: 3960739 - DNA, 19 bp, Homo sapiens
gtctaatgatattttatgc

SEQ ID NO: 3960740 - DNA, 14 bp, Homo sapiens
gtctaccctgggat

SEQ ID NO: 3960741 - DNA, 22 bp, Homo sapiens
gtctaccctgggattcaggaaa

SEQ ID NO: 3960742 - DNA, 12 bp, Homo sapiens
gtctagggagag

SEQ ID NO: 3960743 - DNA, 18 bp, Homo sapiens
gtctataatggaaacatt

SEQ ID NO: 3960744 - DNA, 22 bp, Homo sapiens
gtctataatggaaacatttaca

SEQ ID NO: 3960745 - DNA, 21 bp, Homo sapiens
gtctatgacttatttccttca

SEQ ID NO: 3960746 - DNA, 14 bp, Homo sapiens
gtctattagttttc

SEQ ID NO: 3960747 - DNA, 20 bp, Homo sapiens
gtctcaagagggcactggtg

SEQ ID NO: 3960748 - DNA, 20 bp, Homo sapiens
gtctcaagcactaaaaagtg

SEQ ID NO: 3960749 - DNA, 21 bp, Homo sapiens
gtctcactatgttgcccaggc

SEQ ID NO: 3960750 - DNA, 13 bp, Homo sapiens
gtctcactcctga

SEQ ID NO: 3960751 - DNA, 15 bp, Homo sapiens
gtctcagcctcctca

SEQ ID NO: 3960752 - DNA, 16 bp, Homo sapiens
gtctcaggtccctgca

SEQ ID NO: 3960753 - DNA, 20 bp, Homo sapiens
gtctcagtccagatgccttc

SEQ ID NO: 3960754 - DNA, 23 bp, Homo sapiens
gtctcagtccagatgccttcctg

SEQ ID NO: 3960755 - DNA, 12 bp, Homo sapiens
gtctcccattct

SEQ ID NO: 3960756 - DNA, 15 bp, Homo sapiens
gtctcccattctcat

SEQ ID NO: 3960757 - DNA, 14 bp, Homo sapiens
taacaaggttcttc

SEQ ID NO: 3960758 - DNA, 16 bp, Homo sapiens
taacaatgtatgtgaa

SEQ ID NO: 3960759 - DNA, 21 bp, Homo sapiens
taacaatttcctttatattta

SEQ ID NO: 3960760 - DNA, 16 bp, Homo sapiens
taacacaagccacaga

SEQ ID NO: 3960761 - DNA, 17 bp, Homo sapiens
taacacaagccacagaa

SEQ ID NO: 3960762 - DNA, 18 bp, Homo sapiens
taacactcagaagcctgg

SEQ ID NO: 3960763 - DNA, 19 bp, Homo sapiens
taacactcagaagcctggg

SEQ ID NO: 3960764 - DNA, 23 bp, Homo sapiens
taacagggaaggcaggcagggct

SEQ ID NO: 3960765 - DNA, 17 bp, Homo sapiens
tagtctcctttgcactg

SEQ ID NO: 3960766 - DNA, 14 bp, Homo sapiens
tagtctctgtgctt

SEQ ID NO: 3960767 - DNA, 17 bp, Homo sapiens
tagtctctgtgctttga

SEQ ID NO: 3960768 - DNA, 18 bp, Homo sapiens
tatacatatcagaaaagt

SEQ ID NO: 3960769 - DNA, 23 bp, Homo sapiens
tatacatatgtagactatataca

SEQ ID NO: 3960770 - DNA, 17 bp, Homo sapiens
tatacatattataaata

SEQ ID NO: 3960771 - DNA, 22 bp, Homo sapiens
tatacatattataaataaatgc

SEQ ID NO: 3960772 - DNA, 13 bp, Homo sapiens
tatacatgtgtgt

SEQ ID NO: 3960773 - DNA, 20 bp, Homo sapiens
tatacatgtgtgtatatatg

SEQ ID NO: 3960774 - DNA, 18 bp, Homo sapiens
tatacatgtttagtatta

SEQ ID NO: 3960775 - DNA, 17 bp, Homo sapiens
tatacattctttatctt

SEQ ID NO: 3960776 - DNA, 21 bp, Homo sapiens
tatacatttcataaggcctgc

SEQ ID NO: 3960777 - DNA, 13 bp, Homo sapiens
tatacattttgtt

SEQ ID NO: 3960778 - DNA, 13 bp, Homo sapiens
tataccagagacc

SEQ ID NO: 3960779 - DNA, 19 bp, Homo sapiens
tataccagagacctgaggc

SEQ ID NO: 3960780 - DNA, 19 bp, Homo sapiens
tatacctataatgtgtgta

SEQ ID NO: 3960781 - DNA, 21 bp, Homo sapiens
tatacctataatgtgtgtatg

SEQ ID NO: 3960782 - DNA, 16 bp, Homo sapiens
tatactccatacataa

SEQ ID NO: 3960783 - DNA, 13 bp, Homo sapiens
tatagaaagctgt

SEQ ID NO: 3960784 - DNA, 20 bp, Homo sapiens
tatagcagcaaaaatataaa

SEQ ID NO: 3960785 - DNA, 21 bp, Homo sapiens
tatagccacatccctttgaaa

SEQ ID NO: 3960786 - DNA, 22 bp, Homo sapiens
tatagctattactgtctggttt

SEQ ID NO: 3960787 - DNA, 15 bp, Homo sapiens
tataggatcatttgt

SEQ ID NO: 3960788 - DNA, 13 bp, Homo sapiens
tataggatggatt

SEQ ID NO: 3960789 - DNA, 23 bp, Homo sapiens
tataggtgctacaaaaacacagc

SEQ ID NO: 3960790 - DNA, 20 bp, Homo sapiens
tataggttactcataaggca

SEQ ID NO: 3960791 - DNA, 15 bp, Homo sapiens
tataggttgtgcaaa

SEQ ID NO: 3960792 - DNA, 16 bp, Homo sapiens
tatagtaatgcactct

SEQ ID NO: 3960793 - DNA, 22 bp, Homo sapiens
tatagtagtcaattagtacagt

SEQ ID NO: 3960794 - DNA, 23 bp, Homo sapiens
tatagtatgatttttacaataat

SEQ ID NO: 3960795 - DNA, 21 bp, Homo sapiens
tatagtcatttattttaaaaa

SEQ ID NO: 3960796 - DNA, 13 bp, Homo sapiens
tatagtgtaaaat

SEQ ID NO: 3960797 - DNA, 21 bp, Homo sapiens
tatagtgtaaaataagaatga

SEQ ID NO: 3960798 - DNA, 18 bp, Homo sapiens
tatagttaggatagcatt

SEQ ID NO: 3960799 - DNA, 16 bp, Homo sapiens
tatataactttagaaa

SEQ ID NO: 3960800 - DNA, 14 bp, Homo sapiens
tatataatactaaa

SEQ ID NO: 3960801 - DNA, 15 bp, Homo sapiens
tatataatactaaag

SEQ ID NO: 3960802 - DNA, 16 bp, Homo sapiens
tatatacaataacata

SEQ ID NO: 3960803 - DNA, 12 bp, Homo sapiens
tatatacacata

SEQ ID NO: 3960804 - DNA, 15 bp, Homo sapiens
tatatacacatacat

SEQ ID NO: 3960805 - DNA, 12 bp, Homo sapiens
tatatacatatt

SEQ ID NO: 3960806 - DNA, 13 bp, Homo sapiens
tatatacatatta

SEQ ID NO: 3960807 - DNA, 19 bp, Homo sapiens
tatatacatattataaata

SEQ ID NO: 3960808 - DNA, 21 bp, Homo sapiens
tatatacatattataaataaa

SEQ ID NO: 3960809 - DNA, 15 bp, Homo sapiens
tatatacatgtgtgt

SEQ ID NO: 3960810 - DNA, 14 bp, Homo sapiens
tatatataaatata

SEQ ID NO: 3960811 - DNA, 12 bp, Homo sapiens
tatatatacata

SEQ ID NO: 3960812 - DNA, 14 bp, Homo sapiens
tatatatacataca

SEQ ID NO: 3960813 - DNA, 22 bp, Homo sapiens
tatatatacatacacttgtata

SEQ ID NO: 3960814 - DNA, 13 bp, Homo sapiens
tatatatacatat

SEQ ID NO: 3960815 - DNA, 13 bp, Homo sapiens
tatatatatattt

SEQ ID NO: 3960816 - DNA, 13 bp, Homo sapiens
tatatatatgtat

SEQ ID NO: 3960817 - DNA, 13 bp, Homo sapiens
tatatatatgtgt

SEQ ID NO: 3960818 - DNA, 22 bp, Homo sapiens
tatatatcatattggtattcac

SEQ ID NO: 3960819 - DNA, 13 bp, Homo sapiens
tatatatgtgcag

SEQ ID NO: 3960820 - DNA, 12 bp, Homo sapiens
tatatatgtgta

SEQ ID NO: 3960821 - DNA, 23 bp, Homo sapiens
tatatatgtgtatatatacatac

SEQ ID NO: 3960822 - DNA, 13 bp, Homo sapiens
tatatatgtgtgt

SEQ ID NO: 3960823 - DNA, 22 bp, Homo sapiens
tatatatgtgtgtttaaataaa

SEQ ID NO: 3960824 - DNA, 14 bp, Homo sapiens
tatatatttaaagg

SEQ ID NO: 3960825 - DNA, 22 bp, Homo sapiens
tatatatttgattgtaaaaaca

SEQ ID NO: 3960826 - DNA, 14 bp, Homo sapiens
tatatatttttcaa

SEQ ID NO: 3960827 - DNA, 20 bp, Homo sapiens
tatatatttttggttgtcaa

SEQ ID NO: 3960828 - DNA, 17 bp, Homo sapiens
tatatcatgaaacactt

SEQ ID NO: 3960829 - DNA, 17 bp, Homo sapiens
tatatctaatttataca

SEQ ID NO: 3960830 - DNA, 14 bp, Homo sapiens
tatatctatagtag

SEQ ID NO: 3960831 - DNA, 18 bp, Homo sapiens
tatatctgataaaattgt

SEQ ID NO: 3960832 - DNA, 20 bp, Homo sapiens
tatatctgataaaattgtga

SEQ ID NO: 3960833 - DNA, 16 bp, Homo sapiens
tatatctgcttcagtg

SEQ ID NO: 3960834 - DNA, 17 bp, Homo sapiens
tatatctgcttcagtgg

SEQ ID NO: 3960835 - DNA, 14 bp, Homo sapiens
tatatctttttcca

SEQ ID NO: 3960836 - DNA, 20 bp, Homo sapiens
tatatgagagaatcacacaa

SEQ ID NO: 3960837 - DNA, 17 bp, Homo sapiens
tatatgatttttatcca

SEQ ID NO: 3960838 - DNA, 18 bp, Homo sapiens
tatatgccttaagccaat

SEQ ID NO: 3960839 - DNA, 16 bp, Homo sapiens
tatatggcaagaaagc

SEQ ID NO: 3960840 - DNA, 21 bp, Homo sapiens
tatatgtatatatatatagta

SEQ ID NO: 3960841 - DNA, 17 bp, Homo sapiens
tatatgtatatgtatat

SEQ ID NO: 3960842 - DNA, 18 bp, Homo sapiens
tatatgtatatgtatata

SEQ ID NO: 3960843 - DNA, 20 bp, Homo sapiens
tatatgtatttaaaaaaatc

SEQ ID NO: 3960844 - DNA, 18 bp, Homo sapiens
tatatgtgtatatataca

SEQ ID NO: 3960845 - DNA, 20 bp, Homo sapiens
tatatgtgtatatatacata

SEQ ID NO: 3960846 - DNA, 12 bp, Homo sapiens
tatatgtgtgtg

SEQ ID NO: 3960847 - DNA, 14 bp, Homo sapiens
tatatgttgtaata

SEQ ID NO: 3960848 - DNA, 23 bp, Homo sapiens
tatattataataatgttctctgg

SEQ ID NO: 3960849 - DNA, 16 bp, Homo sapiens
tatattatggtgtaat

SEQ ID NO: 3960850 - DNA, 22 bp, Homo sapiens
tatattcatgtaataaatctga

SEQ ID NO: 3960851 - DNA, 15 bp, Homo sapiens
tatattctggaaaaa

SEQ ID NO: 3960852 - DNA, 19 bp, Homo sapiens
tatattgaatatatcagaa

SEQ ID NO: 3960853 - DNA, 15 bp, Homo sapiens
tatattgtatattct

SEQ ID NO: 3960854 - DNA, 19 bp, Homo sapiens
tatattgtcagatattttt

SEQ ID NO: 3960855 - DNA, 22 bp, Homo sapiens
tatgaaagatggctgtgcctct

SEQ ID NO: 3960856 - DNA, 13 bp, Homo sapiens
tacccagctcctt

SEQ ID NO: 3960857 - DNA, 19 bp, Homo sapiens
taccccaagtccacctgcc

SEQ ID NO: 3960858 - DNA, 12 bp, Homo sapiens
tacccccagaga

SEQ ID NO: 3960859 - DNA, 20 bp, Homo sapiens
tacccctgcctgggttttct

SEQ ID NO: 3960860 - DNA, 14 bp, Homo sapiens
tacccgagcccagc

SEQ ID NO: 3960861 - DNA, 19 bp, Homo sapiens
tacccgagcccagctacat

SEQ ID NO: 3960862 - DNA, 11 bp, Homo sapiens
taccctccccc

SEQ ID NO: 3960863 - DNA, 19 bp, Homo sapiens
tacccttccacctcctaga

SEQ ID NO: 3960864 - DNA, 18 bp, Homo sapiens
tacccttctttaaatcaa

SEQ ID NO: 3960865 - DNA, 16 bp, Homo sapiens
tacccttgtaccccat

SEQ ID NO: 3960866 - DNA, 14 bp, Homo sapiens
taccgagaaaagga

SEQ ID NO: 3960867 - DNA, 19 bp, Homo sapiens
taccgcgtctaccctggga

SEQ ID NO: 3960868 - DNA, 17 bp, Homo sapiens
taccgctggggaacaga

SEQ ID NO: 3960869 - DNA, 15 bp, Homo sapiens
tacctaaacagatat

SEQ ID NO: 3960870 - DNA, 17 bp, Homo sapiens
tacctaccaccttccct

SEQ ID NO: 3960871 - DNA, 20 bp, Homo sapiens
tacctagcacacaataagca

SEQ ID NO: 3960872 - DNA, 16 bp, Homo sapiens
tacctataatgtgtgt

SEQ ID NO: 3960873 - DNA, 18 bp, Homo sapiens
tacctataatgtgtgtat

SEQ ID NO: 3960874 - DNA, 23 bp, Homo sapiens
tacctataatgtgtgtatgtgta

SEQ ID NO: 3960875 - DNA, 16 bp, Homo sapiens
tacctatcatcttaag

SEQ ID NO: 3960876 - DNA, 17 bp, Homo sapiens
tacctcaacctatggta

SEQ ID NO: 3960877 - DNA, 14 bp, Homo sapiens
tacctcgaggctct

SEQ ID NO: 3960878 - DNA, 20 bp, Homo sapiens
tacctgacggacgtcctgct

SEQ ID NO: 3960879 - DNA, 14 bp, Homo sapiens
tacctgccctctct

SEQ ID NO: 3960880 - DNA, 16 bp, Homo sapiens
tacctgggatatgaca

SEQ ID NO: 3960881 - DNA, 16 bp, Homo sapiens
tacctgtagtgagaaa

SEQ ID NO: 3960882 - DNA, 20 bp, Homo sapiens
tacctgtagtgagaaactga

SEQ ID NO: 3960883 - DNA, 16 bp, Homo sapiens
tacctgtgtggacagg

SEQ ID NO: 3960884 - DNA, 23 bp, Homo sapiens
tacctgttactattatctgtgct

SEQ ID NO: 3960885 - DNA, 21 bp, Homo sapiens
taccttagattagctctggac

SEQ ID NO: 3960886 - DNA, 20 bp, Homo sapiens
taccttctggttgcttcaga

SEQ ID NO: 3960887 - DNA, 18 bp, Homo sapiens
tacctttcccatgctgaa

SEQ ID NO: 3960888 - DNA, 23 bp, Homo sapiens
tacgaaactgtatgattaagcaa

SEQ ID NO: 3960889 - DNA, 23 bp, Homo sapiens
tacgcactacatgtggtttatag

SEQ ID NO: 3960890 - DNA, 23 bp, Homo sapiens
tacgccaaagtgcagcccttcct

SEQ ID NO: 3960891 - DNA, 15 bp, Homo sapiens
tacgctctcctttct

SEQ ID NO: 3960892 - DNA, 15 bp, Homo sapiens
tacggttgcttcacc

SEQ ID NO: 3960893 - DNA, 16 bp, Homo sapiens
tacgtacatgtgaggc

SEQ ID NO: 3960894 - DNA, 20 bp, Homo sapiens
tacgtataaatatgaaatga

SEQ ID NO: 3960895 - DNA, 18 bp, Homo sapiens
tacgtcaaacatgaagtg

SEQ ID NO: 3960896 - DNA, 16 bp, Homo sapiens
tacgtgttaggaggct

SEQ ID NO: 3960897 - DNA, 20 bp, Homo sapiens
tactaaaagttcttctccaa

SEQ ID NO: 3960898 - DNA, 14 bp, Homo sapiens
tactaaagagacat

SEQ ID NO: 3960899 - DNA, 15 bp, Homo sapiens
tactaaagtgtctat

SEQ ID NO: 3960900 - DNA, 20 bp, Homo sapiens
tactaaattgtatacatttt

SEQ ID NO: 3960901 - DNA, 15 bp, Homo sapiens
tactaagaggctatt

SEQ ID NO: 3960902 - DNA, 15 bp, Homo sapiens
tactaccaatgccaa

SEQ ID NO: 3960903 - DNA, 18 bp, Homo sapiens
tactagaatggtagcact

SEQ ID NO: 3960904 - DNA, 17 bp, Homo sapiens
tactagaatttgtattt

SEQ ID NO: 3960905 - DNA, 18 bp, Homo sapiens
tactagaatttgtatttt

SEQ ID NO: 3960906 - DNA, 19 bp, Homo sapiens
tactagaatttgtattttg

SEQ ID NO: 3960907 - DNA, 23 bp, Homo sapiens
tactagcttttcaaacaagaatg

SEQ ID NO: 3960908 - DNA, 19 bp, Homo sapiens
tactagttttccttgaaaa

SEQ ID NO: 3960909 - DNA, 13 bp, Homo sapiens
tactatacaacaa

SEQ ID NO: 3960910 - DNA, 14 bp, Homo sapiens
tactatacaacaat

SEQ ID NO: 3960911 - DNA, 15 bp, Homo sapiens
tactatacaacaatg

SEQ ID NO: 3960912 - DNA, 16 bp, Homo sapiens
tactatttgaagcaat

SEQ ID NO: 3960913 - DNA, 12 bp, Homo sapiens
tactcacctcct

SEQ ID NO: 3960914 - DNA, 14 bp, Homo sapiens
tactcacctcctcc

SEQ ID NO: 3960915 - DNA, 15 bp, Homo sapiens
tactcacctcctccc

SEQ ID NO: 3960916 - DNA, 19 bp, Homo sapiens
tactcagcagccctcctca

SEQ ID NO: 3960917 - DNA, 14 bp, Homo sapiens
tactcagccctggg

SEQ ID NO: 3960918 - DNA, 15 bp, Homo sapiens
tactcagccctgggc

SEQ ID NO: 3960919 - DNA, 22 bp, Homo sapiens
tactcagttagaattttcctaa

SEQ ID NO: 3960920 - DNA, 15 bp, Homo sapiens
tactcatttctaaaa

SEQ ID NO: 3960921 - DNA, 13 bp, Homo sapiens
tactcccaggcac

SEQ ID NO: 3960922 - DNA, 13 bp, Homo sapiens
tactcccttcctg

SEQ ID NO: 3960923 - DNA, 17 bp, Homo sapiens
tactcctgtgctctgga

SEQ ID NO: 3960924 - DNA, 11 bp, Homo sapiens
tactcctgtgg

SEQ ID NO: 3960925 - DNA, 12 bp, Homo sapiens
tactcctgtggg

SEQ ID NO: 3960926 - DNA, 17 bp, Homo sapiens
tactcctgtgggagcct

SEQ ID NO: 3960927 - DNA, 17 bp, Homo sapiens
tactctacgccaaagtg

SEQ ID NO: 3960928 - DNA, 20 bp, Homo sapiens
tactctatgccccaaatata

SEQ ID NO: 3960929 - DNA, 16 bp, Homo sapiens
tactctccaacctgga

SEQ ID NO: 3960930 - DNA, 11 bp, Homo sapiens
tactctgagcc

SEQ ID NO: 3960931 - DNA, 15 bp, Homo sapiens
tactctgagcccagg

SEQ ID NO: 3960932 - DNA, 14 bp, Homo sapiens
tactctgtccaggc

SEQ ID NO: 3960933 - DNA, 22 bp, Homo sapiens
tactcttcagaatatggacaaa

SEQ ID NO: 3960934 - DNA, 19 bp, Homo sapiens
tactctttatttctagcag

SEQ ID NO: 3960935 - DNA, 21 bp, Homo sapiens
tactgaaatgaggagagaagg

SEQ ID NO: 3960936 - DNA, 16 bp, Homo sapiens
tactgataaagaaaga

SEQ ID NO: 3960937 - DNA, 15 bp, Homo sapiens
tcatttatccctcaa

SEQ ID NO: 3960938 - DNA, 19 bp, Homo sapiens
tcatttcacattaatggtc

SEQ ID NO: 3960939 - DNA, 13 bp, Homo sapiens
tcatttctaaaag

SEQ ID NO: 3960940 - DNA, 19 bp, Homo sapiens
tcatttctactgtgactga

SEQ ID NO: 3960941 - DNA, 16 bp, Homo sapiens
tcatttgaacaactag

SEQ ID NO: 3960942 - DNA, 15 bp, Homo sapiens
tcattttaaaatctg

SEQ ID NO: 3960943 - DNA, 17 bp, Homo sapiens
tcattttaaaatctgat

SEQ ID NO: 3960944 - DNA, 21 bp, Homo sapiens
tcattttaaaatctgatttaa

SEQ ID NO: 3960945 - DNA, 21 bp, Homo sapiens
tcattttaggcctcctctctg

SEQ ID NO: 3960946 - DNA, 17 bp, Homo sapiens
tcattttagtgactgta

SEQ ID NO: 3960947 - DNA, 13 bp, Homo sapiens
tcattttgcacgt

SEQ ID NO: 3960948 - DNA, 13 bp, Homo sapiens
tcattttttctta

SEQ ID NO: 3960949 - DNA, 18 bp, Homo sapiens
tcatttttttaacacata

SEQ ID NO: 3960950 - DNA, 21 bp, Homo sapiens
tccaaaaaggaacactggaaa

SEQ ID NO: 3960951 - DNA, 19 bp, Homo sapiens
tccaaacaccggcagaaaa

SEQ ID NO: 3960952 - DNA, 12 bp, Homo sapiens
tccaaactcctg

SEQ ID NO: 3960953 - DNA, 14 bp, Homo sapiens
tccaaactcctgcc

SEQ ID NO: 3960954 - DNA, 16 bp, Homo sapiens
tccaaactcctgcctg

SEQ ID NO: 3960955 - DNA, 14 bp, Homo sapiens
tccaaagaaatgta

SEQ ID NO: 3960956 - DNA, 16 bp, Homo sapiens
tccaaaggggctgctg

SEQ ID NO: 3960957 - DNA, 19 bp, Homo sapiens
tccaaaggggctgctgggg

SEQ ID NO: 3960958 - DNA, 19 bp, Homo sapiens
tccaaatgaatgaccttgt

SEQ ID NO: 3960959 - DNA, 13 bp, Homo sapiens
tccaacagtgagt

SEQ ID NO: 3960960 - DNA, 12 bp, Homo sapiens
tccaaccccagc

SEQ ID NO: 3960961 - DNA, 16 bp, Homo sapiens
tccaaccccagctggc

SEQ ID NO: 3960962 - DNA, 17 bp, Homo sapiens
tccaaccccagctggcc

SEQ ID NO: 3960963 - DNA, 14 bp, Homo sapiens
tccaacctggacaa

SEQ ID NO: 3960964 - DNA, 17 bp, Homo sapiens
tccaacctggacaacaa

SEQ ID NO: 3960965 - DNA, 20 bp, Homo sapiens
tccaactcctggagatttca

SEQ ID NO: 3960966 - DNA, 18 bp, Homo sapiens
tccaactgtgttcattag

SEQ ID NO: 3960967 - DNA, 20 bp, Homo sapiens
tccaagattcaaagagacta

SEQ ID NO: 3960968 - DNA, 21 bp, Homo sapiens
tccaagcgaggtcaacagaga

SEQ ID NO: 3960969 - DNA, 23 bp, Homo sapiens
tccaagcttcaagtgatatatgt

SEQ ID NO: 3960970 - DNA, 19 bp, Homo sapiens
tccaaggagaaacagagac

SEQ ID NO: 3960971 - DNA, 12 bp, Homo sapiens
tccaaggagttc

SEQ ID NO: 3960972 - DNA, 17 bp, Homo sapiens
tccaagtattttatctg

SEQ ID NO: 3960973 - DNA, 22 bp, Homo sapiens
tccaagtattttatctgtgttg

SEQ ID NO: 3960974 - DNA, 22 bp, Homo sapiens
tccaagtccaacctgcctgtgc

SEQ ID NO: 3960975 - DNA, 18 bp, Homo sapiens
tccaatcccaccaaccct

SEQ ID NO: 3960976 - DNA, 14 bp, Homo sapiens
tccaatcctttcca

SEQ ID NO: 3960977 - DNA, 17 bp, Homo sapiens
tccaatggctgtaaact

SEQ ID NO: 3960978 - DNA, 20 bp, Homo sapiens
tccaattatgcactggccac

SEQ ID NO: 3960979 - DNA, 13 bp, Homo sapiens
tccaattgtaaaa

SEQ ID NO: 3960980 - DNA, 14 bp, Homo sapiens
tccaattgtaaaaa

SEQ ID NO: 3960981 - DNA, 14 bp, Homo sapiens
tccaattttctgga

SEQ ID NO: 3960982 - DNA, 18 bp, Homo sapiens
tccaattttctggaatac

SEQ ID NO: 3960983 - DNA, 19 bp, Homo sapiens
tccacaaagccgtgccttt

SEQ ID NO: 3960984 - DNA, 18 bp, Homo sapiens
tccacaagattcccagag

SEQ ID NO: 3960985 - DNA, 12 bp, Homo sapiens
tccacacacaga

SEQ ID NO: 3960986 - DNA, 14 bp, Homo sapiens
tccacacacgcagg

SEQ ID NO: 3960987 - DNA, 19 bp, Homo sapiens
tccacaggggcaggcctgg

SEQ ID NO: 3960988 - DNA, 20 bp, Homo sapiens
tccacaggggcaggcctggg

SEQ ID NO: 3960989 - DNA, 17 bp, Homo sapiens
tccacagtctcccattc

SEQ ID NO: 3960990 - DNA, 18 bp, Homo sapiens
tccaccaacccatcagaa

SEQ ID NO: 3960991 - DNA, 17 bp, Homo sapiens
tccaccatcaaatgctg

SEQ ID NO: 3960992 - DNA, 14 bp, Homo sapiens
tccacccagcccat

SEQ ID NO: 3960993 - DNA, 15 bp, Homo sapiens
tccacccagcccatt

SEQ ID NO: 3960994 - DNA, 13 bp, Homo sapiens
tccacccaggctg

SEQ ID NO: 3960995 - DNA, 15 bp, Homo sapiens
tccacccaggctgca

SEQ ID NO: 3960996 - DNA, 16 bp, Homo sapiens
tccacccaggctgcac

SEQ ID NO: 3960997 - DNA, 19 bp, Homo sapiens
tccacccaggctgcactgc

SEQ ID NO: 3960998 - DNA, 12 bp, Homo sapiens
tccacccagtgc

SEQ ID NO: 3960999 - DNA, 15 bp, Homo sapiens
tccacccagtgctgc

SEQ ID NO: 3961000 - DNA, 16 bp, Homo sapiens
tccacccagtgctgcc

SEQ ID NO: 3961001 - DNA, 19 bp, Homo sapiens
tccacccagtgctgccatg

SEQ ID NO: 3961002 - DNA, 20 bp, Homo sapiens
tccacccagtgctgccatgc

SEQ ID NO: 3961003 - DNA, 22 bp, Homo sapiens
tccacccatcctaccaatgcat

SEQ ID NO: 3961004 - DNA, 20 bp, Homo sapiens
tccacccccgccacggccac

SEQ ID NO: 3961005 - DNA, 14 bp, Homo sapiens
tccaccccctccag

SEQ ID NO: 3961006 - DNA, 16 bp, Homo sapiens
tccaccccctccagct

SEQ ID NO: 3961007 - DNA, 18 bp, Homo sapiens
tccaccccctccagctcc

SEQ ID NO: 3961008 - DNA, 14 bp, Homo sapiens
tccaccgctgccta

SEQ ID NO: 3961009 - DNA, 11 bp, Homo sapiens
tccacctcagc

SEQ ID NO: 3961010 - DNA, 16 bp, Homo sapiens
tccacctcagccttgg

SEQ ID NO: 3961011 - DNA, 15 bp, Homo sapiens
tccacctccacccac

SEQ ID NO: 3961012 - DNA, 13 bp, Homo sapiens
tccacctggcccc

SEQ ID NO: 3961013 - DNA, 17 bp, Homo sapiens
tccacctggccccatgt

SEQ ID NO: 3961014 - DNA, 18 bp, Homo sapiens
tccaccttcccatgccct

SEQ ID NO: 3961015 - DNA, 15 bp, Homo sapiens
tccacgcacacatgg

SEQ ID NO: 3961016 - DNA, 14 bp, Homo sapiens
tccacgcctcctgg

SEQ ID NO: 3961017 - DNA, 15 bp, Homo sapiens
tccacgcctcctggc

SEQ ID NO: 3961018 - DNA, 18 bp, Homo sapiens
tccacgcctcctggccag

SEQ ID NO: 3961019 - DNA, 20 bp, Homo sapiens
tccacgcctcctggccagac

SEQ ID NO: 3961020 - DNA, 13 bp, Homo sapiens
tccacggtgcgtg

SEQ ID NO: 3961021 - DNA, 23 bp, Homo sapiens
tccacggtgcgtggctgtggcac

SEQ ID NO: 3961022 - DNA, 16 bp, Homo sapiens
tccactcactccagcc

SEQ ID NO: 3961023 - DNA, 12 bp, Homo sapiens
tccactccaagg

SEQ ID NO: 3961024 - DNA, 18 bp, Homo sapiens
tccatcaggttccatccc

SEQ ID NO: 3961025 - DNA, 19 bp, Homo sapiens
tccatcaggttccatcccg

SEQ ID NO: 3961026 - DNA, 14 bp, Homo sapiens
tccatccccaaact

SEQ ID NO: 3961027 - DNA, 20 bp, Homo sapiens
tccatcccgaaaatctctcg

SEQ ID NO: 3961028 - DNA, 21 bp, Homo sapiens
tccatgaagaccacatccaca

SEQ ID NO: 3961029 - DNA, 23 bp, Homo sapiens
tccatgaagaccacatccacaca

SEQ ID NO: 3961030 - DNA, 20 bp, Homo sapiens
tccatgagggtttcattgtg

SEQ ID NO: 3961031 - DNA, 22 bp, Homo sapiens
tcagagaggccttttggaatgt

SEQ ID NO: 3961032 - DNA, 15 bp, Homo sapiens
tcagagatgaaacta

SEQ ID NO: 3961033 - DNA, 14 bp, Homo sapiens
tcagagcaggggtc

SEQ ID NO: 3961034 - DNA, 14 bp, Homo sapiens
tcagagccagtgaa

SEQ ID NO: 3961035 - DNA, 18 bp, Homo sapiens
tcagagcccctccctgct

SEQ ID NO: 3961036 - DNA, 14 bp, Homo sapiens
tcagagcctagcca

SEQ ID NO: 3961037 - DNA, 17 bp, Homo sapiens
tcagagcctagccacct

SEQ ID NO: 3961038 - DNA, 19 bp, Homo sapiens
tcagagcctagccacctcc

SEQ ID NO: 3961039 - DNA, 17 bp, Homo sapiens
tcagagctcttcaagct

SEQ ID NO: 3961040 - DNA, 22 bp, Homo sapiens
tcagagctcttcaagctgtccc

SEQ ID NO: 3961041 - DNA, 15 bp, Homo sapiens
tcagagctgttggcc

SEQ ID NO: 3961042 - DNA, 18 bp, Homo sapiens
tcagagctgttggcctcg

SEQ ID NO: 3961043 - DNA, 19 bp, Homo sapiens
tcagagctgttggcctcgc

SEQ ID NO: 3961044 - DNA, 21 bp, Homo sapiens
tcagagctgttggcctcgcct

SEQ ID NO: 3961045 - DNA, 14 bp, Homo sapiens
tcagaggagaagag

SEQ ID NO: 3961046 - DNA, 18 bp, Homo sapiens
tcagatatatatcatatt

SEQ ID NO: 3961047 - DNA, 16 bp, Homo sapiens
tcagatatatttttca

SEQ ID NO: 3961048 - DNA, 23 bp, Homo sapiens
tcagatatatttttcacagtttt

SEQ ID NO: 3961049 - DNA, 22 bp, Homo sapiens
tcagatattttttcagaaatat

SEQ ID NO: 3961050 - DNA, 13 bp, Homo sapiens
tcagatcagtgct

SEQ ID NO: 3961051 - DNA, 16 bp, Homo sapiens
tcagatcgtattaatt

SEQ ID NO: 3961052 - DNA, 18 bp, Homo sapiens
tcagatcgtattaattat

SEQ ID NO: 3961053 - DNA, 19 bp, Homo sapiens
tcagatcgtattaattatc

SEQ ID NO: 3961054 - DNA, 15 bp, Homo sapiens
tcagatcttgacagt

SEQ ID NO: 3961055 - DNA, 14 bp, Homo sapiens
tcagattcccagag

SEQ ID NO: 3961056 - DNA, 14 bp, Homo sapiens
tcagcaccatggag

SEQ ID NO: 3961057 - DNA, 20 bp, Homo sapiens
tcagcaccatggaggcaggc

SEQ ID NO: 3961058 - DNA, 14 bp, Homo sapiens
tcagcaccctgggt

SEQ ID NO: 3961059 - DNA, 16 bp, Homo sapiens
tcagcaccctgggtgc

SEQ ID NO: 3961060 - DNA, 19 bp, Homo sapiens
tcagcaccctgggtgccat

SEQ ID NO: 3961061 - DNA, 15 bp, Homo sapiens
tcagcactgaaaata

SEQ ID NO: 3961062 - DNA, 21 bp, Homo sapiens
tcagcactgaaaataccatca

SEQ ID NO: 3961063 - DNA, 20 bp, Homo sapiens
tcagcactgatttcacaaca

SEQ ID NO: 3961064 - DNA, 12 bp, Homo sapiens
tcagcagccccc

SEQ ID NO: 3961065 - DNA, 18 bp, Homo sapiens
tcagcaggaacctgtact

SEQ ID NO: 3961066 - DNA, 18 bp, Homo sapiens
tcagcattattcctccag

SEQ ID NO: 3961067 - DNA, 23 bp, Homo sapiens
tcagccagaatcttcgtcctgcc

SEQ ID NO: 3961068 - DNA, 17 bp, Homo sapiens
tcagccagccgccctgg

SEQ ID NO: 3961069 - DNA, 22 bp, Homo sapiens
tcagccataaagtgccagtttg

SEQ ID NO: 3961070 - DNA, 11 bp, Homo sapiens
tcagccatgtt

SEQ ID NO: 3961071 - DNA, 14 bp, Homo sapiens
tcagccatgtttgg

SEQ ID NO: 3961072 - DNA, 16 bp, Homo sapiens
tcagcccctagtgcta

SEQ ID NO: 3961073 - DNA, 12 bp, Homo sapiens
tcagcccctcct

SEQ ID NO: 3961074 - DNA, 14 bp, Homo sapiens
tcagcccctcctct

SEQ ID NO: 3961075 - DNA, 18 bp, Homo sapiens
tcagcccctcctctgcca

SEQ ID NO: 3961076 - DNA, 16 bp, Homo sapiens
tcagccctccctgccc

SEQ ID NO: 3961077 - DNA, 18 bp, Homo sapiens
tcagccctccctgcccct

SEQ ID NO: 3961078 - DNA, 19 bp, Homo sapiens
tcagccctgggccccacca

SEQ ID NO: 3961079 - DNA, 23 bp, Homo sapiens
tcagccctgggccccaccaccta

SEQ ID NO: 3961080 - DNA, 13 bp, Homo sapiens
tcagcccttgccc

SEQ ID NO: 3961081 - DNA, 18 bp, Homo sapiens
tcagccgagccgggcctg

SEQ ID NO: 3961082 - DNA, 20 bp, Homo sapiens
tcagccgagccgggcctggg

SEQ ID NO: 3961083 - DNA, 21 bp, Homo sapiens
tcagccgagccgggcctgggg

SEQ ID NO: 3961084 - DNA, 18 bp, Homo sapiens
tcagccgcagacaagtaa

SEQ ID NO: 3961085 - DNA, 21 bp, Homo sapiens
tcagccggcgtggcaaatata

SEQ ID NO: 3961086 - DNA, 20 bp, Homo sapiens
tcagccgtgcactccctaag

SEQ ID NO: 3961087 - DNA, 20 bp, Homo sapiens
tcagcctcccaagtagctgg

SEQ ID NO: 3961088 - DNA, 21 bp, Homo sapiens
tcagcctcctaagcagctggg

SEQ ID NO: 3961089 - DNA, 16 bp, Homo sapiens
tcagcctgagtctcct

SEQ ID NO: 3961090 - DNA, 13 bp, Homo sapiens
tcagctcagcctc

SEQ ID NO: 3961091 - DNA, 19 bp, Homo sapiens
tcagctccagaataccttc

SEQ ID NO: 3961092 - DNA, 12 bp, Homo sapiens
tcagctcccata

SEQ ID NO: 3961093 - DNA, 14 bp, Homo sapiens
tcagctcccatagc

SEQ ID NO: 3961094 - DNA, 15 bp, Homo sapiens
tcagctctctgtata

SEQ ID NO: 3961095 - DNA, 16 bp, Homo sapiens
tcagctttcagagcca

SEQ ID NO: 3961096 - DNA, 18 bp, Homo sapiens
tcagctttcagagccagt

SEQ ID NO: 3961097 - DNA, 22 bp, Homo sapiens
tcagctttcagagccagtgaag

SEQ ID NO: 3961098 - DNA, 18 bp, Homo sapiens
tcagctttttgtcttttc

SEQ ID NO: 3961099 - DNA, 20 bp, Homo sapiens
tcagctttttgtcttttctg

SEQ ID NO: 3961100 - DNA, 20 bp, Homo sapiens
tcaggaaaactgacagagga

SEQ ID NO: 3961101 - DNA, 21 bp, Homo sapiens
tcaggaaaactgacagaggag

SEQ ID NO: 3961102 - DNA, 14 bp, Homo sapiens
tcaggaaaaggcct

SEQ ID NO: 3961103 - DNA, 19 bp, Homo sapiens
tcaggaaaaggcctggggt

SEQ ID NO: 3961104 - DNA, 22 bp, Homo sapiens
tcaggaaatcaaatatgcaaag

SEQ ID NO: 3961105 - DNA, 19 bp, Homo sapiens
tcaggaagaaaccccaagc

SEQ ID NO: 3961106 - DNA, 22 bp, Homo sapiens
tcaggaagaaaccccaagcagc

SEQ ID NO: 3961107 - DNA, 23 bp, Homo sapiens
tcaggacacaggcctgtgtagct

SEQ ID NO: 3961108 - DNA, 17 bp, Homo sapiens
tcaggacccaggccctc

SEQ ID NO: 3961109 - DNA, 22 bp, Homo sapiens
tcaggacccaggccctccatgg

SEQ ID NO: 3961110 - DNA, 20 bp, Homo sapiens
tcaggacccaggccgcctgc

SEQ ID NO: 3961111 - DNA, 21 bp, Homo sapiens
tcaggacccaggccgcctgcc

SEQ ID NO: 3961112 - DNA, 22 bp, Homo sapiens
tcaggacccaggccgcctgcca

SEQ ID NO: 3961113 - DNA, 15 bp, Homo sapiens
tcaggacttggtctg

SEQ ID NO: 3961114 - DNA, 22 bp, Homo sapiens
tcaggaggccctggtgtcaggc

SEQ ID NO: 3961115 - DNA, 23 bp, Homo sapiens
tcaggaggcgaataaatgttcaa

SEQ ID NO: 3961116 - DNA, 20 bp, Homo sapiens
tatttaatttttacatgacc

SEQ ID NO: 3961117 - DNA, 21 bp, Homo sapiens
tatttacatgaattgcatttt

SEQ ID NO: 3961118 - DNA, 11 bp, Homo sapiens
tatttatactc

SEQ ID NO: 3961119 - DNA, 18 bp, Homo sapiens
tatttatagcaatccatg

SEQ ID NO: 3961120 - DNA, 16 bp, Homo sapiens
tatttatagtcattta

SEQ ID NO: 3961121 - DNA, 17 bp, Homo sapiens
tatttatatatttgaat

SEQ ID NO: 3961122 - DNA, 15 bp, Homo sapiens
tatttatatttggaa

SEQ ID NO: 3961123 - DNA, 18 bp, Homo sapiens
tatttatgcttaaaatat

SEQ ID NO: 3961124 - DNA, 13 bp, Homo sapiens
tatttatggctta

SEQ ID NO: 3961125 - DNA, 13 bp, Homo sapiens
tatttatttatgg

SEQ ID NO: 3961126 - DNA, 14 bp, Homo sapiens
tatttatttatgga

SEQ ID NO: 3961127 - DNA, 11 bp, Homo sapiens
tatttcaaatg

SEQ ID NO: 3961128 - DNA, 20 bp, Homo sapiens
tatttcagttttaaatgtac

SEQ ID NO: 3961129 - DNA, 12 bp, Homo sapiens
tatttcatttct

SEQ ID NO: 3961130 - DNA, 14 bp, Homo sapiens
tatttcctgctaca

SEQ ID NO: 3961131 - DNA, 19 bp, Homo sapiens
tatttctcgggtgcatttg

SEQ ID NO: 3961132 - DNA, 13 bp, Homo sapiens
tatttgccattca

SEQ ID NO: 3961133 - DNA, 16 bp, Homo sapiens
tatttgtacaaatact

SEQ ID NO: 3961134 - DNA, 19 bp, Homo sapiens
tatttgtatgtactgttat

SEQ ID NO: 3961135 - DNA, 15 bp, Homo sapiens
tatttgtgctctgtg

SEQ ID NO: 3961136 - DNA, 13 bp, Homo sapiens
tatttgtgtaata

SEQ ID NO: 3961137 - DNA, 17 bp, Homo sapiens
tatttgtgtaatagaaa

SEQ ID NO: 3961138 - DNA, 18 bp, Homo sapiens
tatttgttattttcagta

SEQ ID NO: 3961139 - DNA, 19 bp, Homo sapiens
tatttgttgtttttaacaa

SEQ ID NO: 3961140 - DNA, 15 bp, Homo sapiens
tattttaaaaccatg

SEQ ID NO: 3961141 - DNA, 20 bp, Homo sapiens
tattttaaaaccatgcagct

SEQ ID NO: 3961142 - DNA, 12 bp, Homo sapiens
tattttaaaagc

SEQ ID NO: 3961143 - DNA, 19 bp, Homo sapiens
tattttaatattttgtatt

SEQ ID NO: 3961144 - DNA, 15 bp, Homo sapiens
tattttagagaatgg

SEQ ID NO: 3961145 - DNA, 14 bp, Homo sapiens
tattttatatgaga

SEQ ID NO: 3961146 - DNA, 20 bp, Homo sapiens
tattttatatgagagaatca

SEQ ID NO: 3961147 - DNA, 13 bp, Homo sapiens
tattttattccct

SEQ ID NO: 3961148 - DNA, 13 bp, Homo sapiens
tattttcaagaaa

SEQ ID NO: 3961149 - DNA, 17 bp, Homo sapiens
tattttcattacaatgg

SEQ ID NO: 3961150 - DNA, 13 bp, Homo sapiens
tattttctgaatt

SEQ ID NO: 3961151 - DNA, 16 bp, Homo sapiens
tattttcttttgtaaa

SEQ ID NO: 3961152 - DNA, 16 bp, Homo sapiens
tattttgaatgtgaag

SEQ ID NO: 3961153 - DNA, 21 bp, Homo sapiens
tattttgtaaactcaaaatat

SEQ ID NO: 3961154 - DNA, 10 bp, Homo sapiens
tattttgtat

SEQ ID NO: 3961155 - DNA, 15 bp, Homo sapiens
tattttgttgtgatt

SEQ ID NO: 3961156 - DNA, 18 bp, Homo sapiens
tatttttagcagagatgg

SEQ ID NO: 3961157 - DNA, 20 bp, Homo sapiens
tatttttatacaccattgtt

SEQ ID NO: 3961158 - DNA, 21 bp, Homo sapiens
tatttttatatttagttatag

SEQ ID NO: 3961159 - DNA, 15 bp, Homo sapiens
tatttttcacagttt

SEQ ID NO: 3961160 - DNA, 19 bp, Homo sapiens
tatttttgaacccctgtgt

SEQ ID NO: 3961161 - DNA, 14 bp, Homo sapiens
tatttttgtacgtt

SEQ ID NO: 3961162 - DNA, 16 bp, Homo sapiens
tatttttgtacgttat

SEQ ID NO: 3961163 - DNA, 17 bp, Homo sapiens
tattttttattgttttc

SEQ ID NO: 3961164 - DNA, 13 bp, Homo sapiens
tattttttctaca

SEQ ID NO: 3961165 - DNA, 14 bp, Homo sapiens
tattttttctacac

SEQ ID NO: 3961166 - DNA, 16 bp, Homo sapiens
tcaaaaaaacactagt

SEQ ID NO: 3961167 - DNA, 14 bp, Homo sapiens
tcaaaaaacaaaaa

SEQ ID NO: 3961168 - DNA, 12 bp, Homo sapiens
tcaaaaataaac

SEQ ID NO: 3961169 - DNA, 16 bp, Homo sapiens
tcaaaaataaactagt

SEQ ID NO: 3961170 - DNA, 17 bp, Homo sapiens
tcaaaaataaactagtt

SEQ ID NO: 3961171 - DNA, 18 bp, Homo sapiens
tcaaaacaaccatcctgc

SEQ ID NO: 3961172 - DNA, 20 bp, Homo sapiens
tcaaaacaaccatcctgctc

SEQ ID NO: 3961173 - DNA, 13 bp, Homo sapiens
tcaaaacatatca

SEQ ID NO: 3961174 - DNA, 15 bp, Homo sapiens
tcaaaacatatcaat

SEQ ID NO: 3961175 - DNA, 16 bp, Homo sapiens
tcaaaacatatcaatt

SEQ ID NO: 3961176 - DNA, 17 bp, Homo sapiens
tcaaaacatatcaattc

SEQ ID NO: 3961177 - DNA, 18 bp, Homo sapiens
tcaaaagaaaaggcaaaa

SEQ ID NO: 3961178 - DNA, 18 bp, Homo sapiens
tcaaaagcaaatgagatc

SEQ ID NO: 3961179 - DNA, 15 bp, Homo sapiens
tcaaaagctggatta

SEQ ID NO: 3961180 - DNA, 22 bp, Homo sapiens
tcaaaagtgatctgtcccctct

SEQ ID NO: 3961181 - DNA, 16 bp, Homo sapiens
tcaaaataaattgaaa

SEQ ID NO: 3961182 - DNA, 17 bp, Homo sapiens
tcaaaatatttgtacat

SEQ ID NO: 3961183 - DNA, 18 bp, Homo sapiens
tcaaaatgttcgtattct

SEQ ID NO: 3961184 - DNA, 13 bp, Homo sapiens
tcaaacaagaatg

SEQ ID NO: 3961185 - DNA, 22 bp, Homo sapiens
tcaaacagtctcaggaaatcaa

SEQ ID NO: 3961186 - DNA, 18 bp, Homo sapiens
tcaaaccatttaattcat

SEQ ID NO: 3961187 - DNA, 20 bp, Homo sapiens
tcaaaccatttaattcataa

SEQ ID NO: 3961188 - DNA, 23 bp, Homo sapiens
tcaaaccccgaccacctgcccaa

SEQ ID NO: 3961189 - DNA, 20 bp, Homo sapiens
tcaaaccgcactcacccatg

SEQ ID NO: 3961190 - DNA, 20 bp, Homo sapiens
tcaaacttgtgctgagaata

SEQ ID NO: 3961191 - DNA, 16 bp, Homo sapiens
tcaaagaaatgctgat

SEQ ID NO: 3961192 - DNA, 16 bp, Homo sapiens
tcaaagaaggatggca

SEQ ID NO: 3961193 - DNA, 22 bp, Homo sapiens
tcaaagaaggatggcacctaaa

SEQ ID NO: 3961194 - DNA, 16 bp, Homo sapiens
tcaaagattttacctg

SEQ ID NO: 3961195 - DNA, 17 bp, Homo sapiens
tcaaagattttacctgg

SEQ ID NO: 3961196 - DNA, 19 bp, Homo sapiens
tcaaagcaagggctccagc

SEQ ID NO: 3961197 - DNA, 12 bp, Homo sapiens
tcaaagctgagt

SEQ ID NO: 3961198 - DNA, 18 bp, Homo sapiens
tcaaagctgctttattca

SEQ ID NO: 3961199 - DNA, 16 bp, Homo sapiens
tcaaatatgcaaagca

SEQ ID NO: 3961200 - DNA, 18 bp, Homo sapiens
tcaaatatgcaaagcact

SEQ ID NO: 3961201 - DNA, 11 bp, Homo sapiens
tcctttcctct

SEQ ID NO: 3961202 - DNA, 15 bp, Homo sapiens
tcctttcctctgcag

SEQ ID NO: 3961203 - DNA, 11 bp, Homo sapiens
tcctttctatc

SEQ ID NO: 3961204 - DNA, 15 bp, Homo sapiens
tcctttctattgaaa

SEQ ID NO: 3961205 - DNA, 16 bp, Homo sapiens
tcctttctccagccag

SEQ ID NO: 3961206 - DNA, 17 bp, Homo sapiens
tcctttctccagccagc

SEQ ID NO: 3961207 - DNA, 15 bp, Homo sapiens
tcctttctttctaac

SEQ ID NO: 3961208 - DNA, 13 bp, Homo sapiens
tcctttgacattt

SEQ ID NO: 3961209 - DNA, 12 bp, Homo sapiens
tcctttgagaaa

SEQ ID NO: 3961210 - DNA, 14 bp, Homo sapiens
tcctttgcactgag

SEQ ID NO: 3961211 - DNA, 20 bp, Homo sapiens
tcctttgcactgagggccac

SEQ ID NO: 3961212 - DNA, 24 bp, Homo sapiens
tcctttgttcttacctgtatgtct

SEQ ID NO: 3961213 - DNA, 17 bp, Homo sapiens
tccttttattctgtacc

SEQ ID NO: 3961214 - DNA, 21 bp, Homo sapiens
tccttttcttccttctttctc

SEQ ID NO: 3961215 - DNA, 15 bp, Homo sapiens
tcctttttgcagtat

SEQ ID NO: 3961216 - DNA, 18 bp, Homo sapiens
tcgaaccaaggcagcctc

SEQ ID NO: 3961217 - DNA, 20 bp, Homo sapiens
tcgaaccaaggcagcctcca

SEQ ID NO: 3961218 - DNA, 19 bp, Homo sapiens
tcgaccccaaagccccttg

SEQ ID NO: 3961219 - DNA, 16 bp, Homo sapiens
tcgaccctttctctga

SEQ ID NO: 3961220 - DNA, 17 bp, Homo sapiens
tcgactttatacagaac

SEQ ID NO: 3961221 - DNA, 14 bp, Homo sapiens
tcgagacacttgcc

SEQ ID NO: 3961222 - DNA, 18 bp, Homo sapiens
tcgagaccaacctgacca

SEQ ID NO: 3961223 - DNA, 19 bp, Homo sapiens
tcgagaccatcctggcccc

SEQ ID NO: 3961224 - DNA, 13 bp, Homo sapiens
tcgagcccagatg

SEQ ID NO: 3961225 - DNA, 15 bp, Homo sapiens
tcgagcgccctgcag

SEQ ID NO: 3961226 - DNA, 23 bp, Homo sapiens
tcgaggtaggtggatcacctgag

SEQ ID NO: 3961227 - DNA, 20 bp, Homo sapiens
tcgaggtgtcaccctgcaga

SEQ ID NO: 3961228 - DNA, 21 bp, Homo sapiens
tcgatctgtactgtaattttg

SEQ ID NO: 3961229 - DNA, 17 bp, Homo sapiens
tcgcaccttttatacca

SEQ ID NO: 3961230 - DNA, 18 bp, Homo sapiens
tcgcagcaggtgcaagag

SEQ ID NO: 3961231 - DNA, 18 bp, Homo sapiens
tcgcagccaccctgagga

SEQ ID NO: 3961232 - DNA, 12 bp, Homo sapiens
tcgcagcctggc

SEQ ID NO: 3961233 - DNA, 13 bp, Homo sapiens
tcgcagcctggcg

SEQ ID NO: 3961234 - DNA, 21 bp, Homo sapiens
tcgcaggatccgctgccacca

SEQ ID NO: 3961235 - DNA, 20 bp, Homo sapiens
tcgcccacaagccttactca

SEQ ID NO: 3961236 - DNA, 11 bp, Homo sapiens
tcgccccaccc

SEQ ID NO: 3961237 - DNA, 13 bp, Homo sapiens
tcgccccacccag

SEQ ID NO: 3961238 - DNA, 14 bp, Homo sapiens
tcgccccacccagg

SEQ ID NO: 3961239 - DNA, 13 bp, Homo sapiens
tcgccccagactc

SEQ ID NO: 3961240 - DNA, 20 bp, Homo sapiens
tcgccccaggccctccctga

SEQ ID NO: 3961241 - DNA, 16 bp, Homo sapiens
tcgcctgggcccaggc

SEQ ID NO: 3961242 - DNA, 17 bp, Homo sapiens
tcgccttttaggctcag

SEQ ID NO: 3961243 - DNA, 14 bp, Homo sapiens
tcgctccccactct

SEQ ID NO: 3961244 - DNA, 19 bp, Homo sapiens
tcgctccctgtagctctgc

SEQ ID NO: 3961245 - DNA, 21 bp, Homo sapiens
tcgctccctgtagctctgcct

SEQ ID NO: 3961246 - DNA, 15 bp, Homo sapiens
tcgctctgctggcct

SEQ ID NO: 3961247 - DNA, 21 bp, Homo sapiens
tcgctctgctggcctggccgg

SEQ ID NO: 3961248 - DNA, 10 bp, Homo sapiens
tcgctgccag

SEQ ID NO: 3961249 - DNA, 12 bp, Homo sapiens
tcgctgccagga

SEQ ID NO: 3961250 - DNA, 14 bp, Homo sapiens
tcgctgccaggaca

SEQ ID NO: 3961251 - DNA, 20 bp, Homo sapiens
tcgctgccaggacacctgcc

SEQ ID NO: 3961252 - DNA, 23 bp, Homo sapiens
tcgctgccaggacacctgcccca

SEQ ID NO: 3961253 - DNA, 16 bp, Homo sapiens
tcgctgccttgccatg

SEQ ID NO: 3961254 - DNA, 18 bp, Homo sapiens
tcgctgctctagctggca

SEQ ID NO: 3961255 - DNA, 14 bp, Homo sapiens
tcgctgctgctact

SEQ ID NO: 3961256 - DNA, 22 bp, Homo sapiens
tcgctggaatcaatttcccaga

SEQ ID NO: 3961257 - DNA, 14 bp, Homo sapiens
tcgctggacaaccc

SEQ ID NO: 3961258 - DNA, 15 bp, Homo sapiens
tcgctggacaaccca

SEQ ID NO: 3961259 - DNA, 13 bp, Homo sapiens
tctctaagccaca

SEQ ID NO: 3961260 - DNA, 20 bp, Homo sapiens
tctctaagccacagcttctt

SEQ ID NO: 3961261 - DNA, 21 bp, Homo sapiens
tctctaagccacagcttcttc

SEQ ID NO: 3961262 - DNA, 22 bp, Homo sapiens
tctctaagtttagaagcgctca

SEQ ID NO: 3961263 - DNA, 20 bp, Homo sapiens
tctctacagacttctccaga

SEQ ID NO: 3961264 - DNA, 18 bp, Homo sapiens
tctctacccggcccagag

SEQ ID NO: 3961265 - DNA, 14 bp, Homo sapiens
tctctagagaacat

SEQ ID NO: 3961266 - DNA, 16 bp, Homo sapiens
tctctattcctgaccc

SEQ ID NO: 3961267 - DNA, 20 bp, Homo sapiens
tctctcaatatgcttacaaa

SEQ ID NO: 3961268 - DNA, 15 bp, Homo sapiens
tctctcaggagcaca

SEQ ID NO: 3961269 - DNA, 22 bp, Homo sapiens
tctctcaggagcacaggcagct

SEQ ID NO: 3961270 - DNA, 14 bp, Homo sapiens
tctctcattctctt

SEQ ID NO: 3961271 - DNA, 14 bp, Homo sapiens
tctctcccaccccg

SEQ ID NO: 3961272 - DNA, 22 bp, Homo sapiens
tctctcccaccccggcctccac

SEQ ID NO: 3961273 - DNA, 20 bp, Homo sapiens
tctctcccataccatcactg

SEQ ID NO: 3961274 - DNA, 14 bp, Homo sapiens
tctctcctcagact

SEQ ID NO: 3961275 - DNA, 22 bp, Homo sapiens
tctctcctgtataaccccacct

SEQ ID NO: 3961276 - DNA, 13 bp, Homo sapiens
tctctcctgtcca

SEQ ID NO: 3961277 - DNA, 19 bp, Homo sapiens
tctctcgggccccccacac

SEQ ID NO: 3961278 - DNA, 15 bp, Homo sapiens
tctctcggttccacg

SEQ ID NO: 3961279 - DNA, 18 bp, Homo sapiens
tctctcggttccacgtcc

SEQ ID NO: 3961280 - DNA, 14 bp, Homo sapiens
tctctctaaaaata

SEQ ID NO: 3961281 - DNA, 13 bp, Homo sapiens
tctctctcctgtc

SEQ ID NO: 3961282 - DNA, 14 bp, Homo sapiens
tctctctctacaaa

SEQ ID NO: 3961283 - DNA, 13 bp, Homo sapiens
tctctctctccct

SEQ ID NO: 3961284 - DNA, 19 bp, Homo sapiens
tctctctgcctatttattg

SEQ ID NO: 3961285 - DNA, 15 bp, Homo sapiens
tctctctggggccct

SEQ ID NO: 3961286 - DNA, 16 bp, Homo sapiens
tctctgaacagaaaac

SEQ ID NO: 3961287 - DNA, 20 bp, Homo sapiens
tctctgatgtgatatccact

SEQ ID NO: 3961288 - DNA, 15 bp, Homo sapiens
tctctgcagccagcc

SEQ ID NO: 3961289 - DNA, 17 bp, Homo sapiens
tctctgcagccagccca

SEQ ID NO: 3961290 - DNA, 13 bp, Homo sapiens
tctctgctccaga

SEQ ID NO: 3961291 - DNA, 18 bp, Homo sapiens
tctctgctccagagagag

SEQ ID NO: 3961292 - DNA, 17 bp, Homo sapiens
tctctgctctagccagg

SEQ ID NO: 3961293 - DNA, 18 bp, Homo sapiens
tctctgctctagccagga

SEQ ID NO: 3961294 - DNA, 14 bp, Homo sapiens
tctctggggccctg

SEQ ID NO: 3961295 - DNA, 23 bp, Homo sapiens
tctctggggccctgggcctcagt

SEQ ID NO: 3961296 - DNA, 24 bp, Homo sapiens
tctctgggtaggtgttgaaaatga

SEQ ID NO: 3961297 - DNA, 12 bp, Homo sapiens
tctctgtacaaa

SEQ ID NO: 3961298 - DNA, 18 bp, Homo sapiens
tctctgtacaaaaacaaa

SEQ ID NO: 3961299 - DNA, 15 bp, Homo sapiens
tctctgtataaacat

SEQ ID NO: 3961300 - DNA, 19 bp, Homo sapiens
tctctgtgcttcaattaat

SEQ ID NO: 3961301 - DNA, 21 bp, Homo sapiens
tctctgtgctttgactcacct

SEQ ID NO: 3961302 - DNA, 13 bp, Homo sapiens
tctcttcagcccc

SEQ ID NO: 3961303 - DNA, 23 bp, Homo sapiens
tctcttcagcccctagtgctatt

SEQ ID NO: 3961304 - DNA, 18 bp, Homo sapiens
tctcttccctccttccct

SEQ ID NO: 3961305 - DNA, 12 bp, Homo sapiens
tctcttcctctg

SEQ ID NO: 3961306 - DNA, 13 bp, Homo sapiens
tctcttcctctgt

SEQ ID NO: 3961307 - DNA, 11 bp, Homo sapiens
tctcttcctgt

SEQ ID NO: 3961308 - DNA, 16 bp, Homo sapiens
tctcttctccactgga

SEQ ID NO: 3961309 - DNA, 22 bp, Homo sapiens
tctcttttttcaactggctggg

SEQ ID NO: 3961310 - DNA, 16 bp, Homo sapiens
tctgaaaaacattcca

SEQ ID NO: 3961311 - DNA, 22 bp, Homo sapiens
tctgaaaagcaattgccctgta

SEQ ID NO: 3961312 - DNA, 14 bp, Homo sapiens
tctgaaagacagaa

SEQ ID NO: 3961313 - DNA, 12 bp, Homo sapiens
tctgaaagcaca

SEQ ID NO: 3961314 - DNA, 13 bp, Homo sapiens
tctgaaagcacag

SEQ ID NO: 3961315 - DNA, 15 bp, Homo sapiens
tctgaaatttcccac

SEQ ID NO: 3961316 - DNA, 15 bp, Homo sapiens
tctgaacaattctct

SEQ ID NO: 3961317 - DNA, 20 bp, Homo sapiens
tctgaagctattgatgtttc

SEQ ID NO: 3961318 - DNA, 20 bp, Homo sapiens
tctgaagcttcactcactgt

SEQ ID NO: 3961319 - DNA, 21 bp, Homo sapiens
tctgaagctttaccagctgaa

SEQ ID NO: 3961320 - DNA, 12 bp, Homo sapiens
tctgaaggagat

SEQ ID NO: 3961321 - DNA, 17 bp, Homo sapiens
tctgaaggcaaatataa

SEQ ID NO: 3961322 - DNA, 18 bp, Homo sapiens
tctgaaggcaaatataag

SEQ ID NO: 3961323 - DNA, 15 bp, Homo sapiens
tctgaagtcactgca

SEQ ID NO: 3961324 - DNA, 19 bp, Homo sapiens
tctgacaagataaaggaag

SEQ ID NO: 3961325 - DNA, 20 bp, Homo sapiens
tctgacaagggctgacctgc

SEQ ID NO: 3961326 - DNA, 21 bp, Homo sapiens
tctgacagccctgcggagacc

SEQ ID NO: 3961327 - DNA, 21 bp, Homo sapiens
tctgacccagtgagattacag

SEQ ID NO: 3961328 - DNA, 16 bp, Homo sapiens
tctgactcacaagaag

SEQ ID NO: 3961329 - DNA, 19 bp, Homo sapiens
tctgactccagagtctgag

SEQ ID NO: 3961330 - DNA, 20 bp, Homo sapiens
tctgactccagagtctgagc

SEQ ID NO: 3961331 - DNA, 21 bp, Homo sapiens
tctgactccagagtctgagcc

SEQ ID NO: 3961332 - DNA, 14 bp, Homo sapiens
tctgacttcctctg

SEQ ID NO: 3961333 - DNA, 15 bp, Homo sapiens
tctgacttcctctga

SEQ ID NO: 3961334 - DNA, 9 bp, Homo sapiens
tctgagaaa

SEQ ID NO: 3961335 - DNA, 22 bp, Homo sapiens
tctgagaaaagaacgtatttta

SEQ ID NO: 3961336 - DNA, 18 bp, Homo sapiens
tctgagagttggctcagg

SEQ ID NO: 3961337 - DNA, 20 bp, Homo sapiens
tctgagagttggctcaggca

SEQ ID NO: 3961338 - DNA, 22 bp, Homo sapiens
tctgagagttggctcaggcaga

SEQ ID NO: 3961339 - DNA, 16 bp, Homo sapiens
tctgagcaccccctca

SEQ ID NO: 3961340 - DNA, 21 bp, Homo sapiens
tctgagcaccccctcattccc

SEQ ID NO: 3961341 - DNA, 12 bp, Homo sapiens
tctgagcccagg

SEQ ID NO: 3961342 - DNA, 13 bp, Homo sapiens
tctgagcccaggc

SEQ ID NO: 3961343 - DNA, 15 bp, Homo sapiens
tctgagcccaggccg

SEQ ID NO: 3961344 - DNA, 21 bp, Homo sapiens
tctgagcttttcatggaagtg

SEQ ID NO: 3961345 - DNA, 12 bp, Homo sapiens
tctgaggccagc

SEQ ID NO: 3961346 - DNA, 14 bp, Homo sapiens
tctgaggccagcct

SEQ ID NO: 3961347 - DNA, 17 bp, Homo sapiens
tctgaggccagcctggc

SEQ ID NO: 3961348 - DNA, 14 bp, Homo sapiens
tctgaggtcctgag

SEQ ID NO: 3961349 - DNA, 16 bp, Homo sapiens
tctgaggtcctgagca

SEQ ID NO: 3961350 - DNA, 17 bp, Homo sapiens
tctgaggtcctgagcac

SEQ ID NO: 3961351 - DNA, 21 bp, Homo sapiens
tctgaggtcctgagcactgcc

SEQ ID NO: 3961352 - DNA, 24 bp, Homo sapiens
tctgagtgtttttactacagttgt

SEQ ID NO: 3961353 - DNA, 15 bp, Homo sapiens
tctgagtttcattct

SEQ ID NO: 3961354 - DNA, 22 bp, Homo sapiens
tctgagtttcattctcctgcct

SEQ ID NO: 3961355 - DNA, 21 bp, Homo sapiens
tctgataaaattgtgatgttt

SEQ ID NO: 3961356 - DNA, 13 bp, Homo sapiens
tctgatatgggac

SEQ ID NO: 3961357 - DNA, 15 bp, Homo sapiens
tctgatatgggactg

SEQ ID NO: 3961358 - DNA, 21 bp, Homo sapiens
tctgatcgggataacaaaatc

SEQ ID NO: 3961359 - DNA, 20 bp, Homo sapiens
tctgatggtgagctgggaag

SEQ ID NO: 3961360 - DNA, 18 bp, Homo sapiens
tctgatgtttgttgctag

SEQ ID NO: 3961361 - DNA, 18 bp, Homo sapiens
tctgattcactattagag

SEQ ID NO: 3961362 - DNA, 13 bp, Homo sapiens
tctgattccactt

SEQ ID NO: 3961363 - DNA, 18 bp, Homo sapiens
tctgattggctcacccaa

SEQ ID NO: 3961364 - DNA, 12 bp, Homo sapiens
tctgatttaatg

SEQ ID NO: 3961365 - DNA, 17 bp, Homo sapiens
tctgatttaatgttttc

SEQ ID NO: 3961366 - DNA, 17 bp, Homo sapiens
tctgatttttttgttgt

SEQ ID NO: 3961367 - DNA, 19 bp, Homo sapiens
tctgatttttttgttgttg

SEQ ID NO: 3961368 - DNA, 17 bp, Homo sapiens
tctgcaactagccaagg

SEQ ID NO: 3961369 - DNA, 19 bp, Homo sapiens
tctgcaactagccaaggct

SEQ ID NO: 3961370 - DNA, 16 bp, Homo sapiens
tctgcaatgggcactg

SEQ ID NO: 3961371 - DNA, 19 bp, Homo sapiens
tctgcacccagaaattcct

SEQ ID NO: 3961372 - DNA, 13 bp, Homo sapiens
tctgcacccaggg

SEQ ID NO: 3961373 - DNA, 13 bp, Homo sapiens
tctgcactccatg

SEQ ID NO: 3961374 - DNA, 15 bp, Homo sapiens
tctgcactccatggc

SEQ ID NO: 3961375 - DNA, 17 bp, Homo sapiens
tctgcactccatggcca

SEQ ID NO: 3961376 - DNA, 19 bp, Homo sapiens
tctgcactccatggccacc

SEQ ID NO: 3961377 - DNA, 12 bp, Homo sapiens
tctgcactgaaa

SEQ ID NO: 3961378 - DNA, 16 bp, Homo sapiens
tctgcactgaaaaggt

SEQ ID NO: 3961379 - DNA, 13 bp, Homo sapiens
tctgcactgggtg

SEQ ID NO: 3961380 - DNA, 12 bp, Homo sapiens
tctgcagagcag

SEQ ID NO: 3961381 - DNA, 14 bp, Homo sapiens
tctgcagcaactcc

SEQ ID NO: 3961382 - DNA, 19 bp, Homo sapiens
tctgcagcaactcccacga

SEQ ID NO: 3961383 - DNA, 21 bp, Homo sapiens
tctgcagcactttaaccctct

SEQ ID NO: 3961384 - DNA, 16 bp, Homo sapiens
tgacagtgttgaaaat

SEQ ID NO: 3961385 - DNA, 16 bp, Homo sapiens
tgacatcacttgtaca

SEQ ID NO: 3961386 - DNA, 17 bp, Homo sapiens
tgacatcacttgtacaa

SEQ ID NO: 3961387 - DNA, 19 bp, Homo sapiens
tgacatcacttgtacaaaa

SEQ ID NO: 3961388 - DNA, 20 bp, Homo sapiens
tgacatcacttgtacaaaat

SEQ ID NO: 3961389 - DNA, 15 bp, Homo sapiens
tgacatcttatttac

SEQ ID NO: 3961390 - DNA, 14 bp, Homo sapiens
tgacatgcactgac

SEQ ID NO: 3961391 - DNA, 17 bp, Homo sapiens
tgacatgccaccctctc

SEQ ID NO: 3961392 - DNA, 20 bp, Homo sapiens
tgacatgccatccattctgc

SEQ ID NO: 3961393 - DNA, 15 bp, Homo sapiens
tgacatgtgcctgta

SEQ ID NO: 3961394 - DNA, 19 bp, Homo sapiens
tgacatgttatatattttt

SEQ ID NO: 3961395 - DNA, 15 bp, Homo sapiens
tgacattcaaggcat

SEQ ID NO: 3961396 - DNA, 14 bp, Homo sapiens
tgacattcattttc

SEQ ID NO: 3961397 - DNA, 19 bp, Homo sapiens
tgacattgtatgtatctat

SEQ ID NO: 3961398 - DNA, 12 bp, Homo sapiens
tgacatttctaa

SEQ ID NO: 3961399 - DNA, 23 bp, Homo sapiens
tgaccaacaggctgttctgcact

SEQ ID NO: 3961400 - DNA, 20 bp, Homo sapiens
tgaccaacatggagaaaccc

SEQ ID NO: 3961401 - DNA, 15 bp, Homo sapiens
tgaccaagagagaaa

SEQ ID NO: 3961402 - DNA, 18 bp, Homo sapiens
tgaccaagagagaaagaa

SEQ ID NO: 3961403 - DNA, 23 bp, Homo sapiens
tgaccacggacgtttccatcagg

SEQ ID NO: 3961404 - DNA, 19 bp, Homo sapiens
tgaccacgggcctcagttt

SEQ ID NO: 3961405 - DNA, 18 bp, Homo sapiens
tgaccagacctagacctg

SEQ ID NO: 3961406 - DNA, 16 bp, Homo sapiens
tgaccagttctggcca

SEQ ID NO: 3961407 - DNA, 18 bp, Homo sapiens
tgaccagttctggccagg

SEQ ID NO: 3961408 - DNA, 15 bp, Homo sapiens
tgacccaagaggtgg

SEQ ID NO: 3961409 - DNA, 19 bp, Homo sapiens
tgacccactcacacttgga

SEQ ID NO: 3961410 - DNA, 16 bp, Homo sapiens
tgacccagtccctggg

SEQ ID NO: 3961411 - DNA, 16 bp, Homo sapiens
tgacccatgttccctt

SEQ ID NO: 3961412 - DNA, 19 bp, Homo sapiens
tgaccccaaagagcctgga

SEQ ID NO: 3961413 - DNA, 22 bp, Homo sapiens
tgaccccaaagagcctggagaa

SEQ ID NO: 3961414 - DNA, 12 bp, Homo sapiens
tgaccccagggc

SEQ ID NO: 3961415 - DNA, 20 bp, Homo sapiens
tgaccccagggcacaggagc

SEQ ID NO: 3961416 - DNA, 22 bp, Homo sapiens
tgaccccagggcacaggagcta

SEQ ID NO: 3961417 - DNA, 22 bp, Homo sapiens
tgacccctggccggcccaggcc

SEQ ID NO: 3961418 - DNA, 21 bp, Homo sapiens
tgacccggcaccccctgcagc

SEQ ID NO: 3961419 - DNA, 23 bp, Homo sapiens
tgaccctctgaatggtccagggt

SEQ ID NO: 3961420 - DNA, 13 bp, Homo sapiens
tgacccttcaggg

SEQ ID NO: 3961421 - DNA, 16 bp, Homo sapiens
tgacccttcagggcca

SEQ ID NO: 3961422 - DNA, 19 bp, Homo sapiens
tgacccttcccaatcagca

SEQ ID NO: 3961423 - DNA, 15 bp, Homo sapiens
tgacctcacagtgac

SEQ ID NO: 3961424 - DNA, 16 bp, Homo sapiens
tgacctcagctgcaca

SEQ ID NO: 3961425 - DNA, 16 bp, Homo sapiens
tgacctcccagcccta

SEQ ID NO: 3961426 - DNA, 13 bp, Homo sapiens
tgacctccccacc

SEQ ID NO: 3961427 - DNA, 21 bp, Homo sapiens
tgacctgaccggcacctgcga

SEQ ID NO: 3961428 - DNA, 18 bp, Homo sapiens
tgacctgaggctcctgtg

SEQ ID NO: 3961429 - DNA, 21 bp, Homo sapiens
tgacctgcctctcacacacat

SEQ ID NO: 3961430 - DNA, 15 bp, Homo sapiens
tgacctgctgagctc

SEQ ID NO: 3961431 - DNA, 21 bp, Homo sapiens
tgaagccccttgtcctctccc

SEQ ID NO: 3961432 - DNA, 15 bp, Homo sapiens
tgaagcctatttatt

SEQ ID NO: 3961433 - DNA, 19 bp, Homo sapiens
tgaagcctttttttagtaa

SEQ ID NO: 3961434 - DNA, 16 bp, Homo sapiens
tgaagctattgatgtt

SEQ ID NO: 3961435 - DNA, 13 bp, Homo sapiens
tgaagctgtaccc

SEQ ID NO: 3961436 - DNA, 22 bp, Homo sapiens
tgaagcttcactcactgtcaat

SEQ ID NO: 3961437 - DNA, 19 bp, Homo sapiens
tgaaggaatagccagagag

SEQ ID NO: 3961438 - DNA, 19 bp, Homo sapiens
tgaaggaatagcccgagga

SEQ ID NO: 3961439 - DNA, 20 bp, Homo sapiens
tgaaggagagcccttcattt

SEQ ID NO: 3961440 - DNA, 18 bp, Homo sapiens
tgaaggagccacgtgaat

SEQ ID NO: 3961441 - DNA, 13 bp, Homo sapiens
tgaaggaggtgag

SEQ ID NO: 3961442 - DNA, 18 bp, Homo sapiens
tgaaggcagtctgaaccc

SEQ ID NO: 3961443 - DNA, 20 bp, Homo sapiens
tgaaggccttcaacccgaga

SEQ ID NO: 3961444 - DNA, 15 bp, Homo sapiens
tgaaggcgtgcaagg

SEQ ID NO: 3961445 - DNA, 22 bp, Homo sapiens
tgaaggcgtgcaaggggctcag

SEQ ID NO: 3961446 - DNA, 20 bp, Homo sapiens
tgaagggaccttgaagggta

SEQ ID NO: 3961447 - DNA, 22 bp, Homo sapiens
tgaaggggcacaccactgccct

SEQ ID NO: 3961448 - DNA, 15 bp, Homo sapiens
tgaagggggcggcct

SEQ ID NO: 3961449 - DNA, 18 bp, Homo sapiens
tgaagggtgacatcccag

SEQ ID NO: 3961450 - DNA, 15 bp, Homo sapiens
tgaaggttaggattt

SEQ ID NO: 3961451 - DNA, 16 bp, Homo sapiens
tgaaggttaggattta

SEQ ID NO: 3961452 - DNA, 19 bp, Homo sapiens
tgaagtaaaggattgatca

SEQ ID NO: 3961453 - DNA, 22 bp, Homo sapiens
tgaagtaaccttataggttact

SEQ ID NO: 3961454 - DNA, 14 bp, Homo sapiens
tgaagtagtttgta

SEQ ID NO: 3961455 - DNA, 21 bp, Homo sapiens
tgaagtcactgcacagtgcat

SEQ ID NO: 3961456 - DNA, 17 bp, Homo sapiens
tgaagtcgttgtgaggg

SEQ ID NO: 3961457 - DNA, 18 bp, Homo sapiens
tgaagtgtgtttccttca

SEQ ID NO: 3961458 - DNA, 20 bp, Homo sapiens
tgaagttacacaattaattg

SEQ ID NO: 3961459 - DNA, 16 bp, Homo sapiens
tgaagttcatggtgat

SEQ ID NO: 3961460 - DNA, 14 bp, Homo sapiens
tgaagtttctgtag

SEQ ID NO: 3961461 - DNA, 13 bp, Homo sapiens
tgaataaacttca

SEQ ID NO: 3961462 - DNA, 14 bp, Homo sapiens
tgaataaacttcag

SEQ ID NO: 3961463 - DNA, 18 bp, Homo sapiens
tgaataaagcctgctttt

SEQ ID NO: 3961464 - DNA, 18 bp, Homo sapiens
tgaatacccccagagacc

SEQ ID NO: 3961465 - DNA, 15 bp, Homo sapiens
tgaatacttggaagt

SEQ ID NO: 3961466 - DNA, 16 bp, Homo sapiens
tgaatagatgtgatca

SEQ ID NO: 3961467 - DNA, 17 bp, Homo sapiens
tgaatattaatcccagc

SEQ ID NO: 3961468 - DNA, 16 bp, Homo sapiens
tgaatattttgtaata

SEQ ID NO: 3961469 - DNA, 16 bp, Homo sapiens
tgaatcagaccctacc

SEQ ID NO: 3961470 - DNA, 21 bp, Homo sapiens
tgaatcagaccctaccccacc

SEQ ID NO: 3961471 - DNA, 14 bp, Homo sapiens
tgaatcatgttaat

SEQ ID NO: 3961472 - DNA, 17 bp, Homo sapiens
tgaatctgataggaaaa

SEQ ID NO: 3961473 - DNA, 18 bp, Homo sapiens
tgaatctgataggaaaag

SEQ ID NO: 3961474 - DNA, 17 bp, Homo sapiens
tgaatctgttactgaaa

SEQ ID NO: 3961475 - DNA, 18 bp, Homo sapiens
tgaatctgttactgaaat

SEQ ID NO: 3961476 - DNA, 22 bp, Homo sapiens
tcttcaataaattaagttttat

SEQ ID NO: 3961477 - DNA, 23 bp, Homo sapiens
tcttcacctgggcgccaactgct

SEQ ID NO: 3961478 - DNA, 21 bp, Homo sapiens
tcttcactgccatgcctcaag

SEQ ID NO: 3961479 - DNA, 13 bp, Homo sapiens
tcttcagccatca

SEQ ID NO: 3961480 - DNA, 14 bp, Homo sapiens
tcttcagctcccat

SEQ ID NO: 3961481 - DNA, 15 bp, Homo sapiens
tcttcagctcccata

SEQ ID NO: 3961482 - DNA, 13 bp, Homo sapiens
tcttcaggaggcc

SEQ ID NO: 3961483 - DNA, 20 bp, Homo sapiens
tcttcaggaggccctggtgt

SEQ ID NO: 3961484 - DNA, 21 bp, Homo sapiens
tcttcaggaggccctggtgtc

SEQ ID NO: 3961485 - DNA, 16 bp, Homo sapiens
tcttcagggtgagtga

SEQ ID NO: 3961486 - DNA, 13 bp, Homo sapiens
tcttcatcttgac

SEQ ID NO: 3961487 - DNA, 19 bp, Homo sapiens
tcttccaaccccagctggc

SEQ ID NO: 3961488 - DNA, 18 bp, Homo sapiens
tcttccaagcaaaggtga

SEQ ID NO: 3961489 - DNA, 18 bp, Homo sapiens
tcttccagagcctaagaa

SEQ ID NO: 3961490 - DNA, 19 bp, Homo sapiens
tcttccagagcctaagaaa

SEQ ID NO: 3961491 - DNA, 17 bp, Homo sapiens
tcttccagtgcaacaaa

SEQ ID NO: 3961492 - DNA, 16 bp, Homo sapiens
tcttcccatcactgga

SEQ ID NO: 3961493 - DNA, 23 bp, Homo sapiens
tcttcccccacccctaacctggc

SEQ ID NO: 3961494 - DNA, 22 bp, Homo sapiens
tcttccccttgcccttgccctg

SEQ ID NO: 3961495 - DNA, 19 bp, Homo sapiens
tcttcctagttttctcctc

SEQ ID NO: 3961496 - DNA, 23 bp, Homo sapiens
tcttcctagttttctcctcccag

SEQ ID NO: 3961497 - DNA, 12 bp, Homo sapiens
tcttcctcctgg

SEQ ID NO: 3961498 - DNA, 12 bp, Homo sapiens
tcttcctctgct

SEQ ID NO: 3961499 - DNA, 15 bp, Homo sapiens
tcttcctgctgctgt

SEQ ID NO: 3961500 - DNA, 14 bp, Homo sapiens
tcttccttccccca

SEQ ID NO: 3961501 - DNA, 11 bp, Homo sapiens
tcttccttccg

SEQ ID NO: 3961502 - DNA, 18 bp, Homo sapiens
tcttccttctttctcttc

SEQ ID NO: 3961503 - DNA, 20 bp, Homo sapiens
tcttcggtgtttaaagtcaa

SEQ ID NO: 3961504 - DNA, 17 bp, Homo sapiens
tcttcggtttctgagca

SEQ ID NO: 3961505 - DNA, 14 bp, Homo sapiens
tcttcgtcctgccc

SEQ ID NO: 3961506 - DNA, 15 bp, Homo sapiens
tcttctaaaattgaa

SEQ ID NO: 3961507 - DNA, 22 bp, Homo sapiens
tcttctaaaattgaagagattt

SEQ ID NO: 3961508 - DNA, 18 bp, Homo sapiens
tcttctacaaccagagcc

SEQ ID NO: 3961509 - DNA, 19 bp, Homo sapiens
tcttctacgtataaatatg

SEQ ID NO: 3961510 - DNA, 13 bp, Homo sapiens
tcttctatttaaa

SEQ ID NO: 3961511 - DNA, 16 bp, Homo sapiens
tcttctatttaaaaaa

SEQ ID NO: 3961512 - DNA, 13 bp, Homo sapiens
tcttctattttgt

SEQ ID NO: 3961513 - DNA, 12 bp, Homo sapiens
tcttctccactg

SEQ ID NO: 3961514 - DNA, 16 bp, Homo sapiens
tcttctccactggatg

SEQ ID NO: 3961515 - DNA, 19 bp, Homo sapiens
tcttctggagtctccagtg

SEQ ID NO: 3961516 - DNA, 14 bp, Homo sapiens
tcttcttcagaaga

SEQ ID NO: 3961517 - DNA, 14 bp, Homo sapiens
tcttcttcttcaga

SEQ ID NO: 3961518 - DNA, 15 bp, Homo sapiens
tcttcttcttcagaa

SEQ ID NO: 3961519 - DNA, 17 bp, Homo sapiens
tcttctttttttgtgat

SEQ ID NO: 3961520 - DNA, 15 bp, Homo sapiens
tcttgaattcctggg

SEQ ID NO: 3961521 - DNA, 15 bp, Homo sapiens
tgaaaagactccaaa

SEQ ID NO: 3961522 - DNA, 16 bp, Homo sapiens
tgaaaaggcaaaaagc

SEQ ID NO: 3961523 - DNA, 21 bp, Homo sapiens
tgaaaaggttcttcatccctt

SEQ ID NO: 3961524 - DNA, 20 bp, Homo sapiens
tgaaaatatgatgtttcaca

SEQ ID NO: 3961525 - DNA, 21 bp, Homo sapiens
tgaaaatatttgtatcacaaa

SEQ ID NO: 3961526 - DNA, 13 bp, Homo sapiens
tgaaaatcaaagt

SEQ ID NO: 3961527 - DNA, 17 bp, Homo sapiens
tgaaaatcaaagtaaaa

SEQ ID NO: 3961528 - DNA, 14 bp, Homo sapiens
tgaaaatctaatat

SEQ ID NO: 3961529 - DNA, 17 bp, Homo sapiens
tgaaaatctaatattaa

SEQ ID NO: 3961530 - DNA, 16 bp, Homo sapiens
tgaaaatgagcctgta

SEQ ID NO: 3961531 - DNA, 16 bp, Homo sapiens
tgaaaatgttgttatg

SEQ ID NO: 3961532 - DNA, 22 bp, Homo sapiens
tgaaacaacaaataggaattgt

SEQ ID NO: 3961533 - DNA, 14 bp, Homo sapiens
tgaaacagaaacaa

SEQ ID NO: 3961534 - DNA, 18 bp, Homo sapiens
tgaaacagatgataaata

SEQ ID NO: 3961535 - DNA, 19 bp, Homo sapiens
tgaaacagatgataaatat

SEQ ID NO: 3961536 - DNA, 17 bp, Homo sapiens
tgaaacagcctgggtga

SEQ ID NO: 3961537 - DNA, 20 bp, Homo sapiens
tgaaacattccgaagaggga

SEQ ID NO: 3961538 - DNA, 20 bp, Homo sapiens
tgaaacccattaggcatgcc

SEQ ID NO: 3961539 - DNA, 14 bp, Homo sapiens
tgaaaccctgtctc

SEQ ID NO: 3961540 - DNA, 21 bp, Homo sapiens
tgaaactatggctttaaacta

SEQ ID NO: 3961541 - DNA, 19 bp, Homo sapiens
tgaaactcctgattttgta

SEQ ID NO: 3961542 - DNA, 17 bp, Homo sapiens
tgaaactggggcttgca

SEQ ID NO: 3961543 - DNA, 23 bp, Homo sapiens
tgaaactggggcttgcaagagga

SEQ ID NO: 3961544 - DNA, 16 bp, Homo sapiens
tgaaagaattattttt

SEQ ID NO: 3961545 - DNA, 18 bp, Homo sapiens
tgaaagaattatttttgt

SEQ ID NO: 3961546 - DNA, 20 bp, Homo sapiens
tgaaagagtagtgcatttaa

SEQ ID NO: 3961547 - DNA, 19 bp, Homo sapiens
tgaaagatggctgtgcctc

SEQ ID NO: 3961548 - DNA, 21 bp, Homo sapiens
tgaaagatggctgtgcctctg

SEQ ID NO: 3961549 - DNA, 22 bp, Homo sapiens
tgaaagcagcagctaggactga

SEQ ID NO: 3961550 - DNA, 15 bp, Homo sapiens
tgaaagcctctggaa

SEQ ID NO: 3961551 - DNA, 22 bp, Homo sapiens
tgaaagggctatggcaaggggg

SEQ ID NO: 3961552 - DNA, 19 bp, Homo sapiens
tgaaaggttaccctgtaac

SEQ ID NO: 3961553 - DNA, 21 bp, Homo sapiens
tgaaagtatattttcctccca

SEQ ID NO: 3961554 - DNA, 14 bp, Homo sapiens
tgaaagtatgtgat

SEQ ID NO: 3961555 - DNA, 16 bp, Homo sapiens
tgaaagtctgtgtcca

SEQ ID NO: 3961556 - DNA, 18 bp, Homo sapiens
tgaaagtgaataaacttc

SEQ ID NO: 3961557 - DNA, 21 bp, Homo sapiens
tgaaagtgaataaacttcagc

SEQ ID NO: 3961558 - DNA, 11 bp, Homo sapiens
tgaaagtgact

SEQ ID NO: 3961559 - DNA, 20 bp, Homo sapiens
tgaaataaattggtgataag

SEQ ID NO: 3961560 - DNA, 19 bp, Homo sapiens
tgaaatatttaagtatata

SEQ ID NO: 3961561 - DNA, 14 bp, Homo sapiens
tgaaatcctgcttc

SEQ ID NO: 3961562 - DNA, 18 bp, Homo sapiens
tgaaatcttaaaaacctg

SEQ ID NO: 3961563 - DNA, 16 bp, Homo sapiens
tgaaatgctctccttt

SEQ ID NO: 3961564 - DNA, 19 bp, Homo sapiens
tctgggagtgttctgtttc

SEQ ID NO: 3961565 - DNA, 20 bp, Homo sapiens
tctgggcagtaaatccacag

SEQ ID NO: 3961566 - DNA, 16 bp, Homo sapiens
tctgggctcagggctg

SEQ ID NO: 3961567 - DNA, 21 bp, Homo sapiens
tctgggctcctggaaccaatc

SEQ ID NO: 3961568 - DNA, 22 bp, Homo sapiens
tctgggctcctggaaccaatcc

SEQ ID NO: 3961569 - DNA, 14 bp, Homo sapiens
tctggggccctggg

SEQ ID NO: 3961570 - DNA, 19 bp, Homo sapiens
tctggggccctgggcctca

SEQ ID NO: 3961571 - DNA, 20 bp, Homo sapiens
tctggggccctgggcctcag

SEQ ID NO: 3961572 - DNA, 21 bp, Homo sapiens
tctggggttcagcccctcctc

SEQ ID NO: 3961573 - DNA, 17 bp, Homo sapiens
tctgggtccctcggagc

SEQ ID NO: 3961574 - DNA, 13 bp, Homo sapiens
tctgggtggcctc

SEQ ID NO: 3961575 - DNA, 23 bp, Homo sapiens
tctggtatgaacttgaggacaca

SEQ ID NO: 3961576 - DNA, 17 bp, Homo sapiens
tctggtgcctatttatt

SEQ ID NO: 3961577 - DNA, 16 bp, Homo sapiens
tctggtgtagctcctc

SEQ ID NO: 3961578 - DNA, 18 bp, Homo sapiens
tctggtgtagctcctctg

SEQ ID NO: 3961579 - DNA, 21 bp, Homo sapiens
tctggttgttgcaccatctgc

SEQ ID NO: 3961580 - DNA, 13 bp, Homo sapiens
tctggttttaaca

SEQ ID NO: 3961581 - DNA, 12 bp, Homo sapiens
tctgtactgtaa

SEQ ID NO: 3961582 - DNA, 13 bp, Homo sapiens
tctgtactgtaat

SEQ ID NO: 3961583 - DNA, 18 bp, Homo sapiens
tctgtagaaagaatgtgt

SEQ ID NO: 3961584 - DNA, 22 bp, Homo sapiens
tctgtataaacattaaatgtct

SEQ ID NO: 3961585 - DNA, 17 bp, Homo sapiens
tctgtataatctattta

SEQ ID NO: 3961586 - DNA, 20 bp, Homo sapiens
tctgtatatgttgtaataaa

SEQ ID NO: 3961587 - DNA, 21 bp, Homo sapiens
tctgtatatgttgtaataaaa

SEQ ID NO: 3961588 - DNA, 14 bp, Homo sapiens
tctgtcaatgaaaa

SEQ ID NO: 3961589 - DNA, 19 bp, Homo sapiens
tctgtcaccaattggttaa

SEQ ID NO: 3961590 - DNA, 16 bp, Homo sapiens
tctgtcacccaggctg

SEQ ID NO: 3961591 - DNA, 13 bp, Homo sapiens
tctgtcagccagc

SEQ ID NO: 3961592 - DNA, 21 bp, Homo sapiens
tctgtcagcgcaggtttagtt

SEQ ID NO: 3961593 - DNA, 15 bp, Homo sapiens
tctgtcatcactccc

SEQ ID NO: 3961594 - DNA, 18 bp, Homo sapiens
tctgtcatcactccctgg

SEQ ID NO: 3961595 - DNA, 20 bp, Homo sapiens
tctgtcatcactccctggat

SEQ ID NO: 3961596 - DNA, 18 bp, Homo sapiens
tctgtcatctctctgggg

SEQ ID NO: 3961597 - DNA, 21 bp, Homo sapiens
tctgtcatctctctggggccc

SEQ ID NO: 3961598 - DNA, 23 bp, Homo sapiens
tctgtccaggacatgatactgat

SEQ ID NO: 3961599 - DNA, 17 bp, Homo sapiens
tctgtccaggccactgt

SEQ ID NO: 3961600 - DNA, 16 bp, Homo sapiens
tctgtcccctctcccc

SEQ ID NO: 3961601 - DNA, 20 bp, Homo sapiens
tctgtccgtttactccaagg

SEQ ID NO: 3961602 - DNA, 21 bp, Homo sapiens
tctgtctcgagcgccctgcag

SEQ ID NO: 3961603 - DNA, 12 bp, Homo sapiens
tctgtctctctt

SEQ ID NO: 3961604 - DNA, 14 bp, Homo sapiens
tctgtctgtcccaa

SEQ ID NO: 3961605 - DNA, 18 bp, Homo sapiens
tctgtctgtctgtcccaa

SEQ ID NO: 3961606 - DNA, 15 bp, Homo sapiens
tctgtcttcacaaca

SEQ ID NO: 3961607 - DNA, 13 bp, Homo sapiens
tctgtctttgtgg

SEQ ID NO: 3961608 - DNA, 13 bp, Homo sapiens
tctgtgaattaaa

SEQ ID NO: 3961609 - DNA, 22 bp, Homo sapiens
tctgtgaattaaaaaagctcaa

SEQ ID NO: 3961610 - DNA, 14 bp, Homo sapiens
tctccaattgtaaa

SEQ ID NO: 3961611 - DNA, 16 bp, Homo sapiens
tctccaattgtaaaaa

SEQ ID NO: 3961612 - DNA, 11 bp, Homo sapiens
tctccacctca

SEQ ID NO: 3961613 - DNA, 15 bp, Homo sapiens
tctccacctcagcct

SEQ ID NO: 3961614 - DNA, 16 bp, Homo sapiens
tctccacctcagcctt

SEQ ID NO: 3961615 - DNA, 18 bp, Homo sapiens
tctccactgaggatgtga

SEQ ID NO: 3961616 - DNA, 17 bp, Homo sapiens
tctccagaggccaagga

SEQ ID NO: 3961617 - DNA, 12 bp, Homo sapiens
tctccagcccac

SEQ ID NO: 3961618 - DNA, 18 bp, Homo sapiens
tctccagcccacacccct

SEQ ID NO: 3961619 - DNA, 19 bp, Homo sapiens
tctccaggatggtgcagga

SEQ ID NO: 3961620 - DNA, 22 bp, Homo sapiens
tctccaggatggtgcaggatgg

SEQ ID NO: 3961621 - DNA, 17 bp, Homo sapiens
tctccaggcaccatctc

SEQ ID NO: 3961622 - DNA, 17 bp, Homo sapiens
tctccaggcacccttct

SEQ ID NO: 3961623 - DNA, 23 bp, Homo sapiens
tctccaggcacccttctttcctc

SEQ ID NO: 3961624 - DNA, 24 bp, Homo sapiens
tctccagggctgcccctgtaggtt

SEQ ID NO: 3961625 - DNA, 19 bp, Homo sapiens
tctccagtatccactttgc

SEQ ID NO: 3961626 - DNA, 18 bp, Homo sapiens
tctccagtggttgctgtt

SEQ ID NO: 3961627 - DNA, 15 bp, Homo sapiens
tctccagttttcagt

SEQ ID NO: 3961628 - DNA, 15 bp, Homo sapiens
tctccatatctcctt

SEQ ID NO: 3961629 - DNA, 18 bp, Homo sapiens
tctccattctagatgctt

SEQ ID NO: 3961630 - DNA, 16 bp, Homo sapiens
tctccatttcacacag

SEQ ID NO: 3961631 - DNA, 17 bp, Homo sapiens
tctcccaggccccatga

SEQ ID NO: 3961632 - DNA, 18 bp, Homo sapiens
tctcccataccatcactg

SEQ ID NO: 3961633 - DNA, 12 bp, Homo sapiens
tctccccactga

SEQ ID NO: 3961634 - DNA, 14 bp, Homo sapiens
tctccccaggcctc

SEQ ID NO: 3961635 - DNA, 13 bp, Homo sapiens
tctcccctctgcc

SEQ ID NO: 3961636 - DNA, 17 bp, Homo sapiens
tctcccctgccctgctg

SEQ ID NO: 3961637 - DNA, 15 bp, Homo sapiens
tctcccggctgcctg

SEQ ID NO: 3961638 - DNA, 17 bp, Homo sapiens
tctcccggctgcctgcc

SEQ ID NO: 3961639 - DNA, 13 bp, Homo sapiens
tctccctaaaata

SEQ ID NO: 3961640 - DNA, 18 bp, Homo sapiens
tctccctaaaataaaaac

SEQ ID NO: 3961641 - DNA, 19 bp, Homo sapiens
tctccctaaaataaaaacc

SEQ ID NO: 3961642 - DNA, 19 bp, Homo sapiens
tctccctaaggaatctgaa

SEQ ID NO: 3961643 - DNA, 19 bp, Homo sapiens
tctccctcacccccaggtg

SEQ ID NO: 3961644 - DNA, 21 bp, Homo sapiens
tctccctccagggaatccgcc

SEQ ID NO: 3961645 - DNA, 15 bp, Homo sapiens
tctccctctcctgcc

SEQ ID NO: 3961646 - DNA, 13 bp, Homo sapiens
tctgcagggagca

SEQ ID NO: 3961647 - DNA, 18 bp, Homo sapiens
tctgcagtagtctctgtg

SEQ ID NO: 3961648 - DNA, 20 bp, Homo sapiens
tctgcagtagtctctgtgct

SEQ ID NO: 3961649 - DNA, 15 bp, Homo sapiens
tctgcattccccgct

SEQ ID NO: 3961650 - DNA, 22 bp, Homo sapiens
tctgcattgttattgtggaaga

SEQ ID NO: 3961651 - DNA, 23 bp, Homo sapiens
tctgcattgttattgtggaagat

SEQ ID NO: 3961652 - DNA, 13 bp, Homo sapiens
tctgccacagaga

SEQ ID NO: 3961653 - DNA, 23 bp, Homo sapiens
tctgccacagagagtcctttggg

SEQ ID NO: 3961654 - DNA, 13 bp, Homo sapiens
tctgccagcccat

SEQ ID NO: 3961655 - DNA, 12 bp, Homo sapiens
tctgccaggccc

SEQ ID NO: 3961656 - DNA, 17 bp, Homo sapiens
tctgccccaagcagcca

SEQ ID NO: 3961657 - DNA, 19 bp, Homo sapiens
tctgccccaagcagccagc

SEQ ID NO: 3961658 - DNA, 16 bp, Homo sapiens
tctgccccaagccccc

SEQ ID NO: 3961659 - DNA, 12 bp, Homo sapiens
tctgccccaagg

SEQ ID NO: 3961660 - DNA, 17 bp, Homo sapiens
tctgccccacccaccta

SEQ ID NO: 3961661 - DNA, 16 bp, Homo sapiens
tctgccccagctttat

SEQ ID NO: 3961662 - DNA, 22 bp, Homo sapiens
tctgccccttgggcatccaccc

SEQ ID NO: 3961663 - DNA, 13 bp, Homo sapiens
tctgcccgcagag

SEQ ID NO: 3961664 - DNA, 21 bp, Homo sapiens
tctgcccgcagagcccacgcc

SEQ ID NO: 3961665 - DNA, 20 bp, Homo sapiens
tctgccctgcctccctttct

SEQ ID NO: 3961666 - DNA, 16 bp, Homo sapiens
tctgcctcaatgtgaa

SEQ ID NO: 3961667 - DNA, 13 bp, Homo sapiens
tctgcctccctct

SEQ ID NO: 3961668 - DNA, 23 bp, Homo sapiens
tctgcctggaaattctggaactg

SEQ ID NO: 3961669 - DNA, 15 bp, Homo sapiens
tctgcctggcctggc

SEQ ID NO: 3961670 - DNA, 20 bp, Homo sapiens
tctgcctggcctggctcccc

SEQ ID NO: 3961671 - DNA, 15 bp, Homo sapiens
tctgcctgggcctgt

SEQ ID NO: 3961672 - DNA, 17 bp, Homo sapiens
tctgcctgggcctgtgc

SEQ ID NO: 3961673 - DNA, 19 bp, Homo sapiens
tctgcctgggcctgtgcag

SEQ ID NO: 3961674 - DNA, 20 bp, Homo sapiens
tctgcctgggcctgtgcagc

SEQ ID NO: 3961675 - DNA, 21 bp, Homo sapiens
tctgcctgggcctgtgcagca

SEQ ID NO: 3961676 - DNA, 19 bp, Homo sapiens
tctgcctgtggccttgccc

SEQ ID NO: 3961677 - DNA, 21 bp, Homo sapiens
tctgcctgtggccttgcccgc

SEQ ID NO: 3961678 - DNA, 15 bp, Homo sapiens
tctgcggccttccac

SEQ ID NO: 3961679 - DNA, 16 bp, Homo sapiens
tctgcgtgcagggaca

SEQ ID NO: 3961680 - DNA, 19 bp, Homo sapiens
tctgcgtgctttatttatg

SEQ ID NO: 3961681 - DNA, 17 bp, Homo sapiens
tctgctatattttcatg

SEQ ID NO: 3961682 - DNA, 16 bp, Homo sapiens
tctgctcagcaggccc

SEQ ID NO: 3961683 - DNA, 17 bp, Homo sapiens
tctgctcagcaggccct

SEQ ID NO: 3961684 - DNA, 13 bp, Homo sapiens
tctgctcctctcc

SEQ ID NO: 3961685 - DNA, 19 bp, Homo sapiens
tctgctctgaggcttccag

SEQ ID NO: 3961686 - DNA, 15 bp, Homo sapiens
tctgctggcctggcc

SEQ ID NO: 3961687 - DNA, 16 bp, Homo sapiens
tctgctggcctggccg

SEQ ID NO: 3961688 - DNA, 16 bp, Homo sapiens
tctgctggttttaaca

SEQ ID NO: 3961689 - DNA, 13 bp, Homo sapiens
tctgcttaccctt

SEQ ID NO: 3961690 - DNA, 13 bp, Homo sapiens
tctgcttcagtgg

SEQ ID NO: 3961691 - DNA, 14 bp, Homo sapiens
tctgcttcagtgga

SEQ ID NO: 3961692 - DNA, 13 bp, Homo sapiens
tctgcttctagta

SEQ ID NO: 3961693 - DNA, 12 bp, Homo sapiens
ccgctcagccct

SEQ ID NO: 3961694 - DNA, 11 bp, Homo sapiens
ccgctccagat

SEQ ID NO: 3961695 - DNA, 22 bp, Homo sapiens
ccgctcctttacctaccacctt

SEQ ID NO: 3961696 - DNA, 14 bp, Homo sapiens
ccgctctggaccaa

SEQ ID NO: 3961697 - DNA, 13 bp, Homo sapiens
ccgctgcaccacg

SEQ ID NO: 3961698 - DNA, 20 bp, Homo sapiens
ccgctgccaccacgtctgcc

SEQ ID NO: 3961699 - DNA, 17 bp, Homo sapiens
ccgctgccgctgcacca

SEQ ID NO: 3961700 - DNA, 18 bp, Homo sapiens
ccgctgccgctgcaccac

SEQ ID NO: 3961701 - DNA, 21 bp, Homo sapiens
ccgctgccttttgctgctgct

SEQ ID NO: 3961702 - DNA, 12 bp, Homo sapiens
ccgctggggaac

SEQ ID NO: 3961703 - DNA, 16 bp, Homo sapiens
ccgctgttcacccaca

SEQ ID NO: 3961704 - DNA, 21 bp, Homo sapiens
ccgctgttcacccacagggct

SEQ ID NO: 3961705 - DNA, 14 bp, Homo sapiens
ccgcttcacccctg

SEQ ID NO: 3961706 - DNA, 16 bp, Homo sapiens
ccgcttcccagaggcc

SEQ ID NO: 3961707 - DNA, 18 bp, Homo sapiens
ccgcttgtccagcgccta

SEQ ID NO: 3961708 - DNA, 18 bp, Homo sapiens
ccggagcacagccctggg

SEQ ID NO: 3961709 - DNA, 20 bp, Homo sapiens
ccggagcaggggtctgagcc

SEQ ID NO: 3961710 - DNA, 15 bp, Homo sapiens
ccggagctttcaaag

SEQ ID NO: 3961711 - DNA, 14 bp, Homo sapiens
ccggaggggcctgg

SEQ ID NO: 3961712 - DNA, 16 bp, Homo sapiens
ccggaggggcctggca

SEQ ID NO: 3961713 - DNA, 21 bp, Homo sapiens
ccggaggggcctggcagccgt

SEQ ID NO: 3961714 - DNA, 17 bp, Homo sapiens
ccggcaaccccagttct

SEQ ID NO: 3961715 - DNA, 21 bp, Homo sapiens
ccggcaaccccagttctgctc

SEQ ID NO: 3961716 - DNA, 22 bp, Homo sapiens
ccggcaaccccagttctgctcc

SEQ ID NO: 3961717 - DNA, 18 bp, Homo sapiens
ccggcaccccctgcagct

SEQ ID NO: 3961718 - DNA, 21 bp, Homo sapiens
ccggccggagccgcccaccgt

SEQ ID NO: 3961719 - DNA, 13 bp, Homo sapiens
ccggcctcttcca

SEQ ID NO: 3961720 - DNA, 16 bp, Homo sapiens
ccggcctcttccaccc

SEQ ID NO: 3961721 - DNA, 18 bp, Homo sapiens
ccggcctcttccacccat

SEQ ID NO: 3961722 - DNA, 15 bp, Homo sapiens
ccggcgctgcaggta

SEQ ID NO: 3961723 - DNA, 12 bp, Homo sapiens
ccggctctgcct

SEQ ID NO: 3961724 - DNA, 12 bp, Homo sapiens
ccggctgcctgc

SEQ ID NO: 3961725 - DNA, 13 bp, Homo sapiens
ccggctgcctgcc

SEQ ID NO: 3961726 - DNA, 23 bp, Homo sapiens
ccggctgcttccttctgcaccca

SEQ ID NO: 3961727 - DNA, 17 bp, Homo sapiens
ccgggaccattgacctc

SEQ ID NO: 3961728 - DNA, 21 bp, Homo sapiens
ccgggaccattgacctcagct

SEQ ID NO: 3961729 - DNA, 19 bp, Homo sapiens
ccgggacgcttccagacca

SEQ ID NO: 3961730 - DNA, 21 bp, Homo sapiens
ccgggacgcttccagaccacc

SEQ ID NO: 3961731 - DNA, 23 bp, Homo sapiens
ccgggacgcttccagaccacctg

SEQ ID NO: 3961732 - DNA, 20 bp, Homo sapiens
ccgggagaggactctgcctt

SEQ ID NO: 3961733 - DNA, 15 bp, Homo sapiens
ccgggagcctccccc

SEQ ID NO: 3961734 - DNA, 22 bp, Homo sapiens
ccgggagcctccccctcagatg

SEQ ID NO: 3961735 - DNA, 19 bp, Homo sapiens
ccgggcctggagaactaga

SEQ ID NO: 3961736 - DNA, 20 bp, Homo sapiens
ccgggcggaaggggacgcgg

SEQ ID NO: 3961737 - DNA, 13 bp, Homo sapiens
ccgggctctggcc

SEQ ID NO: 3961738 - DNA, 15 bp, Homo sapiens
ccgggctctggccac

SEQ ID NO: 3961739 - DNA, 18 bp, Homo sapiens
ccgggctctggccaccct

SEQ ID NO: 3961740 - DNA, 11 bp, Homo sapiens
ccgggctgccc

SEQ ID NO: 3961741 - DNA, 19 bp, Homo sapiens
ccgggctgcccttcgctgc

SEQ ID NO: 3961742 - DNA, 24 bp, Homo sapiens
ccgggctgcccttcgctgccagga

SEQ ID NO: 3961743 - DNA, 15 bp, Homo sapiens
ccggggaactggcca

SEQ ID NO: 3961744 - DNA, 16 bp, Homo sapiens
ccggggaactggccaa

SEQ ID NO: 3961745 - DNA, 20 bp, Homo sapiens
cctatcaaaacatatcaatt

SEQ ID NO: 3961746 - DNA, 18 bp, Homo sapiens
cctatccacccagcccat

SEQ ID NO: 3961747 - DNA, 23 bp, Homo sapiens
cctatccatcctgcgagctcctt

SEQ ID NO: 3961748 - DNA, 16 bp, Homo sapiens
cctatccttggagagc

SEQ ID NO: 3961749 - DNA, 18 bp, Homo sapiens
cctatccttggagagcag

SEQ ID NO: 3961750 - DNA, 16 bp, Homo sapiens
cctatgacttgggcac

SEQ ID NO: 3961751 - DNA, 17 bp, Homo sapiens
cctatgataaattcaca

SEQ ID NO: 3961752 - DNA, 21 bp, Homo sapiens
cctatggaaaagggtcttctt

SEQ ID NO: 3961753 - DNA, 15 bp, Homo sapiens
cctatggagagccct

SEQ ID NO: 3961754 - DNA, 16 bp, Homo sapiens
cctatggagagccctg

SEQ ID NO: 3961755 - DNA, 17 bp, Homo sapiens
cctatggagagccctgg

SEQ ID NO: 3961756 - DNA, 23 bp, Homo sapiens
cctatgtactctacgccaaagtg

SEQ ID NO: 3961757 - DNA, 14 bp, Homo sapiens
cctatgtcctaagg

SEQ ID NO: 3961758 - DNA, 19 bp, Homo sapiens
cctatgtcctaaggacaca

SEQ ID NO: 3961759 - DNA, 21 bp, Homo sapiens
cctatgtcctaaggacacact

SEQ ID NO: 3961760 - DNA, 23 bp, Homo sapiens
cctatgtcctaaggacacactaa

SEQ ID NO: 3961761 - DNA, 24 bp, Homo sapiens
cctatgtcctaaggacacactaat

SEQ ID NO: 3961762 - DNA, 16 bp, Homo sapiens
cctattaacctagaga

SEQ ID NO: 3961763 - DNA, 11 bp, Homo sapiens
cctattctcac

SEQ ID NO: 3961764 - DNA, 13 bp, Homo sapiens
cctattctcacca

SEQ ID NO: 3961765 - DNA, 13 bp, Homo sapiens
cctatttattggg

SEQ ID NO: 3961766 - DNA, 19 bp, Homo sapiens
cctcaaatgacccaaagac

SEQ ID NO: 3961767 - DNA, 18 bp, Homo sapiens
cctcaaatgtcagagcta

SEQ ID NO: 3961768 - DNA, 19 bp, Homo sapiens
cctcaacgttgctccccat

SEQ ID NO: 3961769 - DNA, 21 bp, Homo sapiens
cctcaatccccaagctggcag

SEQ ID NO: 3961770 - DNA, 20 bp, Homo sapiens
cctcaatgtgaatcagaccc

SEQ ID NO: 3961771 - DNA, 21 bp, Homo sapiens
cctcaatgtgaatcagaccct

SEQ ID NO: 3961772 - DNA, 13 bp, Homo sapiens
cctcacagcctct

SEQ ID NO: 3961773 - DNA, 17 bp, Homo sapiens
cctcacagcctctccct

SEQ ID NO: 3961774 - DNA, 15 bp, Homo sapiens
cctcacaggagcaga

SEQ ID NO: 3961775 - DNA, 21 bp, Homo sapiens
cctcacatagctacccaaaag

SEQ ID NO: 3961776 - DNA, 19 bp, Homo sapiens
cctcacccccagctttgct

SEQ ID NO: 3961777 - DNA, 17 bp, Homo sapiens
cctcacccccaggtgtt

SEQ ID NO: 3961778 - DNA, 16 bp, Homo sapiens
cctcacctgagagcca

SEQ ID NO: 3961779 - DNA, 14 bp, Homo sapiens
cctcacctgggcct

SEQ ID NO: 3961780 - DNA, 16 bp, Homo sapiens
cctcacgctctggaca

SEQ ID NO: 3961781 - DNA, 22 bp, Homo sapiens
cctcactatggtatgctggcca

SEQ ID NO: 3961782 - DNA, 17 bp, Homo sapiens
cctcactattcaagtat

SEQ ID NO: 3961783 - DNA, 13 bp, Homo sapiens
cctcactcctgtt

SEQ ID NO: 3961784 - DNA, 17 bp, Homo sapiens
cctcactgaatgcctca

SEQ ID NO: 3961785 - DNA, 14 bp, Homo sapiens
cctcactggctggg

SEQ ID NO: 3961786 - DNA, 13 bp, Homo sapiens
cctcacttccctg

SEQ ID NO: 3961787 - DNA, 15 bp, Homo sapiens
cctcagacaatccac

SEQ ID NO: 3961788 - DNA, 22 bp, Homo sapiens
cctcagacaatccactctcagg

SEQ ID NO: 3961789 - DNA, 22 bp, Homo sapiens
cctcagaccaactctctcctgt

SEQ ID NO: 3961790 - DNA, 10 bp, Homo sapiens
cctcagactg

SEQ ID NO: 3961791 - DNA, 12 bp, Homo sapiens
cctcagagaggc

SEQ ID NO: 3961792 - DNA, 15 bp, Homo sapiens
cctcagagcaggctc

SEQ ID NO: 3961793 - DNA, 21 bp, Homo sapiens
cctcagatgatctctccacgg

SEQ ID NO: 3961794 - DNA, 17 bp, Homo sapiens
ttctattgtttattctt

SEQ ID NO: 3961795 - DNA, 18 bp, Homo sapiens
ttctatttaaaaaataaa

SEQ ID NO: 3961796 - DNA, 15 bp, Homo sapiens
ttctcaatcagtgca

SEQ ID NO: 3961797 - DNA, 18 bp, Homo sapiens
ttctcacatctgtccaga

SEQ ID NO: 3961798 - DNA, 16 bp, Homo sapiens
ttctcactcctacctg

SEQ ID NO: 3961799 - DNA, 17 bp, Homo sapiens
ttctcactgtctcctgg

SEQ ID NO: 3961800 - DNA, 16 bp, Homo sapiens
ttctcagaacagctga

SEQ ID NO: 3961801 - DNA, 17 bp, Homo sapiens
ttctcagaacagctgaa

SEQ ID NO: 3961802 - DNA, 18 bp, Homo sapiens
ttctcaggacacaggcct

SEQ ID NO: 3961803 - DNA, 19 bp, Homo sapiens
ttctcaggacacaggcctg

SEQ ID NO: 3961804 - DNA, 20 bp, Homo sapiens
ttctcaggacacaggcctgt

SEQ ID NO: 3961805 - DNA, 22 bp, Homo sapiens
ttctcaggacacaggcctgtgt

SEQ ID NO: 3961806 - DNA, 23 bp, Homo sapiens
ttctcaggacacaggcctgtgta

SEQ ID NO: 3961807 - DNA, 22 bp, Homo sapiens
ttctcagtgctctcctacccca

SEQ ID NO: 3961808 - DNA, 24 bp, Homo sapiens
ttctcataggaaaagtacatttaa

SEQ ID NO: 3961809 - DNA, 18 bp, Homo sapiens
ttctcattccaacagtga

SEQ ID NO: 3961810 - DNA, 14 bp, Homo sapiens
ttctccaaatgatt

SEQ ID NO: 3961811 - DNA, 12 bp, Homo sapiens
ttctccactgga

SEQ ID NO: 3961812 - DNA, 19 bp, Homo sapiens
ttctccagcccacacccct

SEQ ID NO: 3961813 - DNA, 18 bp, Homo sapiens
ttctccatctggcagggt

SEQ ID NO: 3961814 - DNA, 20 bp, Homo sapiens
ttctccccccaacacaatct

SEQ ID NO: 3961815 - DNA, 13 bp, Homo sapiens
ttctccctcaccc

SEQ ID NO: 3961816 - DNA, 23 bp, Homo sapiens
ttctccgactgctagggagtggt

SEQ ID NO: 3961817 - DNA, 21 bp, Homo sapiens
ttctccgggtgtggcctcagc

SEQ ID NO: 3961818 - DNA, 14 bp, Homo sapiens
ttctcctaggagaa

SEQ ID NO: 3961819 - DNA, 13 bp, Homo sapiens
ttctcctcccagg

SEQ ID NO: 3961820 - DNA, 17 bp, Homo sapiens
ttctcctttcacaacct

SEQ ID NO: 3961821 - DNA, 22 bp, Homo sapiens
ttctcctttcacaaccttctgt

SEQ ID NO: 3961822 - DNA, 14 bp, Homo sapiens
ttctctccttccct

SEQ ID NO: 3961823 - DNA, 23 bp, Homo sapiens
ttctctctaaaaataaaatgatg

SEQ ID NO: 3961824 - DNA, 16 bp, Homo sapiens
ttctctctcctgtcca

SEQ ID NO: 3961825 - DNA, 20 bp, Homo sapiens
ttctctgcttacccttcacc

SEQ ID NO: 3961826 - DNA, 15 bp, Homo sapiens
ttctctggctccaga

SEQ ID NO: 3961827 - DNA, 21 bp, Homo sapiens
ttctctgggtaggtgttgaaa

SEQ ID NO: 3961828 - DNA, 18 bp, Homo sapiens
ttctcttcactcccaata

SEQ ID NO: 3961829 - DNA, 19 bp, Homo sapiens
ttctcttccctccttccct

SEQ ID NO: 3961830 - DNA, 23 bp, Homo sapiens
ttctgagagttggctcaggcaga

SEQ ID NO: 3961831 - DNA, 13 bp, Homo sapiens
ttctgagccttga

SEQ ID NO: 3961832 - DNA, 20 bp, Homo sapiens
ttctgagtttcattctcctg

SEQ ID NO: 3961833 - DNA, 23 bp, Homo sapiens
ttctgagtttcattctcctgcct

SEQ ID NO: 3961834 - DNA, 22 bp, Homo sapiens
ttctgatgggtcccaaaagctt

SEQ ID NO: 3961835 - DNA, 20 bp, Homo sapiens
ttctgcaactagccaaggct

SEQ ID NO: 3961836 - DNA, 21 bp, Homo sapiens
ttctgcacccagaaattcctt

SEQ ID NO: 3961837 - DNA, 15 bp, Homo sapiens
ttctgcactgaaaag

SEQ ID NO: 3961838 - DNA, 20 bp, Homo sapiens
ttctgcagcaactcccacga

SEQ ID NO: 3961839 - DNA, 21 bp, Homo sapiens
ttctgcagcaactcccacgac

SEQ ID NO: 3961840 - DNA, 15 bp, Homo sapiens
ttctgctcctctcca

SEQ ID NO: 3961841 - DNA, 19 bp, Homo sapiens
ttctgctggcctggatctc

SEQ ID NO: 3961842 - DNA, 11 bp, Homo sapiens
ttctgcttcta

SEQ ID NO: 3961843 - DNA, 12 bp, Homo sapiens
ttctgcttctcc

SEQ ID NO: 3961844 - DNA, 18 bp, Homo sapiens
ttctggaaaagaggagtt

SEQ ID NO: 3961845 - DNA, 21 bp, Homo sapiens
ttctggaaattttgtccattt

SEQ ID NO: 3961846 - DNA, 19 bp, Homo sapiens
ttctggaatacatgaaata

SEQ ID NO: 3961847 - DNA, 13 bp, Homo sapiens
ttctggctcctcc

SEQ ID NO: 3961848 - DNA, 18 bp, Homo sapiens
ttctggctgaaaaaggcc

SEQ ID NO: 3961849 - DNA, 12 bp, Homo sapiens
ttctggctgcaa

SEQ ID NO: 3961850 - DNA, 14 bp, Homo sapiens
ttctggggaggaag

SEQ ID NO: 3961851 - DNA, 15 bp, Homo sapiens
ttctggtcttcactg

SEQ ID NO: 3961852 - DNA, 20 bp, Homo sapiens
ttctgtaaactcaaaactta

SEQ ID NO: 3961853 - DNA, 23 bp, Homo sapiens
ttctgtaaactcaaaacttaaca

SEQ ID NO: 3961854 - DNA, 17 bp, Homo sapiens
ttctgtaatggaactga

SEQ ID NO: 3961855 - DNA, 11 bp, Homo sapiens
ttctgtatttt

SEQ ID NO: 3961856 - DNA, 17 bp, Homo sapiens
ttctgtcacgtgaaata

SEQ ID NO: 3961857 - DNA, 17 bp, Homo sapiens
ttctgtcttcacaacag

SEQ ID NO: 3961858 - DNA, 20 bp, Homo sapiens
ttctgtgcactagcctgtga

SEQ ID NO: 3961859 - DNA, 21 bp, Homo sapiens
ttctgtgggcttggccttgtg

SEQ ID NO: 3961860 - DNA, 20 bp, Homo sapiens
ttctgtgtgggtctggggag

SEQ ID NO: 3961861 - DNA, 17 bp, Homo sapiens
ttctgttgatcccactt

SEQ ID NO: 3961862 - DNA, 22 bp, Homo sapiens
ttctgttgcccaggctggcctg

SEQ ID NO: 3961863 - DNA, 23 bp, Homo sapiens
ttctgttgcccaggctggcctga

SEQ ID NO: 3961864 - DNA, 23 bp, Homo sapiens
ttctgttgtagaataataataaa

SEQ ID NO: 3961865 - DNA, 20 bp, Homo sapiens
ttctgtttctattctctcct

SEQ ID NO: 3961866 - DNA, 20 bp, Homo sapiens
ttcttaagatttctcctgac

SEQ ID NO: 3961867 - DNA, 22 bp, Homo sapiens
ttcttaataggctttatcgttt

SEQ ID NO: 3961868 - DNA, 22 bp, Homo sapiens
ttcttaccgagaaaaggagaaa

SEQ ID NO: 3961869 - DNA, 19 bp, Homo sapiens
ttcttattctcactccacc

SEQ ID NO: 3961870 - DNA, 19 bp, Homo sapiens
ttcttcaagggaagaaaca

SEQ ID NO: 3961871 - DNA, 17 bp, Homo sapiens
ttcttcagaagacactg

SEQ ID NO: 3961872 - DNA, 16 bp, Homo sapiens
ttcttccagtgcaaca

SEQ ID NO: 3961873 - DNA, 20 bp, Homo sapiens
ttcttccccaggtccttcct

SEQ ID NO: 3961874 - DNA, 12 bp, Homo sapiens
ttcttcctctgc

SEQ ID NO: 3961875 - DNA, 20 bp, Homo sapiens
ttcttccttctttctcttcc

SEQ ID NO: 3961876 - DNA, 13 bp, Homo sapiens
ttcttcttcagaa

SEQ ID NO: 3961877 - DNA, 19 bp, Homo sapiens
ttcttgagtagatctgctt

SEQ ID NO: 3961878 - DNA, 15 bp, Homo sapiens
ttcttgatgtcatgt

SEQ ID NO: 3961879 - DNA, 15 bp, Homo sapiens
ttcttgcctgaggct

SEQ ID NO: 3961880 - DNA, 22 bp, Homo sapiens
ttgcacaagcttgtatatacat

SEQ ID NO: 3961881 - DNA, 9 bp, Homo sapiens
ttgcacaat

SEQ ID NO: 3961882 - DNA, 13 bp, Homo sapiens
ttgcacaatttga

SEQ ID NO: 3961883 - DNA, 20 bp, Homo sapiens
ttgcacaggttttcagcaac

SEQ ID NO: 3961884 - DNA, 13 bp, Homo sapiens
ttgcactaggtca

SEQ ID NO: 3961885 - DNA, 17 bp, Homo sapiens
ttgcactatgaaaatca

SEQ ID NO: 3961886 - DNA, 15 bp, Homo sapiens
ttgcactgacaagat

SEQ ID NO: 3961887 - DNA, 12 bp, Homo sapiens
ttgcactgaggg

SEQ ID NO: 3961888 - DNA, 16 bp, Homo sapiens
ttgcactgagggccac

SEQ ID NO: 3961889 - DNA, 16 bp, Homo sapiens
ttgcactgtgggggct

SEQ ID NO: 3961890 - DNA, 18 bp, Homo sapiens
ttgcagaaaagcacctgc

SEQ ID NO: 3961891 - DNA, 17 bp, Homo sapiens
ttgcaggcccagcagac

SEQ ID NO: 3961892 - DNA, 18 bp, Homo sapiens
ttgcaggctctgggctca

SEQ ID NO: 3961893 - DNA, 20 bp, Homo sapiens
ttgcaggctctgggctcagg

SEQ ID NO: 3961894 - DNA, 15 bp, Homo sapiens
ttgcagtatatttct

SEQ ID NO: 3961895 - DNA, 20 bp, Homo sapiens
ttgcagttcaaatcctcacc

SEQ ID NO: 3961896 - DNA, 23 bp, Homo sapiens
ttgcataagattaaaggaaggaa

SEQ ID NO: 3961897 - DNA, 21 bp, Homo sapiens
ttgcatcagtattaatactaa

SEQ ID NO: 3961898 - DNA, 23 bp, Homo sapiens
ttgcatcagtattaatactaaaa

SEQ ID NO: 3961899 - DNA, 18 bp, Homo sapiens
ttgcatgtaaaatgcagt

SEQ ID NO: 3961900 - DNA, 11 bp, Homo sapiens
ttgcattagaa

SEQ ID NO: 3961901 - DNA, 16 bp, Homo sapiens
ttgcattagaaactga

SEQ ID NO: 3961902 - DNA, 14 bp, Homo sapiens
ttgcattccatgat

SEQ ID NO: 3961903 - DNA, 17 bp, Homo sapiens
ttgcattccatgatttt

SEQ ID NO: 3961904 - DNA, 14 bp, Homo sapiens
ttgcatttctgctc

SEQ ID NO: 3961905 - DNA, 21 bp, Homo sapiens
ttgccaccactagagctgaga

SEQ ID NO: 3961906 - DNA, 15 bp, Homo sapiens
ttgccactgcctctt

SEQ ID NO: 3961907 - DNA, 15 bp, Homo sapiens
ttgccactttggctt

SEQ ID NO: 3961908 - DNA, 14 bp, Homo sapiens
ttgccagcacaggg

SEQ ID NO: 3961909 - DNA, 18 bp, Homo sapiens
ttgccatgggcctgctgc

SEQ ID NO: 3961910 - DNA, 14 bp, Homo sapiens
ttgccattcctgga

SEQ ID NO: 3961911 - DNA, 15 bp, Homo sapiens
ttgccatttctctgc

SEQ ID NO: 3961912 - DNA, 12 bp, Homo sapiens
ttgcccagagat

SEQ ID NO: 3961913 - DNA, 18 bp, Homo sapiens
ttgcccagagatgcctcc

SEQ ID NO: 3961914 - DNA, 12 bp, Homo sapiens
ttgcccaggctg

SEQ ID NO: 3961915 - DNA, 18 bp, Homo sapiens
ttgccccagagccccact

SEQ ID NO: 3961916 - DNA, 13 bp, Homo sapiens
ttgcccccatccc

SEQ ID NO: 3961917 - DNA, 15 bp, Homo sapiens
ttgcccccatccctc

SEQ ID NO: 3961918 - DNA, 18 bp, Homo sapiens
ttgcccctccagagacag

SEQ ID NO: 3961919 - DNA, 13 bp, Homo sapiens
ttgccccttcccc

SEQ ID NO: 3961920 - DNA, 22 bp, Homo sapiens
ttgcccgccagcctcagtgcca

SEQ ID NO: 3961921 - DNA, 18 bp, Homo sapiens
ttgccctgacctcccagc

SEQ ID NO: 3961922 - DNA, 20 bp, Homo sapiens
ttgccctgtggattccagca

SEQ ID NO: 3961923 - DNA, 16 bp, Homo sapiens
ttgcccttcacagtgt

SEQ ID NO: 3961924 - DNA, 16 bp, Homo sapiens
ttgcccttgccctgac

SEQ ID NO: 3961925 - DNA, 14 bp, Homo sapiens
ttgccgagagaggc

SEQ ID NO: 3961926 - DNA, 18 bp, Homo sapiens
ttgccgagcctaatgaaa

SEQ ID NO: 3961927 - DNA, 17 bp, Homo sapiens
ttgcctactatgccaga

SEQ ID NO: 3961928 - DNA, 12 bp, Homo sapiens
ttgcctccacct

SEQ ID NO: 3961929 - DNA, 21 bp, Homo sapiens
ttgcctccacctctccttgga

SEQ ID NO: 3961930 - DNA, 16 bp, Homo sapiens
ttgcctggctgtggag

SEQ ID NO: 3961931 - DNA, 14 bp, Homo sapiens
ttgccttagcactt

SEQ ID NO: 3961932 - DNA, 18 bp, Homo sapiens
ttgccttttgcaaacttt

SEQ ID NO: 3961933 - DNA, 19 bp, Homo sapiens
ttgcgggggagctggaaat

SEQ ID NO: 3961934 - DNA, 20 bp, Homo sapiens
ttgcgggggagctggaaata

SEQ ID NO: 3961935 - DNA, 14 bp, Homo sapiens
ttgcgtcctgcaga

SEQ ID NO: 3961936 - DNA, 23 bp, Homo sapiens
ttgctaaacgactccgagaacaa

SEQ ID NO: 3961937 - DNA, 14 bp, Homo sapiens
ttgctacaataaat

SEQ ID NO: 3961938 - DNA, 18 bp, Homo sapiens
ttgctacaataaatgctg

SEQ ID NO: 3961939 - DNA, 16 bp, Homo sapiens
ttgctagacagccagg

SEQ ID NO: 3961940 - DNA, 9 bp, Homo sapiens
ttgctattt

SEQ ID NO: 3961941 - DNA, 19 bp, Homo sapiens
ttgctattttatttgtatt

SEQ ID NO: 3961942 - DNA, 21 bp, Homo sapiens
ttgctcaccaagctgttccac

SEQ ID NO: 3961943 - DNA, 12 bp, Homo sapiens
ttgctcactcag

SEQ ID NO: 3961944 - DNA, 20 bp, Homo sapiens
ttgctcagtgcctcctggcc

SEQ ID NO: 3961945 - DNA, 17 bp, Homo sapiens
ttgctctgcaggcacct

SEQ ID NO: 3961946 - DNA, 14 bp, Homo sapiens
ttgctctggctgag

SEQ ID NO: 3961947 - DNA, 16 bp, Homo sapiens
ttgctcttggaaagct

SEQ ID NO: 3961948 - DNA, 20 bp, Homo sapiens
ttgctgagcaccctctccgg

SEQ ID NO: 3961949 - DNA, 12 bp, Homo sapiens
ttgctgcaggcc

SEQ ID NO: 3961950 - DNA, 21 bp, Homo sapiens
ttgctgcctgaagaacagtaa

SEQ ID NO: 3961951 - DNA, 21 bp, Homo sapiens
ttgctgtcataagaatgaata

SEQ ID NO: 3961952 - DNA, 16 bp, Homo sapiens
ttgctgttgttgcagg

SEQ ID NO: 3961953 - DNA, 17 bp, Homo sapiens
ttgctgttgttgcaggg

SEQ ID NO: 3961954 - DNA, 14 bp, Homo sapiens
ttgcttaaaagaca

SEQ ID NO: 3961955 - DNA, 24 bp, Homo sapiens
ttgcttaggatgtttttcatgaaa

SEQ ID NO: 3961956 - DNA, 13 bp, Homo sapiens
ttgcttgaaacca

SEQ ID NO: 3961957 - DNA, 14 bp, Homo sapiens
ttgcttggcagaga

SEQ ID NO: 3961958 - DNA, 16 bp, Homo sapiens
ttgcttggcagagagg

SEQ ID NO: 3961959 - DNA, 23 bp, Homo sapiens
ttgctttaatgtgtattgaagaa

SEQ ID NO: 3961960 - DNA, 11 bp, Homo sapiens
ttgctttgctg

SEQ ID NO: 3961961 - DNA, 13 bp, Homo sapiens
ttgctttgctgtt

SEQ ID NO: 3961962 - DNA, 14 bp, Homo sapiens
ttggaaaaaaatta

SEQ ID NO: 3961963 - DNA, 21 bp, Homo sapiens
ttggaaaaaaattacaaaatg

SEQ ID NO: 3961964 - DNA, 19 bp, Homo sapiens
ttggaaaagaatacagaaa

SEQ ID NO: 3961965 - DNA, 22 bp, Homo sapiens
ttggaaaagaatacagaaagat

SEQ ID NO: 3961966 - DNA, 18 bp, Homo sapiens
ttggaaagagaccagcac

SEQ ID NO: 3961967 - DNA, 21 bp, Homo sapiens
ttcactgtgttggccaggctg

SEQ ID NO: 3961968 - DNA, 23 bp, Homo sapiens
ttcacttcgatgactggatacag

SEQ ID NO: 3961969 - DNA, 13 bp, Homo sapiens
ttcagaaagcatt

SEQ ID NO: 3961970 - DNA, 20 bp, Homo sapiens
ttcagaaagcattacatttc

SEQ ID NO: 3961971 - DNA, 23 bp, Homo sapiens
ttcagaaataaaatgaaatgtct

SEQ ID NO: 3961972 - DNA, 13 bp, Homo sapiens
ttcagaaatatgt

SEQ ID NO: 3961973 - DNA, 23 bp, Homo sapiens
ttcagaagtttggcaatagtttg

SEQ ID NO: 3961974 - DNA, 16 bp, Homo sapiens
ttcagaataagcttcc

SEQ ID NO: 3961975 - DNA, 18 bp, Homo sapiens
ttcagaattttgtatatt

SEQ ID NO: 3961976 - DNA, 13 bp, Homo sapiens
ttcagactcagac

SEQ ID NO: 3961977 - DNA, 15 bp, Homo sapiens
ttcagagaggccttt

SEQ ID NO: 3961978 - DNA, 14 bp, Homo sapiens
ttcagagcctagcc

SEQ ID NO: 3961979 - DNA, 15 bp, Homo sapiens
ttcagagcctagcca

SEQ ID NO: 3961980 - DNA, 18 bp, Homo sapiens
ttcagagcctagccacct

SEQ ID NO: 3961981 - DNA, 18 bp, Homo sapiens
ttcagagttgtacactgt

SEQ ID NO: 3961982 - DNA, 17 bp, Homo sapiens
ttcagatcagtgcttga

SEQ ID NO: 3961983 - DNA, 21 bp, Homo sapiens
ttcagcacaccccaagggaca

SEQ ID NO: 3961984 - DNA, 22 bp, Homo sapiens
ttcagcaccctgggtgccattc

SEQ ID NO: 3961985 - DNA, 16 bp, Homo sapiens
ttcagcatatttatag

SEQ ID NO: 3961986 - DNA, 14 bp, Homo sapiens
ttcagcccctcctc

SEQ ID NO: 3961987 - DNA, 15 bp, Homo sapiens
ttcagcccctcctct

SEQ ID NO: 3961988 - DNA, 19 bp, Homo sapiens
ttcagctgacagctgctca

SEQ ID NO: 3961989 - DNA, 16 bp, Homo sapiens
ttcaggaaaaggcctg

SEQ ID NO: 3961990 - DNA, 14 bp, Homo sapiens
ttcaggacatgggg

SEQ ID NO: 3961991 - DNA, 15 bp, Homo sapiens
ttcaggactggctca

SEQ ID NO: 3961992 - DNA, 18 bp, Homo sapiens
ttcaggactggctcaccc

SEQ ID NO: 3961993 - DNA, 21 bp, Homo sapiens
ttcaggcttctttcaaagtgt

SEQ ID NO: 3961994 - DNA, 20 bp, Homo sapiens
ttcagggaaatggagggtgg

SEQ ID NO: 3961995 - DNA, 22 bp, Homo sapiens
ttcaggggggttgtgaggcctg

SEQ ID NO: 3961996 - DNA, 20 bp, Homo sapiens
ttcaggtaggcccttgtcct

SEQ ID NO: 3961997 - DNA, 14 bp, Homo sapiens
ttcaggttgttctg

SEQ ID NO: 3961998 - DNA, 16 bp, Homo sapiens
ttcaggttgttctgta

SEQ ID NO: 3961999 - DNA, 16 bp, Homo sapiens
ttcagtgagacacaga

SEQ ID NO: 3962000 - DNA, 19 bp, Homo sapiens
ttcagtttcaattcagtgc

SEQ ID NO: 3962001 - DNA, 23 bp, Homo sapiens
ttcataacttgctgaatttcagg

SEQ ID NO: 3962002 - DNA, 19 bp, Homo sapiens
ttcataaggcctgccctcc

SEQ ID NO: 3962003 - DNA, 20 bp, Homo sapiens
ttcataattagaacaatagc

SEQ ID NO: 3962004 - DNA, 19 bp, Homo sapiens
ttcataggcggtcatgtgt

SEQ ID NO: 3962005 - DNA, 21 bp, Homo sapiens
ttcataggcggtcatgtgtgc

SEQ ID NO: 3962006 - DNA, 15 bp, Homo sapiens
ttcatatttctttgg

SEQ ID NO: 3962007 - DNA, 18 bp, Homo sapiens
ttcatccagttgcaataa

SEQ ID NO: 3962008 - DNA, 23 bp, Homo sapiens
ttcatccagttgcaataaaatag

SEQ ID NO: 3962009 - DNA, 14 bp, Homo sapiens
ttcatcccagcccc

SEQ ID NO: 3962010 - DNA, 23 bp, Homo sapiens
ttcatgacttttccatgtatcta

SEQ ID NO: 3962011 - DNA, 18 bp, Homo sapiens
ttcatgatgaattacttc

SEQ ID NO: 3962012 - DNA, 12 bp, Homo sapiens
ttcatgcctcag

SEQ ID NO: 3962013 - DNA, 15 bp, Homo sapiens
ttcatgcctcagttt

SEQ ID NO: 3962014 - DNA, 17 bp, Homo sapiens
ttcatgctcagccctga

SEQ ID NO: 3962015 - DNA, 23 bp, Homo sapiens
ttcatggcagatgtaggagggac

SEQ ID NO: 3962016 - DNA, 21 bp, Homo sapiens
ttcatggcctttgataaatgt

SEQ ID NO: 3962017 - DNA, 16 bp, Homo sapiens
ttcatgtaataaatct

SEQ ID NO: 3962018 - DNA, 18 bp, Homo sapiens
gcccctgtaggttgctta

SEQ ID NO: 3962019 - DNA, 18 bp, Homo sapiens
gccccttaagggttgaag

SEQ ID NO: 3962020 - DNA, 20 bp, Homo sapiens
gccccttaagggttgaaggc

SEQ ID NO: 3962021 - DNA, 10 bp, Homo sapiens
gccccttcca

SEQ ID NO: 3962022 - DNA, 21 bp, Homo sapiens
gccccttccccatctccattt

SEQ ID NO: 3962023 - DNA, 17 bp, Homo sapiens
gccccttccccctccaa

SEQ ID NO: 3962024 - DNA, 20 bp, Homo sapiens
gccccttgctctcccctgcc

SEQ ID NO: 3962025 - DNA, 17 bp, Homo sapiens
gccccttgtcctctccc

SEQ ID NO: 3962026 - DNA, 17 bp, Homo sapiens
gcccgaaagctgagacc

SEQ ID NO: 3962027 - DNA, 14 bp, Homo sapiens
gcccgaatgcctgt

SEQ ID NO: 3962028 - DNA, 13 bp, Homo sapiens
gcccgacagagag

SEQ ID NO: 3962029 - DNA, 14 bp, Homo sapiens
gcccgacagcctgg

SEQ ID NO: 3962030 - DNA, 15 bp, Homo sapiens
gcccgacagcctggc

SEQ ID NO: 3962031 - DNA, 16 bp, Homo sapiens
gcccgacagcctggca

SEQ ID NO: 3962032 - DNA, 17 bp, Homo sapiens
gcccgacagttctgaac

SEQ ID NO: 3962033 - DNA, 14 bp, Homo sapiens
gcccgagcagctga

SEQ ID NO: 3962034 - DNA, 20 bp, Homo sapiens
gcccgagcagctgagcaggg

SEQ ID NO: 3962035 - DNA, 22 bp, Homo sapiens
gcccgagcagctgagcagggcc

SEQ ID NO: 3962036 - DNA, 13 bp, Homo sapiens
gcccgccagcctc

SEQ ID NO: 3962037 - DNA, 20 bp, Homo sapiens
gcccgccagcctcagtgcca

SEQ ID NO: 3962038 - DNA, 17 bp, Homo sapiens
gcccgcccaaggggact

SEQ ID NO: 3962039 - DNA, 18 bp, Homo sapiens
gcccgcctaggagttgag

SEQ ID NO: 3962040 - DNA, 14 bp, Homo sapiens
gcccgcctctgtcc

SEQ ID NO: 3962041 - DNA, 23 bp, Homo sapiens
gcccggagtaatcaggcagcctt

SEQ ID NO: 3962042 - DNA, 16 bp, Homo sapiens
gcccggccagggcctg

SEQ ID NO: 3962043 - DNA, 18 bp, Homo sapiens
gcccggcctgctcccagc

SEQ ID NO: 3962044 - DNA, 13 bp, Homo sapiens
gcccgtgaagcag

SEQ ID NO: 3962045 - DNA, 14 bp, Homo sapiens
gcccgtgaagcagt

SEQ ID NO: 3962046 - DNA, 20 bp, Homo sapiens
gcccgtgaagcagtgcctcg

SEQ ID NO: 3962047 - DNA, 12 bp, Homo sapiens
gcccgtgcagta

SEQ ID NO: 3962048 - DNA, 17 bp, Homo sapiens
gcccgtgcagtacaggc

SEQ ID NO: 3962049 - DNA, 18 bp, Homo sapiens
gcccgtgcagtacaggca

SEQ ID NO: 3962050 - DNA, 12 bp, Homo sapiens
gccctaccctca

SEQ ID NO: 3962051 - DNA, 18 bp, Homo sapiens
gccctaggattcctcccc

SEQ ID NO: 3962052 - DNA, 23 bp, Homo sapiens
gccctaggattcctcccccagag

SEQ ID NO: 3962053 - DNA, 15 bp, Homo sapiens
gccctatttttgcaa

SEQ ID NO: 3962054 - DNA, 14 bp, Homo sapiens
gccctcacccgccc

SEQ ID NO: 3962055 - DNA, 22 bp, Homo sapiens
agcctcctgacctgaggctcct

SEQ ID NO: 3962056 - DNA, 12 bp, Homo sapiens
agcctctccagg

SEQ ID NO: 3962057 - DNA, 14 bp, Homo sapiens
agcctctcccggct

SEQ ID NO: 3962058 - DNA, 18 bp, Homo sapiens
agcctctcccggctgcct

SEQ ID NO: 3962059 - DNA, 16 bp, Homo sapiens
agcctctgccccaagg

SEQ ID NO: 3962060 - DNA, 18 bp, Homo sapiens
agcctctgccccaagggg

SEQ ID NO: 3962061 - DNA, 19 bp, Homo sapiens
agcctctgccccaaggggc

SEQ ID NO: 3962062 - DNA, 22 bp, Homo sapiens
agcctcttaaagctgcctgtag

SEQ ID NO: 3962063 - DNA, 20 bp, Homo sapiens
agcctcttctgccaagagag

SEQ ID NO: 3962064 - DNA, 17 bp, Homo sapiens
agcctgcaaactcactg

SEQ ID NO: 3962065 - DNA, 17 bp, Homo sapiens
agcctgccgagcaaccg

SEQ ID NO: 3962066 - DNA, 23 bp, Homo sapiens
agcctgccgccgtctctgtcccg

SEQ ID NO: 3962067 - DNA, 14 bp, Homo sapiens
agcctgctccccca

SEQ ID NO: 3962068 - DNA, 17 bp, Homo sapiens
agcctgctcccccaccc

SEQ ID NO: 3962069 - DNA, 23 bp, Homo sapiens
agcctgctcccccaccccctccc

SEQ ID NO: 3962070 - DNA, 16 bp, Homo sapiens
agcctggcacaggact

SEQ ID NO: 3962071 - DNA, 17 bp, Homo sapiens
agcctggcacagggcag

SEQ ID NO: 3962072 - DNA, 18 bp, Homo sapiens
agcctggcacagggcagt

SEQ ID NO: 3962073 - DNA, 15 bp, Homo sapiens
agcctggccatcccc

SEQ ID NO: 3962074 - DNA, 19 bp, Homo sapiens
agcctggcccatagaaaca

SEQ ID NO: 3962075 - DNA, 14 bp, Homo sapiens
agcctggcctcctg

SEQ ID NO: 3962076 - DNA, 16 bp, Homo sapiens
agcctggcctcctgcc

SEQ ID NO: 3962077 - DNA, 23 bp, Homo sapiens
agcctggcggggcaggaggcctg

SEQ ID NO: 3962078 - DNA, 16 bp, Homo sapiens
agcctgggactcccag

SEQ ID NO: 3962079 - DNA, 15 bp, Homo sapiens
agcctgggccagaga

SEQ ID NO: 3962080 - DNA, 19 bp, Homo sapiens
agcctgggcctatggagag

SEQ ID NO: 3962081 - DNA, 23 bp, Homo sapiens
agcctgggcctatggagagccct

SEQ ID NO: 3962082 - DNA, 14 bp, Homo sapiens
agcctggggctcta

SEQ ID NO: 3962083 - DNA, 15 bp, Homo sapiens
agcctggggctctaa

SEQ ID NO: 3962084 - DNA, 21 bp, Homo sapiens
agcctggggctctaacgcctg

SEQ ID NO: 3962085 - DNA, 23 bp, Homo sapiens
agcctgggtgagaatcctgcctc

SEQ ID NO: 3962086 - DNA, 22 bp, Homo sapiens
agcctggtagaattgggaagct

SEQ ID NO: 3962087 - DNA, 15 bp, Homo sapiens
agcctggtctcctcc

SEQ ID NO: 3962088 - DNA, 23 bp, Homo sapiens
agcctgtccactaacttgtcttt

SEQ ID NO: 3962089 - DNA, 15 bp, Homo sapiens
agcctgtgaacccag

SEQ ID NO: 3962090 - DNA, 19 bp, Homo sapiens
agcctgtgaacccaggaca

SEQ ID NO: 3962091 - DNA, 20 bp, Homo sapiens
agcctgtgaacccaggacaa

SEQ ID NO: 3962092 - DNA, 18 bp, Homo sapiens
agcctgtggcggtgcctg

SEQ ID NO: 3962093 - DNA, 20 bp, Homo sapiens
agcctgtggcggtgcctggg

SEQ ID NO: 3962094 - DNA, 14 bp, Homo sapiens
agcctgtgtgttct

SEQ ID NO: 3962095 - DNA, 17 bp, Homo sapiens
agcctgttcatggcaga

SEQ ID NO: 3962096 - DNA, 13 bp, Homo sapiens
agcgggcctcttc

SEQ ID NO: 3962097 - DNA, 14 bp, Homo sapiens
agcggggaggtgcc

SEQ ID NO: 3962098 - DNA, 21 bp, Homo sapiens
agcggggccccagggctaccc

SEQ ID NO: 3962099 - DNA, 22 bp, Homo sapiens
agcgtcccctgctactcctgtg

SEQ ID NO: 3962100 - DNA, 22 bp, Homo sapiens
agcgtggccttgttctgtcacc

SEQ ID NO: 3962101 - DNA, 16 bp, Homo sapiens
agctaaagcccaacct

SEQ ID NO: 3962102 - DNA, 19 bp, Homo sapiens
agctaacagggaaggcagg

SEQ ID NO: 3962103 - DNA, 19 bp, Homo sapiens
agctaatctgtagggctgg

SEQ ID NO: 3962104 - DNA, 15 bp, Homo sapiens
agctaatgaaattga

SEQ ID NO: 3962105 - DNA, 12 bp, Homo sapiens
agctacattcct

SEQ ID NO: 3962106 - DNA, 17 bp, Homo sapiens
agctacattcctcagct

SEQ ID NO: 3962107 - DNA, 16 bp, Homo sapiens
agctacccaaaagaga

SEQ ID NO: 3962108 - DNA, 14 bp, Homo sapiens
agctactctcttgc

SEQ ID NO: 3962109 - DNA, 19 bp, Homo sapiens
agctactctgtccaggcca

SEQ ID NO: 3962110 - DNA, 14 bp, Homo sapiens
agctagaaggccac

SEQ ID NO: 3962111 - DNA, 16 bp, Homo sapiens
agctagcgctgccgca

SEQ ID NO: 3962112 - DNA, 13 bp, Homo sapiens
agctaggactgag

SEQ ID NO: 3962113 - DNA, 15 bp, Homo sapiens
agctaggagcaaagc

SEQ ID NO: 3962114 - DNA, 19 bp, Homo sapiens
agctaggagcaaagcctgt

SEQ ID NO: 3962115 - DNA, 21 bp, Homo sapiens
agctaggagcaaagcctgttc

SEQ ID NO: 3962116 - DNA, 20 bp, Homo sapiens
agctagtgacccacatgcca

SEQ ID NO: 3962117 - DNA, 18 bp, Homo sapiens
agctatgattatgccact

SEQ ID NO: 3962118 - DNA, 17 bp, Homo sapiens
agctatggccccagggt

SEQ ID NO: 3962119 - DNA, 19 bp, Homo sapiens
agctatgttccctccagca

SEQ ID NO: 3962120 - DNA, 20 bp, Homo sapiens
agctattactgtctggtttt

SEQ ID NO: 3962121 - DNA, 16 bp, Homo sapiens
agctattgcatgtaaa

SEQ ID NO: 3962122 - DNA, 22 bp, Homo sapiens
agctattttcttacagtggagt

SEQ ID NO: 3962123 - DNA, 14 bp, Homo sapiens
agctcacaaggcag

SEQ ID NO: 3962124 - DNA, 18 bp, Homo sapiens
agctcacaaggcagcaag

SEQ ID NO: 3962125 - DNA, 21 bp, Homo sapiens
agctcacagttcctcgccctg

SEQ ID NO: 3962126 - DNA, 23 bp, Homo sapiens
agctcacagttcctcgccctggg

SEQ ID NO: 3962127 - DNA, 21 bp, Homo sapiens
agctcacccaataaacattaa

SEQ ID NO: 3962128 - DNA, 16 bp, Homo sapiens
agctcagacccccact

SEQ ID NO: 3962129 - DNA, 18 bp, Homo sapiens
agctcagacccccactct

SEQ ID NO: 3962130 - DNA, 23 bp, Homo sapiens
agctcagacttgccaggctccct

SEQ ID NO: 3962131 - DNA, 22 bp, Homo sapiens
agctcagctttttgtcttttct

SEQ ID NO: 3962132 - DNA, 15 bp, Homo sapiens
agctccaacagcttg

SEQ ID NO: 3962133 - DNA, 19 bp, Homo sapiens
agctccacggtgcgtggct

SEQ ID NO: 3962134 - DNA, 23 bp, Homo sapiens
agctccactgtcaccctccacct

SEQ ID NO: 3962135 - DNA, 17 bp, Homo sapiens
agctcccaccccacccc

SEQ ID NO: 3962136 - DNA, 16 bp, Homo sapiens
agctcccatagcgctg

SEQ ID NO: 3962137 - DNA, 19 bp, Homo sapiens
agctcccatagcgctggct

SEQ ID NO: 3962138 - DNA, 19 bp, Homo sapiens
agctcccctcggagaagag

SEQ ID NO: 3962139 - DNA, 20 bp, Homo sapiens
agctcccctcggagaagagc

SEQ ID NO: 3962140 - DNA, 16 bp, Homo sapiens
agctcccttcttccct

SEQ ID NO: 3962141 - DNA, 19 bp, Homo sapiens
agctcccttttctttttcc

SEQ ID NO: 3962142 - DNA, 14 bp, Homo sapiens
agctccgtggagca

SEQ ID NO: 3962143 - DNA, 15 bp, Homo sapiens
agctcctctccttgg

SEQ ID NO: 3962144 - DNA, 18 bp, Homo sapiens
agctcctctgctgctccc

SEQ ID NO: 3962145 - DNA, 12 bp, Homo sapiens
agctcctctgtc

SEQ ID NO: 3962146 - DNA, 20 bp, Homo sapiens
agctcctcttaccgtagcct

SEQ ID NO: 3962147 - DNA, 16 bp, Homo sapiens
agctcctgtccctacc

SEQ ID NO: 3962148 - DNA, 18 bp, Homo sapiens
agctcctgtccctaccca

SEQ ID NO: 3962149 - DNA, 21 bp, Homo sapiens
agctcctgtccctacccactc

SEQ ID NO: 3962150 - DNA, 14 bp, Homo sapiens
agctcctgtcctcc

SEQ ID NO: 3962151 - DNA, 21 bp, Homo sapiens
agctccttttgtccccagggc

SEQ ID NO: 3962152 - DNA, 11 bp, Homo sapiens
agctctccctc

SEQ ID NO: 3962153 - DNA, 17 bp, Homo sapiens
agctctccctctggccc

SEQ ID NO: 3962154 - DNA, 20 bp, Homo sapiens
agctctccctctggccctgc

SEQ ID NO: 3962155 - DNA, 19 bp, Homo sapiens
agctctctgtataaacatt

SEQ ID NO: 3962156 - DNA, 13 bp, Homo sapiens
agctctgagaggc

SEQ ID NO: 3962157 - DNA, 16 bp, Homo sapiens
agctctgagaggccct

SEQ ID NO: 3962158 - DNA, 23 bp, Homo sapiens
agctctgagaggccctggatcag

SEQ ID NO: 3962159 - DNA, 17 bp, Homo sapiens
agctctgccgcaatggc

SEQ ID NO: 3962160 - DNA, 17 bp, Homo sapiens
agctctgtggcctgtgt

SEQ ID NO: 3962161 - DNA, 20 bp, Homo sapiens
agctctgtggcctgtgtcca

SEQ ID NO: 3962162 - DNA, 20 bp, Homo sapiens
agctcttcactcagccacac

SEQ ID NO: 3962163 - DNA, 23 bp, Homo sapiens
agctcttcactcagccacacccc

SEQ ID NO: 3962164 - DNA, 22 bp, Homo sapiens
agctcttccttactcccaggca

SEQ ID NO: 3962165 - DNA, 17 bp, Homo sapiens
agctcttcggtttctga

SEQ ID NO: 3962166 - DNA, 20 bp, Homo sapiens
agctcttcggtttctgagca

SEQ ID NO: 3962167 - DNA, 13 bp, Homo sapiens
agctcttctattt

SEQ ID NO: 3962168 - DNA, 14 bp, Homo sapiens
agctcttctattta

SEQ ID NO: 3962169 - DNA, 20 bp, Homo sapiens
agctcttctatttaaaaaat

SEQ ID NO: 3962170 - DNA, 22 bp, Homo sapiens
agctgaaacattccgaagaggg

SEQ ID NO: 3962171 - DNA, 14 bp, Homo sapiens
agctgaaagttggg

SEQ ID NO: 3962172 - DNA, 22 bp, Homo sapiens
agctgaacagccaaatgcatgg

SEQ ID NO: 3962173 - DNA, 13 bp, Homo sapiens
agctgaagacaaa

SEQ ID NO: 3962174 - DNA, 16 bp, Homo sapiens
agctgaagattttgga

SEQ ID NO: 3962175 - DNA, 18 bp, Homo sapiens
agctgaagcctatttatt

SEQ ID NO: 3962176 - DNA, 21 bp, Homo sapiens
agctgaagtgaaggagaaagg

SEQ ID NO: 3962177 - DNA, 14 bp, Homo sapiens
agctgacagataca

SEQ ID NO: 3962178 - DNA, 21 bp, Homo sapiens
agctgacccagagtggagtct

SEQ ID NO: 3962179 - DNA, 22 bp, Homo sapiens
agctgacccagagtggagtctg

SEQ ID NO: 3962180 - DNA, 15 bp, Homo sapiens
agctgagagactttt

SEQ ID NO: 3962181 - DNA, 21 bp, Homo sapiens
ttccaggcccctgaggactgg

SEQ ID NO: 3962182 - DNA, 11 bp, Homo sapiens
ttccaggctct

SEQ ID NO: 3962183 - DNA, 20 bp, Homo sapiens
ttccaggctcttcctggacc

SEQ ID NO: 3962184 - DNA, 18 bp, Homo sapiens
ttccagtctctgcatgta

SEQ ID NO: 3962185 - DNA, 15 bp, Homo sapiens
ttccataaacaccca

SEQ ID NO: 3962186 - DNA, 14 bp, Homo sapiens
ttccatgcctgagg

SEQ ID NO: 3962187 - DNA, 17 bp, Homo sapiens
ttccatgtcgcctctgc

SEQ ID NO: 3962188 - DNA, 12 bp, Homo sapiens
ttcccaaatttc

SEQ ID NO: 3962189 - DNA, 16 bp, Homo sapiens
ttcccaactgctctgc

SEQ ID NO: 3962190 - DNA, 17 bp, Homo sapiens
ttcccaactgctctgcc

SEQ ID NO: 3962191 - DNA, 16 bp, Homo sapiens
ttcccaataaaagtga

SEQ ID NO: 3962192 - DNA, 17 bp, Homo sapiens
ttcccaatcagcactga

SEQ ID NO: 3962193 - DNA, 18 bp, Homo sapiens
ttcccaatcagcactgaa

SEQ ID NO: 3962194 - DNA, 21 bp, Homo sapiens
ttcccactaagctttctcctt

SEQ ID NO: 3962195 - DNA, 15 bp, Homo sapiens
ttcccagagacagga

SEQ ID NO: 3962196 - DNA, 19 bp, Homo sapiens
ttcccagagacaggaaaat

SEQ ID NO: 3962197 - DNA, 22 bp, Homo sapiens
ttcccagagacaggaaaatcct

SEQ ID NO: 3962198 - DNA, 18 bp, Homo sapiens
ttcccagagcaaaataat

SEQ ID NO: 3962199 - DNA, 11 bp, Homo sapiens
ttcccagaggc

SEQ ID NO: 3962200 - DNA, 14 bp, Homo sapiens
ttcccagaggcaga

SEQ ID NO: 3962201 - DNA, 22 bp, Homo sapiens
ttcccagagtcagaggagaaga

SEQ ID NO: 3962202 - DNA, 14 bp, Homo sapiens
ttcccagatacttc

SEQ ID NO: 3962203 - DNA, 23 bp, Homo sapiens
ttcccagcagctgggccggccag

SEQ ID NO: 3962204 - DNA, 18 bp, Homo sapiens
ttcccagcattcagtggt

SEQ ID NO: 3962205 - DNA, 16 bp, Homo sapiens
ttcccagctctccctc

SEQ ID NO: 3962206 - DNA, 19 bp, Homo sapiens
ttcccagctctccctctgg

SEQ ID NO: 3962207 - DNA, 16 bp, Homo sapiens
ttcccatgatccagaa

SEQ ID NO: 3962208 - DNA, 16 bp, Homo sapiens
ttcccatgctgaatta

SEQ ID NO: 3962209 - DNA, 22 bp, Homo sapiens
ttcccatgtgtgactccagcct

SEQ ID NO: 3962210 - DNA, 23 bp, Homo sapiens
ttcccattgcatcacctctgtaa

SEQ ID NO: 3962211 - DNA, 15 bp, Homo sapiens
ttccccaaagtctta

SEQ ID NO: 3962212 - DNA, 19 bp, Homo sapiens
ttccccacctcttccttcc

SEQ ID NO: 3962213 - DNA, 19 bp, Homo sapiens
ttccccagactcagctcca

SEQ ID NO: 3962214 - DNA, 21 bp, Homo sapiens
ttccccagactcagctccaga

SEQ ID NO: 3962215 - DNA, 14 bp, Homo sapiens
ttcccccagacaga

SEQ ID NO: 3962216 - DNA, 20 bp, Homo sapiens
ttcccccatcccctttcctc

SEQ ID NO: 3962217 - DNA, 23 bp, Homo sapiens
ttcccccatcccctttcctcccc

SEQ ID NO: 3962218 - DNA, 22 bp, Homo sapiens
ttcccctctgtgtcctctcccc

SEQ ID NO: 3962219 - DNA, 23 bp, Homo sapiens
ttcccctctgtgtcctctcccct

SEQ ID NO: 3962220 - DNA, 12 bp, Homo sapiens
ttcccctgtggt

SEQ ID NO: 3962221 - DNA, 14 bp, Homo sapiens
ttccccttgccctt

SEQ ID NO: 3962222 - DNA, 20 bp, Homo sapiens
ttccccttgcccttgccctg

SEQ ID NO: 3962223 - DNA, 22 bp, Homo sapiens
ttccccttgcccttgccctgac

SEQ ID NO: 3962224 - DNA, 23 bp, Homo sapiens
ttccccttgcccttgccctgacc

SEQ ID NO: 3962225 - DNA, 18 bp, Homo sapiens
ttccccttttgcctggct

SEQ ID NO: 3962226 - DNA, 20 bp, Homo sapiens
ttccccttttgcctggctgt

SEQ ID NO: 3962227 - DNA, 21 bp, Homo sapiens
ttcccgagcaaagtctaaagt

SEQ ID NO: 3962228 - DNA, 17 bp, Homo sapiens
ttcccggagcacagccc

SEQ ID NO: 3962229 - DNA, 23 bp, Homo sapiens
ttccctaggctgagctggcattg

SEQ ID NO: 3962230 - DNA, 23 bp, Homo sapiens
ttatctagaaagaaaagaccctg

SEQ ID NO: 3962231 - DNA, 11 bp, Homo sapiens
ttatctctgta

SEQ ID NO: 3962232 - DNA, 23 bp, Homo sapiens
ttatctgatcgggataacaaaat

SEQ ID NO: 3962233 - DNA, 16 bp, Homo sapiens
ttatctgcctggcctg

SEQ ID NO: 3962234 - DNA, 19 bp, Homo sapiens
ttatctgcctggcctggct

SEQ ID NO: 3962235 - DNA, 15 bp, Homo sapiens
ttatcttacttttgg

SEQ ID NO: 3962236 - DNA, 20 bp, Homo sapiens
ttatgaggtgaaacaattat

SEQ ID NO: 3962237 - DNA, 14 bp, Homo sapiens
ttatgcactggcca

SEQ ID NO: 3962238 - DNA, 15 bp, Homo sapiens
ttatgctattaaagt

SEQ ID NO: 3962239 - DNA, 19 bp, Homo sapiens
ttatgcttaaaatatgtat

SEQ ID NO: 3962240 - DNA, 16 bp, Homo sapiens
ttatggaaatatagtt

SEQ ID NO: 3962241 - DNA, 16 bp, Homo sapiens
ttatggcttataaatg

SEQ ID NO: 3962242 - DNA, 19 bp, Homo sapiens
ttatggcttataaatgtgt

SEQ ID NO: 3962243 - DNA, 13 bp, Homo sapiens
ttatggtgaaatt

SEQ ID NO: 3962244 - DNA, 14 bp, Homo sapiens
ttatggtgaaatta

SEQ ID NO: 3962245 - DNA, 15 bp, Homo sapiens
ttatggtgtaatgca

SEQ ID NO: 3962246 - DNA, 17 bp, Homo sapiens
ttatggtgtgttcctaa

SEQ ID NO: 3962247 - DNA, 19 bp, Homo sapiens
ttatgtctcaaaataagtt

SEQ ID NO: 3962248 - DNA, 17 bp, Homo sapiens
ttatgtgtgcatgtgtg

SEQ ID NO: 3962249 - DNA, 16 bp, Homo sapiens
ttatgtgtgggaaagg

SEQ ID NO: 3962250 - DNA, 14 bp, Homo sapiens
ttattaaaatgatt

SEQ ID NO: 3962251 - DNA, 19 bp, Homo sapiens
ttattaaagcaacatttta

SEQ ID NO: 3962252 - DNA, 19 bp, Homo sapiens
ttattaacgggcatgtatt

SEQ ID NO: 3962253 - DNA, 23 bp, Homo sapiens
ttattaagtctgggatgtagaac

SEQ ID NO: 3962254 - DNA, 24 bp, Homo sapiens
ttattaagtctgggatgtagaact

SEQ ID NO: 3962255 - DNA, 22 bp, Homo sapiens
ttattaagttctcaatgtgaaa

SEQ ID NO: 3962256 - DNA, 16 bp, Homo sapiens
ttattacatttataca

SEQ ID NO: 3962257 - DNA, 18 bp, Homo sapiens
ttattacatttatacatc

SEQ ID NO: 3962258 - DNA, 20 bp, Homo sapiens
ttattacttgttgcaaaggt

SEQ ID NO: 3962259 - DNA, 20 bp, Homo sapiens
ttattagtaagaaaacatca

SEQ ID NO: 3962260 - DNA, 16 bp, Homo sapiens
ttattattagattctc

SEQ ID NO: 3962261 - DNA, 13 bp, Homo sapiens
ttatttgtacagt

SEQ ID NO: 3962262 - DNA, 14 bp, Homo sapiens
ttatttgtacagtt

SEQ ID NO: 3962263 - DNA, 13 bp, Homo sapiens
ttatttgtgtaat

SEQ ID NO: 3962264 - DNA, 20 bp, Homo sapiens
ttatttgtttatatttaatt

SEQ ID NO: 3962265 - DNA, 17 bp, Homo sapiens
ttattttaaacaaaata

SEQ ID NO: 3962266 - DNA, 24 bp, Homo sapiens
ttattttaatattttgtattttca

SEQ ID NO: 3962267 - DNA, 18 bp, Homo sapiens
ttattttaggagacagtc

SEQ ID NO: 3962268 - DNA, 12 bp, Homo sapiens
ttattttcagta

SEQ ID NO: 3962269 - DNA, 16 bp, Homo sapiens
ttattttctatagctc

SEQ ID NO: 3962270 - DNA, 15 bp, Homo sapiens
ttattttctttttgt

SEQ ID NO: 3962271 - DNA, 15 bp, Homo sapiens
ttattttgaaatttg

SEQ ID NO: 3962272 - DNA, 14 bp, Homo sapiens
ttattttgcactgt

SEQ ID NO: 3962273 - DNA, 19 bp, Homo sapiens
ttattttgttacactaaag

SEQ ID NO: 3962274 - DNA, 11 bp, Homo sapiens
ttatttttgaa

SEQ ID NO: 3962275 - DNA, 18 bp, Homo sapiens
ttattttttctacacagt

SEQ ID NO: 3962276 - DNA, 17 bp, Homo sapiens
ttcaaaaaaacactagt

SEQ ID NO: 3962277 - DNA, 21 bp, Homo sapiens
ttcaaaagaatcagaaacagg

SEQ ID NO: 3962278 - DNA, 14 bp, Homo sapiens
ttcaaaagacatgt

SEQ ID NO: 3962279 - DNA, 11 bp, Homo sapiens
ttcaaaagtgg

SEQ ID NO: 3962280 - DNA, 14 bp, Homo sapiens
ttcaaaatgttcgt

SEQ ID NO: 3962281 - DNA, 19 bp, Homo sapiens
ttcaaaccatttaattcat

SEQ ID NO: 3962282 - DNA, 20 bp, Homo sapiens
ttcaaactgacaacctgtgc

SEQ ID NO: 3962283 - DNA, 22 bp, Homo sapiens
ttcaaagagactaatagagaca

SEQ ID NO: 3962284 - DNA, 21 bp, Homo sapiens
ttcaaagttgtagttcttgtg

SEQ ID NO: 3962285 - DNA, 12 bp, Homo sapiens
ttcaaatcctca

SEQ ID NO: 3962286 - DNA, 16 bp, Homo sapiens
ttcaaatgaacacgtg

SEQ ID NO: 3962287 - DNA, 13 bp, Homo sapiens
ttcaaatttcaca

SEQ ID NO: 3962288 - DNA, 18 bp, Homo sapiens
ttcaaccagcattttact

SEQ ID NO: 3962289 - DNA, 23 bp, Homo sapiens
ttcaaccagcattttactacttg

SEQ ID NO: 3962290 - DNA, 20 bp, Homo sapiens
ttcaaccattccccatggga

SEQ ID NO: 3962291 - DNA, 19 bp, Homo sapiens
ttcaacctggtggcaccag

SEQ ID NO: 3962292 - DNA, 13 bp, Homo sapiens
ttcaacgcagccc

SEQ ID NO: 3962293 - DNA, 15 bp, Homo sapiens
ttcaacgcagccctg

SEQ ID NO: 3962294 - DNA, 21 bp, Homo sapiens
ttcaactccagaagtggggct

SEQ ID NO: 3962295 - DNA, 14 bp, Homo sapiens
ttcaactgaaaaga

SEQ ID NO: 3962296 - DNA, 21 bp, Homo sapiens
ttcaagaaaaaataaatggaa

SEQ ID NO: 3962297 - DNA, 12 bp, Homo sapiens
ttcaagaaataa

SEQ ID NO: 3962298 - DNA, 13 bp, Homo sapiens
ttcaagacttgat

SEQ ID NO: 3962299 - DNA, 16 bp, Homo sapiens
ttcaagcacctgcaga

SEQ ID NO: 3962300 - DNA, 19 bp, Homo sapiens
ttcaaggagatataaaatc

SEQ ID NO: 3962301 - DNA, 15 bp, Homo sapiens
ttcaagggaagaaac

SEQ ID NO: 3962302 - DNA, 21 bp, Homo sapiens
ttcaagggaagaaacactctt

SEQ ID NO: 3962303 - DNA, 17 bp, Homo sapiens
ttcaaggtctgcttttc

SEQ ID NO: 3962304 - DNA, 21 bp, Homo sapiens
ttcaagtattaggggtaatat

SEQ ID NO: 3962305 - DNA, 14 bp, Homo sapiens
ttcaagtgatatat

SEQ ID NO: 3962306 - DNA, 17 bp, Homo sapiens
ttcaagtgatatatgta

SEQ ID NO: 3962307 - DNA, 18 bp, Homo sapiens
ttcaagtgatatatgtat

SEQ ID NO: 3962308 - DNA, 20 bp, Homo sapiens
ttcaagtgatatatgtattt

SEQ ID NO: 3962309 - DNA, 22 bp, Homo sapiens
ttcaagtgcatgctctctgcag

SEQ ID NO: 3962310 - DNA, 14 bp, Homo sapiens
ttcaagttattgta

SEQ ID NO: 3962311 - DNA, 17 bp, Homo sapiens
ttcaagttattgtacag

SEQ ID NO: 3962312 - DNA, 21 bp, Homo sapiens
ttcaataaaaaaaagaaatga

SEQ ID NO: 3962313 - DNA, 21 bp, Homo sapiens
ttcacaaccttctgtggctca

SEQ ID NO: 3962314 - DNA, 20 bp, Homo sapiens
ttcacaatgaaatgctctcc

SEQ ID NO: 3962315 - DNA, 23 bp, Homo sapiens
ttcacagttggctggatgaaatt

SEQ ID NO: 3962316 - DNA, 21 bp, Homo sapiens
ttcacatacgtgtctgtgtgt

SEQ ID NO: 3962317 - DNA, 17 bp, Homo sapiens
ttcaccccccactcacc

SEQ ID NO: 3962318 - DNA, 14 bp, Homo sapiens
ttcaccttatgtat

SEQ ID NO: 3962319 - DNA, 17 bp, Homo sapiens
ttcaccttatgtattat

SEQ ID NO: 3962320 - DNA, 15 bp, Homo sapiens
ttcacctttggtgca

SEQ ID NO: 3962321 - DNA, 22 bp, Homo sapiens
ttcacctttggtgcagaggttt

SEQ ID NO: 3962322 - DNA, 15 bp, Homo sapiens
ttcactattagagaa

SEQ ID NO: 3962323 - DNA, 15 bp, Homo sapiens
ttcactcagccacac

SEQ ID NO: 3962324 - DNA, 17 bp, Homo sapiens
ttcactcagccacaccc

SEQ ID NO: 3962325 - DNA, 19 bp, Homo sapiens
ttcactcagccacacccca

SEQ ID NO: 3962326 - DNA, 14 bp, Homo sapiens
ttcactgccatgcc

SEQ ID NO: 3962327 - DNA, 16 bp, Homo sapiens
ttcactggagttacat

SEQ ID NO: 3962328 - DNA, 13 bp, Homo sapiens
ttcactgtaagtt

SEQ ID NO: 3962329 - DNA, 22 bp, Homo sapiens
ttcactgtgttggccaggctgg

SEQ ID NO: 3962330 - DNA, 12 bp, Homo sapiens
ttcactttaaag

SEQ ID NO: 3962331 - DNA, 17 bp, Homo sapiens
ttcactttcaaaaacat

SEQ ID NO: 3962332 - DNA, 14 bp, Homo sapiens
ttcagaagcatcac

SEQ ID NO: 3962333 - DNA, 16 bp, Homo sapiens
ttcagaattttgtata

SEQ ID NO: 3962334 - DNA, 10 bp, Homo sapiens
ttcagacccc

SEQ ID NO: 3962335 - DNA, 15 bp, Homo sapiens
ttcagaccccagcgg

SEQ ID NO: 3962336 - DNA, 23 bp, Homo sapiens
ttcagacctgacaccgtccctca

SEQ ID NO: 3962337 - DNA, 18 bp, Homo sapiens
ttcagacttttatcaaaa

SEQ ID NO: 3962338 - DNA, 21 bp, Homo sapiens
ttcagacttttatcaaaatcc

SEQ ID NO: 3962339 - DNA, 13 bp, Homo sapiens
ttcagagccagtg

SEQ ID NO: 3962340 - DNA, 18 bp, Homo sapiens
ttcagcattaggctttta

SEQ ID NO: 3962341 - DNA, 18 bp, Homo sapiens
ttcagccacaaagtagtt

SEQ ID NO: 3962342 - DNA, 19 bp, Homo sapiens
ttcagcccctagtgctatt

SEQ ID NO: 3962343 - DNA, 13 bp, Homo sapiens
ttcagcccctcct

SEQ ID NO: 3962344 - DNA, 19 bp, Homo sapiens
ttcagcccctcctctgcca

SEQ ID NO: 3962345 - DNA, 20 bp, Homo sapiens
ttcagcccctcctctgccac

SEQ ID NO: 3962346 - DNA, 14 bp, Homo sapiens
ttcagctaagctag

SEQ ID NO: 3962347 - DNA, 20 bp, Homo sapiens
ttcagctaagctaggaatga

SEQ ID NO: 3962348 - DNA, 21 bp, Homo sapiens
ttcagctcccatagcgctggc

SEQ ID NO: 3962349 - DNA, 18 bp, Homo sapiens
ttcagctctctgtataaa

SEQ ID NO: 3962350 - DNA, 17 bp, Homo sapiens
ttcaggaaaaggcctgg

SEQ ID NO: 3962351 - DNA, 19 bp, Homo sapiens
ttcaggaaaaggcctgggg

SEQ ID NO: 3962352 - DNA, 14 bp, Homo sapiens
ttcaggaagatgaa

SEQ ID NO: 3962353 - DNA, 16 bp, Homo sapiens
ttcaggacatggggca

SEQ ID NO: 3962354 - DNA, 20 bp, Homo sapiens
ttcaggaggccctggtgtca

SEQ ID NO: 3962355 - DNA, 17 bp, Homo sapiens
ttcaggagggtccccag

SEQ ID NO: 3962356 - DNA, 22 bp, Homo sapiens
ttcaggagggtccccagctggt

SEQ ID NO: 3962357 - DNA, 16 bp, Homo sapiens
ttcaggcattttgttc

SEQ ID NO: 3962358 - DNA, 15 bp, Homo sapiens
ttcaggctcttctcc

SEQ ID NO: 3962359 - DNA, 16 bp, Homo sapiens
ttcagggccagaagga

SEQ ID NO: 3962360 - DNA, 21 bp, Homo sapiens
ttcaggggggttgtgaggcct

SEQ ID NO: 3962361 - DNA, 16 bp, Homo sapiens
ttcagggtatcccaga

SEQ ID NO: 3962362 - DNA, 13 bp, Homo sapiens
ttcaggtaggccc

SEQ ID NO: 3962363 - DNA, 21 bp, Homo sapiens
ttcaggtaggcccttgtcctg

SEQ ID NO: 3962364 - DNA, 15 bp, Homo sapiens
ttcaggtgaaaatgt

SEQ ID NO: 3962365 - DNA, 19 bp, Homo sapiens
ttcaggttttgtaaagatg

SEQ ID NO: 3962366 - DNA, 21 bp, Homo sapiens
ttcagtaggctttatgctgtg

SEQ ID NO: 3962367 - DNA, 19 bp, Homo sapiens
ttcagtattttggagaaat

SEQ ID NO: 3962368 - DNA, 21 bp, Homo sapiens
ttcagtattttggagaaatta

SEQ ID NO: 3962369 - DNA, 14 bp, Homo sapiens
ttcagtgggagaaa

SEQ ID NO: 3962370 - DNA, 17 bp, Homo sapiens
ttcagttcctctttgca

SEQ ID NO: 3962371 - DNA, 13 bp, Homo sapiens
ttcataattagaa

SEQ ID NO: 3962372 - DNA, 16 bp, Homo sapiens
ttcataattagaacaa

SEQ ID NO: 3962373 - DNA, 17 bp, Homo sapiens
ttcataattagaacaat

SEQ ID NO: 3962374 - DNA, 21 bp, Homo sapiens
ttcataattagaacaatagct

SEQ ID NO: 3962375 - DNA, 22 bp, Homo sapiens
ttcataggcggtcatgtgtgca

SEQ ID NO: 3962376 - DNA, 12 bp, Homo sapiens
ttcatcaatttt

SEQ ID NO: 3962377 - DNA, 18 bp, Homo sapiens
ttcatcaatttttataca

SEQ ID NO: 3962378 - DNA, 22 bp, Homo sapiens
ttcatcaatttttatacatatc

SEQ ID NO: 3962379 - DNA, 21 bp, Homo sapiens
ttcatcatgttggccaggctg

SEQ ID NO: 3962380 - DNA, 13 bp, Homo sapiens
ttcatcctggcct

SEQ ID NO: 3962381 - DNA, 17 bp, Homo sapiens
ttcatcctggcctcctt

SEQ ID NO: 3962382 - DNA, 18 bp, Homo sapiens
ttcatcgaacaaactgat

SEQ ID NO: 3962383 - DNA, 13 bp, Homo sapiens
ttcatctactaca

SEQ ID NO: 3962384 - DNA, 16 bp, Homo sapiens
ttcatgagtggatgga

SEQ ID NO: 3962385 - DNA, 21 bp, Homo sapiens
ttcatgccaattagcaattga

SEQ ID NO: 3962386 - DNA, 16 bp, Homo sapiens
ttcatgccatctgttt

SEQ ID NO: 3962387 - DNA, 18 bp, Homo sapiens
ttcatgccatctgttttc

SEQ ID NO: 3962388 - DNA, 19 bp, Homo sapiens
ttcatgccatctgttttca

SEQ ID NO: 3962389 - DNA, 13 bp, Homo sapiens
ttcatgcctcagt

SEQ ID NO: 3962390 - DNA, 14 bp, Homo sapiens
ttcatgctcagccc

SEQ ID NO: 3962391 - DNA, 16 bp, Homo sapiens
ttcatgctttctcctt

SEQ ID NO: 3962392 - DNA, 14 bp, Homo sapiens
ttcatttaaaatga

SEQ ID NO: 3962393 - DNA, 15 bp, Homo sapiens
ttcatttaaaatgat

SEQ ID NO: 3962394 - DNA, 20 bp, Homo sapiens
ttcattttaatttatatttg

SEQ ID NO: 3962395 - DNA, 17 bp, Homo sapiens
ttcattttgaaaaacac

SEQ ID NO: 3962396 - DNA, 22 bp, Homo sapiens
ttccaaataaggatttgttcac

SEQ ID NO: 3962397 - DNA, 15 bp, Homo sapiens
ttccaaccccagctg

SEQ ID NO: 3962398 - DNA, 13 bp, Homo sapiens
ttccaagcccttt

SEQ ID NO: 3962399 - DNA, 21 bp, Homo sapiens
ttccaagggtatgggaagcca

SEQ ID NO: 3962400 - DNA, 19 bp, Homo sapiens
ttccaagttcctgcactcc

SEQ ID NO: 3962401 - DNA, 21 bp, Homo sapiens
ttccacaagattcccagagac

SEQ ID NO: 3962402 - DNA, 19 bp, Homo sapiens
ttccacacctagcatctca

SEQ ID NO: 3962403 - DNA, 20 bp, Homo sapiens
ttccactgcaaatttcaaaa

SEQ ID NO: 3962404 - DNA, 15 bp, Homo sapiens
ttccagaaaatataa

SEQ ID NO: 3962405 - DNA, 20 bp, Homo sapiens
ttccagaaaatataaatgca

SEQ ID NO: 3962406 - DNA, 21 bp, Homo sapiens
ttccagaaaatataaatgcat

SEQ ID NO: 3962407 - DNA, 11 bp, Homo sapiens
ttccagaccac

SEQ ID NO: 3962408 - DNA, 13 bp, Homo sapiens
ttccagaccacct

SEQ ID NO: 3962409 - DNA, 19 bp, Homo sapiens
ttccagaccacctgccagc

SEQ ID NO: 3962410 - DNA, 23 bp, Homo sapiens
ttccagaccacctgccagccatc

SEQ ID NO: 3962411 - DNA, 17 bp, Homo sapiens
ttccagagagtcctctg

SEQ ID NO: 3962412 - DNA, 17 bp, Homo sapiens
ttccagagagtggctcc

SEQ ID NO: 3962413 - DNA, 21 bp, Homo sapiens
ttccagagagtggctcctccc

SEQ ID NO: 3962414 - DNA, 23 bp, Homo sapiens
ttccagataaccagctgtaacac

SEQ ID NO: 3962415 - DNA, 18 bp, Homo sapiens
ttccagattcttccactg

SEQ ID NO: 3962416 - DNA, 17 bp, Homo sapiens
ttccaggagggaaaatg

SEQ ID NO: 3962417 - DNA, 18 bp, Homo sapiens
ttccaggatcctgcagga

SEQ ID NO: 3962418 - DNA, 12 bp, Homo sapiens
ttccaggcccct

SEQ ID NO: 3962419 - DNA, 22 bp, Homo sapiens
ttccagggcatccgcagcccag

SEQ ID NO: 3962420 - DNA, 18 bp, Homo sapiens
ttccaggtatctccagga

SEQ ID NO: 3962421 - DNA, 19 bp, Homo sapiens
ttccaggtatctccaggat

SEQ ID NO: 3962422 - DNA, 16 bp, Homo sapiens
ttccagtgcaacaaaa

SEQ ID NO: 3962423 - DNA, 19 bp, Homo sapiens
ttccataatctggactcct

SEQ ID NO: 3962424 - DNA, 23 bp, Homo sapiens
ttccataatctggactcctctgt

SEQ ID NO: 3962425 - DNA, 19 bp, Homo sapiens
ttccatcaggttccatccc

SEQ ID NO: 3962426 - DNA, 20 bp, Homo sapiens
ttatttaatgtttgatttag

SEQ ID NO: 3962427 - DNA, 14 bp, Homo sapiens
ttatttacttgaaa

SEQ ID NO: 3962428 - DNA, 19 bp, Homo sapiens
ttatttacttgtagaaatc

SEQ ID NO: 3962429 - DNA, 21 bp, Homo sapiens
ttatttctagcagagtgagga

SEQ ID NO: 3962430 - DNA, 12 bp, Homo sapiens
ttatttctgtca

SEQ ID NO: 3962431 - DNA, 16 bp, Homo sapiens
ttatttctgtcattca

SEQ ID NO: 3962432 - DNA, 11 bp, Homo sapiens
aaaaaaaatgg

SEQ ID NO: 3962433 - DNA, 13 bp, Homo sapiens
aaaaaaaattgca

SEQ ID NO: 3962434 - DNA, 10 bp, Homo sapiens
aaaaaaactg

SEQ ID NO: 3962435 - DNA, 10 bp, Homo sapiens
aaaaaaagaa

SEQ ID NO: 3962436 - DNA, 10 bp, Homo sapiens
aaaaaaatac

SEQ ID NO: 3962437 - DNA, 12 bp, Homo sapiens
aaaaaaatacag

SEQ ID NO: 3962438 - DNA, 12 bp, Homo sapiens
aaaaaaatgaca

SEQ ID NO: 3962439 - DNA, 13 bp, Homo sapiens
aaaaaaatgacta

SEQ ID NO: 3962440 - DNA, 12 bp, Homo sapiens
aaaaaagaaacc

SEQ ID NO: 3962441 - DNA, 21 bp, Homo sapiens
aaaaaagagaaaaaccaatga

SEQ ID NO: 3962442 - DNA, 18 bp, Homo sapiens
aaaaaagttttgatgaaa

SEQ ID NO: 3962443 - DNA, 11 bp, Homo sapiens
aaaaaattgca

SEQ ID NO: 3962444 - DNA, 15 bp, Homo sapiens
aaaaaattgcacaat

SEQ ID NO: 3962445 - DNA, 19 bp, Homo sapiens
aaaaacagcctcacagaag

SEQ ID NO: 3962446 - DNA, 16 bp, Homo sapiens
aaaaaccaatcatttt

SEQ ID NO: 3962447 - DNA, 19 bp, Homo sapiens
aaaaaccaatcattttaag

SEQ ID NO: 3962448 - DNA, 19 bp, Homo sapiens
aaaaacccagcaacagaaa

SEQ ID NO: 3962449 - DNA, 20 bp, Homo sapiens
aaaaactaaatctctaatat

SEQ ID NO: 3962450 - DNA, 12 bp, Homo sapiens
aaaaactgaatg

SEQ ID NO: 3962451 - DNA, 22 bp, Homo sapiens
aaaaactgatcaaaaataaact

SEQ ID NO: 3962452 - DNA, 20 bp, Homo sapiens
aaaaagagaaaaaccaatga

SEQ ID NO: 3962453 - DNA, 20 bp, Homo sapiens
aaaaaggaaagaaaactaac

SEQ ID NO: 3962454 - DNA, 13 bp, Homo sapiens
aaaaagtttgttt

SEQ ID NO: 3962455 - DNA, 13 bp, Homo sapiens
aaaaagttttgat

SEQ ID NO: 3962456 - DNA, 12 bp, Homo sapiens
aaaaataaacta

SEQ ID NO: 3962457 - DNA, 18 bp, Homo sapiens
aaaaatacaccacgaatt

SEQ ID NO: 3962458 - DNA, 14 bp, Homo sapiens
aaaaatacagtaaa

SEQ ID NO: 3962459 - DNA, 23 bp, Homo sapiens
aaaaatactatgaaatgaaagaa

SEQ ID NO: 3962460 - DNA, 16 bp, Homo sapiens
aaaaatattataactt

SEQ ID NO: 3962461 - DNA, 12 bp, Homo sapiens
aaaaatctgttt

SEQ ID NO: 3962462 - DNA, 13 bp, Homo sapiens
aaaaatcttgggc

SEQ ID NO: 3962463 - DNA, 12 bp, Homo sapiens
aaaaatgaaagc

SEQ ID NO: 3962464 - DNA, 14 bp, Homo sapiens
aaaaatgaaattat

SEQ ID NO: 3962465 - DNA, 20 bp, Homo sapiens
aaaaatgactaaaaatatta

SEQ ID NO: 3962466 - DNA, 14 bp, Homo sapiens
aaaaattaaagccc

SEQ ID NO: 3962467 - DNA, 14 bp, Homo sapiens
aaatataaatgcat

SEQ ID NO: 3962468 - DNA, 22 bp, Homo sapiens
aaatataaccattacatgttta

SEQ ID NO: 3962469 - DNA, 23 bp, Homo sapiens
aaatataaccattacatgtttaa

SEQ ID NO: 3962470 - DNA, 19 bp, Homo sapiens
aaatataagctgggaaaaa

SEQ ID NO: 3962471 - DNA, 14 bp, Homo sapiens
aaatatacaaacat

SEQ ID NO: 3962472 - DNA, 10 bp, Homo sapiens
aaatatagcg

SEQ ID NO: 3962473 - DNA, 21 bp, Homo sapiens
aaatatataaaaagaaaagat

SEQ ID NO: 3962474 - DNA, 14 bp, Homo sapiens
aaatatatataaat

SEQ ID NO: 3962475 - DNA, 15 bp, Homo sapiens
aaatatatataaata

SEQ ID NO: 3962476 - DNA, 19 bp, Homo sapiens
aaatatatataaatatata

SEQ ID NO: 3962477 - DNA, 16 bp, Homo sapiens
aaatatatatacatat

SEQ ID NO: 3962478 - DNA, 13 bp, Homo sapiens
aaatatatatagt

SEQ ID NO: 3962479 - DNA, 15 bp, Homo sapiens
aaatatatattgtat

SEQ ID NO: 3962480 - DNA, 16 bp, Homo sapiens
aaatatatatttttca

SEQ ID NO: 3962481 - DNA, 22 bp, Homo sapiens
aaatatatatttttcaaccagc

SEQ ID NO: 3962482 - DNA, 12 bp, Homo sapiens
aaatatatgtct

SEQ ID NO: 3962483 - DNA, 18 bp, Homo sapiens
aaatatcagttactcagc

SEQ ID NO: 3962484 - DNA, 13 bp, Homo sapiens
aaatatgaaatga

SEQ ID NO: 3962485 - DNA, 19 bp, Homo sapiens
aaatatgattttatttgac

SEQ ID NO: 3962486 - DNA, 20 bp, Homo sapiens
aaatatgattttatttgaca

SEQ ID NO: 3962487 - DNA, 16 bp, Homo sapiens
aaatatgcaaagcact

SEQ ID NO: 3962488 - DNA, 20 bp, Homo sapiens
aaatattataacttaaaaaa

SEQ ID NO: 3962489 - DNA, 23 bp, Homo sapiens
aaatattattgtggaaatgaata

SEQ ID NO: 3962490 - DNA, 20 bp, Homo sapiens
aaatattcctgcatttgtga

SEQ ID NO: 3962491 - DNA, 12 bp, Homo sapiens
aaatatttaagt

SEQ ID NO: 3962492 - DNA, 13 bp, Homo sapiens
aaatatttatgct

SEQ ID NO: 3962493 - DNA, 23 bp, Homo sapiens
aaatatttatgcttaaaatatgt

SEQ ID NO: 3962494 - DNA, 17 bp, Homo sapiens
aaatatttggtctctat

SEQ ID NO: 3962495 - DNA, 14 bp, Homo sapiens
aaatcaaaagctgc

SEQ ID NO: 3962496 - DNA, 12 bp, Homo sapiens
aaatcaaatatg

SEQ ID NO: 3962497 - DNA, 14 bp, Homo sapiens
aaatcaaatatgca

SEQ ID NO: 3962498 - DNA, 14 bp, Homo sapiens
aaatcaaccccaga

SEQ ID NO: 3962499 - DNA, 19 bp, Homo sapiens
aaatcacaagcaataatta

SEQ ID NO: 3962500 - DNA, 20 bp, Homo sapiens
aaatcacttgtaaataaata

SEQ ID NO: 3962501 - DNA, 22 bp, Homo sapiens
aaatcagttatattctttaaat

SEQ ID NO: 3962502 - DNA, 16 bp, Homo sapiens
aaatcagttatgtcaa

SEQ ID NO: 3962503 - DNA, 19 bp, Homo sapiens
aaatcattaatactcttct

SEQ ID NO: 3962504 - DNA, 15 bp, Homo sapiens
aaatcattgtagaaa

SEQ ID NO: 3962505 - DNA, 23 bp, Homo sapiens
aaatcatttctgcatcagctgct

SEQ ID NO: 3962506 - DNA, 14 bp, Homo sapiens
aaatccacagccaa

SEQ ID NO: 3962507 - DNA, 11 bp, Homo sapiens
aaatcctctgg

SEQ ID NO: 3962508 - DNA, 18 bp, Homo sapiens
aaatcctttttctttata

SEQ ID NO: 3962509 - DNA, 18 bp, Homo sapiens
aaatctaatattaaaaat

SEQ ID NO: 3962510 - DNA, 19 bp, Homo sapiens
aaatctaatgtaagaaaat

SEQ ID NO: 3962511 - DNA, 16 bp, Homo sapiens
aaatctagatcaatta

SEQ ID NO: 3962512 - DNA, 23 bp, Homo sapiens
aaatctagatcaattaattctta

SEQ ID NO: 3962513 - DNA, 19 bp, Homo sapiens
aaatctagttttttttgta

SEQ ID NO: 3962514 - DNA, 13 bp, Homo sapiens
aaatctattcaga

SEQ ID NO: 3962515 - DNA, 13 bp, Homo sapiens
aaatctctaatat

SEQ ID NO: 3962516 - DNA, 23 bp, Homo sapiens
aaatctgagatctccctccaggg

SEQ ID NO: 3962517 - DNA, 19 bp, Homo sapiens
aaatctgagcctaaatcta

SEQ ID NO: 3962518 - DNA, 21 bp, Homo sapiens
aaatctgagcctaaatctaat

SEQ ID NO: 3962519 - DNA, 22 bp, Homo sapiens
aaatctgagcctaaatctaatc

SEQ ID NO: 3962520 - DNA, 16 bp, Homo sapiens
aaatctgatttaatgt

SEQ ID NO: 3962521 - DNA, 12 bp, Homo sapiens
aaatctggaaat

SEQ ID NO: 3962522 - DNA, 13 bp, Homo sapiens
aaatctggaaatc

SEQ ID NO: 3962523 - DNA, 15 bp, Homo sapiens
aaatctggaaatctg

SEQ ID NO: 3962524 - DNA, 16 bp, Homo sapiens
aaatctgtatatgttg

SEQ ID NO: 3962525 - DNA, 22 bp, Homo sapiens
aaatctgtatatgttgtaataa

SEQ ID NO: 3962526 - DNA, 15 bp, Homo sapiens
aaatctgtgaattaa

SEQ ID NO: 3962527 - DNA, 20 bp, Homo sapiens
aaatcttcaaggtgtaaaat

SEQ ID NO: 3962528 - DNA, 22 bp, Homo sapiens
aaatcttcaaggtgtaaaatat

SEQ ID NO: 3962529 - DNA, 17 bp, Homo sapiens
aaatcttggcacagaaa

SEQ ID NO: 3962530 - DNA, 13 bp, Homo sapiens
aaatgaaatgtct

SEQ ID NO: 3962531 - DNA, 11 bp, Homo sapiens
aaatgaagtgc

SEQ ID NO: 3962532 - DNA, 20 bp, Homo sapiens
aaatgaagtgcaaatttgat

SEQ ID NO: 3962533 - DNA, 19 bp, Homo sapiens
aaatgacatgcactgaccc

SEQ ID NO: 3962534 - DNA, 17 bp, Homo sapiens
aaatgaccaagaaaaag

SEQ ID NO: 3962535 - DNA, 16 bp, Homo sapiens
aaatgacccaaagacc

SEQ ID NO: 3962536 - DNA, 15 bp, Homo sapiens
aaatgagcctgtaat

SEQ ID NO: 3962537 - DNA, 14 bp, Homo sapiens
aaatgaggacatgt

SEQ ID NO: 3962538 - DNA, 18 bp, Homo sapiens
aaatgataaagatgtcaa

SEQ ID NO: 3962539 - DNA, 19 bp, Homo sapiens
aaatgataaagatgtcaaa

SEQ ID NO: 3962540 - DNA, 21 bp, Homo sapiens
aaatgataaagatgtcaaata

SEQ ID NO: 3962541 - DNA, 17 bp, Homo sapiens
aaatgatgtatgatttg

SEQ ID NO: 3962542 - DNA, 20 bp, Homo sapiens
aaatgattttcatcaattta

SEQ ID NO: 3962543 - DNA, 14 bp, Homo sapiens
aaatgcaagatttt

SEQ ID NO: 3962544 - DNA, 14 bp, Homo sapiens
aaatgcagtccaga

SEQ ID NO: 3962545 - DNA, 22 bp, Homo sapiens
aaatgcatccattcctcaggga

SEQ ID NO: 3962546 - DNA, 13 bp, Homo sapiens
aaatgcatggagg

SEQ ID NO: 3962547 - DNA, 20 bp, Homo sapiens
aaatgcattataggatcatt

SEQ ID NO: 3962548 - DNA, 15 bp, Homo sapiens
aaatgctaaatgcaa

SEQ ID NO: 3962549 - DNA, 19 bp, Homo sapiens
aaatgctcgtgtgatttcc

SEQ ID NO: 3962550 - DNA, 18 bp, Homo sapiens
aaatgctttatgcaaacc

SEQ ID NO: 3962551 - DNA, 20 bp, Homo sapiens
aaatggagcttgtacatatt

SEQ ID NO: 3962552 - DNA, 16 bp, Homo sapiens
aaatggccatttgctt

SEQ ID NO: 3962553 - DNA, 22 bp, Homo sapiens
aaatggcttcagaattaaaact

SEQ ID NO: 3962554 - DNA, 21 bp, Homo sapiens
aacgcacgcaacccttgctgc

SEQ ID NO: 3962555 - DNA, 21 bp, Homo sapiens
aacgcagaggcggaaaccttg

SEQ ID NO: 3962556 - DNA, 22 bp, Homo sapiens
aacgcagaggcggaaaccttgc

SEQ ID NO: 3962557 - DNA, 21 bp, Homo sapiens
aacgcctgcttgtccctgccc

SEQ ID NO: 3962558 - DNA, 14 bp, Homo sapiens
aacggaagggttgg

SEQ ID NO: 3962559 - DNA, 20 bp, Homo sapiens
aacggagccccaggcctctg

SEQ ID NO: 3962560 - DNA, 23 bp, Homo sapiens
aacggtgcatccacgcacacatg

SEQ ID NO: 3962561 - DNA, 18 bp, Homo sapiens
aacgtaatgattatatga

SEQ ID NO: 3962562 - DNA, 19 bp, Homo sapiens
aacgtacttaactgtgtga

SEQ ID NO: 3962563 - DNA, 22 bp, Homo sapiens
aacgtacttaactgtgtgaaga

SEQ ID NO: 3962564 - DNA, 19 bp, Homo sapiens
aacgtgggtatttcctgct

SEQ ID NO: 3962565 - DNA, 16 bp, Homo sapiens
aacgttaaaagacagt

SEQ ID NO: 3962566 - DNA, 15 bp, Homo sapiens
aactaaatatatgtc

SEQ ID NO: 3962567 - DNA, 13 bp, Homo sapiens
aactaagccctcg

SEQ ID NO: 3962568 - DNA, 13 bp, Homo sapiens
aactaatcaagag

SEQ ID NO: 3962569 - DNA, 16 bp, Homo sapiens
aactaatcaagagtga

SEQ ID NO: 3962570 - DNA, 12 bp, Homo sapiens
aactaatttaaa

SEQ ID NO: 3962571 - DNA, 17 bp, Homo sapiens
aactaatttaaaccagc

SEQ ID NO: 3962572 - DNA, 16 bp, Homo sapiens
aactacactaataaat

SEQ ID NO: 3962573 - DNA, 18 bp, Homo sapiens
aactactaaagtgcctac

SEQ ID NO: 3962574 - DNA, 20 bp, Homo sapiens
aactactgtaattaagtgca

SEQ ID NO: 3962575 - DNA, 23 bp, Homo sapiens
aactactgtaattaagtgcaatt

SEQ ID NO: 3962576 - DNA, 15 bp, Homo sapiens
aactactttttatac

SEQ ID NO: 3962577 - DNA, 16 bp, Homo sapiens
aactactttttatact

SEQ ID NO: 3962578 - DNA, 17 bp, Homo sapiens
aactactttttatactc

SEQ ID NO: 3962579 - DNA, 16 bp, Homo sapiens
aactagaacctggagg

SEQ ID NO: 3962580 - DNA, 17 bp, Homo sapiens
aactataaactactgta

SEQ ID NO: 3962581 - DNA, 22 bp, Homo sapiens
aactatcaatatttaagtttgt

SEQ ID NO: 3962582 - DNA, 22 bp, Homo sapiens
aactatccaattaaaattaagg

SEQ ID NO: 3962583 - DNA, 21 bp, Homo sapiens
aactatcctgcgggttttaat

SEQ ID NO: 3962584 - DNA, 15 bp, Homo sapiens
aactatgctgaagag

SEQ ID NO: 3962585 - DNA, 22 bp, Homo sapiens
aactatggttcccaataaaagt

SEQ ID NO: 3962586 - DNA, 23 bp, Homo sapiens
aactattattaataaattttaac

SEQ ID NO: 3962587 - DNA, 16 bp, Homo sapiens
aactcaaaatatttgt

SEQ ID NO: 3962588 - DNA, 15 bp, Homo sapiens
aactcaccatgtaaa

SEQ ID NO: 3962589 - DNA, 21 bp, Homo sapiens
aactcaccatgtaaaagagtc

SEQ ID NO: 3962590 - DNA, 14 bp, Homo sapiens
aactcactgctcaa

SEQ ID NO: 3962591 - DNA, 21 bp, Homo sapiens
aactcactgctcaagaagaca

SEQ ID NO: 3962592 - DNA, 22 bp, Homo sapiens
aactcactgctcaagaagacat

SEQ ID NO: 3962593 - DNA, 19 bp, Homo sapiens
aactcagagcccctccctg

SEQ ID NO: 3962594 - DNA, 22 bp, Homo sapiens
aactcagagcccctccctgcta

SEQ ID NO: 3962595 - DNA, 22 bp, Homo sapiens
aactcccagcaacacaagctgg

SEQ ID NO: 3962596 - DNA, 19 bp, Homo sapiens
aactccctgaacctcagtt

SEQ ID NO: 3962597 - DNA, 19 bp, Homo sapiens
aactcctgattttgtagtt

SEQ ID NO: 3962598 - DNA, 13 bp, Homo sapiens
aactcctgcctgt

SEQ ID NO: 3962599 - DNA, 18 bp, Homo sapiens
aactcctggaaatatcag

SEQ ID NO: 3962600 - DNA, 19 bp, Homo sapiens
aactccttattttgtatta

SEQ ID NO: 3962601 - DNA, 18 bp, Homo sapiens
aactcctttagcaggtgg

SEQ ID NO: 3962602 - DNA, 20 bp, Homo sapiens
aactccttttgctgtctttc

SEQ ID NO: 3962603 - DNA, 15 bp, Homo sapiens
aactctgacaagggc

SEQ ID NO: 3962604 - DNA, 21 bp, Homo sapiens
aactctgacaagggctgacct

SEQ ID NO: 3962605 - DNA, 22 bp, Homo sapiens
aactctgcactccatggccacc

SEQ ID NO: 3962606 - DNA, 18 bp, Homo sapiens
aactctggcttccaggta

SEQ ID NO: 3962607 - DNA, 20 bp, Homo sapiens
aactctgtgttgtgaatgtc

SEQ ID NO: 3962608 - DNA, 16 bp, Homo sapiens
aactcttccatttatt

SEQ ID NO: 3962609 - DNA, 20 bp, Homo sapiens
aactcttccatttattgcac

SEQ ID NO: 3962610 - DNA, 12 bp, Homo sapiens
aactgaaaagac

SEQ ID NO: 3962611 - DNA, 14 bp, Homo sapiens
aactgaagagacag

SEQ ID NO: 3962612 - DNA, 13 bp, Homo sapiens
aactgaaggagaa

SEQ ID NO: 3962613 - DNA, 19 bp, Homo sapiens
aactgaagggggcggccta

SEQ ID NO: 3962614 - DNA, 21 bp, Homo sapiens
aactgacaacctgtgcagtcc

SEQ ID NO: 3962615 - DNA, 12 bp, Homo sapiens
aactgacacagg

SEQ ID NO: 3962616 - DNA, 14 bp, Homo sapiens
aactgaccagcctc

SEQ ID NO: 3962617 - DNA, 19 bp, Homo sapiens
aactgaccagcctccatgc

SEQ ID NO: 3962618 - DNA, 17 bp, Homo sapiens
aactgagaaatgaatgc

SEQ ID NO: 3962619 - DNA, 18 bp, Homo sapiens
aactgagaaatgaatgct

SEQ ID NO: 3962620 - DNA, 23 bp, Homo sapiens
aactgagatgtgaacacatcagc

SEQ ID NO: 3962621 - DNA, 22 bp, Homo sapiens
aactgagccaaacacactgtaa

SEQ ID NO: 3962622 - DNA, 20 bp, Homo sapiens
aactgatcaaaaataaacta

SEQ ID NO: 3962623 - DNA, 21 bp, Homo sapiens
aactgatgcgaaaacttgaat

SEQ ID NO: 3962624 - DNA, 22 bp, Homo sapiens
aactgatggaccgggtgggcct

SEQ ID NO: 3962625 - DNA, 14 bp, Homo sapiens
aactgatttctcac

SEQ ID NO: 3962626 - DNA, 19 bp, Homo sapiens
aactgcacacacagctcct

SEQ ID NO: 3962627 - DNA, 22 bp, Homo sapiens
aactgcatatcggaggtggtgg

SEQ ID NO: 3962628 - DNA, 15 bp, Homo sapiens
aactgctaaatactg

SEQ ID NO: 3962629 - DNA, 19 bp, Homo sapiens
aactgctaaatactgtaca

SEQ ID NO: 3962630 - DNA, 20 bp, Homo sapiens
aactgctaaatactgtacat

SEQ ID NO: 3962631 - DNA, 12 bp, Homo sapiens
aactgctctgcc

SEQ ID NO: 3962632 - DNA, 13 bp, Homo sapiens
aactgctgagcca

SEQ ID NO: 3962633 - DNA, 19 bp, Homo sapiens
aactggactggttcaaatg

SEQ ID NO: 3962634 - DNA, 13 bp, Homo sapiens
aactggctgggac

SEQ ID NO: 3962635 - DNA, 19 bp, Homo sapiens
aactggtcaccatgaaact

SEQ ID NO: 3962636 - DNA, 19 bp, Homo sapiens
aactggttcaagagacact

SEQ ID NO: 3962637 - DNA, 21 bp, Homo sapiens
aactgtaaatatgtttgtgcc

SEQ ID NO: 3962638 - DNA, 15 bp, Homo sapiens
aactgtaaatcactt

SEQ ID NO: 3962639 - DNA, 17 bp, Homo sapiens
aactgtaaatcacttgt

SEQ ID NO: 3962640 - DNA, 17 bp, Homo sapiens
aagctctgcatgtgtgt

SEQ ID NO: 3962641 - DNA, 15 bp, Homo sapiens
aagctgaagtgaagg

SEQ ID NO: 3962642 - DNA, 20 bp, Homo sapiens
aagctgagaagaagctgagg

SEQ ID NO: 3962643 - DNA, 12 bp, Homo sapiens
aagctgagcagg

SEQ ID NO: 3962644 - DNA, 16 bp, Homo sapiens
aagctgagcaggcccg

SEQ ID NO: 3962645 - DNA, 18 bp, Homo sapiens
aagctgaggtgcccagga

SEQ ID NO: 3962646 - DNA, 13 bp, Homo sapiens
aagctgcagcttc

SEQ ID NO: 3962647 - DNA, 14 bp, Homo sapiens
aagctgcagcttcc

SEQ ID NO: 3962648 - DNA, 17 bp, Homo sapiens
aagctgcagcttcctgt

SEQ ID NO: 3962649 - DNA, 18 bp, Homo sapiens
aagctgcagcttcctgtc

SEQ ID NO: 3962650 - DNA, 15 bp, Homo sapiens
aagctgccctgccca

SEQ ID NO: 3962651 - DNA, 22 bp, Homo sapiens
aagctgcctgtagttaggaaat

SEQ ID NO: 3962652 - DNA, 23 bp, Homo sapiens
aagctgcttgactatcacataca

SEQ ID NO: 3962653 - DNA, 14 bp, Homo sapiens
aagctgctttattc

SEQ ID NO: 3962654 - DNA, 18 bp, Homo sapiens
aagctggacaagaagctg

SEQ ID NO: 3962655 - DNA, 16 bp, Homo sapiens
aagctggagctcttgg

SEQ ID NO: 3962656 - DNA, 19 bp, Homo sapiens
aagctggaggactagaacc

SEQ ID NO: 3962657 - DNA, 22 bp, Homo sapiens
aagctgtagtagccctttctgt

SEQ ID NO: 3962658 - DNA, 23 bp, Homo sapiens
aagctgtagtagccctttctgtg

SEQ ID NO: 3962659 - DNA, 12 bp, Homo sapiens
aagctgtcccct

SEQ ID NO: 3962660 - DNA, 22 bp, Homo sapiens
aagctgtgtccttgcacctgca

SEQ ID NO: 3962661 - DNA, 12 bp, Homo sapiens
aagctgttccac

SEQ ID NO: 3962662 - DNA, 18 bp, Homo sapiens
aagcttcaaactgcatga

SEQ ID NO: 3962663 - DNA, 14 bp, Homo sapiens
aagcttcaagtgat

SEQ ID NO: 3962664 - DNA, 20 bp, Homo sapiens
aagcttcaagtgatatatgt

SEQ ID NO: 3962665 - DNA, 19 bp, Homo sapiens
aagcttcagagcctagcca

SEQ ID NO: 3962666 - DNA, 21 bp, Homo sapiens
aagcttcagagcctagccacc

SEQ ID NO: 3962667 - DNA, 15 bp, Homo sapiens
aagcttgtatataca

SEQ ID NO: 3962668 - DNA, 16 bp, Homo sapiens
aagcttgtatatacat

SEQ ID NO: 3962669 - DNA, 18 bp, Homo sapiens
aagcttgtatatacatat

SEQ ID NO: 3962670 - DNA, 19 bp, Homo sapiens
aagcttgtatatacatatt

SEQ ID NO: 3962671 - DNA, 12 bp, Homo sapiens
aagctttctcct

SEQ ID NO: 3962672 - DNA, 14 bp, Homo sapiens
aagctttctccttt

SEQ ID NO: 3962673 - DNA, 16 bp, Homo sapiens
aagctttctcctttga

SEQ ID NO: 3962674 - DNA, 19 bp, Homo sapiens
aagctttctgacaagataa

SEQ ID NO: 3962675 - DNA, 23 bp, Homo sapiens
aagctttgaatacccccagagac

SEQ ID NO: 3962676 - DNA, 23 bp, Homo sapiens
aagctttgcttatggtaataaaa

SEQ ID NO: 3962677 - DNA, 23 bp, Homo sapiens
aaggaaaagtcaacatcttctct

SEQ ID NO: 3962678 - DNA, 18 bp, Homo sapiens
aaggaagctccactgtca

SEQ ID NO: 3962679 - DNA, 18 bp, Homo sapiens
aaggaagggacacacaca

SEQ ID NO: 3962680 - DNA, 14 bp, Homo sapiens
aaggaagtctagga

SEQ ID NO: 3962681 - DNA, 21 bp, Homo sapiens
aaggaatagccagagaggagc

SEQ ID NO: 3962682 - DNA, 21 bp, Homo sapiens
aaggaatctccagttttcagt

SEQ ID NO: 3962683 - DNA, 14 bp, Homo sapiens
aaggaatctgaaag

SEQ ID NO: 3962684 - DNA, 20 bp, Homo sapiens
aaggaatctgaaagtatatt

SEQ ID NO: 3962685 - DNA, 20 bp, Homo sapiens
aaggacaatgccttgggaga

SEQ ID NO: 3962686 - DNA, 22 bp, Homo sapiens
aaggacaatgccttgggagaga

SEQ ID NO: 3962687 - DNA, 17 bp, Homo sapiens
aaggacatgtgctattg

SEQ ID NO: 3962688 - DNA, 19 bp, Homo sapiens
aaggaccaactggcttctg

SEQ ID NO: 3962689 - DNA, 18 bp, Homo sapiens
aaggacccggaggggcct

SEQ ID NO: 3962690 - DNA, 16 bp, Homo sapiens
aaggactctggcctct

SEQ ID NO: 3962691 - DNA, 23 bp, Homo sapiens
aaggagactcacctctgcctcaa

SEQ ID NO: 3962692 - DNA, 11 bp, Homo sapiens
aaggagagaag

SEQ ID NO: 3962693 - DNA, 22 bp, Homo sapiens
aaggagagttcaagcctgtggg

SEQ ID NO: 3962694 - DNA, 18 bp, Homo sapiens
aaggagattttccttcct

SEQ ID NO: 3962695 - DNA, 10 bp, Homo sapiens
aaggagcctg

SEQ ID NO: 3962696 - DNA, 13 bp, Homo sapiens
aaggagggcagag

SEQ ID NO: 3962697 - DNA, 14 bp, Homo sapiens
aaggagggcagagc

SEQ ID NO: 3962698 - DNA, 19 bp, Homo sapiens
aaggagggcagagccatgg

SEQ ID NO: 3962699 - DNA, 17 bp, Homo sapiens
aaggagtaagtacaaat

SEQ ID NO: 3962700 - DNA, 19 bp, Homo sapiens
aaggatgaagggcccgaga

SEQ ID NO: 3962701 - DNA, 17 bp, Homo sapiens
aaggatgtaaacagtgc

SEQ ID NO: 3962702 - DNA, 12 bp, Homo sapiens
aaggatttgttc

SEQ ID NO: 3962703 - DNA, 19 bp, Homo sapiens
aaggcagcaaggcccgagc

SEQ ID NO: 3962704 - DNA, 16 bp, Homo sapiens
aaggcagccacagaca

SEQ ID NO: 3962705 - DNA, 16 bp, Homo sapiens
aaggcagcctccagag

SEQ ID NO: 3962706 - DNA, 18 bp, Homo sapiens
aaggcagcctccagagcc

SEQ ID NO: 3962707 - DNA, 13 bp, Homo sapiens
aaggcagctgctc

SEQ ID NO: 3962708 - DNA, 14 bp, Homo sapiens
aaggcagctgctct

SEQ ID NO: 3962709 - DNA, 18 bp, Homo sapiens
aaggcaggcagggctctc

SEQ ID NO: 3962710 - DNA, 19 bp, Homo sapiens
aaggcagggaggaggcaga

SEQ ID NO: 3962711 - DNA, 21 bp, Homo sapiens
aaggcatgatgttaaccagaa

SEQ ID NO: 3962712 - DNA, 18 bp, Homo sapiens
aaggcccgagcagctgag

SEQ ID NO: 3962713 - DNA, 17 bp, Homo sapiens
aaggccgtgtctctgag

SEQ ID NO: 3962714 - DNA, 15 bp, Homo sapiens
aaggcctcttgtgct

SEQ ID NO: 3962715 - DNA, 14 bp, Homo sapiens
aaggcctgccctcc

SEQ ID NO: 3962716 - DNA, 18 bp, Homo sapiens
aaggcctgccctcccatg

SEQ ID NO: 3962717 - DNA, 15 bp, Homo sapiens
aaggcctggggtgac

SEQ ID NO: 3962718 - DNA, 17 bp, Homo sapiens
aaggcctggggtgaccc

SEQ ID NO: 3962719 - DNA, 21 bp, Homo sapiens
aaggcctggggtgacccggca

SEQ ID NO: 3962720 - DNA, 22 bp, Homo sapiens
aaggcctggggtgacccggcac

SEQ ID NO: 3962721 - DNA, 16 bp, Homo sapiens
aaggctactggcatta

SEQ ID NO: 3962722 - DNA, 18 bp, Homo sapiens
aaggctactggcattaat

SEQ ID NO: 3962723 - DNA, 21 bp, Homo sapiens
aaggctagtttattttgttac

SEQ ID NO: 3962724 - DNA, 20 bp, Homo sapiens
aaggctttgccatgggcctg

SEQ ID NO: 3962725 - DNA, 19 bp, Homo sapiens
aagggacagtattctcagt

SEQ ID NO: 3962726 - DNA, 17 bp, Homo sapiens
aatagtccaatatttgg

SEQ ID NO: 3962727 - DNA, 19 bp, Homo sapiens
aatagtgcagaatctcata

SEQ ID NO: 3962728 - DNA, 21 bp, Homo sapiens
aatataaactgaaaaatgtca

SEQ ID NO: 3962729 - DNA, 23 bp, Homo sapiens
aatataaactgaaaaatgtcagt

SEQ ID NO: 3962730 - DNA, 12 bp, Homo sapiens
aatataaacttg

SEQ ID NO: 3962731 - DNA, 15 bp, Homo sapiens
aatataaccattaca

SEQ ID NO: 3962732 - DNA, 16 bp, Homo sapiens
aatataaccattacat

SEQ ID NO: 3962733 - DNA, 19 bp, Homo sapiens
aatataaccattacatgtt

SEQ ID NO: 3962734 - DNA, 15 bp, Homo sapiens
aatatacaaacatgt

SEQ ID NO: 3962735 - DNA, 11 bp, Homo sapiens
aatatagagat

SEQ ID NO: 3962736 - DNA, 16 bp, Homo sapiens
aatatagagatatttt

SEQ ID NO: 3962737 - DNA, 21 bp, Homo sapiens
aatatagagatatttttgtac

SEQ ID NO: 3962738 - DNA, 17 bp, Homo sapiens
aatatataaaaatatat

SEQ ID NO: 3962739 - DNA, 13 bp, Homo sapiens
aatatatatacat

SEQ ID NO: 3962740 - DNA, 15 bp, Homo sapiens
aatatatatacatat

SEQ ID NO: 3962741 - DNA, 19 bp, Homo sapiens
aatatatatacatatgtag

SEQ ID NO: 3962742 - DNA, 17 bp, Homo sapiens
aatatatatatatattt

SEQ ID NO: 3962743 - DNA, 14 bp, Homo sapiens
aatatatatgtgca

SEQ ID NO: 3962744 - DNA, 17 bp, Homo sapiens
aatatatatgtgcagta

SEQ ID NO: 3962745 - DNA, 15 bp, Homo sapiens
aatatatatttttca

SEQ ID NO: 3962746 - DNA, 22 bp, Homo sapiens
aatatatcccagaaattagaaa

SEQ ID NO: 3962747 - DNA, 19 bp, Homo sapiens
aatatatttaatacctttg

SEQ ID NO: 3962748 - DNA, 20 bp, Homo sapiens
aatatatttttatatttagt

SEQ ID NO: 3962749 - DNA, 19 bp, Homo sapiens
aatatcagttactcagccc

SEQ ID NO: 3962750 - DNA, 14 bp, Homo sapiens
aatatctacctgcc

SEQ ID NO: 3962751 - DNA, 20 bp, Homo sapiens
aatatctgacagttactctt

SEQ ID NO: 3962752 - DNA, 16 bp, Homo sapiens
aatatgaaatgataaa

SEQ ID NO: 3962753 - DNA, 22 bp, Homo sapiens
aatatgattttttaaaagaaat

SEQ ID NO: 3962754 - DNA, 24 bp, Homo sapiens
aatatgcaaagcactgacttctaa

SEQ ID NO: 3962755 - DNA, 15 bp, Homo sapiens
aatatggacaaagaa

SEQ ID NO: 3962756 - DNA, 18 bp, Homo sapiens
aatatgtaagtcaggagt

SEQ ID NO: 3962757 - DNA, 17 bp, Homo sapiens
aatatgtctgccacaga

SEQ ID NO: 3962758 - DNA, 14 bp, Homo sapiens
aatatgttcaatgc

SEQ ID NO: 3962759 - DNA, 15 bp, Homo sapiens
aatatgtttgaggtt

SEQ ID NO: 3962760 - DNA, 24 bp, Homo sapiens
aatatgtttgaggttaaaatataa

SEQ ID NO: 3962761 - DNA, 16 bp, Homo sapiens
aatatgtttgtgcctt

SEQ ID NO: 3962762 - DNA, 22 bp, Homo sapiens
aatatgtttgtgccttaaaagg

SEQ ID NO: 3962763 - DNA, 13 bp, Homo sapiens
aatattaaataca

SEQ ID NO: 3962764 - DNA, 17 bp, Homo sapiens
aatattaaatacagaca

SEQ ID NO: 3962765 - DNA, 13 bp, Homo sapiens
aatattaccaaaa

SEQ ID NO: 3962766 - DNA, 15 bp, Homo sapiens
aatattataaatcca

SEQ ID NO: 3962767 - DNA, 16 bp, Homo sapiens
aatattattcaagtgc

SEQ ID NO: 3962768 - DNA, 15 bp, Homo sapiens
aatattcaataaagc

SEQ ID NO: 3962769 - DNA, 15 bp, Homo sapiens
aatattctgtaagaa

SEQ ID NO: 3962770 - DNA, 12 bp, Homo sapiens
aatatttaaaca

SEQ ID NO: 3962771 - DNA, 16 bp, Homo sapiens
aatatttaagtatata

SEQ ID NO: 3962772 - DNA, 18 bp, Homo sapiens
aatatttaagtatatagt

SEQ ID NO: 3962773 - DNA, 23 bp, Homo sapiens
aatatttaagtatatagtatatt

SEQ ID NO: 3962774 - DNA, 15 bp, Homo sapiens
aatatttatgtaaac

SEQ ID NO: 3962775 - DNA, 19 bp, Homo sapiens
aatatttatgtctatttaa

SEQ ID NO: 3962776 - DNA, 21 bp, Homo sapiens
aatatttggtctctatttcat

SEQ ID NO: 3962777 - DNA, 12 bp, Homo sapiens
aatatttgtaca

SEQ ID NO: 3962778 - DNA, 10 bp, Homo sapiens
aatattttgt

SEQ ID NO: 3962779 - DNA, 12 bp, Homo sapiens
aatattttgtaa

SEQ ID NO: 3962780 - DNA, 15 bp, Homo sapiens
aatattttgtatttt

SEQ ID NO: 3962781 - DNA, 10 bp, Homo sapiens
aatcaaaact

SEQ ID NO: 3962782 - DNA, 22 bp, Homo sapiens
aatcaaatatgcaaagcactga

SEQ ID NO: 3962783 - DNA, 18 bp, Homo sapiens
aatcaattattacattta

SEQ ID NO: 3962784 - DNA, 15 bp, Homo sapiens
aatcaatttcccaga

SEQ ID NO: 3962785 - DNA, 15 bp, Homo sapiens
aatcacaagcaataa

SEQ ID NO: 3962786 - DNA, 16 bp, Homo sapiens
aatcacacctctgggc

SEQ ID NO: 3962787 - DNA, 22 bp, Homo sapiens
aatcacagatgggtattaaact

SEQ ID NO: 3962788 - DNA, 13 bp, Homo sapiens
aatcaccaaagta

SEQ ID NO: 3962789 - DNA, 13 bp, Homo sapiens
aatcactgctccc

SEQ ID NO: 3962790 - DNA, 23 bp, Homo sapiens
aatcactgtattttcattttaat

SEQ ID NO: 3962791 - DNA, 12 bp, Homo sapiens
aatcacttgtaa

SEQ ID NO: 3962792 - DNA, 13 bp, Homo sapiens
aatcacttgtaaa

SEQ ID NO: 3962793 - DNA, 15 bp, Homo sapiens
aatcacttgtaaata

SEQ ID NO: 3962794 - DNA, 14 bp, Homo sapiens
aatcagcactgaaa

SEQ ID NO: 3962795 - DNA, 19 bp, Homo sapiens
aatcagcattctcactcct

SEQ ID NO: 3962796 - DNA, 12 bp, Homo sapiens
aatcagcctctt

SEQ ID NO: 3962797 - DNA, 12 bp, Homo sapiens
aatcagtgcagt

SEQ ID NO: 3962798 - DNA, 17 bp, Homo sapiens
aatcagtgcagtgatac

SEQ ID NO: 3962799 - DNA, 15 bp, Homo sapiens
aatcatctgtgtgaa

SEQ ID NO: 3962800 - DNA, 21 bp, Homo sapiens
aatcatgaaaagaggaacagg

SEQ ID NO: 3962801 - DNA, 18 bp, Homo sapiens
aatcattcaatatctgac

SEQ ID NO: 3962802 - DNA, 13 bp, Homo sapiens
aatcattttaaga

SEQ ID NO: 3962803 - DNA, 23 bp, Homo sapiens
aatccaagcgaggtcaacagaga

SEQ ID NO: 3962804 - DNA, 12 bp, Homo sapiens
aatccacccatc

SEQ ID NO: 3962805 - DNA, 14 bp, Homo sapiens
aatccactctcagg

SEQ ID NO: 3962806 - DNA, 17 bp, Homo sapiens
aatccagaaagaaaaaa

SEQ ID NO: 3962807 - DNA, 17 bp, Homo sapiens
aatccatgttagttttt

SEQ ID NO: 3962808 - DNA, 14 bp, Homo sapiens
aatcccaaaagtca

SEQ ID NO: 3962809 - DNA, 18 bp, Homo sapiens
aatcccagctactcagga

SEQ ID NO: 3962810 - DNA, 23 bp, Homo sapiens
aatccctggttttaagtatcaat

SEQ ID NO: 3962811 - DNA, 13 bp, Homo sapiens
aatccctgtttaa

SEQ ID NO: 3962812 - DNA, 17 bp, Homo sapiens
aatccctgtttaatatt

SEQ ID NO: 3962813 - DNA, 21 bp, Homo sapiens
aattaaaaaccactgaacatt

SEQ ID NO: 3962814 - DNA, 20 bp, Homo sapiens
aattaaaaaggaaagaaaac

SEQ ID NO: 3962815 - DNA, 13 bp, Homo sapiens
aattaaaatctgg

SEQ ID NO: 3962816 - DNA, 17 bp, Homo sapiens
aattaagagatacattc

SEQ ID NO: 3962817 - DNA, 20 bp, Homo sapiens
aattaatgtgtgtctgaaga

SEQ ID NO: 3962818 - DNA, 14 bp, Homo sapiens
aattacacccaaag

SEQ ID NO: 3962819 - DNA, 23 bp, Homo sapiens
aattaccttagattagctctgga

SEQ ID NO: 3962820 - DNA, 13 bp, Homo sapiens
aattagaacaata

SEQ ID NO: 3962821 - DNA, 21 bp, Homo sapiens
aattaggaggctcaacaataa

SEQ ID NO: 3962822 - DNA, 16 bp, Homo sapiens
aattaggatctatgca

SEQ ID NO: 3962823 - DNA, 14 bp, Homo sapiens
aattagtaataaaa

SEQ ID NO: 3962824 - DNA, 17 bp, Homo sapiens
aattagtaattgtcaat

SEQ ID NO: 3962825 - DNA, 23 bp, Homo sapiens
aattagtacagtagcttaaataa

SEQ ID NO: 3962826 - DNA, 23 bp, Homo sapiens
aattataacttaaaatattttat

SEQ ID NO: 3962827 - DNA, 12 bp, Homo sapiens
aattataagatg

SEQ ID NO: 3962828 - DNA, 21 bp, Homo sapiens
aattatataggttgtgcaaat

SEQ ID NO: 3962829 - DNA, 14 bp, Homo sapiens
aattatatctaatt

SEQ ID NO: 3962830 - DNA, 16 bp, Homo sapiens
aattatatctaattta

SEQ ID NO: 3962831 - DNA, 17 bp, Homo sapiens
aattatatctaatttat

SEQ ID NO: 3962832 - DNA, 22 bp, Homo sapiens
aattatatctaatttatacaaa

SEQ ID NO: 3962833 - DNA, 13 bp, Homo sapiens
aattatgagatga

SEQ ID NO: 3962834 - DNA, 21 bp, Homo sapiens
aattatgaggtgaaacaatta

SEQ ID NO: 3962835 - DNA, 13 bp, Homo sapiens
aattatgcactgg

SEQ ID NO: 3962836 - DNA, 14 bp, Homo sapiens
aattatggtgaaat

SEQ ID NO: 3962837 - DNA, 15 bp, Homo sapiens
aattatggtgaaatt

SEQ ID NO: 3962838 - DNA, 20 bp, Homo sapiens
aattatttatttatggagga

SEQ ID NO: 3962839 - DNA, 21 bp, Homo sapiens
aattatttgtgtaatagaaaa

SEQ ID NO: 3962840 - DNA, 17 bp, Homo sapiens
aattatttttaagaaat

SEQ ID NO: 3962841 - DNA, 15 bp, Homo sapiens
aattatttttataca

SEQ ID NO: 3962842 - DNA, 14 bp, Homo sapiens
aattatttttgtgt

SEQ ID NO: 3962843 - DNA, 13 bp, Homo sapiens
aattcaaaccatt

SEQ ID NO: 3962844 - DNA, 15 bp, Homo sapiens
aattcacttagggtc

SEQ ID NO: 3962845 - DNA, 20 bp, Homo sapiens
aattcagatatatttttcac

SEQ ID NO: 3962846 - DNA, 12 bp, Homo sapiens
aattcagcaccc

SEQ ID NO: 3962847 - DNA, 20 bp, Homo sapiens
aattcaggactggctcaccc

SEQ ID NO: 3962848 - DNA, 13 bp, Homo sapiens
aattcataattag

SEQ ID NO: 3962849 - DNA, 15 bp, Homo sapiens
aattcataattagaa

SEQ ID NO: 3962850 - DNA, 16 bp, Homo sapiens
aattcataattagaac

SEQ ID NO: 3962851 - DNA, 18 bp, Homo sapiens
aattcataattagaacaa

SEQ ID NO: 3962852 - DNA, 15 bp, Homo sapiens
aattcatttcacatt

SEQ ID NO: 3962853 - DNA, 15 bp, Homo sapiens
aattcatttcacttt

SEQ ID NO: 3962854 - DNA, 17 bp, Homo sapiens
aattcatttcactttaa

SEQ ID NO: 3962855 - DNA, 18 bp, Homo sapiens
aattcatttcactttaaa

SEQ ID NO: 3962856 - DNA, 15 bp, Homo sapiens
aattcatttttttca

SEQ ID NO: 3962857 - DNA, 14 bp, Homo sapiens
aattccaaaggaat

SEQ ID NO: 3962858 - DNA, 23 bp, Homo sapiens
aattccaaggagttccatgaaga

SEQ ID NO: 3962859 - DNA, 21 bp, Homo sapiens
aattcctctcactaaacttta

SEQ ID NO: 3962860 - DNA, 17 bp, Homo sapiens
aattcctgaagccagat

SEQ ID NO: 3962861 - DNA, 16 bp, Homo sapiens
aattctaaatgctggt

SEQ ID NO: 3962862 - DNA, 16 bp, Homo sapiens
aattctacaggatggg

SEQ ID NO: 3962863 - DNA, 13 bp, Homo sapiens
aattctagaaaat

SEQ ID NO: 3962864 - DNA, 17 bp, Homo sapiens
aattctcaacctaccac

SEQ ID NO: 3962865 - DNA, 14 bp, Homo sapiens
aattctctctaaaa

SEQ ID NO: 3962866 - DNA, 22 bp, Homo sapiens
aattctctctaaaaataaaatg

SEQ ID NO: 3962867 - DNA, 23 bp, Homo sapiens
aattctctctaaaaataaaatga

SEQ ID NO: 3962868 - DNA, 17 bp, Homo sapiens
aattctgacttctccca

SEQ ID NO: 3962869 - DNA, 19 bp, Homo sapiens
aattctgacttctcccatc

SEQ ID NO: 3962870 - DNA, 20 bp, Homo sapiens
aattctgcaactagccaagg

SEQ ID NO: 3962871 - DNA, 19 bp, Homo sapiens
aattctgcaatgttttcct

SEQ ID NO: 3962872 - DNA, 20 bp, Homo sapiens
aattctgcaatgttttcctt

SEQ ID NO: 3962873 - DNA, 10 bp, Homo sapiens
aattctgctt

SEQ ID NO: 3962874 - DNA, 21 bp, Homo sapiens
aattctggctggtagagcagg

SEQ ID NO: 3962875 - DNA, 14 bp, Homo sapiens
aattctgtgaagaa

SEQ ID NO: 3962876 - DNA, 15 bp, Homo sapiens
aattctgtgaagaat

SEQ ID NO: 3962877 - DNA, 20 bp, Homo sapiens
aattctgtgaagaatgaagt

SEQ ID NO: 3962878 - DNA, 16 bp, Homo sapiens
aattcttgtatattat

SEQ ID NO: 3962879 - DNA, 20 bp, Homo sapiens
aattgaagagatttcaacat

SEQ ID NO: 3962880 - DNA, 17 bp, Homo sapiens
aattgacccatgttccc

SEQ ID NO: 3962881 - DNA, 14 bp, Homo sapiens
aattgactgtcact

SEQ ID NO: 3962882 - DNA, 12 bp, Homo sapiens
aattgagaaaca

SEQ ID NO: 3962883 - DNA, 14 bp, Homo sapiens
aattgatacttcag

SEQ ID NO: 3962884 - DNA, 14 bp, Homo sapiens
aattgattattctg

SEQ ID NO: 3962885 - DNA, 22 bp, Homo sapiens
aattgatttgacccactcacac

SEQ ID NO: 3962886 - DNA, 23 bp, Homo sapiens
aattgatttgacccactcacact

SEQ ID NO: 3962887 - DNA, 10 bp, Homo sapiens
aattgcacaa

SEQ ID NO: 3962888 - DNA, 11 bp, Homo sapiens
aattgcacaat

SEQ ID NO: 3962889 - DNA, 14 bp, Homo sapiens
aattgcacaatttg

SEQ ID NO: 3962890 - DNA, 17 bp, Homo sapiens
aattgcacaatttgagc

SEQ ID NO: 3962891 - DNA, 14 bp, Homo sapiens
aattgccaaagctg

SEQ ID NO: 3962892 - DNA, 17 bp, Homo sapiens
aattgcttaaaagacat

SEQ ID NO: 3962893 - DNA, 20 bp, Homo sapiens
aattgcttacatttttacaa

SEQ ID NO: 3962894 - DNA, 16 bp, Homo sapiens
aattggagtatctaaa

SEQ ID NO: 3962895 - DNA, 13 bp, Homo sapiens
aattggctcctcc

SEQ ID NO: 3962896 - DNA, 14 bp, Homo sapiens
aattggctcctcca

SEQ ID NO: 3962897 - DNA, 19 bp, Homo sapiens
aattggtgataagtggaaa

SEQ ID NO: 3962898 - DNA, 22 bp, Homo sapiens
aattggttagaacctcctattt

SEQ ID NO: 3962899 - DNA, 18 bp, Homo sapiens
aattgtaaaattgtatag

SEQ ID NO: 3962900 - DNA, 18 bp, Homo sapiens
atatacatatatatatac

SEQ ID NO: 3962901 - DNA, 14 bp, Homo sapiens
atatacatatgtag

SEQ ID NO: 3962902 - DNA, 21 bp, Homo sapiens
atatacatattataaataaat

SEQ ID NO: 3962903 - DNA, 15 bp, Homo sapiens
atataccttctcaaa

SEQ ID NO: 3962904 - DNA, 13 bp, Homo sapiens
atatactatacaa

SEQ ID NO: 3962905 - DNA, 16 bp, Homo sapiens
atatactatacaacaa

SEQ ID NO: 3962906 - DNA, 17 bp, Homo sapiens
atatactatacaacaat

SEQ ID NO: 3962907 - DNA, 18 bp, Homo sapiens
atatactatacaacaatg

SEQ ID NO: 3962908 - DNA, 12 bp, Homo sapiens
atatagatgtgc

SEQ ID NO: 3962909 - DNA, 17 bp, Homo sapiens
atatagcagcaaaaata

SEQ ID NO: 3962910 - DNA, 17 bp, Homo sapiens
atatagtaatgcactct

SEQ ID NO: 3962911 - DNA, 15 bp, Homo sapiens
atatataaatatata

SEQ ID NO: 3962912 - DNA, 13 bp, Homo sapiens
atatatacacata

SEQ ID NO: 3962913 - DNA, 10 bp, Homo sapiens
atatatacat

SEQ ID NO: 3962914 - DNA, 14 bp, Homo sapiens
atatatacatacac

SEQ ID NO: 3962915 - DNA, 16 bp, Homo sapiens
atatatacatacactt

SEQ ID NO: 3962916 - DNA, 18 bp, Homo sapiens
atatatacatacacttgt

SEQ ID NO: 3962917 - DNA, 13 bp, Homo sapiens
atatatacatatg

SEQ ID NO: 3962918 - DNA, 16 bp, Homo sapiens
atatatagtgctatat

SEQ ID NO: 3962919 - DNA, 13 bp, Homo sapiens
atatatatacata

SEQ ID NO: 3962920 - DNA, 15 bp, Homo sapiens
atatatatagtaact

SEQ ID NO: 3962921 - DNA, 15 bp, Homo sapiens
atatatatatatatt

SEQ ID NO: 3962922 - DNA, 13 bp, Homo sapiens
atatatatatgta

SEQ ID NO: 3962923 - DNA, 14 bp, Homo sapiens
atatatatatgtat

SEQ ID NO: 3962924 - DNA, 14 bp, Homo sapiens
atatatatatgtgt

SEQ ID NO: 3962925 - DNA, 14 bp, Homo sapiens
atatatatgtgcag

SEQ ID NO: 3962926 - DNA, 22 bp, Homo sapiens
atatatatgtgcagtattttat

SEQ ID NO: 3962927 - DNA, 14 bp, Homo sapiens
atatatattaaaat

SEQ ID NO: 3962928 - DNA, 23 bp, Homo sapiens
atatatatttgattgtaaaaaca

SEQ ID NO: 3962929 - DNA, 13 bp, Homo sapiens
atatatcatattg

SEQ ID NO: 3962930 - DNA, 12 bp, Homo sapiens
atatatcttatg

SEQ ID NO: 3962931 - DNA, 20 bp, Homo sapiens
atatatcttatgttaaagga

SEQ ID NO: 3962932 - DNA, 23 bp, Homo sapiens
atatatggcatatttatattgta

SEQ ID NO: 3962933 - DNA, 19 bp, Homo sapiens
atatatgtatatatatgca

SEQ ID NO: 3962934 - DNA, 16 bp, Homo sapiens
atatatgtatatgtat

SEQ ID NO: 3962935 - DNA, 19 bp, Homo sapiens
atatatgtatatgtatata

SEQ ID NO: 3962936 - DNA, 20 bp, Homo sapiens
atatatgtatttattgtcat

SEQ ID NO: 3962937 - DNA, 21 bp, Homo sapiens
atatatgtgcagtattttatt

SEQ ID NO: 3962938 - DNA, 19 bp, Homo sapiens
atatatgtgtatatataca

SEQ ID NO: 3962939 - DNA, 20 bp, Homo sapiens
atatatgtgtatatatacat

SEQ ID NO: 3962940 - DNA, 21 bp, Homo sapiens
atatatgtgtatatatacata

SEQ ID NO: 3962941 - DNA, 23 bp, Homo sapiens
atatatgtgtatatatacataca

SEQ ID NO: 3962942 - DNA, 12 bp, Homo sapiens
atatattcatgt

SEQ ID NO: 3962943 - DNA, 14 bp, Homo sapiens
atatattcatgtaa

SEQ ID NO: 3962944 - DNA, 15 bp, Homo sapiens
atatattcatgtaat

SEQ ID NO: 3962945 - DNA, 23 bp, Homo sapiens
atatattcatgtaataaatctga

SEQ ID NO: 3962946 - DNA, 14 bp, Homo sapiens
atatatttttatat

SEQ ID NO: 3962947 - DNA, 15 bp, Homo sapiens
atatatttttatatt

SEQ ID NO: 3962948 - DNA, 17 bp, Homo sapiens
atatatttttcaaccag

SEQ ID NO: 3962949 - DNA, 19 bp, Homo sapiens
atatatttttcaaccagca

SEQ ID NO: 3962950 - DNA, 14 bp, Homo sapiens
atatattttttgta

SEQ ID NO: 3962951 - DNA, 14 bp, Homo sapiens
atatcaattcaaca

SEQ ID NO: 3962952 - DNA, 17 bp, Homo sapiens
atatcacctctcttcag

SEQ ID NO: 3962953 - DNA, 17 bp, Homo sapiens
atatcagaaaagggaag

SEQ ID NO: 3962954 - DNA, 13 bp, Homo sapiens
atatcagaaaagt

SEQ ID NO: 3962955 - DNA, 21 bp, Homo sapiens
atatcagaaaagtagaattat

SEQ ID NO: 3962956 - DNA, 20 bp, Homo sapiens
atatcagcctgagtctcctg

SEQ ID NO: 3962957 - DNA, 22 bp, Homo sapiens
atatcagcctgagtctcctgtg

SEQ ID NO: 3962958 - DNA, 17 bp, Homo sapiens
atatcagttactcagcc

SEQ ID NO: 3962959 - DNA, 19 bp, Homo sapiens
atatcagttactcagccct

SEQ ID NO: 3962960 - DNA, 22 bp, Homo sapiens
atatcagttactcagccctggg

SEQ ID NO: 3962961 - DNA, 16 bp, Homo sapiens
atatcagttataatta

SEQ ID NO: 3962962 - DNA, 14 bp, Homo sapiens
atatcatattggta

SEQ ID NO: 3962963 - DNA, 18 bp, Homo sapiens
atatcatcagcatacctt

SEQ ID NO: 3962964 - DNA, 20 bp, Homo sapiens
atatcatcagcataccttta

SEQ ID NO: 3962965 - DNA, 22 bp, Homo sapiens
atatcatgctttaaagtgtaat

SEQ ID NO: 3962966 - DNA, 17 bp, Homo sapiens
atatcattaaattggaa

SEQ ID NO: 3962967 - DNA, 22 bp, Homo sapiens
atgaacacacatggatgcacac

SEQ ID NO: 3962968 - DNA, 20 bp, Homo sapiens
atgaacacagctgctgaaga

SEQ ID NO: 3962969 - DNA, 13 bp, Homo sapiens
atgaacctggagg

SEQ ID NO: 3962970 - DNA, 18 bp, Homo sapiens
atgaacttgaggacacat

SEQ ID NO: 3962971 - DNA, 19 bp, Homo sapiens
atgaacttgaggacacatg

SEQ ID NO: 3962972 - DNA, 12 bp, Homo sapiens
atgaagacccag

SEQ ID NO: 3962973 - DNA, 20 bp, Homo sapiens
atgaagacccagtgtaaaga

SEQ ID NO: 3962974 - DNA, 22 bp, Homo sapiens
atgaagacccagtgtaaagaat

SEQ ID NO: 3962975 - DNA, 16 bp, Homo sapiens
atgaagagaagctgag

SEQ ID NO: 3962976 - DNA, 18 bp, Homo sapiens
atgaagagtgagagggca

SEQ ID NO: 3962977 - DNA, 19 bp, Homo sapiens
atgaagagtgagagggcat

SEQ ID NO: 3962978 - DNA, 22 bp, Homo sapiens
atgaagattctcctgtgctaga

SEQ ID NO: 3962979 - DNA, 16 bp, Homo sapiens
atgaagcccaataaac

SEQ ID NO: 3962980 - DNA, 17 bp, Homo sapiens
atgaaggcgtgcaaggg

SEQ ID NO: 3962981 - DNA, 17 bp, Homo sapiens
atgaagggaaaggatat

SEQ ID NO: 3962982 - DNA, 19 bp, Homo sapiens
atgaagtgtgtttccttca

SEQ ID NO: 3962983 - DNA, 15 bp, Homo sapiens
atgaagtgttagata

SEQ ID NO: 3962984 - DNA, 20 bp, Homo sapiens
atgaatagatgtgatcactg

SEQ ID NO: 3962985 - DNA, 16 bp, Homo sapiens
atgaatcttttccact

SEQ ID NO: 3962986 - DNA, 13 bp, Homo sapiens
atgaatgctgacc

SEQ ID NO: 3962987 - DNA, 21 bp, Homo sapiens
atgacaatcctgaagaaacca

SEQ ID NO: 3962988 - DNA, 17 bp, Homo sapiens
atgacacctccatttct

SEQ ID NO: 3962989 - DNA, 19 bp, Homo sapiens
atgacacggtaggccaagc

SEQ ID NO: 3962990 - DNA, 12 bp, Homo sapiens
atgacactgacc

SEQ ID NO: 3962991 - DNA, 20 bp, Homo sapiens
atgacatattttatcttgtt

SEQ ID NO: 3962992 - DNA, 14 bp, Homo sapiens
atgacatgcactga

SEQ ID NO: 3962993 - DNA, 15 bp, Homo sapiens
atgacatgcactgac

SEQ ID NO: 3962994 - DNA, 16 bp, Homo sapiens
atgacatgcactgacc

SEQ ID NO: 3962995 - DNA, 18 bp, Homo sapiens
atgacatgcactgaccct

SEQ ID NO: 3962996 - DNA, 19 bp, Homo sapiens
atgacatgcactgaccctt

SEQ ID NO: 3962997 - DNA, 22 bp, Homo sapiens
atgacatgcactgacccttcca

SEQ ID NO: 3962998 - DNA, 23 bp, Homo sapiens
atgacatgcactgacccttccag

SEQ ID NO: 3962999 - DNA, 15 bp, Homo sapiens
atgacatgccaccct

SEQ ID NO: 3963000 - DNA, 17 bp, Homo sapiens
atgacatgccaccctct

SEQ ID NO: 3963001 - DNA, 17 bp, Homo sapiens
atgaccacgggcctcag

SEQ ID NO: 3963002 - DNA, 18 bp, Homo sapiens
atgaccacgggcctcagt

SEQ ID NO: 3963003 - DNA, 21 bp, Homo sapiens
atgaccagaaaacaaatcttc

SEQ ID NO: 3963004 - DNA, 13 bp, Homo sapiens
atgaccaggacta

SEQ ID NO: 3963005 - DNA, 22 bp, Homo sapiens
atgacctactagttttccttga

SEQ ID NO: 3963006 - DNA, 12 bp, Homo sapiens
atgacctccagc

SEQ ID NO: 3963007 - DNA, 14 bp, Homo sapiens
atgactaaaaatat

SEQ ID NO: 3963008 - DNA, 15 bp, Homo sapiens
atgactagaggcagg

SEQ ID NO: 3963009 - DNA, 14 bp, Homo sapiens
atgactataaacat

SEQ ID NO: 3963010 - DNA, 23 bp, Homo sapiens
atgactgctccccagccctggct

SEQ ID NO: 3963011 - DNA, 20 bp, Homo sapiens
atgacttgggcacccccagc

SEQ ID NO: 3963012 - DNA, 20 bp, Homo sapiens
atgacttttccatgtatcta

SEQ ID NO: 3963013 - DNA, 23 bp, Homo sapiens
atgagaaactttgatctctgctt

SEQ ID NO: 3963014 - DNA, 17 bp, Homo sapiens
atgagaacaagtcacag

SEQ ID NO: 3963015 - DNA, 23 bp, Homo sapiens
atgagaacaagtcacagctgcag

SEQ ID NO: 3963016 - DNA, 15 bp, Homo sapiens
atgagaagagggcct

SEQ ID NO: 3963017 - DNA, 16 bp, Homo sapiens
atgagaagagggcctg

SEQ ID NO: 3963018 - DNA, 21 bp, Homo sapiens
atgagaagagggcctgtggga

SEQ ID NO: 3963019 - DNA, 11 bp, Homo sapiens
atgagaatcta

SEQ ID NO: 3963020 - DNA, 23 bp, Homo sapiens
atgagacttccaaacctgacaga

SEQ ID NO: 3963021 - DNA, 20 bp, Homo sapiens
atgagccgctgtgagcccct

SEQ ID NO: 3963022 - DNA, 23 bp, Homo sapiens
atgagccgctgtgagcccctggt

SEQ ID NO: 3963023 - DNA, 14 bp, Homo sapiens
atgagctcctcttc

SEQ ID NO: 3963024 - DNA, 15 bp, Homo sapiens
atgaggaacctcaaa

SEQ ID NO: 3963025 - DNA, 22 bp, Homo sapiens
atgaggaacctcaaactgggta

SEQ ID NO: 3963026 - DNA, 14 bp, Homo sapiens
atgaggagagaagg

SEQ ID NO: 3963027 - DNA, 17 bp, Homo sapiens
atgaggagagaaggaca

SEQ ID NO: 3963028 - DNA, 21 bp, Homo sapiens
atgaggcctcttggacctctg

SEQ ID NO: 3963029 - DNA, 14 bp, Homo sapiens
atgagggactggaa

SEQ ID NO: 3963030 - DNA, 14 bp, Homo sapiens
atgagggcagcagc

SEQ ID NO: 3963031 - DNA, 15 bp, Homo sapiens
atgagggcagcagcc

SEQ ID NO: 3963032 - DNA, 18 bp, Homo sapiens
atgagggcagcagccagc

SEQ ID NO: 3963033 - DNA, 23 bp, Homo sapiens
atgagggcagcagccagccctgc

SEQ ID NO: 3963034 - DNA, 18 bp, Homo sapiens
atgagtatacaatatata

SEQ ID NO: 3963035 - DNA, 21 bp, Homo sapiens
atgagtatacaatatataaaa

SEQ ID NO: 3963036 - DNA, 22 bp, Homo sapiens
atgagtcagtctctctctccct

SEQ ID NO: 3963037 - DNA, 12 bp, Homo sapiens
atgagtggatgg

SEQ ID NO: 3963038 - DNA, 18 bp, Homo sapiens
atgagtggatggatggac

SEQ ID NO: 3963039 - DNA, 22 bp, Homo sapiens
atgagtggatggatggacagaa

SEQ ID NO: 3963040 - DNA, 19 bp, Homo sapiens
atgagttgttttcagactc

SEQ ID NO: 3963041 - DNA, 14 bp, Homo sapiens
atgagtttgcttat

SEQ ID NO: 3963042 - DNA, 15 bp, Homo sapiens
atgataaagatgtca

SEQ ID NO: 3963043 - DNA, 18 bp, Homo sapiens
atgataaatatttatgct

SEQ ID NO: 3963044 - DNA, 13 bp, Homo sapiens
atgatactgatgc

SEQ ID NO: 3963045 - DNA, 18 bp, Homo sapiens
atgatcacagtgacttta

SEQ ID NO: 3963046 - DNA, 18 bp, Homo sapiens
atgatctaatacaaagat

SEQ ID NO: 3963047 - DNA, 14 bp, Homo sapiens
atgatctccctgcc

SEQ ID NO: 3963048 - DNA, 18 bp, Homo sapiens
atgatgatctttaaaata

SEQ ID NO: 3963049 - DNA, 20 bp, Homo sapiens
atgatgattaaacacctgac

SEQ ID NO: 3963050 - DNA, 23 bp, Homo sapiens
atgatgattaaacacctgacaca

SEQ ID NO: 3963051 - DNA, 19 bp, Homo sapiens
atgatggcaattttgtaac

SEQ ID NO: 3963052 - DNA, 13 bp, Homo sapiens
atgattaaacacc

SEQ ID NO: 3963053 - DNA, 19 bp, Homo sapiens
atgattaaacacctgacac

SEQ ID NO: 3963054 - DNA, 21 bp, Homo sapiens
atgattaaacacctgacacat

SEQ ID NO: 3963055 - DNA, 15 bp, Homo sapiens
atgattattttcatt

SEQ ID NO: 3963056 - DNA, 18 bp, Homo sapiens
atgattattttcattaca

SEQ ID NO: 3963057 - DNA, 18 bp, Homo sapiens
atgattccttgagcattt

SEQ ID NO: 3963058 - DNA, 21 bp, Homo sapiens
atgattccttgagcattttat

SEQ ID NO: 3963059 - DNA, 22 bp, Homo sapiens
atgattccttgatggagatatt

SEQ ID NO: 3963060 - DNA, 21 bp, Homo sapiens
atgattggattattcatttaa

SEQ ID NO: 3963061 - DNA, 15 bp, Homo sapiens
atgattgtaaaatag

SEQ ID NO: 3963062 - DNA, 20 bp, Homo sapiens
atgatttagggaagcaggga

SEQ ID NO: 3963063 - DNA, 22 bp, Homo sapiens
atgatttatatatggcatattt

SEQ ID NO: 3963064 - DNA, 13 bp, Homo sapiens
atgattttacaga

SEQ ID NO: 3963065 - DNA, 15 bp, Homo sapiens
atgattttacagaga

SEQ ID NO: 3963066 - DNA, 16 bp, Homo sapiens
atgattttacagagaa

SEQ ID NO: 3963067 - DNA, 18 bp, Homo sapiens
atgattttatacatagtc

SEQ ID NO: 3963068 - DNA, 22 bp, Homo sapiens
atgattttatacatagtcacaa

SEQ ID NO: 3963069 - DNA, 23 bp, Homo sapiens
atgattttatttgacaaaatttg

SEQ ID NO: 3963070 - DNA, 17 bp, Homo sapiens
atgattttttaaaagaa

SEQ ID NO: 3963071 - DNA, 20 bp, Homo sapiens
atgattttttaaaagaaatt

SEQ ID NO: 3963072 - DNA, 20 bp, Homo sapiens
atgcaaacactgtgtattta

SEQ ID NO: 3963073 - DNA, 16 bp, Homo sapiens
atgcaattcatcccag

SEQ ID NO: 3963074 - DNA, 21 bp, Homo sapiens
atgcaatttttaaactagtaa

SEQ ID NO: 3963075 - DNA, 11 bp, Homo sapiens
atgcacaattt

SEQ ID NO: 3963076 - DNA, 15 bp, Homo sapiens
atgcacaatttagaa

SEQ ID NO: 3963077 - DNA, 19 bp, Homo sapiens
atgcacaatttagaaaaca

SEQ ID NO: 3963078 - DNA, 20 bp, Homo sapiens
atgcacaatttagaaaacat

SEQ ID NO: 3963079 - DNA, 12 bp, Homo sapiens
atgcacacacag

SEQ ID NO: 3963080 - DNA, 13 bp, Homo sapiens
atgcacagctgct

SEQ ID NO: 3963081 - DNA, 16 bp, Homo sapiens
atgcacagctgcttgt

SEQ ID NO: 3963082 - DNA, 17 bp, Homo sapiens
atgcacagctgcttgtc

SEQ ID NO: 3963083 - DNA, 20 bp, Homo sapiens
atgcacagctgcttgtcctg

SEQ ID NO: 3963084 - DNA, 14 bp, Homo sapiens
atgcacatttatat

SEQ ID NO: 3963085 - DNA, 23 bp, Homo sapiens
atgcactgacccttccagacata

SEQ ID NO: 3963086 - DNA, 12 bp, Homo sapiens
atgcactggcca

SEQ ID NO: 3963087 - DNA, 13 bp, Homo sapiens
atgcagaaggaag

SEQ ID NO: 3963088 - DNA, 16 bp, Homo sapiens
atgcagattcctgggc

SEQ ID NO: 3963089 - DNA, 18 bp, Homo sapiens
atgcagattcctgggcct

SEQ ID NO: 3963090 - DNA, 21 bp, Homo sapiens
atgcagcctaaggctgtatga

SEQ ID NO: 3963091 - DNA, 17 bp, Homo sapiens
atgcagctgaggtctgt

SEQ ID NO: 3963092 - DNA, 14 bp, Homo sapiens
atgcagcttcatca

SEQ ID NO: 3963093 - DNA, 18 bp, Homo sapiens
atgcagggaagagggcag

SEQ ID NO: 3963094 - DNA, 19 bp, Homo sapiens
atgcagtccagaataagtg

SEQ ID NO: 3963095 - DNA, 20 bp, Homo sapiens
atgcagtccagaataagtgc

SEQ ID NO: 3963096 - DNA, 18 bp, Homo sapiens
atgcatcagaaagggagg

SEQ ID NO: 3963097 - DNA, 16 bp, Homo sapiens
atgcatcatcagccta

SEQ ID NO: 3963098 - DNA, 12 bp, Homo sapiens
atgcatgatttt

SEQ ID NO: 3963099 - DNA, 13 bp, Homo sapiens
atgcatgatttta

SEQ ID NO: 3963100 - DNA, 14 bp, Homo sapiens
atgcatgattttat

SEQ ID NO: 3963101 - DNA, 18 bp, Homo sapiens
atgcatgattttatacat

SEQ ID NO: 3963102 - DNA, 19 bp, Homo sapiens
atgcatggtgcagttgaca

SEQ ID NO: 3963103 - DNA, 21 bp, Homo sapiens
atgcattataggatcatttgt

SEQ ID NO: 3963104 - DNA, 22 bp, Homo sapiens
atgcattataggatcatttgtt

SEQ ID NO: 3963105 - DNA, 20 bp, Homo sapiens
atgcatttccacactgtcag

SEQ ID NO: 3963106 - DNA, 22 bp, Homo sapiens
atgccaacatacccttctttaa

SEQ ID NO: 3963107 - DNA, 22 bp, Homo sapiens
atgccacagccccacagcaccc

SEQ ID NO: 3963108 - DNA, 15 bp, Homo sapiens
atgccaccctctcca

SEQ ID NO: 3963109 - DNA, 20 bp, Homo sapiens
atgccaccctgttttcagct

SEQ ID NO: 3963110 - DNA, 18 bp, Homo sapiens
atgccactgccaggcacc

SEQ ID NO: 3963111 - DNA, 23 bp, Homo sapiens
atgccactgccaggcacctggcc

SEQ ID NO: 3963112 - DNA, 20 bp, Homo sapiens
atgccagcttcctgtgggcc

SEQ ID NO: 3963113 - DNA, 17 bp, Homo sapiens
atgccatccattctgcc

SEQ ID NO: 3963114 - DNA, 17 bp, Homo sapiens
atgccatttaaagctta

SEQ ID NO: 3963115 - DNA, 16 bp, Homo sapiens
atgccatttgtactga

SEQ ID NO: 3963116 - DNA, 11 bp, Homo sapiens
atggaggagaa

SEQ ID NO: 3963117 - DNA, 15 bp, Homo sapiens
atggaggagaaataa

SEQ ID NO: 3963118 - DNA, 16 bp, Homo sapiens
atggaggagaaataaa

SEQ ID NO: 3963119 - DNA, 13 bp, Homo sapiens
atggaggagaaga

SEQ ID NO: 3963120 - DNA, 17 bp, Homo sapiens
atggaggagaagaattt

SEQ ID NO: 3963121 - DNA, 16 bp, Homo sapiens
atggaggatggagaga

SEQ ID NO: 3963122 - DNA, 22 bp, Homo sapiens
atggaggcctcacacccagagg

SEQ ID NO: 3963123 - DNA, 14 bp, Homo sapiens
atggagggtggggc

SEQ ID NO: 3963124 - DNA, 11 bp, Homo sapiens
atggagtgacg

SEQ ID NO: 3963125 - DNA, 21 bp, Homo sapiens
atggagtgggagatcagccac

SEQ ID NO: 3963126 - DNA, 19 bp, Homo sapiens
atggataacctatatgatt

SEQ ID NO: 3963127 - DNA, 22 bp, Homo sapiens
atggatttttaaattatactgt

SEQ ID NO: 3963128 - DNA, 14 bp, Homo sapiens
atggcaaaaatggc

SEQ ID NO: 3963129 - DNA, 23 bp, Homo sapiens
atggcaagaaagctggtaaacta

SEQ ID NO: 3963130 - DNA, 19 bp, Homo sapiens
atggcaaggactgcaggga

SEQ ID NO: 3963131 - DNA, 21 bp, Homo sapiens
atggcaagtgatatcacctct

SEQ ID NO: 3963132 - DNA, 14 bp, Homo sapiens
atggcaccagaggc

SEQ ID NO: 3963133 - DNA, 19 bp, Homo sapiens
atggcaccagccccctgga

SEQ ID NO: 3963134 - DNA, 22 bp, Homo sapiens
atggcaccagccccctggatgg

SEQ ID NO: 3963135 - DNA, 20 bp, Homo sapiens
atggcacttagctatcagaa

SEQ ID NO: 3963136 - DNA, 19 bp, Homo sapiens
atggcagaggaatatcaat

SEQ ID NO: 3963137 - DNA, 20 bp, Homo sapiens
atggcagcagttccatgaag

SEQ ID NO: 3963138 - DNA, 15 bp, Homo sapiens
atggccaagagcatc

SEQ ID NO: 3963139 - DNA, 21 bp, Homo sapiens
atggccaagggggtggacgca

SEQ ID NO: 3963140 - DNA, 18 bp, Homo sapiens
atggccaccccgtgccac

SEQ ID NO: 3963141 - DNA, 20 bp, Homo sapiens
atggccaccccgtgccaccc

SEQ ID NO: 3963142 - DNA, 22 bp, Homo sapiens
atggccaggtggccactccaga

SEQ ID NO: 3963143 - DNA, 13 bp, Homo sapiens
atggccccagggt

SEQ ID NO: 3963144 - DNA, 11 bp, Homo sapiens
atggccctggg

SEQ ID NO: 3963145 - DNA, 20 bp, Homo sapiens
atggcctattatattaaaat

SEQ ID NO: 3963146 - DNA, 18 bp, Homo sapiens
atggccttccctccccac

SEQ ID NO: 3963147 - DNA, 17 bp, Homo sapiens
atggcgcgggaggcacc

SEQ ID NO: 3963148 - DNA, 19 bp, Homo sapiens
atggcgcgggaggcaccag

SEQ ID NO: 3963149 - DNA, 16 bp, Homo sapiens
atggctaattcccaga

SEQ ID NO: 3963150 - DNA, 15 bp, Homo sapiens
atggctataggtgct

SEQ ID NO: 3963151 - DNA, 20 bp, Homo sapiens
atggctcaggcaagcccctc

SEQ ID NO: 3963152 - DNA, 18 bp, Homo sapiens
atggctgtaaactataaa

SEQ ID NO: 3963153 - DNA, 17 bp, Homo sapiens
atggctgtgcctctgcc

SEQ ID NO: 3963154 - DNA, 19 bp, Homo sapiens
atggctgtgcctctgcctg

SEQ ID NO: 3963155 - DNA, 15 bp, Homo sapiens
atggcttataaatgt

SEQ ID NO: 3963156 - DNA, 16 bp, Homo sapiens
atggcttataaatgtg

SEQ ID NO: 3963157 - DNA, 13 bp, Homo sapiens
atggcttggggag

SEQ ID NO: 3963158 - DNA, 14 bp, Homo sapiens
atggcttggggagc

SEQ ID NO: 3963159 - DNA, 17 bp, Homo sapiens
atggcttggggagcaga

SEQ ID NO: 3963160 - DNA, 18 bp, Homo sapiens
atggcttggggagcagag

SEQ ID NO: 3963161 - DNA, 19 bp, Homo sapiens
atggcttggggagcagagt

SEQ ID NO: 3963162 - DNA, 20 bp, Homo sapiens
atggctttaaactaccctcc

SEQ ID NO: 3963163 - DNA, 19 bp, Homo sapiens
atggctttgctttgtgtaa

SEQ ID NO: 3963164 - DNA, 23 bp, Homo sapiens
atgggaaaggaggcatgcctctg

SEQ ID NO: 3963165 - DNA, 22 bp, Homo sapiens
atgggaagatggtagcagataa

SEQ ID NO: 3963166 - DNA, 23 bp, Homo sapiens
atgggaattctttacaataaaca

SEQ ID NO: 3963167 - DNA, 11 bp, Homo sapiens
atgggaccagg

SEQ ID NO: 3963168 - DNA, 15 bp, Homo sapiens
atgggagagtagatg

SEQ ID NO: 3963169 - DNA, 22 bp, Homo sapiens
atgggagctggttagaaatgca

SEQ ID NO: 3963170 - DNA, 16 bp, Homo sapiens
atgggagggagggaga

SEQ ID NO: 3963171 - DNA, 17 bp, Homo sapiens
atgggagggggctccat

SEQ ID NO: 3963172 - DNA, 23 bp, Homo sapiens
atgggattcagtgcttcttaaag

SEQ ID NO: 3963173 - DNA, 18 bp, Homo sapiens
atgggcacatgaggaggg

SEQ ID NO: 3963174 - DNA, 20 bp, Homo sapiens
atgggcacatgaggagggtg

SEQ ID NO: 3963175 - DNA, 18 bp, Homo sapiens
atgggcattgggctgaca

SEQ ID NO: 3963176 - DNA, 19 bp, Homo sapiens
atgggcattgggctgacac

SEQ ID NO: 3963177 - DNA, 17 bp, Homo sapiens
atgggccaattaaaata

SEQ ID NO: 3963178 - DNA, 20 bp, Homo sapiens
atgggccaattaaaatatat

SEQ ID NO: 3963179 - DNA, 11 bp, Homo sapiens
atgggccaggg

SEQ ID NO: 3963180 - DNA, 15 bp, Homo sapiens
atgggcctgggcctg

SEQ ID NO: 3963181 - DNA, 16 bp, Homo sapiens
atgggcctgggcctgc

SEQ ID NO: 3963182 - DNA, 12 bp, Homo sapiens
atgggccttgct

SEQ ID NO: 3963183 - DNA, 19 bp, Homo sapiens
atgggccttgctttgggct

SEQ ID NO: 3963184 - DNA, 20 bp, Homo sapiens
atgggcttggacttcctggg

SEQ ID NO: 3963185 - DNA, 22 bp, Homo sapiens
atgggcttggacttcctggggc

SEQ ID NO: 3963186 - DNA, 15 bp, Homo sapiens
atggggaagtgctcc

SEQ ID NO: 3963187 - DNA, 18 bp, Homo sapiens
atggggaagtgctcccca

SEQ ID NO: 3963188 - DNA, 12 bp, Homo sapiens
atggggagaaag

SEQ ID NO: 3963189 - DNA, 22 bp, Homo sapiens
atggggctgaacggggagaaaa

SEQ ID NO: 3963190 - DNA, 15 bp, Homo sapiens
atgggtattaaactt

SEQ ID NO: 3963191 - DNA, 17 bp, Homo sapiens
atgggtctggctgagct

SEQ ID NO: 3963192 - DNA, 12 bp, Homo sapiens
atgggtgctggc

SEQ ID NO: 3963193 - DNA, 22 bp, Homo sapiens
atggtaagactgtaattaagta

SEQ ID NO: 3963194 - DNA, 17 bp, Homo sapiens
atggtaatctacagctc

SEQ ID NO: 3963195 - DNA, 12 bp, Homo sapiens
atggtagcagat

SEQ ID NO: 3963196 - DNA, 20 bp, Homo sapiens
atggtatgagctgagggggg

SEQ ID NO: 3963197 - DNA, 15 bp, Homo sapiens
atggtatgctggcca

SEQ ID NO: 3963198 - DNA, 22 bp, Homo sapiens
atggtatgctggccagcaccct

SEQ ID NO: 3963199 - DNA, 15 bp, Homo sapiens
atgtttgatttagta

SEQ ID NO: 3963200 - DNA, 23 bp, Homo sapiens
atgtttgggcagaagggagaagg

SEQ ID NO: 3963201 - DNA, 20 bp, Homo sapiens
atgtttggttgtaaatgctc

SEQ ID NO: 3963202 - DNA, 14 bp, Homo sapiens
atgttttgttcaaa

SEQ ID NO: 3963203 - DNA, 15 bp, Homo sapiens
atgtttttcatgaaa

SEQ ID NO: 3963204 - DNA, 13 bp, Homo sapiens
attaaaaaccact

SEQ ID NO: 3963205 - DNA, 20 bp, Homo sapiens
attaaaaaccactgaacatt

SEQ ID NO: 3963206 - DNA, 22 bp, Homo sapiens
attaaaaatgaaattatttata

SEQ ID NO: 3963207 - DNA, 15 bp, Homo sapiens
attaaaagaatattt

SEQ ID NO: 3963208 - DNA, 16 bp, Homo sapiens
attaaaatatatataa

SEQ ID NO: 3963209 - DNA, 22 bp, Homo sapiens
attaaaatatggctataaatat

SEQ ID NO: 3963210 - DNA, 18 bp, Homo sapiens
attaaaatgattgtaaaa

SEQ ID NO: 3963211 - DNA, 13 bp, Homo sapiens
attaaacacctga

SEQ ID NO: 3963212 - DNA, 19 bp, Homo sapiens
attaaacacctgacacatc

SEQ ID NO: 3963213 - DNA, 20 bp, Homo sapiens
attaaacacctgacacatct

SEQ ID NO: 3963214 - DNA, 14 bp, Homo sapiens
attaaacactgtaa

SEQ ID NO: 3963215 - DNA, 17 bp, Homo sapiens
attaaagcaacatttta

SEQ ID NO: 3963216 - DNA, 21 bp, Homo sapiens
attaaataacagtgtgtgacc

SEQ ID NO: 3963217 - DNA, 17 bp, Homo sapiens
attaaatacagacacta

SEQ ID NO: 3963218 - DNA, 24 bp, Homo sapiens
attaaattatatctgaggcactga

SEQ ID NO: 3963219 - DNA, 22 bp, Homo sapiens
attaacatcatcaggcttggaa

SEQ ID NO: 3963220 - DNA, 11 bp, Homo sapiens
attaacctaga

SEQ ID NO: 3963221 - DNA, 13 bp, Homo sapiens
attaacctagaga

SEQ ID NO: 3963222 - DNA, 14 bp, Homo sapiens
attaacgggcatgt

SEQ ID NO: 3963223 - DNA, 11 bp, Homo sapiens
attaagacttt

SEQ ID NO: 3963224 - DNA, 13 bp, Homo sapiens
attaagactttaa

SEQ ID NO: 3963225 - DNA, 19 bp, Homo sapiens
attaagactttaaaagatg

SEQ ID NO: 3963226 - DNA, 19 bp, Homo sapiens
attaagagatacattccct

SEQ ID NO: 3963227 - DNA, 13 bp, Homo sapiens
attaagatttcca

SEQ ID NO: 3963228 - DNA, 16 bp, Homo sapiens
attaagatttccaagt

SEQ ID NO: 3963229 - DNA, 15 bp, Homo sapiens
attaaggtgatgtga

SEQ ID NO: 3963230 - DNA, 17 bp, Homo sapiens
attaaggtgatgtgatt

SEQ ID NO: 3963231 - DNA, 18 bp, Homo sapiens
attaagtggctttttaac

SEQ ID NO: 3963232 - DNA, 18 bp, Homo sapiens
attaataccaaatatttt

SEQ ID NO: 3963233 - DNA, 20 bp, Homo sapiens
attaataccaaatattttag

SEQ ID NO: 3963234 - DNA, 19 bp, Homo sapiens
attaatagcttttattgta

SEQ ID NO: 3963235 - DNA, 23 bp, Homo sapiens
attaatagcttttattgtataaa

SEQ ID NO: 3963236 - DNA, 23 bp, Homo sapiens
attaatcaatcatctgtgtgaaa

SEQ ID NO: 3963237 - DNA, 16 bp, Homo sapiens
attaatcaccaaagta

SEQ ID NO: 3963238 - DNA, 16 bp, Homo sapiens
attaatcgtgtcttca

SEQ ID NO: 3963239 - DNA, 23 bp, Homo sapiens
attaatctttctttacctgagac

SEQ ID NO: 3963240 - DNA, 14 bp, Homo sapiens
attaatggcactga

SEQ ID NO: 3963241 - DNA, 17 bp, Homo sapiens
attaatggtctaaaaat

SEQ ID NO: 3963242 - DNA, 21 bp, Homo sapiens
attaatgtaggtttagatata

SEQ ID NO: 3963243 - DNA, 14 bp, Homo sapiens
attaatgttttgta

SEQ ID NO: 3963244 - DNA, 16 bp, Homo sapiens
attaatgttttgtaca

SEQ ID NO: 3963245 - DNA, 13 bp, Homo sapiens
attaattatctga

SEQ ID NO: 3963246 - DNA, 11 bp, Homo sapiens
attaattcatt

SEQ ID NO: 3963247 - DNA, 12 bp, Homo sapiens
attaattcatta

SEQ ID NO: 3963248 - DNA, 21 bp, Homo sapiens
attaatttatggtttctgcgt

SEQ ID NO: 3963249 - DNA, 14 bp, Homo sapiens
attaatttgagaat

SEQ ID NO: 3963250 - DNA, 19 bp, Homo sapiens
attaatttgagaattattc

SEQ ID NO: 3963251 - DNA, 15 bp, Homo sapiens
attacaatggaaaca

SEQ ID NO: 3963252 - DNA, 14 bp, Homo sapiens
attacacccaaaga

SEQ ID NO: 3963253 - DNA, 15 bp, Homo sapiens
attacagctggagaa

SEQ ID NO: 3963254 - DNA, 19 bp, Homo sapiens
attacataatcaaagctac

SEQ ID NO: 3963255 - DNA, 17 bp, Homo sapiens
attacatgtttaaattg

SEQ ID NO: 3963256 - DNA, 18 bp, Homo sapiens
attacatgtttaaattgt

SEQ ID NO: 3963257 - DNA, 16 bp, Homo sapiens
attacatttatacatc

SEQ ID NO: 3963258 - DNA, 17 bp, Homo sapiens
attacatttccaaatga

SEQ ID NO: 3963259 - DNA, 18 bp, Homo sapiens
attacatttccaaatgaa

SEQ ID NO: 3963260 - DNA, 18 bp, Homo sapiens
attaccaaaaaagtattt

SEQ ID NO: 3963261 - DNA, 21 bp, Homo sapiens
attaccttagattagctctgg

SEQ ID NO: 3963262 - DNA, 16 bp, Homo sapiens
attactgcctttggaa

SEQ ID NO: 3963263 - DNA, 23 bp, Homo sapiens
attactgcctttggaagaaacag

SEQ ID NO: 3963264 - DNA, 18 bp, Homo sapiens
attactgtctggttttaa

SEQ ID NO: 3963265 - DNA, 12 bp, Homo sapiens
attacttgcaca

SEQ ID NO: 3963266 - DNA, 13 bp, Homo sapiens
attacttgcacaa

SEQ ID NO: 3963267 - DNA, 15 bp, Homo sapiens
attactttgtcccgc

SEQ ID NO: 3963268 - DNA, 18 bp, Homo sapiens
attagaacaggcaagtga

SEQ ID NO: 3963269 - DNA, 19 bp, Homo sapiens
attagagggaggagaatga

SEQ ID NO: 3963270 - DNA, 18 bp, Homo sapiens
attagatcttcaaacaga

SEQ ID NO: 3963271 - DNA, 17 bp, Homo sapiens
attagcagtttgctttg

SEQ ID NO: 3963272 - DNA, 17 bp, Homo sapiens
attagctagaatgcaca

SEQ ID NO: 3963273 - DNA, 12 bp, Homo sapiens
attagctctgga

SEQ ID NO: 3963274 - DNA, 20 bp, Homo sapiens
attagctggttggagagcta

SEQ ID NO: 3963275 - DNA, 13 bp, Homo sapiens
attagctgtaaat

SEQ ID NO: 3963276 - DNA, 16 bp, Homo sapiens
attaggatctatgcaa

SEQ ID NO: 3963277 - DNA, 20 bp, Homo sapiens
attaggatctatgcaatttt

SEQ ID NO: 3963278 - DNA, 23 bp, Homo sapiens
attaggatctatgcaatttttaa

SEQ ID NO: 3963279 - DNA, 14 bp, Homo sapiens
attaggatttcatg

SEQ ID NO: 3963280 - DNA, 16 bp, Homo sapiens
attaggatttcatgat

SEQ ID NO: 3963281 - DNA, 19 bp, Homo sapiens
attaggatttgccccttcc

SEQ ID NO: 3963282 - DNA, 20 bp, Homo sapiens
attaggtactatctgtgaag

SEQ ID NO: 3963283 - DNA, 16 bp, Homo sapiens
attagtaattgtaagt

SEQ ID NO: 3963284 - DNA, 23 bp, Homo sapiens
attagtccaaatgtgatcaactg

SEQ ID NO: 3963285 - DNA, 19 bp, Homo sapiens
attataaataaatgccaac

SEQ ID NO: 3963286 - DNA, 18 bp, Homo sapiens
attcatctgggaggcaga

SEQ ID NO: 3963287 - DNA, 16 bp, Homo sapiens
attcatgctttctcct

SEQ ID NO: 3963288 - DNA, 13 bp, Homo sapiens
attcatgggtgtc

SEQ ID NO: 3963289 - DNA, 13 bp, Homo sapiens
attcatgtaataa

SEQ ID NO: 3963290 - DNA, 14 bp, Homo sapiens
attcatgtaataaa

SEQ ID NO: 3963291 - DNA, 19 bp, Homo sapiens
attcatgtaataaatctga

SEQ ID NO: 3963292 - DNA, 10 bp, Homo sapiens
attcatttaa

SEQ ID NO: 3963293 - DNA, 16 bp, Homo sapiens
attcatttaaaatgat

SEQ ID NO: 3963294 - DNA, 17 bp, Homo sapiens
attcatttaaaatgatt

SEQ ID NO: 3963295 - DNA, 13 bp, Homo sapiens
attcatttcacat

SEQ ID NO: 3963296 - DNA, 17 bp, Homo sapiens
attcatttcactttaaa

SEQ ID NO: 3963297 - DNA, 20 bp, Homo sapiens
attccaacagctcaagtctt

SEQ ID NO: 3963298 - DNA, 22 bp, Homo sapiens
attccactcaatatgtgatttt

SEQ ID NO: 3963299 - DNA, 21 bp, Homo sapiens
attccagagagtggctcctcc

SEQ ID NO: 3963300 - DNA, 12 bp, Homo sapiens
attccatgattt

SEQ ID NO: 3963301 - DNA, 18 bp, Homo sapiens
attccatgattttacaga

SEQ ID NO: 3963302 - DNA, 20 bp, Homo sapiens
attccatgattttacagaga

SEQ ID NO: 3963303 - DNA, 21 bp, Homo sapiens
attccatgattttacagagaa

SEQ ID NO: 3963304 - DNA, 15 bp, Homo sapiens
attccatgtccctgt

SEQ ID NO: 3963305 - DNA, 21 bp, Homo sapiens
attcccaactagacattacca

SEQ ID NO: 3963306 - DNA, 15 bp, Homo sapiens
attcccaactgctct

SEQ ID NO: 3963307 - DNA, 14 bp, Homo sapiens
attcccaagaaatg

SEQ ID NO: 3963308 - DNA, 20 bp, Homo sapiens
caaagttcctgttcacctta

SEQ ID NO: 3963309 - DNA, 17 bp, Homo sapiens
caaagttggggcaggct

SEQ ID NO: 3963310 - DNA, 15 bp, Homo sapiens
caaataaatgtgtaa

SEQ ID NO: 3963311 - DNA, 20 bp, Homo sapiens
caaataaatgtgtaaatgtg

SEQ ID NO: 3963312 - DNA, 23 bp, Homo sapiens
caaatactcattttaggaaaaaa

SEQ ID NO: 3963313 - DNA, 18 bp, Homo sapiens
caaatactccaagcttca

SEQ ID NO: 3963314 - DNA, 17 bp, Homo sapiens
caaatataaaacttaca

SEQ ID NO: 3963315 - DNA, 18 bp, Homo sapiens
caaatatgcaaagcactg

SEQ ID NO: 3963316 - DNA, 16 bp, Homo sapiens
caaatcaaccccagac

SEQ ID NO: 3963317 - DNA, 15 bp, Homo sapiens
caaatccacaagcca

SEQ ID NO: 3963318 - DNA, 16 bp, Homo sapiens
caaatccttgagcact

SEQ ID NO: 3963319 - DNA, 22 bp, Homo sapiens
caaatctattcagacaagcaac

SEQ ID NO: 3963320 - DNA, 21 bp, Homo sapiens
caaatcttcaaggtgtaaaat

SEQ ID NO: 3963321 - DNA, 16 bp, Homo sapiens
caaatgcacaagctca

SEQ ID NO: 3963322 - DNA, 17 bp, Homo sapiens
caaatgcgcgtgtgcac

SEQ ID NO: 3963323 - DNA, 14 bp, Homo sapiens
caaatgctaaatgc

SEQ ID NO: 3963324 - DNA, 16 bp, Homo sapiens
caaatggtttttgcaa

SEQ ID NO: 3963325 - DNA, 21 bp, Homo sapiens
caaatggtttttgcaagattt

SEQ ID NO: 3963326 - DNA, 18 bp, Homo sapiens
caaatgtaaaataagtat

SEQ ID NO: 3963327 - DNA, 16 bp, Homo sapiens
caaatgtcattatgta

SEQ ID NO: 3963328 - DNA, 16 bp, Homo sapiens
caaatgtgatcaactg

SEQ ID NO: 3963329 - DNA, 12 bp, Homo sapiens
caaattatttgt

SEQ ID NO: 3963330 - DNA, 20 bp, Homo sapiens
caaattatttgtgtaataga

SEQ ID NO: 3963331 - DNA, 14 bp, Homo sapiens
caaattattttaat

SEQ ID NO: 3963332 - DNA, 15 bp, Homo sapiens
caaattccatgtccc

SEQ ID NO: 3963333 - DNA, 22 bp, Homo sapiens
caaattctacagcatacagagc

SEQ ID NO: 3963334 - DNA, 17 bp, Homo sapiens
caaattggtgtttctga

SEQ ID NO: 3963335 - DNA, 13 bp, Homo sapiens
caaattttgcatt

SEQ ID NO: 3963336 - DNA, 18 bp, Homo sapiens
caaattttgcatttagtt

SEQ ID NO: 3963337 - DNA, 15 bp, Homo sapiens
caaatttttcctgca

SEQ ID NO: 3963338 - DNA, 14 bp, Homo sapiens
caacaaaatcaatt

SEQ ID NO: 3963339 - DNA, 14 bp, Homo sapiens
caacaaaccaaaac

SEQ ID NO: 3963340 - DNA, 19 bp, Homo sapiens
caacaaagccaacagtcaa

SEQ ID NO: 3963341 - DNA, 12 bp, Homo sapiens
caacaacaataa

SEQ ID NO: 3963342 - DNA, 13 bp, Homo sapiens
caacaacaataac

SEQ ID NO: 3963343 - DNA, 12 bp, Homo sapiens
caacaacaatac

SEQ ID NO: 3963344 - DNA, 13 bp, Homo sapiens
caacaacaataca

SEQ ID NO: 3963345 - DNA, 15 bp, Homo sapiens
caacaacaatacaac

SEQ ID NO: 3963346 - DNA, 12 bp, Homo sapiens
caacaagaacaa

SEQ ID NO: 3963347 - DNA, 14 bp, Homo sapiens
caacaagaacaaca

SEQ ID NO: 3963348 - DNA, 17 bp, Homo sapiens
caacaagagcaaaatga

SEQ ID NO: 3963349 - DNA, 13 bp, Homo sapiens
caacaagtaactt

SEQ ID NO: 3963350 - DNA, 14 bp, Homo sapiens
caacaataaaacat

SEQ ID NO: 3963351 - DNA, 14 bp, Homo sapiens
caacaataaagagc

SEQ ID NO: 3963352 - DNA, 15 bp, Homo sapiens
caacaataacaacaa

SEQ ID NO: 3963353 - DNA, 16 bp, Homo sapiens
caacaataacaacaat

SEQ ID NO: 3963354 - DNA, 16 bp, Homo sapiens
caacaatggggtgggc

SEQ ID NO: 3963355 - DNA, 18 bp, Homo sapiens
caacaatggggtgggccc

SEQ ID NO: 3963356 - DNA, 19 bp, Homo sapiens
caacaatggggtgggccca

SEQ ID NO: 3963357 - DNA, 21 bp, Homo sapiens
caacaatggtttacatgaaca

SEQ ID NO: 3963358 - DNA, 13 bp, Homo sapiens
caacacaaagaga

SEQ ID NO: 3963359 - DNA, 20 bp, Homo sapiens
caacacaaagagaaaaagaa

SEQ ID NO: 3963360 - DNA, 22 bp, Homo sapiens
caacacaaagagaaaaagaaat

SEQ ID NO: 3963361 - DNA, 23 bp, Homo sapiens
caacacaaagagaaaaagaaatg

SEQ ID NO: 3963362 - DNA, 21 bp, Homo sapiens
caacacaatctttccttgtct

SEQ ID NO: 3963363 - DNA, 16 bp, Homo sapiens
caacacattacttgca

SEQ ID NO: 3963364 - DNA, 23 bp, Homo sapiens
caacacattacttgcacaagctt

SEQ ID NO: 3963365 - DNA, 17 bp, Homo sapiens
caacagaagcttcagaa

SEQ ID NO: 3963366 - DNA, 17 bp, Homo sapiens
caacagatcaatttgta

SEQ ID NO: 3963367 - DNA, 18 bp, Homo sapiens
caacagcagatggcacca

SEQ ID NO: 3963368 - DNA, 16 bp, Homo sapiens
caacagctcagagatg

SEQ ID NO: 3963369 - DNA, 14 bp, Homo sapiens
caacagcttgacca

SEQ ID NO: 3963370 - DNA, 19 bp, Homo sapiens
caacagcttgaccagacct

SEQ ID NO: 3963371 - DNA, 19 bp, Homo sapiens
caacaggctgttctgcact

SEQ ID NO: 3963372 - DNA, 21 bp, Homo sapiens
caacaggctgttctgcactga

SEQ ID NO: 3963373 - DNA, 18 bp, Homo sapiens
caacaggtggcaggacca

SEQ ID NO: 3963374 - DNA, 22 bp, Homo sapiens
caacaggtggcaggaccaggac

SEQ ID NO: 3963375 - DNA, 11 bp, Homo sapiens
caacagtaaca

SEQ ID NO: 3963376 - DNA, 15 bp, Homo sapiens
caacagtaacacatc

SEQ ID NO: 3963377 - DNA, 14 bp, Homo sapiens
caacagtcaaaaca

SEQ ID NO: 3963378 - DNA, 11 bp, Homo sapiens
caacagtgagt

SEQ ID NO: 3963379 - DNA, 19 bp, Homo sapiens
caacagttgggctgtcaac

SEQ ID NO: 3963380 - DNA, 17 bp, Homo sapiens
caacatacccttcttta

SEQ ID NO: 3963381 - DNA, 19 bp, Homo sapiens
caacatacccttctttaaa

SEQ ID NO: 3963382 - DNA, 23 bp, Homo sapiens
caacatacccttctttaaatcaa

SEQ ID NO: 3963383 - DNA, 19 bp, Homo sapiens
caacatcccattgccctgg

SEQ ID NO: 3963384 - DNA, 15 bp, Homo sapiens
caacatcttctctct

SEQ ID NO: 3963385 - DNA, 15 bp, Homo sapiens
caacatctttttcct

SEQ ID NO: 3963386 - DNA, 19 bp, Homo sapiens
caacatctttttcctccct

SEQ ID NO: 3963387 - DNA, 22 bp, Homo sapiens
caacatggagaaaccctgtctc

SEQ ID NO: 3963388 - DNA, 20 bp, Homo sapiens
caacatgtagctgagtttaa

SEQ ID NO: 3963389 - DNA, 17 bp, Homo sapiens
caacattcaaagcagca

SEQ ID NO: 3963390 - DNA, 19 bp, Homo sapiens
caacattcccccaacatta

SEQ ID NO: 3963391 - DNA, 12 bp, Homo sapiens
caacattttatt

SEQ ID NO: 3963392 - DNA, 16 bp, Homo sapiens
caaccaatgtagaaag

SEQ ID NO: 3963393 - DNA, 14 bp, Homo sapiens
caaccacaaaccac

SEQ ID NO: 3963394 - DNA, 12 bp, Homo sapiens
caaccagagccc

SEQ ID NO: 3963395 - DNA, 13 bp, Homo sapiens
caaccagcattca

SEQ ID NO: 3963396 - DNA, 15 bp, Homo sapiens
caaccatcaatggaa

SEQ ID NO: 3963397 - DNA, 13 bp, Homo sapiens
caaccattccaga

SEQ ID NO: 3963398 - DNA, 22 bp, Homo sapiens
caaccattccagactgcttcca

SEQ ID NO: 3963399 - DNA, 13 bp, Homo sapiens
caaccccagctgg

SEQ ID NO: 3963400 - DNA, 18 bp, Homo sapiens
caaccccagctggcctct

SEQ ID NO: 3963401 - DNA, 22 bp, Homo sapiens
caaccccagctggcctctagaa

SEQ ID NO: 3963402 - DNA, 23 bp, Homo sapiens
caaccccagctggcctctagaac

SEQ ID NO: 3963403 - DNA, 13 bp, Homo sapiens
caaccccagttct

SEQ ID NO: 3963404 - DNA, 20 bp, Homo sapiens
caaccccagttctgctcctc

SEQ ID NO: 3963405 - DNA, 22 bp, Homo sapiens
caaccccagttctgctcctctc

SEQ ID NO: 3963406 - DNA, 19 bp, Homo sapiens
caaccccgcggtgctctgg

SEQ ID NO: 3963407 - DNA, 14 bp, Homo sapiens
caacccctgtaccc

SEQ ID NO: 3963408 - DNA, 16 bp, Homo sapiens
caacccgtggaggctg

SEQ ID NO: 3963409 - DNA, 13 bp, Homo sapiens
caaccctcagagc

SEQ ID NO: 3963410 - DNA, 23 bp, Homo sapiens
caaccctgcccacttcagcccag

SEQ ID NO: 3963411 - DNA, 13 bp, Homo sapiens
caaccctgtttcc

SEQ ID NO: 3963412 - DNA, 17 bp, Homo sapiens
caacccttgctgctgcc

SEQ ID NO: 3963413 - DNA, 16 bp, Homo sapiens
caaccgcttgccatat

SEQ ID NO: 3963414 - DNA, 21 bp, Homo sapiens
caaccgtggcccttcctggac

SEQ ID NO: 3963415 - DNA, 22 bp, Homo sapiens
caaccgtggcccttcctggaca

SEQ ID NO: 3963416 - DNA, 18 bp, Homo sapiens
caacctaccaccccttcc

SEQ ID NO: 3963417 - DNA, 21 bp, Homo sapiens
caacctaccaccccttcctgt

SEQ ID NO: 3963418 - DNA, 16 bp, Homo sapiens
caacctcaatgccctg

SEQ ID NO: 3963419 - DNA, 12 bp, Homo sapiens
caacctcttcct

SEQ ID NO: 3963420 - DNA, 23 bp, Homo sapiens
caacctgaccaacatggagaaac

SEQ ID NO: 3963421 - DNA, 21 bp, Homo sapiens
caacctgatgccccttcccca

SEQ ID NO: 3963422 - DNA, 23 bp, Homo sapiens
caacctgatgccccttccccaag

SEQ ID NO: 3963423 - DNA, 11 bp, Homo sapiens
caacctggaga

SEQ ID NO: 3963424 - DNA, 14 bp, Homo sapiens
caacctggtggcac

SEQ ID NO: 3963425 - DNA, 17 bp, Homo sapiens
caacctggtggcaccag

SEQ ID NO: 3963426 - DNA, 18 bp, Homo sapiens
caacctggtggcaccaga

SEQ ID NO: 3963427 - DNA, 16 bp, Homo sapiens
caaccttctgtggctc

SEQ ID NO: 3963428 - DNA, 13 bp, Homo sapiens
caacgcagccctg

SEQ ID NO: 3963429 - DNA, 18 bp, Homo sapiens
caacgcagccctgctttg

SEQ ID NO: 3963430 - DNA, 17 bp, Homo sapiens
caacgggaagcaacctc

SEQ ID NO: 3963431 - DNA, 18 bp, Homo sapiens
caacgttaaaagacagtg

SEQ ID NO: 3963432 - DNA, 16 bp, Homo sapiens
caactaagcagtccct

SEQ ID NO: 3963433 - DNA, 13 bp, Homo sapiens
caactaagccctc

SEQ ID NO: 3963434 - DNA, 13 bp, Homo sapiens
caactagccaagg

SEQ ID NO: 3963435 - DNA, 21 bp, Homo sapiens
caactccctgaacctcagttt

SEQ ID NO: 3963436 - DNA, 12 bp, Homo sapiens
caactcctcctt

SEQ ID NO: 3963437 - DNA, 12 bp, Homo sapiens
caactctctcct

SEQ ID NO: 3963438 - DNA, 15 bp, Homo sapiens
caactctctcctgta

SEQ ID NO: 3963439 - DNA, 12 bp, Homo sapiens
caactctgcact

SEQ ID NO: 3963440 - DNA, 13 bp, Homo sapiens
caactctgcactc

SEQ ID NO: 3963441 - DNA, 22 bp, Homo sapiens
caactcttcattttgagtctca

SEQ ID NO: 3963442 - DNA, 14 bp, Homo sapiens
caactgaaaagact

SEQ ID NO: 3963443 - DNA, 18 bp, Homo sapiens
caactgacaatatgattt

SEQ ID NO: 3963444 - DNA, 11 bp, Homo sapiens
caactgacaca

SEQ ID NO: 3963445 - DNA, 13 bp, Homo sapiens
caactgacacagg

SEQ ID NO: 3963446 - DNA, 15 bp, Homo sapiens
caactgaccagcctc

SEQ ID NO: 3963447 - DNA, 17 bp, Homo sapiens
caactgaccagcctcca

SEQ ID NO: 3963448 - DNA, 13 bp, Homo sapiens
caactgctctgcc

SEQ ID NO: 3963449 - DNA, 20 bp, Homo sapiens
caactgctctgcccactgtg

SEQ ID NO: 3963450 - DNA, 18 bp, Homo sapiens
caactggagcaagaagga

SEQ ID NO: 3963451 - DNA, 22 bp, Homo sapiens
caactggagcaagaaggaagga

SEQ ID NO: 3963452 - DNA, 14 bp, Homo sapiens
caactggctgggac

SEQ ID NO: 3963453 - DNA, 12 bp, Homo sapiens
caactggcttct

SEQ ID NO: 3963454 - DNA, 15 bp, Homo sapiens
caactggcttctgtg

SEQ ID NO: 3963455 - DNA, 16 bp, Homo sapiens
caactggcttctgtgc

SEQ ID NO: 3963456 - DNA, 16 bp, Homo sapiens
caacttcaagtgcatg

SEQ ID NO: 3963457 - DNA, 18 bp, Homo sapiens
caacttcaagtgcatgct

SEQ ID NO: 3963458 - DNA, 19 bp, Homo sapiens
caacttgaagcaagctttc

SEQ ID NO: 3963459 - DNA, 22 bp, Homo sapiens
caacttgtaaatacaccacctc

SEQ ID NO: 3963460 - DNA, 12 bp, Homo sapiens
caacttgtgtac

SEQ ID NO: 3963461 - DNA, 14 bp, Homo sapiens
caacttgtgttcta

SEQ ID NO: 3963462 - DNA, 16 bp, Homo sapiens
caactttctgtaaact

SEQ ID NO: 3963463 - DNA, 21 bp, Homo sapiens
caagaaaagaggaaaaaaagc

SEQ ID NO: 3963464 - DNA, 15 bp, Homo sapiens
caagaaacagaagta

SEQ ID NO: 3963465 - DNA, 18 bp, Homo sapiens
caagaaacagaagtagaa

SEQ ID NO: 3963466 - DNA, 18 bp, Homo sapiens
caagaaactgaggaattt

SEQ ID NO: 3963467 - DNA, 12 bp, Homo sapiens
caagaaagtcca

SEQ ID NO: 3963468 - DNA, 13 bp, Homo sapiens
caagaaatttgat

SEQ ID NO: 3963469 - DNA, 16 bp, Homo sapiens
caagaaatttgatttc

SEQ ID NO: 3963470 - DNA, 21 bp, Homo sapiens
caagaagaccagactgtggag

SEQ ID NO: 3963471 - DNA, 20 bp, Homo sapiens
caagaagctcccagatgctg

SEQ ID NO: 3963472 - DNA, 22 bp, Homo sapiens
caagaagctcccagatgctggg

SEQ ID NO: 3963473 - DNA, 22 bp, Homo sapiens
caagaagctttaatatttaaat

SEQ ID NO: 3963474 - DNA, 16 bp, Homo sapiens
caagaaggtgagtgct

SEQ ID NO: 3963475 - DNA, 17 bp, Homo sapiens
caagaatattcaaatgt

SEQ ID NO: 3963476 - DNA, 17 bp, Homo sapiens
caagaattctagaaaat

SEQ ID NO: 3963477 - DNA, 20 bp, Homo sapiens
caagaattgtccatgtgctt

SEQ ID NO: 3963478 - DNA, 13 bp, Homo sapiens
caagacacccaag

SEQ ID NO: 3963479 - DNA, 19 bp, Homo sapiens
caagacaccttttgtattt

SEQ ID NO: 3963480 - DNA, 13 bp, Homo sapiens
caagagaagaaaa

SEQ ID NO: 3963481 - DNA, 18 bp, Homo sapiens
caagagaagaaaaaatta

SEQ ID NO: 3963482 - DNA, 16 bp, Homo sapiens
caagagacagagcccc

SEQ ID NO: 3963483 - DNA, 18 bp, Homo sapiens
caagagacagagccccca

SEQ ID NO: 3963484 - DNA, 14 bp, Homo sapiens
caagagagaaagaa

SEQ ID NO: 3963485 - DNA, 23 bp, Homo sapiens
caagagagagctcgctcttggga

SEQ ID NO: 3963486 - DNA, 14 bp, Homo sapiens
caagagagggcaag

SEQ ID NO: 3963487 - DNA, 19 bp, Homo sapiens
caagagcatcatgcctctg

SEQ ID NO: 3963488 - DNA, 13 bp, Homo sapiens
caagagcccagca

SEQ ID NO: 3963489 - DNA, 19 bp, Homo sapiens
caagagcccagcagggcct

SEQ ID NO: 3963490 - DNA, 18 bp, Homo sapiens
caagagcgaaactccgtc

SEQ ID NO: 3963491 - DNA, 14 bp, Homo sapiens
caagaggcccaggg

SEQ ID NO: 3963492 - DNA, 17 bp, Homo sapiens
caagagggcactggtgg

SEQ ID NO: 3963493 - DNA, 14 bp, Homo sapiens
caagaggtctgagc

SEQ ID NO: 3963494 - DNA, 16 bp, Homo sapiens
caagaggtctgagccc

SEQ ID NO: 3963495 - DNA, 11 bp, Homo sapiens
caagaggtggg

SEQ ID NO: 3963496 - DNA, 16 bp, Homo sapiens
caagatatttatatat

SEQ ID NO: 3963497 - DNA, 14 bp, Homo sapiens
caagatgggcacat

SEQ ID NO: 3963498 - DNA, 15 bp, Homo sapiens
caagattcaaagaga

SEQ ID NO: 3963499 - DNA, 14 bp, Homo sapiens
caagattcccagag

SEQ ID NO: 3963500 - DNA, 23 bp, Homo sapiens
caagatttaacactaaaaaggtt

SEQ ID NO: 3963501 - DNA, 18 bp, Homo sapiens
caagatttcacatcagct

SEQ ID NO: 3963502 - DNA, 20 bp, Homo sapiens
caagattttttttgtaactt

SEQ ID NO: 3963503 - DNA, 19 bp, Homo sapiens
caagcaaaggtgaagagac

SEQ ID NO: 3963504 - DNA, 18 bp, Homo sapiens
caagcaatggacctttgg

SEQ ID NO: 3963505 - DNA, 18 bp, Homo sapiens
caagcacctagcctcgct

SEQ ID NO: 3963506 - DNA, 18 bp, Homo sapiens
caagcacctgcagattct

SEQ ID NO: 3963507 - DNA, 19 bp, Homo sapiens
caagcacctgcagattctg

SEQ ID NO: 3963508 - DNA, 19 bp, Homo sapiens
caagcactcgagaccatcc

SEQ ID NO: 3963509 - DNA, 21 bp, Homo sapiens
caagcactcgagaccatcctg

SEQ ID NO: 3963510 - DNA, 18 bp, Homo sapiens
caagcactgctaggcgag

SEQ ID NO: 3963511 - DNA, 12 bp, Homo sapiens
caagcagccagc

SEQ ID NO: 3963512 - DNA, 13 bp, Homo sapiens
caagcagccagcc

SEQ ID NO: 3963513 - DNA, 22 bp, Homo sapiens
caagcagccagccagtcttgcc

SEQ ID NO: 3963514 - DNA, 16 bp, Homo sapiens
caagcagcctcctggg

SEQ ID NO: 3963515 - DNA, 16 bp, Homo sapiens
caagcaggaagttcaa

SEQ ID NO: 3963516 - DNA, 23 bp, Homo sapiens
caagcagggaaagctccacggtg

SEQ ID NO: 3963517 - DNA, 13 bp, Homo sapiens
caagcatgcaata

SEQ ID NO: 3963518 - DNA, 21 bp, Homo sapiens
caagcatgcaataatgtgcaa

SEQ ID NO: 3963519 - DNA, 13 bp, Homo sapiens
caagcattctcct

SEQ ID NO: 3963520 - DNA, 15 bp, Homo sapiens
caagcattctcctgt

SEQ ID NO: 3963521 - DNA, 16 bp, Homo sapiens
caagcatttgccctgt

SEQ ID NO: 3963522 - DNA, 14 bp, Homo sapiens
caagccacagaagc

SEQ ID NO: 3963523 - DNA, 19 bp, Homo sapiens
caagccacagaagccagga

SEQ ID NO: 3963524 - DNA, 22 bp, Homo sapiens
caagccagcaacacagagcact

SEQ ID NO: 3963525 - DNA, 20 bp, Homo sapiens
caagccattttttgaggaga

SEQ ID NO: 3963526 - DNA, 18 bp, Homo sapiens
caagcccctcagcccttg

SEQ ID NO: 3963527 - DNA, 21 bp, Homo sapiens
caagccctccccatcccatgt

SEQ ID NO: 3963528 - DNA, 18 bp, Homo sapiens
caagccgtggcttcccgc

SEQ ID NO: 3963529 - DNA, 18 bp, Homo sapiens
caagcctcactattactt

SEQ ID NO: 3963530 - DNA, 12 bp, Homo sapiens
caagcctctgcc

SEQ ID NO: 3963531 - DNA, 18 bp, Homo sapiens
caagcctctgccccaagg

SEQ ID NO: 3963532 - DNA, 20 bp, Homo sapiens
caagcctctgccccaagggg

SEQ ID NO: 3963533 - DNA, 14 bp, Homo sapiens
caagcctgcctagg

SEQ ID NO: 3963534 - DNA, 15 bp, Homo sapiens
caagcctggtctcct

SEQ ID NO: 3963535 - DNA, 17 bp, Homo sapiens
caagcctggtctcctcc

SEQ ID NO: 3963536 - DNA, 17 bp, Homo sapiens
caagccttactcacctc

SEQ ID NO: 3963537 - DNA, 18 bp, Homo sapiens
caagccttactcacctct

SEQ ID NO: 3963538 - DNA, 17 bp, Homo sapiens
caagcgaggtcaacaga

SEQ ID NO: 3963539 - DNA, 13 bp, Homo sapiens
caagcgcagggag

SEQ ID NO: 3963540 - DNA, 16 bp, Homo sapiens
caagctagaacctgga

SEQ ID NO: 3963541 - DNA, 17 bp, Homo sapiens
caagctagaacctggag

SEQ ID NO: 3963542 - DNA, 18 bp, Homo sapiens
caagctagaacctggagg

SEQ ID NO: 3963543 - DNA, 15 bp, Homo sapiens
caagctcagaataga

SEQ ID NO: 3963544 - DNA, 22 bp, Homo sapiens
caagctcaggaggcgaataaat

SEQ ID NO: 3963545 - DNA, 17 bp, Homo sapiens
caagctccatctccact

SEQ ID NO: 3963546 - DNA, 13 bp, Homo sapiens
caagctcttcctt

SEQ ID NO: 3963547 - DNA, 21 bp, Homo sapiens
caagctgaagtgaaggagaaa

SEQ ID NO: 3963548 - DNA, 15 bp, Homo sapiens
caagctgagtgactg

SEQ ID NO: 3963549 - DNA, 13 bp, Homo sapiens
caagctggaagca

SEQ ID NO: 3963550 - DNA, 19 bp, Homo sapiens
caagctgtcccctctgtca

SEQ ID NO: 3963551 - DNA, 16 bp, Homo sapiens
caagctgttttcttct

SEQ ID NO: 3963552 - DNA, 19 bp, Homo sapiens
caagcttcaagtgatatat

SEQ ID NO: 3963553 - DNA, 21 bp, Homo sapiens
caagcttcaagtgatatatgt

SEQ ID NO: 3963554 - DNA, 15 bp, Homo sapiens
caagcttcagagcct

SEQ ID NO: 3963555 - DNA, 18 bp, Homo sapiens
caagcttcagagcctagc

SEQ ID NO: 3963556 - DNA, 24 bp, Homo sapiens
caagcttgtatatacatattataa

SEQ ID NO: 3963557 - DNA, 20 bp, Homo sapiens
caagcttgtgagagctggtt

SEQ ID NO: 3963558 - DNA, 21 bp, Homo sapiens
caagctttcttctacaaccag

SEQ ID NO: 3963559 - DNA, 22 bp, Homo sapiens
caagctttcttctacaaccaga

SEQ ID NO: 3963560 - DNA, 17 bp, Homo sapiens
caaggaaagtgaacctt

SEQ ID NO: 3963561 - DNA, 12 bp, Homo sapiens
caaggaacaaga

SEQ ID NO: 3963562 - DNA, 19 bp, Homo sapiens
caaggaagggtgggaagct

SEQ ID NO: 3963563 - DNA, 18 bp, Homo sapiens
caaggacaacctgcccct

SEQ ID NO: 3963564 - DNA, 19 bp, Homo sapiens
caaggacaatgccttggga

SEQ ID NO: 3963565 - DNA, 21 bp, Homo sapiens
caaggaccctgttttccacac

SEQ ID NO: 3963566 - DNA, 16 bp, Homo sapiens
caaggactctggcctc

SEQ ID NO: 3963567 - DNA, 15 bp, Homo sapiens
attgaactgagccaa

SEQ ID NO: 3963568 - DNA, 14 bp, Homo sapiens
attgaagaaacaga

SEQ ID NO: 3963569 - DNA, 20 bp, Homo sapiens
attgaagagatttcaacata

SEQ ID NO: 3963570 - DNA, 16 bp, Homo sapiens
attgaatgtttccaac

SEQ ID NO: 3963571 - DNA, 13 bp, Homo sapiens
attgacaacattt

SEQ ID NO: 3963572 - DNA, 15 bp, Homo sapiens
attgacaacatttta

SEQ ID NO: 3963573 - DNA, 18 bp, Homo sapiens
attgacaataatttcagg

SEQ ID NO: 3963574 - DNA, 20 bp, Homo sapiens
attgacaataatttcaggtt

SEQ ID NO: 3963575 - DNA, 15 bp, Homo sapiens
attgacctcagctgc

SEQ ID NO: 3963576 - DNA, 19 bp, Homo sapiens
attgacctcagctgcacat

SEQ ID NO: 3963577 - DNA, 21 bp, Homo sapiens
attgacctcagctgcacattc

SEQ ID NO: 3963578 - DNA, 23 bp, Homo sapiens
attgacctcagctgcacattcct

SEQ ID NO: 3963579 - DNA, 19 bp, Homo sapiens
attgagctgcagaaacgaa

SEQ ID NO: 3963580 - DNA, 12 bp, Homo sapiens
attgaggcctgc

SEQ ID NO: 3963581 - DNA, 13 bp, Homo sapiens
attgatacttcag

SEQ ID NO: 3963582 - DNA, 23 bp, Homo sapiens
attgatcactttgttaaaaatat

SEQ ID NO: 3963583 - DNA, 17 bp, Homo sapiens
attgatgtttccagaaa

SEQ ID NO: 3963584 - DNA, 18 bp, Homo sapiens
attgatgtttccagaaaa

SEQ ID NO: 3963585 - DNA, 23 bp, Homo sapiens
attgatgtttccagaaaatataa

SEQ ID NO: 3963586 - DNA, 22 bp, Homo sapiens
attgattattctgattccactt

SEQ ID NO: 3963587 - DNA, 11 bp, Homo sapiens
attgcacaatt

SEQ ID NO: 3963588 - DNA, 16 bp, Homo sapiens
attgcacaatttgagc

SEQ ID NO: 3963589 - DNA, 13 bp, Homo sapiens
attgcactatgaa

SEQ ID NO: 3963590 - DNA, 18 bp, Homo sapiens
attgcactatgaaaatca

SEQ ID NO: 3963591 - DNA, 20 bp, Homo sapiens
attgcagttcaaatcctcac

SEQ ID NO: 3963592 - DNA, 11 bp, Homo sapiens
attgccctggt

SEQ ID NO: 3963593 - DNA, 10 bp, Homo sapiens
attgcctcca

SEQ ID NO: 3963594 - DNA, 17 bp, Homo sapiens
attgcctgcagagagaa

SEQ ID NO: 3963595 - DNA, 12 bp, Homo sapiens
attgctgttgtt

SEQ ID NO: 3963596 - DNA, 21 bp, Homo sapiens
attgcttacatttttacaata

SEQ ID NO: 3963597 - DNA, 16 bp, Homo sapiens
attgcttattcttgag

SEQ ID NO: 3963598 - DNA, 22 bp, Homo sapiens
attgcttcttgtgaaaccacag

SEQ ID NO: 3963599 - DNA, 14 bp, Homo sapiens
attggaagaaattc

SEQ ID NO: 3963600 - DNA, 18 bp, Homo sapiens
attggaagaaattcctgt

SEQ ID NO: 3963601 - DNA, 18 bp, Homo sapiens
attggagagtaaaaactg

SEQ ID NO: 3963602 - DNA, 13 bp, Homo sapiens
attggagggaaga

SEQ ID NO: 3963603 - DNA, 20 bp, Homo sapiens
attggccactgggtctcact

SEQ ID NO: 3963604 - DNA, 15 bp, Homo sapiens
attggctataacatg

SEQ ID NO: 3963605 - DNA, 16 bp, Homo sapiens
attggctatatggaat

SEQ ID NO: 3963606 - DNA, 21 bp, Homo sapiens
attggctcacccaagcaaggc

SEQ ID NO: 3963607 - DNA, 13 bp, Homo sapiens
attggggccctct

SEQ ID NO: 3963608 - DNA, 16 bp, Homo sapiens
attgggttttatcagt

SEQ ID NO: 3963609 - DNA, 17 bp, Homo sapiens
attggtaggatttatat

SEQ ID NO: 3963610 - DNA, 15 bp, Homo sapiens
attggtccagcttgc

SEQ ID NO: 3963611 - DNA, 11 bp, Homo sapiens
attgtaaaaaa

SEQ ID NO: 3963612 - DNA, 12 bp, Homo sapiens
attgtaaaaaaa

SEQ ID NO: 3963613 - DNA, 14 bp, Homo sapiens
attgtaaaaacaaa

SEQ ID NO: 3963614 - DNA, 15 bp, Homo sapiens
attgtaaaatagctt

SEQ ID NO: 3963615 - DNA, 19 bp, Homo sapiens
attgtaaaatagcttgtat

SEQ ID NO: 3963616 - DNA, 15 bp, Homo sapiens
attgtaaaattgtat

SEQ ID NO: 3963617 - DNA, 16 bp, Homo sapiens
attgtacagctgttta

SEQ ID NO: 3963618 - DNA, 13 bp, Homo sapiens
attgtataaacta

SEQ ID NO: 3963619 - DNA, 21 bp, Homo sapiens
attgtataaactatcagtttg

SEQ ID NO: 3963620 - DNA, 18 bp, Homo sapiens
attgtatattctggaaaa

SEQ ID NO: 3963621 - DNA, 14 bp, Homo sapiens
attgtatcctgagg

SEQ ID NO: 3963622 - DNA, 22 bp, Homo sapiens
attgtattttagcagggtacat

SEQ ID NO: 3963623 - DNA, 19 bp, Homo sapiens
attgtcagagttctgctct

SEQ ID NO: 3963624 - DNA, 14 bp, Homo sapiens
attgtcagatattt

SEQ ID NO: 3963625 - DNA, 23 bp, Homo sapiens
attgtcagatattttttcagaaa

SEQ ID NO: 3963626 - DNA, 15 bp, Homo sapiens
attgtcattactgcc

SEQ ID NO: 3963627 - DNA, 21 bp, Homo sapiens
attgtccatatcagacctctg

SEQ ID NO: 3963628 - DNA, 16 bp, Homo sapiens
attgtccctgtttcaa

SEQ ID NO: 3963629 - DNA, 23 bp, Homo sapiens
attgtcctcccctattttaagac

SEQ ID NO: 3963630 - DNA, 13 bp, Homo sapiens
attgtccttcaga

SEQ ID NO: 3963631 - DNA, 15 bp, Homo sapiens
attgtccttcagagc

SEQ ID NO: 3963632 - DNA, 11 bp, Homo sapiens
attgtcttcca

SEQ ID NO: 3963633 - DNA, 19 bp, Homo sapiens
attgtcttccaaccccagc

SEQ ID NO: 3963634 - DNA, 20 bp, Homo sapiens
attgtcttccaaccccagct

SEQ ID NO: 3963635 - DNA, 21 bp, Homo sapiens
attgtcttccaaccccagctg

SEQ ID NO: 3963636 - DNA, 21 bp, Homo sapiens
attgtgatctatcaatagtca

SEQ ID NO: 3963637 - DNA, 14 bp, Homo sapiens
attgtgatgttttg

SEQ ID NO: 3963638 - DNA, 19 bp, Homo sapiens
attgtgatgttttgttcaa

SEQ ID NO: 3963639 - DNA, 13 bp, Homo sapiens
attgtgcttaaat

SEQ ID NO: 3963640 - DNA, 18 bp, Homo sapiens
attgtggtacaatctcaa

SEQ ID NO: 3963641 - DNA, 19 bp, Homo sapiens
attgtggtacaatctcaaa

SEQ ID NO: 3963642 - DNA, 19 bp, Homo sapiens
attgtgtattatgttgttc

SEQ ID NO: 3963643 - DNA, 14 bp, Homo sapiens
attgtgtctgcatt

SEQ ID NO: 3963644 - DNA, 15 bp, Homo sapiens
attgttaaaataact

SEQ ID NO: 3963645 - DNA, 15 bp, Homo sapiens
attgttacagaagct

SEQ ID NO: 3963646 - DNA, 16 bp, Homo sapiens
attgttaccatgaaga

SEQ ID NO: 3963647 - DNA, 21 bp, Homo sapiens
attgttccttacctttacata

SEQ ID NO: 3963648 - DNA, 14 bp, Homo sapiens
attgttgctccctg

SEQ ID NO: 3963649 - DNA, 21 bp, Homo sapiens
attgtttaaaaacaggaaaaa

SEQ ID NO: 3963650 - DNA, 19 bp, Homo sapiens
attgtttaaaatcatttct

SEQ ID NO: 3963651 - DNA, 14 bp, Homo sapiens
attgtttattcttt

SEQ ID NO: 3963652 - DNA, 15 bp, Homo sapiens
attgttttagagact

SEQ ID NO: 3963653 - DNA, 18 bp, Homo sapiens
attgttttatcatgacat

SEQ ID NO: 3963654 - DNA, 19 bp, Homo sapiens
caaaaatggtggtttgtca

SEQ ID NO: 3963655 - DNA, 16 bp, Homo sapiens
caaaacaaaacaacaa

SEQ ID NO: 3963656 - DNA, 17 bp, Homo sapiens
caaaacaaaacaacaac

SEQ ID NO: 3963657 - DNA, 11 bp, Homo sapiens
caaaacaacaa

SEQ ID NO: 3963658 - DNA, 15 bp, Homo sapiens
caaaacaacaacaat

SEQ ID NO: 3963659 - DNA, 16 bp, Homo sapiens
caaaacaacaacaata

SEQ ID NO: 3963660 - DNA, 14 bp, Homo sapiens
caaaacaagaaaga

SEQ ID NO: 3963661 - DNA, 19 bp, Homo sapiens
caaaacagagatgtgataa

SEQ ID NO: 3963662 - DNA, 16 bp, Homo sapiens
caaaacatatcaattc

SEQ ID NO: 3963663 - DNA, 21 bp, Homo sapiens
caaaacctttccccagacaca

SEQ ID NO: 3963664 - DNA, 14 bp, Homo sapiens
caaaactgcactgt

SEQ ID NO: 3963665 - DNA, 15 bp, Homo sapiens
caaaagacatgttgt

SEQ ID NO: 3963666 - DNA, 21 bp, Homo sapiens
caaaagacatgttgtaaatta

SEQ ID NO: 3963667 - DNA, 14 bp, Homo sapiens
caaaagagaaaaaa

SEQ ID NO: 3963668 - DNA, 12 bp, Homo sapiens
caaaagagagaa

SEQ ID NO: 3963669 - DNA, 16 bp, Homo sapiens
caaaagagagaatgag

SEQ ID NO: 3963670 - DNA, 23 bp, Homo sapiens
caaaagcaagactgttgctcaaa

SEQ ID NO: 3963671 - DNA, 14 bp, Homo sapiens
caaaagcctgggtg

SEQ ID NO: 3963672 - DNA, 15 bp, Homo sapiens
caaaagggcagccag

SEQ ID NO: 3963673 - DNA, 15 bp, Homo sapiens
caaaagtaccataga

SEQ ID NO: 3963674 - DNA, 19 bp, Homo sapiens
caaaagtcaaaaggtgcct

SEQ ID NO: 3963675 - DNA, 22 bp, Homo sapiens
caaaagtgatctgtcccctctc

SEQ ID NO: 3963676 - DNA, 17 bp, Homo sapiens
caaaagttagctgagcg

SEQ ID NO: 3963677 - DNA, 15 bp, Homo sapiens
caaaagttttcctga

SEQ ID NO: 3963678 - DNA, 15 bp, Homo sapiens
caaaataaaattatg

SEQ ID NO: 3963679 - DNA, 11 bp, Homo sapiens
caaaataattt

SEQ ID NO: 3963680 - DNA, 17 bp, Homo sapiens
caaaataatttaactaa

SEQ ID NO: 3963681 - DNA, 17 bp, Homo sapiens
caaaatactacacatcc

SEQ ID NO: 3963682 - DNA, 23 bp, Homo sapiens
caaaatattatgcaaactactgt

SEQ ID NO: 3963683 - DNA, 16 bp, Homo sapiens
caaaatcacaagcaat

SEQ ID NO: 3963684 - DNA, 20 bp, Homo sapiens
caaaatccttgcttatgaca

SEQ ID NO: 3963685 - DNA, 20 bp, Homo sapiens
caaaattaccaaaaatcttg

SEQ ID NO: 3963686 - DNA, 18 bp, Homo sapiens
caaaatttctttttttaa

SEQ ID NO: 3963687 - DNA, 11 bp, Homo sapiens
caaaatttgtt

SEQ ID NO: 3963688 - DNA, 14 bp, Homo sapiens
caaacaagcacaga

SEQ ID NO: 3963689 - DNA, 17 bp, Homo sapiens
caaacacaccgatgcac

SEQ ID NO: 3963690 - DNA, 14 bp, Homo sapiens
caaacacactgtaa

SEQ ID NO: 3963691 - DNA, 17 bp, Homo sapiens
caaacacactgtaaata

SEQ ID NO: 3963692 - DNA, 14 bp, Homo sapiens
caaacactgtgtat

SEQ ID NO: 3963693 - DNA, 15 bp, Homo sapiens
caaacactgtgtatt

SEQ ID NO: 3963694 - DNA, 17 bp, Homo sapiens
caaacagtctcaggaaa

SEQ ID NO: 3963695 - DNA, 21 bp, Homo sapiens
caaacatgaagtgtgtttcct

SEQ ID NO: 3963696 - DNA, 22 bp, Homo sapiens
caaacatgaagtgtgtttcctt

SEQ ID NO: 3963697 - DNA, 15 bp, Homo sapiens
caaaccactgtacat

SEQ ID NO: 3963698 - DNA, 17 bp, Homo sapiens
caaaccactgtacatat

SEQ ID NO: 3963699 - DNA, 18 bp, Homo sapiens
caaaccaggactctgccc

SEQ ID NO: 3963700 - DNA, 22 bp, Homo sapiens
caaaccatttaattcataatta

SEQ ID NO: 3963701 - DNA, 16 bp, Homo sapiens
caaaccatttcaaatg

SEQ ID NO: 3963702 - DNA, 14 bp, Homo sapiens
caaacccatcagac

SEQ ID NO: 3963703 - DNA, 22 bp, Homo sapiens
caaacctcagtcatattcttat

SEQ ID NO: 3963704 - DNA, 17 bp, Homo sapiens
caaactacagaataatg

SEQ ID NO: 3963705 - DNA, 16 bp, Homo sapiens
caaactattgggaggg

SEQ ID NO: 3963706 - DNA, 15 bp, Homo sapiens
caaactcaaggtcaa

SEQ ID NO: 3963707 - DNA, 15 bp, Homo sapiens
caaactcctgcctgt

SEQ ID NO: 3963708 - DNA, 18 bp, Homo sapiens
caaactcctgcctgtgtt

SEQ ID NO: 3963709 - DNA, 19 bp, Homo sapiens
caaactgagtaaattggaa

SEQ ID NO: 3963710 - DNA, 16 bp, Homo sapiens
caaactgatttctcac

SEQ ID NO: 3963711 - DNA, 18 bp, Homo sapiens
caaactgcacacacagct

SEQ ID NO: 3963712 - DNA, 21 bp, Homo sapiens
caaactgcacacacagctcct

SEQ ID NO: 3963713 - DNA, 15 bp, Homo sapiens
caaactgtgccctgc

SEQ ID NO: 3963714 - DNA, 15 bp, Homo sapiens
caaacttgtgctgag

SEQ ID NO: 3963715 - DNA, 14 bp, Homo sapiens
caaactttaaattc

SEQ ID NO: 3963716 - DNA, 13 bp, Homo sapiens
caaagaaacccaa

SEQ ID NO: 3963717 - DNA, 19 bp, Homo sapiens
caaagaacggcatgtgaat

SEQ ID NO: 3963718 - DNA, 21 bp, Homo sapiens
caaagaacggcatgtgaattc

SEQ ID NO: 3963719 - DNA, 22 bp, Homo sapiens
caaagaactgccccatctcctc

SEQ ID NO: 3963720 - DNA, 21 bp, Homo sapiens
caaagaattcctgaagccaga

SEQ ID NO: 3963721 - DNA, 22 bp, Homo sapiens
caaagaattcctgaagccagat

SEQ ID NO: 3963722 - DNA, 15 bp, Homo sapiens
caaagagaaaaagaa

SEQ ID NO: 3963723 - DNA, 20 bp, Homo sapiens
caaagagaaaaagaaatgca

SEQ ID NO: 3963724 - DNA, 13 bp, Homo sapiens
caaagaggtattt

SEQ ID NO: 3963725 - DNA, 11 bp, Homo sapiens
caaagcaaggg

SEQ ID NO: 3963726 - DNA, 17 bp, Homo sapiens
caaagcaagggctccag

SEQ ID NO: 3963727 - DNA, 18 bp, Homo sapiens
caaagcaagggctccagc

SEQ ID NO: 3963728 - DNA, 19 bp, Homo sapiens
caaagcaagggctccagca

SEQ ID NO: 3963729 - DNA, 22 bp, Homo sapiens
caaagcactgacttctaagtaa

SEQ ID NO: 3963730 - DNA, 23 bp, Homo sapiens
caaagccccttgctctcccctgc

SEQ ID NO: 3963731 - DNA, 21 bp, Homo sapiens
caaagcctgttcatggcagat

SEQ ID NO: 3963732 - DNA, 22 bp, Homo sapiens
caaagcctgttcatggcagatg

SEQ ID NO: 3963733 - DNA, 23 bp, Homo sapiens
caaagctctattaagatttccaa

SEQ ID NO: 3963734 - DNA, 21 bp, Homo sapiens
caaagctgagttacttgtctg

SEQ ID NO: 3963735 - DNA, 21 bp, Homo sapiens
caaagcttctatcccaggagg

SEQ ID NO: 3963736 - DNA, 20 bp, Homo sapiens
caaaggacattatgtgtgca

SEQ ID NO: 3963737 - DNA, 11 bp, Homo sapiens
caaaggagcct

SEQ ID NO: 3963738 - DNA, 15 bp, Homo sapiens
caaaggagcctgtga

SEQ ID NO: 3963739 - DNA, 23 bp, Homo sapiens
caaaggatccagagacttgggga

SEQ ID NO: 3963740 - DNA, 22 bp, Homo sapiens
caaagggctcctctccagtctg

SEQ ID NO: 3963741 - DNA, 15 bp, Homo sapiens
agtgtgggaagggag

SEQ ID NO: 3963742 - DNA, 13 bp, Homo sapiens
agtgtgtcagagt

SEQ ID NO: 3963743 - DNA, 19 bp, Homo sapiens
agtgtgtccttggggcaca

SEQ ID NO: 3963744 - DNA, 20 bp, Homo sapiens
agtgtgtccttggggcacag

SEQ ID NO: 3963745 - DNA, 21 bp, Homo sapiens
agtgtgtccttggggcacagt

SEQ ID NO: 3963746 - DNA, 13 bp, Homo sapiens
agtgtgtgtgcat

SEQ ID NO: 3963747 - DNA, 17 bp, Homo sapiens
agtgtgtgtgcatgtgt

SEQ ID NO: 3963748 - DNA, 20 bp, Homo sapiens
agtgtgtgtgcatgtgtgtg

SEQ ID NO: 3963749 - DNA, 20 bp, Homo sapiens
agtgtgtttccttcagtgca

SEQ ID NO: 3963750 - DNA, 22 bp, Homo sapiens
agtgttcattttagtgactgta

SEQ ID NO: 3963751 - DNA, 22 bp, Homo sapiens
agtgttctgtgggcttggcctt

SEQ ID NO: 3963752 - DNA, 16 bp, Homo sapiens
agtgttgaaaatgttc

SEQ ID NO: 3963753 - DNA, 17 bp, Homo sapiens
agtgttgaaaatgttca

SEQ ID NO: 3963754 - DNA, 14 bp, Homo sapiens
agtgttgctcttgg

SEQ ID NO: 3963755 - DNA, 17 bp, Homo sapiens
agtgttggctgtgtgac

SEQ ID NO: 3963756 - DNA, 19 bp, Homo sapiens
agtgttttctcagaacagc

SEQ ID NO: 3963757 - DNA, 21 bp, Homo sapiens
agttaaaagactgcagctgct

SEQ ID NO: 3963758 - DNA, 12 bp, Homo sapiens
agttaacagaga

SEQ ID NO: 3963759 - DNA, 18 bp, Homo sapiens
agttaactttaagactga

SEQ ID NO: 3963760 - DNA, 15 bp, Homo sapiens
agttaagtatttaca

SEQ ID NO: 3963761 - DNA, 19 bp, Homo sapiens
agttaagtatttacagatg

SEQ ID NO: 3963762 - DNA, 16 bp, Homo sapiens
agttacacaattaatt

SEQ ID NO: 3963763 - DNA, 22 bp, Homo sapiens
agttacagcgagaggcagagaa

SEQ ID NO: 3963764 - DNA, 23 bp, Homo sapiens
agttacagcgagaggcagagaaa

SEQ ID NO: 3963765 - DNA, 17 bp, Homo sapiens
agttacagggcccaggt

SEQ ID NO: 3963766 - DNA, 15 bp, Homo sapiens
agttacttgtctgag

SEQ ID NO: 3963767 - DNA, 20 bp, Homo sapiens
agttacttgtctgaggcctc

SEQ ID NO: 3963768 - DNA, 16 bp, Homo sapiens
agttagagaatatatt

SEQ ID NO: 3963769 - DNA, 15 bp, Homo sapiens
agttaggaaataaaa

SEQ ID NO: 3963770 - DNA, 17 bp, Homo sapiens
agttaggaaataaaacc

SEQ ID NO: 3963771 - DNA, 21 bp, Homo sapiens
agttaggaaataaaacctttc

SEQ ID NO: 3963772 - DNA, 20 bp, Homo sapiens
agttaggggagaggaaaagt

SEQ ID NO: 3963773 - DNA, 23 bp, Homo sapiens
agttagttctctcgtaactggtt

SEQ ID NO: 3963774 - DNA, 19 bp, Homo sapiens
agttatagtatatctggac

SEQ ID NO: 3963775 - DNA, 16 bp, Homo sapiens
agttatagtttgcttt

SEQ ID NO: 3963776 - DNA, 19 bp, Homo sapiens
agttatattctttaaattt

SEQ ID NO: 3963777 - DNA, 16 bp, Homo sapiens
agttatgagggtcagg

SEQ ID NO: 3963778 - DNA, 21 bp, Homo sapiens
agttatgagggtcagggcagt

SEQ ID NO: 3963779 - DNA, 19 bp, Homo sapiens
agttatggctataggtgct

SEQ ID NO: 3963780 - DNA, 12 bp, Homo sapiens
agttattgattt

SEQ ID NO: 3963781 - DNA, 16 bp, Homo sapiens
agttatttacttgaaa

SEQ ID NO: 3963782 - DNA, 19 bp, Homo sapiens
agttatttacttgaaagat

SEQ ID NO: 3963783 - DNA, 20 bp, Homo sapiens
agttatttacttgaaagatg

SEQ ID NO: 3963784 - DNA, 21 bp, Homo sapiens
agttatttacttgaaagatgg

SEQ ID NO: 3963785 - DNA, 22 bp, Homo sapiens
agttcaaatcctcaccatccac

SEQ ID NO: 3963786 - DNA, 21 bp, Homo sapiens
agttcaacctggtggcaccag

SEQ ID NO: 3963787 - DNA, 22 bp, Homo sapiens
agttcaagcctgtgggagtaga

SEQ ID NO: 3963788 - DNA, 16 bp, Homo sapiens
agttcagccaccctga

SEQ ID NO: 3963789 - DNA, 15 bp, Homo sapiens
agttcagccagaatc

SEQ ID NO: 3963790 - DNA, 15 bp, Homo sapiens
agttcagggaagcag

SEQ ID NO: 3963791 - DNA, 15 bp, Homo sapiens
agttcagttctgttt

SEQ ID NO: 3963792 - DNA, 20 bp, Homo sapiens
agttcatcccagccccaatt

SEQ ID NO: 3963793 - DNA, 15 bp, Homo sapiens
agttcatgtttgtaa

SEQ ID NO: 3963794 - DNA, 13 bp, Homo sapiens
agttccatgaaga

SEQ ID NO: 3963795 - DNA, 18 bp, Homo sapiens
agttcccggagcacagcc

SEQ ID NO: 3963796 - DNA, 17 bp, Homo sapiens
agttccctacttcctgt

SEQ ID NO: 3963797 - DNA, 17 bp, Homo sapiens
agttcctcgccctgggt

SEQ ID NO: 3963798 - DNA, 16 bp, Homo sapiens
agttcctctttgcatg

SEQ ID NO: 3963799 - DNA, 16 bp, Homo sapiens
agttcctgcactccag

SEQ ID NO: 3963800 - DNA, 13 bp, Homo sapiens
agttcgcagccac

SEQ ID NO: 3963801 - DNA, 17 bp, Homo sapiens
agttcgcagccaccctg

SEQ ID NO: 3963802 - DNA, 19 bp, Homo sapiens
agttctacaagcatatttg

SEQ ID NO: 3963803 - DNA, 23 bp, Homo sapiens
agttctacaagcatatttgagaa

SEQ ID NO: 3963804 - DNA, 16 bp, Homo sapiens
agttctagagaagagg

SEQ ID NO: 3963805 - DNA, 17 bp, Homo sapiens
agttctagagaagaggc

SEQ ID NO: 3963806 - DNA, 15 bp, Homo sapiens
agttctgacattcat

SEQ ID NO: 3963807 - DNA, 14 bp, Homo sapiens
agttctgctcctct

SEQ ID NO: 3963808 - DNA, 20 bp, Homo sapiens
agttctgctcctctccaggc

SEQ ID NO: 3963809 - DNA, 19 bp, Homo sapiens
agttctggaaaccacgtgg

SEQ ID NO: 3963810 - DNA, 22 bp, Homo sapiens
agttcttgtctgattggctcac

SEQ ID NO: 3963811 - DNA, 17 bp, Homo sapiens
agttcttgtgcatgttt

SEQ ID NO: 3963812 - DNA, 16 bp, Homo sapiens
agttgaaaaatctagt

SEQ ID NO: 3963813 - DNA, 19 bp, Homo sapiens
agttgaaaagactccaaag

SEQ ID NO: 3963814 - DNA, 21 bp, Homo sapiens
agttgaaaagactccaaagaa

SEQ ID NO: 3963815 - DNA, 15 bp, Homo sapiens
agttgaacactgtca

SEQ ID NO: 3963816 - DNA, 19 bp, Homo sapiens
agttgaatgacaacagaag

SEQ ID NO: 3963817 - DNA, 22 bp, Homo sapiens
agttgacaaaaagctcttacac

SEQ ID NO: 3963818 - DNA, 17 bp, Homo sapiens
agttgacgcatcctgca

SEQ ID NO: 3963819 - DNA, 18 bp, Homo sapiens
agttgacgcatcctgcag

SEQ ID NO: 3963820 - DNA, 14 bp, Homo sapiens
agttgctcactcag

SEQ ID NO: 3963821 - DNA, 22 bp, Homo sapiens
agttgctttaaagtacctgtag

SEQ ID NO: 3963822 - DNA, 15 bp, Homo sapiens
agttggacacactgt

SEQ ID NO: 3963823 - DNA, 14 bp, Homo sapiens
agttggcagagaag

SEQ ID NO: 3963824 - DNA, 19 bp, Homo sapiens
agttggcagagaaggcctc

SEQ ID NO: 3963825 - DNA, 20 bp, Homo sapiens
agttggccatgatgtctttt

SEQ ID NO: 3963826 - DNA, 16 bp, Homo sapiens
agttgtacgtaatgta

SEQ ID NO: 3963827 - DNA, 17 bp, Homo sapiens
agttgtacgtaatgtat

SEQ ID NO: 3963828 - DNA, 19 bp, Homo sapiens
agttgtgccttttatagct

SEQ ID NO: 3963829 - DNA, 22 bp, Homo sapiens
agttgtgccttttatagctatt

SEQ ID NO: 3963830 - DNA, 23 bp, Homo sapiens
agttgtgccttttatagctatta

SEQ ID NO: 3963831 - DNA, 19 bp, Homo sapiens
agttgttcacatatatgta

SEQ ID NO: 3963832 - DNA, 19 bp, Homo sapiens
agttgttttggtgcctgcc

SEQ ID NO: 3963833 - DNA, 21 bp, Homo sapiens
agttgttttggtgcctgcctc

SEQ ID NO: 3963834 - DNA, 22 bp, Homo sapiens
agttgttttggtgcctgcctct

SEQ ID NO: 3963835 - DNA, 15 bp, Homo sapiens
agtttaaaaaataca

SEQ ID NO: 3963836 - DNA, 12 bp, Homo sapiens
agtttaacacaa

SEQ ID NO: 3963837 - DNA, 20 bp, Homo sapiens
agtttaattaactatgtgat

SEQ ID NO: 3963838 - DNA, 20 bp, Homo sapiens
agtttacagtaaataaattg

SEQ ID NO: 3963839 - DNA, 21 bp, Homo sapiens
agtttagaagcgctcatctgg

SEQ ID NO: 3963840 - DNA, 14 bp, Homo sapiens
agtttagaggaaaa

SEQ ID NO: 3963841 - DNA, 22 bp, Homo sapiens
agtttatttccaaataaaatga

SEQ ID NO: 3963842 - DNA, 14 bp, Homo sapiens
agtttattttgtta

SEQ ID NO: 3963843 - DNA, 13 bp, Homo sapiens
agtttcaccattt

SEQ ID NO: 3963844 - DNA, 15 bp, Homo sapiens
agtttcagatatata

SEQ ID NO: 3963845 - DNA, 20 bp, Homo sapiens
agtttcccaaattccctgga

SEQ ID NO: 3963846 - DNA, 13 bp, Homo sapiens
agtttcccttcta

SEQ ID NO: 3963847 - DNA, 18 bp, Homo sapiens
agtttcctcatctgcaga

SEQ ID NO: 3963848 - DNA, 15 bp, Homo sapiens
agtttctcagctccc

SEQ ID NO: 3963849 - DNA, 16 bp, Homo sapiens
agtttctcagctccca

SEQ ID NO: 3963850 - DNA, 16 bp, Homo sapiens
agtttctggagcaaga

SEQ ID NO: 3963851 - DNA, 16 bp, Homo sapiens
agtttctggccctggc

SEQ ID NO: 3963852 - DNA, 21 bp, Homo sapiens
agtttgaaggaggtgagggat

SEQ ID NO: 3963853 - DNA, 17 bp, Homo sapiens
agtttgagacaagccct

SEQ ID NO: 3963854 - DNA, 20 bp, Homo sapiens
agtttgagacaagccctggc

SEQ ID NO: 3963855 - DNA, 21 bp, Homo sapiens
agtttgagacaagccctggca

SEQ ID NO: 3963856 - DNA, 22 bp, Homo sapiens
agtttgcagaaaagcacctgcc

SEQ ID NO: 3963857 - DNA, 15 bp, Homo sapiens
agtttgctgggttta

SEQ ID NO: 3963858 - DNA, 16 bp, Homo sapiens
agtttggcaatagttt

SEQ ID NO: 3963859 - DNA, 20 bp, Homo sapiens
agtttgggggttttgctgtt

SEQ ID NO: 3963860 - DNA, 17 bp, Homo sapiens
agtttgttgctgtcaag

SEQ ID NO: 3963861 - DNA, 12 bp, Homo sapiens
agtttgttttac

SEQ ID NO: 3963862 - DNA, 13 bp, Homo sapiens
agtttgttttaca

SEQ ID NO: 3963863 - DNA, 18 bp, Homo sapiens
agttttaacagaaccaga

SEQ ID NO: 3963864 - DNA, 19 bp, Homo sapiens
agttttatggcatgattta

SEQ ID NO: 3963865 - DNA, 16 bp, Homo sapiens
agttttattgagaatt

SEQ ID NO: 3963866 - DNA, 12 bp, Homo sapiens
agttttctgaga

SEQ ID NO: 3963867 - DNA, 23 bp, Homo sapiens
agttttctgagaaagactattca

SEQ ID NO: 3963868 - DNA, 13 bp, Homo sapiens
agttttctttgta

SEQ ID NO: 3963869 - DNA, 17 bp, Homo sapiens
agttttctttgtaaagg

SEQ ID NO: 3963870 - DNA, 15 bp, Homo sapiens
agttttgaaagaaaa

SEQ ID NO: 3963871 - DNA, 18 bp, Homo sapiens
agttttgatatgagtata

SEQ ID NO: 3963872 - DNA, 23 bp, Homo sapiens
ataaaaagactattaagagcaat

SEQ ID NO: 3963873 - DNA, 16 bp, Homo sapiens
ataaaaatactatgaa

SEQ ID NO: 3963874 - DNA, 11 bp, Homo sapiens
ataaaaccatg

SEQ ID NO: 3963875 - DNA, 20 bp, Homo sapiens
ataaaacccagcatgtacaa

SEQ ID NO: 3963876 - DNA, 11 bp, Homo sapiens
ataaaaccttt

SEQ ID NO: 3963877 - DNA, 20 bp, Homo sapiens
ataaaacctttcaaatttca

SEQ ID NO: 3963878 - DNA, 22 bp, Homo sapiens
ataaaacctttcaaatttcaca

SEQ ID NO: 3963879 - DNA, 15 bp, Homo sapiens
ataaaactaaatata

SEQ ID NO: 3963880 - DNA, 18 bp, Homo sapiens
ataaaactaaatatatgt

SEQ ID NO: 3963881 - DNA, 17 bp, Homo sapiens
ataaaactcagttaaaa

SEQ ID NO: 3963882 - DNA, 19 bp, Homo sapiens
ataaaacttatgctagttt

SEQ ID NO: 3963883 - DNA, 17 bp, Homo sapiens
ataaaatactctagcct

SEQ ID NO: 3963884 - DNA, 12 bp, Homo sapiens
ataaaatagtat

SEQ ID NO: 3963885 - DNA, 19 bp, Homo sapiens
ataaaatagttgtccatat

SEQ ID NO: 3963886 - DNA, 18 bp, Homo sapiens
ataaaatgaggacatgtt

SEQ ID NO: 3963887 - DNA, 12 bp, Homo sapiens
ataaaatgatgt

SEQ ID NO: 3963888 - DNA, 15 bp, Homo sapiens
ataaaatgatgtatg

SEQ ID NO: 3963889 - DNA, 13 bp, Homo sapiens
ataaaattgtgat

SEQ ID NO: 3963890 - DNA, 17 bp, Homo sapiens
ataaacacccatgaatc

SEQ ID NO: 3963891 - DNA, 20 bp, Homo sapiens
ataaacattaaaagaagact

SEQ ID NO: 3963892 - DNA, 18 bp, Homo sapiens
ataaacattaaacactgt

SEQ ID NO: 3963893 - DNA, 15 bp, Homo sapiens
ataaacattaaatgt

SEQ ID NO: 3963894 - DNA, 16 bp, Homo sapiens
ataaacattaaatgtc

SEQ ID NO: 3963895 - DNA, 16 bp, Homo sapiens
ataaaccaaaggacat

SEQ ID NO: 3963896 - DNA, 21 bp, Homo sapiens
ataaaccaaaggacattatgt

SEQ ID NO: 3963897 - DNA, 16 bp, Homo sapiens
ataaactagtttccag

SEQ ID NO: 3963898 - DNA, 15 bp, Homo sapiens
ataaactctaaacat

SEQ ID NO: 3963899 - DNA, 15 bp, Homo sapiens
ataaacttagaataa

SEQ ID NO: 3963900 - DNA, 12 bp, Homo sapiens
ataaagacacct

SEQ ID NO: 3963901 - DNA, 17 bp, Homo sapiens
ataaagacagctgacag

SEQ ID NO: 3963902 - DNA, 18 bp, Homo sapiens
ataaagacagctgacaga

SEQ ID NO: 3963903 - DNA, 20 bp, Homo sapiens
ataaagacagctgacagata

SEQ ID NO: 3963904 - DNA, 11 bp, Homo sapiens
ataaagagctc

SEQ ID NO: 3963905 - DNA, 13 bp, Homo sapiens
ataaagataaaat

SEQ ID NO: 3963906 - DNA, 20 bp, Homo sapiens
ataaagatgatctactcaga

SEQ ID NO: 3963907 - DNA, 18 bp, Homo sapiens
ataaagatggctgacttt

SEQ ID NO: 3963908 - DNA, 19 bp, Homo sapiens
ataaagatgtcaaatatct

SEQ ID NO: 3963909 - DNA, 21 bp, Homo sapiens
ataaagatgtcaaatatctca

SEQ ID NO: 3963910 - DNA, 18 bp, Homo sapiens
ataaagcaaatagacaca

SEQ ID NO: 3963911 - DNA, 14 bp, Homo sapiens
ataaagcctatttt

SEQ ID NO: 3963912 - DNA, 19 bp, Homo sapiens
ataaaggccccaaatacca

SEQ ID NO: 3963913 - DNA, 21 bp, Homo sapiens
ataaaggttgacaataaatgt

SEQ ID NO: 3963914 - DNA, 17 bp, Homo sapiens
ataaagtatcatgcatt

SEQ ID NO: 3963915 - DNA, 21 bp, Homo sapiens
ataaagtcacttccagtgttg

SEQ ID NO: 3963916 - DNA, 12 bp, Homo sapiens
ataaataaatgc

SEQ ID NO: 3963917 - DNA, 21 bp, Homo sapiens
ataaataatcggcccacagct

SEQ ID NO: 3963918 - DNA, 23 bp, Homo sapiens
ataaatatataaaaagaaaagat

SEQ ID NO: 3963919 - DNA, 14 bp, Homo sapiens
ataaatatatattt

SEQ ID NO: 3963920 - DNA, 16 bp, Homo sapiens
ataaatatttatgctt

SEQ ID NO: 3963921 - DNA, 20 bp, Homo sapiens
ataaatctgagcctaaatct

SEQ ID NO: 3963922 - DNA, 22 bp, Homo sapiens
ataaatctgagcctaaatctaa

SEQ ID NO: 3963923 - DNA, 14 bp, Homo sapiens
ataaatgcatgatt

SEQ ID NO: 3963924 - DNA, 21 bp, Homo sapiens
ataaatgcatgattttataca

SEQ ID NO: 3963925 - DNA, 13 bp, Homo sapiens
ataaatggctggt

SEQ ID NO: 3963926 - DNA, 13 bp, Homo sapiens
ataaatgtatata

SEQ ID NO: 3963927 - DNA, 14 bp, Homo sapiens
ataaatgtatatac

SEQ ID NO: 3963928 - DNA, 15 bp, Homo sapiens
ataaatgtatataca

SEQ ID NO: 3963929 - DNA, 18 bp, Homo sapiens
ataaatgtatatacacat

SEQ ID NO: 3963930 - DNA, 19 bp, Homo sapiens
ataaatgtgccttcatttt

SEQ ID NO: 3963931 - DNA, 21 bp, Homo sapiens
ataaatgtgtggtgctaactg

SEQ ID NO: 3963932 - DNA, 10 bp, Homo sapiens
ataaatgttc

SEQ ID NO: 3963933 - DNA, 17 bp, Homo sapiens
ataaatgttcaaactgt

SEQ ID NO: 3963934 - DNA, 17 bp, Homo sapiens
ataaatgtttttattaa

SEQ ID NO: 3963935 - DNA, 14 bp, Homo sapiens
ataaattaagactt

SEQ ID NO: 3963936 - DNA, 15 bp, Homo sapiens
ataaattaagacttt

SEQ ID NO: 3963937 - DNA, 15 bp, Homo sapiens
ataaattcaaaccat

SEQ ID NO: 3963938 - DNA, 16 bp, Homo sapiens
ataaattcaaaccatt

SEQ ID NO: 3963939 - DNA, 17 bp, Homo sapiens
ataaattcaaaccattt

SEQ ID NO: 3963940 - DNA, 13 bp, Homo sapiens
ataaattgaaata

SEQ ID NO: 3963941 - DNA, 19 bp, Homo sapiens
ataaattggtgataagtgg

SEQ ID NO: 3963942 - DNA, 20 bp, Homo sapiens
ataaattggtgataagtgga

SEQ ID NO: 3963943 - DNA, 16 bp, Homo sapiens
ataaattttgtttcag

SEQ ID NO: 3963944 - DNA, 11 bp, Homo sapiens
ataacaaaatc

SEQ ID NO: 3963945 - DNA, 15 bp, Homo sapiens
ataacaaaatcacaa

SEQ ID NO: 3963946 - DNA, 21 bp, Homo sapiens
ataacaaaatcacaagcaata

SEQ ID NO: 3963947 - DNA, 15 bp, Homo sapiens
ataacaactccctga

SEQ ID NO: 3963948 - DNA, 19 bp, Homo sapiens
ataacagattttttttgga

SEQ ID NO: 3963949 - DNA, 11 bp, Homo sapiens
ataacatcttt

SEQ ID NO: 3963950 - DNA, 19 bp, Homo sapiens
ataacatctttgaaaagaa

SEQ ID NO: 3963951 - DNA, 21 bp, Homo sapiens
ataacatctttgaaaagaaaa

SEQ ID NO: 3963952 - DNA, 14 bp, Homo sapiens
ataaccagctgtaa

SEQ ID NO: 3963953 - DNA, 20 bp, Homo sapiens
ataaccatgtgaaaaggcaa

SEQ ID NO: 3963954 - DNA, 13 bp, Homo sapiens
ataaccccacctt

SEQ ID NO: 3963955 - DNA, 21 bp, Homo sapiens
ataaccccaccttgccaagct

SEQ ID NO: 3963956 - DNA, 19 bp, Homo sapiens
ataactaatgctaagaaat

SEQ ID NO: 3963957 - DNA, 15 bp, Homo sapiens
ataactagaaacctg

SEQ ID NO: 3963958 - DNA, 14 bp, Homo sapiens
ataactgaaggaga

SEQ ID NO: 3963959 - DNA, 19 bp, Homo sapiens
ataacttaaaaaaatgaca

SEQ ID NO: 3963960 - DNA, 16 bp, Homo sapiens
ataacttcttaaaagt

SEQ ID NO: 3963961 - DNA, 18 bp, Homo sapiens
ataacttgctgaatttca

SEQ ID NO: 3963962 - DNA, 22 bp, Homo sapiens
ataactttagaaataagaagca

SEQ ID NO: 3963963 - DNA, 20 bp, Homo sapiens
ataagaaacatgatgtgaga

SEQ ID NO: 3963964 - DNA, 20 bp, Homo sapiens
ataagaccgtgtcccaagga

SEQ ID NO: 3963965 - DNA, 14 bp, Homo sapiens
ataagattaaagga

SEQ ID NO: 3963966 - DNA, 19 bp, Homo sapiens
ataagattaaaggaaggaa

SEQ ID NO: 3963967 - DNA, 13 bp, Homo sapiens
ataagattagaat

SEQ ID NO: 3963968 - DNA, 19 bp, Homo sapiens
ataagcaaatttcaaaaga

SEQ ID NO: 3963969 - DNA, 17 bp, Homo sapiens
ataagcccagctctgct

SEQ ID NO: 3963970 - DNA, 13 bp, Homo sapiens
ataagctaagcct

SEQ ID NO: 3963971 - DNA, 13 bp, Homo sapiens
ataaggagaatgt

SEQ ID NO: 3963972 - DNA, 15 bp, Homo sapiens
ataaggataataatc

SEQ ID NO: 3963973 - DNA, 14 bp, Homo sapiens
ataaggatcagaac

SEQ ID NO: 3963974 - DNA, 22 bp, Homo sapiens
ataaggatcagaacagcagagg

SEQ ID NO: 3963975 - DNA, 15 bp, Homo sapiens
ataaggcctgccctc

SEQ ID NO: 3963976 - DNA, 19 bp, Homo sapiens
ataagtgcacacagaaata

SEQ ID NO: 3963977 - DNA, 23 bp, Homo sapiens
ataagtgcacacagaaatatata

SEQ ID NO: 3963978 - DNA, 12 bp, Homo sapiens
ataagtgctgtt

SEQ ID NO: 3963979 - DNA, 15 bp, Homo sapiens
ataagtggaaaaaag

SEQ ID NO: 3963980 - DNA, 17 bp, Homo sapiens
ataagtggaaaaaagag

SEQ ID NO: 3963981 - DNA, 19 bp, Homo sapiens
ataccagatcactcaaaaa

SEQ ID NO: 3963982 - DNA, 12 bp, Homo sapiens
ataccagtgtgg

SEQ ID NO: 3963983 - DNA, 19 bp, Homo sapiens
ataccatatgtctgcttct

SEQ ID NO: 3963984 - DNA, 17 bp, Homo sapiens
ataccccaagtccacct

SEQ ID NO: 3963985 - DNA, 13 bp, Homo sapiens
atacccccagaga

SEQ ID NO: 3963986 - DNA, 16 bp, Homo sapiens
atacccccagagacct

SEQ ID NO: 3963987 - DNA, 13 bp, Homo sapiens
atacccctgcctg

SEQ ID NO: 3963988 - DNA, 14 bp, Homo sapiens
atacctataatgtg

SEQ ID NO: 3963989 - DNA, 17 bp, Homo sapiens
atacctttggaaaaatc

SEQ ID NO: 3963990 - DNA, 21 bp, Homo sapiens
atacgtgttaggaggctgcat

SEQ ID NO: 3963991 - DNA, 12 bp, Homo sapiens
atactaaaatat

SEQ ID NO: 3963992 - DNA, 16 bp, Homo sapiens
atactaaaatatgtct

SEQ ID NO: 3963993 - DNA, 17 bp, Homo sapiens
atactatacaacaatgt

SEQ ID NO: 3963994 - DNA, 13 bp, Homo sapiens
atactcacctcct

SEQ ID NO: 3963995 - DNA, 15 bp, Homo sapiens
atactcacctcctcc

SEQ ID NO: 3963996 - DNA, 22 bp, Homo sapiens
atactcacctcctcccagactt

SEQ ID NO: 3963997 - DNA, 16 bp, Homo sapiens
atactccatacataac

SEQ ID NO: 3963998 - DNA, 20 bp, Homo sapiens
atactctagaacatgcacat

SEQ ID NO: 3963999 - DNA, 21 bp, Homo sapiens
atactgcctagaaaatgcaaa

SEQ ID NO: 3964000 - DNA, 13 bp, Homo sapiens
atactgctctgaa

SEQ ID NO: 3964001 - DNA, 22 bp, Homo sapiens
atactgctctgaatattttgta

SEQ ID NO: 3964002 - DNA, 12 bp, Homo sapiens
atactgtacata

SEQ ID NO: 3964003 - DNA, 15 bp, Homo sapiens
atactgtacatagat

SEQ ID NO: 3964004 - DNA, 22 bp, Homo sapiens
atactgtacatagatgtatcat

SEQ ID NO: 3964005 - DNA, 14 bp, Homo sapiens
atacttcactcact

SEQ ID NO: 3964006 - DNA, 18 bp, Homo sapiens
atacttcaggtgcttttg

SEQ ID NO: 3964007 - DNA, 17 bp, Homo sapiens
atacttgagctgtatat

SEQ ID NO: 3964008 - DNA, 17 bp, Homo sapiens
atagaaaactgaaaatc

SEQ ID NO: 3964009 - DNA, 20 bp, Homo sapiens
atagaaaagatgagaggcag

SEQ ID NO: 3964010 - DNA, 19 bp, Homo sapiens
atagaaagtgccagaaagt

SEQ ID NO: 3964011 - DNA, 16 bp, Homo sapiens
atagaagctgtagtag

SEQ ID NO: 3964012 - DNA, 18 bp, Homo sapiens
atagacagtgctgccctg

SEQ ID NO: 3964013 - DNA, 20 bp, Homo sapiens
atagagatatttttgtacgt

SEQ ID NO: 3964014 - DNA, 14 bp, Homo sapiens
atagagggccaaga

SEQ ID NO: 3964015 - DNA, 16 bp, Homo sapiens
atagagtatactaaaa

SEQ ID NO: 3964016 - DNA, 13 bp, Homo sapiens
atagagttcatcc

SEQ ID NO: 3964017 - DNA, 16 bp, Homo sapiens
atagatgcaagatatt

SEQ ID NO: 3964018 - DNA, 13 bp, Homo sapiens
atagatggaccag

SEQ ID NO: 3964019 - DNA, 22 bp, Homo sapiens
atagatgggtctggctgagctg

SEQ ID NO: 3964020 - DNA, 18 bp, Homo sapiens
atagattaatggcactga

SEQ ID NO: 3964021 - DNA, 14 bp, Homo sapiens
atagatttgattat

SEQ ID NO: 3964022 - DNA, 17 bp, Homo sapiens
atagatttgtattttaa

SEQ ID NO: 3964023 - DNA, 17 bp, Homo sapiens
atagcaagattgcttaa

SEQ ID NO: 3964024 - DNA, 16 bp, Homo sapiens
atagcattctctatca

SEQ ID NO: 3964025 - DNA, 18 bp, Homo sapiens
atagcatttttgatttat

SEQ ID NO: 3964026 - DNA, 21 bp, Homo sapiens
atagcatttttgatttatgca

SEQ ID NO: 3964027 - DNA, 14 bp, Homo sapiens
atagcccaggtcct

SEQ ID NO: 3964028 - DNA, 14 bp, Homo sapiens
atagcgctggctca

SEQ ID NO: 3964029 - DNA, 17 bp, Homo sapiens
atagcgctggctcagga

SEQ ID NO: 3964030 - DNA, 18 bp, Homo sapiens
atagcgctggctcaggaa

SEQ ID NO: 3964031 - DNA, 14 bp, Homo sapiens
atagctacccaaaa

SEQ ID NO: 3964032 - DNA, 19 bp, Homo sapiens
atagctacccaaaagagaa

SEQ ID NO: 3964033 - DNA, 22 bp, Homo sapiens
atagctattactgtctggtttt

SEQ ID NO: 3964034 - DNA, 17 bp, Homo sapiens
atagctattgcatgtaa

SEQ ID NO: 3964035 - DNA, 22 bp, Homo sapiens
atagctattgcatgtaaaatgc

SEQ ID NO: 3964036 - DNA, 19 bp, Homo sapiens
atagctcttctatttaaaa

SEQ ID NO: 3964037 - DNA, 15 bp, Homo sapiens
atagctctttcaggg

SEQ ID NO: 3964038 - DNA, 19 bp, Homo sapiens
atagctgacatctcctcta

SEQ ID NO: 3964039 - DNA, 24 bp, Homo sapiens
atagctgggaacccgactgtgaaa

SEQ ID NO: 3964040 - DNA, 14 bp, Homo sapiens
atagcttgtatagt

SEQ ID NO: 3964041 - DNA, 12 bp, Homo sapiens
ataggaaaagaa

SEQ ID NO: 3964042 - DNA, 22 bp, Homo sapiens
ataggatataaaacacatcaag

SEQ ID NO: 3964043 - DNA, 23 bp, Homo sapiens
ataggatcatttgttggaatgaa

SEQ ID NO: 3964044 - DNA, 19 bp, Homo sapiens
ataggatgtcagacaatac

SEQ ID NO: 3964045 - DNA, 13 bp, Homo sapiens
ataggctggagaa

SEQ ID NO: 3964046 - DNA, 22 bp, Homo sapiens
atagtaactactttttatactc

SEQ ID NO: 3964047 - DNA, 15 bp, Homo sapiens
atagtatatctggac

SEQ ID NO: 3964048 - DNA, 15 bp, Homo sapiens
atagtatatttatac

SEQ ID NO: 3964049 - DNA, 18 bp, Homo sapiens
atagtatatttatactct

SEQ ID NO: 3964050 - DNA, 21 bp, Homo sapiens
atagtcaagaaaaattattgt

SEQ ID NO: 3964051 - DNA, 18 bp, Homo sapiens
atagtcatttattttaaa

SEQ ID NO: 3964052 - DNA, 14 bp, Homo sapiens
atagtccaatattt

SEQ ID NO: 3964053 - DNA, 20 bp, Homo sapiens
atagtgctatatatataaat

SEQ ID NO: 3964054 - DNA, 22 bp, Homo sapiens
atagtgctatatatataaatat

SEQ ID NO: 3964055 - DNA, 19 bp, Homo sapiens
atagttaaaagactgcagc

SEQ ID NO: 3964056 - DNA, 14 bp, Homo sapiens
atagttagccctca

SEQ ID NO: 3964057 - DNA, 22 bp, Homo sapiens
atagttattgttttatgttcta

SEQ ID NO: 3964058 - DNA, 19 bp, Homo sapiens
atagttatttacttgaaag

SEQ ID NO: 3964059 - DNA, 19 bp, Homo sapiens
atagttgtccatattttca

SEQ ID NO: 3964060 - DNA, 13 bp, Homo sapiens
atagtttattgac

SEQ ID NO: 3964061 - DNA, 14 bp, Homo sapiens
atagtttcagatat

SEQ ID NO: 3964062 - DNA, 17 bp, Homo sapiens
atagttttataaaactc

SEQ ID NO: 3964063 - DNA, 18 bp, Homo sapiens
atataaaaagaaaagata

SEQ ID NO: 3964064 - DNA, 23 bp, Homo sapiens
atataaaaagaaaagataaagat

SEQ ID NO: 3964065 - DNA, 23 bp, Homo sapiens
atataaacttgtgtatgatccaa

SEQ ID NO: 3964066 - DNA, 21 bp, Homo sapiens
atataaatatatatttttcaa

SEQ ID NO: 3964067 - DNA, 11 bp, Homo sapiens
atataaatgca

SEQ ID NO: 3964068 - DNA, 19 bp, Homo sapiens
agggtttgaggattcctga

SEQ ID NO: 3964069 - DNA, 13 bp, Homo sapiens
agggttttgtatt

SEQ ID NO: 3964070 - DNA, 13 bp, Homo sapiens
aggtaatgaggga

SEQ ID NO: 3964071 - DNA, 14 bp, Homo sapiens
aggtaatgagggac

SEQ ID NO: 3964072 - DNA, 22 bp, Homo sapiens
aggtaattctccctaaggaatc

SEQ ID NO: 3964073 - DNA, 12 bp, Homo sapiens
aggtacactctt

SEQ ID NO: 3964074 - DNA, 22 bp, Homo sapiens
aggtaccagcaatatgtaaata

SEQ ID NO: 3964075 - DNA, 20 bp, Homo sapiens
aggtactgatcctgtttctt

SEQ ID NO: 3964076 - DNA, 21 bp, Homo sapiens
aggtactgatcctgtttcttg

SEQ ID NO: 3964077 - DNA, 15 bp, Homo sapiens
aggtagagatgtgtg

SEQ ID NO: 3964078 - DNA, 18 bp, Homo sapiens
aggtagagatgtgtgtgt

SEQ ID NO: 3964079 - DNA, 21 bp, Homo sapiens
aggtagatcgcttgagcccag

SEQ ID NO: 3964080 - DNA, 22 bp, Homo sapiens
aggtagatcgcttgagcccagg

SEQ ID NO: 3964081 - DNA, 15 bp, Homo sapiens
aggtagcgagctgct

SEQ ID NO: 3964082 - DNA, 19 bp, Homo sapiens
aggtagcgagctgctctgc

SEQ ID NO: 3964083 - DNA, 12 bp, Homo sapiens
aggtaggccctt

SEQ ID NO: 3964084 - DNA, 22 bp, Homo sapiens
aggtaggcccttgtcctgccag

SEQ ID NO: 3964085 - DNA, 11 bp, Homo sapiens
aggtataattt

SEQ ID NO: 3964086 - DNA, 15 bp, Homo sapiens
aggtataattttatg

SEQ ID NO: 3964087 - DNA, 22 bp, Homo sapiens
aggtatagctgacatctcctct

SEQ ID NO: 3964088 - DNA, 16 bp, Homo sapiens
aggtatcaggcacagg

SEQ ID NO: 3964089 - DNA, 20 bp, Homo sapiens
aggtatcaggcacaggcagg

SEQ ID NO: 3964090 - DNA, 14 bp, Homo sapiens
aggtatctccagga

SEQ ID NO: 3964091 - DNA, 17 bp, Homo sapiens
aggtcaacagagaaggc

SEQ ID NO: 3964092 - DNA, 21 bp, Homo sapiens
aggtcaatgccagagacggaa

SEQ ID NO: 3964093 - DNA, 19 bp, Homo sapiens
aggtcactagatggcgagc

SEQ ID NO: 3964094 - DNA, 19 bp, Homo sapiens
aggtcagcgtgcttagcct

SEQ ID NO: 3964095 - DNA, 15 bp, Homo sapiens
aggtcctcagagaat

SEQ ID NO: 3964096 - DNA, 21 bp, Homo sapiens
aggtcctgaaagtctgtgtcc

SEQ ID NO: 3964097 - DNA, 22 bp, Homo sapiens
aggtcctgaaagtctgtgtcca

SEQ ID NO: 3964098 - DNA, 12 bp, Homo sapiens
aggtcctgagca

SEQ ID NO: 3964099 - DNA, 21 bp, Homo sapiens
aggtcctgagcactgccagga

SEQ ID NO: 3964100 - DNA, 13 bp, Homo sapiens
aggtcctgcccat

SEQ ID NO: 3964101 - DNA, 17 bp, Homo sapiens
aggtcctgcccatgtgt

SEQ ID NO: 3964102 - DNA, 15 bp, Homo sapiens
aggtcctggcttcta

SEQ ID NO: 3964103 - DNA, 20 bp, Homo sapiens
aggtctagactttctcagtg

SEQ ID NO: 3964104 - DNA, 22 bp, Homo sapiens
aggtctccactgaggatgtgag

SEQ ID NO: 3964105 - DNA, 17 bp, Homo sapiens
aggtctcccacgtggga

SEQ ID NO: 3964106 - DNA, 12 bp, Homo sapiens
aggtctgagccc

SEQ ID NO: 3964107 - DNA, 17 bp, Homo sapiens
aggtcttcttgtgtcct

SEQ ID NO: 3964108 - DNA, 18 bp, Homo sapiens
aggtcttcttgtgtcctg

SEQ ID NO: 3964109 - DNA, 21 bp, Homo sapiens
aggtcttcttgtgtcctgatg

SEQ ID NO: 3964110 - DNA, 18 bp, Homo sapiens
aggtctttggttcagcta

SEQ ID NO: 3964111 - DNA, 19 bp, Homo sapiens
aggtgaacaccactttgtc

SEQ ID NO: 3964112 - DNA, 20 bp, Homo sapiens
aggtgacccaatgctcctgg

SEQ ID NO: 3964113 - DNA, 19 bp, Homo sapiens
aggtgaccccagggcacag

SEQ ID NO: 3964114 - DNA, 14 bp, Homo sapiens
aggtgactggagcc

SEQ ID NO: 3964115 - DNA, 18 bp, Homo sapiens
aggtgagaaaaggggcat

SEQ ID NO: 3964116 - DNA, 13 bp, Homo sapiens
aggtgagggatgt

SEQ ID NO: 3964117 - DNA, 21 bp, Homo sapiens
aggtgcatctggggaactaga

SEQ ID NO: 3964118 - DNA, 19 bp, Homo sapiens
aggtgccaccaataaaaat

SEQ ID NO: 3964119 - DNA, 22 bp, Homo sapiens
aggtgccaccaataaaaatcct

SEQ ID NO: 3964120 - DNA, 18 bp, Homo sapiens
aggtgccactccctgagc

SEQ ID NO: 3964121 - DNA, 13 bp, Homo sapiens
aggtgccaggctg

SEQ ID NO: 3964122 - DNA, 13 bp, Homo sapiens
aggtgcccaggag

SEQ ID NO: 3964123 - DNA, 14 bp, Homo sapiens
aggtgcccaggaga

SEQ ID NO: 3964124 - DNA, 18 bp, Homo sapiens
aggtgcctcacgcctgta

SEQ ID NO: 3964125 - DNA, 16 bp, Homo sapiens
aggtgcctgagctggg

SEQ ID NO: 3964126 - DNA, 22 bp, Homo sapiens
aggtgcctgtgaggcaggggcg

SEQ ID NO: 3964127 - DNA, 13 bp, Homo sapiens
aggtgccttctta

SEQ ID NO: 3964128 - DNA, 21 bp, Homo sapiens
aggtgctacaaaaacacagca

SEQ ID NO: 3964129 - DNA, 18 bp, Homo sapiens
aggtgctgagcttagcct

SEQ ID NO: 3964130 - DNA, 15 bp, Homo sapiens
aggtgcttgccccca

SEQ ID NO: 3964131 - DNA, 14 bp, Homo sapiens
aggtgcttttgatg

SEQ ID NO: 3964132 - DNA, 18 bp, Homo sapiens
aggtggaaaaacatctga

SEQ ID NO: 3964133 - DNA, 14 bp, Homo sapiens
aggtggaagccctc

SEQ ID NO: 3964134 - DNA, 17 bp, Homo sapiens
aggtggaagccctcctt

SEQ ID NO: 3964135 - DNA, 20 bp, Homo sapiens
aggtggaggttgcagtgagc

SEQ ID NO: 3964136 - DNA, 14 bp, Homo sapiens
aggtggagtctcat

SEQ ID NO: 3964137 - DNA, 18 bp, Homo sapiens
aggtggattcctgggcaa

SEQ ID NO: 3964138 - DNA, 17 bp, Homo sapiens
aggtggcaggaccagga

SEQ ID NO: 3964139 - DNA, 15 bp, Homo sapiens
aggtggcatctctaa

SEQ ID NO: 3964140 - DNA, 21 bp, Homo sapiens
aggtggccactttaagagaga

SEQ ID NO: 3964141 - DNA, 14 bp, Homo sapiens
aggtggctctccag

SEQ ID NO: 3964142 - DNA, 21 bp, Homo sapiens
aggtggctgacccagtccctg

SEQ ID NO: 3964143 - DNA, 23 bp, Homo sapiens
aggtgggaaatggtatgagctga

SEQ ID NO: 3964144 - DNA, 16 bp, Homo sapiens
aggtgggagacaagga

SEQ ID NO: 3964145 - DNA, 11 bp, Homo sapiens
aggtgggagag

SEQ ID NO: 3964146 - DNA, 12 bp, Homo sapiens
aggtgggagaga

SEQ ID NO: 3964147 - DNA, 13 bp, Homo sapiens
aggtgggcagctg

SEQ ID NO: 3964148 - DNA, 16 bp, Homo sapiens
aggtgggcagctgggc

SEQ ID NO: 3964149 - DNA, 18 bp, Homo sapiens
aggtgggcagctgggccc

SEQ ID NO: 3964150 - DNA, 21 bp, Homo sapiens
aggtggggtacatttctctga

SEQ ID NO: 3964151 - DNA, 22 bp, Homo sapiens
aggtggggtatttaccacagca

SEQ ID NO: 3964152 - DNA, 23 bp, Homo sapiens
aggtggggtatttaccacagcag

SEQ ID NO: 3964153 - DNA, 23 bp, Homo sapiens
aggtgggtccaggaaggcagctg

SEQ ID NO: 3964154 - DNA, 21 bp, Homo sapiens
aggtgggttttcttcccatca

SEQ ID NO: 3964155 - DNA, 15 bp, Homo sapiens
aggtggtgcttacat

SEQ ID NO: 3964156 - DNA, 13 bp, Homo sapiens
aggtggtggagga

SEQ ID NO: 3964157 - DNA, 19 bp, Homo sapiens
aggtggtgttgagaaagaa

SEQ ID NO: 3964158 - DNA, 14 bp, Homo sapiens
aggtgtaaagttgt

SEQ ID NO: 3964159 - DNA, 13 bp, Homo sapiens
aggtgtcccaagc

SEQ ID NO: 3964160 - DNA, 21 bp, Homo sapiens
aggtgtggtgtaatttataaa

SEQ ID NO: 3964161 - DNA, 22 bp, Homo sapiens
aggtgtttccatttctcaatca

SEQ ID NO: 3964162 - DNA, 23 bp, Homo sapiens
aggttaaaatataaattaagact

SEQ ID NO: 3964163 - DNA, 21 bp, Homo sapiens
aggttaccctgtaacatgcaa

SEQ ID NO: 3964164 - DNA, 18 bp, Homo sapiens
aggttagaacctagaagg

SEQ ID NO: 3964165 - DNA, 13 bp, Homo sapiens
aggttatctgcct

SEQ ID NO: 3964166 - DNA, 14 bp, Homo sapiens
aggttatctgcctg

SEQ ID NO: 3964167 - DNA, 17 bp, Homo sapiens
aggttatctgcctggcc

SEQ ID NO: 3964168 - DNA, 19 bp, Homo sapiens
aggttatctgcctggcctg

SEQ ID NO: 3964169 - DNA, 23 bp, Homo sapiens
aggttatctgcctggcctggctc

SEQ ID NO: 3964170 - DNA, 19 bp, Homo sapiens
aggttcttcatccctttcc

SEQ ID NO: 3964171 - DNA, 16 bp, Homo sapiens
aggttcttgatgtcat

SEQ ID NO: 3964172 - DNA, 18 bp, Homo sapiens
aggttcttgatgtcatgt

SEQ ID NO: 3964173 - DNA, 20 bp, Homo sapiens
aggttgccccttccccatct

SEQ ID NO: 3964174 - DNA, 21 bp, Homo sapiens
aggttgccccttccccatctc

SEQ ID NO: 3964175 - DNA, 22 bp, Homo sapiens
aggttgccccttccccatctcc

SEQ ID NO: 3964176 - DNA, 24 bp, Homo sapiens
aggttgtggatgctccagggcagc

SEQ ID NO: 3964177 - DNA, 14 bp, Homo sapiens
aggttgttctgtat

SEQ ID NO: 3964178 - DNA, 19 bp, Homo sapiens
aggtttgccagtgaagact

SEQ ID NO: 3964179 - DNA, 14 bp, Homo sapiens
aggtttgccctgcc

SEQ ID NO: 3964180 - DNA, 18 bp, Homo sapiens
aggtttgccctgcctgca

SEQ ID NO: 3964181 - DNA, 22 bp, Homo sapiens
aggtttggggagggggaagaga

SEQ ID NO: 3964182 - DNA, 23 bp, Homo sapiens
aggtttggggagggggaagagaa

SEQ ID NO: 3964183 - DNA, 12 bp, Homo sapiens
aggtttgtatat

SEQ ID NO: 3964184 - DNA, 13 bp, Homo sapiens
aggtttgtatatt

SEQ ID NO: 3964185 - DNA, 20 bp, Homo sapiens
aggtttgtatattgtcagat

SEQ ID NO: 3964186 - DNA, 13 bp, Homo sapiens
aggttttctccac

SEQ ID NO: 3964187 - DNA, 13 bp, Homo sapiens
aggttttgtaaag

SEQ ID NO: 3964188 - DNA, 17 bp, Homo sapiens
aggttttgttgttttat

SEQ ID NO: 3964189 - DNA, 19 bp, Homo sapiens
aggtttttgtttgtttcct

SEQ ID NO: 3964190 - DNA, 15 bp, Homo sapiens
agtaaaaccacagca

SEQ ID NO: 3964191 - DNA, 19 bp, Homo sapiens
agtaaaaccacagcagttg

SEQ ID NO: 3964192 - DNA, 12 bp, Homo sapiens
agtaaaagctaa

SEQ ID NO: 3964193 - DNA, 14 bp, Homo sapiens
agtaaaagctaatt

SEQ ID NO: 3964194 - DNA, 20 bp, Homo sapiens
agtaaaagctaattaggatt

SEQ ID NO: 3964195 - DNA, 22 bp, Homo sapiens
agtaaaggcctcatctccttta

SEQ ID NO: 3964196 - DNA, 18 bp, Homo sapiens
agtaaagtcaaggagaaa

SEQ ID NO: 3964197 - DNA, 18 bp, Homo sapiens
agtaaagtgataatttct

SEQ ID NO: 3964198 - DNA, 19 bp, Homo sapiens
agtaaagtgataatttctg

SEQ ID NO: 3964199 - DNA, 17 bp, Homo sapiens
agtaaagtttaaaaaat

SEQ ID NO: 3964200 - DNA, 14 bp, Homo sapiens
agtaaataaattgt

SEQ ID NO: 3964201 - DNA, 18 bp, Homo sapiens
agtaaataaattgtttga

SEQ ID NO: 3964202 - DNA, 19 bp, Homo sapiens
agtaaataaattgtttgac

SEQ ID NO: 3964203 - DNA, 14 bp, Homo sapiens
agtaaataatgaaa

SEQ ID NO: 3964204 - DNA, 15 bp, Homo sapiens
agtaaattggaaaca

SEQ ID NO: 3964205 - DNA, 13 bp, Homo sapiens
agtaactactttt

SEQ ID NO: 3964206 - DNA, 17 bp, Homo sapiens
agtaagcctccctcctc

SEQ ID NO: 3964207 - DNA, 18 bp, Homo sapiens
agtaagcctccctcctcg

SEQ ID NO: 3964208 - DNA, 19 bp, Homo sapiens
agtaagcctccctcctcgt

SEQ ID NO: 3964209 - DNA, 18 bp, Homo sapiens
agtaataaaacccagcat

SEQ ID NO: 3964210 - DNA, 18 bp, Homo sapiens
agtaatagtccaatattt

SEQ ID NO: 3964211 - DNA, 11 bp, Homo sapiens
agtaatataat

SEQ ID NO: 3964212 - DNA, 16 bp, Homo sapiens
agtaatcaggcagcct

SEQ ID NO: 3964213 - DNA, 17 bp, Homo sapiens
agtaatcaggcagcctt

SEQ ID NO: 3964214 - DNA, 19 bp, Homo sapiens
agtaatgggccaattaaaa

SEQ ID NO: 3964215 - DNA, 20 bp, Homo sapiens
agtaatgggccaattaaaat

SEQ ID NO: 3964216 - DNA, 19 bp, Homo sapiens
agtaattgcatttctgctc

SEQ ID NO: 3964217 - DNA, 15 bp, Homo sapiens
agtaatttgaggaca

SEQ ID NO: 3964218 - DNA, 14 bp, Homo sapiens
agtacaatgtttca

SEQ ID NO: 3964219 - DNA, 15 bp, Homo sapiens
agtacaattcttact

SEQ ID NO: 3964220 - DNA, 21 bp, Homo sapiens
agtacagagaaattctgtggt

SEQ ID NO: 3964221 - DNA, 13 bp, Homo sapiens
agtacatttaata

SEQ ID NO: 3964222 - DNA, 21 bp, Homo sapiens
agtaccaaatccacaagccat

SEQ ID NO: 3964223 - DNA, 15 bp, Homo sapiens
agtaccatagaacag

SEQ ID NO: 3964224 - DNA, 17 bp, Homo sapiens
agtacctgtagtgagaa

SEQ ID NO: 3964225 - DNA, 18 bp, Homo sapiens
agtacctgtagtgagaaa

SEQ ID NO: 3964226 - DNA, 19 bp, Homo sapiens
agtactctctgctctagcc

SEQ ID NO: 3964227 - DNA, 20 bp, Homo sapiens
agtactctctgctctagcca

SEQ ID NO: 3964228 - DNA, 23 bp, Homo sapiens
agtactctctgctctagccagga

SEQ ID NO: 3964229 - DNA, 23 bp, Homo sapiens
agtactggggagaaataattgtt

SEQ ID NO: 3964230 - DNA, 14 bp, Homo sapiens
agtacttctaagag

SEQ ID NO: 3964231 - DNA, 15 bp, Homo sapiens
agtagaattatatct

SEQ ID NO: 3964232 - DNA, 21 bp, Homo sapiens
agtagaattatatctaattta

SEQ ID NO: 3964233 - DNA, 22 bp, Homo sapiens
agtagaattatatctaatttat

SEQ ID NO: 3964234 - DNA, 14 bp, Homo sapiens
agtagcatgagaga

SEQ ID NO: 3964235 - DNA, 23 bp, Homo sapiens
agtagcatgagagaattgtatca

SEQ ID NO: 3964236 - DNA, 18 bp, Homo sapiens
agtagcatggactctggg

SEQ ID NO: 3964237 - DNA, 15 bp, Homo sapiens
agtagccaagttata

SEQ ID NO: 3964238 - DNA, 19 bp, Homo sapiens
agtagccctttctgtgtgc

SEQ ID NO: 3964239 - DNA, 16 bp, Homo sapiens
agtagccgagagcctg

SEQ ID NO: 3964240 - DNA, 18 bp, Homo sapiens
agtagccgagagcctgct

SEQ ID NO: 3964241 - DNA, 18 bp, Homo sapiens
agtagctgagaggaagat

SEQ ID NO: 3964242 - DNA, 13 bp, Homo sapiens
agtagctgagctc

SEQ ID NO: 3964243 - DNA, 23 bp, Homo sapiens
agtagctgagctcacaaggcagc

SEQ ID NO: 3964244 - DNA, 18 bp, Homo sapiens
agtagcttaaataaattc

SEQ ID NO: 3964245 - DNA, 20 bp, Homo sapiens
agtagcttaaataaattcaa

SEQ ID NO: 3964246 - DNA, 19 bp, Homo sapiens
agtagtaattgatttgacc

SEQ ID NO: 3964247 - DNA, 15 bp, Homo sapiens
agtagtcaattagta

SEQ ID NO: 3964248 - DNA, 19 bp, Homo sapiens
agtagtcaattagtacagt

SEQ ID NO: 3964249 - DNA, 20 bp, Homo sapiens
agtagtcagaagcaggttct

SEQ ID NO: 3964250 - DNA, 13 bp, Homo sapiens
agtagtgcattta

SEQ ID NO: 3964251 - DNA, 12 bp, Homo sapiens
agtagtttgtat

SEQ ID NO: 3964252 - DNA, 15 bp, Homo sapiens
agtagttttgaaact

SEQ ID NO: 3964253 - DNA, 15 bp, Homo sapiens
agtataaaactgctt

SEQ ID NO: 3964254 - DNA, 19 bp, Homo sapiens
agtataaagtcacttccag

SEQ ID NO: 3964255 - DNA, 16 bp, Homo sapiens
agtatacaatatataa

SEQ ID NO: 3964256 - DNA, 23 bp, Homo sapiens
agtatacaatatataaaaatata

SEQ ID NO: 3964257 - DNA, 17 bp, Homo sapiens
agtatatagtatattta

SEQ ID NO: 3964258 - DNA, 16 bp, Homo sapiens
agtatatctggacaag

SEQ ID NO: 3964259 - DNA, 13 bp, Homo sapiens
agtatatttatac

SEQ ID NO: 3964260 - DNA, 15 bp, Homo sapiens
agtatatttatactc

SEQ ID NO: 3964261 - DNA, 11 bp, Homo sapiens
agtatcatgca

SEQ ID NO: 3964262 - DNA, 12 bp, Homo sapiens
agtatcatgcat

SEQ ID NO: 3964263 - DNA, 15 bp, Homo sapiens
agtatcttttaaaat

SEQ ID NO: 3964264 - DNA, 16 bp, Homo sapiens
agtatgaataaagaca

SEQ ID NO: 3964265 - DNA, 15 bp, Homo sapiens
agtatggaagggagg

SEQ ID NO: 3964266 - DNA, 18 bp, Homo sapiens
agtatggaagggaggggt

SEQ ID NO: 3964267 - DNA, 16 bp, Homo sapiens
agtatgtaaagtatgt

SEQ ID NO: 3964268 - DNA, 16 bp, Homo sapiens
agtattctcagtgctc

SEQ ID NO: 3964269 - DNA, 17 bp, Homo sapiens
agtattgcgaatgtgca

SEQ ID NO: 3964270 - DNA, 16 bp, Homo sapiens
agtattttatctgtgt

SEQ ID NO: 3964271 - DNA, 20 bp, Homo sapiens
agtattttattaaagcaaca

SEQ ID NO: 3964272 - DNA, 21 bp, Homo sapiens
agtatttttttaagttagaga

SEQ ID NO: 3964273 - DNA, 14 bp, Homo sapiens
agtcaaaagcctgg

SEQ ID NO: 3964274 - DNA, 15 bp, Homo sapiens
agtcaaaaggtgcct

SEQ ID NO: 3964275 - DNA, 17 bp, Homo sapiens
agtcaaaaggtgcctgt

SEQ ID NO: 3964276 - DNA, 21 bp, Homo sapiens
agtcaaaaggtgcctgtgagg

SEQ ID NO: 3964277 - DNA, 21 bp, Homo sapiens
agtcaaagtaaaacttgctgc

SEQ ID NO: 3964278 - DNA, 21 bp, Homo sapiens
agtcaacactcttcttgagca

SEQ ID NO: 3964279 - DNA, 22 bp, Homo sapiens
agtcacaccatcttaaatgaca

SEQ ID NO: 3964280 - DNA, 16 bp, Homo sapiens
agtcacagctgcagct

SEQ ID NO: 3964281 - DNA, 19 bp, Homo sapiens
agtcacagctgcagctggg

SEQ ID NO: 3964282 - DNA, 20 bp, Homo sapiens
agtcacagctgcagctgggc

SEQ ID NO: 3964283 - DNA, 19 bp, Homo sapiens
agtcaccactccattccca

SEQ ID NO: 3964284 - DNA, 13 bp, Homo sapiens
agtcacctcctcc

SEQ ID NO: 3964285 - DNA, 17 bp, Homo sapiens
agtcacctcctccactc

SEQ ID NO: 3964286 - DNA, 15 bp, Homo sapiens
agtcacctgcaagcc

SEQ ID NO: 3964287 - DNA, 16 bp, Homo sapiens
agtcacctgcaagccc

SEQ ID NO: 3964288 - DNA, 15 bp, Homo sapiens
agtcagaggagaaga

SEQ ID NO: 3964289 - DNA, 16 bp, Homo sapiens
agtcagaggagaagag

SEQ ID NO: 3964290 - DNA, 17 bp, Homo sapiens
agtcagttcccggagca

SEQ ID NO: 3964291 - DNA, 20 bp, Homo sapiens
agtcagttcccggagcacag

SEQ ID NO: 3964292 - DNA, 22 bp, Homo sapiens
agtcagttcccggagcacagcc

SEQ ID NO: 3964293 - DNA, 22 bp, Homo sapiens
agtcatagaaatacctcattcg

SEQ ID NO: 3964294 - DNA, 15 bp, Homo sapiens
agtcatattcttatg

SEQ ID NO: 3964295 - DNA, 15 bp, Homo sapiens
agtcatgatctccct

SEQ ID NO: 3964296 - DNA, 18 bp, Homo sapiens
agtcatgatctccctgcc

SEQ ID NO: 3964297 - DNA, 13 bp, Homo sapiens
agtcatttaataa

SEQ ID NO: 3964298 - DNA, 15 bp, Homo sapiens
agtcatttattttaa

SEQ ID NO: 3964299 - DNA, 20 bp, Homo sapiens
agtcatttattttaaaaaat

SEQ ID NO: 3964300 - DNA, 11 bp, Homo sapiens
agtccaagcat

SEQ ID NO: 3964301 - DNA, 13 bp, Homo sapiens
agtccagagccgg

SEQ ID NO: 3964302 - DNA, 15 bp, Homo sapiens
agtccagatgccttc

SEQ ID NO: 3964303 - DNA, 16 bp, Homo sapiens
agtccagatgccttcc

SEQ ID NO: 3964304 - DNA, 22 bp, Homo sapiens
agtccagatgccttcctgtctt

SEQ ID NO: 3964305 - DNA, 20 bp, Homo sapiens
agtccagggcgggagtgggg

SEQ ID NO: 3964306 - DNA, 14 bp, Homo sapiens
agtccaggtcctgg

SEQ ID NO: 3964307 - DNA, 18 bp, Homo sapiens
agtccaggtcctggtggg

SEQ ID NO: 3964308 - DNA, 17 bp, Homo sapiens
agtccagtgacctgctg

SEQ ID NO: 3964309 - DNA, 19 bp, Homo sapiens
agtcccagaaccacactgt

SEQ ID NO: 3964310 - DNA, 14 bp, Homo sapiens
agtccccagccctt

SEQ ID NO: 3964311 - DNA, 18 bp, Homo sapiens
agtccccagcccttctgc

SEQ ID NO: 3964312 - DNA, 16 bp, Homo sapiens
agtccccaggtcatgc

SEQ ID NO: 3964313 - DNA, 16 bp, Homo sapiens
agtccccctgccccag

SEQ ID NO: 3964314 - DNA, 16 bp, Homo sapiens
agtccccgtcccccag

SEQ ID NO: 3964315 - DNA, 15 bp, Homo sapiens
agtccccgtgccccg

SEQ ID NO: 3964316 - DNA, 20 bp, Homo sapiens
agtccccgtgccccgcctcc

SEQ ID NO: 3964317 - DNA, 14 bp, Homo sapiens
agtcccctgggcct

SEQ ID NO: 3964318 - DNA, 20 bp, Homo sapiens
agtccctgggggaagccctg

SEQ ID NO: 3964319 - DNA, 20 bp, Homo sapiens
agtccgcaagttcagggaag

SEQ ID NO: 3964320 - DNA, 16 bp, Homo sapiens
agtcctagagctcctg

SEQ ID NO: 3964321 - DNA, 17 bp, Homo sapiens
agtcctatcgactttat

SEQ ID NO: 3964322 - DNA, 18 bp, Homo sapiens
agtcctatcgactttata

SEQ ID NO: 3964323 - DNA, 15 bp, Homo sapiens
agtcctctcttctct

SEQ ID NO: 3964324 - DNA, 11 bp, Homo sapiens
agtcctggcca

SEQ ID NO: 3964325 - DNA, 22 bp, Homo sapiens
agtcctggccattttcttgcct

SEQ ID NO: 3964326 - DNA, 16 bp, Homo sapiens
agtcctgtctctgcct

SEQ ID NO: 3964327 - DNA, 17 bp, Homo sapiens
agtcgcaggatccgctg

SEQ ID NO: 3964328 - DNA, 19 bp, Homo sapiens
agtcgtccttactcctgtg

SEQ ID NO: 3964329 - DNA, 22 bp, Homo sapiens
agtcgtccttactcctgtggga

SEQ ID NO: 3964330 - DNA, 14 bp, Homo sapiens
agtctaaagtttac

SEQ ID NO: 3964331 - DNA, 18 bp, Homo sapiens
agtctaaagtttacagta

SEQ ID NO: 3964332 - DNA, 23 bp, Homo sapiens
agtctaaagtttacagtaaataa

SEQ ID NO: 3964333 - DNA, 14 bp, Homo sapiens
agtctacgctctcc

SEQ ID NO: 3964334 - DNA, 17 bp, Homo sapiens
agtctacgctctccttt

SEQ ID NO: 3964335 - DNA, 20 bp, Homo sapiens
agtctacgctctcctttctt

SEQ ID NO: 3964336 - DNA, 22 bp, Homo sapiens
agtctaggagctgggaggaaaa

SEQ ID NO: 3964337 - DNA, 18 bp, Homo sapiens
agtctatatgaaaaacaa

SEQ ID NO: 3964338 - DNA, 20 bp, Homo sapiens
agtctcaagcactaaaaagt

SEQ ID NO: 3964339 - DNA, 16 bp, Homo sapiens
agtctcaggaaatcaa

SEQ ID NO: 3964340 - DNA, 23 bp, Homo sapiens
agtctcaggccctgaaggttcct

SEQ ID NO: 3964341 - DNA, 22 bp, Homo sapiens
agtctccagtggttgctgttga

SEQ ID NO: 3964342 - DNA, 13 bp, Homo sapiens
agtctcccattct

SEQ ID NO: 3964343 - DNA, 15 bp, Homo sapiens
agtctcccattctca

SEQ ID NO: 3964344 - DNA, 13 bp, Homo sapiens
agtctcctgacat

SEQ ID NO: 3964345 - DNA, 14 bp, Homo sapiens
agtctcctgacatt

SEQ ID NO: 3964346 - DNA, 21 bp, Homo sapiens
agtctcctttgcactgagggc

SEQ ID NO: 3964347 - DNA, 22 bp, Homo sapiens
agtctcctttgcactgagggcc

SEQ ID NO: 3964348 - DNA, 23 bp, Homo sapiens
agtctctcaatgggtaaccatta

SEQ ID NO: 3964349 - DNA, 15 bp, Homo sapiens
agtctcttctccact

SEQ ID NO: 3964350 - DNA, 21 bp, Homo sapiens
agtctcttctccactggatgg

SEQ ID NO: 3964351 - DNA, 19 bp, Homo sapiens
agtctcttttttattctgt

SEQ ID NO: 3964352 - DNA, 20 bp, Homo sapiens
agtctgaggccccaggccct

SEQ ID NO: 3964353 - DNA, 22 bp, Homo sapiens
agtctgaggccccaggccctag

SEQ ID NO: 3964354 - DNA, 19 bp, Homo sapiens
agtctgaggtcctgagcac

SEQ ID NO: 3964355 - DNA, 19 bp, Homo sapiens
agtctgagtcctgtctctg

SEQ ID NO: 3964356 - DNA, 23 bp, Homo sapiens
agtctgagtcctgtctctgcctg

SEQ ID NO: 3964357 - DNA, 17 bp, Homo sapiens
agtctgctatattttca

SEQ ID NO: 3964358 - DNA, 15 bp, Homo sapiens
agtctggatctggga

SEQ ID NO: 3964359 - DNA, 17 bp, Homo sapiens
agtctggatctgggacc

SEQ ID NO: 3964360 - DNA, 16 bp, Homo sapiens
agtctgtgtgcacaat

SEQ ID NO: 3964361 - DNA, 17 bp, Homo sapiens
agtctgtgtgcacaatg

SEQ ID NO: 3964362 - DNA, 13 bp, Homo sapiens
agtcttaaaataa

SEQ ID NO: 3964363 - DNA, 22 bp, Homo sapiens
agtcttccagagcctaagaaaa

SEQ ID NO: 3964364 - DNA, 20 bp, Homo sapiens
agtcttgctttgctgtctgg

SEQ ID NO: 3964365 - DNA, 15 bp, Homo sapiens
agtcttggcctgcct

SEQ ID NO: 3964366 - DNA, 21 bp, Homo sapiens
agtcttgtcagaattggcctc

SEQ ID NO: 3964367 - DNA, 23 bp, Homo sapiens
agtctttccgtctccctaaaata

SEQ ID NO: 3964368 - DNA, 22 bp, Homo sapiens
agtgaaaaatatgttgagtgtt

SEQ ID NO: 3964369 - DNA, 21 bp, Homo sapiens
agtgaaggagaaaggagccgg

SEQ ID NO: 3964370 - DNA, 17 bp, Homo sapiens
agtgaataaacttcagc

SEQ ID NO: 3964371 - DNA, 22 bp, Homo sapiens
agtgacaaattgtaactacact

SEQ ID NO: 3964372 - DNA, 15 bp, Homo sapiens
agtgacaagtggagg

SEQ ID NO: 3964373 - DNA, 22 bp, Homo sapiens
agtgacatctctttgatgtcat

SEQ ID NO: 3964374 - DNA, 19 bp, Homo sapiens
agtgaccataaaggcatgg

SEQ ID NO: 3964375 - DNA, 13 bp, Homo sapiens
agtgacccttccc

SEQ ID NO: 3964376 - DNA, 12 bp, Homo sapiens
agtgacctgacc

SEQ ID NO: 3964377 - DNA, 13 bp, Homo sapiens
agtgacctgaccg

SEQ ID NO: 3964378 - DNA, 18 bp, Homo sapiens
agtgactccaagaacaat

SEQ ID NO: 3964379 - DNA, 14 bp, Homo sapiens
agtgactcgagggt

SEQ ID NO: 3964380 - DNA, 22 bp, Homo sapiens
agtgactcggtgtaaaaccatg

SEQ ID NO: 3964381 - DNA, 13 bp, Homo sapiens
agtgactggcagg

SEQ ID NO: 3964382 - DNA, 15 bp, Homo sapiens
agtgactggcaggtg

SEQ ID NO: 3964383 - DNA, 17 bp, Homo sapiens
agtgactggcaggtgca

SEQ ID NO: 3964384 - DNA, 22 bp, Homo sapiens
agtgactgtcgtgtttacaaaa

SEQ ID NO: 3964385 - DNA, 18 bp, Homo sapiens
agtgagaaaaagctcctg

SEQ ID NO: 3964386 - DNA, 19 bp, Homo sapiens
agtgagaatctggctcctg

SEQ ID NO: 3964387 - DNA, 20 bp, Homo sapiens
agtgagaatctggctcctgt

SEQ ID NO: 3964388 - DNA, 22 bp, Homo sapiens
agtgagatcttacaggtatcag

SEQ ID NO: 3964389 - DNA, 18 bp, Homo sapiens
agtgaggagggtggagga

SEQ ID NO: 3964390 - DNA, 15 bp, Homo sapiens
agtgaggcttccagg

SEQ ID NO: 3964391 - DNA, 19 bp, Homo sapiens
agtgaggcttccaggctct

SEQ ID NO: 3964392 - DNA, 15 bp, Homo sapiens
agtgagtctgtcagc

SEQ ID NO: 3964393 - DNA, 22 bp, Homo sapiens
agtgagttacagcgagaggcag

SEQ ID NO: 3964394 - DNA, 20 bp, Homo sapiens
agtgagttgttgccctgggt

SEQ ID NO: 3964395 - DNA, 17 bp, Homo sapiens
agtgatacaacttcaag

SEQ ID NO: 3964396 - DNA, 14 bp, Homo sapiens
agtgatatatgtat

SEQ ID NO: 3964397 - DNA, 17 bp, Homo sapiens
agtgatatatgtattta

SEQ ID NO: 3964398 - DNA, 15 bp, Homo sapiens
agtgatatcacctct

SEQ ID NO: 3964399 - DNA, 20 bp, Homo sapiens
agtgatctgtcccctctccc

SEQ ID NO: 3964400 - DNA, 14 bp, Homo sapiens
agtgatgtgctgga

SEQ ID NO: 3964401 - DNA, 19 bp, Homo sapiens
agtgatgttgtttgggaga

SEQ ID NO: 3964402 - DNA, 23 bp, Homo sapiens
agtgatgtttttatgatatccct

SEQ ID NO: 3964403 - DNA, 17 bp, Homo sapiens
agtgcaaagtgccctca

SEQ ID NO: 3964404 - DNA, 18 bp, Homo sapiens
agtgcaaatttgatacat

SEQ ID NO: 3964405 - DNA, 15 bp, Homo sapiens
agtgcaatttcccct

SEQ ID NO: 3964406 - DNA, 16 bp, Homo sapiens
agtgcaatttcccctc

SEQ ID NO: 3964407 - DNA, 17 bp, Homo sapiens
agtgcattttcccagat

SEQ ID NO: 3964408 - DNA, 11 bp, Homo sapiens
agtgccacaga

SEQ ID NO: 3964409 - DNA, 14 bp, Homo sapiens
agtgccacagagaa

SEQ ID NO: 3964410 - DNA, 17 bp, Homo sapiens
agtgccacttgacattc

SEQ ID NO: 3964411 - DNA, 20 bp, Homo sapiens
agtgccacttgacattcctt

SEQ ID NO: 3964412 - DNA, 21 bp, Homo sapiens
agtgccacttgacattccttg

SEQ ID NO: 3964413 - DNA, 13 bp, Homo sapiens
agtgccaggactc

SEQ ID NO: 3964414 - DNA, 23 bp, Homo sapiens
agtgccaggactccccaggccag

SEQ ID NO: 3964415 - DNA, 16 bp, Homo sapiens
agtgccatcccacatt

SEQ ID NO: 3964416 - DNA, 16 bp, Homo sapiens
agtgcccaccaacatc

SEQ ID NO: 3964417 - DNA, 19 bp, Homo sapiens
agtgcctcttgttgcagag

SEQ ID NO: 3964418 - DNA, 17 bp, Homo sapiens
agtgcctggcaaggcct

SEQ ID NO: 3964419 - DNA, 18 bp, Homo sapiens
agtgccttacctcctgcc

SEQ ID NO: 3964420 - DNA, 20 bp, Homo sapiens
agtgcgctcttggtccctgg

SEQ ID NO: 3964421 - DNA, 15 bp, Homo sapiens
agtgctattctgtgt

SEQ ID NO: 3964422 - DNA, 13 bp, Homo sapiens
agtgctccccaca

SEQ ID NO: 3964423 - DNA, 11 bp, Homo sapiens
agtgctgccat

SEQ ID NO: 3964424 - DNA, 14 bp, Homo sapiens
agtgctgccatgcc

SEQ ID NO: 3964425 - DNA, 24 bp, Homo sapiens
agtgctgccatgccactgccaggc

SEQ ID NO: 3964426 - DNA, 16 bp, Homo sapiens
agtgctgtacccttcc

SEQ ID NO: 3964427 - DNA, 18 bp, Homo sapiens
agtgctgtacccttccac

SEQ ID NO: 3964428 - DNA, 21 bp, Homo sapiens
agtgctgtttgagatgtgatg

SEQ ID NO: 3964429 - DNA, 22 bp, Homo sapiens
agtgcttagaaagttattgtgt

SEQ ID NO: 3964430 - DNA, 21 bp, Homo sapiens
agtgcttcatttgggaaattc

SEQ ID NO: 3964431 - DNA, 21 bp, Homo sapiens
agtgcttcttaaagagttctt

SEQ ID NO: 3964432 - DNA, 15 bp, Homo sapiens
agtggaaaaaagaga

SEQ ID NO: 3964433 - DNA, 23 bp, Homo sapiens
agtggaaaaaagagaaaaaccaa

SEQ ID NO: 3964434 - DNA, 22 bp, Homo sapiens
agtggaaattcaggtgaaaatg

SEQ ID NO: 3964435 - DNA, 14 bp, Homo sapiens
agtggaagagcagc

SEQ ID NO: 3964436 - DNA, 15 bp, Homo sapiens
agtggaagagcagcc

SEQ ID NO: 3964437 - DNA, 20 bp, Homo sapiens
agtggaagagcagcctgatg

SEQ ID NO: 3964438 - DNA, 23 bp, Homo sapiens
agtggaagagcagcctgatggcc

SEQ ID NO: 3964439 - DNA, 19 bp, Homo sapiens
agtggaatcactgtatttt

SEQ ID NO: 3964440 - DNA, 16 bp, Homo sapiens
agtggaatgcagggaa

SEQ ID NO: 3964441 - DNA, 21 bp, Homo sapiens
agtggaatgcagggaagaggg

SEQ ID NO: 3964442 - DNA, 16 bp, Homo sapiens
agtggaccaggacagg

SEQ ID NO: 3964443 - DNA, 19 bp, Homo sapiens
agtggaccaggacaggacc

SEQ ID NO: 3964444 - DNA, 20 bp, Homo sapiens
agtggaccaggacaggacca

SEQ ID NO: 3964445 - DNA, 15 bp, Homo sapiens
agtggagagtgttcc

SEQ ID NO: 3964446 - DNA, 19 bp, Homo sapiens
agtggaggaaaatccatgg

SEQ ID NO: 3964447 - DNA, 14 bp, Homo sapiens
agtggagtctgagt

SEQ ID NO: 3964448 - DNA, 15 bp, Homo sapiens
agtggagtgagatct

SEQ ID NO: 3964449 - DNA, 13 bp, Homo sapiens
agtggatggatgg

SEQ ID NO: 3964450 - DNA, 15 bp, Homo sapiens
agtggatggatggac

SEQ ID NO: 3964451 - DNA, 23 bp, Homo sapiens
agtggatggatggacagaatgat

SEQ ID NO: 3964452 - DNA, 13 bp, Homo sapiens
agtggcagccatg

SEQ ID NO: 3964453 - DNA, 23 bp, Homo sapiens
agtggcagccatgcctcatgcca

SEQ ID NO: 3964454 - DNA, 21 bp, Homo sapiens
agtggcccctcacctgggcct

SEQ ID NO: 3964455 - DNA, 21 bp, Homo sapiens
agtggccgcaagcgcagggag

SEQ ID NO: 3964456 - DNA, 15 bp, Homo sapiens
agtggcgagaggaga

SEQ ID NO: 3964457 - DNA, 17 bp, Homo sapiens
agtggcgagaggagagg

SEQ ID NO: 3964458 - DNA, 18 bp, Homo sapiens
agtggcgagaggagagga

SEQ ID NO: 3964459 - DNA, 16 bp, Homo sapiens
agtggctaattcaatt

SEQ ID NO: 3964460 - DNA, 17 bp, Homo sapiens
agtggctcacgcctgta

SEQ ID NO: 3964461 - DNA, 13 bp, Homo sapiens
agtggctcctccc

SEQ ID NO: 3964462 - DNA, 21 bp, Homo sapiens
agtggctcctcccggtgccca

SEQ ID NO: 3964463 - DNA, 15 bp, Homo sapiens
agtggcttcaaaata

SEQ ID NO: 3964464 - DNA, 20 bp, Homo sapiens
agtggcttgtgattctggga

SEQ ID NO: 3964465 - DNA, 15 bp, Homo sapiens
agtgggaagtgaagc

SEQ ID NO: 3964466 - DNA, 15 bp, Homo sapiens
agtgggacaaaccag

SEQ ID NO: 3964467 - DNA, 21 bp, Homo sapiens
agtgggacaaaccagagcaga

SEQ ID NO: 3964468 - DNA, 19 bp, Homo sapiens
agtgggacagggcatggcc

SEQ ID NO: 3964469 - DNA, 14 bp, Homo sapiens
agtgggagaaaaca

SEQ ID NO: 3964470 - DNA, 20 bp, Homo sapiens
agtgggccaggacaggcccg

SEQ ID NO: 3964471 - DNA, 17 bp, Homo sapiens
agtgggctgcatctggg

SEQ ID NO: 3964472 - DNA, 15 bp, Homo sapiens
agtggggtaattctg

SEQ ID NO: 3964473 - DNA, 18 bp, Homo sapiens
agtggggtctccctctcc

SEQ ID NO: 3964474 - DNA, 20 bp, Homo sapiens
agtggggtctccctctcctg

SEQ ID NO: 3964475 - DNA, 23 bp, Homo sapiens
agtggggtctccctctcctgcct

SEQ ID NO: 3964476 - DNA, 19 bp, Homo sapiens
agtggggttgcaaccactg

SEQ ID NO: 3964477 - DNA, 22 bp, Homo sapiens
agtggtcaaaccgcactcaccc

SEQ ID NO: 3964478 - DNA, 23 bp, Homo sapiens
agtggtcaaaccgcactcaccca

SEQ ID NO: 3964479 - DNA, 13 bp, Homo sapiens
agtgtaaaataag

SEQ ID NO: 3964480 - DNA, 17 bp, Homo sapiens
agtgtaaaatagaatgt

SEQ ID NO: 3964481 - DNA, 17 bp, Homo sapiens
agtgtaaagaataaatg

SEQ ID NO: 3964482 - DNA, 14 bp, Homo sapiens
agtgtaaatccttt

SEQ ID NO: 3964483 - DNA, 21 bp, Homo sapiens
agtgtaaggcatagggaatat

SEQ ID NO: 3964484 - DNA, 16 bp, Homo sapiens
agtgtatggaaataaa

SEQ ID NO: 3964485 - DNA, 22 bp, Homo sapiens
agtgtatggaaataaatgtatc

SEQ ID NO: 3964486 - DNA, 20 bp, Homo sapiens
agtgtcaccagctgccaaaa

SEQ ID NO: 3964487 - DNA, 16 bp, Homo sapiens
agtgtcatcagaagat

SEQ ID NO: 3964488 - DNA, 17 bp, Homo sapiens
agtgtcccctccactgt

SEQ ID NO: 3964489 - DNA, 18 bp, Homo sapiens
agtgtcttaattaaaaga

SEQ ID NO: 3964490 - DNA, 21 bp, Homo sapiens
agtgtcttaattaaaagaata

SEQ ID NO: 3964491 - DNA, 15 bp, Homo sapiens
agtgtgagtggcagc

SEQ ID NO: 3964492 - DNA, 19 bp, Homo sapiens
agtgtgagtggcagccatg

SEQ ID NO: 3964493 - DNA, 20 bp, Homo sapiens
agtgtgagtggcagccatgc

SEQ ID NO: 3964494 - DNA, 15 bp, Homo sapiens
agtgtgcagactgat

SEQ ID NO: 3964495 - DNA, 16 bp, Homo sapiens
agtgtgcagactgatg

SEQ ID NO: 3964496 - DNA, 20 bp, Homo sapiens
aggcggaggttgcagtgagc

SEQ ID NO: 3964497 - DNA, 17 bp, Homo sapiens
aggcggctccaggtccg

SEQ ID NO: 3964498 - DNA, 20 bp, Homo sapiens
aggcggtcatgtgtgcatgt

SEQ ID NO: 3964499 - DNA, 22 bp, Homo sapiens
aggcggtcatgtgtgcatgtga

SEQ ID NO: 3964500 - DNA, 16 bp, Homo sapiens
aggcgttggtgccact

SEQ ID NO: 3964501 - DNA, 21 bp, Homo sapiens
aggctaagatgagatttgcca

SEQ ID NO: 3964502 - DNA, 17 bp, Homo sapiens
aggctagtttattttgt

SEQ ID NO: 3964503 - DNA, 17 bp, Homo sapiens
aggctattaaaagaatc

SEQ ID NO: 3964504 - DNA, 16 bp, Homo sapiens
aggctattattttcac

SEQ ID NO: 3964505 - DNA, 17 bp, Homo sapiens
aggctcaacaataaaac

SEQ ID NO: 3964506 - DNA, 19 bp, Homo sapiens
aggctcaacaataaaacat

SEQ ID NO: 3964507 - DNA, 14 bp, Homo sapiens
aggctcaagaggcc

SEQ ID NO: 3964508 - DNA, 17 bp, Homo sapiens
aggctcaagaggcccag

SEQ ID NO: 3964509 - DNA, 21 bp, Homo sapiens
aggctcaagaggcccagggag

SEQ ID NO: 3964510 - DNA, 12 bp, Homo sapiens
aggctcctgtcc

SEQ ID NO: 3964511 - DNA, 17 bp, Homo sapiens
aggctctggagccagag

SEQ ID NO: 3964512 - DNA, 11 bp, Homo sapiens
aggctctggga

SEQ ID NO: 3964513 - DNA, 12 bp, Homo sapiens
aggctctgggaa

SEQ ID NO: 3964514 - DNA, 17 bp, Homo sapiens
aggctctgggaaggggt

SEQ ID NO: 3964515 - DNA, 23 bp, Homo sapiens
aggctctgggctcagggctggag

SEQ ID NO: 3964516 - DNA, 16 bp, Homo sapiens
aggctcttcctggacc

SEQ ID NO: 3964517 - DNA, 14 bp, Homo sapiens
aggctgaccaagag

SEQ ID NO: 3964518 - DNA, 17 bp, Homo sapiens
aggctgaccaagagaga

SEQ ID NO: 3964519 - DNA, 18 bp, Homo sapiens
aggctgaccaagagagaa

SEQ ID NO: 3964520 - DNA, 20 bp, Homo sapiens
aggctgaccaagagagaaag

SEQ ID NO: 3964521 - DNA, 22 bp, Homo sapiens
aggctgaccaagagagaaagaa

SEQ ID NO: 3964522 - DNA, 14 bp, Homo sapiens
aggctgagacagga

SEQ ID NO: 3964523 - DNA, 15 bp, Homo sapiens
aggctgagacaggag

SEQ ID NO: 3964524 - DNA, 17 bp, Homo sapiens
aggctgaggcagaagaa

SEQ ID NO: 3964525 - DNA, 21 bp, Homo sapiens
aggctgcagaaggccaagaat

SEQ ID NO: 3964526 - DNA, 18 bp, Homo sapiens
aggctgcagagctgaccc

SEQ ID NO: 3964527 - DNA, 18 bp, Homo sapiens
aggctgcatgctctggaa

SEQ ID NO: 3964528 - DNA, 17 bp, Homo sapiens
aggctgctcggggtgca

SEQ ID NO: 3964529 - DNA, 22 bp, Homo sapiens
aggctgctcggggtgcacagga

SEQ ID NO: 3964530 - DNA, 18 bp, Homo sapiens
aggctgctcttgaattcc

SEQ ID NO: 3964531 - DNA, 12 bp, Homo sapiens
aggctggagaag

SEQ ID NO: 3964532 - DNA, 13 bp, Homo sapiens
aggctggagaagc

SEQ ID NO: 3964533 - DNA, 20 bp, Homo sapiens
aggctggagaagctcaccca

SEQ ID NO: 3964534 - DNA, 16 bp, Homo sapiens
aggctggaggcagggc

SEQ ID NO: 3964535 - DNA, 22 bp, Homo sapiens
aggctggcctgatcttggctca

SEQ ID NO: 3964536 - DNA, 13 bp, Homo sapiens
aggctggctggcc

SEQ ID NO: 3964537 - DNA, 13 bp, Homo sapiens
aggctgggccagc

SEQ ID NO: 3964538 - DNA, 14 bp, Homo sapiens
aggctgggccagcc

SEQ ID NO: 3964539 - DNA, 16 bp, Homo sapiens
aggctgggccagcctc

SEQ ID NO: 3964540 - DNA, 18 bp, Homo sapiens
aggctgggccagcctcag

SEQ ID NO: 3964541 - DNA, 20 bp, Homo sapiens
aggctgggccagcctcagct

SEQ ID NO: 3964542 - DNA, 23 bp, Homo sapiens
aggctgggggcgggggagccaac

SEQ ID NO: 3964543 - DNA, 22 bp, Homo sapiens
aggctggtctcgaactcctgac

SEQ ID NO: 3964544 - DNA, 22 bp, Homo sapiens
aggctgtaagcattctgagctg

SEQ ID NO: 3964545 - DNA, 20 bp, Homo sapiens
aggctgttctgcactgaaaa

SEQ ID NO: 3964546 - DNA, 16 bp, Homo sapiens
aggcttaggtgccagg

SEQ ID NO: 3964547 - DNA, 12 bp, Homo sapiens
aggcttcaccct

SEQ ID NO: 3964548 - DNA, 15 bp, Homo sapiens
aggcttccaggctct

SEQ ID NO: 3964549 - DNA, 16 bp, Homo sapiens
aggcttccaggctctt

SEQ ID NO: 3964550 - DNA, 16 bp, Homo sapiens
aggcttggaatgaatt

SEQ ID NO: 3964551 - DNA, 19 bp, Homo sapiens
aggctttgccatgggcctg

SEQ ID NO: 3964552 - DNA, 16 bp, Homo sapiens
agggaaactgccagca

SEQ ID NO: 3964553 - DNA, 15 bp, Homo sapiens
agggaacagacagga

SEQ ID NO: 3964554 - DNA, 18 bp, Homo sapiens
agggaacagacaggagaa

SEQ ID NO: 3964555 - DNA, 20 bp, Homo sapiens
agggaacagacaggagaaat

SEQ ID NO: 3964556 - DNA, 16 bp, Homo sapiens
agggaagagggcagta

SEQ ID NO: 3964557 - DNA, 12 bp, Homo sapiens
agggaagcaggc

SEQ ID NO: 3964558 - DNA, 15 bp, Homo sapiens
agggaagcaggcaga

SEQ ID NO: 3964559 - DNA, 18 bp, Homo sapiens
agggaaggcaggcagggc

SEQ ID NO: 3964560 - DNA, 20 bp, Homo sapiens
agggaaggcaggcagggctc

SEQ ID NO: 3964561 - DNA, 21 bp, Homo sapiens
agggaatccgcctgcagagga

SEQ ID NO: 3964562 - DNA, 23 bp, Homo sapiens
agggccggggaactggccaagct

SEQ ID NO: 3964563 - DNA, 17 bp, Homo sapiens
agggcctgggggcagtg

SEQ ID NO: 3964564 - DNA, 18 bp, Homo sapiens
agggccttgcccagagat

SEQ ID NO: 3964565 - DNA, 15 bp, Homo sapiens
agggcgtgactcacc

SEQ ID NO: 3964566 - DNA, 13 bp, Homo sapiens
agggctaagagct

SEQ ID NO: 3964567 - DNA, 14 bp, Homo sapiens
agggctaagagcta

SEQ ID NO: 3964568 - DNA, 21 bp, Homo sapiens
agggctactgcagctttacat

SEQ ID NO: 3964569 - DNA, 22 bp, Homo sapiens
agggctagaacctagaagggct

SEQ ID NO: 3964570 - DNA, 16 bp, Homo sapiens
agggctagaacctgga

SEQ ID NO: 3964571 - DNA, 19 bp, Homo sapiens
agggctagaacctggagag

SEQ ID NO: 3964572 - DNA, 22 bp, Homo sapiens
agggctagaacctggagggcta

SEQ ID NO: 3964573 - DNA, 22 bp, Homo sapiens
agggctagaacctgtagagcta

SEQ ID NO: 3964574 - DNA, 23 bp, Homo sapiens
agggctccagcatccagcctgtg

SEQ ID NO: 3964575 - DNA, 14 bp, Homo sapiens
agggctccctcctg

SEQ ID NO: 3964576 - DNA, 17 bp, Homo sapiens
agggctctcctggcttc

SEQ ID NO: 3964577 - DNA, 16 bp, Homo sapiens
agggctctgaggcgcc

SEQ ID NO: 3964578 - DNA, 17 bp, Homo sapiens
agggctgacctgcctct

SEQ ID NO: 3964579 - DNA, 23 bp, Homo sapiens
agggctgacctgcctctcacaca

SEQ ID NO: 3964580 - DNA, 14 bp, Homo sapiens
agggctgggcagct

SEQ ID NO: 3964581 - DNA, 16 bp, Homo sapiens
agggctgttggacagc

SEQ ID NO: 3964582 - DNA, 17 bp, Homo sapiens
agggctgttggacagct

SEQ ID NO: 3964583 - DNA, 21 bp, Homo sapiens
agggctgttggacagctgctt

SEQ ID NO: 3964584 - DNA, 20 bp, Homo sapiens
agggcttggtaaaacacaga

SEQ ID NO: 3964585 - DNA, 21 bp, Homo sapiens
agggcttggtaaaacacagat

SEQ ID NO: 3964586 - DNA, 21 bp, Homo sapiens
agggcttttttttgagaatac

SEQ ID NO: 3964587 - DNA, 14 bp, Homo sapiens
aggggaagggccag

SEQ ID NO: 3964588 - DNA, 23 bp, Homo sapiens
aggggaagggccagtctgggctg

SEQ ID NO: 3964589 - DNA, 18 bp, Homo sapiens
aggggaataatagaagaa

SEQ ID NO: 3964590 - DNA, 17 bp, Homo sapiens
aggggagacagggcaat

SEQ ID NO: 3964591 - DNA, 10 bp, Homo sapiens
aggggagagg

SEQ ID NO: 3964592 - DNA, 17 bp, Homo sapiens
aggggagagggtctgga

SEQ ID NO: 3964593 - DNA, 20 bp, Homo sapiens
aggggagatactctccctga

SEQ ID NO: 3964594 - DNA, 14 bp, Homo sapiens
aggggcacctggga

SEQ ID NO: 3964595 - DNA, 18 bp, Homo sapiens
aggggccagtgagggctg

SEQ ID NO: 3964596 - DNA, 24 bp, Homo sapiens
aggggccagtgagggctgggccca

SEQ ID NO: 3964597 - DNA, 19 bp, Homo sapiens
aggggcccacaaaggggag

SEQ ID NO: 3964598 - DNA, 14 bp, Homo sapiens
aggggcccacaggg

SEQ ID NO: 3964599 - DNA, 21 bp, Homo sapiens
aggggcccacagggaaccctg

SEQ ID NO: 3964600 - DNA, 21 bp, Homo sapiens
aggggccccagatctgcctgg

SEQ ID NO: 3964601 - DNA, 17 bp, Homo sapiens
aggggccccggggctgg

SEQ ID NO: 3964602 - DNA, 22 bp, Homo sapiens
aggggccccggggctggcaagc

SEQ ID NO: 3964603 - DNA, 20 bp, Homo sapiens
aggggcctctgaaatttccc

SEQ ID NO: 3964604 - DNA, 12 bp, Homo sapiens
aggggcctggca

SEQ ID NO: 3964605 - DNA, 23 bp, Homo sapiens
aggggcctggcagccgtgccttc

SEQ ID NO: 3964606 - DNA, 17 bp, Homo sapiens
aggggcctgggaaagga

SEQ ID NO: 3964607 - DNA, 18 bp, Homo sapiens
aggggcctgggaaaggaa

SEQ ID NO: 3964608 - DNA, 19 bp, Homo sapiens
aggggcctgggaaaggaaa

SEQ ID NO: 3964609 - DNA, 13 bp, Homo sapiens
aggggcgagcacc

SEQ ID NO: 3964610 - DNA, 13 bp, Homo sapiens
aggggcggggcag

SEQ ID NO: 3964611 - DNA, 18 bp, Homo sapiens
aggggctaggggctggtc

SEQ ID NO: 3964612 - DNA, 11 bp, Homo sapiens
aggggctgctg

SEQ ID NO: 3964613 - DNA, 13 bp, Homo sapiens
aggggctgctggg

SEQ ID NO: 3964614 - DNA, 13 bp, Homo sapiens
aggggcttcctgg

SEQ ID NO: 3964615 - DNA, 17 bp, Homo sapiens
agggggattggagggaa

SEQ ID NO: 3964616 - DNA, 20 bp, Homo sapiens
agggggcctttaaagactta

SEQ ID NO: 3964617 - DNA, 14 bp, Homo sapiens
agggggctccatgg

SEQ ID NO: 3964618 - DNA, 16 bp, Homo sapiens
agggggctccatggag

SEQ ID NO: 3964619 - DNA, 16 bp, Homo sapiens
agggggtccacccagc

SEQ ID NO: 3964620 - DNA, 16 bp, Homo sapiens
agggggtcgtggagag

SEQ ID NO: 3964621 - DNA, 19 bp, Homo sapiens
agggggtcgtggagagcta

SEQ ID NO: 3964622 - DNA, 17 bp, Homo sapiens
aggggtaggcagagcct

SEQ ID NO: 3964623 - DNA, 20 bp, Homo sapiens
aggggtatatttagaccctg

SEQ ID NO: 3964624 - DNA, 14 bp, Homo sapiens
aggggtcaaagaaa

SEQ ID NO: 3964625 - DNA, 16 bp, Homo sapiens
aggggtcaaagaaatg

SEQ ID NO: 3964626 - DNA, 16 bp, Homo sapiens
aggggtctccctggag

SEQ ID NO: 3964627 - DNA, 17 bp, Homo sapiens
aggggtgatttcagaga

SEQ ID NO: 3964628 - DNA, 22 bp, Homo sapiens
aggggtgcacccactcaccagg

SEQ ID NO: 3964629 - DNA, 13 bp, Homo sapiens
aggggtgccctct

SEQ ID NO: 3964630 - DNA, 14 bp, Homo sapiens
aggggtgccctctg

SEQ ID NO: 3964631 - DNA, 18 bp, Homo sapiens
aggggtgtgattggagtg

SEQ ID NO: 3964632 - DNA, 17 bp, Homo sapiens
aggggttgcgggggagc

SEQ ID NO: 3964633 - DNA, 19 bp, Homo sapiens
agggtaagggagagggagg

SEQ ID NO: 3964634 - DNA, 14 bp, Homo sapiens
agggtaaggtgcct

SEQ ID NO: 3964635 - DNA, 21 bp, Homo sapiens
agggtaccaatcctggcagga

SEQ ID NO: 3964636 - DNA, 23 bp, Homo sapiens
agggtagaattctggctggtaga

SEQ ID NO: 3964637 - DNA, 14 bp, Homo sapiens
agggtagggcagca

SEQ ID NO: 3964638 - DNA, 14 bp, Homo sapiens
agggtaggggagtg

SEQ ID NO: 3964639 - DNA, 20 bp, Homo sapiens
agggtaggggagtgtgggtg

SEQ ID NO: 3964640 - DNA, 16 bp, Homo sapiens
agggtatcccagaccc

SEQ ID NO: 3964641 - DNA, 18 bp, Homo sapiens
agggtccccacctgggac

SEQ ID NO: 3964642 - DNA, 14 bp, Homo sapiens
agggtctggagaag

SEQ ID NO: 3964643 - DNA, 15 bp, Homo sapiens
agggtctgttgtaaa

SEQ ID NO: 3964644 - DNA, 17 bp, Homo sapiens
agggtcttcttggcagc

SEQ ID NO: 3964645 - DNA, 18 bp, Homo sapiens
agggtcttcttggcagct

SEQ ID NO: 3964646 - DNA, 17 bp, Homo sapiens
agggtcttgggctactg

SEQ ID NO: 3964647 - DNA, 23 bp, Homo sapiens
agggtcttgggctactggcagct

SEQ ID NO: 3964648 - DNA, 18 bp, Homo sapiens
aggatgaagggcccgaga

SEQ ID NO: 3964649 - DNA, 23 bp, Homo sapiens
aggatgaggaacctcaaactggg

SEQ ID NO: 3964650 - DNA, 12 bp, Homo sapiens
aggatgccacag

SEQ ID NO: 3964651 - DNA, 13 bp, Homo sapiens
aggatgccacagc

SEQ ID NO: 3964652 - DNA, 16 bp, Homo sapiens
aggatgccacagcccc

SEQ ID NO: 3964653 - DNA, 13 bp, Homo sapiens
aggatggagagag

SEQ ID NO: 3964654 - DNA, 17 bp, Homo sapiens
aggatggattgcagtcc

SEQ ID NO: 3964655 - DNA, 15 bp, Homo sapiens
aggatggtgcaggat

SEQ ID NO: 3964656 - DNA, 19 bp, Homo sapiens
aggatgtaaacagtgcctg

SEQ ID NO: 3964657 - DNA, 21 bp, Homo sapiens
aggatgtaaacagtgcctgct

SEQ ID NO: 3964658 - DNA, 22 bp, Homo sapiens
aggatgttctggacctccccct

SEQ ID NO: 3964659 - DNA, 14 bp, Homo sapiens
aggattgaagagca

SEQ ID NO: 3964660 - DNA, 12 bp, Homo sapiens
aggatttaacag

SEQ ID NO: 3964661 - DNA, 12 bp, Homo sapiens
aggatttcaagc

SEQ ID NO: 3964662 - DNA, 23 bp, Homo sapiens
aggattttaacaaaagcaagact

SEQ ID NO: 3964663 - DNA, 16 bp, Homo sapiens
aggattttgtgttttt

SEQ ID NO: 3964664 - DNA, 21 bp, Homo sapiens
aggcaaaacacgcaagggcat

SEQ ID NO: 3964665 - DNA, 15 bp, Homo sapiens
aggcaaagcccctgg

SEQ ID NO: 3964666 - DNA, 20 bp, Homo sapiens
aggcaaaggccagcagcaga

SEQ ID NO: 3964667 - DNA, 14 bp, Homo sapiens
aggcaagagacaga

SEQ ID NO: 3964668 - DNA, 15 bp, Homo sapiens
aggcaagagacagaa

SEQ ID NO: 3964669 - DNA, 13 bp, Homo sapiens
aggcaagcccctc

SEQ ID NO: 3964670 - DNA, 14 bp, Homo sapiens
aggcaagcccctca

SEQ ID NO: 3964671 - DNA, 20 bp, Homo sapiens
aggcaagcccctcagccctt

SEQ ID NO: 3964672 - DNA, 16 bp, Homo sapiens
aggcaatatctttaat

SEQ ID NO: 3964673 - DNA, 18 bp, Homo sapiens
aggcacacagcagccccc

SEQ ID NO: 3964674 - DNA, 13 bp, Homo sapiens
aggcacaggcagg

SEQ ID NO: 3964675 - DNA, 14 bp, Homo sapiens
aggcacaggcagga

SEQ ID NO: 3964676 - DNA, 18 bp, Homo sapiens
aggcacaggcaggaagag

SEQ ID NO: 3964677 - DNA, 16 bp, Homo sapiens
aggcaccagctctgtg

SEQ ID NO: 3964678 - DNA, 21 bp, Homo sapiens
aggcaccagctctgtggcctg

SEQ ID NO: 3964679 - DNA, 22 bp, Homo sapiens
aggcaccagctctgtggcctgt

SEQ ID NO: 3964680 - DNA, 15 bp, Homo sapiens
aggcaccccctggag

SEQ ID NO: 3964681 - DNA, 17 bp, Homo sapiens
aggcaccccctggagag

SEQ ID NO: 3964682 - DNA, 14 bp, Homo sapiens
aggcaccggcgctg

SEQ ID NO: 3964683 - DNA, 19 bp, Homo sapiens
aggcaccggcgctgcaggt

SEQ ID NO: 3964684 - DNA, 15 bp, Homo sapiens
aggcacctggcctgc

SEQ ID NO: 3964685 - DNA, 19 bp, Homo sapiens
aggcacctggcctgctggg

SEQ ID NO: 3964686 - DNA, 19 bp, Homo sapiens
aggcacgaacccacctgct

SEQ ID NO: 3964687 - DNA, 20 bp, Homo sapiens
aggcacgaacccacctgctg

SEQ ID NO: 3964688 - DNA, 21 bp, Homo sapiens
aggcacgaacccacctgctga

SEQ ID NO: 3964689 - DNA, 21 bp, Homo sapiens
aggcacgccagtttcaccatt

SEQ ID NO: 3964690 - DNA, 22 bp, Homo sapiens
aggcactgctgcccagcctcca

SEQ ID NO: 3964691 - DNA, 21 bp, Homo sapiens
aggcagaagaattgaacccag

SEQ ID NO: 3964692 - DNA, 22 bp, Homo sapiens
aggcagaagaattgaacccagg

SEQ ID NO: 3964693 - DNA, 14 bp, Homo sapiens
aggcagacaagagc

SEQ ID NO: 3964694 - DNA, 15 bp, Homo sapiens
aggcagacaagagct

SEQ ID NO: 3964695 - DNA, 16 bp, Homo sapiens
aggcagacaagagctg

SEQ ID NO: 3964696 - DNA, 17 bp, Homo sapiens
aggcagacaagagctgc

SEQ ID NO: 3964697 - DNA, 19 bp, Homo sapiens
aggcagacaagagctgctg

SEQ ID NO: 3964698 - DNA, 22 bp, Homo sapiens
aggcagacttccctgaatgtat

SEQ ID NO: 3964699 - DNA, 13 bp, Homo sapiens
aggcagagaaaga

SEQ ID NO: 3964700 - DNA, 13 bp, Homo sapiens
aggcagagaagaa

SEQ ID NO: 3964701 - DNA, 16 bp, Homo sapiens
aggcagagcggggagg

SEQ ID NO: 3964702 - DNA, 19 bp, Homo sapiens
aggcagagcggggaggtgc

SEQ ID NO: 3964703 - DNA, 21 bp, Homo sapiens
aggcagagcggggaggtgcct

SEQ ID NO: 3964704 - DNA, 17 bp, Homo sapiens
aggcagaggcagacagg

SEQ ID NO: 3964705 - DNA, 15 bp, Homo sapiens
aggcagcaaggcccg

SEQ ID NO: 3964706 - DNA, 17 bp, Homo sapiens
aggcagcaaggcccgag

SEQ ID NO: 3964707 - DNA, 15 bp, Homo sapiens
aggcagccctttggg

SEQ ID NO: 3964708 - DNA, 11 bp, Homo sapiens
aggcagcctcc

SEQ ID NO: 3964709 - DNA, 12 bp, Homo sapiens
aggcagcctcca

SEQ ID NO: 3964710 - DNA, 14 bp, Homo sapiens
aggcagcctccaga

SEQ ID NO: 3964711 - DNA, 15 bp, Homo sapiens
aggcagcctccagag

SEQ ID NO: 3964712 - DNA, 21 bp, Homo sapiens
aggcagcctccagagccagcc

SEQ ID NO: 3964713 - DNA, 16 bp, Homo sapiens
aggcagctccaacagc

SEQ ID NO: 3964714 - DNA, 13 bp, Homo sapiens
aggcaggaagaga

SEQ ID NO: 3964715 - DNA, 23 bp, Homo sapiens
aggcaggaagagagagagagagg

SEQ ID NO: 3964716 - DNA, 18 bp, Homo sapiens
aggcagggacagagatgg

SEQ ID NO: 3964717 - DNA, 22 bp, Homo sapiens
aggcagggaggaggcagagaag

SEQ ID NO: 3964718 - DNA, 14 bp, Homo sapiens
aggcagggagggga

SEQ ID NO: 3964719 - DNA, 16 bp, Homo sapiens
aggcagggaggggact

SEQ ID NO: 3964720 - DNA, 18 bp, Homo sapiens
aggcagggcaaatgacat

SEQ ID NO: 3964721 - DNA, 19 bp, Homo sapiens
aggcagggccttgcccaga

SEQ ID NO: 3964722 - DNA, 20 bp, Homo sapiens
aggcagggccttgcccagag

SEQ ID NO: 3964723 - DNA, 21 bp, Homo sapiens
aggcagggccttgcccagaga

SEQ ID NO: 3964724 - DNA, 14 bp, Homo sapiens
aggcagggctctcc

SEQ ID NO: 3964725 - DNA, 15 bp, Homo sapiens
aggcagggctctcct

SEQ ID NO: 3964726 - DNA, 17 bp, Homo sapiens
aggcagggctctcctgg

SEQ ID NO: 3964727 - DNA, 19 bp, Homo sapiens
aggcagggctctcctggct

SEQ ID NO: 3964728 - DNA, 15 bp, Homo sapiens
aggcaggggtgggag

SEQ ID NO: 3964729 - DNA, 23 bp, Homo sapiens
aggcaggggtgggagagccagct

SEQ ID NO: 3964730 - DNA, 16 bp, Homo sapiens
aggcagtctgaaccct

SEQ ID NO: 3964731 - DNA, 16 bp, Homo sapiens
aggcatcccaggggac

SEQ ID NO: 3964732 - DNA, 19 bp, Homo sapiens
aggcatgaacacacatgga

SEQ ID NO: 3964733 - DNA, 14 bp, Homo sapiens
aggcatgcctctga

SEQ ID NO: 3964734 - DNA, 16 bp, Homo sapiens
aggcatgctggcctcc

SEQ ID NO: 3964735 - DNA, 13 bp, Homo sapiens
aggcatggccctg

SEQ ID NO: 3964736 - DNA, 14 bp, Homo sapiens
aggcatggccctgg

SEQ ID NO: 3964737 - DNA, 16 bp, Homo sapiens
aggcatggccctgggg

SEQ ID NO: 3964738 - DNA, 14 bp, Homo sapiens
aggcatttcctggg

SEQ ID NO: 3964739 - DNA, 16 bp, Homo sapiens
aggcatttcctgggtg

SEQ ID NO: 3964740 - DNA, 15 bp, Homo sapiens
aggccacatgtcacc

SEQ ID NO: 3964741 - DNA, 12 bp, Homo sapiens
aggccaccagga

SEQ ID NO: 3964742 - DNA, 15 bp, Homo sapiens
aggccagcctggcct

SEQ ID NO: 3964743 - DNA, 21 bp, Homo sapiens
aggccagcctggcctcctgcc

SEQ ID NO: 3964744 - DNA, 13 bp, Homo sapiens
aggcccagcctgt

SEQ ID NO: 3964745 - DNA, 18 bp, Homo sapiens
aggcccagcctgtcctgg

SEQ ID NO: 3964746 - DNA, 21 bp, Homo sapiens
aggcccagcctgtcctggtac

SEQ ID NO: 3964747 - DNA, 20 bp, Homo sapiens
aggcccagctatggccccag

SEQ ID NO: 3964748 - DNA, 21 bp, Homo sapiens
aggcccagggagcaatgggag

SEQ ID NO: 3964749 - DNA, 12 bp, Homo sapiens
aggcccatctca

SEQ ID NO: 3964750 - DNA, 19 bp, Homo sapiens
aggcccatctcaggtgcca

SEQ ID NO: 3964751 - DNA, 15 bp, Homo sapiens
aggccccgcttgtcc

SEQ ID NO: 3964752 - DNA, 17 bp, Homo sapiens
aggccccgcttgtccag

SEQ ID NO: 3964753 - DNA, 20 bp, Homo sapiens
aggccccgcttgtccagcgc

SEQ ID NO: 3964754 - DNA, 22 bp, Homo sapiens
aggccccgcttgtccagcgcct

SEQ ID NO: 3964755 - DNA, 16 bp, Homo sapiens
aggcccctgaggactg

SEQ ID NO: 3964756 - DNA, 21 bp, Homo sapiens
aggcccgagcagctgagcagg

SEQ ID NO: 3964757 - DNA, 14 bp, Homo sapiens
aggcccggggctgg

SEQ ID NO: 3964758 - DNA, 17 bp, Homo sapiens
aggccctaggattcctc

SEQ ID NO: 3964759 - DNA, 16 bp, Homo sapiens
aggccctccatgggct

SEQ ID NO: 3964760 - DNA, 18 bp, Homo sapiens
aggccctccatgggctag

SEQ ID NO: 3964761 - DNA, 14 bp, Homo sapiens
aggccctgtctgta

SEQ ID NO: 3964762 - DNA, 16 bp, Homo sapiens
aggcccttattttcaa

SEQ ID NO: 3964763 - DNA, 13 bp, Homo sapiens
aggcccttcctct

SEQ ID NO: 3964764 - DNA, 13 bp, Homo sapiens
aggcccttgtcct

SEQ ID NO: 3964765 - DNA, 15 bp, Homo sapiens
aggcccttgtcctgc

SEQ ID NO: 3964766 - DNA, 17 bp, Homo sapiens
aggcccttgtcctgcca

SEQ ID NO: 3964767 - DNA, 18 bp, Homo sapiens
aggcccttgtcctgccag

SEQ ID NO: 3964768 - DNA, 20 bp, Homo sapiens
aggcccttgtcctgccagct

SEQ ID NO: 3964769 - DNA, 23 bp, Homo sapiens
aggcccttgtcctgccagctgcc

SEQ ID NO: 3964770 - DNA, 12 bp, Homo sapiens
aggccgagccaa

SEQ ID NO: 3964771 - DNA, 13 bp, Homo sapiens
aggccgcctgcca

SEQ ID NO: 3964772 - DNA, 17 bp, Homo sapiens
aggccgctgttcaccca

SEQ ID NO: 3964773 - DNA, 16 bp, Homo sapiens
aggccgtgtctctgag

SEQ ID NO: 3964774 - DNA, 13 bp, Homo sapiens
aggccgttcccct

SEQ ID NO: 3964775 - DNA, 18 bp, Homo sapiens
aggccgttccccttggct

SEQ ID NO: 3964776 - DNA, 16 bp, Homo sapiens
aggcctaaaagtaaac

SEQ ID NO: 3964777 - DNA, 11 bp, Homo sapiens
aggcctcagtt

SEQ ID NO: 3964778 - DNA, 21 bp, Homo sapiens
aggcctcagtttctccatcag

SEQ ID NO: 3964779 - DNA, 22 bp, Homo sapiens
aggcctcagtttctccatcagc

SEQ ID NO: 3964780 - DNA, 14 bp, Homo sapiens
aggcctcatccctc

SEQ ID NO: 3964781 - DNA, 11 bp, Homo sapiens
aggcctccagc

SEQ ID NO: 3964782 - DNA, 14 bp, Homo sapiens
aggcctccagcctc

SEQ ID NO: 3964783 - DNA, 15 bp, Homo sapiens
aggcctccagcctct

SEQ ID NO: 3964784 - DNA, 22 bp, Homo sapiens
aggcctccagcctctcccggct

SEQ ID NO: 3964785 - DNA, 22 bp, Homo sapiens
aggcctcgtaccagccaggatc

SEQ ID NO: 3964786 - DNA, 19 bp, Homo sapiens
aggcctctggaaagcaaag

SEQ ID NO: 3964787 - DNA, 13 bp, Homo sapiens
aggcctctgtgtc

SEQ ID NO: 3964788 - DNA, 18 bp, Homo sapiens
aggcctcttggacctctg

SEQ ID NO: 3964789 - DNA, 21 bp, Homo sapiens
aggcctcttggacctctgctc

SEQ ID NO: 3964790 - DNA, 15 bp, Homo sapiens
aggcctgatgctgcc

SEQ ID NO: 3964791 - DNA, 11 bp, Homo sapiens
aggcctgccct

SEQ ID NO: 3964792 - DNA, 16 bp, Homo sapiens
aggcctgccctcaggg

SEQ ID NO: 3964793 - DNA, 18 bp, Homo sapiens
aggcctgctcagggactg

SEQ ID NO: 3964794 - DNA, 13 bp, Homo sapiens
aggcctggccagg

SEQ ID NO: 3964795 - DNA, 14 bp, Homo sapiens
aggcctggccaggc

SEQ ID NO: 3964796 - DNA, 20 bp, Homo sapiens
aggcctggccttgtcaggac

SEQ ID NO: 3964797 - DNA, 23 bp, Homo sapiens
aggcctggccttgtcaggaccca

SEQ ID NO: 3964798 - DNA, 15 bp, Homo sapiens
aggcctgggacccag

SEQ ID NO: 3964799 - DNA, 19 bp, Homo sapiens
aggcctgggacccagctac

SEQ ID NO: 3964800 - DNA, 11 bp, Homo sapiens
aggcctggggt

SEQ ID NO: 3964801 - DNA, 20 bp, Homo sapiens
aggcctgtgtagctgtgacc

SEQ ID NO: 3964802 - DNA, 21 bp, Homo sapiens
aggcctgtgtagctgtgacct

SEQ ID NO: 3964803 - DNA, 22 bp, Homo sapiens
acttcttttataactagtcctt

SEQ ID NO: 3964804 - DNA, 19 bp, Homo sapiens
acttcttttgctcttagct

SEQ ID NO: 3964805 - DNA, 16 bp, Homo sapiens
acttgaatcaaagcag

SEQ ID NO: 3964806 - DNA, 16 bp, Homo sapiens
acttgaatctgttact

SEQ ID NO: 3964807 - DNA, 19 bp, Homo sapiens
acttgaatctgttactgaa

SEQ ID NO: 3964808 - DNA, 19 bp, Homo sapiens
acttgagctgtatatatat

SEQ ID NO: 3964809 - DNA, 23 bp, Homo sapiens
acttgagctgtatatatatatgt

SEQ ID NO: 3964810 - DNA, 14 bp, Homo sapiens
acttgaggacacat

SEQ ID NO: 3964811 - DNA, 18 bp, Homo sapiens
acttgaggacacatgtcc

SEQ ID NO: 3964812 - DNA, 19 bp, Homo sapiens
acttgatatagaaagctgt

SEQ ID NO: 3964813 - DNA, 20 bp, Homo sapiens
acttgcacaagcttgtatat

SEQ ID NO: 3964814 - DNA, 15 bp, Homo sapiens
acttgcgtcctgcag

SEQ ID NO: 3964815 - DNA, 23 bp, Homo sapiens
acttgctgcctgaagaacagtaa

SEQ ID NO: 3964816 - DNA, 14 bp, Homo sapiens
acttggaaaaagaa

SEQ ID NO: 3964817 - DNA, 15 bp, Homo sapiens
acttggcaacagaag

SEQ ID NO: 3964818 - DNA, 16 bp, Homo sapiens
acttggcaacagaagc

SEQ ID NO: 3964819 - DNA, 13 bp, Homo sapiens
acttggctgctca

SEQ ID NO: 3964820 - DNA, 17 bp, Homo sapiens
acttgggcacccccagc

SEQ ID NO: 3964821 - DNA, 22 bp, Homo sapiens
acttgggcacccccagcctggg

SEQ ID NO: 3964822 - DNA, 19 bp, Homo sapiens
acttggtttttggctcttt

SEQ ID NO: 3964823 - DNA, 13 bp, Homo sapiens
acttgtaaataaa

SEQ ID NO: 3964824 - DNA, 14 bp, Homo sapiens
acttgtaaataaat

SEQ ID NO: 3964825 - DNA, 17 bp, Homo sapiens
acttgtaaataaataga

SEQ ID NO: 3964826 - DNA, 20 bp, Homo sapiens
acttgtaaataaatagattt

SEQ ID NO: 3964827 - DNA, 20 bp, Homo sapiens
acttgtataaatgtatatac

SEQ ID NO: 3964828 - DNA, 14 bp, Homo sapiens
acttgtctgaggcc

SEQ ID NO: 3964829 - DNA, 11 bp, Homo sapiens
acttgtgccag

SEQ ID NO: 3964830 - DNA, 20 bp, Homo sapiens
acttgtgtactgataaaata

SEQ ID NO: 3964831 - DNA, 15 bp, Homo sapiens
acttgttccttctgc

SEQ ID NO: 3964832 - DNA, 18 bp, Homo sapiens
acttgttccttctgcttc

SEQ ID NO: 3964833 - DNA, 12 bp, Homo sapiens
actttaagagag

SEQ ID NO: 3964834 - DNA, 16 bp, Homo sapiens
actttaagagagaaat

SEQ ID NO: 3964835 - DNA, 17 bp, Homo sapiens
actttaagagagaaatc

SEQ ID NO: 3964836 - DNA, 23 bp, Homo sapiens
actttaagagagaaatctgaaaa

SEQ ID NO: 3964837 - DNA, 21 bp, Homo sapiens
actttaatactcacctcctcc

SEQ ID NO: 3964838 - DNA, 20 bp, Homo sapiens
actttaattgcttaaaagac

SEQ ID NO: 3964839 - DNA, 22 bp, Homo sapiens
actttacactctctgtacaaaa

SEQ ID NO: 3964840 - DNA, 23 bp, Homo sapiens
actttacaggaggttgtggatgc

SEQ ID NO: 3964841 - DNA, 12 bp, Homo sapiens
actttagctatg

SEQ ID NO: 3964842 - DNA, 15 bp, Homo sapiens
actttagctatgtgg

SEQ ID NO: 3964843 - DNA, 16 bp, Homo sapiens
actttagctatgtgga

SEQ ID NO: 3964844 - DNA, 21 bp, Homo sapiens
actttatctgtgaccacacgc

SEQ ID NO: 3964845 - DNA, 14 bp, Homo sapiens
actttccaaaacct

SEQ ID NO: 3964846 - DNA, 13 bp, Homo sapiens
actttcctacaaa

SEQ ID NO: 3964847 - DNA, 22 bp, Homo sapiens
actttctatagcagattgtgta

SEQ ID NO: 3964848 - DNA, 12 bp, Homo sapiens
actttgaaggac

SEQ ID NO: 3964849 - DNA, 16 bp, Homo sapiens
actttgatctctgctt

SEQ ID NO: 3964850 - DNA, 19 bp, Homo sapiens
actttggcttctcctgtga

SEQ ID NO: 3964851 - DNA, 16 bp, Homo sapiens
acttttagtaaagtca

SEQ ID NO: 3964852 - DNA, 12 bp, Homo sapiens
acttttcagtga

SEQ ID NO: 3964853 - DNA, 17 bp, Homo sapiens
acttttccatgtatcta

SEQ ID NO: 3964854 - DNA, 12 bp, Homo sapiens
actttttatact

SEQ ID NO: 3964855 - DNA, 18 bp, Homo sapiens
actttttatactccatac

SEQ ID NO: 3964856 - DNA, 20 bp, Homo sapiens
agaaaaaaaaaaacttacac

SEQ ID NO: 3964857 - DNA, 15 bp, Homo sapiens
agaaaaaaaaaaaga

SEQ ID NO: 3964858 - DNA, 21 bp, Homo sapiens
agaaaaaaagtttgccagaag

SEQ ID NO: 3964859 - DNA, 14 bp, Homo sapiens
agaaaaaataaatg

SEQ ID NO: 3964860 - DNA, 16 bp, Homo sapiens
agaaaaaataaatgga

SEQ ID NO: 3964861 - DNA, 16 bp, Homo sapiens
agaaaaaccaatgatt

SEQ ID NO: 3964862 - DNA, 18 bp, Homo sapiens
agaaaaaccaatgattca

SEQ ID NO: 3964863 - DNA, 20 bp, Homo sapiens
agaaaaaccaatgattcata

SEQ ID NO: 3964864 - DNA, 15 bp, Homo sapiens
agaaaaattattgta

SEQ ID NO: 3964865 - DNA, 17 bp, Homo sapiens
agaaaacacttgtaagt

SEQ ID NO: 3964866 - DNA, 20 bp, Homo sapiens
agaaaacggagagtgcttgg

SEQ ID NO: 3964867 - DNA, 16 bp, Homo sapiens
agaaaactgaaaatct

SEQ ID NO: 3964868 - DNA, 16 bp, Homo sapiens
agaaaagaccctgaga

SEQ ID NO: 3964869 - DNA, 16 bp, Homo sapiens
agaaaagtagaattat

SEQ ID NO: 3964870 - DNA, 17 bp, Homo sapiens
agaaaagtagaattata

SEQ ID NO: 3964871 - DNA, 18 bp, Homo sapiens
agaaaagtagaattatat

SEQ ID NO: 3964872 - DNA, 19 bp, Homo sapiens
agaaaagtgcttagaaagt

SEQ ID NO: 3964873 - DNA, 20 bp, Homo sapiens
agaaaagtgcttagaaagtt

SEQ ID NO: 3964874 - DNA, 15 bp, Homo sapiens
agaaaatataaatgc

SEQ ID NO: 3964875 - DNA, 19 bp, Homo sapiens
agaaacacaaatgtaaaat

SEQ ID NO: 3964876 - DNA, 16 bp, Homo sapiens
agaaacacagttttga

SEQ ID NO: 3964877 - DNA, 16 bp, Homo sapiens
agaaacagaagtagaa

SEQ ID NO: 3964878 - DNA, 18 bp, Homo sapiens
agaaacaggggatcaaag

SEQ ID NO: 3964879 - DNA, 19 bp, Homo sapiens
agaaacaggggatcaaagt

SEQ ID NO: 3964880 - DNA, 17 bp, Homo sapiens
agaaacatgaattattt

SEQ ID NO: 3964881 - DNA, 14 bp, Homo sapiens
agaaacatggtttt

SEQ ID NO: 3964882 - DNA, 23 bp, Homo sapiens
agaaaccagtatggaagggaggg

SEQ ID NO: 3964883 - DNA, 13 bp, Homo sapiens
agaaaccccaagc

SEQ ID NO: 3964884 - DNA, 14 bp, Homo sapiens
agaaaccccaagca

SEQ ID NO: 3964885 - DNA, 17 bp, Homo sapiens
agaaaccccaagcagca

SEQ ID NO: 3964886 - DNA, 14 bp, Homo sapiens
agaaaccctgtctc

SEQ ID NO: 3964887 - DNA, 20 bp, Homo sapiens
agaaactcacgatgaaattg

SEQ ID NO: 3964888 - DNA, 19 bp, Homo sapiens
agaaactgaaaactgtaaa

SEQ ID NO: 3964889 - DNA, 13 bp, Homo sapiens
agaaactgaggaa

SEQ ID NO: 3964890 - DNA, 16 bp, Homo sapiens
aggactactatttgaa

SEQ ID NO: 3964891 - DNA, 17 bp, Homo sapiens
aggactagaacctggag

SEQ ID NO: 3964892 - DNA, 16 bp, Homo sapiens
aggactatagcccagg

SEQ ID NO: 3964893 - DNA, 20 bp, Homo sapiens
aggactatagcccaggtcct

SEQ ID NO: 3964894 - DNA, 18 bp, Homo sapiens
aggactccccaggccagg

SEQ ID NO: 3964895 - DNA, 19 bp, Homo sapiens
aggactccccaggccaggc

SEQ ID NO: 3964896 - DNA, 18 bp, Homo sapiens
aggactccgggaccattg

SEQ ID NO: 3964897 - DNA, 18 bp, Homo sapiens
aggactctgccccttctg

SEQ ID NO: 3964898 - DNA, 16 bp, Homo sapiens
aggactctgcctcctc

SEQ ID NO: 3964899 - DNA, 14 bp, Homo sapiens
aggactctggcctc

SEQ ID NO: 3964900 - DNA, 19 bp, Homo sapiens
aggactgaattgtccccag

SEQ ID NO: 3964901 - DNA, 20 bp, Homo sapiens
aggactgaattgtccccagt

SEQ ID NO: 3964902 - DNA, 12 bp, Homo sapiens
aggactggctca

SEQ ID NO: 3964903 - DNA, 14 bp, Homo sapiens
aggactggctcacc

SEQ ID NO: 3964904 - DNA, 16 bp, Homo sapiens
aggagaaacagagaca

SEQ ID NO: 3964905 - DNA, 16 bp, Homo sapiens
aggagaaaggagctct

SEQ ID NO: 3964906 - DNA, 13 bp, Homo sapiens
aggagaagagaca

SEQ ID NO: 3964907 - DNA, 16 bp, Homo sapiens
aggagaatccaagcga

SEQ ID NO: 3964908 - DNA, 15 bp, Homo sapiens
aggagaatgagcctc

SEQ ID NO: 3964909 - DNA, 18 bp, Homo sapiens
aggagacagttcaagaaa

SEQ ID NO: 3964910 - DNA, 13 bp, Homo sapiens
aggagaccctgga

SEQ ID NO: 3964911 - DNA, 21 bp, Homo sapiens
aggagactcacctctgcctca

SEQ ID NO: 3964912 - DNA, 14 bp, Homo sapiens
aggagagaaggaca

SEQ ID NO: 3964913 - DNA, 17 bp, Homo sapiens
aggagagactgaaagca

SEQ ID NO: 3964914 - DNA, 23 bp, Homo sapiens
aggagagactgaaagcagcagct

SEQ ID NO: 3964915 - DNA, 13 bp, Homo sapiens
aggagagagatct

SEQ ID NO: 3964916 - DNA, 22 bp, Homo sapiens
aggagaggggaagggccagtct

SEQ ID NO: 3964917 - DNA, 15 bp, Homo sapiens
aggagcacaggcagc

SEQ ID NO: 3964918 - DNA, 22 bp, Homo sapiens
aggagcacaggcagctggatga

SEQ ID NO: 3964919 - DNA, 15 bp, Homo sapiens
aggagcagacagaga

SEQ ID NO: 3964920 - DNA, 18 bp, Homo sapiens
aggagcagacagagaaat

SEQ ID NO: 3964921 - DNA, 20 bp, Homo sapiens
aggagcagcttcagttgttt

SEQ ID NO: 3964922 - DNA, 20 bp, Homo sapiens
aggagcccagagggccaaga

SEQ ID NO: 3964923 - DNA, 13 bp, Homo sapiens
aggagcctgtgaa

SEQ ID NO: 3964924 - DNA, 19 bp, Homo sapiens
aggagcctgtgaacccagg

SEQ ID NO: 3964925 - DNA, 21 bp, Homo sapiens
aggagcctgtgaacccaggac

SEQ ID NO: 3964926 - DNA, 22 bp, Homo sapiens
aggagcctgtgaacccaggaca

SEQ ID NO: 3964927 - DNA, 15 bp, Homo sapiens
aggagctacctgtgt

SEQ ID NO: 3964928 - DNA, 23 bp, Homo sapiens
aggagctacctgtgtggacagga

SEQ ID NO: 3964929 - DNA, 23 bp, Homo sapiens
aggagctccgctaagacctcccc

SEQ ID NO: 3964930 - DNA, 18 bp, Homo sapiens
aggagctgagtcacctcc

SEQ ID NO: 3964931 - DNA, 17 bp, Homo sapiens
aggagctgggaggaaaa

SEQ ID NO: 3964932 - DNA, 13 bp, Homo sapiens
aggagcttctctg

SEQ ID NO: 3964933 - DNA, 13 bp, Homo sapiens
aggaggaaggcaa

SEQ ID NO: 3964934 - DNA, 15 bp, Homo sapiens
aggaggacttgcagg

SEQ ID NO: 3964935 - DNA, 13 bp, Homo sapiens
aggaggaggagga

SEQ ID NO: 3964936 - DNA, 14 bp, Homo sapiens
aggaggaggaggaa

SEQ ID NO: 3964937 - DNA, 13 bp, Homo sapiens
aggaggattgctt

SEQ ID NO: 3964938 - DNA, 14 bp, Homo sapiens
aggaggcagagaag

SEQ ID NO: 3964939 - DNA, 19 bp, Homo sapiens
aggaggccctggtgtcagg

SEQ ID NO: 3964940 - DNA, 14 bp, Homo sapiens
aggaggcctggcct

SEQ ID NO: 3964941 - DNA, 15 bp, Homo sapiens
aggaggcctggcctt

SEQ ID NO: 3964942 - DNA, 15 bp, Homo sapiens
aggaggcgaataaat

SEQ ID NO: 3964943 - DNA, 17 bp, Homo sapiens
aggaggcgaataaatgt

SEQ ID NO: 3964944 - DNA, 16 bp, Homo sapiens
aggaggcgcagcccga

SEQ ID NO: 3964945 - DNA, 22 bp, Homo sapiens
aggaggcgcagcccgaagccca

SEQ ID NO: 3964946 - DNA, 15 bp, Homo sapiens
aggaggctgcatgct

SEQ ID NO: 3964947 - DNA, 18 bp, Homo sapiens
aggaggctgcatgctctg

SEQ ID NO: 3964948 - DNA, 21 bp, Homo sapiens
aggaggctgcatgctctggaa

SEQ ID NO: 3964949 - DNA, 23 bp, Homo sapiens
aggagggacaaaggagcctgtga

SEQ ID NO: 3964950 - DNA, 14 bp, Homo sapiens
aggagggcagagcc

SEQ ID NO: 3964951 - DNA, 15 bp, Homo sapiens
aggagggcagagcca

SEQ ID NO: 3964952 - DNA, 22 bp, Homo sapiens
aggagggcgtgactcacccaag

SEQ ID NO: 3964953 - DNA, 14 bp, Homo sapiens
aggagggtgccctc

SEQ ID NO: 3964954 - DNA, 14 bp, Homo sapiens
aggagggtggagga

SEQ ID NO: 3964955 - DNA, 18 bp, Homo sapiens
aggagggtggaggaaggt

SEQ ID NO: 3964956 - DNA, 14 bp, Homo sapiens
aggaggtcctcctc

SEQ ID NO: 3964957 - DNA, 20 bp, Homo sapiens
aggaggtggaggttgcagtg

SEQ ID NO: 3964958 - DNA, 14 bp, Homo sapiens
aggaggtgtcccaa

SEQ ID NO: 3964959 - DNA, 15 bp, Homo sapiens
aggaggtgtcccaag

SEQ ID NO: 3964960 - DNA, 15 bp, Homo sapiens
aggaggttgtggatg

SEQ ID NO: 3964961 - DNA, 14 bp, Homo sapiens
aggaggtttggatg

SEQ ID NO: 3964962 - DNA, 17 bp, Homo sapiens
aggagtagctgagagga

SEQ ID NO: 3964963 - DNA, 16 bp, Homo sapiens
aggagtagctgagctc

SEQ ID NO: 3964964 - DNA, 18 bp, Homo sapiens
aggagtatgcagggagct

SEQ ID NO: 3964965 - DNA, 20 bp, Homo sapiens
aggagtctgaggtcctgagc

SEQ ID NO: 3964966 - DNA, 21 bp, Homo sapiens
aggagtctgaggtcctgagca

SEQ ID NO: 3964967 - DNA, 17 bp, Homo sapiens
aggagtctgtgctcttt

SEQ ID NO: 3964968 - DNA, 23 bp, Homo sapiens
aggagtgggttttattgtccttc

SEQ ID NO: 3964969 - DNA, 16 bp, Homo sapiens
aggagtgtgagaatca

SEQ ID NO: 3964970 - DNA, 17 bp, Homo sapiens
aggagttaagagtagca

SEQ ID NO: 3964971 - DNA, 13 bp, Homo sapiens
aggagttctgaag

SEQ ID NO: 3964972 - DNA, 22 bp, Homo sapiens
aggagttctgaagctgacagca

SEQ ID NO: 3964973 - DNA, 20 bp, Homo sapiens
aggagttgagtacagtgagg

SEQ ID NO: 3964974 - DNA, 16 bp, Homo sapiens
aggagttgccagggaa

SEQ ID NO: 3964975 - DNA, 14 bp, Homo sapiens
aggagttgctgttt

SEQ ID NO: 3964976 - DNA, 21 bp, Homo sapiens
aggagttgctgtttgtttgac

SEQ ID NO: 3964977 - DNA, 17 bp, Homo sapiens
acgttatatattgtatt

SEQ ID NO: 3964978 - DNA, 13 bp, Homo sapiens
acgttgctcccca

SEQ ID NO: 3964979 - DNA, 19 bp, Homo sapiens
acgtttttgtgctgtgggc

SEQ ID NO: 3964980 - DNA, 14 bp, Homo sapiens
actaaaatatgtct

SEQ ID NO: 3964981 - DNA, 19 bp, Homo sapiens
actaaagagacatatttat

SEQ ID NO: 3964982 - DNA, 19 bp, Homo sapiens
actaaagatatcagagctc

SEQ ID NO: 3964983 - DNA, 22 bp, Homo sapiens
actaaagggcaggtggttctaa

SEQ ID NO: 3964984 - DNA, 14 bp, Homo sapiens
actaaagtgtctat

SEQ ID NO: 3964985 - DNA, 17 bp, Homo sapiens
actaaatctctaatatg

SEQ ID NO: 3964986 - DNA, 17 bp, Homo sapiens
actaacactcagaagcc

SEQ ID NO: 3964987 - DNA, 20 bp, Homo sapiens
actaacactcagaagcctgg

SEQ ID NO: 3964988 - DNA, 20 bp, Homo sapiens
actaacataaaatctgtgaa

SEQ ID NO: 3964989 - DNA, 17 bp, Homo sapiens
actaaccccaacgcaca

SEQ ID NO: 3964990 - DNA, 18 bp, Homo sapiens
actaagaggctatttaaa

SEQ ID NO: 3964991 - DNA, 21 bp, Homo sapiens
actaagccctcgaaccaaggc

SEQ ID NO: 3964992 - DNA, 13 bp, Homo sapiens
actaagccctgtc

SEQ ID NO: 3964993 - DNA, 16 bp, Homo sapiens
actaagccctgtcgag

SEQ ID NO: 3964994 - DNA, 18 bp, Homo sapiens
actaagccctgtcgagac

SEQ ID NO: 3964995 - DNA, 16 bp, Homo sapiens
actaagctttctcctt

SEQ ID NO: 3964996 - DNA, 17 bp, Homo sapiens
actaagttatagtatat

SEQ ID NO: 3964997 - DNA, 14 bp, Homo sapiens
actaatagagacac

SEQ ID NO: 3964998 - DNA, 21 bp, Homo sapiens
actaatagagacacagagatg

SEQ ID NO: 3964999 - DNA, 16 bp, Homo sapiens
actaatgctaagaaat

SEQ ID NO: 3965000 - DNA, 18 bp, Homo sapiens
actaattaaaatctggaa

SEQ ID NO: 3965001 - DNA, 15 bp, Homo sapiens
actaatttaaaaaat

SEQ ID NO: 3965002 - DNA, 21 bp, Homo sapiens
actaatttaaaccagcagaaa

SEQ ID NO: 3965003 - DNA, 22 bp, Homo sapiens
actaatttaaaccagcagaaaa

SEQ ID NO: 3965004 - DNA, 23 bp, Homo sapiens
actaatttaaaccagcagaaaag

SEQ ID NO: 3965005 - DNA, 23 bp, Homo sapiens
actacaaagcttctatcccagga

SEQ ID NO: 3965006 - DNA, 20 bp, Homo sapiens
actacacatccctaatgtgt

SEQ ID NO: 3965007 - DNA, 23 bp, Homo sapiens
actacacatccctaatgtgtgcc

SEQ ID NO: 3965008 - DNA, 23 bp, Homo sapiens
actacaccatgtttgagctcaga

SEQ ID NO: 3965009 - DNA, 14 bp, Homo sapiens
actaccctccagag

SEQ ID NO: 3965010 - DNA, 14 bp, Homo sapiens
actacgtgccagct

SEQ ID NO: 3965011 - DNA, 13 bp, Homo sapiens
actactaaagtgc

SEQ ID NO: 3965012 - DNA, 14 bp, Homo sapiens
actactgctgcaaa

SEQ ID NO: 3965013 - DNA, 19 bp, Homo sapiens
actactgctgcaaagtgca

SEQ ID NO: 3965014 - DNA, 21 bp, Homo sapiens
actactgctgcaaagtgcaaa

SEQ ID NO: 3965015 - DNA, 22 bp, Homo sapiens
actactgctgcaaagtgcaaat

SEQ ID NO: 3965016 - DNA, 21 bp, Homo sapiens
actactgtaattaagtgcaat

SEQ ID NO: 3965017 - DNA, 15 bp, Homo sapiens
actactttttatact

SEQ ID NO: 3965018 - DNA, 14 bp, Homo sapiens
actagaacctggag

SEQ ID NO: 3965019 - DNA, 18 bp, Homo sapiens
actagaatggtagcacta

SEQ ID NO: 3965020 - DNA, 19 bp, Homo sapiens
actagagacctctcaacag

SEQ ID NO: 3965021 - DNA, 16 bp, Homo sapiens
actagaggcagggagg

SEQ ID NO: 3965022 - DNA, 23 bp, Homo sapiens
actagatctcctatttttcagaa

SEQ ID NO: 3965023 - DNA, 12 bp, Homo sapiens
actagccaaggc

SEQ ID NO: 3965024 - DNA, 16 bp, Homo sapiens
actagcttttcaaaca

SEQ ID NO: 3965025 - DNA, 21 bp, Homo sapiens
actaggttcaattccctgaag

SEQ ID NO: 3965026 - DNA, 18 bp, Homo sapiens
actagtaatgggccaatt

SEQ ID NO: 3965027 - DNA, 22 bp, Homo sapiens
actagtaatgggccaattaaaa

SEQ ID NO: 3965028 - DNA, 20 bp, Homo sapiens
actagtcatagaaatacctc

SEQ ID NO: 3965029 - DNA, 15 bp, Homo sapiens
actagtgttgcttgg

SEQ ID NO: 3965030 - DNA, 14 bp, Homo sapiens
actagtttccagtg

SEQ ID NO: 3965031 - DNA, 16 bp, Homo sapiens
actataaactactgta

SEQ ID NO: 3965032 - DNA, 19 bp, Homo sapiens
actataaactactgtaatt

SEQ ID NO: 3965033 - DNA, 17 bp, Homo sapiens
actatatacatgtgtgt

SEQ ID NO: 3965034 - DNA, 22 bp, Homo sapiens
actatatgataaagagggatgt

SEQ ID NO: 3965035 - DNA, 14 bp, Homo sapiens
actatattttagat

SEQ ID NO: 3965036 - DNA, 17 bp, Homo sapiens
actatattttagatgca

SEQ ID NO: 3965037 - DNA, 21 bp, Homo sapiens
actatattttagatgcaatgt

SEQ ID NO: 3965038 - DNA, 15 bp, Homo sapiens
actatcacatacaat

SEQ ID NO: 3965039 - DNA, 18 bp, Homo sapiens
actatcacatacaatttg

SEQ ID NO: 3965040 - DNA, 20 bp, Homo sapiens
actatccaattaaaattaag

SEQ ID NO: 3965041 - DNA, 17 bp, Homo sapiens
actatgaaatgaaagaa

SEQ ID NO: 3965042 - DNA, 18 bp, Homo sapiens
actatgaactacaaagct

SEQ ID NO: 3965043 - DNA, 15 bp, Homo sapiens
actatgactgctccc

SEQ ID NO: 3965044 - DNA, 22 bp, Homo sapiens
actatgctatttctggcctcag

SEQ ID NO: 3965045 - DNA, 23 bp, Homo sapiens
actatggttcccaataaaagtga

SEQ ID NO: 3965046 - DNA, 18 bp, Homo sapiens
actatgttgcccaggctg

SEQ ID NO: 3965047 - DNA, 13 bp, Homo sapiens
actattacttgaa

SEQ ID NO: 3965048 - DNA, 15 bp, Homo sapiens
actattacttgaact

SEQ ID NO: 3965049 - DNA, 13 bp, Homo sapiens
actattattaata

SEQ ID NO: 3965050 - DNA, 13 bp, Homo sapiens
actattcaaacag

SEQ ID NO: 3965051 - DNA, 16 bp, Homo sapiens
actattcaaacagtct

SEQ ID NO: 3965052 - DNA, 22 bp, Homo sapiens
actattctcggggccctgtgta

SEQ ID NO: 3965053 - DNA, 19 bp, Homo sapiens
actattgcaagtcatactt

SEQ ID NO: 3965054 - DNA, 14 bp, Homo sapiens
actattgcattgtt

SEQ ID NO: 3965055 - DNA, 17 bp, Homo sapiens
actattgggagggatga

SEQ ID NO: 3965056 - DNA, 13 bp, Homo sapiens
actattgtttaaa

SEQ ID NO: 3965057 - DNA, 16 bp, Homo sapiens
actatttgtctttcag

SEQ ID NO: 3965058 - DNA, 17 bp, Homo sapiens
actcaagggtccagaag

SEQ ID NO: 3965059 - DNA, 14 bp, Homo sapiens
actcaataaaagaa

SEQ ID NO: 3965060 - DNA, 16 bp, Homo sapiens
actcacaagaagacca

SEQ ID NO: 3965061 - DNA, 21 bp, Homo sapiens
actcacaagaagaccagactg

SEQ ID NO: 3965062 - DNA, 13 bp, Homo sapiens
actcaccagggtc

SEQ ID NO: 3965063 - DNA, 21 bp, Homo sapiens
actgatggaccgggtgggcct

SEQ ID NO: 3965064 - DNA, 13 bp, Homo sapiens
actgattctcctg

SEQ ID NO: 3965065 - DNA, 18 bp, Homo sapiens
actgattctcctgtcaga

SEQ ID NO: 3965066 - DNA, 20 bp, Homo sapiens
actgattctgggatgctcct

SEQ ID NO: 3965067 - DNA, 22 bp, Homo sapiens
actgattgggtgccatgtggag

SEQ ID NO: 3965068 - DNA, 14 bp, Homo sapiens
actgatttttgtga

SEQ ID NO: 3965069 - DNA, 22 bp, Homo sapiens
actgcaacctccacctcctgag

SEQ ID NO: 3965070 - DNA, 20 bp, Homo sapiens
actgcaacctcttcctcctg

SEQ ID NO: 3965071 - DNA, 22 bp, Homo sapiens
actgcaacctcttcctcctggt

SEQ ID NO: 3965072 - DNA, 18 bp, Homo sapiens
actgcaagaggctcctgt

SEQ ID NO: 3965073 - DNA, 19 bp, Homo sapiens
actgcacacacagctcctc

SEQ ID NO: 3965074 - DNA, 20 bp, Homo sapiens
actgcacagcggcccctgca

SEQ ID NO: 3965075 - DNA, 18 bp, Homo sapiens
actgcacagtgcatctca

SEQ ID NO: 3965076 - DNA, 23 bp, Homo sapiens
actgcacagtgcatctcagccca

SEQ ID NO: 3965077 - DNA, 13 bp, Homo sapiens
actgcagctgctg

SEQ ID NO: 3965078 - DNA, 17 bp, Homo sapiens
acacctccttgctttgc

SEQ ID NO: 3965079 - DNA, 19 bp, Homo sapiens
acacctctggatccctgga

SEQ ID NO: 3965080 - DNA, 11 bp, Homo sapiens
acacctgcacc

SEQ ID NO: 3965081 - DNA, 20 bp, Homo sapiens
acacctgccccagcgcggct

SEQ ID NO: 3965082 - DNA, 22 bp, Homo sapiens
acacctgccccagcgcggcttg

SEQ ID NO: 3965083 - DNA, 14 bp, Homo sapiens
acacctgccctgcc

SEQ ID NO: 3965084 - DNA, 15 bp, Homo sapiens
acacctgccctgccc

SEQ ID NO: 3965085 - DNA, 20 bp, Homo sapiens
acacctgccctgccctgcca

SEQ ID NO: 3965086 - DNA, 23 bp, Homo sapiens
acacctgccctgccctgccacct

SEQ ID NO: 3965087 - DNA, 20 bp, Homo sapiens
acaccttcttggcttctggg

SEQ ID NO: 3965088 - DNA, 21 bp, Homo sapiens
acaccttgtgaccttctctat

SEQ ID NO: 3965089 - DNA, 23 bp, Homo sapiens
acaccttgtgaccttctctatat

SEQ ID NO: 3965090 - DNA, 17 bp, Homo sapiens
acacctttgttttgcac

SEQ ID NO: 3965091 - DNA, 18 bp, Homo sapiens
acaccttttgtatttaaa

SEQ ID NO: 3965092 - DNA, 14 bp, Homo sapiens
acacgagcaggcta

SEQ ID NO: 3965093 - DNA, 21 bp, Homo sapiens
acacgagcaggctactgtcag

SEQ ID NO: 3965094 - DNA, 16 bp, Homo sapiens
acacgatcttgtaaga

SEQ ID NO: 3965095 - DNA, 22 bp, Homo sapiens
acacgcaagggcatcaggcact

SEQ ID NO: 3965096 - DNA, 23 bp, Homo sapiens
acacgcaagggcatcaggcactg

SEQ ID NO: 3965097 - DNA, 19 bp, Homo sapiens
acacgcaggaactcccagc

SEQ ID NO: 3965098 - DNA, 17 bp, Homo sapiens
acacggaggcatctgca

SEQ ID NO: 3965099 - DNA, 18 bp, Homo sapiens
acacggaggcatctgcac

SEQ ID NO: 3965100 - DNA, 13 bp, Homo sapiens
acacggcagctgt

SEQ ID NO: 3965101 - DNA, 15 bp, Homo sapiens
acacggtaggccaag

SEQ ID NO: 3965102 - DNA, 14 bp, Homo sapiens
acacgtgctcgcag

SEQ ID NO: 3965103 - DNA, 12 bp, Homo sapiens
acactaattcct

SEQ ID NO: 3965104 - DNA, 17 bp, Homo sapiens
acactcagaagcctggg

SEQ ID NO: 3965105 - DNA, 20 bp, Homo sapiens
acactccaccccctccagct

SEQ ID NO: 3965106 - DNA, 23 bp, Homo sapiens
acactccaccccctccagctcca

SEQ ID NO: 3965107 - DNA, 13 bp, Homo sapiens
acactcccaggga

SEQ ID NO: 3965108 - DNA, 23 bp, Homo sapiens
acactccccgcctgtcctgcctc

SEQ ID NO: 3965109 - DNA, 15 bp, Homo sapiens
acactgaatcatgtt

SEQ ID NO: 3965110 - DNA, 22 bp, Homo sapiens
acactgaccttggagagacaca

SEQ ID NO: 3965111 - DNA, 23 bp, Homo sapiens
acactgaccttggagagacacag

SEQ ID NO: 3965112 - DNA, 14 bp, Homo sapiens
acactgctgcacca

SEQ ID NO: 3965113 - DNA, 14 bp, Homo sapiens
acactggatatgtt

SEQ ID NO: 3965114 - DNA, 16 bp, Homo sapiens
acactgtaaacccctg

SEQ ID NO: 3965115 - DNA, 15 bp, Homo sapiens
acactgtgctataaa

SEQ ID NO: 3965116 - DNA, 22 bp, Homo sapiens
acacttcaggctcttctccttt

SEQ ID NO: 3965117 - DNA, 20 bp, Homo sapiens
acacttctcaggacacaggc

SEQ ID NO: 3965118 - DNA, 16 bp, Homo sapiens
acacttcttgaaacag

SEQ ID NO: 3965119 - DNA, 19 bp, Homo sapiens
acacttcttgaaacagcct

SEQ ID NO: 3965120 - DNA, 13 bp, Homo sapiens
acacttggagccc

SEQ ID NO: 3965121 - DNA, 16 bp, Homo sapiens
acacttgtataaatgt

SEQ ID NO: 3965122 - DNA, 21 bp, Homo sapiens
acactttggccaagcaagagg

SEQ ID NO: 3965123 - DNA, 18 bp, Homo sapiens
acagaaaaaaataaaaac

SEQ ID NO: 3965124 - DNA, 19 bp, Homo sapiens
acagaaaacaaaagagaga

SEQ ID NO: 3965125 - DNA, 17 bp, Homo sapiens
acagaaacaaaaacact

SEQ ID NO: 3965126 - DNA, 14 bp, Homo sapiens
acagaaacattttc

SEQ ID NO: 3965127 - DNA, 17 bp, Homo sapiens
acagaaatactgctctg

SEQ ID NO: 3965128 - DNA, 22 bp, Homo sapiens
acagaacaattaaacagccaaa

SEQ ID NO: 3965129 - DNA, 13 bp, Homo sapiens
acagaacactaaa

SEQ ID NO: 3965130 - DNA, 20 bp, Homo sapiens
acagaactgctaaatactgt

SEQ ID NO: 3965131 - DNA, 22 bp, Homo sapiens
acagaagcagttgagtcgtcat

SEQ ID NO: 3965132 - DNA, 16 bp, Homo sapiens
acagaagccaggagca

SEQ ID NO: 3965133 - DNA, 18 bp, Homo sapiens
acagaagcttcagaagtt

SEQ ID NO: 3965134 - DNA, 17 bp, Homo sapiens
acagaatgctgttttaa

SEQ ID NO: 3965135 - DNA, 20 bp, Homo sapiens
acagacaaaaacagcctcac

SEQ ID NO: 3965136 - DNA, 21 bp, Homo sapiens
acagacagatcccatccatca

SEQ ID NO: 3965137 - DNA, 18 bp, Homo sapiens
acagaccccttggctttt

SEQ ID NO: 3965138 - DNA, 23 bp, Homo sapiens
acagacgattaacacaccacact

SEQ ID NO: 3965139 - DNA, 17 bp, Homo sapiens
acagacgtctcaagact

SEQ ID NO: 3965140 - DNA, 21 bp, Homo sapiens
acagacgtctcaagactgaaa

SEQ ID NO: 3965141 - DNA, 19 bp, Homo sapiens
acagactccctcccctgcc

SEQ ID NO: 3965142 - DNA, 14 bp, Homo sapiens
acagagaaggcagg

SEQ ID NO: 3965143 - DNA, 12 bp, Homo sapiens
acagagaatctg

SEQ ID NO: 3965144 - DNA, 13 bp, Homo sapiens
acagggaaggcag

SEQ ID NO: 3965145 - DNA, 15 bp, Homo sapiens
acagggaaggcaggc

SEQ ID NO: 3965146 - DNA, 21 bp, Homo sapiens
acagggaaggcaggcagggct

SEQ ID NO: 3965147 - DNA, 21 bp, Homo sapiens
acagggagcccctaggaaagc

SEQ ID NO: 3965148 - DNA, 14 bp, Homo sapiens
acagggcaatcttg

SEQ ID NO: 3965149 - DNA, 23 bp, Homo sapiens
acagggcagtgacaagtggaggg

SEQ ID NO: 3965150 - DNA, 12 bp, Homo sapiens
acagggctcttt

SEQ ID NO: 3965151 - DNA, 15 bp, Homo sapiens
acaggggatcaaagt

SEQ ID NO: 3965152 - DNA, 16 bp, Homo sapiens
acaggggcaggcctgg

SEQ ID NO: 3965153 - DNA, 20 bp, Homo sapiens
acaggggcaggcctgggacc

SEQ ID NO: 3965154 - DNA, 23 bp, Homo sapiens
acaggggccccagatctgcctgg

SEQ ID NO: 3965155 - DNA, 17 bp, Homo sapiens
acagggtagcaggtacc

SEQ ID NO: 3965156 - DNA, 14 bp, Homo sapiens
acagggttttgtat

SEQ ID NO: 3965157 - DNA, 14 bp, Homo sapiens
acaggtaaccacaa

SEQ ID NO: 3965158 - DNA, 15 bp, Homo sapiens
acaggtaaccacaat

SEQ ID NO: 3965159 - DNA, 14 bp, Homo sapiens
acaggtatcaggca

SEQ ID NO: 3965160 - DNA, 16 bp, Homo sapiens
acaggtatcaggcaca

SEQ ID NO: 3965161 - DNA, 17 bp, Homo sapiens
acaggtatcaggcacag

SEQ ID NO: 3965162 - DNA, 19 bp, Homo sapiens
acaggtatcaggcacaggc

SEQ ID NO: 3965163 - DNA, 21 bp, Homo sapiens
acaggtatcaggcacaggcag

SEQ ID NO: 3965164 - DNA, 22 bp, Homo sapiens
acaggtatcaggcacaggcagg

SEQ ID NO: 3965165 - DNA, 23 bp, Homo sapiens
acaggtatcaggcacaggcagga

SEQ ID NO: 3965166 - DNA, 17 bp, Homo sapiens
acaggtctagactttct

SEQ ID NO: 3965167 - DNA, 16 bp, Homo sapiens
acaggtgtaaatatag

SEQ ID NO: 3965168 - DNA, 12 bp, Homo sapiens
acaggttcccag

SEQ ID NO: 3965169 - DNA, 14 bp, Homo sapiens
acaggttcccagca

SEQ ID NO: 3965170 - DNA, 14 bp, Homo sapiens
acaggttttataat

SEQ ID NO: 3965171 - DNA, 22 bp, Homo sapiens
acagtaaaaacttgtactatgt

SEQ ID NO: 3965172 - DNA, 23 bp, Homo sapiens
acagtaaagtttaaaaaatacac

SEQ ID NO: 3965173 - DNA, 12 bp, Homo sapiens
acagtagcttaa

SEQ ID NO: 3965174 - DNA, 15 bp, Homo sapiens
acagtagcttaaata

SEQ ID NO: 3965175 - DNA, 15 bp, Homo sapiens
acagtatatttgaaa

SEQ ID NO: 3965176 - DNA, 17 bp, Homo sapiens
acagtattctcagtgct

SEQ ID NO: 3965177 - DNA, 16 bp, Homo sapiens
acagtcaaaacagaga

SEQ ID NO: 3965178 - DNA, 14 bp, Homo sapiens
acagtcatttaaaa

SEQ ID NO: 3965179 - DNA, 16 bp, Homo sapiens
acagtcctcacagcct

SEQ ID NO: 3965180 - DNA, 22 bp, Homo sapiens
acagtcctcacagcctctccct

SEQ ID NO: 3965181 - DNA, 15 bp, Homo sapiens
acagtctcaggaaat

SEQ ID NO: 3965182 - DNA, 16 bp, Homo sapiens
acagtctcaggaaatc

SEQ ID NO: 3965183 - DNA, 16 bp, Homo sapiens
acagtctcccattctc

SEQ ID NO: 3965184 - DNA, 19 bp, Homo sapiens
acagtgacaaattgtaact

SEQ ID NO: 3965185 - DNA, 22 bp, Homo sapiens
acagtgacaaattgtaactaca

SEQ ID NO: 3965186 - DNA, 16 bp, Homo sapiens
acagtgacccttccca

SEQ ID NO: 3965187 - DNA, 12 bp, Homo sapiens
acagtgagccaa

SEQ ID NO: 3965188 - DNA, 15 bp, Homo sapiens
acagtgcatctcagc

SEQ ID NO: 3965189 - DNA, 18 bp, Homo sapiens
acagtgcatctcagccca

SEQ ID NO: 3965190 - DNA, 12 bp, Homo sapiens
acagtgctgctt

SEQ ID NO: 3965191 - DNA, 13 bp, Homo sapiens
acagtggagtgag

SEQ ID NO: 3965192 - DNA, 15 bp, Homo sapiens
acagtgggtggtgga

SEQ ID NO: 3965193 - DNA, 16 bp, Homo sapiens
acagtgtagcttgccc

SEQ ID NO: 3965194 - DNA, 19 bp, Homo sapiens
acagtgttgaaaatgttca

SEQ ID NO: 3965195 - DNA, 17 bp, Homo sapiens
acagtgtttgcaatggt

SEQ ID NO: 3965196 - DNA, 16 bp, Homo sapiens
acagttactcttcagt

SEQ ID NO: 3965197 - DNA, 18 bp, Homo sapiens
acagttactcttcagttt

SEQ ID NO: 3965198 - DNA, 23 bp, Homo sapiens
acagttatttatagtcatttatt

SEQ ID NO: 3965199 - DNA, 12 bp, Homo sapiens
acagttcctcgc

SEQ ID NO: 3965200 - DNA, 14 bp, Homo sapiens
acagttcctcgccc

SEQ ID NO: 3965201 - DNA, 15 bp, Homo sapiens
acagttcctcgccct

SEQ ID NO: 3965202 - DNA, 16 bp, Homo sapiens
acagttcctcgccctg

SEQ ID NO: 3965203 - DNA, 18 bp, Homo sapiens
acagttcctcgccctggg

SEQ ID NO: 3965204 - DNA, 13 bp, Homo sapiens
acagttccttcag

SEQ ID NO: 3965205 - DNA, 15 bp, Homo sapiens
acagttgctgtcata

SEQ ID NO: 3965206 - DNA, 14 bp, Homo sapiens
acagttggcagaga

SEQ ID NO: 3965207 - DNA, 21 bp, Homo sapiens
acagttggcagagaaggcctc

SEQ ID NO: 3965208 - DNA, 20 bp, Homo sapiens
acagttgtctattctgagcc

SEQ ID NO: 3965209 - DNA, 23 bp, Homo sapiens
acagttgtctattctgagccttg

SEQ ID NO: 3965210 - DNA, 16 bp, Homo sapiens
acagtttgatgtcatt

SEQ ID NO: 3965211 - DNA, 15 bp, Homo sapiens
acagttttctgagaa

SEQ ID NO: 3965212 - DNA, 16 bp, Homo sapiens
acagttttctgagaaa

SEQ ID NO: 3965213 - DNA, 18 bp, Homo sapiens
acagttttctgagaaaga

SEQ ID NO: 3965214 - DNA, 21 bp, Homo sapiens
acagttttctgagaaagacta

SEQ ID NO: 3965215 - DNA, 12 bp, Homo sapiens
acagtttttaaa

SEQ ID NO: 3965216 - DNA, 14 bp, Homo sapiens
acagtttttaaact

SEQ ID NO: 3965217 - DNA, 19 bp, Homo sapiens
acataaaatatacaaacat

SEQ ID NO: 3965218 - DNA, 20 bp, Homo sapiens
acataaaatatacaaacatg

SEQ ID NO: 3965219 - DNA, 21 bp, Homo sapiens
acataaagcaaatagacacag

SEQ ID NO: 3965220 - DNA, 13 bp, Homo sapiens
acataacaagaaa

SEQ ID NO: 3965221 - DNA, 15 bp, Homo sapiens
acataacaagaaaat

SEQ ID NO: 3965222 - DNA, 20 bp, Homo sapiens
acataactagtttaattaac

SEQ ID NO: 3965223 - DNA, 18 bp, Homo sapiens
acataacttgatatagaa

SEQ ID NO: 3965224 - DNA, 22 bp, Homo sapiens
acataacttgatatagaaagct

SEQ ID NO: 3965225 - DNA, 18 bp, Homo sapiens
acataattttttattcaa

SEQ ID NO: 3965226 - DNA, 20 bp, Homo sapiens
acatacaatttgcactgtta

SEQ ID NO: 3965227 - DNA, 12 bp, Homo sapiens
acatacatacat

SEQ ID NO: 3965228 - DNA, 17 bp, Homo sapiens
acatacatacatacata

SEQ ID NO: 3965229 - DNA, 15 bp, Homo sapiens
acatacatacatata

SEQ ID NO: 3965230 - DNA, 18 bp, Homo sapiens
acatacatacatatatat

SEQ ID NO: 3965231 - DNA, 21 bp, Homo sapiens
accaatgtacccaccgggcca

SEQ ID NO: 3965232 - DNA, 20 bp, Homo sapiens
accaattgtacattccctgc

SEQ ID NO: 3965233 - DNA, 16 bp, Homo sapiens
accaattttaaataca

SEQ ID NO: 3965234 - DNA, 17 bp, Homo sapiens
accacactgttgagttg

SEQ ID NO: 3965235 - DNA, 19 bp, Homo sapiens
accacactttgagaacctg

SEQ ID NO: 3965236 - DNA, 13 bp, Homo sapiens
accacagcgtccc

SEQ ID NO: 3965237 - DNA, 16 bp, Homo sapiens
accacagtgggtggca

SEQ ID NO: 3965238 - DNA, 20 bp, Homo sapiens
accacctaggccactcctcc

SEQ ID NO: 3965239 - DNA, 16 bp, Homo sapiens
accacctcactcctgt

SEQ ID NO: 3965240 - DNA, 16 bp, Homo sapiens
accaccttcccagctc

SEQ ID NO: 3965241 - DNA, 21 bp, Homo sapiens
accaccttcccagctctccct

SEQ ID NO: 3965242 - DNA, 14 bp, Homo sapiens
accaccttccctct

SEQ ID NO: 3965243 - DNA, 20 bp, Homo sapiens
accaccttggactcctccca

SEQ ID NO: 3965244 - DNA, 21 bp, Homo sapiens
accaccttggactcctcccac

SEQ ID NO: 3965245 - DNA, 17 bp, Homo sapiens
accacgatgtggccctg

SEQ ID NO: 3965246 - DNA, 20 bp, Homo sapiens
accacggacgtttccatcag

SEQ ID NO: 3965247 - DNA, 15 bp, Homo sapiens
accacgggcctcagt

SEQ ID NO: 3965248 - DNA, 16 bp, Homo sapiens
accacgtctgccaggc

SEQ ID NO: 3965249 - DNA, 19 bp, Homo sapiens
accacgtctgccaggccca

SEQ ID NO: 3965250 - DNA, 23 bp, Homo sapiens
accacgtctgccaggcccatctc

SEQ ID NO: 3965251 - DNA, 14 bp, Homo sapiens
accactagagctga

SEQ ID NO: 3965252 - DNA, 16 bp, Homo sapiens
accactctggcagcca

SEQ ID NO: 3965253 - DNA, 15 bp, Homo sapiens
accactgccctgcct

SEQ ID NO: 3965254 - DNA, 16 bp, Homo sapiens
accactgccctgcctg

SEQ ID NO: 3965255 - DNA, 18 bp, Homo sapiens
accactgccctgcctgcc

SEQ ID NO: 3965256 - DNA, 21 bp, Homo sapiens
accactgtcctggctgctctc

SEQ ID NO: 3965257 - DNA, 16 bp, Homo sapiens
accactgtgtatttaa

SEQ ID NO: 3965258 - DNA, 16 bp, Homo sapiens
accacttcttttataa

SEQ ID NO: 3965259 - DNA, 14 bp, Homo sapiens
accacttggctgct

SEQ ID NO: 3965260 - DNA, 20 bp, Homo sapiens
accagaaaacaaatcttcaa

SEQ ID NO: 3965261 - DNA, 15 bp, Homo sapiens
accagaatcataatt

SEQ ID NO: 3965262 - DNA, 17 bp, Homo sapiens
accagaattgtgcaaat

SEQ ID NO: 3965263 - DNA, 20 bp, Homo sapiens
accagactgtggagaaataa

SEQ ID NO: 3965264 - DNA, 16 bp, Homo sapiens
accagagccccccaca

SEQ ID NO: 3965265 - DNA, 19 bp, Homo sapiens
accagagccccccacaatg

SEQ ID NO: 3965266 - DNA, 20 bp, Homo sapiens
accagagccccccacaatga

SEQ ID NO: 3965267 - DNA, 12 bp, Homo sapiens
accagcaggtgt

SEQ ID NO: 3965268 - DNA, 13 bp, Homo sapiens
accagcaggtgtg

SEQ ID NO: 3965269 - DNA, 23 bp, Homo sapiens
accagcaggtgtggtggctcatg

SEQ ID NO: 3965270 - DNA, 13 bp, Homo sapiens
accagcattttac

SEQ ID NO: 3965271 - DNA, 19 bp, Homo sapiens
accagcattttactacttg

SEQ ID NO: 3965272 - DNA, 15 bp, Homo sapiens
accagccccctggat

SEQ ID NO: 3965273 - DNA, 19 bp, Homo sapiens
accagccccctggatgggc

SEQ ID NO: 3965274 - DNA, 16 bp, Homo sapiens
accagcccggcctgct

SEQ ID NO: 3965275 - DNA, 13 bp, Homo sapiens
accagcccttccc

SEQ ID NO: 3965276 - DNA, 15 bp, Homo sapiens
accagcccttccctg

SEQ ID NO: 3965277 - DNA, 21 bp, Homo sapiens
accagcctccatgctgcctcc

SEQ ID NO: 3965278 - DNA, 15 bp, Homo sapiens
accagctctgtggcc

SEQ ID NO: 3965279 - DNA, 23 bp, Homo sapiens
accagctctgtggcctgtgtcca

SEQ ID NO: 3965280 - DNA, 20 bp, Homo sapiens
accagctgaaagttgggact

SEQ ID NO: 3965281 - DNA, 17 bp, Homo sapiens
accagctgctgctctga

SEQ ID NO: 3965282 - DNA, 14 bp, Homo sapiens
accaggacaggacc

SEQ ID NO: 3965283 - DNA, 20 bp, Homo sapiens
accaggactatagcccaggt

SEQ ID NO: 3965284 - DNA, 21 bp, Homo sapiens
accaggactatagcccaggtc

SEQ ID NO: 3965285 - DNA, 14 bp, Homo sapiens
accaggatgaaggc

SEQ ID NO: 3965286 - DNA, 14 bp, Homo sapiens
accaggatggccct

SEQ ID NO: 3965287 - DNA, 22 bp, Homo sapiens
accaggcacgaacccacctgct

SEQ ID NO: 3965288 - DNA, 14 bp, Homo sapiens
accagggcgcaagc

SEQ ID NO: 3965289 - DNA, 24 bp, Homo sapiens
accaggggtgatttcagagagggc

SEQ ID NO: 3965290 - DNA, 20 bp, Homo sapiens
accagggtccgcaccagctg

SEQ ID NO: 3965291 - DNA, 16 bp, Homo sapiens
accagggtgcatggct

SEQ ID NO: 3965292 - DNA, 15 bp, Homo sapiens
accagtatggaaggg

SEQ ID NO: 3965293 - DNA, 21 bp, Homo sapiens
accagtatggaagggaggggt

SEQ ID NO: 3965294 - DNA, 19 bp, Homo sapiens
accagttaagaatggaaga

SEQ ID NO: 3965295 - DNA, 16 bp, Homo sapiens
accagttggccatgat

SEQ ID NO: 3965296 - DNA, 15 bp, Homo sapiens
accagttgggagcac

SEQ ID NO: 3965297 - DNA, 21 bp, Homo sapiens
accagttgggagcactggagt

SEQ ID NO: 3965298 - DNA, 14 bp, Homo sapiens
accatacattatca

SEQ ID NO: 3965299 - DNA, 19 bp, Homo sapiens
accatactcatttctaaaa

SEQ ID NO: 3965300 - DNA, 14 bp, Homo sapiens
accatagaacagaa

SEQ ID NO: 3965301 - DNA, 17 bp, Homo sapiens
accatatgtctgcttct

SEQ ID NO: 3965302 - DNA, 13 bp, Homo sapiens
accatcaaatgct

SEQ ID NO: 3965303 - DNA, 15 bp, Homo sapiens
accatcaatggaaac

SEQ ID NO: 3965304 - DNA, 13 bp, Homo sapiens
accatcctattta

SEQ ID NO: 3965305 - DNA, 14 bp, Homo sapiens
accatcctggcccc

SEQ ID NO: 3965306 - DNA, 23 bp, Homo sapiens
accatgagaataagagaaagaaa

SEQ ID NO: 3965307 - DNA, 18 bp, Homo sapiens
accatgagcaattctcct

SEQ ID NO: 3965308 - DNA, 17 bp, Homo sapiens
accatgcagcttcatca

SEQ ID NO: 3965309 - DNA, 20 bp, Homo sapiens
accatgcagcttcatcaatt

SEQ ID NO: 3965310 - DNA, 12 bp, Homo sapiens
accatgccaggg

SEQ ID NO: 3965311 - DNA, 12 bp, Homo sapiens
accatgctgctt

SEQ ID NO: 3965312 - DNA, 17 bp, Homo sapiens
accatgtaacaaccaga

SEQ ID NO: 3965313 - DNA, 16 bp, Homo sapiens
accatgtagttttaac

SEQ ID NO: 3965314 - DNA, 21 bp, Homo sapiens
accatgtagttttaacagaac

SEQ ID NO: 3965315 - DNA, 13 bp, Homo sapiens
accattcacattt

SEQ ID NO: 3965316 - DNA, 19 bp, Homo sapiens
accattcacatttgatgta

SEQ ID NO: 3965317 - DNA, 12 bp, Homo sapiens
accattccccat

SEQ ID NO: 3965318 - DNA, 20 bp, Homo sapiens
acctcagctgcacattcctg

SEQ ID NO: 3965319 - DNA, 22 bp, Homo sapiens
acctcagctgcacattcctggc

SEQ ID NO: 3965320 - DNA, 19 bp, Homo sapiens
acctcagggacaacatttt

SEQ ID NO: 3965321 - DNA, 20 bp, Homo sapiens
acctcatctacaagcatttg

SEQ ID NO: 3965322 - DNA, 23 bp, Homo sapiens
acctcatgcctggcccccctcca

SEQ ID NO: 3965323 - DNA, 22 bp, Homo sapiens
acctccacccccgccacggcca

SEQ ID NO: 3965324 - DNA, 17 bp, Homo sapiens
acctccagctttcctgt

SEQ ID NO: 3965325 - DNA, 15 bp, Homo sapiens
acctcccagccctat

SEQ ID NO: 3965326 - DNA, 19 bp, Homo sapiens
acctcccagccctatggat

SEQ ID NO: 3965327 - DNA, 21 bp, Homo sapiens
acctcccagccctatggatgt

SEQ ID NO: 3965328 - DNA, 15 bp, Homo sapiens
acctccccccactgc

SEQ ID NO: 3965329 - DNA, 17 bp, Homo sapiens
acctccccccactgcag

SEQ ID NO: 3965330 - DNA, 14 bp, Homo sapiens
acctcccctatcca

SEQ ID NO: 3965331 - DNA, 17 bp, Homo sapiens
acctcccctatccaccc

SEQ ID NO: 3965332 - DNA, 18 bp, Homo sapiens
acctcccctatccaccca

SEQ ID NO: 3965333 - DNA, 11 bp, Homo sapiens
acctccctact

SEQ ID NO: 3965334 - DNA, 15 bp, Homo sapiens
acctccctgaaccat

SEQ ID NO: 3965335 - DNA, 23 bp, Homo sapiens
acctcctagaggtgggcagctgg

SEQ ID NO: 3965336 - DNA, 22 bp, Homo sapiens
acctcctattttaattggaatt

SEQ ID NO: 3965337 - DNA, 20 bp, Homo sapiens
acctcctccactcactccag

SEQ ID NO: 3965338 - DNA, 21 bp, Homo sapiens
acctcctgagaaggcgaggag

SEQ ID NO: 3965339 - DNA, 15 bp, Homo sapiens
acctcctgcccagga

SEQ ID NO: 3965340 - DNA, 16 bp, Homo sapiens
acctcctgcccaggag

SEQ ID NO: 3965341 - DNA, 18 bp, Homo sapiens
acctcctgcccaggagag

SEQ ID NO: 3965342 - DNA, 19 bp, Homo sapiens
acctcctgcccaggagagc

SEQ ID NO: 3965343 - DNA, 19 bp, Homo sapiens
acctccttgctttgctgtt

SEQ ID NO: 3965344 - DNA, 14 bp, Homo sapiens
acctcgtcctcccc

SEQ ID NO: 3965345 - DNA, 19 bp, Homo sapiens
acctctcaatattcaataa

SEQ ID NO: 3965346 - DNA, 20 bp, Homo sapiens
acctctcaatattcaataaa

SEQ ID NO: 3965347 - DNA, 23 bp, Homo sapiens
acctctcaatattcaataaagct

SEQ ID NO: 3965348 - DNA, 20 bp, Homo sapiens
acctctcctttggccattcc

SEQ ID NO: 3965349 - DNA, 20 bp, Homo sapiens
acctctctctaagtttagaa

SEQ ID NO: 3965350 - DNA, 19 bp, Homo sapiens
acctctgaaggcaaatata

SEQ ID NO: 3965351 - DNA, 14 bp, Homo sapiens
acctctgatccctc

SEQ ID NO: 3965352 - DNA, 12 bp, Homo sapiens
acctctgcctca

SEQ ID NO: 3965353 - DNA, 14 bp, Homo sapiens
acctctgcctcaat

SEQ ID NO: 3965354 - DNA, 23 bp, Homo sapiens
acctctgctctgaggcttccaga

SEQ ID NO: 3965355 - DNA, 15 bp, Homo sapiens
acctctgctgcctcc

SEQ ID NO: 3965356 - DNA, 13 bp, Homo sapiens
acctctgtaattt

SEQ ID NO: 3965357 - DNA, 15 bp, Homo sapiens
acctcttcctcctgg

SEQ ID NO: 3965358 - DNA, 15 bp, Homo sapiens
acctcttctatgcaa

SEQ ID NO: 3965359 - DNA, 22 bp, Homo sapiens
acctcttctatgcaagccttgc

SEQ ID NO: 3965360 - DNA, 16 bp, Homo sapiens
acctcttctcttcctg

SEQ ID NO: 3965361 - DNA, 21 bp, Homo sapiens
acctcttctcttcctgtaaca

SEQ ID NO: 3965362 - DNA, 19 bp, Homo sapiens
acctctttattttttgatt

SEQ ID NO: 3965363 - DNA, 18 bp, Homo sapiens
acctgaaaaaaagtttac

SEQ ID NO: 3965364 - DNA, 21 bp, Homo sapiens
acctgaaaaaaagtttacaag

SEQ ID NO: 3965365 - DNA, 15 bp, Homo sapiens
acctgacacaagagg

SEQ ID NO: 3965366 - DNA, 14 bp, Homo sapiens
acctgacacatctt

SEQ ID NO: 3965367 - DNA, 23 bp, Homo sapiens
acctgagaccagttgggagcact

SEQ ID NO: 3965368 - DNA, 16 bp, Homo sapiens
acctgagcctgccgag

SEQ ID NO: 3965369 - DNA, 17 bp, Homo sapiens
acctgagcctgccgagc

SEQ ID NO: 3965370 - DNA, 21 bp, Homo sapiens
acctgagcctgccgagcaacc

SEQ ID NO: 3965371 - DNA, 15 bp, Homo sapiens
acctgaggcctgaag

SEQ ID NO: 3965372 - DNA, 18 bp, Homo sapiens
acctgagtctgctatatt

SEQ ID NO: 3965373 - DNA, 18 bp, Homo sapiens
acctgatcatggtcagct

SEQ ID NO: 3965374 - DNA, 17 bp, Homo sapiens
acctgatgccccttccc

SEQ ID NO: 3965375 - DNA, 13 bp, Homo sapiens
acctgcaaaaaat

SEQ ID NO: 3965376 - DNA, 19 bp, Homo sapiens
acctgcaagccccagggcc

SEQ ID NO: 3965377 - DNA, 20 bp, Homo sapiens
acctgcaagccccagggcct

SEQ ID NO: 3965378 - DNA, 21 bp, Homo sapiens
acctgcaagccccagggcctg

SEQ ID NO: 3965379 - DNA, 22 bp, Homo sapiens
acctgcaagccccagggcctgg

SEQ ID NO: 3965380 - DNA, 14 bp, Homo sapiens
acctgcacctcccc

SEQ ID NO: 3965381 - DNA, 19 bp, Homo sapiens
acctgcacctccccccact

SEQ ID NO: 3965382 - DNA, 21 bp, Homo sapiens
acctgcatccgtagttccctg

SEQ ID NO: 3965383 - DNA, 21 bp, Homo sapiens
acctgcatgtgttgtacaata

SEQ ID NO: 3965384 - DNA, 12 bp, Homo sapiens
acctgccagcca

SEQ ID NO: 3965385 - DNA, 14 bp, Homo sapiens
acctgccagccatc

SEQ ID NO: 3965386 - DNA, 15 bp, Homo sapiens
acctgccagccatca

SEQ ID NO: 3965387 - DNA, 14 bp, Homo sapiens
acctgccctctctc

SEQ ID NO: 3965388 - DNA, 16 bp, Homo sapiens
acctgccctctctcag

SEQ ID NO: 3965389 - DNA, 17 bp, Homo sapiens
acctgccctctctcagt

SEQ ID NO: 3965390 - DNA, 12 bp, Homo sapiens
acctgccctgcc

SEQ ID NO: 3965391 - DNA, 17 bp, Homo sapiens
acctgccctgcccccac

SEQ ID NO: 3965392 - DNA, 21 bp, Homo sapiens
acctgccctgccctgccacct

SEQ ID NO: 3965393 - DNA, 11 bp, Homo sapiens
acctgcctctc

SEQ ID NO: 3965394 - DNA, 22 bp, Homo sapiens
acctgcggctgctgtgtgcctt

SEQ ID NO: 3965395 - DNA, 12 bp, Homo sapiens
acctgctctcct

SEQ ID NO: 3965396 - DNA, 19 bp, Homo sapiens
acctgctctcctcttgcca

SEQ ID NO: 3965397 - DNA, 16 bp, Homo sapiens
acctgctgagagaccc

SEQ ID NO: 3965398 - DNA, 22 bp, Homo sapiens
acctgctgagagacccaaggag

SEQ ID NO: 3965399 - DNA, 18 bp, Homo sapiens
acctgctgagctctgaga

SEQ ID NO: 3965400 - DNA, 20 bp, Homo sapiens
acctgctgagctctgagagg

SEQ ID NO: 3965401 - DNA, 21 bp, Homo sapiens
acctgctgagctctgagaggc

SEQ ID NO: 3965402 - DNA, 23 bp, Homo sapiens
acctgctgagctctgagaggccc

SEQ ID NO: 3965403 - DNA, 17 bp, Homo sapiens
acctgctgggtaaactg

SEQ ID NO: 3965404 - DNA, 23 bp, Homo sapiens
acgagtaagatattatttaaatg

SEQ ID NO: 3965405 - DNA, 17 bp, Homo sapiens
acgagtcacctgcaagc

SEQ ID NO: 3965406 - DNA, 15 bp, Homo sapiens
acgatgtcaaggact

SEQ ID NO: 3965407 - DNA, 17 bp, Homo sapiens
acgatgtggccctggcc

SEQ ID NO: 3965408 - DNA, 22 bp, Homo sapiens
acgatgtggccctggcctgctg

SEQ ID NO: 3965409 - DNA, 13 bp, Homo sapiens
acgattttgcaca

SEQ ID NO: 3965410 - DNA, 14 bp, Homo sapiens
acgcacacatggac

SEQ ID NO: 3965411 - DNA, 15 bp, Homo sapiens
acgcacagccaagga

SEQ ID NO: 3965412 - DNA, 22 bp, Homo sapiens
acgcagaggcggaaaccttgca

SEQ ID NO: 3965413 - DNA, 23 bp, Homo sapiens
acgcagcagctgggacccctccc

SEQ ID NO: 3965414 - DNA, 12 bp, Homo sapiens
acgcagccctgg

SEQ ID NO: 3965415 - DNA, 21 bp, Homo sapiens
acgcagccctgggggccagct

SEQ ID NO: 3965416 - DNA, 18 bp, Homo sapiens
acgccagtttcaccattt

SEQ ID NO: 3965417 - DNA, 18 bp, Homo sapiens
acgcccagctgaggctgg

SEQ ID NO: 3965418 - DNA, 17 bp, Homo sapiens
tttaatgttttctgctg

SEQ ID NO: 3965419 - DNA, 13 bp, Homo sapiens
tttaatttaaagc

SEQ ID NO: 3965420 - DNA, 16 bp, Homo sapiens
tttaatttgatacaaa

SEQ ID NO: 3965421 - DNA, 23 bp, Homo sapiens
tttacagctcttggcattttcct

SEQ ID NO: 3965422 - DNA, 20 bp, Homo sapiens
tttacagtaaataaattgtt

SEQ ID NO: 3965423 - DNA, 14 bp, Homo sapiens
tttacatgaacaca

SEQ ID NO: 3965424 - DNA, 20 bp, Homo sapiens
tttacatgcaatttattaaa

SEQ ID NO: 3965425 - DNA, 18 bp, Homo sapiens
tttaccagggatgtagat

SEQ ID NO: 3965426 - DNA, 17 bp, Homo sapiens
tttacccagtgggacag

SEQ ID NO: 3965427 - DNA, 20 bp, Homo sapiens
tttactaaagagacatattt

SEQ ID NO: 3965428 - DNA, 20 bp, Homo sapiens
tttactaaagatatcagagc

SEQ ID NO: 3965429 - DNA, 15 bp, Homo sapiens
tttactaagtaaaag

SEQ ID NO: 3965430 - DNA, 20 bp, Homo sapiens
tttactcccttcctggcctc

SEQ ID NO: 3965431 - DNA, 21 bp, Homo sapiens
tttactctatgccccaaatat

SEQ ID NO: 3965432 - DNA, 22 bp, Homo sapiens
tttactctatgccccaaatata

SEQ ID NO: 3965433 - DNA, 22 bp, Homo sapiens
tttacttgtagaaatctgtaat

SEQ ID NO: 3965434 - DNA, 14 bp, Homo sapiens
tttagattccagga

SEQ ID NO: 3965435 - DNA, 16 bp, Homo sapiens
tttagatttcaagaaa

SEQ ID NO: 3965436 - DNA, 13 bp, Homo sapiens
tttagccagtgac

SEQ ID NO: 3965437 - DNA, 14 bp, Homo sapiens
tttagctatgtgga

SEQ ID NO: 3965438 - DNA, 16 bp, Homo sapiens
tttagcttctctgcca

SEQ ID NO: 3965439 - DNA, 16 bp, Homo sapiens
tttaggcaagagaaaa

SEQ ID NO: 3965440 - DNA, 20 bp, Homo sapiens
tttaggcagcctgccgccgt

SEQ ID NO: 3965441 - DNA, 19 bp, Homo sapiens
tttaggcagggatttgagg

SEQ ID NO: 3965442 - DNA, 17 bp, Homo sapiens
tttagtgactgtaatta

SEQ ID NO: 3965443 - DNA, 14 bp, Homo sapiens
tttagttatagttt

SEQ ID NO: 3965444 - DNA, 15 bp, Homo sapiens
tttagttatagtttc

SEQ ID NO: 3965445 - DNA, 14 bp, Homo sapiens
tttagttgaaaaat

SEQ ID NO: 3965446 - DNA, 16 bp, Homo sapiens
tttataagcaaatttc

SEQ ID NO: 3965447 - DNA, 18 bp, Homo sapiens
tttatacaaaataattta

SEQ ID NO: 3965448 - DNA, 22 bp, Homo sapiens
tttatacaaaataatttaacta

SEQ ID NO: 3965449 - DNA, 11 bp, Homo sapiens
tttatacatag

SEQ ID NO: 3965450 - DNA, 20 bp, Homo sapiens
tttatacatagtcacaaaaa

SEQ ID NO: 3965451 - DNA, 21 bp, Homo sapiens
tttatacatatcagaaaagta

SEQ ID NO: 3965452 - DNA, 19 bp, Homo sapiens
tttatactccatacataac

SEQ ID NO: 3965453 - DNA, 23 bp, Homo sapiens
tttatactctagaacatgcacat

SEQ ID NO: 3965454 - DNA, 17 bp, Homo sapiens
tttatagctattactgt

SEQ ID NO: 3965455 - DNA, 20 bp, Homo sapiens
tttatagctattactgtctg

SEQ ID NO: 3965456 - DNA, 15 bp, Homo sapiens
tttatatatggcata

SEQ ID NO: 3965457 - DNA, 17 bp, Homo sapiens
tttatatcagcctgagt

SEQ ID NO: 3965458 - DNA, 15 bp, Homo sapiens
tttatattgtatatt

SEQ ID NO: 3965459 - DNA, 13 bp, Homo sapiens
tttatatttggaa

SEQ ID NO: 3965460 - DNA, 22 bp, Homo sapiens
tttatcaaacagaattttaaag

SEQ ID NO: 3965461 - DNA, 24 bp, Homo sapiens
tttatcagtgcttaatgtgaacta

SEQ ID NO: 3965462 - DNA, 15 bp, Homo sapiens
tttatcatgacatgt

SEQ ID NO: 3965463 - DNA, 23 bp, Homo sapiens
tttatcatgacatgttatatatt

SEQ ID NO: 3965464 - DNA, 14 bp, Homo sapiens
tttatccttaggaa

SEQ ID NO: 3965465 - DNA, 18 bp, Homo sapiens
tttatcgtttattgctta

SEQ ID NO: 3965466 - DNA, 14 bp, Homo sapiens
tttatctctattta

SEQ ID NO: 3965467 - DNA, 13 bp, Homo sapiens
tttatctgtcaca

SEQ ID NO: 3965468 - DNA, 20 bp, Homo sapiens
tttatgagtcagtctctctc

SEQ ID NO: 3965469 - DNA, 18 bp, Homo sapiens
tttatgcttaaaatatgt

SEQ ID NO: 3965470 - DNA, 21 bp, Homo sapiens
tttatggcatgatttatatat

SEQ ID NO: 3965471 - DNA, 22 bp, Homo sapiens
tttatggggctgaacggggaga

SEQ ID NO: 3965472 - DNA, 22 bp, Homo sapiens
tttatggtgtgttcctaacata

SEQ ID NO: 3965473 - DNA, 18 bp, Homo sapiens
tttatgtctatttaagcc

SEQ ID NO: 3965474 - DNA, 23 bp, Homo sapiens
tttattaaaatgattgtaaaata

SEQ ID NO: 3965475 - DNA, 13 bp, Homo sapiens
tttattactgatt

SEQ ID NO: 3965476 - DNA, 16 bp, Homo sapiens
tttattagctgtaaat

SEQ ID NO: 3965477 - DNA, 20 bp, Homo sapiens
tttattcatgccatctgttt

SEQ ID NO: 3965478 - DNA, 17 bp, Homo sapiens
tttattctgttttcttg

SEQ ID NO: 3965479 - DNA, 16 bp, Homo sapiens
tttattctttttaaag

SEQ ID NO: 3965480 - DNA, 13 bp, Homo sapiens
ttggcagagaagg

SEQ ID NO: 3965481 - DNA, 14 bp, Homo sapiens
ttggcagagaaggc

SEQ ID NO: 3965482 - DNA, 19 bp, Homo sapiens
ttggccactgggtctcact

SEQ ID NO: 3965483 - DNA, 11 bp, Homo sapiens
ttggccgccat

SEQ ID NO: 3965484 - DNA, 23 bp, Homo sapiens
ttggccgtggccatcagggtggg

SEQ ID NO: 3965485 - DNA, 12 bp, Homo sapiens
ttggctcaccca

SEQ ID NO: 3965486 - DNA, 22 bp, Homo sapiens
ttggctcacccaagcaaggcca

SEQ ID NO: 3965487 - DNA, 20 bp, Homo sapiens
ttggctggatgaaattttct

SEQ ID NO: 3965488 - DNA, 16 bp, Homo sapiens
ttggcttcctccgtcc

SEQ ID NO: 3965489 - DNA, 15 bp, Homo sapiens
ttggcttctcctgtg

SEQ ID NO: 3965490 - DNA, 17 bp, Homo sapiens
ttggcttctcctgtgac

SEQ ID NO: 3965491 - DNA, 15 bp, Homo sapiens
ttgggatcagcctcc

SEQ ID NO: 3965492 - DNA, 17 bp, Homo sapiens
ttgggatttatatctat

SEQ ID NO: 3965493 - DNA, 20 bp, Homo sapiens
ttgggcacccccagcctggg

SEQ ID NO: 3965494 - DNA, 20 bp, Homo sapiens
ttgggcatccacccagtgct

SEQ ID NO: 3965495 - DNA, 20 bp, Homo sapiens
ttgggccagctgtcgcatct

SEQ ID NO: 3965496 - DNA, 18 bp, Homo sapiens
ttgggctttgcaggctct

SEQ ID NO: 3965497 - DNA, 19 bp, Homo sapiens
ttgggctttgcaggctctg

SEQ ID NO: 3965498 - DNA, 13 bp, Homo sapiens
ttggggaccagag

SEQ ID NO: 3965499 - DNA, 23 bp, Homo sapiens
ttggggagggggaagagaaattt

SEQ ID NO: 3965500 - DNA, 23 bp, Homo sapiens
ttggggcaggagtagctgagctc

SEQ ID NO: 3965501 - DNA, 16 bp, Homo sapiens
ttggggcctggcttgc

SEQ ID NO: 3965502 - DNA, 13 bp, Homo sapiens
ttggggtcagcca

SEQ ID NO: 3965503 - DNA, 16 bp, Homo sapiens
ttggggtctgccacca

SEQ ID NO: 3965504 - DNA, 22 bp, Homo sapiens
ttggggttcccccagacagagc

SEQ ID NO: 3965505 - DNA, 16 bp, Homo sapiens
ttgggtactactgctg

SEQ ID NO: 3965506 - DNA, 22 bp, Homo sapiens
ttgggtcctgcaatctccaggg

SEQ ID NO: 3965507 - DNA, 21 bp, Homo sapiens
ttggtaacatcctttctattg

SEQ ID NO: 3965508 - DNA, 23 bp, Homo sapiens
ttggtcccgtgcagcttctgtcc

SEQ ID NO: 3965509 - DNA, 20 bp, Homo sapiens
ttggtgataagtggaaaaaa

SEQ ID NO: 3965510 - DNA, 14 bp, Homo sapiens
ttggtgcctgcctc

SEQ ID NO: 3965511 - DNA, 17 bp, Homo sapiens
ttggtgcctgcctctgc

SEQ ID NO: 3965512 - DNA, 16 bp, Homo sapiens
ttggtgtgtggagatg

SEQ ID NO: 3965513 - DNA, 13 bp, Homo sapiens
ttggttagctgga

SEQ ID NO: 3965514 - DNA, 18 bp, Homo sapiens
ttggttgtcaatattaaa

SEQ ID NO: 3965515 - DNA, 17 bp, Homo sapiens
ttggtttggggagaaat

SEQ ID NO: 3965516 - DNA, 18 bp, Homo sapiens
ttgtaaaaacaaaaagac

SEQ ID NO: 3965517 - DNA, 21 bp, Homo sapiens
ttgtaaaagaacagtaaacat

SEQ ID NO: 3965518 - DNA, 12 bp, Homo sapiens
ttgtaaatacac

SEQ ID NO: 3965519 - DNA, 16 bp, Homo sapiens
ttgtaaatatttatgt

SEQ ID NO: 3965520 - DNA, 22 bp, Homo sapiens
ttgtaaatgaccaagaaaaaga

SEQ ID NO: 3965521 - DNA, 14 bp, Homo sapiens
ttgtaaattttaga

SEQ ID NO: 3965522 - DNA, 12 bp, Homo sapiens
ttgtaagtttat

SEQ ID NO: 3965523 - DNA, 16 bp, Homo sapiens
ttgtaattagtaataa

SEQ ID NO: 3965524 - DNA, 17 bp, Homo sapiens
ttgtaattgcttacatt

SEQ ID NO: 3965525 - DNA, 19 bp, Homo sapiens
ttgtaattgcttacatttt

SEQ ID NO: 3965526 - DNA, 23 bp, Homo sapiens
ttgtacaaaataaacaaataaca

SEQ ID NO: 3965527 - DNA, 14 bp, Homo sapiens
ttgtacaaatactg

SEQ ID NO: 3965528 - DNA, 19 bp, Homo sapiens
ttgtacaattactaaattg

SEQ ID NO: 3965529 - DNA, 12 bp, Homo sapiens
ttgtacagaatt

SEQ ID NO: 3965530 - DNA, 16 bp, Homo sapiens
ttgtacatagttattt

SEQ ID NO: 3965531 - DNA, 18 bp, Homo sapiens
ttgtaccccatcccttcc

SEQ ID NO: 3965532 - DNA, 17 bp, Homo sapiens
ttgtacgtaaagcttaa

SEQ ID NO: 3965533 - DNA, 16 bp, Homo sapiens
ttgtacgttatatatt

SEQ ID NO: 3965534 - DNA, 22 bp, Homo sapiens
ttgtagaaacacagttttgaaa

SEQ ID NO: 3965535 - DNA, 16 bp, Homo sapiens
ttgtagaaatctgtaa

SEQ ID NO: 3965536 - DNA, 14 bp, Homo sapiens
ttgtagaataataa

SEQ ID NO: 3965537 - DNA, 16 bp, Homo sapiens
ttgtagaccactgtcc

SEQ ID NO: 3965538 - DNA, 18 bp, Homo sapiens
ttgtagttcttgtgcatg

SEQ ID NO: 3965539 - DNA, 19 bp, Homo sapiens
ttgtataaataataaagaa

SEQ ID NO: 3965540 - DNA, 22 bp, Homo sapiens
ttgtataaatgtatatacacat

SEQ ID NO: 3965541 - DNA, 21 bp, Homo sapiens
ttgtataagattagaatgaaa

SEQ ID NO: 3965542 - DNA, 12 bp, Homo sapiens
ttgtatatacat

SEQ ID NO: 3965543 - DNA, 13 bp, Homo sapiens
ttgtatatacata

SEQ ID NO: 3965544 - DNA, 16 bp, Homo sapiens
ttgtatatacatatta

SEQ ID NO: 3965545 - DNA, 18 bp, Homo sapiens
ttgtatatacatattata

SEQ ID NO: 3965546 - DNA, 11 bp, Homo sapiens
ttgtatatatc

SEQ ID NO: 3965547 - DNA, 19 bp, Homo sapiens
ttgtatatatctgcttcag

SEQ ID NO: 3965548 - DNA, 17 bp, Homo sapiens
ttgtatattctggaaaa

SEQ ID NO: 3965549 - DNA, 19 bp, Homo sapiens
ttgtatcacaaatcttaac

SEQ ID NO: 3965550 - DNA, 14 bp, Homo sapiens
ttgtattttaaatg

SEQ ID NO: 3965551 - DNA, 22 bp, Homo sapiens
ttgtcaaatgtcattatgtaga

SEQ ID NO: 3965552 - DNA, 18 bp, Homo sapiens
ttgtcaatattaaataca

SEQ ID NO: 3965553 - DNA, 19 bp, Homo sapiens
ttgtcaatattaaatacag

SEQ ID NO: 3965554 - DNA, 23 bp, Homo sapiens
ttgtcactgtcttcacaacctcc

SEQ ID NO: 3965555 - DNA, 15 bp, Homo sapiens
ttgtcaggacccagg

SEQ ID NO: 3965556 - DNA, 23 bp, Homo sapiens
ttgtcatatattcatgtaataaa

SEQ ID NO: 3965557 - DNA, 23 bp, Homo sapiens
ttgtcatcattgtatatatgtgt

SEQ ID NO: 3965558 - DNA, 13 bp, Homo sapiens
ttgtcattatgta

SEQ ID NO: 3965559 - DNA, 20 bp, Homo sapiens
ttgtcattcaagcctgtgaa

SEQ ID NO: 3965560 - DNA, 19 bp, Homo sapiens
ttgtccaatggctgtaaac

SEQ ID NO: 3965561 - DNA, 20 bp, Homo sapiens
ttgtccacagtctcccattc

SEQ ID NO: 3965562 - DNA, 13 bp, Homo sapiens
ttgtccagcgcct

SEQ ID NO: 3965563 - DNA, 18 bp, Homo sapiens
ttgtccatatcagacctc

SEQ ID NO: 3965564 - DNA, 20 bp, Homo sapiens
ttgtccatgtgcttccctag

SEQ ID NO: 3965565 - DNA, 13 bp, Homo sapiens
ttgtccccagggc

SEQ ID NO: 3965566 - DNA, 14 bp, Homo sapiens
ttgtccccagggcc

SEQ ID NO: 3965567 - DNA, 15 bp, Homo sapiens
ttgtccccagggccc

SEQ ID NO: 3965568 - DNA, 14 bp, Homo sapiens
ttgtccctgctcct

SEQ ID NO: 3965569 - DNA, 18 bp, Homo sapiens
ttgtccctggtgcagagg

SEQ ID NO: 3965570 - DNA, 15 bp, Homo sapiens
ttgtcctatgtcaat

SEQ ID NO: 3965571 - DNA, 19 bp, Homo sapiens
ttgtcctcccctattttaa

SEQ ID NO: 3965572 - DNA, 13 bp, Homo sapiens
ttgtcctctcccg

SEQ ID NO: 3965573 - DNA, 15 bp, Homo sapiens
ttgtcctgccagctg

SEQ ID NO: 3965574 - DNA, 17 bp, Homo sapiens
ttgtcctgccagctgcc

SEQ ID NO: 3965575 - DNA, 21 bp, Homo sapiens
ttgtcctgccagctgccttcc

SEQ ID NO: 3965576 - DNA, 16 bp, Homo sapiens
ttgtccttcagagctc

SEQ ID NO: 3965577 - DNA, 16 bp, Homo sapiens
ttgtctattctgagcc

SEQ ID NO: 3965578 - DNA, 17 bp, Homo sapiens
ttgtctattctgagcct

SEQ ID NO: 3965579 - DNA, 18 bp, Homo sapiens
ttgtctattctgagcctt

SEQ ID NO: 3965580 - DNA, 23 bp, Homo sapiens
ttgtctcctacctgctgctgcta

SEQ ID NO: 3965581 - DNA, 11 bp, Homo sapiens
ttgtctctgag

SEQ ID NO: 3965582 - DNA, 11 bp, Homo sapiens
ttgtcttccaa

SEQ ID NO: 3965583 - DNA, 12 bp, Homo sapiens
ttgtcttccaac

SEQ ID NO: 3965584 - DNA, 18 bp, Homo sapiens
ttgtcttccaaccccagc

SEQ ID NO: 3965585 - DNA, 22 bp, Homo sapiens
ttgtcttccaaccccagctggc

SEQ ID NO: 3965586 - DNA, 23 bp, Homo sapiens
ttgtgacaggaaagccctccccc

SEQ ID NO: 3965587 - DNA, 12 bp, Homo sapiens
ttgtgagatggg

SEQ ID NO: 3965588 - DNA, 21 bp, Homo sapiens
ttgtgagtgactcggtgtaaa

SEQ ID NO: 3965589 - DNA, 22 bp, Homo sapiens
ttgtgatgtcccaacttgtaaa

SEQ ID NO: 3965590 - DNA, 22 bp, Homo sapiens
ttgtgattttgtacagaatttt

SEQ ID NO: 3965591 - DNA, 16 bp, Homo sapiens
ttgtgcatgtttactt

SEQ ID NO: 3965592 - DNA, 16 bp, Homo sapiens
ttgtgcttaaattatt

SEQ ID NO: 3965593 - DNA, 21 bp, Homo sapiens
ttgtggaattgggagcttggg

SEQ ID NO: 3965594 - DNA, 16 bp, Homo sapiens
ttgtggataagggaga

SEQ ID NO: 3965595 - DNA, 17 bp, Homo sapiens
ttgtggatgctccaggg

SEQ ID NO: 3965596 - DNA, 14 bp, Homo sapiens
ttgtggtttatgtc

SEQ ID NO: 3965597 - DNA, 13 bp, Homo sapiens
ttgtgtatgtgta

SEQ ID NO: 3965598 - DNA, 14 bp, Homo sapiens
ttgtgtatgtgtat

SEQ ID NO: 3965599 - DNA, 18 bp, Homo sapiens
ttgttaaaaatattttct

SEQ ID NO: 3965600 - DNA, 14 bp, Homo sapiens
ttgttatgctatta

SEQ ID NO: 3965601 - DNA, 14 bp, Homo sapiens
ttgttattgtggaa

SEQ ID NO: 3965602 - DNA, 15 bp, Homo sapiens
ttgttatttgtacag

SEQ ID NO: 3965603 - DNA, 13 bp, Homo sapiens
ttgttattttcag

SEQ ID NO: 3965604 - DNA, 12 bp, Homo sapiens
ttgttcccacac

SEQ ID NO: 3965605 - DNA, 16 bp, Homo sapiens
ttgttccttaccttta

SEQ ID NO: 3965606 - DNA, 22 bp, Homo sapiens
ttgttcgccgcgtggaatgtga

SEQ ID NO: 3965607 - DNA, 23 bp, Homo sapiens
ttgttctccgggtgtggcctcag

SEQ ID NO: 3965608 - DNA, 14 bp, Homo sapiens
ttgttctgtcacca

SEQ ID NO: 3965609 - DNA, 18 bp, Homo sapiens
ttgttgacatgagtggaa

SEQ ID NO: 3965610 - DNA, 15 bp, Homo sapiens
ttgttgattaatttg

SEQ ID NO: 3965611 - DNA, 19 bp, Homo sapiens
ttgttgattaatttgagaa

SEQ ID NO: 3965612 - DNA, 21 bp, Homo sapiens
ttgttggaaaagaatacagaa

SEQ ID NO: 3965613 - DNA, 12 bp, Homo sapiens
ttgttgtgactt

SEQ ID NO: 3965614 - DNA, 16 bp, Homo sapiens
ttgttgtttttaagat

SEQ ID NO: 3965615 - DNA, 20 bp, Homo sapiens
ttgtttaaaaacaggaaaaa

SEQ ID NO: 3965616 - DNA, 20 bp, Homo sapiens
ttgttttcttctgtatgtta

SEQ ID NO: 3965617 - DNA, 13 bp, Homo sapiens
ttgttttgcactg

SEQ ID NO: 3965618 - DNA, 15 bp, Homo sapiens
ttgtttttgctacta

SEQ ID NO: 3965619 - DNA, 19 bp, Homo sapiens
ttgttttttttttccactt

SEQ ID NO: 3965620 - DNA, 23 bp, Homo sapiens
tttaaaaaacaaaaaccagcagg

SEQ ID NO: 3965621 - DNA, 22 bp, Homo sapiens
tttaaaaaataaaaaaatacag

SEQ ID NO: 3965622 - DNA, 16 bp, Homo sapiens
tttaaaaacaggaaaa

SEQ ID NO: 3965623 - DNA, 14 bp, Homo sapiens
tttaaaaccatgca

SEQ ID NO: 3965624 - DNA, 12 bp, Homo sapiens
tttaaaagaaat

SEQ ID NO: 3965625 - DNA, 22 bp, Homo sapiens
tttaaaagtataaaactgcttt

SEQ ID NO: 3965626 - DNA, 20 bp, Homo sapiens
tttaaaagttactcctttta

SEQ ID NO: 3965627 - DNA, 20 bp, Homo sapiens
tttaaacaaaatagaagctg

SEQ ID NO: 3965628 - DNA, 16 bp, Homo sapiens
tttaaacatagaaagt

SEQ ID NO: 3965629 - DNA, 16 bp, Homo sapiens
tttaaaccagcagaaa

SEQ ID NO: 3965630 - DNA, 21 bp, Homo sapiens
tggctgaccccaaagagcctg

SEQ ID NO: 3965631 - DNA, 15 bp, Homo sapiens
tggctgagcttggcc

SEQ ID NO: 3965632 - DNA, 14 bp, Homo sapiens
tggctgagggcagt

SEQ ID NO: 3965633 - DNA, 20 bp, Homo sapiens
tggctgagtggaatgcaggg

SEQ ID NO: 3965634 - DNA, 21 bp, Homo sapiens
tggctgagtggaatgcaggga

SEQ ID NO: 3965635 - DNA, 22 bp, Homo sapiens
tggctgagtggaatgcagggaa

SEQ ID NO: 3965636 - DNA, 13 bp, Homo sapiens
tggctgccaggcg

SEQ ID NO: 3965637 - DNA, 22 bp, Homo sapiens
tggctgccaggcgttggtgcca

SEQ ID NO: 3965638 - DNA, 19 bp, Homo sapiens
tggctggatgaaattttct

SEQ ID NO: 3965639 - DNA, 12 bp, Homo sapiens
tggctggctgag

SEQ ID NO: 3965640 - DNA, 14 bp, Homo sapiens
tggctggggcagag

SEQ ID NO: 3965641 - DNA, 22 bp, Homo sapiens
tggctgtcaggacaccagcctg

SEQ ID NO: 3965642 - DNA, 15 bp, Homo sapiens
tggctgtgcctctgc

SEQ ID NO: 3965643 - DNA, 19 bp, Homo sapiens
tggctgtgctctcaccagc

SEQ ID NO: 3965644 - DNA, 13 bp, Homo sapiens
tggctgtggcaca

SEQ ID NO: 3965645 - DNA, 16 bp, Homo sapiens
tggctgtggcacagac

SEQ ID NO: 3965646 - DNA, 18 bp, Homo sapiens
tggctgtggggagtgttt

SEQ ID NO: 3965647 - DNA, 15 bp, Homo sapiens
tggctgtgtgacaga

SEQ ID NO: 3965648 - DNA, 21 bp, Homo sapiens
tggcttacaaattctacagca

SEQ ID NO: 3965649 - DNA, 15 bp, Homo sapiens
tggcttataaatgtg

SEQ ID NO: 3965650 - DNA, 14 bp, Homo sapiens
tggcttccaggtat

SEQ ID NO: 3965651 - DNA, 21 bp, Homo sapiens
tggcttccaggtatctccagg

SEQ ID NO: 3965652 - DNA, 23 bp, Homo sapiens
tggcttccaggtatctccaggat

SEQ ID NO: 3965653 - DNA, 19 bp, Homo sapiens
tggcttcccatccccagcg

SEQ ID NO: 3965654 - DNA, 20 bp, Homo sapiens
tggcttcccgctcagccctc

SEQ ID NO: 3965655 - DNA, 22 bp, Homo sapiens
tggcttcgtcatttgcaagctg

SEQ ID NO: 3965656 - DNA, 11 bp, Homo sapiens
tggcttctggg

SEQ ID NO: 3965657 - DNA, 14 bp, Homo sapiens
tggcttctgggacc

SEQ ID NO: 3965658 - DNA, 19 bp, Homo sapiens
tggcttctgggacctgtgt

SEQ ID NO: 3965659 - DNA, 14 bp, Homo sapiens
tggcttctgggaga

SEQ ID NO: 3965660 - DNA, 14 bp, Homo sapiens
tggcttctgtgcac

SEQ ID NO: 3965661 - DNA, 12 bp, Homo sapiens
tggcttgctcca

SEQ ID NO: 3965662 - DNA, 19 bp, Homo sapiens
tggcttgctccagggtctt

SEQ ID NO: 3965663 - DNA, 13 bp, Homo sapiens
tggcttggggagc

SEQ ID NO: 3965664 - DNA, 14 bp, Homo sapiens
tggcttggggagca

SEQ ID NO: 3965665 - DNA, 12 bp, Homo sapiens
tggctttcccgg

SEQ ID NO: 3965666 - DNA, 13 bp, Homo sapiens
tggctttgtctct

SEQ ID NO: 3965667 - DNA, 16 bp, Homo sapiens
tggcttttcactgctg

SEQ ID NO: 3965668 - DNA, 21 bp, Homo sapiens
tggcttttcactgctggctgc

SEQ ID NO: 3965669 - DNA, 17 bp, Homo sapiens
tgggaaaacagaggaat

SEQ ID NO: 3965670 - DNA, 14 bp, Homo sapiens
tgggaaagcattgt

SEQ ID NO: 3965671 - DNA, 17 bp, Homo sapiens
tgggaaagcattgtaaa

SEQ ID NO: 3965672 - DNA, 23 bp, Homo sapiens
tgggaaagggacccgaagcccag

SEQ ID NO: 3965673 - DNA, 23 bp, Homo sapiens
tgggaacctagtactctctgctc

SEQ ID NO: 3965674 - DNA, 17 bp, Homo sapiens
tgggaactggttcaaga

SEQ ID NO: 3965675 - DNA, 23 bp, Homo sapiens
tgggaagaaagaatgcaagagtg

SEQ ID NO: 3965676 - DNA, 15 bp, Homo sapiens
tgggaagagaaggga

SEQ ID NO: 3965677 - DNA, 20 bp, Homo sapiens
tgggaagagaagggaagcct

SEQ ID NO: 3965678 - DNA, 11 bp, Homo sapiens
tgggaagccat

SEQ ID NO: 3965679 - DNA, 15 bp, Homo sapiens
tgggaagctgtactc

SEQ ID NO: 3965680 - DNA, 13 bp, Homo sapiens
tgggaagggagag

SEQ ID NO: 3965681 - DNA, 23 bp, Homo sapiens
tgggaagtcgtccttactcctgt

SEQ ID NO: 3965682 - DNA, 16 bp, Homo sapiens
tgggaagtgaagcccc

SEQ ID NO: 3965683 - DNA, 11 bp, Homo sapiens
tgggacagagg

SEQ ID NO: 3965684 - DNA, 18 bp, Homo sapiens
tgggacagaggagcaagg

SEQ ID NO: 3965685 - DNA, 11 bp, Homo sapiens
tgggacagccc

SEQ ID NO: 3965686 - DNA, 17 bp, Homo sapiens
tgggacattccaaagaa

SEQ ID NO: 3965687 - DNA, 13 bp, Homo sapiens
tgggacccagcta

SEQ ID NO: 3965688 - DNA, 22 bp, Homo sapiens
tgggacccagctactctgtcca

SEQ ID NO: 3965689 - DNA, 22 bp, Homo sapiens
tgggagacaagaaatccctgtt

SEQ ID NO: 3965690 - DNA, 23 bp, Homo sapiens
tgggctctccacctcagccttgg

SEQ ID NO: 3965691 - DNA, 15 bp, Homo sapiens
tgggctgccctggtg

SEQ ID NO: 3965692 - DNA, 13 bp, Homo sapiens
tgggctggcccag

SEQ ID NO: 3965693 - DNA, 12 bp, Homo sapiens
tgggctgtctgt

SEQ ID NO: 3965694 - DNA, 14 bp, Homo sapiens
tgggcttggccttg

SEQ ID NO: 3965695 - DNA, 18 bp, Homo sapiens
tgggctttctccggggtc

SEQ ID NO: 3965696 - DNA, 16 bp, Homo sapiens
tgggctttgatttcca

SEQ ID NO: 3965697 - DNA, 19 bp, Homo sapiens
tggggacagttggcagaga

SEQ ID NO: 3965698 - DNA, 21 bp, Homo sapiens
tggggacagttggcagagaag

SEQ ID NO: 3965699 - DNA, 11 bp, Homo sapiens
tggggagaaat

SEQ ID NO: 3965700 - DNA, 20 bp, Homo sapiens
tggggagacggtgttgcaga

SEQ ID NO: 3965701 - DNA, 20 bp, Homo sapiens
tggggagcacttgcgtcctg

SEQ ID NO: 3965702 - DNA, 14 bp, Homo sapiens
tggggagcagagta

SEQ ID NO: 3965703 - DNA, 18 bp, Homo sapiens
tggggaggaagggccagg

SEQ ID NO: 3965704 - DNA, 15 bp, Homo sapiens
tggggaggcagctcc

SEQ ID NO: 3965705 - DNA, 17 bp, Homo sapiens
tggggaggcagctccaa

SEQ ID NO: 3965706 - DNA, 21 bp, Homo sapiens
tggggagggagacagagacag

SEQ ID NO: 3965707 - DNA, 14 bp, Homo sapiens
tggggagggggaag

SEQ ID NO: 3965708 - DNA, 16 bp, Homo sapiens
tggggatgtgggaggg

SEQ ID NO: 3965709 - DNA, 16 bp, Homo sapiens
tggggcagaggggcag

SEQ ID NO: 3965710 - DNA, 17 bp, Homo sapiens
tggggcagaggggcagc

SEQ ID NO: 3965711 - DNA, 13 bp, Homo sapiens
tggggcaggagta

SEQ ID NO: 3965712 - DNA, 14 bp, Homo sapiens
tggggcaggagtag

SEQ ID NO: 3965713 - DNA, 15 bp, Homo sapiens
tggggcaggagtagc

SEQ ID NO: 3965714 - DNA, 18 bp, Homo sapiens
tggggcaggagtagctga

SEQ ID NO: 3965715 - DNA, 17 bp, Homo sapiens
tggggcaggctggctgg

SEQ ID NO: 3965716 - DNA, 23 bp, Homo sapiens
tggggcatggttccttccctggg

SEQ ID NO: 3965717 - DNA, 18 bp, Homo sapiens
tggggccctgggcctcag

SEQ ID NO: 3965718 - DNA, 19 bp, Homo sapiens
tggggccctgggcctcagt

SEQ ID NO: 3965719 - DNA, 15 bp, Homo sapiens
tggggcctggagagg

SEQ ID NO: 3965720 - DNA, 11 bp, Homo sapiens
tggggcctggc

SEQ ID NO: 3965721 - DNA, 16 bp, Homo sapiens
tggggcctggcttgct

SEQ ID NO: 3965722 - DNA, 20 bp, Homo sapiens
tggggcctggcttgctccag

SEQ ID NO: 3965723 - DNA, 20 bp, Homo sapiens
tggggcctgtactgcctgct

SEQ ID NO: 3965724 - DNA, 19 bp, Homo sapiens
tggggctctaacgcctgag

SEQ ID NO: 3965725 - DNA, 22 bp, Homo sapiens
tggggctctaacgcctgagccc

SEQ ID NO: 3965726 - DNA, 23 bp, Homo sapiens
tggggctctaacgcctgagccca

SEQ ID NO: 3965727 - DNA, 20 bp, Homo sapiens
tggggcttgcaagaggaggt

SEQ ID NO: 3965728 - DNA, 16 bp, Homo sapiens
tggggcttgggggctc

SEQ ID NO: 3965729 - DNA, 14 bp, Homo sapiens
tgggggaagccctg

SEQ ID NO: 3965730 - DNA, 18 bp, Homo sapiens
tgggggatgggccagggt

SEQ ID NO: 3965731 - DNA, 17 bp, Homo sapiens
tgggggcagagggcaga

SEQ ID NO: 3965732 - DNA, 18 bp, Homo sapiens
tgggggcagagggcagag

SEQ ID NO: 3965733 - DNA, 20 bp, Homo sapiens
tgggggcagtgactggcagg

SEQ ID NO: 3965734 - DNA, 14 bp, Homo sapiens
tgggggccagctgg

SEQ ID NO: 3965735 - DNA, 13 bp, Homo sapiens
tgggggcctggct

SEQ ID NO: 3965736 - DNA, 15 bp, Homo sapiens
tgggggcctggctgg

SEQ ID NO: 3965737 - DNA, 16 bp, Homo sapiens
tgggggtggcaggcac

SEQ ID NO: 3965738 - DNA, 14 bp, Homo sapiens
tgggggtggccatc

SEQ ID NO: 3965739 - DNA, 23 bp, Homo sapiens
tgggggtggccatccctgggccc

SEQ ID NO: 3965740 - DNA, 15 bp, Homo sapiens
tgggggttctttctt

SEQ ID NO: 3965741 - DNA, 20 bp, Homo sapiens
tgggggttctttcttcctct

SEQ ID NO: 3965742 - DNA, 21 bp, Homo sapiens
tgggggttggatgggaagatg

SEQ ID NO: 3965743 - DNA, 18 bp, Homo sapiens
tggggtaagccagagcct

SEQ ID NO: 3965744 - DNA, 19 bp, Homo sapiens
tggggtaagccagagcctg

SEQ ID NO: 3965745 - DNA, 20 bp, Homo sapiens
tggggtacaggtttggggag

SEQ ID NO: 3965746 - DNA, 21 bp, Homo sapiens
tggggtcaccaccctcccctg

SEQ ID NO: 3965747 - DNA, 14 bp, Homo sapiens
tggggtcagccagg

SEQ ID NO: 3965748 - DNA, 18 bp, Homo sapiens
tggggtcagccagggcca

SEQ ID NO: 3965749 - DNA, 19 bp, Homo sapiens
tggggtcagccagggccag

SEQ ID NO: 3965750 - DNA, 20 bp, Homo sapiens
tggggtcttgctatattgcc

SEQ ID NO: 3965751 - DNA, 23 bp, Homo sapiens
tggggtgacccggcaccccctgc

SEQ ID NO: 3965752 - DNA, 21 bp, Homo sapiens
tggggtgcatcccccagcact

SEQ ID NO: 3965753 - DNA, 14 bp, Homo sapiens
tggggtggggcagg

SEQ ID NO: 3965754 - DNA, 15 bp, Homo sapiens
tggggtggggcagga

SEQ ID NO: 3965755 - DNA, 14 bp, Homo sapiens
tggggttcagcccc

SEQ ID NO: 3965756 - DNA, 19 bp, Homo sapiens
tggggttcagcccctcctc

SEQ ID NO: 3965757 - DNA, 17 bp, Homo sapiens
tggggttttatgtgtgg

SEQ ID NO: 3965758 - DNA, 14 bp, Homo sapiens
tgggtaactgtcaa

SEQ ID NO: 3965759 - DNA, 16 bp, Homo sapiens
tgggtacatgtgagga

SEQ ID NO: 3965760 - DNA, 18 bp, Homo sapiens
tgggtccaggaaggcagc

SEQ ID NO: 3965761 - DNA, 19 bp, Homo sapiens
tgggtcctgcaatctccag

SEQ ID NO: 3965762 - DNA, 15 bp, Homo sapiens
tgggtctggctgagc

SEQ ID NO: 3965763 - DNA, 22 bp, Homo sapiens
tgggtcttgttttttttttcca

SEQ ID NO: 3965764 - DNA, 15 bp, Homo sapiens
tgggtgaaagtgact

SEQ ID NO: 3965765 - DNA, 15 bp, Homo sapiens
tgggtgccatgtgga

SEQ ID NO: 3965766 - DNA, 15 bp, Homo sapiens
tgggtggcctcggga

SEQ ID NO: 3965767 - DNA, 14 bp, Homo sapiens
tgggtggctactct

SEQ ID NO: 3965768 - DNA, 21 bp, Homo sapiens
tgggtggggctgctcctccag

SEQ ID NO: 3965769 - DNA, 14 bp, Homo sapiens
tgggtggtggatct

SEQ ID NO: 3965770 - DNA, 15 bp, Homo sapiens
tgggtggtggatctg

SEQ ID NO: 3965771 - DNA, 20 bp, Homo sapiens
tgggttatttttgtccctgc

SEQ ID NO: 3965772 - DNA, 23 bp, Homo sapiens
tgggttcattccccggccctccg

SEQ ID NO: 3965773 - DNA, 23 bp, Homo sapiens
tgggttctttggaaggagtgaga

SEQ ID NO: 3965774 - DNA, 18 bp, Homo sapiens
tgggttttctaactgtaa

SEQ ID NO: 3965775 - DNA, 21 bp, Homo sapiens
tgggttttctaactgtaaatc

SEQ ID NO: 3965776 - DNA, 24 bp, Homo sapiens
tgggttttcttcccatcactggag

SEQ ID NO: 3965777 - DNA, 13 bp, Homo sapiens
tgttccctgcacc

SEQ ID NO: 3965778 - DNA, 14 bp, Homo sapiens
tgttccctgcaccc

SEQ ID NO: 3965779 - DNA, 17 bp, Homo sapiens
tgttccctgcaccctgg

SEQ ID NO: 3965780 - DNA, 16 bp, Homo sapiens
tgttcctgatgtgcca

SEQ ID NO: 3965781 - DNA, 17 bp, Homo sapiens
tgttcctggctttgaca

SEQ ID NO: 3965782 - DNA, 19 bp, Homo sapiens
tgttccttctgcttctccc

SEQ ID NO: 3965783 - DNA, 23 bp, Homo sapiens
tgttctccgggtgtggcctcagc

SEQ ID NO: 3965784 - DNA, 16 bp, Homo sapiens
tgttctccgtccctgc

SEQ ID NO: 3965785 - DNA, 22 bp, Homo sapiens
tgttctcctccattgctgttgt

SEQ ID NO: 3965786 - DNA, 13 bp, Homo sapiens
tgttctgcactga

SEQ ID NO: 3965787 - DNA, 15 bp, Homo sapiens
tgttctgcactgaaa

SEQ ID NO: 3965788 - DNA, 17 bp, Homo sapiens
tgttctgcactgaaaag

SEQ ID NO: 3965789 - DNA, 23 bp, Homo sapiens
tgttctgcccaatgcctttttga

SEQ ID NO: 3965790 - DNA, 20 bp, Homo sapiens
tgttctggattttcccctga

SEQ ID NO: 3965791 - DNA, 12 bp, Homo sapiens
tgttctgtattt

SEQ ID NO: 3965792 - DNA, 13 bp, Homo sapiens
tgttctgtatttt

SEQ ID NO: 3965793 - DNA, 13 bp, Homo sapiens
tgttctgtcacca

SEQ ID NO: 3965794 - DNA, 20 bp, Homo sapiens
tgttctgtgggcttggcctt

SEQ ID NO: 3965795 - DNA, 21 bp, Homo sapiens
tgttctgtgggcttggccttg

SEQ ID NO: 3965796 - DNA, 14 bp, Homo sapiens
tgttctgtgtgggt

SEQ ID NO: 3965797 - DNA, 15 bp, Homo sapiens
tgttgaaattatgta

SEQ ID NO: 3965798 - DNA, 14 bp, Homo sapiens
tgttgagtgttcat

SEQ ID NO: 3965799 - DNA, 18 bp, Homo sapiens
tgttgagtgttcatttta

SEQ ID NO: 3965800 - DNA, 18 bp, Homo sapiens
tgttgagttggacacact

SEQ ID NO: 3965801 - DNA, 20 bp, Homo sapiens
tgttgagttggacacactgt

SEQ ID NO: 3965802 - DNA, 20 bp, Homo sapiens
tgttgatcccacttcactgt

SEQ ID NO: 3965803 - DNA, 22 bp, Homo sapiens
tgttgatcccacttcactgtga

SEQ ID NO: 3965804 - DNA, 22 bp, Homo sapiens
tgttgattacataatcaaagct

SEQ ID NO: 3965805 - DNA, 19 bp, Homo sapiens
tgttgcaagtactgctgta

SEQ ID NO: 3965806 - DNA, 17 bp, Homo sapiens
tgttgcaccatctgctt

SEQ ID NO: 3965807 - DNA, 19 bp, Homo sapiens
tgttgcaccatctgcttgg

SEQ ID NO: 3965808 - DNA, 17 bp, Homo sapiens
tgttgcagagatttcct

SEQ ID NO: 3965809 - DNA, 21 bp, Homo sapiens
tgttgccacctgttaaaatgt

SEQ ID NO: 3965810 - DNA, 15 bp, Homo sapiens
tgttgccatttctct

SEQ ID NO: 3965811 - DNA, 19 bp, Homo sapiens
tgttgcccaggctggcctg

SEQ ID NO: 3965812 - DNA, 13 bp, Homo sapiens
tgttgctgtcaag

SEQ ID NO: 3965813 - DNA, 18 bp, Homo sapiens
tgttgcttagatgagggt

SEQ ID NO: 3965814 - DNA, 14 bp, Homo sapiens
tgttgcttggacta

SEQ ID NO: 3965815 - DNA, 13 bp, Homo sapiens
tgttggaaaagaa

SEQ ID NO: 3965816 - DNA, 13 bp, Homo sapiens
tgttggacccgct

SEQ ID NO: 3965817 - DNA, 19 bp, Homo sapiens
tgttggacccgctctggac

SEQ ID NO: 3965818 - DNA, 23 bp, Homo sapiens
tgttggcctcgcctgggcccagg

SEQ ID NO: 3965819 - DNA, 15 bp, Homo sapiens
tgttggctaatgaag

SEQ ID NO: 3965820 - DNA, 14 bp, Homo sapiens
tgttggctgtgtga

SEQ ID NO: 3965821 - DNA, 16 bp, Homo sapiens
tgttggctgtgtgaca

SEQ ID NO: 3965822 - DNA, 22 bp, Homo sapiens
tgttgggcttgggggaaaagag

SEQ ID NO: 3965823 - DNA, 15 bp, Homo sapiens
tgttgtaaatgacca

SEQ ID NO: 3965824 - DNA, 18 bp, Homo sapiens
tgttgtaataaaacttat

SEQ ID NO: 3965825 - DNA, 15 bp, Homo sapiens
tgttgtacaagctca

SEQ ID NO: 3965826 - DNA, 23 bp, Homo sapiens
tgttgtacatacagaggtaacta

SEQ ID NO: 3965827 - DNA, 17 bp, Homo sapiens
tgttgtacgtaaagctt

SEQ ID NO: 3965828 - DNA, 13 bp, Homo sapiens
tgttgtgaatgtc

SEQ ID NO: 3965829 - DNA, 12 bp, Homo sapiens
tgttgtgattaa

SEQ ID NO: 3965830 - DNA, 13 bp, Homo sapiens
tgttgtgattttg

SEQ ID NO: 3965831 - DNA, 21 bp, Homo sapiens
tgttgtgattttgtacagaat

SEQ ID NO: 3965832 - DNA, 14 bp, Homo sapiens
tgttgttatgctat

SEQ ID NO: 3965833 - DNA, 21 bp, Homo sapiens
tgttgttcccacacacaaacc

SEQ ID NO: 3965834 - DNA, 18 bp, Homo sapiens
tgttgtttttaagtcctg

SEQ ID NO: 3965835 - DNA, 18 bp, Homo sapiens
tgtttaaaaacaggaaaa

SEQ ID NO: 3965836 - DNA, 13 bp, Homo sapiens
tgtttaaaatcat

SEQ ID NO: 3965837 - DNA, 19 bp, Homo sapiens
tgtttaaactttgtgcctt

SEQ ID NO: 3965838 - DNA, 12 bp, Homo sapiens
tgtttaaataaa

SEQ ID NO: 3965839 - DNA, 13 bp, Homo sapiens
tgtttaaatataa

SEQ ID NO: 3965840 - DNA, 14 bp, Homo sapiens
tgtttaagatgggc

SEQ ID NO: 3965841 - DNA, 21 bp, Homo sapiens
tgtttaagtgttgtaaatatt

SEQ ID NO: 3965842 - DNA, 23 bp, Homo sapiens
tgtttacaaaaggcagccctttg

SEQ ID NO: 3965843 - DNA, 12 bp, Homo sapiens
tgtttacatatc

SEQ ID NO: 3965844 - DNA, 16 bp, Homo sapiens
tgtttagattccagga

SEQ ID NO: 3965845 - DNA, 17 bp, Homo sapiens
tgtttagattccaggat

SEQ ID NO: 3965846 - DNA, 15 bp, Homo sapiens
tgtttatacagctca

SEQ ID NO: 3965847 - DNA, 13 bp, Homo sapiens
tgtttattaacaa

SEQ ID NO: 3965848 - DNA, 13 bp, Homo sapiens
tgtttattccttg

SEQ ID NO: 3965849 - DNA, 22 bp, Homo sapiens
tgtttatttataagcagattta

SEQ ID NO: 3965850 - DNA, 20 bp, Homo sapiens
tgtttatttattcactgtaa

SEQ ID NO: 3965851 - DNA, 19 bp, Homo sapiens
tgtttcaatgacctgtatt

SEQ ID NO: 3965852 - DNA, 15 bp, Homo sapiens
tgtttccagaaaata

SEQ ID NO: 3965853 - DNA, 17 bp, Homo sapiens
tgtttccagaaaatata

SEQ ID NO: 3965854 - DNA, 18 bp, Homo sapiens
tgtttccagaaaatataa

SEQ ID NO: 3965855 - DNA, 23 bp, Homo sapiens
tgtttccagaaaatataaatgca

SEQ ID NO: 3965856 - DNA, 11 bp, Homo sapiens
tgtttcctgag

SEQ ID NO: 3965857 - DNA, 24 bp, Homo sapiens
tgtttctattctctcctcagactg

SEQ ID NO: 3965858 - DNA, 22 bp, Homo sapiens
tgtttctgcagtagtctctgtg

SEQ ID NO: 3965859 - DNA, 15 bp, Homo sapiens
tgtttgagatgtgat

SEQ ID NO: 3965860 - DNA, 17 bp, Homo sapiens
tgtttgagatgtgatgc

SEQ ID NO: 3965861 - DNA, 14 bp, Homo sapiens
tgtttgagctcaga

SEQ ID NO: 3965862 - DNA, 22 bp, Homo sapiens
tgtttgggcagaagggagaagg

SEQ ID NO: 3965863 - DNA, 15 bp, Homo sapiens
tgtttggggcaggag

SEQ ID NO: 3965864 - DNA, 13 bp, Homo sapiens
ttaactattatta

SEQ ID NO: 3965865 - DNA, 18 bp, Homo sapiens
ttaactgtgtgaagaaat

SEQ ID NO: 3965866 - DNA, 22 bp, Homo sapiens
ttaactgtgtgaagaaatggaa

SEQ ID NO: 3965867 - DNA, 22 bp, Homo sapiens
ttaacttaaaagattcactaaa

SEQ ID NO: 3965868 - DNA, 16 bp, Homo sapiens
ttaacttggagtttca

SEQ ID NO: 3965869 - DNA, 16 bp, Homo sapiens
ttaacttgtcaaaaaa

SEQ ID NO: 3965870 - DNA, 16 bp, Homo sapiens
ttaactttaagactga

SEQ ID NO: 3965871 - DNA, 17 bp, Homo sapiens
ttaactttgggcccaga

SEQ ID NO: 3965872 - DNA, 23 bp, Homo sapiens
ttaagaatgcagattcctgggcc

SEQ ID NO: 3965873 - DNA, 17 bp, Homo sapiens
ttaagaatggaagaaaa

SEQ ID NO: 3965874 - DNA, 15 bp, Homo sapiens
ttaagacgtgaatgt

SEQ ID NO: 3965875 - DNA, 16 bp, Homo sapiens
ttaagacgtgaatgtc

SEQ ID NO: 3965876 - DNA, 21 bp, Homo sapiens
ttaagactgagcacctgcttc

SEQ ID NO: 3965877 - DNA, 15 bp, Homo sapiens
ttaagagaaatggca

SEQ ID NO: 3965878 - DNA, 13 bp, Homo sapiens
ttaagagagaaat

SEQ ID NO: 3965879 - DNA, 15 bp, Homo sapiens
ttaagagagaaatct

SEQ ID NO: 3965880 - DNA, 14 bp, Homo sapiens
ttaagagatacatt

SEQ ID NO: 3965881 - DNA, 15 bp, Homo sapiens
ttaagagatacattc

SEQ ID NO: 3965882 - DNA, 14 bp, Homo sapiens
ttaagagcaataaa

SEQ ID NO: 3965883 - DNA, 20 bp, Homo sapiens
ttaagagtagcaagttctag

SEQ ID NO: 3965884 - DNA, 17 bp, Homo sapiens
ttaagatacactcctgc

SEQ ID NO: 3965885 - DNA, 19 bp, Homo sapiens
ttaagcaaaggaaaccaaa

SEQ ID NO: 3965886 - DNA, 13 bp, Homo sapiens
ttaagccctgagg

SEQ ID NO: 3965887 - DNA, 21 bp, Homo sapiens
ttaaggagaggagaaactgag

SEQ ID NO: 3965888 - DNA, 22 bp, Homo sapiens
ttaaggtctgggagtgttctgt

SEQ ID NO: 3965889 - DNA, 17 bp, Homo sapiens
ttaagtcctctcttctc

SEQ ID NO: 3965890 - DNA, 19 bp, Homo sapiens
ttaagtctgggatgtagaa

SEQ ID NO: 3965891 - DNA, 19 bp, Homo sapiens
ttaagttagagaatatatt

SEQ ID NO: 3965892 - DNA, 20 bp, Homo sapiens
ttaataaaaacttcagaaaa

SEQ ID NO: 3965893 - DNA, 20 bp, Homo sapiens
ttaataaattttaacatttt

SEQ ID NO: 3965894 - DNA, 17 bp, Homo sapiens
ttaataccaaatatttt

SEQ ID NO: 3965895 - DNA, 18 bp, Homo sapiens
ttaatagcttttattgta

SEQ ID NO: 3965896 - DNA, 20 bp, Homo sapiens
ttaatatatcccagaaatta

SEQ ID NO: 3965897 - DNA, 17 bp, Homo sapiens
ttaatatttaaacagca

SEQ ID NO: 3965898 - DNA, 15 bp, Homo sapiens
ttaatcaccaaagta

SEQ ID NO: 3965899 - DNA, 20 bp, Homo sapiens
ttaatcaggtcctcagagaa

SEQ ID NO: 3965900 - DNA, 15 bp, Homo sapiens
ttaatcgtgtcttca

SEQ ID NO: 3965901 - DNA, 21 bp, Homo sapiens
ttaatctttctttacctgaga

SEQ ID NO: 3965902 - DNA, 23 bp, Homo sapiens
ttaatgaagacccagtgtaaaga

SEQ ID NO: 3965903 - DNA, 15 bp, Homo sapiens
ttaatggtctaaaaa

SEQ ID NO: 3965904 - DNA, 22 bp, Homo sapiens
ttaatggtctaaaaataaacca

SEQ ID NO: 3965905 - DNA, 19 bp, Homo sapiens
ttaatgtacaagttttgta

SEQ ID NO: 3965906 - DNA, 21 bp, Homo sapiens
ttaatgtacaagttttgtata

SEQ ID NO: 3965907 - DNA, 19 bp, Homo sapiens
ttaatgtgtgtctgaagac

SEQ ID NO: 3965908 - DNA, 17 bp, Homo sapiens
ttaatgtttattcctga

SEQ ID NO: 3965909 - DNA, 18 bp, Homo sapiens
ttaatgtttgatttagta

SEQ ID NO: 3965910 - DNA, 18 bp, Homo sapiens
ttaattaactatgtgatg

SEQ ID NO: 3965911 - DNA, 13 bp, Homo sapiens
ttaattcataatt

SEQ ID NO: 3965912 - DNA, 16 bp, Homo sapiens
ttaattcataattaga

SEQ ID NO: 3965913 - DNA, 13 bp, Homo sapiens
ttaattcattaaa

SEQ ID NO: 3965914 - DNA, 22 bp, Homo sapiens
ttaattgattattctgattcca

SEQ ID NO: 3965915 - DNA, 15 bp, Homo sapiens
ttaatttgttatgta

SEQ ID NO: 3965916 - DNA, 20 bp, Homo sapiens
ttaatttttacatgaccaga

SEQ ID NO: 3965917 - DNA, 18 bp, Homo sapiens
ttaattttttttaatgta

SEQ ID NO: 3965918 - DNA, 14 bp, Homo sapiens
ttacaaaaggcagc

SEQ ID NO: 3965919 - DNA, 19 bp, Homo sapiens
ttacaacagtaacacatct

SEQ ID NO: 3965920 - DNA, 18 bp, Homo sapiens
ttacaagaattgtccatg

SEQ ID NO: 3965921 - DNA, 14 bp, Homo sapiens
ttacaagtgtatat

SEQ ID NO: 3965922 - DNA, 14 bp, Homo sapiens
ttacaataaacata

SEQ ID NO: 3965923 - DNA, 20 bp, Homo sapiens
ttacaataattaatgtgtgt

SEQ ID NO: 3965924 - DNA, 14 bp, Homo sapiens
ttacaatggaaaca

SEQ ID NO: 3965925 - DNA, 17 bp, Homo sapiens
ttacacattatgttaga

SEQ ID NO: 3965926 - DNA, 15 bp, Homo sapiens
ttacagcgagaggca

SEQ ID NO: 3965927 - DNA, 21 bp, Homo sapiens
ttacagcgagaggcagagaaa

SEQ ID NO: 3965928 - DNA, 15 bp, Homo sapiens
ttacagctttacaca

SEQ ID NO: 3965929 - DNA, 19 bp, Homo sapiens
ttacaggaggttgtggatg

SEQ ID NO: 3965930 - DNA, 18 bp, Homo sapiens
ttacagggcccaggtgag

SEQ ID NO: 3965931 - DNA, 13 bp, Homo sapiens
ttacagtaaataa

SEQ ID NO: 3965932 - DNA, 18 bp, Homo sapiens
ttacagtaaataaattgt

SEQ ID NO: 3965933 - DNA, 13 bp, Homo sapiens
ttacagtgactgt

SEQ ID NO: 3965934 - DNA, 13 bp, Homo sapiens
ttacatctaatgc

SEQ ID NO: 3965935 - DNA, 18 bp, Homo sapiens
ttacatctgttttaaatt

SEQ ID NO: 3965936 - DNA, 14 bp, Homo sapiens
ttacatttatacat

SEQ ID NO: 3965937 - DNA, 15 bp, Homo sapiens
ttacatttatacatc

SEQ ID NO: 3965938 - DNA, 16 bp, Homo sapiens
ttacatttccaaatga

SEQ ID NO: 3965939 - DNA, 17 bp, Homo sapiens
ttacatttccaaatgaa

SEQ ID NO: 3965940 - DNA, 16 bp, Homo sapiens
ttacatttttacaata

SEQ ID NO: 3965941 - DNA, 13 bp, Homo sapiens
ttaccaactttct

SEQ ID NO: 3965942 - DNA, 17 bp, Homo sapiens
ttaccagggatgtagat

SEQ ID NO: 3965943 - DNA, 24 bp, Homo sapiens
ttacccaaaaactaaatctctaat

SEQ ID NO: 3965944 - DNA, 21 bp, Homo sapiens
ttacccagagaatatatacat

SEQ ID NO: 3965945 - DNA, 17 bp, Homo sapiens
ttacctaaacagatata

SEQ ID NO: 3965946 - DNA, 18 bp, Homo sapiens
ttacctaaacagatataa

SEQ ID NO: 3965947 - DNA, 19 bp, Homo sapiens
ttacctaaacagatataaa

SEQ ID NO: 3965948 - DNA, 20 bp, Homo sapiens
ttacctaaacagatataaat

SEQ ID NO: 3965949 - DNA, 15 bp, Homo sapiens
ttacctcctgcccag

SEQ ID NO: 3965950 - DNA, 15 bp, Homo sapiens
ttacctttaaaatca

SEQ ID NO: 3965951 - DNA, 14 bp, Homo sapiens
ttataaatgtgtgg

SEQ ID NO: 3965952 - DNA, 16 bp, Homo sapiens
ttataagcagatttaa

SEQ ID NO: 3965953 - DNA, 14 bp, Homo sapiens
ttataataatgttc

SEQ ID NO: 3965954 - DNA, 19 bp, Homo sapiens
ttataatgtggatttccta

SEQ ID NO: 3965955 - DNA, 23 bp, Homo sapiens
ttataatgtggatttcctatttt

SEQ ID NO: 3965956 - DNA, 13 bp, Homo sapiens
ttatacaaaataa

SEQ ID NO: 3965957 - DNA, 18 bp, Homo sapiens
ttatacaccattgttcct

SEQ ID NO: 3965958 - DNA, 19 bp, Homo sapiens
ttatacatagtcacaaaaa

SEQ ID NO: 3965959 - DNA, 15 bp, Homo sapiens
ttatacatatcagaa

SEQ ID NO: 3965960 - DNA, 21 bp, Homo sapiens
ttatacatatcagaaaagtag

SEQ ID NO: 3965961 - DNA, 22 bp, Homo sapiens
ttatacatatcagaaaagtaga

SEQ ID NO: 3965962 - DNA, 21 bp, Homo sapiens
ttatacctgtgtattttttaa

SEQ ID NO: 3965963 - DNA, 22 bp, Homo sapiens
ttatactctagaacatgcacat

SEQ ID NO: 3965964 - DNA, 15 bp, Homo sapiens
ttatagacaaataat

SEQ ID NO: 3965965 - DNA, 17 bp, Homo sapiens
ttatagctattactgtc

SEQ ID NO: 3965966 - DNA, 15 bp, Homo sapiens
ttatagtatatctgg

SEQ ID NO: 3965967 - DNA, 15 bp, Homo sapiens
ttatatatatatgta

SEQ ID NO: 3965968 - DNA, 18 bp, Homo sapiens
ttatatatatatgtatat

SEQ ID NO: 3965969 - DNA, 13 bp, Homo sapiens
ttatatctaattt

SEQ ID NO: 3965970 - DNA, 19 bp, Homo sapiens
ttatatctaatttatacaa

SEQ ID NO: 3965971 - DNA, 15 bp, Homo sapiens
ttatatgttaatttg

SEQ ID NO: 3965972 - DNA, 15 bp, Homo sapiens
ttatattaaaatatg

SEQ ID NO: 3965973 - DNA, 17 bp, Homo sapiens
ttatattgaatatatca

SEQ ID NO: 3965974 - DNA, 22 bp, Homo sapiens
ttatatttagttatagtttcag

SEQ ID NO: 3965975 - DNA, 15 bp, Homo sapiens
ttatatttttataga

SEQ ID NO: 3965976 - DNA, 22 bp, Homo sapiens
ttatcacatcaagcatgcaata

SEQ ID NO: 3965977 - DNA, 17 bp, Homo sapiens
ttatcagccatgtttgg

SEQ ID NO: 3965978 - DNA, 19 bp, Homo sapiens
ttatcatgacatgttatat

SEQ ID NO: 3965979 - DNA, 20 bp, Homo sapiens
ttatccttaggaaaatgctt

SEQ ID NO: 3965980 - DNA, 24 bp, Homo sapiens
ttatccttttttaaaagtaaatgt

SEQ ID NO: 3965981 - DNA, 14 bp, Homo sapiens
ttatctctatttaa

SEQ ID NO: 3965982 - DNA, 12 bp, Homo sapiens
ttatctgcctgg

SEQ ID NO: 3965983 - DNA, 16 bp, Homo sapiens
ttatctgtgaccacac

SEQ ID NO: 3965984 - DNA, 13 bp, Homo sapiens
ttatgccactgct

SEQ ID NO: 3965985 - DNA, 22 bp, Homo sapiens
ttatgcttaaaatatgtatgtc

SEQ ID NO: 3965986 - DNA, 17 bp, Homo sapiens
ttatggagtgtcaccag

SEQ ID NO: 3965987 - DNA, 22 bp, Homo sapiens
ttatggatcccaattcatttca

SEQ ID NO: 3965988 - DNA, 14 bp, Homo sapiens
ttatggcaagtgat

SEQ ID NO: 3965989 - DNA, 18 bp, Homo sapiens
ttatggctataggtgcta

SEQ ID NO: 3965990 - DNA, 18 bp, Homo sapiens
ttatggcttataaatgtg

SEQ ID NO: 3965991 - DNA, 16 bp, Homo sapiens
ttatggtgtaatgcac

SEQ ID NO: 3965992 - DNA, 19 bp, Homo sapiens
ttatggtgtaatgcacaat

SEQ ID NO: 3965993 - DNA, 23 bp, Homo sapiens
ttatgtatatactatacaacaat

SEQ ID NO: 3965994 - DNA, 17 bp, Homo sapiens
ttatgtatatagatgtg

SEQ ID NO: 3965995 - DNA, 19 bp, Homo sapiens
ttatgtattattttctata

SEQ ID NO: 3965996 - DNA, 20 bp, Homo sapiens
ttatgtgtgcatgtgtgtat

SEQ ID NO: 3965997 - DNA, 21 bp, Homo sapiens
ttatgtgtgcatgtgtgtata

SEQ ID NO: 3965998 - DNA, 13 bp, Homo sapiens
ttatgttaaaatc

SEQ ID NO: 3965999 - DNA, 15 bp, Homo sapiens
ttatgttacatctgt

SEQ ID NO: 3966000 - DNA, 20 bp, Homo sapiens
ttatgttatttatatattgg

SEQ ID NO: 3966001 - DNA, 19 bp, Homo sapiens
ttattaaaatgattgtaaa

SEQ ID NO: 3966002 - DNA, 20 bp, Homo sapiens
ttattaaaatgattgtaaaa

SEQ ID NO: 3966003 - DNA, 20 bp, Homo sapiens
ttattaacgggcatgtatta

SEQ ID NO: 3966004 - DNA, 18 bp, Homo sapiens
ttattaataccaaatatt

SEQ ID NO: 3966005 - DNA, 15 bp, Homo sapiens
ttattaatattgtgc

SEQ ID NO: 3966006 - DNA, 15 bp, Homo sapiens
ttattcactgtaagt

SEQ ID NO: 3966007 - DNA, 22 bp, Homo sapiens
ttattcatgccatctgttttca

SEQ ID NO: 3966008 - DNA, 20 bp, Homo sapiens
ttattcatttaaaatgatta

SEQ ID NO: 3966009 - DNA, 14 bp, Homo sapiens
ttattcatttgagt

SEQ ID NO: 3966010 - DNA, 13 bp, Homo sapiens
ttattctagatta

SEQ ID NO: 3966011 - DNA, 16 bp, Homo sapiens
ttattgaatcttaatt

SEQ ID NO: 3966012 - DNA, 14 bp, Homo sapiens
ttattgacaataat

SEQ ID NO: 3966013 - DNA, 14 bp, Homo sapiens
ttattgagctctat

SEQ ID NO: 3966014 - DNA, 12 bp, Homo sapiens
ttattgctgttg

SEQ ID NO: 3966015 - DNA, 15 bp, Homo sapiens
ttattgcttaatccc

SEQ ID NO: 3966016 - DNA, 20 bp, Homo sapiens
ttattggcctgctaatagct

SEQ ID NO: 3966017 - DNA, 14 bp, Homo sapiens
ttattgtataaact

SEQ ID NO: 3966018 - DNA, 19 bp, Homo sapiens
ttattgtcattactgcctt

SEQ ID NO: 3966019 - DNA, 11 bp, Homo sapiens
ttatttaaatg

SEQ ID NO: 3966020 - DNA, 20 bp, Homo sapiens
ttatttatgcctctgtattt

SEQ ID NO: 3966021 - DNA, 13 bp, Homo sapiens
ttatttattcact

SEQ ID NO: 3966022 - DNA, 19 bp, Homo sapiens
ttatttccaaataaaatga

SEQ ID NO: 3966023 - DNA, 14 bp, Homo sapiens
ttatttccctcatc

SEQ ID NO: 3966024 - DNA, 14 bp, Homo sapiens
ttatttctaaaata

SEQ ID NO: 3966025 - DNA, 19 bp, Homo sapiens
ttatttctcgggtgcattt

SEQ ID NO: 3966026 - DNA, 15 bp, Homo sapiens
ttatttgtacagttc

SEQ ID NO: 3966027 - DNA, 13 bp, Homo sapiens
ttatttgtattca

SEQ ID NO: 3966028 - DNA, 21 bp, Homo sapiens
ttatttgtgtaatagaaaact

SEQ ID NO: 3966029 - DNA, 14 bp, Homo sapiens
ttattttaaacaaa

SEQ ID NO: 3966030 - DNA, 16 bp, Homo sapiens
ttattttaaacaaaat

SEQ ID NO: 3966031 - DNA, 14 bp, Homo sapiens
ttattttcattaca

SEQ ID NO: 3966032 - DNA, 23 bp, Homo sapiens
ttattttgccatggatgagagtc

SEQ ID NO: 3966033 - DNA, 22 bp, Homo sapiens
ttattttgtattacatctaatg

SEQ ID NO: 3966034 - DNA, 20 bp, Homo sapiens
ttattttgttgtgattttgt

SEQ ID NO: 3966035 - DNA, 19 bp, Homo sapiens
ttatttttatacaccattg

SEQ ID NO: 3966036 - DNA, 21 bp, Homo sapiens
ttatttttatacaccattgtt

SEQ ID NO: 3966037 - DNA, 20 bp, Homo sapiens
ttatttttatatcagcctga

SEQ ID NO: 3966038 - DNA, 20 bp, Homo sapiens
tggtctgagcaccccctcat

SEQ ID NO: 3966039 - DNA, 22 bp, Homo sapiens
tggtctttcctatcatggagtg

SEQ ID NO: 3966040 - DNA, 18 bp, Homo sapiens
tggtgacatgtgcctgta

SEQ ID NO: 3966041 - DNA, 12 bp, Homo sapiens
tggtgacttcct

SEQ ID NO: 3966042 - DNA, 21 bp, Homo sapiens
tggtgagctgggaagctgtac

SEQ ID NO: 3966043 - DNA, 14 bp, Homo sapiens
tggtgaggtgtgga

SEQ ID NO: 3966044 - DNA, 19 bp, Homo sapiens
tggtgcagaggtgagcaga

SEQ ID NO: 3966045 - DNA, 20 bp, Homo sapiens
tggtgcagaggtgagcagag

SEQ ID NO: 3966046 - DNA, 19 bp, Homo sapiens
tggtgcagaggtttcttga

SEQ ID NO: 3966047 - DNA, 20 bp, Homo sapiens
tggtgcagaggtttcttgaa

SEQ ID NO: 3966048 - DNA, 17 bp, Homo sapiens
tggtgcaggatggcttt

SEQ ID NO: 3966049 - DNA, 13 bp, Homo sapiens
tggtgcctgcctc

SEQ ID NO: 3966050 - DNA, 12 bp, Homo sapiens
tggtgctaactg

SEQ ID NO: 3966051 - DNA, 14 bp, Homo sapiens
tggtgctaactgta

SEQ ID NO: 3966052 - DNA, 13 bp, Homo sapiens
tggtgctgacctc

SEQ ID NO: 3966053 - DNA, 12 bp, Homo sapiens
tggtgctgtggc

SEQ ID NO: 3966054 - DNA, 13 bp, Homo sapiens
tggtgctgtggcc

SEQ ID NO: 3966055 - DNA, 17 bp, Homo sapiens
tggtgctgtggccaggg

SEQ ID NO: 3966056 - DNA, 17 bp, Homo sapiens
tggtgctttcaggtctg

SEQ ID NO: 3966057 - DNA, 16 bp, Homo sapiens
tggtggaggaggagga

SEQ ID NO: 3966058 - DNA, 19 bp, Homo sapiens
tggtggcccgacagcctgg

SEQ ID NO: 3966059 - DNA, 17 bp, Homo sapiens
tggtggcgggcacctgt

SEQ ID NO: 3966060 - DNA, 23 bp, Homo sapiens
tggtgggagacgaacggaagggt

SEQ ID NO: 3966061 - DNA, 15 bp, Homo sapiens
tggtgggagggggag

SEQ ID NO: 3966062 - DNA, 12 bp, Homo sapiens
tggtgggctggc

SEQ ID NO: 3966063 - DNA, 16 bp, Homo sapiens
tggtgtaatgcacaat

SEQ ID NO: 3966064 - DNA, 19 bp, Homo sapiens
tggtgtaatgcacaattta

SEQ ID NO: 3966065 - DNA, 23 bp, Homo sapiens
tggtgtatcccccccctgtatag

SEQ ID NO: 3966066 - DNA, 13 bp, Homo sapiens
tggtgtcaggcag

SEQ ID NO: 3966067 - DNA, 14 bp, Homo sapiens
tggtgtcaggcagg

SEQ ID NO: 3966068 - DNA, 17 bp, Homo sapiens
tggtgtccacctggccc

SEQ ID NO: 3966069 - DNA, 18 bp, Homo sapiens
tggtgtccacctggcccc

SEQ ID NO: 3966070 - DNA, 13 bp, Homo sapiens
tggtgtccctgcg

SEQ ID NO: 3966071 - DNA, 18 bp, Homo sapiens
tggtgtgaccctctgaat

SEQ ID NO: 3966072 - DNA, 11 bp, Homo sapiens
tggtgtgtttc

SEQ ID NO: 3966073 - DNA, 11 bp, Homo sapiens
tggtgttgccc

SEQ ID NO: 3966074 - DNA, 17 bp, Homo sapiens
tggttaatctttcctga

SEQ ID NO: 3966075 - DNA, 16 bp, Homo sapiens
tggttactctggtgct

SEQ ID NO: 3966076 - DNA, 14 bp, Homo sapiens
tggttccaagaaag

SEQ ID NO: 3966077 - DNA, 20 bp, Homo sapiens
tggttcccaataaaagtgac

SEQ ID NO: 3966078 - DNA, 21 bp, Homo sapiens
tggttcccaataaaagtgact

SEQ ID NO: 3966079 - DNA, 18 bp, Homo sapiens
tggttcccctgttcactc

SEQ ID NO: 3966080 - DNA, 14 bp, Homo sapiens
tggttcctctacta

SEQ ID NO: 3966081 - DNA, 16 bp, Homo sapiens
tggttccttccctggg

SEQ ID NO: 3966082 - DNA, 15 bp, Homo sapiens
tggttgaggtggaag

SEQ ID NO: 3966083 - DNA, 18 bp, Homo sapiens
tggttgccttaaagaaag

SEQ ID NO: 3966084 - DNA, 12 bp, Homo sapiens
tggttgcttcag

SEQ ID NO: 3966085 - DNA, 13 bp, Homo sapiens
tggttggggtggg

SEQ ID NO: 3966086 - DNA, 15 bp, Homo sapiens
tggttggggtggggc

SEQ ID NO: 3966087 - DNA, 17 bp, Homo sapiens
tggttgtaaatgctcgt

SEQ ID NO: 3966088 - DNA, 17 bp, Homo sapiens
tggttgtcaatattaaa

SEQ ID NO: 3966089 - DNA, 15 bp, Homo sapiens
tggtttaatttaaag

SEQ ID NO: 3966090 - DNA, 12 bp, Homo sapiens
tggtttatgtca

SEQ ID NO: 3966091 - DNA, 19 bp, Homo sapiens
tggtttctgcgtgctttat

SEQ ID NO: 3966092 - DNA, 14 bp, Homo sapiens
tggtttggggagaa

SEQ ID NO: 3966093 - DNA, 12 bp, Homo sapiens
tggttttaacaa

SEQ ID NO: 3966094 - DNA, 24 bp, Homo sapiens
tggtttttgcaagatttaacacta

SEQ ID NO: 3966095 - DNA, 20 bp, Homo sapiens
tgtaaaaacaaaaagacagt

SEQ ID NO: 3966096 - DNA, 22 bp, Homo sapiens
tgtaaaaagagagaaaacttat

SEQ ID NO: 3966097 - DNA, 19 bp, Homo sapiens
tgtaaaagaacagtaaaca

SEQ ID NO: 3966098 - DNA, 18 bp, Homo sapiens
tgtaaaatatctacctgc

SEQ ID NO: 3966099 - DNA, 18 bp, Homo sapiens
tgtaaaatgcagtccaga

SEQ ID NO: 3966100 - DNA, 21 bp, Homo sapiens
tgtaaaatttatacacacaaa

SEQ ID NO: 3966101 - DNA, 20 bp, Homo sapiens
tgtaaacaggagacaggaag

SEQ ID NO: 3966102 - DNA, 12 bp, Homo sapiens
tgtaaacagtgc

SEQ ID NO: 3966103 - DNA, 16 bp, Homo sapiens
tgtaaacagtgcctgc

SEQ ID NO: 3966104 - DNA, 17 bp, Homo sapiens
tgtaaacattcatcaag

SEQ ID NO: 3966105 - DNA, 23 bp, Homo sapiens
tgtaaactataaactactgtaat

SEQ ID NO: 3966106 - DNA, 16 bp, Homo sapiens
tgtaaactcaaaactt

SEQ ID NO: 3966107 - DNA, 22 bp, Homo sapiens
tgtaaactcaaaacttaacata

SEQ ID NO: 3966108 - DNA, 15 bp, Homo sapiens
tgtaaactcaaaata

SEQ ID NO: 3966109 - DNA, 23 bp, Homo sapiens
tgtaaactcaaaatatttgtaca

SEQ ID NO: 3966110 - DNA, 20 bp, Homo sapiens
tgtaaagaataaatgaatct

SEQ ID NO: 3966111 - DNA, 18 bp, Homo sapiens
tgtaaagccaacaccctg

SEQ ID NO: 3966112 - DNA, 17 bp, Homo sapiens
tgtaaagtgtaaatcct

SEQ ID NO: 3966113 - DNA, 13 bp, Homo sapiens
tgtaaatacaaaa

SEQ ID NO: 3966114 - DNA, 16 bp, Homo sapiens
tgtaaatacatgtgtg

SEQ ID NO: 3966115 - DNA, 18 bp, Homo sapiens
tgtaaatacatgtgtgga

SEQ ID NO: 3966116 - DNA, 12 bp, Homo sapiens
tgtaaatattta

SEQ ID NO: 3966117 - DNA, 14 bp, Homo sapiens
tgtaaatcacttgt

SEQ ID NO: 3966118 - DNA, 20 bp, Homo sapiens
tgtaaatcacttgtaaataa

SEQ ID NO: 3966119 - DNA, 21 bp, Homo sapiens
tgtaaatcacttgtaaataaa

SEQ ID NO: 3966120 - DNA, 12 bp, Homo sapiens
tgtaaatccttt

SEQ ID NO: 3966121 - DNA, 21 bp, Homo sapiens
tgtaaatgaccaagaaaaaga

SEQ ID NO: 3966122 - DNA, 23 bp, Homo sapiens
tgtaaatgaccaagaaaaagaaa

SEQ ID NO: 3966123 - DNA, 22 bp, Homo sapiens
tgtaaatgctgtcaactatgat

SEQ ID NO: 3966124 - DNA, 18 bp, Homo sapiens
tgtaaatggagcttgtac

SEQ ID NO: 3966125 - DNA, 23 bp, Homo sapiens
tgtaaattaggaggctcaacaat

SEQ ID NO: 3966126 - DNA, 20 bp, Homo sapiens
tgtaacacagctgagagact

SEQ ID NO: 3966127 - DNA, 12 bp, Homo sapiens
tgtaactccacc

SEQ ID NO: 3966128 - DNA, 17 bp, Homo sapiens
tgtaactgctgagccac

SEQ ID NO: 3966129 - DNA, 12 bp, Homo sapiens
tgtaacttcaaa

SEQ ID NO: 3966130 - DNA, 20 bp, Homo sapiens
tgtaacttttgtaagacaaa

SEQ ID NO: 3966131 - DNA, 20 bp, Homo sapiens
tgtaagacaaaggttttcct

SEQ ID NO: 3966132 - DNA, 16 bp, Homo sapiens
tgtaagggtctgttgt

SEQ ID NO: 3966133 - DNA, 18 bp, Homo sapiens
tgtaagggtctgttgtaa

SEQ ID NO: 3966134 - DNA, 21 bp, Homo sapiens
tgtaagggtctgttgtaaatg

SEQ ID NO: 3966135 - DNA, 14 bp, Homo sapiens
tgtaaggtcttctt

SEQ ID NO: 3966136 - DNA, 21 bp, Homo sapiens
tgtaagtaattgcatttctgc

SEQ ID NO: 3966137 - DNA, 13 bp, Homo sapiens
tgtaagtcaggag

SEQ ID NO: 3966138 - DNA, 13 bp, Homo sapiens
tgtaataaaaggt

SEQ ID NO: 3966139 - DNA, 14 bp, Homo sapiens
tgtaatcagtttta

SEQ ID NO: 3966140 - DNA, 20 bp, Homo sapiens
tgtaatcccagctactcagg

SEQ ID NO: 3966141 - DNA, 23 bp, Homo sapiens
tgtaatcccagctactcaggagg

SEQ ID NO: 3966142 - DNA, 22 bp, Homo sapiens
tgtaatcctgtatattatggtg

SEQ ID NO: 3966143 - DNA, 23 bp, Homo sapiens
tgtaatgcacaatttagaaaaca

SEQ ID NO: 3966144 - DNA, 20 bp, Homo sapiens
tgtaatgtcaccaccttccc

SEQ ID NO: 3966145 - DNA, 16 bp, Homo sapiens
tgtaattaagtgcaat

SEQ ID NO: 3966146 - DNA, 20 bp, Homo sapiens
tgtaattaagtgcaatttcc

SEQ ID NO: 3966147 - DNA, 15 bp, Homo sapiens
tgtaattaatatctt

SEQ ID NO: 3966148 - DNA, 14 bp, Homo sapiens
tgtaattgcttaca

SEQ ID NO: 3966149 - DNA, 16 bp, Homo sapiens
tgtaattttgtttgta

SEQ ID NO: 3966150 - DNA, 22 bp, Homo sapiens
tgtaatttttcagctctctgta

SEQ ID NO: 3966151 - DNA, 14 bp, Homo sapiens
tgtacaaaagtacc

SEQ ID NO: 3966152 - DNA, 13 bp, Homo sapiens
tgtacaaatactg

SEQ ID NO: 3966153 - DNA, 13 bp, Homo sapiens
tgtacagaatttt

SEQ ID NO: 3966154 - DNA, 18 bp, Homo sapiens
tgtacagaatttttaatg

SEQ ID NO: 3966155 - DNA, 18 bp, Homo sapiens
tgtacatagttatttatt

SEQ ID NO: 3966156 - DNA, 12 bp, Homo sapiens
tgtacatgtgta

SEQ ID NO: 3966157 - DNA, 22 bp, Homo sapiens
tgtacatgtgtagggaaagtta

SEQ ID NO: 3966158 - DNA, 23 bp, Homo sapiens
tgtacattccctgcatccaatct

SEQ ID NO: 3966159 - DNA, 15 bp, Homo sapiens
tgtacattctaaaat

SEQ ID NO: 3966160 - DNA, 14 bp, Homo sapiens
tgtaccaagcccct

SEQ ID NO: 3966161 - DNA, 17 bp, Homo sapiens
tgtaccaggtcattctt

SEQ ID NO: 3966162 - DNA, 16 bp, Homo sapiens
tgtacccaatttaatt

SEQ ID NO: 3966163 - DNA, 21 bp, Homo sapiens
tgtacccaccgggccactcct

SEQ ID NO: 3966164 - DNA, 16 bp, Homo sapiens
tgtacccttcctacag

SEQ ID NO: 3966165 - DNA, 19 bp, Homo sapiens
tgtaccgcgtctaccctgg

SEQ ID NO: 3966166 - DNA, 20 bp, Homo sapiens
tgtaccgcgtctaccctggg

SEQ ID NO: 3966167 - DNA, 15 bp, Homo sapiens
tgtaccttgaccatc

SEQ ID NO: 3966168 - DNA, 17 bp, Homo sapiens
tgtacgttatatattgt

SEQ ID NO: 3966169 - DNA, 21 bp, Homo sapiens
tgtactacgtgccagctctag

SEQ ID NO: 3966170 - DNA, 16 bp, Homo sapiens
tgtactattgtttaaa

SEQ ID NO: 3966171 - DNA, 15 bp, Homo sapiens
tgtactcagagcaga

SEQ ID NO: 3966172 - DNA, 19 bp, Homo sapiens
tgtactcagagcagagcaa

SEQ ID NO: 3966173 - DNA, 21 bp, Homo sapiens
tgtactccagagggacagggt

SEQ ID NO: 3966174 - DNA, 13 bp, Homo sapiens
tgtactcctccca

SEQ ID NO: 3966175 - DNA, 19 bp, Homo sapiens
tgtactctacgccaaagtg

SEQ ID NO: 3966176 - DNA, 12 bp, Homo sapiens
tgtactgaaaaa

SEQ ID NO: 3966177 - DNA, 14 bp, Homo sapiens
tgtactgcctgctt

SEQ ID NO: 3966178 - DNA, 15 bp, Homo sapiens
tgtactgtaattttg

SEQ ID NO: 3966179 - DNA, 16 bp, Homo sapiens
tgtacttcctgtgtac

SEQ ID NO: 3966180 - DNA, 19 bp, Homo sapiens
tgtacttcctgtgtactct

SEQ ID NO: 3966181 - DNA, 15 bp, Homo sapiens
tgtagaaatctgtaa

SEQ ID NO: 3966182 - DNA, 20 bp, Homo sapiens
tgtagaaatctgtaattcta

SEQ ID NO: 3966183 - DNA, 17 bp, Homo sapiens
tgtagaatgatttcatg

SEQ ID NO: 3966184 - DNA, 14 bp, Homo sapiens
tgtagagcttctgg

SEQ ID NO: 3966185 - DNA, 15 bp, Homo sapiens
tgtagattacctgcc

SEQ ID NO: 3966186 - DNA, 17 bp, Homo sapiens
tgtagattacctgccac

SEQ ID NO: 3966187 - DNA, 15 bp, Homo sapiens
tgtagccagccgggg

SEQ ID NO: 3966188 - DNA, 21 bp, Homo sapiens
tgtagccatggctcaggcaag

SEQ ID NO: 3966189 - DNA, 16 bp, Homo sapiens
tgtagcccggccaggg

SEQ ID NO: 3966190 - DNA, 16 bp, Homo sapiens
tgtagctcctctgctg

SEQ ID NO: 3966191 - DNA, 14 bp, Homo sapiens
tgtagctctgcctc

SEQ ID NO: 3966192 - DNA, 14 bp, Homo sapiens
tgtagctgatgaaa

SEQ ID NO: 3966193 - DNA, 15 bp, Homo sapiens
tgtagctgtgacctg

SEQ ID NO: 3966194 - DNA, 17 bp, Homo sapiens
tgtagctgtgacctgct

SEQ ID NO: 3966195 - DNA, 19 bp, Homo sapiens
tgtagctgtgacctgctga

SEQ ID NO: 3966196 - DNA, 20 bp, Homo sapiens
tgtagctgtgacctgctgag

SEQ ID NO: 3966197 - DNA, 21 bp, Homo sapiens
tgtagctgtgacctgctgagc

SEQ ID NO: 3966198 - DNA, 22 bp, Homo sapiens
tgtagctgtgacctgctgagct

SEQ ID NO: 3966199 - DNA, 15 bp, Homo sapiens
tgtagctttatcctt

SEQ ID NO: 3966200 - DNA, 13 bp, Homo sapiens
tgtagctttgctc

SEQ ID NO: 3966201 - DNA, 19 bp, Homo sapiens
tgtaggaatcctttgagaa

SEQ ID NO: 3966202 - DNA, 23 bp, Homo sapiens
tgtaggaatgaccacgggcctca

SEQ ID NO: 3966203 - DNA, 11 bp, Homo sapiens
tgtaggagaat

SEQ ID NO: 3966204 - DNA, 15 bp, Homo sapiens
tgtagggctggacct

SEQ ID NO: 3966205 - DNA, 16 bp, Homo sapiens
tgtagggctggaccta

SEQ ID NO: 3966206 - DNA, 14 bp, Homo sapiens
tgtaggtaaatcta

SEQ ID NO: 3966207 - DNA, 20 bp, Homo sapiens
tgtaggtgtctgcacccagg

SEQ ID NO: 3966208 - DNA, 18 bp, Homo sapiens
tgtagtagccctttctgt

SEQ ID NO: 3966209 - DNA, 15 bp, Homo sapiens
tgtagtcccagccac

SEQ ID NO: 3966210 - DNA, 13 bp, Homo sapiens
tgtagtggaagag

SEQ ID NO: 3966211 - DNA, 20 bp, Homo sapiens
tgtagtggaagagcagcctg

SEQ ID NO: 3966212 - DNA, 13 bp, Homo sapiens
tgtagttaggaaa

SEQ ID NO: 3966213 - DNA, 23 bp, Homo sapiens
tgtagttaggaaataaaaccttt

SEQ ID NO: 3966214 - DNA, 19 bp, Homo sapiens
tgtagttcttgtctgattg

SEQ ID NO: 3966215 - DNA, 19 bp, Homo sapiens
tgtagttcttgtgcatgtt

SEQ ID NO: 3966216 - DNA, 16 bp, Homo sapiens
tgtagttttaacagaa

SEQ ID NO: 3966217 - DNA, 15 bp, Homo sapiens
tgtataaatgtatat

SEQ ID NO: 3966218 - DNA, 16 bp, Homo sapiens
tgtataaatgtatata

SEQ ID NO: 3966219 - DNA, 18 bp, Homo sapiens
tgtataaatgtatataca

SEQ ID NO: 3966220 - DNA, 22 bp, Homo sapiens
tgtataagattagaatgaaaat

SEQ ID NO: 3966221 - DNA, 16 bp, Homo sapiens
tgtataagtgcacaca

SEQ ID NO: 3966222 - DNA, 22 bp, Homo sapiens
tgtataatttaacagtgccctt

SEQ ID NO: 3966223 - DNA, 13 bp, Homo sapiens
tgtatacacacat

SEQ ID NO: 3966224 - DNA, 18 bp, Homo sapiens
tgtatacacacatataca

SEQ ID NO: 3966225 - DNA, 17 bp, Homo sapiens
tgtatacattttgttat

SEQ ID NO: 3966226 - DNA, 22 bp, Homo sapiens
tgtatacattttgttatagaat

SEQ ID NO: 3966227 - DNA, 18 bp, Homo sapiens
tgtatagatgcaagatat

SEQ ID NO: 3966228 - DNA, 20 bp, Homo sapiens
tgtatagatgcaagatattt

SEQ ID NO: 3966229 - DNA, 16 bp, Homo sapiens
tgtatagtgtaaaata

SEQ ID NO: 3966230 - DNA, 24 bp, Homo sapiens
tgtatagtgtaaaataagaatgat

SEQ ID NO: 3966231 - DNA, 21 bp, Homo sapiens
tgtatagttttataaaactca

SEQ ID NO: 3966232 - DNA, 21 bp, Homo sapiens
tgtatataatactaaagtgtc

SEQ ID NO: 3966233 - DNA, 15 bp, Homo sapiens
tgtatatacaataac

SEQ ID NO: 3966234 - DNA, 14 bp, Homo sapiens
tgtatatacacata

SEQ ID NO: 3966235 - DNA, 20 bp, Homo sapiens
tgtatatacacatataccta

SEQ ID NO: 3966236 - DNA, 17 bp, Homo sapiens
tgtatatacatattata

SEQ ID NO: 3966237 - DNA, 18 bp, Homo sapiens
tgtatatagatgtgcaag

SEQ ID NO: 3966238 - DNA, 11 bp, Homo sapiens
tgtatatatac

SEQ ID NO: 3966239 - DNA, 13 bp, Homo sapiens
tgtatatatacat

SEQ ID NO: 3966240 - DNA, 14 bp, Homo sapiens
tgtatatatacata

SEQ ID NO: 3966241 - DNA, 20 bp, Homo sapiens
tgtatatatacatacacttg

SEQ ID NO: 3966242 - DNA, 15 bp, Homo sapiens
tgtatatatatatgt

SEQ ID NO: 3966243 - DNA, 13 bp, Homo sapiens
tgtatatatgtgt

SEQ ID NO: 3966244 - DNA, 14 bp, Homo sapiens
tgtatatatgtgta

SEQ ID NO: 3966245 - DNA, 16 bp, Homo sapiens
tgtatatatgtgtata

SEQ ID NO: 3966246 - DNA, 18 bp, Homo sapiens
tgtatatatgtgtatata

SEQ ID NO: 3966247 - DNA, 23 bp, Homo sapiens
tgtatatatgtgtatatatacat

SEQ ID NO: 3966248 - DNA, 13 bp, Homo sapiens
tgtatatgatcta

SEQ ID NO: 3966249 - DNA, 23 bp, Homo sapiens
tgtatatgatctaatacaaagat

SEQ ID NO: 3966250 - DNA, 21 bp, Homo sapiens
tgtatattatggaagatttta

SEQ ID NO: 3966251 - DNA, 21 bp, Homo sapiens
tgtatattccaccattcacat

SEQ ID NO: 3966252 - DNA, 22 bp, Homo sapiens
tgtatattccaccattcacatt

SEQ ID NO: 3966253 - DNA, 15 bp, Homo sapiens
tgtatcacaaatctt

SEQ ID NO: 3966254 - DNA, 15 bp, Homo sapiens
tgtatcatagaaatg

SEQ ID NO: 3966255 - DNA, 17 bp, Homo sapiens
tgtatcatagaaatgta

SEQ ID NO: 3966256 - DNA, 14 bp, Homo sapiens
tgtatcattaatgt

SEQ ID NO: 3966257 - DNA, 20 bp, Homo sapiens
tgtatcctgaggctgagaga

SEQ ID NO: 3966258 - DNA, 19 bp, Homo sapiens
tgtatcttctgcagacact

SEQ ID NO: 3966259 - DNA, 14 bp, Homo sapiens
tgtatgcactttgt

SEQ ID NO: 3966260 - DNA, 18 bp, Homo sapiens
tgtatggaatacagtgtt

SEQ ID NO: 3966261 - DNA, 14 bp, Homo sapiens
tgtatgtatgtgtg

SEQ ID NO: 3966262 - DNA, 21 bp, Homo sapiens
tgtatgtcagacatccatgtt

SEQ ID NO: 3966263 - DNA, 12 bp, Homo sapiens
tgtatgtctgcc

SEQ ID NO: 3966264 - DNA, 12 bp, Homo sapiens
tgtatgtgaaag

SEQ ID NO: 3966265 - DNA, 12 bp, Homo sapiens
tgtatgtgtatt

SEQ ID NO: 3966266 - DNA, 19 bp, Homo sapiens
tgtattaagccaaacatga

SEQ ID NO: 3966267 - DNA, 16 bp, Homo sapiens
tgtattatcacatcaa

SEQ ID NO: 3966268 - DNA, 21 bp, Homo sapiens
tgtattatcacatcaagcatg

SEQ ID NO: 3966269 - DNA, 16 bp, Homo sapiens
tgtattattttctata

SEQ ID NO: 3966270 - DNA, 19 bp, Homo sapiens
tgtattcagatcgtattaa

SEQ ID NO: 3966271 - DNA, 21 bp, Homo sapiens
tgtattcagatcgtattaatt

SEQ ID NO: 3966272 - DNA, 13 bp, Homo sapiens
tgtattctggctg

SEQ ID NO: 3966273 - DNA, 17 bp, Homo sapiens
tgtattctttactaaag

SEQ ID NO: 3966274 - DNA, 22 bp, Homo sapiens
tgtatttaaaaccttgatttaa

SEQ ID NO: 3966275 - DNA, 23 bp, Homo sapiens
tgtatttattgaagaaacagata

SEQ ID NO: 3966276 - DNA, 20 bp, Homo sapiens
tgtattttaaatgttttaca

SEQ ID NO: 3966277 - DNA, 14 bp, Homo sapiens
tgtattttttaaag

SEQ ID NO: 3966278 - DNA, 14 bp, Homo sapiens
tgtcaaaaaaaaaa

SEQ ID NO: 3966279 - DNA, 13 bp, Homo sapiens
tgtcaagattttt

SEQ ID NO: 3966280 - DNA, 19 bp, Homo sapiens
tgtcaagtacaagcaagac

SEQ ID NO: 3966281 - DNA, 15 bp, Homo sapiens
tgtcaatttgtatat

SEQ ID NO: 3966282 - DNA, 17 bp, Homo sapiens
tgtcaatttgtatatca

SEQ ID NO: 3966283 - DNA, 18 bp, Homo sapiens
tgtcaatttgtatatcat

SEQ ID NO: 3966284 - DNA, 15 bp, Homo sapiens
tgtcacagctctgta

SEQ ID NO: 3966285 - DNA, 18 bp, Homo sapiens
tgtcacagctctgtagaa

SEQ ID NO: 3966286 - DNA, 16 bp, Homo sapiens
tgtcaccaccttccca

SEQ ID NO: 3966287 - DNA, 21 bp, Homo sapiens
tgtcaccaccttcccagctct

SEQ ID NO: 3966288 - DNA, 23 bp, Homo sapiens
tgtcaccaccttcccagctctcc

SEQ ID NO: 3966289 - DNA, 14 bp, Homo sapiens
tgtcaccagctatc

SEQ ID NO: 3966290 - DNA, 17 bp, Homo sapiens
tgtcaccagctgccaaa

SEQ ID NO: 3966291 - DNA, 18 bp, Homo sapiens
tgtcaccagctgccaaaa

SEQ ID NO: 3966292 - DNA, 18 bp, Homo sapiens
tgtcaccctgcagagcta

SEQ ID NO: 3966293 - DNA, 16 bp, Homo sapiens
tgtcaccgtgagcagc

SEQ ID NO: 3966294 - DNA, 22 bp, Homo sapiens
tgtcaccgtgagcagctttgga

SEQ ID NO: 3966295 - DNA, 20 bp, Homo sapiens
tgtcaccgtggaccttcctg

SEQ ID NO: 3966296 - DNA, 22 bp, Homo sapiens
tgtcaccgtggaccttcctgcc

SEQ ID NO: 3966297 - DNA, 21 bp, Homo sapiens
tgtcactggtagaccaaaata

SEQ ID NO: 3966298 - DNA, 18 bp, Homo sapiens
tgtcagacaataccactg

SEQ ID NO: 3966299 - DNA, 17 bp, Homo sapiens
tgtcagagccaggctct

SEQ ID NO: 3966300 - DNA, 19 bp, Homo sapiens
tgtcagagctgttggcctc

SEQ ID NO: 3966301 - DNA, 15 bp, Homo sapiens
tgtcagccagccgcc

SEQ ID NO: 3966302 - DNA, 18 bp, Homo sapiens
tgtcagccagccgccctg

SEQ ID NO: 3966303 - DNA, 21 bp, Homo sapiens
tgtcagccgagccgggcctgg

SEQ ID NO: 3966304 - DNA, 21 bp, Homo sapiens
tgtcagctcccctcggagaag

SEQ ID NO: 3966305 - DNA, 17 bp, Homo sapiens
tgtcaggacccaggccg

SEQ ID NO: 3966306 - DNA, 20 bp, Homo sapiens
tgtcaggacccaggccgcct

SEQ ID NO: 3966307 - DNA, 14 bp, Homo sapiens
tgtcataagaatga

SEQ ID NO: 3966308 - DNA, 16 bp, Homo sapiens
tgtcatagaaattaca

SEQ ID NO: 3966309 - DNA, 15 bp, Homo sapiens
tgtcatatattcatg

SEQ ID NO: 3966310 - DNA, 16 bp, Homo sapiens
tgtcatatattcatgt

SEQ ID NO: 3966311 - DNA, 19 bp, Homo sapiens
tgtcatcaaatattaccaa

SEQ ID NO: 3966312 - DNA, 19 bp, Homo sapiens
tgtcatcagaagataactt

SEQ ID NO: 3966313 - DNA, 14 bp, Homo sapiens
tgtcatctctctgg

SEQ ID NO: 3966314 - DNA, 23 bp, Homo sapiens
tgtcatctttcttctattttatt

SEQ ID NO: 3966315 - DNA, 15 bp, Homo sapiens
tgtcatggaaaagcc

SEQ ID NO: 3966316 - DNA, 18 bp, Homo sapiens
tgtcatggaaaagcccag

SEQ ID NO: 3966317 - DNA, 22 bp, Homo sapiens
tgtcatggaaaatgtcctgtgg

SEQ ID NO: 3966318 - DNA, 19 bp, Homo sapiens
tgtcatgtacttcctgtgt

SEQ ID NO: 3966319 - DNA, 23 bp, Homo sapiens
tgtcattaaatggggctcacaaa

SEQ ID NO: 3966320 - DNA, 14 bp, Homo sapiens
tgtcattaatgtgt

SEQ ID NO: 3966321 - DNA, 15 bp, Homo sapiens
tgtcattaatgtgtt

SEQ ID NO: 3966322 - DNA, 16 bp, Homo sapiens
tgtcattatgtagaaa

SEQ ID NO: 3966323 - DNA, 16 bp, Homo sapiens
tgtcattcaagcctgt

SEQ ID NO: 3966324 - DNA, 15 bp, Homo sapiens
tgtcattttaaaatc

SEQ ID NO: 3966325 - DNA, 14 bp, Homo sapiens
tgtccaaggaaact

SEQ ID NO: 3966326 - DNA, 21 bp, Homo sapiens
tgtccaatggctgtaaactat

SEQ ID NO: 3966327 - DNA, 15 bp, Homo sapiens
tgtccaattatgcac

SEQ ID NO: 3966328 - DNA, 18 bp, Homo sapiens
tgtccaattatgcactgg

SEQ ID NO: 3966329 - DNA, 19 bp, Homo sapiens
tgtccaattatgcactggc

SEQ ID NO: 3966330 - DNA, 21 bp, Homo sapiens
tgtccagacagagccctgtga

SEQ ID NO: 3966331 - DNA, 22 bp, Homo sapiens
tgtccagacagagccctgtgag

SEQ ID NO: 3966332 - DNA, 20 bp, Homo sapiens
tgtccagaccattgtcttcc

SEQ ID NO: 3966333 - DNA, 21 bp, Homo sapiens
tgtccagaccattgtcttcca

SEQ ID NO: 3966334 - DNA, 12 bp, Homo sapiens
tgtccagcagct

SEQ ID NO: 3966335 - DNA, 14 bp, Homo sapiens
tgtccagcgcctag

SEQ ID NO: 3966336 - DNA, 14 bp, Homo sapiens
tgtccaggccactg

SEQ ID NO: 3966337 - DNA, 21 bp, Homo sapiens
tgtccaggccactgtggccag

SEQ ID NO: 3966338 - DNA, 14 bp, Homo sapiens
tgtccatgtgcttc

SEQ ID NO: 3966339 - DNA, 20 bp, Homo sapiens
tgtccatgtggttcttcaaa

SEQ ID NO: 3966340 - DNA, 22 bp, Homo sapiens
tgtcccaagctttgaatacccc

SEQ ID NO: 3966341 - DNA, 13 bp, Homo sapiens
tgtcccaccaact

SEQ ID NO: 3966342 - DNA, 16 bp, Homo sapiens
tgtcccaccaactctg

SEQ ID NO: 3966343 - DNA, 13 bp, Homo sapiens
tgtcccaccagct

SEQ ID NO: 3966344 - DNA, 22 bp, Homo sapiens
tgtcccacctcttctcttcctg

SEQ ID NO: 3966345 - DNA, 23 bp, Homo sapiens
tgtcccacctcttctcttcctgt

SEQ ID NO: 3966346 - DNA, 22 bp, Homo sapiens
tgtcccagaggttatctgcctg

SEQ ID NO: 3966347 - DNA, 14 bp, Homo sapiens
tgtcccaggtcctc

SEQ ID NO: 3966348 - DNA, 16 bp, Homo sapiens
tgtcccaggtcctcac

SEQ ID NO: 3966349 - DNA, 19 bp, Homo sapiens
tgtccccagtttgcagaaa

SEQ ID NO: 3966350 - DNA, 15 bp, Homo sapiens
tgtcccctcactctg

SEQ ID NO: 3966351 - DNA, 13 bp, Homo sapiens
tgtcccctctgtc

SEQ ID NO: 3966352 - DNA, 13 bp, Homo sapiens
tgtcccctgtccc

SEQ ID NO: 3966353 - DNA, 15 bp, Homo sapiens
tgtcccctgtcccac

SEQ ID NO: 3966354 - DNA, 20 bp, Homo sapiens
tgtcccctgtcccaccaact

SEQ ID NO: 3966355 - DNA, 15 bp, Homo sapiens
tgtccctacccactc

SEQ ID NO: 3966356 - DNA, 16 bp, Homo sapiens
tgtccctacccactct

SEQ ID NO: 3966357 - DNA, 21 bp, Homo sapiens
tgtccctaccgagtctcttct

SEQ ID NO: 3966358 - DNA, 19 bp, Homo sapiens
tgtccctcaaatgacccaa

SEQ ID NO: 3966359 - DNA, 14 bp, Homo sapiens
tgtccctggtgcag

SEQ ID NO: 3966360 - DNA, 21 bp, Homo sapiens
tgtccctgtcaccaagctcac

SEQ ID NO: 3966361 - DNA, 15 bp, Homo sapiens
tgtccgcctctgccc

SEQ ID NO: 3966362 - DNA, 23 bp, Homo sapiens
tgtcctccaacaataaagagctc

SEQ ID NO: 3966363 - DNA, 13 bp, Homo sapiens
tgtcctcccatcc

SEQ ID NO: 3966364 - DNA, 22 bp, Homo sapiens
tgtcctcccatcccctggactg

SEQ ID NO: 3966365 - DNA, 11 bp, Homo sapiens
tgtcctcctcg

SEQ ID NO: 3966366 - DNA, 21 bp, Homo sapiens
tgtcctcctcggatcaccgag

SEQ ID NO: 3966367 - DNA, 12 bp, Homo sapiens
tgtcctctcccc

SEQ ID NO: 3966368 - DNA, 21 bp, Homo sapiens
tgtcctctcccctctgccctg

SEQ ID NO: 3966369 - DNA, 23 bp, Homo sapiens
tgtcctctttactcccttcctgg

SEQ ID NO: 3966370 - DNA, 15 bp, Homo sapiens
tgtcctgccagctgc

SEQ ID NO: 3966371 - DNA, 11 bp, Homo sapiens
tgtcctgcctc

SEQ ID NO: 3966372 - DNA, 21 bp, Homo sapiens
tgtcctgcctctctgctccag

SEQ ID NO: 3966373 - DNA, 22 bp, Homo sapiens
tgtcctgcctctctgctccaga

SEQ ID NO: 3966374 - DNA, 23 bp, Homo sapiens
tgtcctgcctctctgctccagag

SEQ ID NO: 3966375 - DNA, 19 bp, Homo sapiens
tgtcctgctctcttcagga

SEQ ID NO: 3966376 - DNA, 15 bp, Homo sapiens
tgtcctggctgctct

SEQ ID NO: 3966377 - DNA, 18 bp, Homo sapiens
tgtcctggtacagcaggg

SEQ ID NO: 3966378 - DNA, 20 bp, Homo sapiens
tgtcctgtagaggttttgtt

SEQ ID NO: 3966379 - DNA, 16 bp, Homo sapiens
tgtccttcagagctct

SEQ ID NO: 3966380 - DNA, 18 bp, Homo sapiens
tgtccttcagagctcttc

SEQ ID NO: 3966381 - DNA, 16 bp, Homo sapiens
tgtccttccctgcatt

SEQ ID NO: 3966382 - DNA, 14 bp, Homo sapiens
tgtcctttgagaaa

SEQ ID NO: 3966383 - DNA, 13 bp, Homo sapiens
tgtcgagacactt

SEQ ID NO: 3966384 - DNA, 19 bp, Homo sapiens
tgtcgctctgctggcctgg

SEQ ID NO: 3966385 - DNA, 18 bp, Homo sapiens
tgtcggcacgtcccatgt

SEQ ID NO: 3966386 - DNA, 17 bp, Homo sapiens
tgtcgtgtttacaaaag

SEQ ID NO: 3966387 - DNA, 19 bp, Homo sapiens
tgtctaaagagctttagtc

SEQ ID NO: 3966388 - DNA, 22 bp, Homo sapiens
tgtctaaggtcacacagtatta

SEQ ID NO: 3966389 - DNA, 18 bp, Homo sapiens
tgtctataatggaaacat

SEQ ID NO: 3966390 - DNA, 22 bp, Homo sapiens
tgtctattagttttctttgtaa

SEQ ID NO: 3966391 - DNA, 19 bp, Homo sapiens
tgtctattctgagccttga

SEQ ID NO: 3966392 - DNA, 18 bp, Homo sapiens
tgtctcaagagggcactg

SEQ ID NO: 3966393 - DNA, 21 bp, Homo sapiens
tgtctcaagagggcactggtg

SEQ ID NO: 3966394 - DNA, 19 bp, Homo sapiens
tgtctcaagctcttcctta

SEQ ID NO: 3966395 - DNA, 17 bp, Homo sapiens
tgtctcagcctcctcag

SEQ ID NO: 3966396 - DNA, 17 bp, Homo sapiens
tgtctcaggtccctgca

SEQ ID NO: 3966397 - DNA, 15 bp, Homo sapiens
tgtctcagtgctggt

SEQ ID NO: 3966398 - DNA, 15 bp, Homo sapiens
tgtctccataatgcc

SEQ ID NO: 3966399 - DNA, 15 bp, Homo sapiens
tgtctcgagcgccct

SEQ ID NO: 3966400 - DNA, 17 bp, Homo sapiens
tgtctcgagcgccctgc

SEQ ID NO: 3966401 - DNA, 20 bp, Homo sapiens
tgtctcgagcgccctgcaga

SEQ ID NO: 3966402 - DNA, 19 bp, Homo sapiens
tgtctctagccactttggt

SEQ ID NO: 3966403 - DNA, 15 bp, Homo sapiens
tgtctctagccgggc

SEQ ID NO: 3966404 - DNA, 18 bp, Homo sapiens
tgtctctagtttctttct

SEQ ID NO: 3966405 - DNA, 13 bp, Homo sapiens
tgtctctcattct

SEQ ID NO: 3966406 - DNA, 16 bp, Homo sapiens
tgtctctcattctctt

SEQ ID NO: 3966407 - DNA, 21 bp, Homo sapiens
tgtctctcattctctttcttt

SEQ ID NO: 3966408 - DNA, 15 bp, Homo sapiens
tgtctctcccacccc

SEQ ID NO: 3966409 - DNA, 13 bp, Homo sapiens
tgtctctgaggac

SEQ ID NO: 3966410 - DNA, 16 bp, Homo sapiens
tgtctctgcatctcat

SEQ ID NO: 3966411 - DNA, 16 bp, Homo sapiens
tgtctgaagtcactgc

SEQ ID NO: 3966412 - DNA, 19 bp, Homo sapiens
tgtctgaagtcactgcaca

SEQ ID NO: 3966413 - DNA, 16 bp, Homo sapiens
tgtctgaggcctcatc

SEQ ID NO: 3966414 - DNA, 14 bp, Homo sapiens
tgtctgcacccagg

SEQ ID NO: 3966415 - DNA, 15 bp, Homo sapiens
tgtctgcacccaggg

SEQ ID NO: 3966416 - DNA, 13 bp, Homo sapiens
tgtctgcttctgt

SEQ ID NO: 3966417 - DNA, 16 bp, Homo sapiens
tgtctggaagctgagc

SEQ ID NO: 3966418 - DNA, 23 bp, Homo sapiens
tgtctggctgaggatttcaagcc

SEQ ID NO: 3966419 - DNA, 22 bp, Homo sapiens
tgtctggttttaacaatttcct

SEQ ID NO: 3966420 - DNA, 11 bp, Homo sapiens
tgtctgtcacc

SEQ ID NO: 3966421 - DNA, 24 bp, Homo sapiens
tgtctgtcaccagctatctgtcat

SEQ ID NO: 3966422 - DNA, 15 bp, Homo sapiens
tgtctgtctgtctgt

SEQ ID NO: 3966423 - DNA, 22 bp, Homo sapiens
tgtctgtttcaatgacctgtat

SEQ ID NO: 3966424 - DNA, 12 bp, Homo sapiens
tgtcttaattaa

SEQ ID NO: 3966425 - DNA, 17 bp, Homo sapiens
tgtcttccaaccccagc

SEQ ID NO: 3966426 - DNA, 17 bp, Homo sapiens
tgtgaaaatgaggagga

SEQ ID NO: 3966427 - DNA, 16 bp, Homo sapiens
tgtgaaaccacaggcc

SEQ ID NO: 3966428 - DNA, 20 bp, Homo sapiens
tgtgaaaggaagctccactg

SEQ ID NO: 3966429 - DNA, 16 bp, Homo sapiens
tgtgaaagtatgtgat

SEQ ID NO: 3966430 - DNA, 14 bp, Homo sapiens
tgtgaacatggact

SEQ ID NO: 3966431 - DNA, 13 bp, Homo sapiens
tgtgaacccagga

SEQ ID NO: 3966432 - DNA, 14 bp, Homo sapiens
tgtgaacccaggac

SEQ ID NO: 3966433 - DNA, 16 bp, Homo sapiens
tgtgaacccaggacaa

SEQ ID NO: 3966434 - DNA, 15 bp, Homo sapiens
tgtgaatcagaccct

SEQ ID NO: 3966435 - DNA, 16 bp, Homo sapiens
tgtgaattctgtgaag

SEQ ID NO: 3966436 - DNA, 18 bp, Homo sapiens
tgtgaattgcctgcagag

SEQ ID NO: 3966437 - DNA, 23 bp, Homo sapiens
tgtgaatttcttcactgttgaaa

SEQ ID NO: 3966438 - DNA, 20 bp, Homo sapiens
tgtgacagaatcttgtattt

SEQ ID NO: 3966439 - DNA, 19 bp, Homo sapiens
tgtgaccacatacgtgtta

SEQ ID NO: 3966440 - DNA, 21 bp, Homo sapiens
tgtgacccagatcctcacaac

SEQ ID NO: 3966441 - DNA, 14 bp, Homo sapiens
tgtgaccctctgaa

SEQ ID NO: 3966442 - DNA, 16 bp, Homo sapiens
tgtgaccctctgaatg

SEQ ID NO: 3966443 - DNA, 17 bp, Homo sapiens
tgtgacctgctgagctc

SEQ ID NO: 3966444 - DNA, 18 bp, Homo sapiens
tgtgacctgctgagctct

SEQ ID NO: 3966445 - DNA, 22 bp, Homo sapiens
tgtgacctgctgagctctgaga

SEQ ID NO: 3966446 - DNA, 12 bp, Homo sapiens
tgtgactctctt

SEQ ID NO: 3966447 - DNA, 21 bp, Homo sapiens
tgtgagattactttgtcccgc

SEQ ID NO: 3966448 - DNA, 14 bp, Homo sapiens
tgtgagcccctggt

SEQ ID NO: 3966449 - DNA, 21 bp, Homo sapiens
tgtgagcccctggtcctgagg

SEQ ID NO: 3966450 - DNA, 22 bp, Homo sapiens
tgtgagcccctggtcctgaggg

SEQ ID NO: 3966451 - DNA, 20 bp, Homo sapiens
tgtgaggactgggggcacct

SEQ ID NO: 3966452 - DNA, 14 bp, Homo sapiens
tgtgaggcccctgg

SEQ ID NO: 3966453 - DNA, 22 bp, Homo sapiens
tgtgaggcccctggacaagcag

SEQ ID NO: 3966454 - DNA, 14 bp, Homo sapiens
tgtgaggctgggcc

SEQ ID NO: 3966455 - DNA, 19 bp, Homo sapiens
tgtgaggctgggccagcct

SEQ ID NO: 3966456 - DNA, 20 bp, Homo sapiens
tgtgagtgactcggtgtaaa

SEQ ID NO: 3966457 - DNA, 19 bp, Homo sapiens
tgtgagtggcagccatgcc

SEQ ID NO: 3966458 - DNA, 17 bp, Homo sapiens
tgtgatccttttatgtt

SEQ ID NO: 3966459 - DNA, 21 bp, Homo sapiens
tgtgatccttttatgttattt

SEQ ID NO: 3966460 - DNA, 20 bp, Homo sapiens
tgtgatctatcaatagtcaa

SEQ ID NO: 3966461 - DNA, 15 bp, Homo sapiens
tgtgatgaactttct

SEQ ID NO: 3966462 - DNA, 16 bp, Homo sapiens
tgtgatgaggcagagg

SEQ ID NO: 3966463 - DNA, 15 bp, Homo sapiens
tgtgattcaaaagat

SEQ ID NO: 3966464 - DNA, 13 bp, Homo sapiens
tgtgattggagtg

SEQ ID NO: 3966465 - DNA, 17 bp, Homo sapiens
tgtgattggagtgtgtc

SEQ ID NO: 3966466 - DNA, 14 bp, Homo sapiens
tgtgatttcctaca

SEQ ID NO: 3966467 - DNA, 12 bp, Homo sapiens
tgtgcaaatcct

SEQ ID NO: 3966468 - DNA, 16 bp, Homo sapiens
tgcctcctcttcaact

SEQ ID NO: 3966469 - DNA, 18 bp, Homo sapiens
tgcctccttatttatcaa

SEQ ID NO: 3966470 - DNA, 17 bp, Homo sapiens
tgcctcgaggcaccggc

SEQ ID NO: 3966471 - DNA, 23 bp, Homo sapiens
tgcctcgaggcaccggcgctgca

SEQ ID NO: 3966472 - DNA, 16 bp, Homo sapiens
tgcctctactgggaag

SEQ ID NO: 3966473 - DNA, 23 bp, Homo sapiens
tgcctctactgggaaggctactt

SEQ ID NO: 3966474 - DNA, 12 bp, Homo sapiens
tgcctctcacac

SEQ ID NO: 3966475 - DNA, 11 bp, Homo sapiens
tgcctctgagg

SEQ ID NO: 3966476 - DNA, 16 bp, Homo sapiens
tgcctctgaggccagc

SEQ ID NO: 3966477 - DNA, 19 bp, Homo sapiens
tgcctctgaggccagcctg

SEQ ID NO: 3966478 - DNA, 18 bp, Homo sapiens
tgcctctgatatgggact

SEQ ID NO: 3966479 - DNA, 16 bp, Homo sapiens
tgcctctgccatgccc

SEQ ID NO: 3966480 - DNA, 20 bp, Homo sapiens
tgcctcttggcagcccttga

SEQ ID NO: 3966481 - DNA, 14 bp, Homo sapiens
tgcctcttgttgca

SEQ ID NO: 3966482 - DNA, 15 bp, Homo sapiens
tgcctcttgttgcag

SEQ ID NO: 3966483 - DNA, 18 bp, Homo sapiens
tgcctgagcccaggagct

SEQ ID NO: 3966484 - DNA, 14 bp, Homo sapiens
tgcctgcagagaga

SEQ ID NO: 3966485 - DNA, 15 bp, Homo sapiens
tgcctgcagagagaa

SEQ ID NO: 3966486 - DNA, 14 bp, Homo sapiens
tgcctgcagcctcc

SEQ ID NO: 3966487 - DNA, 16 bp, Homo sapiens
tgcctgccgcccaaag

SEQ ID NO: 3966488 - DNA, 15 bp, Homo sapiens
tgcctgcctctgcca

SEQ ID NO: 3966489 - DNA, 19 bp, Homo sapiens
tgcctgcctctgccatgcc

SEQ ID NO: 3966490 - DNA, 21 bp, Homo sapiens
tgcctgcctctgccatgccca

SEQ ID NO: 3966491 - DNA, 15 bp, Homo sapiens
tgcctggaggacctg

SEQ ID NO: 3966492 - DNA, 16 bp, Homo sapiens
tgcctggaggacctga

SEQ ID NO: 3966493 - DNA, 19 bp, Homo sapiens
tgcctggaggacctgagcc

SEQ ID NO: 3966494 - DNA, 20 bp, Homo sapiens
tgcctggaggacctgagcct

SEQ ID NO: 3966495 - DNA, 21 bp, Homo sapiens
tgcctggaggacctgagcctg

SEQ ID NO: 3966496 - DNA, 22 bp, Homo sapiens
tgcctggaggacctgagcctgc

SEQ ID NO: 3966497 - DNA, 21 bp, Homo sapiens
tgcctggaggatccctccatc

SEQ ID NO: 3966498 - DNA, 13 bp, Homo sapiens
tgcctggcctggc

SEQ ID NO: 3966499 - DNA, 14 bp, Homo sapiens
tgcctggcctggct

SEQ ID NO: 3966500 - DNA, 15 bp, Homo sapiens
tgcctggcctggctc

SEQ ID NO: 3966501 - DNA, 12 bp, Homo sapiens
tgcctggctgtg

SEQ ID NO: 3966502 - DNA, 19 bp, Homo sapiens
tgcctggctgtggaggcct

SEQ ID NO: 3966503 - DNA, 20 bp, Homo sapiens
tgcctggctgtggaggcctg

SEQ ID NO: 3966504 - DNA, 14 bp, Homo sapiens
tgcctgggaggctt

SEQ ID NO: 3966505 - DNA, 12 bp, Homo sapiens
tgcctgggcctg

SEQ ID NO: 3966506 - DNA, 17 bp, Homo sapiens
tgcctgggcctgtgcag

SEQ ID NO: 3966507 - DNA, 17 bp, Homo sapiens
tgcctgggtggggctgc

SEQ ID NO: 3966508 - DNA, 19 bp, Homo sapiens
tgcctgggtggggctgctc

SEQ ID NO: 3966509 - DNA, 22 bp, Homo sapiens
tgcctgggtggggctgctcctc

SEQ ID NO: 3966510 - DNA, 22 bp, Homo sapiens
tgcctgggttttctaactgtaa

SEQ ID NO: 3966511 - DNA, 23 bp, Homo sapiens
tgcctgggttttctaactgtaaa

SEQ ID NO: 3966512 - DNA, 18 bp, Homo sapiens
tgcctgtagttaggaaat

SEQ ID NO: 3966513 - DNA, 21 bp, Homo sapiens
tgcctgtagttaggaaataaa

SEQ ID NO: 3966514 - DNA, 20 bp, Homo sapiens
tgcctgtcagtttcatggag

SEQ ID NO: 3966515 - DNA, 14 bp, Homo sapiens
tgcctgtgaggcag

SEQ ID NO: 3966516 - DNA, 16 bp, Homo sapiens
tgcctgtgaggcaggg

SEQ ID NO: 3966517 - DNA, 23 bp, Homo sapiens
tgcctgtgcatgacctgatcatt

SEQ ID NO: 3966518 - DNA, 18 bp, Homo sapiens
tgcctgtggcagaaaaga

SEQ ID NO: 3966519 - DNA, 23 bp, Homo sapiens
tgcctgtgggggtccatttgggt

SEQ ID NO: 3966520 - DNA, 17 bp, Homo sapiens
tgccttaaaaggagaga

SEQ ID NO: 3966521 - DNA, 20 bp, Homo sapiens
tgccttaaaaggagagaaga

SEQ ID NO: 3966522 - DNA, 15 bp, Homo sapiens
tgccttaaagaaagt

SEQ ID NO: 3966523 - DNA, 14 bp, Homo sapiens
tgccttagaacctt

SEQ ID NO: 3966524 - DNA, 21 bp, Homo sapiens
tgccttagaacctttcttaca

SEQ ID NO: 3966525 - DNA, 17 bp, Homo sapiens
tgccttatgtaattatt

SEQ ID NO: 3966526 - DNA, 18 bp, Homo sapiens
tgccttcagctctacagc

SEQ ID NO: 3966527 - DNA, 13 bp, Homo sapiens
tgccttcctcatc

SEQ ID NO: 3966528 - DNA, 16 bp, Homo sapiens
tgccttcctcatcccc

SEQ ID NO: 3966529 - DNA, 17 bp, Homo sapiens
tgccttcctcatcccct

SEQ ID NO: 3966530 - DNA, 20 bp, Homo sapiens
tgccttcgcggtggaaggcc

SEQ ID NO: 3966531 - DNA, 16 bp, Homo sapiens
tgccttcttcacccag

SEQ ID NO: 3966532 - DNA, 17 bp, Homo sapiens
tgccttcttcacccagc

SEQ ID NO: 3966533 - DNA, 21 bp, Homo sapiens
tgccttcttcggggaactcct

SEQ ID NO: 3966534 - DNA, 18 bp, Homo sapiens
tgccttgacaacagactg

SEQ ID NO: 3966535 - DNA, 19 bp, Homo sapiens
tgccttgacaacagactga

SEQ ID NO: 3966536 - DNA, 17 bp, Homo sapiens
tgcctttagatgtgagc

SEQ ID NO: 3966537 - DNA, 15 bp, Homo sapiens
tgccttttaaaagaa

SEQ ID NO: 3966538 - DNA, 17 bp, Homo sapiens
tgccttttatagctatt

SEQ ID NO: 3966539 - DNA, 16 bp, Homo sapiens
tgccttttttcacagc

SEQ ID NO: 3966540 - DNA, 23 bp, Homo sapiens
tgccttttttcacagcccgggtg

SEQ ID NO: 3966541 - DNA, 21 bp, Homo sapiens
tgcgagaggtccctgcttacc

SEQ ID NO: 3966542 - DNA, 19 bp, Homo sapiens
tgcgattttgcctgtgtct

SEQ ID NO: 3966543 - DNA, 22 bp, Homo sapiens
tgcgcacaaggctgaccaagag

SEQ ID NO: 3966544 - DNA, 14 bp, Homo sapiens
tgcgcgtgtgcacg

SEQ ID NO: 3966545 - DNA, 12 bp, Homo sapiens
tgcggcaggagc

SEQ ID NO: 3966546 - DNA, 17 bp, Homo sapiens
tgcgggggagctggaaa

SEQ ID NO: 3966547 - DNA, 20 bp, Homo sapiens
tgcgggggagctggaaataa

SEQ ID NO: 3966548 - DNA, 21 bp, Homo sapiens
tgcggtggctcacgcctgtaa

SEQ ID NO: 3966549 - DNA, 18 bp, Homo sapiens
tgcggtggtgccagaggt

SEQ ID NO: 3966550 - DNA, 16 bp, Homo sapiens
tgcgtatatgtgcgtc

SEQ ID NO: 3966551 - DNA, 13 bp, Homo sapiens
tgcgtccctgtac

SEQ ID NO: 3966552 - DNA, 22 bp, Homo sapiens
tgcgtctctctttctccctcac

SEQ ID NO: 3966553 - DNA, 16 bp, Homo sapiens
tgcgtgcgtgtgcgtg

SEQ ID NO: 3966554 - DNA, 23 bp, Homo sapiens
tgctgaattattttgttgtgatt

SEQ ID NO: 3966555 - DNA, 14 bp, Homo sapiens
tgctgaatttcagg

SEQ ID NO: 3966556 - DNA, 15 bp, Homo sapiens
tgctgacagctgacc

SEQ ID NO: 3966557 - DNA, 23 bp, Homo sapiens
tgctgacatggctttgctttgtg

SEQ ID NO: 3966558 - DNA, 16 bp, Homo sapiens
tgctgactgtactcct

SEQ ID NO: 3966559 - DNA, 15 bp, Homo sapiens
tgctgagaatagtgt

SEQ ID NO: 3966560 - DNA, 17 bp, Homo sapiens
tgctgagagacccaagg

SEQ ID NO: 3966561 - DNA, 21 bp, Homo sapiens
tgctgagagacccaaggagga

SEQ ID NO: 3966562 - DNA, 14 bp, Homo sapiens
tgctgagctctgag

SEQ ID NO: 3966563 - DNA, 15 bp, Homo sapiens
tgctgagctctgaga

SEQ ID NO: 3966564 - DNA, 21 bp, Homo sapiens
tgctgagctctgagaggccct

SEQ ID NO: 3966565 - DNA, 23 bp, Homo sapiens
tgctgagctctgagaggccctgg

SEQ ID NO: 3966566 - DNA, 15 bp, Homo sapiens
tgctgagcttagcct

SEQ ID NO: 3966567 - DNA, 16 bp, Homo sapiens
tgctgagcttagcctt

SEQ ID NO: 3966568 - DNA, 24 bp, Homo sapiens
tgctgagcttagccttgtgccctg

SEQ ID NO: 3966569 - DNA, 21 bp, Homo sapiens
tgctgattcaagaaacagaag

SEQ ID NO: 3966570 - DNA, 16 bp, Homo sapiens
tgctgcaaagtgcaaa

SEQ ID NO: 3966571 - DNA, 20 bp, Homo sapiens
tgctgcaaagtgcaaatact

SEQ ID NO: 3966572 - DNA, 13 bp, Homo sapiens
tgctgcaccagag

SEQ ID NO: 3966573 - DNA, 14 bp, Homo sapiens
tgctgcaccagagt

SEQ ID NO: 3966574 - DNA, 19 bp, Homo sapiens
tgctgccacacttcaggct

SEQ ID NO: 3966575 - DNA, 22 bp, Homo sapiens
tgctgccacacttcaggctctt

SEQ ID NO: 3966576 - DNA, 13 bp, Homo sapiens
tgctgccatgcca

SEQ ID NO: 3966577 - DNA, 21 bp, Homo sapiens
tgctgccatgccactgccagg

SEQ ID NO: 3966578 - DNA, 20 bp, Homo sapiens
tgctgccgcctcccagcctg

SEQ ID NO: 3966579 - DNA, 20 bp, Homo sapiens
tgctgcgtcagaccagtact

SEQ ID NO: 3966580 - DNA, 15 bp, Homo sapiens
tgctgctcatccagg

SEQ ID NO: 3966581 - DNA, 13 bp, Homo sapiens
tgctgctgagaac

SEQ ID NO: 3966582 - DNA, 15 bp, Homo sapiens
tgctgctgagaacct

SEQ ID NO: 3966583 - DNA, 17 bp, Homo sapiens
tgctgctgagaacctgg

SEQ ID NO: 3966584 - DNA, 20 bp, Homo sapiens
tgctgctgagaacctggcct

SEQ ID NO: 3966585 - DNA, 23 bp, Homo sapiens
tgctgctgtaactgctgagccac

SEQ ID NO: 3966586 - DNA, 18 bp, Homo sapiens
tgctggaaaccacacttc

SEQ ID NO: 3966587 - DNA, 14 bp, Homo sapiens
tgctggactgagga

SEQ ID NO: 3966588 - DNA, 15 bp, Homo sapiens
tgctggactgaggac

SEQ ID NO: 3966589 - DNA, 19 bp, Homo sapiens
tgctggactgaggaccaca

SEQ ID NO: 3966590 - DNA, 19 bp, Homo sapiens
tgctggactgtcatagaaa

SEQ ID NO: 3966591 - DNA, 12 bp, Homo sapiens
tgctggagctgg

SEQ ID NO: 3966592 - DNA, 16 bp, Homo sapiens
tgctggagctggcttt

SEQ ID NO: 3966593 - DNA, 15 bp, Homo sapiens
tgctggattaatgtt

SEQ ID NO: 3966594 - DNA, 15 bp, Homo sapiens
tgctggcacctcaga

SEQ ID NO: 3966595 - DNA, 17 bp, Homo sapiens
tgctggcacctcagaca

SEQ ID NO: 3966596 - DNA, 14 bp, Homo sapiens
tgctggccagcacc

SEQ ID NO: 3966597 - DNA, 16 bp, Homo sapiens
tgctggccagcaccct

SEQ ID NO: 3966598 - DNA, 14 bp, Homo sapiens
tgctggcctggatc

SEQ ID NO: 3966599 - DNA, 18 bp, Homo sapiens
tgctggcctggatctccc

SEQ ID NO: 3966600 - DNA, 13 bp, Homo sapiens
tgctggcctggcc

SEQ ID NO: 3966601 - DNA, 20 bp, Homo sapiens
tgctggcggcgcagagggaa

SEQ ID NO: 3966602 - DNA, 14 bp, Homo sapiens
tgctggctgcctta

SEQ ID NO: 3966603 - DNA, 19 bp, Homo sapiens
tgctgggaaccccgcagcc

SEQ ID NO: 3966604 - DNA, 20 bp, Homo sapiens
tgctgggaaccccgcagccc

SEQ ID NO: 3966605 - DNA, 23 bp, Homo sapiens
tgctgggaaccccgcagcccgtg

SEQ ID NO: 3966606 - DNA, 16 bp, Homo sapiens
tgctgggctctccacc

SEQ ID NO: 3966607 - DNA, 19 bp, Homo sapiens
tgctggggcatgtgtgcct

SEQ ID NO: 3966608 - DNA, 22 bp, Homo sapiens
tgctggtaatttgtatctgaag

SEQ ID NO: 3966609 - DNA, 20 bp, Homo sapiens
tgctggtctaggagctgtct

SEQ ID NO: 3966610 - DNA, 16 bp, Homo sapiens
tgctggttttaacaac

SEQ ID NO: 3966611 - DNA, 19 bp, Homo sapiens
tgctgtaactgctgagcca

SEQ ID NO: 3966612 - DNA, 20 bp, Homo sapiens
tgctgtctccataatgccac

SEQ ID NO: 3966613 - DNA, 22 bp, Homo sapiens
tgctgtctccataatgccactg

SEQ ID NO: 3966614 - DNA, 13 bp, Homo sapiens
tgctgtgcctgct

SEQ ID NO: 3966615 - DNA, 15 bp, Homo sapiens
tgctgtgcctgctag

SEQ ID NO: 3966616 - DNA, 12 bp, Homo sapiens
tgctgtggccag

SEQ ID NO: 3966617 - DNA, 14 bp, Homo sapiens
tgctgtggccaggg

SEQ ID NO: 3966618 - DNA, 14 bp, Homo sapiens
tgctgtgggagagc

SEQ ID NO: 3966619 - DNA, 21 bp, Homo sapiens
tgctgtgggcagcaccctccc

SEQ ID NO: 3966620 - DNA, 21 bp, Homo sapiens
tgctgtgggtgatatggacag

SEQ ID NO: 3966621 - DNA, 15 bp, Homo sapiens
tgctgttgttgcagg

SEQ ID NO: 3966622 - DNA, 19 bp, Homo sapiens
tgctgtttgtttgacaaag

SEQ ID NO: 3966623 - DNA, 18 bp, Homo sapiens
tgctgttttgatttgtac

SEQ ID NO: 3966624 - DNA, 13 bp, Homo sapiens
tgcttaaaatatg

SEQ ID NO: 3966625 - DNA, 15 bp, Homo sapiens
tgcttaaaatatgta

SEQ ID NO: 3966626 - DNA, 12 bp, Homo sapiens
tgcttaaattat

SEQ ID NO: 3966627 - DNA, 21 bp, Homo sapiens
tgcttaaattatttttataca

SEQ ID NO: 3966628 - DNA, 17 bp, Homo sapiens
tgcttacagtgactgtc

SEQ ID NO: 3966629 - DNA, 13 bp, Homo sapiens
tgcttacctgacg

SEQ ID NO: 3966630 - DNA, 15 bp, Homo sapiens
tgcttagaaagttat

SEQ ID NO: 3966631 - DNA, 16 bp, Homo sapiens
tgcttagaaagttatt

SEQ ID NO: 3966632 - DNA, 18 bp, Homo sapiens
tgcttagaaagttattgt

SEQ ID NO: 3966633 - DNA, 14 bp, Homo sapiens
tgcttagcctcctg

SEQ ID NO: 3966634 - DNA, 14 bp, Homo sapiens
tgcttaggatgttt

SEQ ID NO: 3966635 - DNA, 20 bp, Homo sapiens
tgcttagtatggttctcaga

SEQ ID NO: 3966636 - DNA, 21 bp, Homo sapiens
tgcttatgacatcacttgtac

SEQ ID NO: 3966637 - DNA, 18 bp, Homo sapiens
tgcttatttccctcatct

SEQ ID NO: 3966638 - DNA, 23 bp, Homo sapiens
tgcttcaattaataaaaaatgga

SEQ ID NO: 3966639 - DNA, 16 bp, Homo sapiens
tgcttcagtggagaat

SEQ ID NO: 3966640 - DNA, 15 bp, Homo sapiens
tgcttccaattttct

SEQ ID NO: 3966641 - DNA, 21 bp, Homo sapiens
tcatccctatgggattcagtg

SEQ ID NO: 3966642 - DNA, 12 bp, Homo sapiens
tcatccctttcc

SEQ ID NO: 3966643 - DNA, 18 bp, Homo sapiens
tcatcctgtgtggggagg

SEQ ID NO: 3966644 - DNA, 19 bp, Homo sapiens
tcatcctgtgtggggaggc

SEQ ID NO: 3966645 - DNA, 15 bp, Homo sapiens
tcatcgaacaaactg

SEQ ID NO: 3966646 - DNA, 17 bp, Homo sapiens
tcatctcactgcccagt

SEQ ID NO: 3966647 - DNA, 13 bp, Homo sapiens
tcatctctctggg

SEQ ID NO: 3966648 - DNA, 15 bp, Homo sapiens
tcatctctctggggc

SEQ ID NO: 3966649 - DNA, 20 bp, Homo sapiens
tcatctggcttttcgcttgc

SEQ ID NO: 3966650 - DNA, 19 bp, Homo sapiens
tcatctgtgtgaaaatggg

SEQ ID NO: 3966651 - DNA, 14 bp, Homo sapiens
tcatgaaaagagga

SEQ ID NO: 3966652 - DNA, 23 bp, Homo sapiens
tcatgaaaagaggaacaggtgga

SEQ ID NO: 3966653 - DNA, 11 bp, Homo sapiens
tcatgaaaagt

SEQ ID NO: 3966654 - DNA, 23 bp, Homo sapiens
tcatgacaaagttacaaattcaa

SEQ ID NO: 3966655 - DNA, 21 bp, Homo sapiens
tcatgacatgttatatatttt

SEQ ID NO: 3966656 - DNA, 15 bp, Homo sapiens
tcatgaccagcaaat

SEQ ID NO: 3966657 - DNA, 14 bp, Homo sapiens
tcatgagtggatgg

SEQ ID NO: 3966658 - DNA, 15 bp, Homo sapiens
tcatgagtggatgga

SEQ ID NO: 3966659 - DNA, 23 bp, Homo sapiens
tcatgagtggatggatggacaga

SEQ ID NO: 3966660 - DNA, 13 bp, Homo sapiens
tcatgatctccct

SEQ ID NO: 3966661 - DNA, 14 bp, Homo sapiens
tcatgatctccctg

SEQ ID NO: 3966662 - DNA, 19 bp, Homo sapiens
tcatgatctccctgccgcc

SEQ ID NO: 3966663 - DNA, 22 bp, Homo sapiens
tcatgatctccctgccgcctca

SEQ ID NO: 3966664 - DNA, 20 bp, Homo sapiens
tcatgccaaagcaaaagaag

SEQ ID NO: 3966665 - DNA, 18 bp, Homo sapiens
tcatgccatctgttttca

SEQ ID NO: 3966666 - DNA, 16 bp, Homo sapiens
tcatgcctcagtttcc

SEQ ID NO: 3966667 - DNA, 19 bp, Homo sapiens
tcatgcctcagtttcccca

SEQ ID NO: 3966668 - DNA, 21 bp, Homo sapiens
tcatgcctctgaggccagcct

SEQ ID NO: 3966669 - DNA, 23 bp, Homo sapiens
tcatgcctgcctgataccctgct

SEQ ID NO: 3966670 - DNA, 19 bp, Homo sapiens
tcatgcctggcccccctcc

SEQ ID NO: 3966671 - DNA, 23 bp, Homo sapiens
tcatgcctggcccccctccaggc

SEQ ID NO: 3966672 - DNA, 17 bp, Homo sapiens
tcatgcttcttccttac

SEQ ID NO: 3966673 - DNA, 16 bp, Homo sapiens
tcatggaaaagcccag

SEQ ID NO: 3966674 - DNA, 11 bp, Homo sapiens
tcatggagaaa

SEQ ID NO: 3966675 - DNA, 23 bp, Homo sapiens
tcatggagtgacggtcccacact

SEQ ID NO: 3966676 - DNA, 15 bp, Homo sapiens
tcatggcttaatgtt

SEQ ID NO: 3966677 - DNA, 15 bp, Homo sapiens
tcatggcttagaaat

SEQ ID NO: 3966678 - DNA, 17 bp, Homo sapiens
tcatggtcagctcacac

SEQ ID NO: 3966679 - DNA, 23 bp, Homo sapiens
tcatgtaaattttgtatgaaaaa

SEQ ID NO: 3966680 - DNA, 19 bp, Homo sapiens
tcatgtatgttcagaagaa

SEQ ID NO: 3966681 - DNA, 16 bp, Homo sapiens
tcatgtcaggcctgtg

SEQ ID NO: 3966682 - DNA, 17 bp, Homo sapiens
tcatgtcaggcctgtgt

SEQ ID NO: 3966683 - DNA, 19 bp, Homo sapiens
tcatgtcaggcctgtgtgt

SEQ ID NO: 3966684 - DNA, 15 bp, Homo sapiens
tcatgtgatcctttt

SEQ ID NO: 3966685 - DNA, 18 bp, Homo sapiens
tcatgtggaatataaaga

SEQ ID NO: 3966686 - DNA, 14 bp, Homo sapiens
tcatgtgtgcatgt

SEQ ID NO: 3966687 - DNA, 15 bp, Homo sapiens
tcatgtgtgcatgtg

SEQ ID NO: 3966688 - DNA, 16 bp, Homo sapiens
tcatgtgtgctgtgct

SEQ ID NO: 3966689 - DNA, 13 bp, Homo sapiens
tcatgttcctcaa

SEQ ID NO: 3966690 - DNA, 17 bp, Homo sapiens
tcatgttggccaggctg

SEQ ID NO: 3966691 - DNA, 13 bp, Homo sapiens
tcatgttggtcaa

SEQ ID NO: 3966692 - DNA, 18 bp, Homo sapiens
tcatgttgttcccacaca

SEQ ID NO: 3966693 - DNA, 15 bp, Homo sapiens
tcattaaatggggct

SEQ ID NO: 3966694 - DNA, 18 bp, Homo sapiens
tcattaaattggaatttt

SEQ ID NO: 3966695 - DNA, 16 bp, Homo sapiens
tcattaggtttccttt

SEQ ID NO: 3966696 - DNA, 18 bp, Homo sapiens
tcattcaagcctgtgaat

SEQ ID NO: 3966697 - DNA, 16 bp, Homo sapiens
tcattcaatacaagtg

SEQ ID NO: 3966698 - DNA, 12 bp, Homo sapiens
tcattcccctcg

SEQ ID NO: 3966699 - DNA, 13 bp, Homo sapiens
tcattcccctcgt

SEQ ID NO: 3966700 - DNA, 15 bp, Homo sapiens
tcattccttcactca

SEQ ID NO: 3966701 - DNA, 17 bp, Homo sapiens
tcattcgcctgtgggaa

SEQ ID NO: 3966702 - DNA, 12 bp, Homo sapiens
tcattctcctgc

SEQ ID NO: 3966703 - DNA, 15 bp, Homo sapiens
tcattctcctgcctg

SEQ ID NO: 3966704 - DNA, 16 bp, Homo sapiens
tcattctcctgcctgt

SEQ ID NO: 3966705 - DNA, 13 bp, Homo sapiens
tcattctctttct

SEQ ID NO: 3966706 - DNA, 22 bp, Homo sapiens
tcattcttaagatttctcctga

SEQ ID NO: 3966707 - DNA, 17 bp, Homo sapiens
tcattgggttttatcag

SEQ ID NO: 3966708 - DNA, 19 bp, Homo sapiens
tcattgggttttatcagtg

SEQ ID NO: 3966709 - DNA, 17 bp, Homo sapiens
tcattgtagaaacacag

SEQ ID NO: 3966710 - DNA, 14 bp, Homo sapiens
tcattgtagagctt

SEQ ID NO: 3966711 - DNA, 21 bp, Homo sapiens
tcattgtatatatgtgtgttt

SEQ ID NO: 3966712 - DNA, 19 bp, Homo sapiens
tccaccgctgcctaagtgg

SEQ ID NO: 3966713 - DNA, 13 bp, Homo sapiens
tccacctcagcct

SEQ ID NO: 3966714 - DNA, 13 bp, Homo sapiens
tccacctcctaga

SEQ ID NO: 3966715 - DNA, 13 bp, Homo sapiens
tccacctgcctat

SEQ ID NO: 3966716 - DNA, 15 bp, Homo sapiens
tccaccttgctcttc

SEQ ID NO: 3966717 - DNA, 16 bp, Homo sapiens
tccacgcacacatgga

SEQ ID NO: 3966718 - DNA, 19 bp, Homo sapiens
tccacgcctcctggccaga

SEQ ID NO: 3966719 - DNA, 18 bp, Homo sapiens
tccacgggggcggcaggc

SEQ ID NO: 3966720 - DNA, 22 bp, Homo sapiens
tccacgggtctcacttatacca

SEQ ID NO: 3966721 - DNA, 20 bp, Homo sapiens
tccacggtgcgtggctgtgg

SEQ ID NO: 3966722 - DNA, 17 bp, Homo sapiens
tccacgtccccctgggg

SEQ ID NO: 3966723 - DNA, 12 bp, Homo sapiens
tccactcactcc

SEQ ID NO: 3966724 - DNA, 13 bp, Homo sapiens
tccactcactcca

SEQ ID NO: 3966725 - DNA, 18 bp, Homo sapiens
tccactcactccagccca

SEQ ID NO: 3966726 - DNA, 21 bp, Homo sapiens
tccactcactccagcccaaca

SEQ ID NO: 3966727 - DNA, 17 bp, Homo sapiens
tccactccacctccacc

SEQ ID NO: 3966728 - DNA, 15 bp, Homo sapiens
tccactctcaggagg

SEQ ID NO: 3966729 - DNA, 15 bp, Homo sapiens
tccactgccttcgat

SEQ ID NO: 3966730 - DNA, 22 bp, Homo sapiens
tccactgccttcgatacaccgg

SEQ ID NO: 3966731 - DNA, 17 bp, Homo sapiens
tccagaaaatataaatg

SEQ ID NO: 3966732 - DNA, 22 bp, Homo sapiens
tccagaaaatataaatgcatga

SEQ ID NO: 3966733 - DNA, 23 bp, Homo sapiens
tccagaaaatataaatgcatgat

SEQ ID NO: 3966734 - DNA, 23 bp, Homo sapiens
tccagaactgaggtcactgggtt

SEQ ID NO: 3966735 - DNA, 18 bp, Homo sapiens
tccagaagaatattcagg

SEQ ID NO: 3966736 - DNA, 21 bp, Homo sapiens
tccagaagaatattcaggact

SEQ ID NO: 3966737 - DNA, 17 bp, Homo sapiens
tccagaagatgccctcc

SEQ ID NO: 3966738 - DNA, 18 bp, Homo sapiens
tccagaagatgccctcca

SEQ ID NO: 3966739 - DNA, 19 bp, Homo sapiens
tccagacatacgaaacaca

SEQ ID NO: 3966740 - DNA, 22 bp, Homo sapiens
tccagaccacctgccagccatc

SEQ ID NO: 3966741 - DNA, 15 bp, Homo sapiens
tccagaccattgtct

SEQ ID NO: 3966742 - DNA, 20 bp, Homo sapiens
tccagaccattgtcttccaa

SEQ ID NO: 3966743 - DNA, 13 bp, Homo sapiens
tccagacccctgg

SEQ ID NO: 3966744 - DNA, 17 bp, Homo sapiens
tccagacccctggcttt

SEQ ID NO: 3966745 - DNA, 18 bp, Homo sapiens
tccagacccctggctttt

SEQ ID NO: 3966746 - DNA, 19 bp, Homo sapiens
tccagaccctgcctgagcc

SEQ ID NO: 3966747 - DNA, 22 bp, Homo sapiens
tccagaccctgcctgagcccag

SEQ ID NO: 3966748 - DNA, 22 bp, Homo sapiens
tccagactgcttccaattttct

SEQ ID NO: 3966749 - DNA, 12 bp, Homo sapiens
tccagagacagg

SEQ ID NO: 3966750 - DNA, 13 bp, Homo sapiens
tccagagacagga

SEQ ID NO: 3966751 - DNA, 22 bp, Homo sapiens
tccagagagaggatgcagaggg

SEQ ID NO: 3966752 - DNA, 10 bp, Homo sapiens
tccagagcca

SEQ ID NO: 3966753 - DNA, 18 bp, Homo sapiens
tccagagcctaagaaaat

SEQ ID NO: 3966754 - DNA, 17 bp, Homo sapiens
tccagagggacagggtg

SEQ ID NO: 3966755 - DNA, 11 bp, Homo sapiens
tccagatctgc

SEQ ID NO: 3966756 - DNA, 12 bp, Homo sapiens
tccagatctgca

SEQ ID NO: 3966757 - DNA, 14 bp, Homo sapiens
tccagatgccttcc

SEQ ID NO: 3966758 - DNA, 21 bp, Homo sapiens
tccagatgccttcctgtcttt

SEQ ID NO: 3966759 - DNA, 13 bp, Homo sapiens
tccagcagctgcg

SEQ ID NO: 3966760 - DNA, 15 bp, Homo sapiens
tccagcagctgcggg

SEQ ID NO: 3966761 - DNA, 17 bp, Homo sapiens
tccagcccacacccctc

SEQ ID NO: 3966762 - DNA, 16 bp, Homo sapiens
tccagcctctcccggc

SEQ ID NO: 3966763 - DNA, 17 bp, Homo sapiens
tccagcctctcccggct

SEQ ID NO: 3966764 - DNA, 22 bp, Homo sapiens
tccagcctctcccggctgcctg

SEQ ID NO: 3966765 - DNA, 17 bp, Homo sapiens
tccagcgcctgccctcc

SEQ ID NO: 3966766 - DNA, 20 bp, Homo sapiens
tccagctagtgacccacatg

SEQ ID NO: 3966767 - DNA, 16 bp, Homo sapiens
tccagctgcctgggag

SEQ ID NO: 3966768 - DNA, 21 bp, Homo sapiens
tccaggaaggcagctgctctt

SEQ ID NO: 3966769 - DNA, 15 bp, Homo sapiens
tccaggacatgatac

SEQ ID NO: 3966770 - DNA, 14 bp, Homo sapiens
tccaggagcccaga

SEQ ID NO: 3966771 - DNA, 16 bp, Homo sapiens
tccaggagcccagagg

SEQ ID NO: 3966772 - DNA, 14 bp, Homo sapiens
tccaggagcctggc

SEQ ID NO: 3966773 - DNA, 15 bp, Homo sapiens
tccaggatcctgcag

SEQ ID NO: 3966774 - DNA, 19 bp, Homo sapiens
tccaggattgaagagcatt

SEQ ID NO: 3966775 - DNA, 16 bp, Homo sapiens
tccaggcacccttctt

SEQ ID NO: 3966776 - DNA, 20 bp, Homo sapiens
tccaggcacccttctttcct

SEQ ID NO: 3966777 - DNA, 19 bp, Homo sapiens
tccaggcatgctggcctcc

SEQ ID NO: 3966778 - DNA, 19 bp, Homo sapiens
tccaggccactgtggccag

SEQ ID NO: 3966779 - DNA, 22 bp, Homo sapiens
tccaggccactgtggccagagc

SEQ ID NO: 3966780 - DNA, 17 bp, Homo sapiens
tccaggcccctgaggac

SEQ ID NO: 3966781 - DNA, 22 bp, Homo sapiens
tccaggctcttcctggacctga

SEQ ID NO: 3966782 - DNA, 22 bp, Homo sapiens
tccagggcatccgcagcccagg

SEQ ID NO: 3966783 - DNA, 13 bp, Homo sapiens
tccagggtcttgg

SEQ ID NO: 3966784 - DNA, 15 bp, Homo sapiens
tccagggtcttgggc

SEQ ID NO: 3966785 - DNA, 17 bp, Homo sapiens
tccagggtcttgggcta

SEQ ID NO: 3966786 - DNA, 21 bp, Homo sapiens
tccagggtcttgggctactgg

SEQ ID NO: 3966787 - DNA, 15 bp, Homo sapiens
tccaggtctcgggtc

SEQ ID NO: 3966788 - DNA, 15 bp, Homo sapiens
tccagtctcctgaca

SEQ ID NO: 3966789 - DNA, 13 bp, Homo sapiens
tccagtgagctgg

SEQ ID NO: 3966790 - DNA, 18 bp, Homo sapiens
tccagtgatgtgctggag

SEQ ID NO: 3966791 - DNA, 17 bp, Homo sapiens
tccagtgcaaccacaca

SEQ ID NO: 3966792 - DNA, 23 bp, Homo sapiens
tccagtgggaggtgagaccacct

SEQ ID NO: 3966793 - DNA, 21 bp, Homo sapiens
tccagtgttggctgtgtgaca

SEQ ID NO: 3966794 - DNA, 22 bp, Homo sapiens
tccagttaaggaccgtggccct

SEQ ID NO: 3966795 - DNA, 16 bp, Homo sapiens
tccagttcatgagaat

SEQ ID NO: 3966796 - DNA, 16 bp, Homo sapiens
tccagttgcaataaaa

SEQ ID NO: 3966797 - DNA, 18 bp, Homo sapiens
tccagttgcaataaaata

SEQ ID NO: 3966798 - DNA, 20 bp, Homo sapiens
tccagttgcaataaaatagt

SEQ ID NO: 3966799 - DNA, 22 bp, Homo sapiens
tcccagcacttttggaggccaa

SEQ ID NO: 3966800 - DNA, 18 bp, Homo sapiens
tcccagcagccctaagga

SEQ ID NO: 3966801 - DNA, 16 bp, Homo sapiens
tcccagcagctgggcc

SEQ ID NO: 3966802 - DNA, 18 bp, Homo sapiens
tcccagcagctgggccgg

SEQ ID NO: 3966803 - DNA, 15 bp, Homo sapiens
tcccagcccaaagct

SEQ ID NO: 3966804 - DNA, 18 bp, Homo sapiens
tcccagccctgccaggag

SEQ ID NO: 3966805 - DNA, 19 bp, Homo sapiens
tcccagccctgccaggagg

SEQ ID NO: 3966806 - DNA, 24 bp, Homo sapiens
tcccagcgtttagtttctagaggc

SEQ ID NO: 3966807 - DNA, 14 bp, Homo sapiens
tcccagctactcag

SEQ ID NO: 3966808 - DNA, 15 bp, Homo sapiens
tcccagctactcagg

SEQ ID NO: 3966809 - DNA, 17 bp, Homo sapiens
tcccagctactcaggag

SEQ ID NO: 3966810 - DNA, 16 bp, Homo sapiens
tcccagctctccctct

SEQ ID NO: 3966811 - DNA, 18 bp, Homo sapiens
tcccagctctccctctgg

SEQ ID NO: 3966812 - DNA, 22 bp, Homo sapiens
tcccagctctccctctggccct

SEQ ID NO: 3966813 - DNA, 23 bp, Homo sapiens
tcccagctctccctctggccctg

SEQ ID NO: 3966814 - DNA, 18 bp, Homo sapiens
tcccaggaatatcccaaa

SEQ ID NO: 3966815 - DNA, 22 bp, Homo sapiens
tcccaggagacagttcaagaaa

SEQ ID NO: 3966816 - DNA, 12 bp, Homo sapiens
tcccaggagggg

SEQ ID NO: 3966817 - DNA, 13 bp, Homo sapiens
tcagcaccctggg

SEQ ID NO: 3966818 - DNA, 12 bp, Homo sapiens
tcagcactgaaa

SEQ ID NO: 3966819 - DNA, 13 bp, Homo sapiens
tcagcactgaaaa

SEQ ID NO: 3966820 - DNA, 17 bp, Homo sapiens
tcagcactgatttcaca

SEQ ID NO: 3966821 - DNA, 22 bp, Homo sapiens
tcagcagagttattgaatctta

SEQ ID NO: 3966822 - DNA, 17 bp, Homo sapiens
tcagcagccccctgccc

SEQ ID NO: 3966823 - DNA, 14 bp, Homo sapiens
tcagcagccctcct

SEQ ID NO: 3966824 - DNA, 23 bp, Homo sapiens
tcagcattctcactcctacctgg

SEQ ID NO: 3966825 - DNA, 19 bp, Homo sapiens
tcagccaccctgaggcctc

SEQ ID NO: 3966826 - DNA, 20 bp, Homo sapiens
tcagccagaatcttcgtcct

SEQ ID NO: 3966827 - DNA, 23 bp, Homo sapiens
tcagccagccgccctgggctgtc

SEQ ID NO: 3966828 - DNA, 12 bp, Homo sapiens
tcagccagggcc

SEQ ID NO: 3966829 - DNA, 14 bp, Homo sapiens
tcagccagggccag

SEQ ID NO: 3966830 - DNA, 21 bp, Homo sapiens
tcagccatgaggagttgctgt

SEQ ID NO: 3966831 - DNA, 23 bp, Homo sapiens
tcagccatgaggagttgctgttt

SEQ ID NO: 3966832 - DNA, 16 bp, Homo sapiens
tcagcccatatttcat

SEQ ID NO: 3966833 - DNA, 17 bp, Homo sapiens
tcagcccctcctctgcc

SEQ ID NO: 3966834 - DNA, 15 bp, Homo sapiens
tcagcccgggacagg

SEQ ID NO: 3966835 - DNA, 14 bp, Homo sapiens
tcagccctccctgc

SEQ ID NO: 3966836 - DNA, 15 bp, Homo sapiens
tcagccctccctgcc

SEQ ID NO: 3966837 - DNA, 17 bp, Homo sapiens
tcagccctccctgcccc

SEQ ID NO: 3966838 - DNA, 22 bp, Homo sapiens
tcagccctgggccccaccacct

SEQ ID NO: 3966839 - DNA, 21 bp, Homo sapiens
tcagcccttgcccccatccct

SEQ ID NO: 3966840 - DNA, 22 bp, Homo sapiens
tcagccggcgtggcaaatataa

SEQ ID NO: 3966841 - DNA, 17 bp, Homo sapiens
tcagcctccccctgctg

SEQ ID NO: 3966842 - DNA, 19 bp, Homo sapiens
tcagcctccccctgctgct

SEQ ID NO: 3966843 - DNA, 21 bp, Homo sapiens
tcagcctcccgagtagctgag

SEQ ID NO: 3966844 - DNA, 21 bp, Homo sapiens
tcagcctcttaaagctgcctg

SEQ ID NO: 3966845 - DNA, 11 bp, Homo sapiens
tcagcctgagt

SEQ ID NO: 3966846 - DNA, 22 bp, Homo sapiens
tcagccttggataatgctgttg

SEQ ID NO: 3966847 - DNA, 13 bp, Homo sapiens
tcagcgccctgga

SEQ ID NO: 3966848 - DNA, 18 bp, Homo sapiens
tcagcgtgcttagcctcc

SEQ ID NO: 3966849 - DNA, 14 bp, Homo sapiens
tcagcgtggccttg

SEQ ID NO: 3966850 - DNA, 18 bp, Homo sapiens
tcagctaaagcccaacct

SEQ ID NO: 3966851 - DNA, 23 bp, Homo sapiens
tcagctaagccccctactgagaa

SEQ ID NO: 3966852 - DNA, 14 bp, Homo sapiens
tcagctactgattt

SEQ ID NO: 3966853 - DNA, 15 bp, Homo sapiens
tcagctactgatttt

SEQ ID NO: 3966854 - DNA, 17 bp, Homo sapiens
tcagctcagcctccccc

SEQ ID NO: 3966855 - DNA, 13 bp, Homo sapiens
tcagctcccatag

SEQ ID NO: 3966856 - DNA, 19 bp, Homo sapiens
tcagctcccatagcgctgg

SEQ ID NO: 3966857 - DNA, 20 bp, Homo sapiens
tcagctcccttcccctgcct

SEQ ID NO: 3966858 - DNA, 17 bp, Homo sapiens
tcagctctcctgctgca

SEQ ID NO: 3966859 - DNA, 18 bp, Homo sapiens
tcagctgacacataattt

SEQ ID NO: 3966860 - DNA, 20 bp, Homo sapiens
tcagctgcacattcctggcc

SEQ ID NO: 3966861 - DNA, 22 bp, Homo sapiens
tcagctgcacattcctggcccc

SEQ ID NO: 3966862 - DNA, 21 bp, Homo sapiens
tcagctgtgaacatggactct

SEQ ID NO: 3966863 - DNA, 16 bp, Homo sapiens
tcagcttatgggatcc

SEQ ID NO: 3966864 - DNA, 19 bp, Homo sapiens
tcagctttcagagccagtg

SEQ ID NO: 3966865 - DNA, 16 bp, Homo sapiens
tcagcttttaataaaa

SEQ ID NO: 3966866 - DNA, 16 bp, Homo sapiens
tcagcttttgcttcat

SEQ ID NO: 3966867 - DNA, 15 bp, Homo sapiens
tcaggaaaaggcctg

SEQ ID NO: 3966868 - DNA, 16 bp, Homo sapiens
tcaggaaaaggcctgg

SEQ ID NO: 3966869 - DNA, 17 bp, Homo sapiens
tcaggaaaaggcctggg

SEQ ID NO: 3966870 - DNA, 14 bp, Homo sapiens
tcaggaaagacgga

SEQ ID NO: 3966871 - DNA, 20 bp, Homo sapiens
tcaggaaatcaaatatgcaa

SEQ ID NO: 3966872 - DNA, 21 bp, Homo sapiens
tcaggaaatcaaatatgcaaa

SEQ ID NO: 3966873 - DNA, 23 bp, Homo sapiens
tcaggaaatcaaatatgcaaagc

SEQ ID NO: 3966874 - DNA, 21 bp, Homo sapiens
tcaggaagaaaccccaagcag

SEQ ID NO: 3966875 - DNA, 15 bp, Homo sapiens
tcaggaagagaagga

SEQ ID NO: 3966876 - DNA, 20 bp, Homo sapiens
tcaggaagatgaaagaggag

SEQ ID NO: 3966877 - DNA, 15 bp, Homo sapiens
tcaggacacaggcct

SEQ ID NO: 3966878 - DNA, 18 bp, Homo sapiens
tcaggacacaggcctgtg

SEQ ID NO: 3966879 - DNA, 16 bp, Homo sapiens
tcaggacatggggcat

SEQ ID NO: 3966880 - DNA, 18 bp, Homo sapiens
tcaggacatggggcatag

SEQ ID NO: 3966881 - DNA, 12 bp, Homo sapiens
tcaggacccagg

SEQ ID NO: 3966882 - DNA, 15 bp, Homo sapiens
tcaggacccaggccg

SEQ ID NO: 3966883 - DNA, 17 bp, Homo sapiens
tcaggacccaggccgcc

SEQ ID NO: 3966884 - DNA, 19 bp, Homo sapiens
tcaggacctccggggagag

SEQ ID NO: 3966885 - DNA, 12 bp, Homo sapiens
tcaggactggct

SEQ ID NO: 3966886 - DNA, 18 bp, Homo sapiens
tcaggactggctcacccc

SEQ ID NO: 3966887 - DNA, 11 bp, Homo sapiens
tcaggagcaca

SEQ ID NO: 3966888 - DNA, 18 bp, Homo sapiens
tcaggaggccctggtgtc

SEQ ID NO: 3966889 - DNA, 17 bp, Homo sapiens
tcaggaggcgaataaat

SEQ ID NO: 3966890 - DNA, 19 bp, Homo sapiens
tcaggaggcgaataaatgt

SEQ ID NO: 3966891 - DNA, 21 bp, Homo sapiens
tcaggaggcgaataaatgttc

SEQ ID NO: 3966892 - DNA, 19 bp, Homo sapiens
tcaggaggcgcagcccgaa

SEQ ID NO: 3966893 - DNA, 20 bp, Homo sapiens
tcaggaggctgaggcagaag

SEQ ID NO: 3966894 - DNA, 22 bp, Homo sapiens
tcaggagttcaagaccagcctg

SEQ ID NO: 3966895 - DNA, 18 bp, Homo sapiens
tcaggatactctgtcaga

SEQ ID NO: 3966896 - DNA, 20 bp, Homo sapiens
tcaggatactctgtcagatg

SEQ ID NO: 3966897 - DNA, 16 bp, Homo sapiens
tcaggatcaagaaagt

SEQ ID NO: 3966898 - DNA, 21 bp, Homo sapiens
tcaggatttttacaagttggt

SEQ ID NO: 3966899 - DNA, 15 bp, Homo sapiens
tcaggcacaggcagg

SEQ ID NO: 3966900 - DNA, 15 bp, Homo sapiens
tcaggcactggtggc

SEQ ID NO: 3966901 - DNA, 16 bp, Homo sapiens
tcaggcagccttcata

SEQ ID NO: 3966902 - DNA, 23 bp, Homo sapiens
tcaggcaggcacctagcaattcc

SEQ ID NO: 3966903 - DNA, 15 bp, Homo sapiens
taacttgtatattcc

SEQ ID NO: 3966904 - DNA, 16 bp, Homo sapiens
taacttgtatattcca

SEQ ID NO: 3966905 - DNA, 22 bp, Homo sapiens
taagaaacacagggttttgtat

SEQ ID NO: 3966906 - DNA, 23 bp, Homo sapiens
taagaaacacagggttttgtatt

SEQ ID NO: 3966907 - DNA, 14 bp, Homo sapiens
taagaatggaagaa

SEQ ID NO: 3966908 - DNA, 17 bp, Homo sapiens
taagaatggttgcctta

SEQ ID NO: 3966909 - DNA, 17 bp, Homo sapiens
taagacacacctctgga

SEQ ID NO: 3966910 - DNA, 15 bp, Homo sapiens
taagaccccatctct

SEQ ID NO: 3966911 - DNA, 16 bp, Homo sapiens
taagaccgtgtcccaa

SEQ ID NO: 3966912 - DNA, 19 bp, Homo sapiens
taagaccgtgtcccaagga

SEQ ID NO: 3966913 - DNA, 23 bp, Homo sapiens
taagaccgtgtcccaaggagctg

SEQ ID NO: 3966914 - DNA, 17 bp, Homo sapiens
taagacctccccacccc

SEQ ID NO: 3966915 - DNA, 13 bp, Homo sapiens
taagacgtgaatg

SEQ ID NO: 3966916 - DNA, 20 bp, Homo sapiens
taagacgtgaatgtctcagc

SEQ ID NO: 3966917 - DNA, 15 bp, Homo sapiens
taagagaaacaggcc

SEQ ID NO: 3966918 - DNA, 13 bp, Homo sapiens
taagagaaagaaa

SEQ ID NO: 3966919 - DNA, 15 bp, Homo sapiens
taagagaaatggcaa

SEQ ID NO: 3966920 - DNA, 16 bp, Homo sapiens
taagagctagcgctgc

SEQ ID NO: 3966921 - DNA, 20 bp, Homo sapiens
taagagctagcgctgccgca

SEQ ID NO: 3966922 - DNA, 15 bp, Homo sapiens
taagaggcagcgtga

SEQ ID NO: 3966923 - DNA, 21 bp, Homo sapiens
taagatacactcctgctgtgc

SEQ ID NO: 3966924 - DNA, 21 bp, Homo sapiens
taagatgagatttgccagcac

SEQ ID NO: 3966925 - DNA, 18 bp, Homo sapiens
taagatgggcagctagtt

SEQ ID NO: 3966926 - DNA, 13 bp, Homo sapiens
taagattaaagga

SEQ ID NO: 3966927 - DNA, 15 bp, Homo sapiens
taagattagaatgaa

SEQ ID NO: 3966928 - DNA, 21 bp, Homo sapiens
taagattccagagagtggctc

SEQ ID NO: 3966929 - DNA, 20 bp, Homo sapiens
taagcaaaggaaaccaaagg

SEQ ID NO: 3966930 - DNA, 16 bp, Homo sapiens
taagcaaatttcaaaa

SEQ ID NO: 3966931 - DNA, 14 bp, Homo sapiens
taagcaggaaggat

SEQ ID NO: 3966932 - DNA, 12 bp, Homo sapiens
taagcagtccct

SEQ ID NO: 3966933 - DNA, 21 bp, Homo sapiens
taagcatcttgtcaagaaata

SEQ ID NO: 3966934 - DNA, 15 bp, Homo sapiens
taagcattctgagct

SEQ ID NO: 3966935 - DNA, 21 bp, Homo sapiens
taagcattctgagctgggctt

SEQ ID NO: 3966936 - DNA, 16 bp, Homo sapiens
taagccacaagaaatt

SEQ ID NO: 3966937 - DNA, 12 bp, Homo sapiens
taagccacagct

SEQ ID NO: 3966938 - DNA, 16 bp, Homo sapiens
taagccagagcctggg

SEQ ID NO: 3966939 - DNA, 22 bp, Homo sapiens
taagccctcgaaccaaggcagc

SEQ ID NO: 3966940 - DNA, 11 bp, Homo sapiens
taagccctgtc

SEQ ID NO: 3966941 - DNA, 16 bp, Homo sapiens
taagcctcatatttaa

SEQ ID NO: 3966942 - DNA, 23 bp, Homo sapiens
taagcgaatgtgtacaaagtgta

SEQ ID NO: 3966943 - DNA, 18 bp, Homo sapiens
taagctgcagcttcctgt

SEQ ID NO: 3966944 - DNA, 16 bp, Homo sapiens
taagctggagctcttg

SEQ ID NO: 3966945 - DNA, 19 bp, Homo sapiens
taagctggagctcttggaa

SEQ ID NO: 3966946 - DNA, 21 bp, Homo sapiens
taagctgggaaaaaagttttg

SEQ ID NO: 3966947 - DNA, 15 bp, Homo sapiens
taagctgtaaaaaga

SEQ ID NO: 3966948 - DNA, 22 bp, Homo sapiens
taagctttatttatttctttgt

SEQ ID NO: 3966949 - DNA, 14 bp, Homo sapiens
taagctttctcctt

SEQ ID NO: 3966950 - DNA, 15 bp, Homo sapiens
taagctttctccttt

SEQ ID NO: 3966951 - DNA, 17 bp, Homo sapiens
taaggacttctgcagct

SEQ ID NO: 3966952 - DNA, 19 bp, Homo sapiens
taaggatcagaacagcaga

SEQ ID NO: 3966953 - DNA, 16 bp, Homo sapiens
taaggatctctcagga

SEQ ID NO: 3966954 - DNA, 19 bp, Homo sapiens
taaggccagaaactccttt

SEQ ID NO: 3966955 - DNA, 16 bp, Homo sapiens
taaggccgtgtctctg

SEQ ID NO: 3966956 - DNA, 18 bp, Homo sapiens
taaggcttaggtgccagg

SEQ ID NO: 3966957 - DNA, 21 bp, Homo sapiens
taagggaaggaactctggctt

SEQ ID NO: 3966958 - DNA, 12 bp, Homo sapiens
taagggactgtg

SEQ ID NO: 3966959 - DNA, 15 bp, Homo sapiens
taagggtctgttgta

SEQ ID NO: 3966960 - DNA, 16 bp, Homo sapiens
taagggttgaaggcag

SEQ ID NO: 3966961 - DNA, 18 bp, Homo sapiens
taaggtagaacctcacct

SEQ ID NO: 3966962 - DNA, 21 bp, Homo sapiens
taaggtctgggagtgttctgt

SEQ ID NO: 3966963 - DNA, 22 bp, Homo sapiens
taaggtgggtccaggaaggcag

SEQ ID NO: 3966964 - DNA, 16 bp, Homo sapiens
taaggttctcatagga

SEQ ID NO: 3966965 - DNA, 16 bp, Homo sapiens
taagtaaaaccacagc

SEQ ID NO: 3966966 - DNA, 20 bp, Homo sapiens
taagtagatagaaagcaata

SEQ ID NO: 3966967 - DNA, 12 bp, Homo sapiens
taagtatatagt

SEQ ID NO: 3966968 - DNA, 13 bp, Homo sapiens
taagtatatagta

SEQ ID NO: 3966969 - DNA, 23 bp, Homo sapiens
taagtatatagtatatttatact

SEQ ID NO: 3966970 - DNA, 12 bp, Homo sapiens
taagtatttagg

SEQ ID NO: 3966971 - DNA, 16 bp, Homo sapiens
taagtctccaagaata

SEQ ID NO: 3966972 - DNA, 18 bp, Homo sapiens
taagtgatttttttgtcc

SEQ ID NO: 3966973 - DNA, 18 bp, Homo sapiens
taagtgcacacagaaata

SEQ ID NO: 3966974 - DNA, 18 bp, Homo sapiens
taagtggaaaaaagagaa

SEQ ID NO: 3966975 - DNA, 22 bp, Homo sapiens
taagtggaaaaaagagaaaaac

SEQ ID NO: 3966976 - DNA, 16 bp, Homo sapiens
taattaggatctatgc

SEQ ID NO: 3966977 - DNA, 21 bp, Homo sapiens
taattaggatctatgcaattt

SEQ ID NO: 3966978 - DNA, 12 bp, Homo sapiens
taattatctgat

SEQ ID NO: 3966979 - DNA, 22 bp, Homo sapiens
taattcaaagctctattaagat

SEQ ID NO: 3966980 - DNA, 19 bp, Homo sapiens
taattcagcactgatttca

SEQ ID NO: 3966981 - DNA, 21 bp, Homo sapiens
taattcagcactgatttcaca

SEQ ID NO: 3966982 - DNA, 14 bp, Homo sapiens
taattcattaaatt

SEQ ID NO: 3966983 - DNA, 14 bp, Homo sapiens
taattccataaccc

SEQ ID NO: 3966984 - DNA, 23 bp, Homo sapiens
taattctccctaaggaatctgaa

SEQ ID NO: 3966985 - DNA, 13 bp, Homo sapiens
taattctgcttct

SEQ ID NO: 3966986 - DNA, 18 bp, Homo sapiens
taattcttaataggcttt

SEQ ID NO: 3966987 - DNA, 16 bp, Homo sapiens
taattcttgtatatta

SEQ ID NO: 3966988 - DNA, 13 bp, Homo sapiens
ggcagctcctctg

SEQ ID NO: 3966989 - DNA, 15 bp, Homo sapiens
ggcagctgctcttag

SEQ ID NO: 3966990 - DNA, 12 bp, Homo sapiens
ggcagctgggcc

SEQ ID NO: 3966991 - DNA, 14 bp, Homo sapiens
ggcaggaagagaga

SEQ ID NO: 3966992 - DNA, 23 bp, Homo sapiens
ggcaggaagagagagagagaggt

SEQ ID NO: 3966993 - DNA, 16 bp, Homo sapiens
ggcaggacacatcccg

SEQ ID NO: 3966994 - DNA, 13 bp, Homo sapiens
ggcaggaggcctg

SEQ ID NO: 3966995 - DNA, 17 bp, Homo sapiens
ggcaggagtagctgagc

SEQ ID NO: 3966996 - DNA, 17 bp, Homo sapiens
ggcaggcacacagcagc

SEQ ID NO: 3966997 - DNA, 19 bp, Homo sapiens
ggcaggcacacagcagccc

SEQ ID NO: 3966998 - DNA, 13 bp, Homo sapiens
ggcaggcagggct

SEQ ID NO: 3966999 - DNA, 19 bp, Homo sapiens
ggcaggcagggctctcctg

SEQ ID NO: 3967000 - DNA, 12 bp, Homo sapiens
ggcaggcctggg

SEQ ID NO: 3967001 - DNA, 13 bp, Homo sapiens
ggcaggcctggga

SEQ ID NO: 3967002 - DNA, 19 bp, Homo sapiens
ggcaggcctgggacccagc

SEQ ID NO: 3967003 - DNA, 16 bp, Homo sapiens
ggcaggctaccccttc

SEQ ID NO: 3967004 - DNA, 18 bp, Homo sapiens
ggcaggctagaacctggc

SEQ ID NO: 3967005 - DNA, 19 bp, Homo sapiens
ggcaggctagaacctggca

SEQ ID NO: 3967006 - DNA, 15 bp, Homo sapiens
ggcagggatttgagg

SEQ ID NO: 3967007 - DNA, 23 bp, Homo sapiens
ggcagggcaaatgacatgcactg

SEQ ID NO: 3967008 - DNA, 13 bp, Homo sapiens
ggcagggcagagg

SEQ ID NO: 3967009 - DNA, 15 bp, Homo sapiens
ggcagggcagaggga

SEQ ID NO: 3967010 - DNA, 16 bp, Homo sapiens
ggcagggccttgccca

SEQ ID NO: 3967011 - DNA, 18 bp, Homo sapiens
ggcagggccttgcccaga

SEQ ID NO: 3967012 - DNA, 19 bp, Homo sapiens
ggcagggccttgcccagag

SEQ ID NO: 3967013 - DNA, 16 bp, Homo sapiens
ggcagggctctcctgg

SEQ ID NO: 3967014 - DNA, 18 bp, Homo sapiens
ggcagggctctcctggct

SEQ ID NO: 3967015 - DNA, 19 bp, Homo sapiens
ggcagggctctcctggctt

SEQ ID NO: 3967016 - DNA, 12 bp, Homo sapiens
ggcaggggcgga

SEQ ID NO: 3967017 - DNA, 15 bp, Homo sapiens
ggcaggggtgggaga

SEQ ID NO: 3967018 - DNA, 18 bp, Homo sapiens
ggcaggggtgggagagcc

SEQ ID NO: 3967019 - DNA, 21 bp, Homo sapiens
ggcagggtgggatggaggaga

SEQ ID NO: 3967020 - DNA, 15 bp, Homo sapiens
ggcaggtcctgccca

SEQ ID NO: 3967021 - DNA, 12 bp, Homo sapiens
ggcaggtgcaga

SEQ ID NO: 3967022 - DNA, 19 bp, Homo sapiens
ggcaggtgcagatgggctg

SEQ ID NO: 3967023 - DNA, 13 bp, Homo sapiens
ggcagtacctggg

SEQ ID NO: 3967024 - DNA, 23 bp, Homo sapiens
ggcagtacctgggaaaggaccca

SEQ ID NO: 3967025 - DNA, 23 bp, Homo sapiens
ggcagtcattcagcaccagagca

SEQ ID NO: 3967026 - DNA, 23 bp, Homo sapiens
ggcagtgaacacactcagcagcc

SEQ ID NO: 3967027 - DNA, 13 bp, Homo sapiens
ggcagtgacaagt

SEQ ID NO: 3967028 - DNA, 17 bp, Homo sapiens
ggcagtgacaagtggag

SEQ ID NO: 3967029 - DNA, 18 bp, Homo sapiens
ggcagtgacaagtggagg

SEQ ID NO: 3967030 - DNA, 19 bp, Homo sapiens
ggcagtgacaagtggaggg

SEQ ID NO: 3967031 - DNA, 13 bp, Homo sapiens
ggcagtgactggc

SEQ ID NO: 3967032 - DNA, 21 bp, Homo sapiens
ggcagtgactggcaggtgcag

SEQ ID NO: 3967033 - DNA, 13 bp, Homo sapiens
ggcagtgcctcct

SEQ ID NO: 3967034 - DNA, 21 bp, Homo sapiens
ggcagtgggacagggcatggc

SEQ ID NO: 3967035 - DNA, 21 bp, Homo sapiens
ggcagttcgcagccaccctga

SEQ ID NO: 3967036 - DNA, 19 bp, Homo sapiens
ggcatagaaactgaggagt

SEQ ID NO: 3967037 - DNA, 14 bp, Homo sapiens
ggcatcaggcactg

SEQ ID NO: 3967038 - DNA, 15 bp, Homo sapiens
ggcatccacccagtg

SEQ ID NO: 3967039 - DNA, 19 bp, Homo sapiens
ggcatccacccagtgctgc

SEQ ID NO: 3967040 - DNA, 15 bp, Homo sapiens
ggcatcccatccctt

SEQ ID NO: 3967041 - DNA, 16 bp, Homo sapiens
ggcatccgcagcccag

SEQ ID NO: 3967042 - DNA, 19 bp, Homo sapiens
ggcatccttctgccttttt

SEQ ID NO: 3967043 - DNA, 21 bp, Homo sapiens
ggcatctcgtgccagggcagg

SEQ ID NO: 3967044 - DNA, 22 bp, Homo sapiens
ggcatctcgtgccagggcaggc

SEQ ID NO: 3967045 - DNA, 18 bp, Homo sapiens
ggcatctctaattggaag

SEQ ID NO: 3967046 - DNA, 15 bp, Homo sapiens
ggcatctgcaccctc

SEQ ID NO: 3967047 - DNA, 15 bp, Homo sapiens
ggcatgaacgcactt

SEQ ID NO: 3967048 - DNA, 14 bp, Homo sapiens
ggcatgacactcta

SEQ ID NO: 3967049 - DNA, 19 bp, Homo sapiens
ggcatggtggcgcaagcct

SEQ ID NO: 3967050 - DNA, 21 bp, Homo sapiens
ggcatggttccttccctggga

SEQ ID NO: 3967051 - DNA, 19 bp, Homo sapiens
ggcatgtattatcacatca

SEQ ID NO: 3967052 - DNA, 14 bp, Homo sapiens
ggcatgtggagaca

SEQ ID NO: 3967053 - DNA, 15 bp, Homo sapiens
ggcatgtgtgcctgt

SEQ ID NO: 3967054 - DNA, 21 bp, Homo sapiens
ggcatgtgtgcctgtggcaga

SEQ ID NO: 3967055 - DNA, 14 bp, Homo sapiens
ggcatgttcctctg

SEQ ID NO: 3967056 - DNA, 18 bp, Homo sapiens
ggcattatttaatgtttg

SEQ ID NO: 3967057 - DNA, 14 bp, Homo sapiens
ggcattgggctgac

SEQ ID NO: 3967058 - DNA, 15 bp, Homo sapiens
ggcattgggctgaca

SEQ ID NO: 3967059 - DNA, 17 bp, Homo sapiens
ggcattttcctcgccta

SEQ ID NO: 3967060 - DNA, 17 bp, Homo sapiens
ggccaaaagggcagcca

SEQ ID NO: 3967061 - DNA, 20 bp, Homo sapiens
ggccaaaagggcagccaggg

SEQ ID NO: 3967062 - DNA, 19 bp, Homo sapiens
ggccaaatgcacaagctca

SEQ ID NO: 3967063 - DNA, 21 bp, Homo sapiens
ggccaaattatttgtgtaata

SEQ ID NO: 3967064 - DNA, 15 bp, Homo sapiens
ggccaagacttggca

SEQ ID NO: 3967065 - DNA, 15 bp, Homo sapiens
ggccaagagagacat

SEQ ID NO: 3967066 - DNA, 20 bp, Homo sapiens
ggccaagctgaggtgcccag

SEQ ID NO: 3967067 - DNA, 22 bp, Homo sapiens
ggccaagctgaggtgcccagga

SEQ ID NO: 3967068 - DNA, 19 bp, Homo sapiens
ggccaattaaaatatatat

SEQ ID NO: 3967069 - DNA, 23 bp, Homo sapiens
ggccacaaatcaaagcaagggct

SEQ ID NO: 3967070 - DNA, 21 bp, Homo sapiens
ggccacactattaccatgaga

SEQ ID NO: 3967071 - DNA, 23 bp, Homo sapiens
ggccacccgttctgctggcctgg

SEQ ID NO: 3967072 - DNA, 12 bp, Homo sapiens
ggccaccctcct

SEQ ID NO: 3967073 - DNA, 13 bp, Homo sapiens
ggccaccctggcc

SEQ ID NO: 3967074 - DNA, 12 bp, Homo sapiens
ggccacgtgcca

SEQ ID NO: 3967075 - DNA, 18 bp, Homo sapiens
taaatcacttgtaaataa

SEQ ID NO: 3967076 - DNA, 14 bp, Homo sapiens
taaatcattaatac

SEQ ID NO: 3967077 - DNA, 17 bp, Homo sapiens
taaatcctttttcttta

SEQ ID NO: 3967078 - DNA, 23 bp, Homo sapiens
taaatctgagatctccctccagg

SEQ ID NO: 3967079 - DNA, 19 bp, Homo sapiens
taaatctgagcctaaatct

SEQ ID NO: 3967080 - DNA, 19 bp, Homo sapiens
taaatgaccaagaaaaaga

SEQ ID NO: 3967081 - DNA, 17 bp, Homo sapiens
taaatgcaaacactgtg

SEQ ID NO: 3967082 - DNA, 21 bp, Homo sapiens
taaatggagcttgtacatatt

SEQ ID NO: 3967083 - DNA, 22 bp, Homo sapiens
taaatggtgggaaccctcccca

SEQ ID NO: 3967084 - DNA, 12 bp, Homo sapiens
taaatgtatata

SEQ ID NO: 3967085 - DNA, 15 bp, Homo sapiens
taaatgtatatacac

SEQ ID NO: 3967086 - DNA, 12 bp, Homo sapiens
taaatgtgtaaa

SEQ ID NO: 3967087 - DNA, 13 bp, Homo sapiens
taaatgtgtaaat

SEQ ID NO: 3967088 - DNA, 18 bp, Homo sapiens
taaatgtgtattctggct

SEQ ID NO: 3967089 - DNA, 12 bp, Homo sapiens
taaatgttcaaa

SEQ ID NO: 3967090 - DNA, 15 bp, Homo sapiens
taaatgttgaaatct

SEQ ID NO: 3967091 - DNA, 18 bp, Homo sapiens
taaatgtttaaatataaa

SEQ ID NO: 3967092 - DNA, 20 bp, Homo sapiens
taaattaaaaaggaaagaaa

SEQ ID NO: 3967093 - DNA, 19 bp, Homo sapiens
taaattaatacttcatttg

SEQ ID NO: 3967094 - DNA, 22 bp, Homo sapiens
taaattacattaaaacaaaaaa

SEQ ID NO: 3967095 - DNA, 23 bp, Homo sapiens
taaattaggaggctcaacaataa

SEQ ID NO: 3967096 - DNA, 16 bp, Homo sapiens
taaattatatctgagg

SEQ ID NO: 3967097 - DNA, 13 bp, Homo sapiens
taaattctttatt

SEQ ID NO: 3967098 - DNA, 15 bp, Homo sapiens
taaattgctccttga

SEQ ID NO: 3967099 - DNA, 12 bp, Homo sapiens
taaattgtttga

SEQ ID NO: 3967100 - DNA, 23 bp, Homo sapiens
taaatttaataaaaacttcagaa

SEQ ID NO: 3967101 - DNA, 14 bp, Homo sapiens
taaatttgtaccta

SEQ ID NO: 3967102 - DNA, 22 bp, Homo sapiens
taaattttagagcataccagta

SEQ ID NO: 3967103 - DNA, 15 bp, Homo sapiens
taaattttgaatgtt

SEQ ID NO: 3967104 - DNA, 18 bp, Homo sapiens
taacaaaacaagaaagaa

SEQ ID NO: 3967105 - DNA, 13 bp, Homo sapiens
taacaaaatcaca

SEQ ID NO: 3967106 - DNA, 9 bp, Homo sapiens
taacaacaa

SEQ ID NO: 3967107 - DNA, 15 bp, Homo sapiens
taacaagaaaatcaa

SEQ ID NO: 3967108 - DNA, 13 bp, Homo sapiens
taacaatttcctt

SEQ ID NO: 3967109 - DNA, 17 bp, Homo sapiens
taacacaagtcctgtga

SEQ ID NO: 3967110 - DNA, 18 bp, Homo sapiens
taacacaagtcctgtgaa

SEQ ID NO: 3967111 - DNA, 16 bp, Homo sapiens
taacactagaaaacat

SEQ ID NO: 3967112 - DNA, 21 bp, Homo sapiens
taacactcagaagcctggggg

SEQ ID NO: 3967113 - DNA, 15 bp, Homo sapiens
taacagaaccagagg

SEQ ID NO: 3967114 - DNA, 17 bp, Homo sapiens
taacagggaaggcaggc

SEQ ID NO: 3967115 - DNA, 14 bp, Homo sapiens
taacaggtaaccac

SEQ ID NO: 3967116 - DNA, 19 bp, Homo sapiens
taacagtatttgtacaaat

SEQ ID NO: 3967117 - DNA, 22 bp, Homo sapiens
taacagtatttgtacaaatact

SEQ ID NO: 3967118 - DNA, 18 bp, Homo sapiens
taacagtcatttaaaaaa

SEQ ID NO: 3967119 - DNA, 15 bp, Homo sapiens
taacataaaatctgt

SEQ ID NO: 3967120 - DNA, 20 bp, Homo sapiens
taacataaaatctgtgaatt

SEQ ID NO: 3967121 - DNA, 16 bp, Homo sapiens
taacataatttgtaca

SEQ ID NO: 3967122 - DNA, 13 bp, Homo sapiens
taacatatttact

SEQ ID NO: 3967123 - DNA, 14 bp, Homo sapiens
taacatatttacta

SEQ ID NO: 3967124 - DNA, 13 bp, Homo sapiens
taacatccagaag

SEQ ID NO: 3967125 - DNA, 21 bp, Homo sapiens
taacatctattataaaaccat

SEQ ID NO: 3967126 - DNA, 19 bp, Homo sapiens
taacatctttgaaaagaaa

SEQ ID NO: 3967127 - DNA, 23 bp, Homo sapiens
taacatgaaaaacacggcagctg

SEQ ID NO: 3967128 - DNA, 15 bp, Homo sapiens
taaccagctgtaaca

SEQ ID NO: 3967129 - DNA, 17 bp, Homo sapiens
taaccatggtgcttgtt

SEQ ID NO: 3967130 - DNA, 22 bp, Homo sapiens
taaccatgtgaaaaggcaaaaa

SEQ ID NO: 3967131 - DNA, 18 bp, Homo sapiens
taaccattacatgtttaa

SEQ ID NO: 3967132 - DNA, 20 bp, Homo sapiens
taaccattacatgtttaaat

SEQ ID NO: 3967133 - DNA, 13 bp, Homo sapiens
taacccctttcct

SEQ ID NO: 3967134 - DNA, 15 bp, Homo sapiens
taaccctctcttccc

SEQ ID NO: 3967135 - DNA, 16 bp, Homo sapiens
taaccctctcttccct

SEQ ID NO: 3967136 - DNA, 19 bp, Homo sapiens
taaccctctcttccctatt

SEQ ID NO: 3967137 - DNA, 16 bp, Homo sapiens
taacctactagacaat

SEQ ID NO: 3967138 - DNA, 13 bp, Homo sapiens
taacggctccagg

SEQ ID NO: 3967139 - DNA, 13 bp, Homo sapiens
taactaatttaaa

SEQ ID NO: 3967140 - DNA, 20 bp, Homo sapiens
taactaatttaaaccagcag

SEQ ID NO: 3967141 - DNA, 18 bp, Homo sapiens
taactactttttatactc

SEQ ID NO: 3967142 - DNA, 19 bp, Homo sapiens
taactactttttatactcc

SEQ ID NO: 3967143 - DNA, 13 bp, Homo sapiens
taactatgtgatg

SEQ ID NO: 3967144 - DNA, 17 bp, Homo sapiens
taactcagacattccaa

SEQ ID NO: 3967145 - DNA, 19 bp, Homo sapiens
taactccagtgatgttctt

SEQ ID NO: 3967146 - DNA, 15 bp, Homo sapiens
taactccccacccca

SEQ ID NO: 3967147 - DNA, 14 bp, Homo sapiens
taactgaagagaca

SEQ ID NO: 3967148 - DNA, 14 bp, Homo sapiens
taactgaaggagaa

SEQ ID NO: 3967149 - DNA, 14 bp, Homo sapiens
taactgctgagcca

SEQ ID NO: 3967150 - DNA, 15 bp, Homo sapiens
taactgctgagccac

SEQ ID NO: 3967151 - DNA, 16 bp, Homo sapiens
taactgctgagccact

SEQ ID NO: 3967152 - DNA, 15 bp, Homo sapiens
tacccaaaagagaaa

SEQ ID NO: 3967153 - DNA, 17 bp, Homo sapiens
tacccaaaagagaaaaa

SEQ ID NO: 3967154 - DNA, 18 bp, Homo sapiens
tacccaatttaattccat

SEQ ID NO: 3967155 - DNA, 22 bp, Homo sapiens
tacccaccgggccactccttcc

SEQ ID NO: 3967156 - DNA, 21 bp, Homo sapiens
tacccactctttgctacaata

SEQ ID NO: 3967157 - DNA, 20 bp, Homo sapiens
taccccaagtccacctgcct

SEQ ID NO: 3967158 - DNA, 22 bp, Homo sapiens
taccccaccacgatgtggccct

SEQ ID NO: 3967159 - DNA, 20 bp, Homo sapiens
taccccacctcatgcctggc

SEQ ID NO: 3967160 - DNA, 13 bp, Homo sapiens
taccccatccctt

SEQ ID NO: 3967161 - DNA, 14 bp, Homo sapiens
taccccatcccttc

SEQ ID NO: 3967162 - DNA, 13 bp, Homo sapiens
tacccctgcctgg

SEQ ID NO: 3967163 - DNA, 14 bp, Homo sapiens
tacccctgcctggg

SEQ ID NO: 3967164 - DNA, 16 bp, Homo sapiens
tacccgagcccagcta

SEQ ID NO: 3967165 - DNA, 23 bp, Homo sapiens
tacccgagcccagctacattcct

SEQ ID NO: 3967166 - DNA, 13 bp, Homo sapiens
taccctccagagt

SEQ ID NO: 3967167 - DNA, 14 bp, Homo sapiens
tacccttctttaaa

SEQ ID NO: 3967168 - DNA, 18 bp, Homo sapiens
tacccttgtaccccatcc

SEQ ID NO: 3967169 - DNA, 18 bp, Homo sapiens
taccgagtctcttctcca

SEQ ID NO: 3967170 - DNA, 22 bp, Homo sapiens
taccgagtctcttctccactgg

SEQ ID NO: 3967171 - DNA, 15 bp, Homo sapiens
taccgctggggaaca

SEQ ID NO: 3967172 - DNA, 14 bp, Homo sapiens
taccgtagcctccg

SEQ ID NO: 3967173 - DNA, 14 bp, Homo sapiens
tacctaaacagata

SEQ ID NO: 3967174 - DNA, 22 bp, Homo sapiens
tacctaaacagatataaatggc

SEQ ID NO: 3967175 - DNA, 14 bp, Homo sapiens
tacctataatgtgt

SEQ ID NO: 3967176 - DNA, 15 bp, Homo sapiens
tacctcatgggacag

SEQ ID NO: 3967177 - DNA, 13 bp, Homo sapiens
tacctcctgccca

SEQ ID NO: 3967178 - DNA, 12 bp, Homo sapiens
tacctgagacca

SEQ ID NO: 3967179 - DNA, 12 bp, Homo sapiens
tacctgccctct

SEQ ID NO: 3967180 - DNA, 18 bp, Homo sapiens
tacctgccctctctcagt

SEQ ID NO: 3967181 - DNA, 11 bp, Homo sapiens
tacctgggaaa

SEQ ID NO: 3967182 - DNA, 18 bp, Homo sapiens
tacctgggaaaggaccca

SEQ ID NO: 3967183 - DNA, 22 bp, Homo sapiens
tacctgggaaaggacccaccca

SEQ ID NO: 3967184 - DNA, 22 bp, Homo sapiens
tacctgtgtattttttaaagct

SEQ ID NO: 3967185 - DNA, 22 bp, Homo sapiens
tacctgttactattatctgtgc

SEQ ID NO: 3967186 - DNA, 22 bp, Homo sapiens
taccttagattagctctggacc

SEQ ID NO: 3967187 - DNA, 14 bp, Homo sapiens
taccttctggttgc

SEQ ID NO: 3967188 - DNA, 15 bp, Homo sapiens
taccttctggttgct

SEQ ID NO: 3967189 - DNA, 20 bp, Homo sapiens
taccttgaccatcgtccttc

SEQ ID NO: 3967190 - DNA, 20 bp, Homo sapiens
taccttgcagccatgaccag

SEQ ID NO: 3967191 - DNA, 12 bp, Homo sapiens
tacctttggaaa

SEQ ID NO: 3967192 - DNA, 14 bp, Homo sapiens
tacctttggaaaaa

SEQ ID NO: 3967193 - DNA, 17 bp, Homo sapiens
taccttttctgttgtac

SEQ ID NO: 3967194 - DNA, 15 bp, Homo sapiens
tacgaaacacaaacc

SEQ ID NO: 3967195 - DNA, 21 bp, Homo sapiens
tacgctctcctttctttctaa

SEQ ID NO: 3967196 - DNA, 19 bp, Homo sapiens
tacggagggaggacatcat

SEQ ID NO: 3967197 - DNA, 14 bp, Homo sapiens
tacgtgagccaggt

SEQ ID NO: 3967198 - DNA, 22 bp, Homo sapiens
tactaaagatatcagagctctt

SEQ ID NO: 3967199 - DNA, 14 bp, Homo sapiens
tactaattgagaaa

SEQ ID NO: 3967200 - DNA, 15 bp, Homo sapiens
tactactgctgcaaa

SEQ ID NO: 3967201 - DNA, 21 bp, Homo sapiens
tactactgctgcaaagtgcaa

SEQ ID NO: 3967202 - DNA, 14 bp, Homo sapiens
tactacttcttgga

SEQ ID NO: 3967203 - DNA, 15 bp, Homo sapiens
tactagaatttgtat

SEQ ID NO: 3967204 - DNA, 14 bp, Homo sapiens
tactattggtaata

SEQ ID NO: 3967205 - DNA, 15 bp, Homo sapiens
tactattgtttaaaa

SEQ ID NO: 3967206 - DNA, 21 bp, Homo sapiens
tactattgtttaaaaacagga

SEQ ID NO: 3967207 - DNA, 13 bp, Homo sapiens
tactcacacaggc

SEQ ID NO: 3967208 - DNA, 15 bp, Homo sapiens
tactcagcagccctc

SEQ ID NO: 3967209 - DNA, 23 bp, Homo sapiens
tactcagcagccctcctcacccc

SEQ ID NO: 3967210 - DNA, 13 bp, Homo sapiens
tactcagccctgg

SEQ ID NO: 3967211 - DNA, 22 bp, Homo sapiens
tactcagccctgggccccacca

SEQ ID NO: 3967212 - DNA, 16 bp, Homo sapiens
tactcagctctcctgc

SEQ ID NO: 3967213 - DNA, 20 bp, Homo sapiens
tactcataaggcatatacaa

SEQ ID NO: 3967214 - DNA, 12 bp, Homo sapiens
tactcattgtct

SEQ ID NO: 3967215 - DNA, 11 bp, Homo sapiens
tactcatttct

SEQ ID NO: 3967216 - DNA, 18 bp, Homo sapiens
tactcatttctaaaagaa

SEQ ID NO: 3967217 - DNA, 22 bp, Homo sapiens
tactcatttctaaaagaatatt

SEQ ID NO: 3967218 - DNA, 15 bp, Homo sapiens
tactccaagcttcaa

SEQ ID NO: 3967219 - DNA, 18 bp, Homo sapiens
tactccaagcttcaagtg

SEQ ID NO: 3967220 - DNA, 19 bp, Homo sapiens
tactccagtggtgaagaaa

SEQ ID NO: 3967221 - DNA, 20 bp, Homo sapiens
tactcccaggcactgtctta

SEQ ID NO: 3967222 - DNA, 23 bp, Homo sapiens
tactcccctgatcccccaggttc

SEQ ID NO: 3967223 - DNA, 14 bp, Homo sapiens
tactcccctgggca

SEQ ID NO: 3967224 - DNA, 21 bp, Homo sapiens
tactcccctgggcatcttctg

SEQ ID NO: 3967225 - DNA, 15 bp, Homo sapiens
tactcccttcctggc

SEQ ID NO: 3967226 - DNA, 17 bp, Homo sapiens
tactcccttcctggcct

SEQ ID NO: 3967227 - DNA, 16 bp, Homo sapiens
tactcctgtgctctgg

SEQ ID NO: 3967228 - DNA, 14 bp, Homo sapiens
tactctccaacctg

SEQ ID NO: 3967229 - DNA, 18 bp, Homo sapiens
tactctccaacctggaca

SEQ ID NO: 3967230 - DNA, 20 bp, Homo sapiens
tactctcctcggccccctcc

SEQ ID NO: 3967231 - DNA, 14 bp, Homo sapiens
tactctctgctcta

SEQ ID NO: 3967232 - DNA, 16 bp, Homo sapiens
tactctctgctctagc

SEQ ID NO: 3967233 - DNA, 14 bp, Homo sapiens
tactctgaaaagca

SEQ ID NO: 3967234 - DNA, 13 bp, Homo sapiens
tactctgagccca

SEQ ID NO: 3967235 - DNA, 23 bp, Homo sapiens
tactctgcggtggtgccagaggt

SEQ ID NO: 3967236 - DNA, 15 bp, Homo sapiens
tactctgtccaggcc

SEQ ID NO: 3967237 - DNA, 17 bp, Homo sapiens
tactctgtccaggccac

SEQ ID NO: 3967238 - DNA, 18 bp, Homo sapiens
tactctgtgccagagcct

SEQ ID NO: 3967239 - DNA, 14 bp, Homo sapiens
tagcttttattgta

SEQ ID NO: 3967240 - DNA, 19 bp, Homo sapiens
taggaaaagtacatttaat

SEQ ID NO: 3967241 - DNA, 16 bp, Homo sapiens
taggaaataaaacctt

SEQ ID NO: 3967242 - DNA, 18 bp, Homo sapiens
taggaatgtccagactgt

SEQ ID NO: 3967243 - DNA, 15 bp, Homo sapiens
taggaccaatgttgt

SEQ ID NO: 3967244 - DNA, 16 bp, Homo sapiens
taggagcaaagcctgt

SEQ ID NO: 3967245 - DNA, 17 bp, Homo sapiens
taggagcaaagcctgtt

SEQ ID NO: 3967246 - DNA, 14 bp, Homo sapiens
taggagcagagctc

SEQ ID NO: 3967247 - DNA, 18 bp, Homo sapiens
taggagctgggaggaaaa

SEQ ID NO: 3967248 - DNA, 15 bp, Homo sapiens
taggaggaccccggg

SEQ ID NO: 3967249 - DNA, 20 bp, Homo sapiens
taggaggctgcatgctctgg

SEQ ID NO: 3967250 - DNA, 23 bp, Homo sapiens
taggagggactgtcgctgcttcg

SEQ ID NO: 3967251 - DNA, 13 bp, Homo sapiens
taggatagcattt

SEQ ID NO: 3967252 - DNA, 20 bp, Homo sapiens
taggatcatttgttggaatg

SEQ ID NO: 3967253 - DNA, 19 bp, Homo sapiens
taggatgtttttcatgaaa

SEQ ID NO: 3967254 - DNA, 12 bp, Homo sapiens
taggatttaaca

SEQ ID NO: 3967255 - DNA, 15 bp, Homo sapiens
taggcaatatcttta

SEQ ID NO: 3967256 - DNA, 13 bp, Homo sapiens
taggcagagcctt

SEQ ID NO: 3967257 - DNA, 16 bp, Homo sapiens
taggcagagcctttgg

SEQ ID NO: 3967258 - DNA, 12 bp, Homo sapiens
taggcagcctct

SEQ ID NO: 3967259 - DNA, 16 bp, Homo sapiens
taggcagcctctctgc

SEQ ID NO: 3967260 - DNA, 13 bp, Homo sapiens
taggcagcctgcc

SEQ ID NO: 3967261 - DNA, 17 bp, Homo sapiens
taggcagggatttgagg

SEQ ID NO: 3967262 - DNA, 13 bp, Homo sapiens
taggcattattta

SEQ ID NO: 3967263 - DNA, 17 bp, Homo sapiens
taggcattatttaatgt

SEQ ID NO: 3967264 - DNA, 22 bp, Homo sapiens
taggccaagctgaagtgaagga

SEQ ID NO: 3967265 - DNA, 13 bp, Homo sapiens
taggcccttgtcc

SEQ ID NO: 3967266 - DNA, 20 bp, Homo sapiens
taggcccttgtcctgccagc

SEQ ID NO: 3967267 - DNA, 23 bp, Homo sapiens
taggcccttgtcctgccagctgc

SEQ ID NO: 3967268 - DNA, 19 bp, Homo sapiens
taggcggtcatgtgtgcat

SEQ ID NO: 3967269 - DNA, 20 bp, Homo sapiens
taggcggtcatgtgtgcatg

SEQ ID NO: 3967270 - DNA, 19 bp, Homo sapiens
taggctctgaaatcttggg

SEQ ID NO: 3967271 - DNA, 12 bp, Homo sapiens
taggctggagaa

SEQ ID NO: 3967272 - DNA, 19 bp, Homo sapiens
taggctggagaagctcacc

SEQ ID NO: 3967273 - DNA, 18 bp, Homo sapiens
taggctttatgctgtgtt

SEQ ID NO: 3967274 - DNA, 14 bp, Homo sapiens
tagggacttaaaaa

SEQ ID NO: 3967275 - DNA, 15 bp, Homo sapiens
tagggagagaagata

SEQ ID NO: 3967276 - DNA, 22 bp, Homo sapiens
tagggcaggagtgagaggtctc

SEQ ID NO: 3967277 - DNA, 15 bp, Homo sapiens
tagggccaggcaggt

SEQ ID NO: 3967278 - DNA, 17 bp, Homo sapiens
taggggaagtatgtgtg

SEQ ID NO: 3967279 - DNA, 18 bp, Homo sapiens
taggggaagtatgtgtgg

SEQ ID NO: 3967280 - DNA, 16 bp, Homo sapiens
taggggtaatatattg

SEQ ID NO: 3967281 - DNA, 23 bp, Homo sapiens
taggggtaatatattgctgctgg

SEQ ID NO: 3967282 - DNA, 14 bp, Homo sapiens
taggggtcaaagaa

SEQ ID NO: 3967283 - DNA, 12 bp, Homo sapiens
taggtaagggcc

SEQ ID NO: 3967284 - DNA, 19 bp, Homo sapiens
taggtattaaagatgtgtt

SEQ ID NO: 3967285 - DNA, 15 bp, Homo sapiens
taggtcattactaac

SEQ ID NO: 3967286 - DNA, 12 bp, Homo sapiens
taggtctggttg

SEQ ID NO: 3967287 - DNA, 17 bp, Homo sapiens
taggtgaaagtgtaata

SEQ ID NO: 3967288 - DNA, 18 bp, Homo sapiens
taggtgctacaaaaacac

SEQ ID NO: 3967289 - DNA, 15 bp, Homo sapiens
taggtttttgtttgt

SEQ ID NO: 3967290 - DNA, 17 bp, Homo sapiens
tagtaaagtcaaggaga

SEQ ID NO: 3967291 - DNA, 21 bp, Homo sapiens
tagtaactactttttatactc

SEQ ID NO: 3967292 - DNA, 16 bp, Homo sapiens
tagtaagaaaacatca

SEQ ID NO: 3967293 - DNA, 18 bp, Homo sapiens
tagtaatagtccaatatt

SEQ ID NO: 3967294 - DNA, 22 bp, Homo sapiens
tagtaatagtccaatatttggc

SEQ ID NO: 3967295 - DNA, 18 bp, Homo sapiens
tagtaatgggccaattaa

SEQ ID NO: 3967296 - DNA, 13 bp, Homo sapiens
tagtaattgtaag

SEQ ID NO: 3967297 - DNA, 19 bp, Homo sapiens
tagtaccctatagagaggg

SEQ ID NO: 3967298 - DNA, 16 bp, Homo sapiens
tagtagccctttctgt

SEQ ID NO: 3967299 - DNA, 17 bp, Homo sapiens
tagtagccctttctgtg

SEQ ID NO: 3967300 - DNA, 19 bp, Homo sapiens
tagtagccctttctgtgtg

SEQ ID NO: 3967301 - DNA, 18 bp, Homo sapiens
tagtagctaatgaaattg

SEQ ID NO: 3967302 - DNA, 14 bp, Homo sapiens
tagtagtttgggtg

SEQ ID NO: 3967303 - DNA, 16 bp, Homo sapiens
tagtatatttatactc

SEQ ID NO: 3967304 - DNA, 17 bp, Homo sapiens
tagtatatttatactct

SEQ ID NO: 3967305 - DNA, 15 bp, Homo sapiens
tagtcaattagtaca

SEQ ID NO: 3967306 - DNA, 16 bp, Homo sapiens
tagtcaattagtacag

SEQ ID NO: 3967307 - DNA, 19 bp, Homo sapiens
tagtcaattagtacagtag

SEQ ID NO: 3967308 - DNA, 14 bp, Homo sapiens
tagtcacaccatct

SEQ ID NO: 3967309 - DNA, 21 bp, Homo sapiens
tagtccaaatgtgatcaactg

SEQ ID NO: 3967310 - DNA, 16 bp, Homo sapiens
tagtccaatatttggc

SEQ ID NO: 3967311 - DNA, 14 bp, Homo sapiens
tagtccccatcagc

SEQ ID NO: 3967312 - DNA, 19 bp, Homo sapiens
tagtccccatcagcaccat

SEQ ID NO: 3967313 - DNA, 22 bp, Homo sapiens
tagtctcctttgcactgagggc

SEQ ID NO: 3967314 - DNA, 18 bp, Homo sapiens
tagtctgtgtgcacaatg

SEQ ID NO: 3967315 - DNA, 15 bp, Homo sapiens
tagtgaagatgttgt

SEQ ID NO: 3967316 - DNA, 13 bp, Homo sapiens
tagtgatggttcc

SEQ ID NO: 3967317 - DNA, 20 bp, Homo sapiens
tagtgatgttgtttgggaga

SEQ ID NO: 3967318 - DNA, 16 bp, Homo sapiens
tagtgatttcctgtat

SEQ ID NO: 3967319 - DNA, 22 bp, Homo sapiens
tagtgccccctctaacccccag

SEQ ID NO: 3967320 - DNA, 15 bp, Homo sapiens
tagtgctatatatat

SEQ ID NO: 3967321 - DNA, 17 bp, Homo sapiens
tagtggaagagcagcct

SEQ ID NO: 3967322 - DNA, 21 bp, Homo sapiens
tagtgtgagtggcagccatgc

SEQ ID NO: 3967323 - DNA, 14 bp, Homo sapiens
tagtgtgtgtgcat

SEQ ID NO: 3967324 - DNA, 18 bp, Homo sapiens
tagtgtgtgtgcatgtgt

SEQ ID NO: 3967325 - DNA, 19 bp, Homo sapiens
tagttaaaagactgcagct

SEQ ID NO: 3967326 - DNA, 12 bp, Homo sapiens
tatatttatact

SEQ ID NO: 3967327 - DNA, 16 bp, Homo sapiens
tatatttggaaagaga

SEQ ID NO: 3967328 - DNA, 16 bp, Homo sapiens
tatatttgtgtatgtg

SEQ ID NO: 3967329 - DNA, 23 bp, Homo sapiens
tatattttcatgacttttccatg

SEQ ID NO: 3967330 - DNA, 18 bp, Homo sapiens
tatatttttatatttagt

SEQ ID NO: 3967331 - DNA, 13 bp, Homo sapiens
tatatttttcaac

SEQ ID NO: 3967332 - DNA, 22 bp, Homo sapiens
tatatttttcaaccagcatttt

SEQ ID NO: 3967333 - DNA, 18 bp, Homo sapiens
tatcaaaacatatcaatt

SEQ ID NO: 3967334 - DNA, 13 bp, Homo sapiens
tatcaaatctgta

SEQ ID NO: 3967335 - DNA, 16 bp, Homo sapiens
tatcaaatctgtatat

SEQ ID NO: 3967336 - DNA, 22 bp, Homo sapiens
tatcaaatctgtatatgttgta

SEQ ID NO: 3967337 - DNA, 12 bp, Homo sapiens
tatcaagaaagt

SEQ ID NO: 3967338 - DNA, 19 bp, Homo sapiens
tatcaaggatgttctggct

SEQ ID NO: 3967339 - DNA, 15 bp, Homo sapiens
tatcaatcctgcccc

SEQ ID NO: 3967340 - DNA, 17 bp, Homo sapiens
tatcaatccttgttcag

SEQ ID NO: 3967341 - DNA, 20 bp, Homo sapiens
tatcacatacaatttgcact

SEQ ID NO: 3967342 - DNA, 17 bp, Homo sapiens
tatcacctctcttcagc

SEQ ID NO: 3967343 - DNA, 14 bp, Homo sapiens
tatcacttatatat

SEQ ID NO: 3967344 - DNA, 13 bp, Homo sapiens
tatcagaaaagta

SEQ ID NO: 3967345 - DNA, 17 bp, Homo sapiens
tatcagaaaagtagaat

SEQ ID NO: 3967346 - DNA, 21 bp, Homo sapiens
tatcagaaaagtagaattata

SEQ ID NO: 3967347 - DNA, 21 bp, Homo sapiens
tatcagaagaccacaaaaatt

SEQ ID NO: 3967348 - DNA, 18 bp, Homo sapiens
tatcagaatctgtgtgaa

SEQ ID NO: 3967349 - DNA, 16 bp, Homo sapiens
tatcagacctctgatc

SEQ ID NO: 3967350 - DNA, 13 bp, Homo sapiens
tatcagcctgagt

SEQ ID NO: 3967351 - DNA, 19 bp, Homo sapiens
tatcagctacttaagagaa

SEQ ID NO: 3967352 - DNA, 14 bp, Homo sapiens
tatcaggcacaggc

SEQ ID NO: 3967353 - DNA, 16 bp, Homo sapiens
tatcaggcacaggcag

SEQ ID NO: 3967354 - DNA, 23 bp, Homo sapiens
tatcagtgatggtctcacagagc

SEQ ID NO: 3967355 - DNA, 20 bp, Homo sapiens
tatcagtttgtcctgtagag

SEQ ID NO: 3967356 - DNA, 15 bp, Homo sapiens
tatcatagaaatgta

SEQ ID NO: 3967357 - DNA, 12 bp, Homo sapiens
tatcatgcattc

SEQ ID NO: 3967358 - DNA, 21 bp, Homo sapiens
tatcatgctttaaagtgtaat

SEQ ID NO: 3967359 - DNA, 20 bp, Homo sapiens
tatcatgggaaaagaccagg

SEQ ID NO: 3967360 - DNA, 16 bp, Homo sapiens
tatcattaaattggaa

SEQ ID NO: 3967361 - DNA, 21 bp, Homo sapiens
tatccacagaaacattttcat

SEQ ID NO: 3967362 - DNA, 20 bp, Homo sapiens
tatccacccagcccattctc

SEQ ID NO: 3967363 - DNA, 20 bp, Homo sapiens
tatccagtgatgtgctggag

SEQ ID NO: 3967364 - DNA, 16 bp, Homo sapiens
tatcccaaacttcgga

SEQ ID NO: 3967365 - DNA, 19 bp, Homo sapiens
tatcccaaacttcggaaac

SEQ ID NO: 3967366 - DNA, 15 bp, Homo sapiens
tatcctacaacaaga

SEQ ID NO: 3967367 - DNA, 20 bp, Homo sapiens
tatcctagagaggctggcaa

SEQ ID NO: 3967368 - DNA, 14 bp, Homo sapiens
tatcctgaaatttc

SEQ ID NO: 3967369 - DNA, 17 bp, Homo sapiens
tatcctgaaatttcaga

SEQ ID NO: 3967370 - DNA, 21 bp, Homo sapiens
tatcctgcgggttttaattta

SEQ ID NO: 3967371 - DNA, 19 bp, Homo sapiens
tatcctgctagctgtagaa

SEQ ID NO: 3967372 - DNA, 19 bp, Homo sapiens
tatccttaggaaaatgctt

SEQ ID NO: 3967373 - DNA, 21 bp, Homo sapiens
tatccttaggaaaatgcttct

SEQ ID NO: 3967374 - DNA, 22 bp, Homo sapiens
tatcctttgtggcaccttttct

SEQ ID NO: 3967375 - DNA, 20 bp, Homo sapiens
tatcgcaccactgtgtattt

SEQ ID NO: 3967376 - DNA, 16 bp, Homo sapiens
tatctaatttatacaa

SEQ ID NO: 3967377 - DNA, 20 bp, Homo sapiens
tatctaatttatacaaaata

SEQ ID NO: 3967378 - DNA, 16 bp, Homo sapiens
tatctacctgccctct

SEQ ID NO: 3967379 - DNA, 21 bp, Homo sapiens
tatctacctgccctctctcag

SEQ ID NO: 3967380 - DNA, 15 bp, Homo sapiens
tatctagaaagaaaa

SEQ ID NO: 3967381 - DNA, 21 bp, Homo sapiens
tatctagaaagaaaagaccct

SEQ ID NO: 3967382 - DNA, 15 bp, Homo sapiens
tatctcagaggctat

SEQ ID NO: 3967383 - DNA, 13 bp, Homo sapiens
tatctcctcctat

SEQ ID NO: 3967384 - DNA, 21 bp, Homo sapiens
tatctgaacacatactagaaa

SEQ ID NO: 3967385 - DNA, 22 bp, Homo sapiens
tatctgaacacatactagaaag

SEQ ID NO: 3967386 - DNA, 21 bp, Homo sapiens
tatctgaaggagattttcctt

SEQ ID NO: 3967387 - DNA, 17 bp, Homo sapiens
tatctgaggcactgata

SEQ ID NO: 3967388 - DNA, 23 bp, Homo sapiens
tatctgaggcactgataatatgt

SEQ ID NO: 3967389 - DNA, 23 bp, Homo sapiens
tatctgcatttataaatgtgtgg

SEQ ID NO: 3967390 - DNA, 11 bp, Homo sapiens
tatctgcctgg

SEQ ID NO: 3967391 - DNA, 13 bp, Homo sapiens
tatctgcctggcc

SEQ ID NO: 3967392 - DNA, 21 bp, Homo sapiens
tatctgcctggcctggctccc

SEQ ID NO: 3967393 - DNA, 15 bp, Homo sapiens
tatctgtcatctctc

SEQ ID NO: 3967394 - DNA, 14 bp, Homo sapiens
tatcttacttttgg

SEQ ID NO: 3967395 - DNA, 12 bp, Homo sapiens
tatcttcacata

SEQ ID NO: 3967396 - DNA, 15 bp, Homo sapiens
tatcttcacatagtt

SEQ ID NO: 3967397 - DNA, 23 bp, Homo sapiens
tatcttggtgaatttttttttcc

SEQ ID NO: 3967398 - DNA, 23 bp, Homo sapiens
tatctttgaatggtcttctgcca

SEQ ID NO: 3967399 - DNA, 23 bp, Homo sapiens
tatgaaagatggctgtgcctctg

SEQ ID NO: 3967400 - DNA, 20 bp, Homo sapiens
tatgaaatgataaagatgtc

SEQ ID NO: 3967401 - DNA, 20 bp, Homo sapiens
tatgaacttgaggacacatg

SEQ ID NO: 3967402 - DNA, 18 bp, Homo sapiens
tatgaataaagacaccta

SEQ ID NO: 3967403 - DNA, 22 bp, Homo sapiens
tatgaatgatgttttagaatga

SEQ ID NO: 3967404 - DNA, 23 bp, Homo sapiens
tatgacatcacttgtacaaaata

SEQ ID NO: 3967405 - DNA, 24 bp, Homo sapiens
tatgacatcacttgtacaaaataa

SEQ ID NO: 3967406 - DNA, 15 bp, Homo sapiens
tatgacatgccaccc

SEQ ID NO: 3967407 - DNA, 18 bp, Homo sapiens
tatgactgctccccagcc

SEQ ID NO: 3967408 - DNA, 21 bp, Homo sapiens
tatgacttgggcacccccagc

SEQ ID NO: 3967409 - DNA, 22 bp, Homo sapiens
tatgacttgggcacccccagcc

SEQ ID NO: 3967410 - DNA, 23 bp, Homo sapiens
tatgacttgggcacccccagcct

SEQ ID NO: 3967411 - DNA, 16 bp, Homo sapiens
tatgagctgagggggg

SEQ ID NO: 3967412 - DNA, 17 bp, Homo sapiens
tattataataatgttct

SEQ ID NO: 3967413 - DNA, 21 bp, Homo sapiens
tattatgactcaataaaagaa

SEQ ID NO: 3967414 - DNA, 15 bp, Homo sapiens
tattatggcaagtga

SEQ ID NO: 3967415 - DNA, 23 bp, Homo sapiens
tattatggcaagtgatatcacct

SEQ ID NO: 3967416 - DNA, 16 bp, Homo sapiens
tattatggtgtaatgc

SEQ ID NO: 3967417 - DNA, 21 bp, Homo sapiens
tattatggtgtaatgcacaat

SEQ ID NO: 3967418 - DNA, 18 bp, Homo sapiens
tattatgtaacatccaga

SEQ ID NO: 3967419 - DNA, 14 bp, Homo sapiens
tattatgttgttca

SEQ ID NO: 3967420 - DNA, 14 bp, Homo sapiens
tattattaataaat

SEQ ID NO: 3967421 - DNA, 15 bp, Homo sapiens
tattattagattctc

SEQ ID NO: 3967422 - DNA, 12 bp, Homo sapiens
tattattgttct

SEQ ID NO: 3967423 - DNA, 19 bp, Homo sapiens
tattatttaaatgttgaaa

SEQ ID NO: 3967424 - DNA, 15 bp, Homo sapiens
tattcaaacagtctc

SEQ ID NO: 3967425 - DNA, 12 bp, Homo sapiens
tattcaataaag

SEQ ID NO: 3967426 - DNA, 14 bp, Homo sapiens
tattcatgcttctt

SEQ ID NO: 3967427 - DNA, 19 bp, Homo sapiens
tattcatgctttctccttt

SEQ ID NO: 3967428 - DNA, 20 bp, Homo sapiens
tattcatgtaataaatctga

SEQ ID NO: 3967429 - DNA, 14 bp, Homo sapiens
tattcatttaaaat

SEQ ID NO: 3967430 - DNA, 15 bp, Homo sapiens
tattcatttaaaatg

SEQ ID NO: 3967431 - DNA, 19 bp, Homo sapiens
tattcatttaaaatgatta

SEQ ID NO: 3967432 - DNA, 16 bp, Homo sapiens
tattccaccattcaca

SEQ ID NO: 3967433 - DNA, 20 bp, Homo sapiens
tattcccatgtgtgactcca

SEQ ID NO: 3967434 - DNA, 20 bp, Homo sapiens
tattcctatatagtttattg

SEQ ID NO: 3967435 - DNA, 21 bp, Homo sapiens
tattcctgcatttgtgaaatg

SEQ ID NO: 3967436 - DNA, 14 bp, Homo sapiens
tattctcactccac

SEQ ID NO: 3967437 - DNA, 15 bp, Homo sapiens
tattctcctccctgt

SEQ ID NO: 3967438 - DNA, 16 bp, Homo sapiens
tattctctcctcagac

SEQ ID NO: 3967439 - DNA, 21 bp, Homo sapiens
tattctcttaatttttcttaa

SEQ ID NO: 3967440 - DNA, 12 bp, Homo sapiens
tattctcttcac

SEQ ID NO: 3967441 - DNA, 12 bp, Homo sapiens
tattctgagcct

SEQ ID NO: 3967442 - DNA, 13 bp, Homo sapiens
tattctgagcctt

SEQ ID NO: 3967443 - DNA, 15 bp, Homo sapiens
tattctgagccttga

SEQ ID NO: 3967444 - DNA, 14 bp, Homo sapiens
tattctggaaaaaa

SEQ ID NO: 3967445 - DNA, 20 bp, Homo sapiens
tattctgggctcctggaacc

SEQ ID NO: 3967446 - DNA, 14 bp, Homo sapiens
tattctgtgttgaa

SEQ ID NO: 3967447 - DNA, 13 bp, Homo sapiens
tattctgttttct

SEQ ID NO: 3967448 - DNA, 22 bp, Homo sapiens
tattcttaagggaacttccaca

SEQ ID NO: 3967449 - DNA, 14 bp, Homo sapiens
tattgaagaaacag

SEQ ID NO: 3967450 - DNA, 15 bp, Homo sapiens
tattgaatatatcag

SEQ ID NO: 3967451 - DNA, 18 bp, Homo sapiens
tattgacaataatttcag

SEQ ID NO: 3967452 - DNA, 16 bp, Homo sapiens
tattgatgtttccaga

SEQ ID NO: 3967453 - DNA, 20 bp, Homo sapiens
tattgatgtttccagaaaat

SEQ ID NO: 3967454 - DNA, 19 bp, Homo sapiens
tattgcatgtaaaatgcag

SEQ ID NO: 3967455 - DNA, 21 bp, Homo sapiens
tattgccacaatgcctctccc

SEQ ID NO: 3967456 - DNA, 16 bp, Homo sapiens
tattgcgaatgtgcag

SEQ ID NO: 3967457 - DNA, 22 bp, Homo sapiens
tattgctgctggtaatttgtat

SEQ ID NO: 3967458 - DNA, 19 bp, Homo sapiens
tattggaagtgttcaagaa

SEQ ID NO: 3967459 - DNA, 14 bp, Homo sapiens
tattggccactggg

SEQ ID NO: 3967460 - DNA, 18 bp, Homo sapiens
tattgggagggatgagag

SEQ ID NO: 3967461 - DNA, 21 bp, Homo sapiens
tattggggttggttggggtgg

SEQ ID NO: 3967462 - DNA, 15 bp, Homo sapiens
tattggtaacatcct

SEQ ID NO: 3967463 - DNA, 18 bp, Homo sapiens
tattggtaacatcctttc

SEQ ID NO: 3967464 - DNA, 21 bp, Homo sapiens
tattggtaacatcctttctat

SEQ ID NO: 3967465 - DNA, 22 bp, Homo sapiens
tattgtataagattagaatgaa

SEQ ID NO: 3967466 - DNA, 12 bp, Homo sapiens
tattgtatgtaa

SEQ ID NO: 3967467 - DNA, 13 bp, Homo sapiens
tattgtatgtaag

SEQ ID NO: 3967468 - DNA, 15 bp, Homo sapiens
tattgtatgtaagta

SEQ ID NO: 3967469 - DNA, 16 bp, Homo sapiens
tattgtattaagggca

SEQ ID NO: 3967470 - DNA, 16 bp, Homo sapiens
tattgtcagatatttt

SEQ ID NO: 3967471 - DNA, 23 bp, Homo sapiens
tattgtccatatcagacctctga

SEQ ID NO: 3967472 - DNA, 20 bp, Homo sapiens
tattgtcctcccctatttta

SEQ ID NO: 3967473 - DNA, 13 bp, Homo sapiens
tattgtgatctat

SEQ ID NO: 3967474 - DNA, 16 bp, Homo sapiens
tattgtttaaaatcat

SEQ ID NO: 3967475 - DNA, 20 bp, Homo sapiens
tattgtttaaaatcatttct

SEQ ID NO: 3967476 - DNA, 20 bp, Homo sapiens
tattgtttctttaagaaagt

SEQ ID NO: 3967477 - DNA, 17 bp, Homo sapiens
tattgttttatgttcta

SEQ ID NO: 3967478 - DNA, 14 bp, Homo sapiens
tatttaaaaaataa

SEQ ID NO: 3967479 - DNA, 19 bp, Homo sapiens
tatttaaactgttctgtgt

SEQ ID NO: 3967480 - DNA, 14 bp, Homo sapiens
tatttaaatgttga

SEQ ID NO: 3967481 - DNA, 16 bp, Homo sapiens
tatttaaatgttgaaa

SEQ ID NO: 3967482 - DNA, 20 bp, Homo sapiens
tatttaagcctcatatttaa

SEQ ID NO: 3967483 - DNA, 13 bp, Homo sapiens
tatttaagccttt

SEQ ID NO: 3967484 - DNA, 16 bp, Homo sapiens
tatttaagtatatagt

SEQ ID NO: 3967485 - DNA, 14 bp, Homo sapiens
tatttactaaaaga

SEQ ID NO: 3967486 - DNA, 16 bp, Homo sapiens
tatttacttgtagaaa

SEQ ID NO: 3967487 - DNA, 19 bp, Homo sapiens
tatttagattgttaaaata

SEQ ID NO: 3967488 - DNA, 15 bp, Homo sapiens
tatttagttatagtt

SEQ ID NO: 3967489 - DNA, 20 bp, Homo sapiens
tatttagttatagtttcaga

SEQ ID NO: 3967490 - DNA, 17 bp, Homo sapiens
tatttataagcagattt

SEQ ID NO: 3967491 - DNA, 12 bp, Homo sapiens
tatttatactct

SEQ ID NO: 3967492 - DNA, 23 bp, Homo sapiens
tatttatactctagaacatgcac

SEQ ID NO: 3967493 - DNA, 14 bp, Homo sapiens
tatttatatatatt

SEQ ID NO: 3967494 - DNA, 13 bp, Homo sapiens
tatttatatattt

SEQ ID NO: 3967495 - DNA, 15 bp, Homo sapiens
tatttatatatttga

SEQ ID NO: 3967496 - DNA, 14 bp, Homo sapiens
tatttatatgttaa

SEQ ID NO: 3967497 - DNA, 21 bp, Homo sapiens
tatttatatgttaatttgtta

SEQ ID NO: 3967498 - DNA, 13 bp, Homo sapiens
tatttatattgta

SEQ ID NO: 3967499 - DNA, 14 bp, Homo sapiens
tatttatatttgga

SEQ ID NO: 3967500 - DNA, 20 bp, Homo sapiens
tatttatctgtgcaaatcct

SEQ ID NO: 3967501 - DNA, 21 bp, Homo sapiens
tatttatggcttataaatgtg

SEQ ID NO: 3967502 - DNA, 14 bp, Homo sapiens
tatttattactatg

SEQ ID NO: 3967503 - DNA, 12 bp, Homo sapiens
tatttattgggg

SEQ ID NO: 3967504 - DNA, 21 bp, Homo sapiens
tatttattgtcattactgcct

SEQ ID NO: 3967505 - DNA, 23 bp, Homo sapiens
tatttattgtcattactgccttt

SEQ ID NO: 3967506 - DNA, 16 bp, Homo sapiens
tatttatttaagctta

SEQ ID NO: 3967507 - DNA, 20 bp, Homo sapiens
tatttattttttttaagtat

SEQ ID NO: 3967508 - DNA, 12 bp, Homo sapiens
tatttcaaatga

SEQ ID NO: 3967509 - DNA, 15 bp, Homo sapiens
tatttcaaatgaaca

SEQ ID NO: 3967510 - DNA, 18 bp, Homo sapiens
tatttcattttttgcatc

SEQ ID NO: 3967511 - DNA, 11 bp, Homo sapiens
tatttcctgct

SEQ ID NO: 3967512 - DNA, 15 bp, Homo sapiens
tatttctagcagagt

SEQ ID NO: 3967513 - DNA, 17 bp, Homo sapiens
tatttctggcctcagca

SEQ ID NO: 3967514 - DNA, 18 bp, Homo sapiens
tatttctttgtgataaca

SEQ ID NO: 3967515 - DNA, 15 bp, Homo sapiens
tatttgaatatcatt

SEQ ID NO: 3967516 - DNA, 22 bp, Homo sapiens
tatttgagcatgcacagctgct

SEQ ID NO: 3967517 - DNA, 16 bp, Homo sapiens
tatttgcactgtagcc

SEQ ID NO: 3967518 - DNA, 18 bp, Homo sapiens
tatttggtctctatttca

SEQ ID NO: 3967519 - DNA, 14 bp, Homo sapiens
tatttgttattttc

SEQ ID NO: 3967520 - DNA, 18 bp, Homo sapiens
tatttgtttacatgcaga

SEQ ID NO: 3967521 - DNA, 19 bp, Homo sapiens
tattttaaaaccatgcagc

SEQ ID NO: 3967522 - DNA, 14 bp, Homo sapiens
tattttaaaagcca

SEQ ID NO: 3967523 - DNA, 14 bp, Homo sapiens
tattttaaacaaaa

SEQ ID NO: 3967524 - DNA, 19 bp, Homo sapiens
tattttaaacaaaatagaa

SEQ ID NO: 3967525 - DNA, 17 bp, Homo sapiens
tattttaggagacagtc

SEQ ID NO: 3967526 - DNA, 20 bp, Homo sapiens
tattttgtaaactcaaaata

SEQ ID NO: 3967527 - DNA, 15 bp, Homo sapiens
tattttgtatatatc

SEQ ID NO: 3967528 - DNA, 15 bp, Homo sapiens
tattttgtctcctac

SEQ ID NO: 3967529 - DNA, 17 bp, Homo sapiens
tattttgttacactaaa

SEQ ID NO: 3967530 - DNA, 22 bp, Homo sapiens
tattttgttgtgattttgtaca

SEQ ID NO: 3967531 - DNA, 14 bp, Homo sapiens
tatttttctaaggt

SEQ ID NO: 3967532 - DNA, 11 bp, Homo sapiens
tatttttgtac

SEQ ID NO: 3967533 - DNA, 14 bp, Homo sapiens
tatttttgtccctg

SEQ ID NO: 3967534 - DNA, 15 bp, Homo sapiens
tatttttgtgtttct

SEQ ID NO: 3967535 - DNA, 17 bp, Homo sapiens
tattttttttaagtatt

SEQ ID NO: 3967536 - DNA, 23 bp, Homo sapiens
tcaaaaagtctacgctctccttt

SEQ ID NO: 3967537 - DNA, 13 bp, Homo sapiens
tcaaaaataaact

SEQ ID NO: 3967538 - DNA, 21 bp, Homo sapiens
tcaaaaataaactagtttcca

SEQ ID NO: 3967539 - DNA, 22 bp, Homo sapiens
tcaaaaataaactagtttccag

SEQ ID NO: 3967540 - DNA, 19 bp, Homo sapiens
tcaaaacatatcaattcaa

SEQ ID NO: 3967541 - DNA, 13 bp, Homo sapiens
tcaaaactgcact

SEQ ID NO: 3967542 - DNA, 17 bp, Homo sapiens
tcaaaagacatgttgta

SEQ ID NO: 3967543 - DNA, 21 bp, Homo sapiens
tcaaaagacatgttgtaaatt

SEQ ID NO: 3967544 - DNA, 17 bp, Homo sapiens
tcaaaagattgttttat

SEQ ID NO: 3967545 - DNA, 15 bp, Homo sapiens
tcaaaagcacttgtt

SEQ ID NO: 3967546 - DNA, 12 bp, Homo sapiens
tcaaaagcctgg

SEQ ID NO: 3967547 - DNA, 12 bp, Homo sapiens
tcaaaagctgct

SEQ ID NO: 3967548 - DNA, 13 bp, Homo sapiens
tcaaaaggtgcct

SEQ ID NO: 3967549 - DNA, 23 bp, Homo sapiens
tcaaaaggtgcctgtgaggcagg

SEQ ID NO: 3967550 - DNA, 17 bp, Homo sapiens
tcaaaagtgatctgtcc

SEQ ID NO: 3967551 - DNA, 23 bp, Homo sapiens
tcaaaataccatgccatttaaag

SEQ ID NO: 3967552 - DNA, 14 bp, Homo sapiens
tcaaacaagaatgt

SEQ ID NO: 3967553 - DNA, 21 bp, Homo sapiens
tcaaacagtctcaggaaatca

SEQ ID NO: 3967554 - DNA, 22 bp, Homo sapiens
tcaaacatgaagtgtgtttcct

SEQ ID NO: 3967555 - DNA, 13 bp, Homo sapiens
tcaaaccaggatt

SEQ ID NO: 3967556 - DNA, 14 bp, Homo sapiens
tcaaaccaggattt

SEQ ID NO: 3967557 - DNA, 15 bp, Homo sapiens
tcaaaccatttaatt

SEQ ID NO: 3967558 - DNA, 16 bp, Homo sapiens
tcaaaccatttaattc

SEQ ID NO: 3967559 - DNA, 19 bp, Homo sapiens
tcaaaccatttaattcata

SEQ ID NO: 3967560 - DNA, 21 bp, Homo sapiens
tcaaaccatttaattcataat

SEQ ID NO: 3967561 - DNA, 23 bp, Homo sapiens
tcaaaccatttaattcataatta

SEQ ID NO: 3967562 - DNA, 19 bp, Homo sapiens
tcaaaccccgaccacctgc

SEQ ID NO: 3967563 - DNA, 19 bp, Homo sapiens
tcaaactgacaacctgtgc

SEQ ID NO: 3967564 - DNA, 23 bp, Homo sapiens
tcaaactgagtaaattggaaaca

SEQ ID NO: 3967565 - DNA, 13 bp, Homo sapiens
tcaaactgggtat

SEQ ID NO: 3967566 - DNA, 14 bp, Homo sapiens
tcaaacttgtgctg

SEQ ID NO: 3967567 - DNA, 21 bp, Homo sapiens
tcaaactttactctaagtctc

SEQ ID NO: 3967568 - DNA, 22 bp, Homo sapiens
tcaaactttactctaagtctcc

SEQ ID NO: 3967569 - DNA, 19 bp, Homo sapiens
tcaaagaaatgctgatgga

SEQ ID NO: 3967570 - DNA, 12 bp, Homo sapiens
tcaaagaaggaa

SEQ ID NO: 3967571 - DNA, 17 bp, Homo sapiens
tcaaagacaatggaaac

SEQ ID NO: 3967572 - DNA, 17 bp, Homo sapiens
tcaaagcaagggctcca

SEQ ID NO: 3967573 - DNA, 18 bp, Homo sapiens
tcaaagcaagggctccag

SEQ ID NO: 3967574 - DNA, 17 bp, Homo sapiens
tcaaagccggttgcaga

SEQ ID NO: 3967575 - DNA, 12 bp, Homo sapiens
tcaaaggaagac

SEQ ID NO: 3967576 - DNA, 18 bp, Homo sapiens
tcaaagggcccacagtga

SEQ ID NO: 3967577 - DNA, 22 bp, Homo sapiens
tcaaagtaaaaaattaaagccc

SEQ ID NO: 3967578 - DNA, 20 bp, Homo sapiens
tcaaatatctcagaggctat

SEQ ID NO: 3967579 - DNA, 17 bp, Homo sapiens
tcaaatatgcaaagcac

SEQ ID NO: 3967580 - DNA, 19 bp, Homo sapiens
tcaaatatgcaaagcactg

SEQ ID NO: 3967581 - DNA, 15 bp, Homo sapiens
tcaaatattaccaaa

SEQ ID NO: 3967582 - DNA, 15 bp, Homo sapiens
tcaaatccatccaga

SEQ ID NO: 3967583 - DNA, 23 bp, Homo sapiens
tcaaatccccggctgcttccttc

SEQ ID NO: 3967584 - DNA, 16 bp, Homo sapiens
tcaaatctccagtatt

SEQ ID NO: 3967585 - DNA, 21 bp, Homo sapiens
tcaaatctgtatatgttgtaa

SEQ ID NO: 3967586 - DNA, 21 bp, Homo sapiens
tcactatggtatgctggccag

SEQ ID NO: 3967587 - DNA, 17 bp, Homo sapiens
tcactcactcactcatt

SEQ ID NO: 3967588 - DNA, 15 bp, Homo sapiens
tcactcactcattcc

SEQ ID NO: 3967589 - DNA, 16 bp, Homo sapiens
tcactcactgtcaatg

SEQ ID NO: 3967590 - DNA, 13 bp, Homo sapiens
tcactcagccaca

SEQ ID NO: 3967591 - DNA, 14 bp, Homo sapiens
tcactcagccacac

SEQ ID NO: 3967592 - DNA, 15 bp, Homo sapiens
tcactccagtgttac

SEQ ID NO: 3967593 - DNA, 12 bp, Homo sapiens
tcactccctgga

SEQ ID NO: 3967594 - DNA, 19 bp, Homo sapiens
tcactctacttagcatgtc

SEQ ID NO: 3967595 - DNA, 13 bp, Homo sapiens
tcactctgtcagc

SEQ ID NO: 3967596 - DNA, 17 bp, Homo sapiens
tcactctgtcagccagc

SEQ ID NO: 3967597 - DNA, 17 bp, Homo sapiens
tcactcttatgaaatgg

SEQ ID NO: 3967598 - DNA, 18 bp, Homo sapiens
tcactcttcctgcaagga

SEQ ID NO: 3967599 - DNA, 15 bp, Homo sapiens
tcactgagtggcttg

SEQ ID NO: 3967600 - DNA, 18 bp, Homo sapiens
tcactgattgggtgccat

SEQ ID NO: 3967601 - DNA, 14 bp, Homo sapiens
tcactgccatgcct

SEQ ID NO: 3967602 - DNA, 17 bp, Homo sapiens
gtcctgacgccctgcgt

SEQ ID NO: 3967603 - DNA, 16 bp, Homo sapiens
gtcctgagcactgcca

SEQ ID NO: 3967604 - DNA, 21 bp, Homo sapiens
gtcctgagggtccccacctgg

SEQ ID NO: 3967605 - DNA, 20 bp, Homo sapiens
gtcctgcaatctccagggct

SEQ ID NO: 3967606 - DNA, 21 bp, Homo sapiens
gtcctgcaatctccagggctg

SEQ ID NO: 3967607 - DNA, 20 bp, Homo sapiens
gtcctgcagaggaccacagt

SEQ ID NO: 3967608 - DNA, 21 bp, Homo sapiens
gtcctgcagaggaccacagtg

SEQ ID NO: 3967609 - DNA, 13 bp, Homo sapiens
gtcacctcctcca

SEQ ID NO: 3967610 - DNA, 17 bp, Homo sapiens
gtcacctcctccactca

SEQ ID NO: 3967611 - DNA, 12 bp, Homo sapiens
gtcacctgcaag

SEQ ID NO: 3967612 - DNA, 13 bp, Homo sapiens
gtcacctgcaagc

SEQ ID NO: 3967613 - DNA, 14 bp, Homo sapiens
gtcacctgcaagcc

SEQ ID NO: 3967614 - DNA, 19 bp, Homo sapiens
gtcacctgcaagccccagg

SEQ ID NO: 3967615 - DNA, 22 bp, Homo sapiens
gtcacctgcaagccccagggcc

SEQ ID NO: 3967616 - DNA, 24 bp, Homo sapiens
gtcacctgcaagccccagggcctg

SEQ ID NO: 3967617 - DNA, 22 bp, Homo sapiens
gtcacgaggtccagacccactc

SEQ ID NO: 3967618 - DNA, 16 bp, Homo sapiens
gtcactatgctatttc

SEQ ID NO: 3967619 - DNA, 18 bp, Homo sapiens
gtcactatgctatttctg

SEQ ID NO: 3967620 - DNA, 22 bp, Homo sapiens
gtcactatgctatttctggcct

SEQ ID NO: 3967621 - DNA, 23 bp, Homo sapiens
gtcactgcacagtgcatctcagc

SEQ ID NO: 3967622 - DNA, 15 bp, Homo sapiens
gtcactgctctggac

SEQ ID NO: 3967623 - DNA, 21 bp, Homo sapiens
gtcactggtagaccaaaataa

SEQ ID NO: 3967624 - DNA, 15 bp, Homo sapiens
gtcagaagcaggttc

SEQ ID NO: 3967625 - DNA, 22 bp, Homo sapiens
gtcagaagcaggttcttgatgt

SEQ ID NO: 3967626 - DNA, 18 bp, Homo sapiens
gtcagacatccatgtttg

SEQ ID NO: 3967627 - DNA, 18 bp, Homo sapiens
gtcagaccagtactggga

SEQ ID NO: 3967628 - DNA, 19 bp, Homo sapiens
gtcagagctatgttccctc

SEQ ID NO: 3967629 - DNA, 13 bp, Homo sapiens
gtcagaggagaag

SEQ ID NO: 3967630 - DNA, 14 bp, Homo sapiens
gtcagaggagaaga

SEQ ID NO: 3967631 - DNA, 18 bp, Homo sapiens
gtcagccagccgccctgg

SEQ ID NO: 3967632 - DNA, 21 bp, Homo sapiens
gtcagccagccgccctgggct

SEQ ID NO: 3967633 - DNA, 11 bp, Homo sapiens
gtcagccaggg

SEQ ID NO: 3967634 - DNA, 19 bp, Homo sapiens
gtcagcccgaatgcctgtc

SEQ ID NO: 3967635 - DNA, 20 bp, Homo sapiens
gtcagccgagccgggcctgg

SEQ ID NO: 3967636 - DNA, 21 bp, Homo sapiens
gtcagccgagccgggcctggg

SEQ ID NO: 3967637 - DNA, 20 bp, Homo sapiens
gtcagcgtgcttagcctcct

SEQ ID NO: 3967638 - DNA, 21 bp, Homo sapiens
gtcagctcccctcggagaaga

SEQ ID NO: 3967639 - DNA, 22 bp, Homo sapiens
gtcagctcccctcggagaagag

SEQ ID NO: 3967640 - DNA, 13 bp, Homo sapiens
gtcagctttcaga

SEQ ID NO: 3967641 - DNA, 17 bp, Homo sapiens
gtcagctttcagagcca

SEQ ID NO: 3967642 - DNA, 19 bp, Homo sapiens
gtcagctttgcttttcctg

SEQ ID NO: 3967643 - DNA, 17 bp, Homo sapiens
gtcagtaggtccaaggg

SEQ ID NO: 3967644 - DNA, 20 bp, Homo sapiens
gtcagtaggtccaagggcca

SEQ ID NO: 3967645 - DNA, 18 bp, Homo sapiens
gtcagtctctctctccct

SEQ ID NO: 3967646 - DNA, 22 bp, Homo sapiens
gtcagtgggaacgtgactgccc

SEQ ID NO: 3967647 - DNA, 19 bp, Homo sapiens
gtcagtgtggagaggggtg

SEQ ID NO: 3967648 - DNA, 21 bp, Homo sapiens
gtcagttcccggagcacagcc

SEQ ID NO: 3967649 - DNA, 18 bp, Homo sapiens
gtcatcactccctggatg

SEQ ID NO: 3967650 - DNA, 15 bp, Homo sapiens
gtcatcacttttcag

SEQ ID NO: 3967651 - DNA, 14 bp, Homo sapiens
gtcatcccctacac

SEQ ID NO: 3967652 - DNA, 18 bp, Homo sapiens
gtcatcggaggctgggcc

SEQ ID NO: 3967653 - DNA, 22 bp, Homo sapiens
gtcatctctctggggccctggg

SEQ ID NO: 3967654 - DNA, 16 bp, Homo sapiens
gtcatctggtagattt

SEQ ID NO: 3967655 - DNA, 16 bp, Homo sapiens
gtcatgatctccctgc

SEQ ID NO: 3967656 - DNA, 19 bp, Homo sapiens
gtcatgatctccctgccgc

SEQ ID NO: 3967657 - DNA, 15 bp, Homo sapiens
gtcatgatggagact

SEQ ID NO: 3967658 - DNA, 17 bp, Homo sapiens
gtcatggaaaagcccag

SEQ ID NO: 3967659 - DNA, 15 bp, Homo sapiens
gtcatgtgacaggta

SEQ ID NO: 3967660 - DNA, 17 bp, Homo sapiens
gtcatgtgtgcatgtga

SEQ ID NO: 3967661 - DNA, 11 bp, Homo sapiens
gtcattaaatg

SEQ ID NO: 3967662 - DNA, 14 bp, Homo sapiens
gtcattaatgtgtt

SEQ ID NO: 3967663 - DNA, 14 bp, Homo sapiens
gtcattactgcctt

SEQ ID NO: 3967664 - DNA, 18 bp, Homo sapiens
gtcattcaagcctgtgaa

SEQ ID NO: 3967665 - DNA, 21 bp, Homo sapiens
gtcatttattttaaaaaatga

SEQ ID NO: 3967666 - DNA, 17 bp, Homo sapiens
gtcattttaaaatctga

SEQ ID NO: 3967667 - DNA, 19 bp, Homo sapiens
gtccaaatgtgatcaactg

SEQ ID NO: 3967668 - DNA, 16 bp, Homo sapiens
gtccaacctgcctgtg

SEQ ID NO: 3967669 - DNA, 24 bp, Homo sapiens
gtccaagcataccaacacgagcag

SEQ ID NO: 3967670 - DNA, 13 bp, Homo sapiens
gtccacaggggca

SEQ ID NO: 3967671 - DNA, 14 bp, Homo sapiens
gtccacccagcaaa

SEQ ID NO: 3967672 - DNA, 19 bp, Homo sapiens
gtccacccaggctgcactg

SEQ ID NO: 3967673 - DNA, 15 bp, Homo sapiens
gtccacctgcctatc

SEQ ID NO: 3967674 - DNA, 19 bp, Homo sapiens
gtccactctcggggccctt

SEQ ID NO: 3967675 - DNA, 17 bp, Homo sapiens
gtccagaagaatattca

SEQ ID NO: 3967676 - DNA, 19 bp, Homo sapiens
gtccagaagaatattcagg

SEQ ID NO: 3967677 - DNA, 21 bp, Homo sapiens
gtccagaagaatattcaggac

SEQ ID NO: 3967678 - DNA, 16 bp, Homo sapiens
gtccagaataagtgct

SEQ ID NO: 3967679 - DNA, 16 bp, Homo sapiens
gtccagatgccttcct

SEQ ID NO: 3967680 - DNA, 20 bp, Homo sapiens
gtccagatgccttcctgtct

SEQ ID NO: 3967681 - DNA, 15 bp, Homo sapiens
gtccagcagctgcgg

SEQ ID NO: 3967682 - DNA, 16 bp, Homo sapiens
gtccagcttgctcttc

SEQ ID NO: 3967683 - DNA, 14 bp, Homo sapiens
gtccaggaaggcag

SEQ ID NO: 3967684 - DNA, 17 bp, Homo sapiens
gtccaggaaggcagctg

SEQ ID NO: 3967685 - DNA, 13 bp, Homo sapiens
gtccaggacatga

SEQ ID NO: 3967686 - DNA, 22 bp, Homo sapiens
gtccaggccactgtggccagag

SEQ ID NO: 3967687 - DNA, 23 bp, Homo sapiens
gtccaggccactgtggccagagc

SEQ ID NO: 3967688 - DNA, 16 bp, Homo sapiens
gtccagggcctgggaa

SEQ ID NO: 3967689 - DNA, 19 bp, Homo sapiens
gtccatatcagacctctga

SEQ ID NO: 3967690 - DNA, 16 bp, Homo sapiens
gtccatattttcacag

SEQ ID NO: 3967691 - DNA, 12 bp, Homo sapiens
gtccatggcacc

SEQ ID NO: 3967692 - DNA, 13 bp, Homo sapiens
gtccatggcacca

SEQ ID NO: 3967693 - DNA, 15 bp, Homo sapiens
gtccatggcaccagc

SEQ ID NO: 3967694 - DNA, 18 bp, Homo sapiens
gtccatggcaccagcccc

SEQ ID NO: 3967695 - DNA, 18 bp, Homo sapiens
gtacagtgaggagggtgg

SEQ ID NO: 3967696 - DNA, 13 bp, Homo sapiens
gtaccaagcccct

SEQ ID NO: 3967697 - DNA, 13 bp, Homo sapiens
gtacccagctcct

SEQ ID NO: 3967698 - DNA, 13 bp, Homo sapiens
gtaccccatccct

SEQ ID NO: 3967699 - DNA, 16 bp, Homo sapiens
gtacctatgtgacaga

SEQ ID NO: 3967700 - DNA, 18 bp, Homo sapiens
gtacctgggaaaggaccc

SEQ ID NO: 3967701 - DNA, 19 bp, Homo sapiens
gtacctgggaaaggaccca

SEQ ID NO: 3967702 - DNA, 22 bp, Homo sapiens
gtacctgggaaaggacccaccc

SEQ ID NO: 3967703 - DNA, 21 bp, Homo sapiens
gtaccttcagaataagcttcc

SEQ ID NO: 3967704 - DNA, 12 bp, Homo sapiens
gtacgtaatgta

SEQ ID NO: 3967705 - DNA, 15 bp, Homo sapiens
gtacgttatatattg

SEQ ID NO: 3967706 - DNA, 14 bp, Homo sapiens
gtactcagagcaga

SEQ ID NO: 3967707 - DNA, 18 bp, Homo sapiens
gtactctacgccaaagtg

SEQ ID NO: 3967708 - DNA, 21 bp, Homo sapiens
gtactctctgctctagccagg

SEQ ID NO: 3967709 - DNA, 18 bp, Homo sapiens
gtactcttgctttttcaa

SEQ ID NO: 3967710 - DNA, 15 bp, Homo sapiens
gtactctttatttct

SEQ ID NO: 3967711 - DNA, 12 bp, Homo sapiens
gtacttcctgtg

SEQ ID NO: 3967712 - DNA, 12 bp, Homo sapiens
gtagaaatatta

SEQ ID NO: 3967713 - DNA, 11 bp, Homo sapiens
gtagaaatctg

SEQ ID NO: 3967714 - DNA, 16 bp, Homo sapiens
gtagaagatggactct

SEQ ID NO: 3967715 - DNA, 14 bp, Homo sapiens
gtagaataataata

SEQ ID NO: 3967716 - DNA, 15 bp, Homo sapiens
gtagactatatacat

SEQ ID NO: 3967717 - DNA, 16 bp, Homo sapiens
gtagactcctgcttct

SEQ ID NO: 3967718 - DNA, 21 bp, Homo sapiens
gtagagctagaacatggagag

SEQ ID NO: 3967719 - DNA, 23 bp, Homo sapiens
gtagaggcatgaacacacatgga

SEQ ID NO: 3967720 - DNA, 14 bp, Homo sapiens
gtagaggttttgtt

SEQ ID NO: 3967721 - DNA, 23 bp, Homo sapiens
gtagatagttaaaagactgcagc

SEQ ID NO: 3967722 - DNA, 19 bp, Homo sapiens
gtagattacctgccacttc

SEQ ID NO: 3967723 - DNA, 20 bp, Homo sapiens
gtagattacctgccacttcc

SEQ ID NO: 3967724 - DNA, 20 bp, Homo sapiens
gtagcaagttctagagaaga

SEQ ID NO: 3967725 - DNA, 13 bp, Homo sapiens
gtagcagaaacca

SEQ ID NO: 3967726 - DNA, 18 bp, Homo sapiens
gtagcagataaagacagc

SEQ ID NO: 3967727 - DNA, 20 bp, Homo sapiens
gtagcagataaagacagctg

SEQ ID NO: 3967728 - DNA, 24 bp, Homo sapiens
gtagcagataaagacagctgacag

SEQ ID NO: 3967729 - DNA, 18 bp, Homo sapiens
gtagcatggactctgggt

SEQ ID NO: 3967730 - DNA, 15 bp, Homo sapiens
gtagccagccggggc

SEQ ID NO: 3967731 - DNA, 16 bp, Homo sapiens
gtagccatggctcagg

SEQ ID NO: 3967732 - DNA, 17 bp, Homo sapiens
gtagcccatcaaaatgt

SEQ ID NO: 3967733 - DNA, 20 bp, Homo sapiens
gtagcccggccagggcctgg

SEQ ID NO: 3967734 - DNA, 20 bp, Homo sapiens
gtagcctccgtttatgggcc

SEQ ID NO: 3967735 - DNA, 21 bp, Homo sapiens
gtagcctcgccgtctgtgaat

SEQ ID NO: 3967736 - DNA, 23 bp, Homo sapiens
gtagccttgccttttaaaagaaa

SEQ ID NO: 3967737 - DNA, 13 bp, Homo sapiens
gtagcgagctgct

SEQ ID NO: 3967738 - DNA, 16 bp, Homo sapiens
gtagctcctctgctgc

SEQ ID NO: 3967739 - DNA, 18 bp, Homo sapiens
gtagctcctctgctgctc

SEQ ID NO: 3967740 - DNA, 12 bp, Homo sapiens
gtagctgagagg

SEQ ID NO: 3967741 - DNA, 15 bp, Homo sapiens
gtagctgagaggaag

SEQ ID NO: 3967742 - DNA, 16 bp, Homo sapiens
gtagctgagaggaaga

SEQ ID NO: 3967743 - DNA, 12 bp, Homo sapiens
gtagctgagctc

SEQ ID NO: 3967744 - DNA, 18 bp, Homo sapiens
gtagctgtgacctgctga

SEQ ID NO: 3967745 - DNA, 20 bp, Homo sapiens
gtagctgtgacctgctgagc

SEQ ID NO: 3967746 - DNA, 18 bp, Homo sapiens
gtagctgtggtgaggtgg

SEQ ID NO: 3967747 - DNA, 17 bp, Homo sapiens
gtagcttacctgacaca

SEQ ID NO: 3967748 - DNA, 19 bp, Homo sapiens
gtaggaaaaataaaaacag

SEQ ID NO: 3967749 - DNA, 20 bp, Homo sapiens
gtaggaaggctactggcatt

SEQ ID NO: 3967750 - DNA, 23 bp, Homo sapiens
gtaggcatgagggatcacagggc

SEQ ID NO: 3967751 - DNA, 13 bp, Homo sapiens
gtaggccaagctg

SEQ ID NO: 3967752 - DNA, 21 bp, Homo sapiens
gtagggaagaaaactatcctg

SEQ ID NO: 3967753 - DNA, 19 bp, Homo sapiens
gtaggggagtgtgggtgat

SEQ ID NO: 3967754 - DNA, 23 bp, Homo sapiens
gtaggggagtgtgggtgatcaga

SEQ ID NO: 3967755 - DNA, 15 bp, Homo sapiens
gtaggtattaaagat

SEQ ID NO: 3967756 - DNA, 16 bp, Homo sapiens
gtaggtgttgaaaatg

SEQ ID NO: 3967757 - DNA, 17 bp, Homo sapiens
gtagtagccctttctgt

SEQ ID NO: 3967758 - DNA, 20 bp, Homo sapiens
gtagtagccctttctgtgtg

SEQ ID NO: 3967759 - DNA, 15 bp, Homo sapiens
gtagtggaagagcag

SEQ ID NO: 3967760 - DNA, 18 bp, Homo sapiens
gtagtggaagagcagcct

SEQ ID NO: 3967761 - DNA, 19 bp, Homo sapiens
gtagtggaagagcagcctg

SEQ ID NO: 3967762 - DNA, 21 bp, Homo sapiens
gtagtggaagagcagcctgat

SEQ ID NO: 3967763 - DNA, 17 bp, Homo sapiens
gtagttccctgaaaacc

SEQ ID NO: 3967764 - DNA, 20 bp, Homo sapiens
gtagttccctgaaaacccag

SEQ ID NO: 3967765 - DNA, 19 bp, Homo sapiens
gtagtttttcagctagttt

SEQ ID NO: 3967766 - DNA, 18 bp, Homo sapiens
gtataaacattaaatgtc

SEQ ID NO: 3967767 - DNA, 13 bp, Homo sapiens
gtataaactatca

SEQ ID NO: 3967768 - DNA, 14 bp, Homo sapiens
gtataaataataaa

SEQ ID NO: 3967769 - DNA, 15 bp, Homo sapiens
gtataaatatgaaat

SEQ ID NO: 3967770 - DNA, 12 bp, Homo sapiens
gtataaatggtt

SEQ ID NO: 3967771 - DNA, 12 bp, Homo sapiens
gtataaatgtat

SEQ ID NO: 3967772 - DNA, 16 bp, Homo sapiens
gtataaatgtatatac

SEQ ID NO: 3967773 - DNA, 19 bp, Homo sapiens
gtataaatgtatatacaca

SEQ ID NO: 3967774 - DNA, 22 bp, Homo sapiens
gtataaatgtatatacacatat

SEQ ID NO: 3967775 - DNA, 21 bp, Homo sapiens
gtataatggttgactgggttt

SEQ ID NO: 3967776 - DNA, 22 bp, Homo sapiens
gtatacaatatataaaaatata

SEQ ID NO: 3967777 - DNA, 18 bp, Homo sapiens
gtatacacacatatacat

SEQ ID NO: 3967778 - DNA, 19 bp, Homo sapiens
gtatacacacatatacata

SEQ ID NO: 3967779 - DNA, 19 bp, Homo sapiens
gtatagtactggcatggta

SEQ ID NO: 3967780 - DNA, 14 bp, Homo sapiens
gtatagtgtaaaat

SEQ ID NO: 3967781 - DNA, 15 bp, Homo sapiens
gtatagtgtaaaata

SEQ ID NO: 3967782 - DNA, 19 bp, Homo sapiens
gtatagttaggatagcatt

SEQ ID NO: 3967783 - DNA, 20 bp, Homo sapiens
gtatataatactaaagtgtc

SEQ ID NO: 3967784 - DNA, 21 bp, Homo sapiens
gtatataatactaaagtgtct

SEQ ID NO: 3967785 - DNA, 12 bp, Homo sapiens
gtatatacacat

SEQ ID NO: 3967786 - DNA, 13 bp, Homo sapiens
gtatatacacata

SEQ ID NO: 3967787 - DNA, 14 bp, Homo sapiens
gtatatacacatat

SEQ ID NO: 3967788 - DNA, 18 bp, Homo sapiens
gtatatacacatatacct

SEQ ID NO: 3967789 - DNA, 14 bp, Homo sapiens
gtatatacatatta

SEQ ID NO: 3967790 - DNA, 23 bp, Homo sapiens
gtatatacatattataaataaat

SEQ ID NO: 3967791 - DNA, 15 bp, Homo sapiens
gtatatacttcactc

SEQ ID NO: 3967792 - DNA, 16 bp, Homo sapiens
gtatatacttcactca

SEQ ID NO: 3967793 - DNA, 20 bp, Homo sapiens
gtatatagtatatttatact

SEQ ID NO: 3967794 - DNA, 21 bp, Homo sapiens
gtatatagtatatttatactc

SEQ ID NO: 3967795 - DNA, 11 bp, Homo sapiens
gtatatataca

SEQ ID NO: 3967796 - DNA, 17 bp, Homo sapiens
gtatatatacatacact

SEQ ID NO: 3967797 - DNA, 20 bp, Homo sapiens
gtatatatatatgtgtgtgt

SEQ ID NO: 3967798 - DNA, 13 bp, Homo sapiens
gtatatatgtgta

SEQ ID NO: 3967799 - DNA, 14 bp, Homo sapiens
gtatatatgtgtat

SEQ ID NO: 3967800 - DNA, 20 bp, Homo sapiens
gtatatatgtgtatatatac

SEQ ID NO: 3967801 - DNA, 23 bp, Homo sapiens
gtatatatgtgtatatatacata

SEQ ID NO: 3967802 - DNA, 14 bp, Homo sapiens
gtatatatgtgtgt

SEQ ID NO: 3967803 - DNA, 20 bp, Homo sapiens
gtatatatgtgtgtttaaat

SEQ ID NO: 3967804 - DNA, 19 bp, Homo sapiens
gtatatcagaaaagggaag

SEQ ID NO: 3967805 - DNA, 13 bp, Homo sapiens
gtatatgtctcag

SEQ ID NO: 3967806 - DNA, 15 bp, Homo sapiens
gtatattatggtgta

SEQ ID NO: 3967807 - DNA, 13 bp, Homo sapiens
gtatattctggaa

SEQ ID NO: 3967808 - DNA, 16 bp, Homo sapiens
gtatatttatactcta

SEQ ID NO: 3967809 - DNA, 13 bp, Homo sapiens
gtatatttatagt

SEQ ID NO: 3967810 - DNA, 17 bp, Homo sapiens
gtatcaggcacaggcag

SEQ ID NO: 3967811 - DNA, 22 bp, Homo sapiens
gtatcaggcacaggcaggaaga

SEQ ID NO: 3967812 - DNA, 12 bp, Homo sapiens
gtatcatagaaa

SEQ ID NO: 3967813 - DNA, 22 bp, Homo sapiens
gtatccagtgatgtgctggagc

SEQ ID NO: 3967814 - DNA, 20 bp, Homo sapiens
gtatcccccccctgtatagt

SEQ ID NO: 3967815 - DNA, 22 bp, Homo sapiens
gtatgaacttgaggacacatgt

SEQ ID NO: 3967816 - DNA, 19 bp, Homo sapiens
gtatgaataaagacaccta

SEQ ID NO: 3967817 - DNA, 12 bp, Homo sapiens
gtatgagctgag

SEQ ID NO: 3967818 - DNA, 14 bp, Homo sapiens
gtatgagctgaggg

SEQ ID NO: 3967819 - DNA, 23 bp, Homo sapiens
gtatgggaagccatattcacacc

SEQ ID NO: 3967820 - DNA, 14 bp, Homo sapiens
gtatgtactgttat

SEQ ID NO: 3967821 - DNA, 9 bp, Homo sapiens
gtatgtata

SEQ ID NO: 3967822 - DNA, 10 bp, Homo sapiens
gtatgtatac

SEQ ID NO: 3967823 - DNA, 20 bp, Homo sapiens
gtatgtgatatctgaacaca

SEQ ID NO: 3967824 - DNA, 11 bp, Homo sapiens
gtatgtgtgtg

SEQ ID NO: 3967825 - DNA, 13 bp, Homo sapiens
gtatgtgtgtggt

SEQ ID NO: 3967826 - DNA, 22 bp, Homo sapiens
gtatgttaaagcatcagagatg

SEQ ID NO: 3967827 - DNA, 21 bp, Homo sapiens
gtattaatactaaaatatgtc

SEQ ID NO: 3967828 - DNA, 15 bp, Homo sapiens
gtattaattatctga

SEQ ID NO: 3967829 - DNA, 22 bp, Homo sapiens
gtattatcacatcaagcatgca

SEQ ID NO: 3967830 - DNA, 22 bp, Homo sapiens
gtattcagatcgtattaattat

SEQ ID NO: 3967831 - DNA, 22 bp, Homo sapiens
gtattgccacaatgcctctccc

SEQ ID NO: 3967832 - DNA, 21 bp, Homo sapiens
gtattgtccatatcagacctc

SEQ ID NO: 3967833 - DNA, 15 bp, Homo sapiens
gtatttatatttgga

SEQ ID NO: 3967834 - DNA, 19 bp, Homo sapiens
gtatttatatttggaaaga

SEQ ID NO: 3967835 - DNA, 18 bp, Homo sapiens
gtatttattgaagaaaca

SEQ ID NO: 3967836 - DNA, 16 bp, Homo sapiens
gtattttaaatgtttt

SEQ ID NO: 3967837 - DNA, 19 bp, Homo sapiens
gtattttattaaagcaaca

SEQ ID NO: 3967838 - DNA, 22 bp, Homo sapiens
gtattttattaaagcaacattt

SEQ ID NO: 3967839 - DNA, 17 bp, Homo sapiens
gtattttggagaaatta

SEQ ID NO: 3967840 - DNA, 21 bp, Homo sapiens
gtatttttcaggtaggccctt

SEQ ID NO: 3967841 - DNA, 15 bp, Homo sapiens
gtcaaacatgaagtg

SEQ ID NO: 3967842 - DNA, 16 bp, Homo sapiens
gtcaaaccataaactt

SEQ ID NO: 3967843 - DNA, 13 bp, Homo sapiens
gtcaaaccgcact

SEQ ID NO: 3967844 - DNA, 12 bp, Homo sapiens
gtcaaagaaatg

SEQ ID NO: 3967845 - DNA, 16 bp, Homo sapiens
gtcaaagaaatgctga

SEQ ID NO: 3967846 - DNA, 15 bp, Homo sapiens
gtcaacatcttctct

SEQ ID NO: 3967847 - DNA, 18 bp, Homo sapiens
gtcaagattttttttgta

SEQ ID NO: 3967848 - DNA, 15 bp, Homo sapiens
gtcaatattaaatac

SEQ ID NO: 3967849 - DNA, 22 bp, Homo sapiens
gtcaatttccctgactcctcta

SEQ ID NO: 3967850 - DNA, 18 bp, Homo sapiens
gtcacacaaggctgggca

SEQ ID NO: 3967851 - DNA, 11 bp, Homo sapiens
gtcacagctgc

SEQ ID NO: 3967852 - DNA, 13 bp, Homo sapiens
gtcacagctgcag

SEQ ID NO: 3967853 - DNA, 17 bp, Homo sapiens
gtcacagctgcagctgg

SEQ ID NO: 3967854 - DNA, 21 bp, Homo sapiens
gtcacagctgcagctgggccc

SEQ ID NO: 3967855 - DNA, 18 bp, Homo sapiens
gtcacaggactctgcctc

SEQ ID NO: 3967856 - DNA, 19 bp, Homo sapiens
gtcacaggactctgcctcc

SEQ ID NO: 3967857 - DNA, 14 bp, Homo sapiens
gtcacattcaggaa

SEQ ID NO: 3967858 - DNA, 14 bp, Homo sapiens
gtcaccaccctccc

SEQ ID NO: 3967859 - DNA, 15 bp, Homo sapiens
gtcaccagcaacatc

SEQ ID NO: 3967860 - DNA, 18 bp, Homo sapiens
gtcaccagctatctgtca

SEQ ID NO: 3967861 - DNA, 19 bp, Homo sapiens
gtcaccagctatctgtcat

SEQ ID NO: 3967862 - DNA, 18 bp, Homo sapiens
gtcaccaggaatgttaaa

SEQ ID NO: 3967863 - DNA, 21 bp, Homo sapiens
gtcacccaggctctggagcca

SEQ ID NO: 3967864 - DNA, 23 bp, Homo sapiens
gtcacccaggctctggagccaga

SEQ ID NO: 3967865 - DNA, 14 bp, Homo sapiens
gtcacccttctggg

SEQ ID NO: 3967866 - DNA, 22 bp, Homo sapiens
gtcaccgggatgaacctatcct

SEQ ID NO: 3967867 - DNA, 22 bp, Homo sapiens
gggcctatggagagccctggga

SEQ ID NO: 3967868 - DNA, 17 bp, Homo sapiens
gggcctcagtttcccca

SEQ ID NO: 3967869 - DNA, 11 bp, Homo sapiens
gggcctgctgc

SEQ ID NO: 3967870 - DNA, 16 bp, Homo sapiens
gggcctgctgctgaga

SEQ ID NO: 3967871 - DNA, 17 bp, Homo sapiens
gggcctgctgctgagaa

SEQ ID NO: 3967872 - DNA, 18 bp, Homo sapiens
gggcctgctgctgagaac

SEQ ID NO: 3967873 - DNA, 22 bp, Homo sapiens
gggcctgctgctgagaacctgg

SEQ ID NO: 3967874 - DNA, 12 bp, Homo sapiens
gggcctggagag

SEQ ID NO: 3967875 - DNA, 16 bp, Homo sapiens
gggcctggagaggggc

SEQ ID NO: 3967876 - DNA, 10 bp, Homo sapiens
gggcctggca

SEQ ID NO: 3967877 - DNA, 12 bp, Homo sapiens
gggcctggcctg

SEQ ID NO: 3967878 - DNA, 19 bp, Homo sapiens
gggcctggcctgagctggg

SEQ ID NO: 3967879 - DNA, 17 bp, Homo sapiens
gggcctggctggctgag

SEQ ID NO: 3967880 - DNA, 20 bp, Homo sapiens
gggcctggctggctgagggc

SEQ ID NO: 3967881 - DNA, 21 bp, Homo sapiens
gggcctggctggctgagggca

SEQ ID NO: 3967882 - DNA, 16 bp, Homo sapiens
gggcctggcttgctcc

SEQ ID NO: 3967883 - DNA, 15 bp, Homo sapiens
gggcctgggcctgct

SEQ ID NO: 3967884 - DNA, 18 bp, Homo sapiens
gggcctgtactgcctgct

SEQ ID NO: 3967885 - DNA, 20 bp, Homo sapiens
gggcctgtactgcctgcttg

SEQ ID NO: 3967886 - DNA, 17 bp, Homo sapiens
gggcctgtgcagcagcc

SEQ ID NO: 3967887 - DNA, 12 bp, Homo sapiens
gggccttgccca

SEQ ID NO: 3967888 - DNA, 22 bp, Homo sapiens
gggcgcccattcgtctgtccca

SEQ ID NO: 3967889 - DNA, 12 bp, Homo sapiens
gggcgctcagga

SEQ ID NO: 3967890 - DNA, 15 bp, Homo sapiens
gggcgctcaggaccc

SEQ ID NO: 3967891 - DNA, 14 bp, Homo sapiens
gggcggaaggggac

SEQ ID NO: 3967892 - DNA, 13 bp, Homo sapiens
gggcggaggcggc

SEQ ID NO: 3967893 - DNA, 20 bp, Homo sapiens
gggcgtcgctggacaaccca

SEQ ID NO: 3967894 - DNA, 22 bp, Homo sapiens
gggcgtcgctggacaacccaga

SEQ ID NO: 3967895 - DNA, 23 bp, Homo sapiens
gggcgtcgctggacaacccagaa

SEQ ID NO: 3967896 - DNA, 16 bp, Homo sapiens
gggcgtgactcaccca

SEQ ID NO: 3967897 - DNA, 12 bp, Homo sapiens
gggcgtggacca

SEQ ID NO: 3967898 - DNA, 23 bp, Homo sapiens
gggctaagagctagcgctgccgc

SEQ ID NO: 3967899 - DNA, 20 bp, Homo sapiens
gggctactgcagctttacat

SEQ ID NO: 3967900 - DNA, 13 bp, Homo sapiens
gggctactggcag

SEQ ID NO: 3967901 - DNA, 15 bp, Homo sapiens
gggctactggcagct

SEQ ID NO: 3967902 - DNA, 18 bp, Homo sapiens
gggctactggcagctcct

SEQ ID NO: 3967903 - DNA, 19 bp, Homo sapiens
gggctactggcagctcctc

SEQ ID NO: 3967904 - DNA, 12 bp, Homo sapiens
gggctagaatct

SEQ ID NO: 3967905 - DNA, 19 bp, Homo sapiens
gggctagtgtgagtggcag

SEQ ID NO: 3967906 - DNA, 20 bp, Homo sapiens
gggctatgtgtcacagctct

SEQ ID NO: 3967907 - DNA, 18 bp, Homo sapiens
gggctatttctctcccca

SEQ ID NO: 3967908 - DNA, 14 bp, Homo sapiens
gggctcagcaaggt

SEQ ID NO: 3967909 - DNA, 12 bp, Homo sapiens
gggctcagggct

SEQ ID NO: 3967910 - DNA, 15 bp, Homo sapiens
gggctccatggagga

SEQ ID NO: 3967911 - DNA, 17 bp, Homo sapiens
gggctccatggaggagg

SEQ ID NO: 3967912 - DNA, 18 bp, Homo sapiens
gggctccatggaggaggt

SEQ ID NO: 3967913 - DNA, 13 bp, Homo sapiens
gggctcctggctg

SEQ ID NO: 3967914 - DNA, 17 bp, Homo sapiens
gggctcctggctgccag

SEQ ID NO: 3967915 - DNA, 18 bp, Homo sapiens
gggctctaacgcctgagc

SEQ ID NO: 3967916 - DNA, 16 bp, Homo sapiens
gggctctccaaagggg

SEQ ID NO: 3967917 - DNA, 14 bp, Homo sapiens
gggctctccacctc

SEQ ID NO: 3967918 - DNA, 23 bp, Homo sapiens
gggctctgacagccctgcggaga

SEQ ID NO: 3967919 - DNA, 23 bp, Homo sapiens
gggctctgccccagaggcctctc

SEQ ID NO: 3967920 - DNA, 21 bp, Homo sapiens
gggctgacacctaccatgctg

SEQ ID NO: 3967921 - DNA, 14 bp, Homo sapiens
gggctgccctggtg

SEQ ID NO: 3967922 - DNA, 21 bp, Homo sapiens
gggctgcccttcgctgccagg

SEQ ID NO: 3967923 - DNA, 17 bp, Homo sapiens
gggctggagtgcgctct

SEQ ID NO: 3967924 - DNA, 23 bp, Homo sapiens
gggctggagtgcgctcttggtcc

SEQ ID NO: 3967925 - DNA, 16 bp, Homo sapiens
gggctggcaagcaggg

SEQ ID NO: 3967926 - DNA, 13 bp, Homo sapiens
gggctggcccagc

SEQ ID NO: 3967927 - DNA, 19 bp, Homo sapiens
gggctggcggctactcagc

SEQ ID NO: 3967928 - DNA, 16 bp, Homo sapiens
gggctgggagctctgc

SEQ ID NO: 3967929 - DNA, 14 bp, Homo sapiens
gggctgtctgtcac

SEQ ID NO: 3967930 - DNA, 22 bp, Homo sapiens
gggctgttggacagctgcttgt

SEQ ID NO: 3967931 - DNA, 17 bp, Homo sapiens
gggcttcctgggtcctg

SEQ ID NO: 3967932 - DNA, 18 bp, Homo sapiens
gggcttgcaagaggaggt

SEQ ID NO: 3967933 - DNA, 16 bp, Homo sapiens
gggcttggacttcctg

SEQ ID NO: 3967934 - DNA, 13 bp, Homo sapiens
gggcttggccttg

SEQ ID NO: 3967935 - DNA, 22 bp, Homo sapiens
gggcttgtagaccactgtcctg

SEQ ID NO: 3967936 - DNA, 14 bp, Homo sapiens
gggctttgcaggct

SEQ ID NO: 3967937 - DNA, 23 bp, Homo sapiens
gggctttgtttgggccactgcca

SEQ ID NO: 3967938 - DNA, 20 bp, Homo sapiens
ggggaacccagccctggggt

SEQ ID NO: 3967939 - DNA, 14 bp, Homo sapiens
ggggaacgcagagg

SEQ ID NO: 3967940 - DNA, 21 bp, Homo sapiens
ggggaactggccaagctgagg

SEQ ID NO: 3967941 - DNA, 14 bp, Homo sapiens
ggggaagggtggtc

SEQ ID NO: 3967942 - DNA, 18 bp, Homo sapiens
ggggacgcgcacacacac

SEQ ID NO: 3967943 - DNA, 11 bp, Homo sapiens
ggggagaaagg

SEQ ID NO: 3967944 - DNA, 19 bp, Homo sapiens
ggggagaaataaattttgt

SEQ ID NO: 3967945 - DNA, 22 bp, Homo sapiens
ggggagcagagtataggatgga

SEQ ID NO: 3967946 - DNA, 11 bp, Homo sapiens
ggggaggaagg

SEQ ID NO: 3967947 - DNA, 21 bp, Homo sapiens
ggggagttgagtcacaagagg

SEQ ID NO: 3967948 - DNA, 21 bp, Homo sapiens
ggggatctgcattccccgctg

SEQ ID NO: 3967949 - DNA, 14 bp, Homo sapiens
ggggcaaggtctcc

SEQ ID NO: 3967950 - DNA, 18 bp, Homo sapiens
ggggcaaggtctccttac

SEQ ID NO: 3967951 - DNA, 21 bp, Homo sapiens
ggggcacaccactgccctgcc

SEQ ID NO: 3967952 - DNA, 13 bp, Homo sapiens
ggggcacagtcat

SEQ ID NO: 3967953 - DNA, 18 bp, Homo sapiens
ggggcagagggcagaggc

SEQ ID NO: 3967954 - DNA, 20 bp, Homo sapiens
ggggcagaggggcagccgct

SEQ ID NO: 3967955 - DNA, 19 bp, Homo sapiens
ggggcagccgctaggagag

SEQ ID NO: 3967956 - DNA, 15 bp, Homo sapiens
ggggcaggaggcctg

SEQ ID NO: 3967957 - DNA, 19 bp, Homo sapiens
ggggcaggaggcctggcct

SEQ ID NO: 3967958 - DNA, 20 bp, Homo sapiens
ggggcaggaggcctggcctt

SEQ ID NO: 3967959 - DNA, 11 bp, Homo sapiens
ggggcaggagt

SEQ ID NO: 3967960 - DNA, 20 bp, Homo sapiens
ggggcaggagtagctgagct

SEQ ID NO: 3967961 - DNA, 12 bp, Homo sapiens
ggggcaggcctg

SEQ ID NO: 3967962 - DNA, 13 bp, Homo sapiens
ggggccagacaca

SEQ ID NO: 3967963 - DNA, 19 bp, Homo sapiens
ggggccagctggtgctgca

SEQ ID NO: 3967964 - DNA, 19 bp, Homo sapiens
ggggcccacaaaggggaga

SEQ ID NO: 3967965 - DNA, 14 bp, Homo sapiens
ggggccccagatct

SEQ ID NO: 3967966 - DNA, 22 bp, Homo sapiens
ggggccccagatctgcctgggc

SEQ ID NO: 3967967 - DNA, 16 bp, Homo sapiens
ggggccccggggctgg

SEQ ID NO: 3967968 - DNA, 18 bp, Homo sapiens
ggggcccttggggcctgg

SEQ ID NO: 3967969 - DNA, 19 bp, Homo sapiens
ggggcccttggggcctggc

SEQ ID NO: 3967970 - DNA, 18 bp, Homo sapiens
ggggccgtgggggttgag

SEQ ID NO: 3967971 - DNA, 12 bp, Homo sapiens
ggggcctccctg

SEQ ID NO: 3967972 - DNA, 19 bp, Homo sapiens
ggggcctggctggctgagg

SEQ ID NO: 3967973 - DNA, 19 bp, Homo sapiens
ggggcctgtactgcctgct

SEQ ID NO: 3967974 - DNA, 14 bp, Homo sapiens
ggggcggggcagga

SEQ ID NO: 3967975 - DNA, 14 bp, Homo sapiens
ggggctccatggag

SEQ ID NO: 3967976 - DNA, 19 bp, Homo sapiens
ggggctccatggaggaggt

SEQ ID NO: 3967977 - DNA, 18 bp, Homo sapiens
ggggctcgtggccttccc

SEQ ID NO: 3967978 - DNA, 21 bp, Homo sapiens
ggggctctaacgcctgagccc

SEQ ID NO: 3967979 - DNA, 23 bp, Homo sapiens
ggggctctaacgcctgagcccag

SEQ ID NO: 3967980 - DNA, 16 bp, Homo sapiens
ggggctgctcctccag

SEQ ID NO: 3967981 - DNA, 20 bp, Homo sapiens
ggggctgctcctccagggcc

SEQ ID NO: 3967982 - DNA, 15 bp, Homo sapiens
ggggctgctggggca

SEQ ID NO: 3967983 - DNA, 14 bp, Homo sapiens
ggggctggtccttc

SEQ ID NO: 3967984 - DNA, 17 bp, Homo sapiens
gggggagccaacagcag

SEQ ID NO: 3967985 - DNA, 18 bp, Homo sapiens
gggggagccaacagcagc

SEQ ID NO: 3967986 - DNA, 12 bp, Homo sapiens
gggggccagctg

SEQ ID NO: 3967987 - DNA, 12 bp, Homo sapiens
gggggcctggct

SEQ ID NO: 3967988 - DNA, 17 bp, Homo sapiens
gggggcctggctggctg

SEQ ID NO: 3967989 - DNA, 19 bp, Homo sapiens
gggggcctttaaagactta

SEQ ID NO: 3967990 - DNA, 16 bp, Homo sapiens
gggggctggtcctgag

SEQ ID NO: 3967991 - DNA, 16 bp, Homo sapiens
gggggtccacccagca

SEQ ID NO: 3967992 - DNA, 18 bp, Homo sapiens
gggggtgatgagggcagc

SEQ ID NO: 3967993 - DNA, 20 bp, Homo sapiens
gggggtgatgagggcagcag

SEQ ID NO: 3967994 - DNA, 12 bp, Homo sapiens
gggggtggccat

SEQ ID NO: 3967995 - DNA, 19 bp, Homo sapiens
ggggtaagccagagcctgg

SEQ ID NO: 3967996 - DNA, 14 bp, Homo sapiens
ggggtcaaaggaag

SEQ ID NO: 3967997 - DNA, 15 bp, Homo sapiens
ggggtcaggctccat

SEQ ID NO: 3967998 - DNA, 23 bp, Homo sapiens
ggggtccccatcatcccagctgc

SEQ ID NO: 3967999 - DNA, 22 bp, Homo sapiens
ggggtctccctctcctgcctac

SEQ ID NO: 3968000 - DNA, 13 bp, Homo sapiens
ggggtctgtgctg

SEQ ID NO: 3968001 - DNA, 20 bp, Homo sapiens
ggggtctgtgctgtgcctgc

SEQ ID NO: 3968002 - DNA, 17 bp, Homo sapiens
ggggtgatgagggcagc

SEQ ID NO: 3968003 - DNA, 15 bp, Homo sapiens
ggggtgcacaggagg

SEQ ID NO: 3968004 - DNA, 14 bp, Homo sapiens
ggggtgccctctgg

SEQ ID NO: 3968005 - DNA, 14 bp, Homo sapiens
ggggtggggcagga

SEQ ID NO: 3968006 - DNA, 22 bp, Homo sapiens
ggggtgtctggaagctgagcag

SEQ ID NO: 3968007 - DNA, 17 bp, Homo sapiens
ggggttgcgggggagct

SEQ ID NO: 3968008 - DNA, 23 bp, Homo sapiens
ggggttgcgggggagctggaaat

SEQ ID NO: 3968009 - DNA, 13 bp, Homo sapiens
ggggttggatggg

SEQ ID NO: 3968010 - DNA, 14 bp, Homo sapiens
ggggttggatggga

SEQ ID NO: 3968011 - DNA, 20 bp, Homo sapiens
ggggttggatgggaagatgg

SEQ ID NO: 3968012 - DNA, 14 bp, Homo sapiens
gggtaaggtgcctt

SEQ ID NO: 3968013 - DNA, 22 bp, Homo sapiens
gggtaatcagcattattcttca

SEQ ID NO: 3968014 - DNA, 18 bp, Homo sapiens
gggtaccaatcctggcag

SEQ ID NO: 3968015 - DNA, 14 bp, Homo sapiens
gggtatttcctgct

SEQ ID NO: 3968016 - DNA, 16 bp, Homo sapiens
gggtcaccaccctccc

SEQ ID NO: 3968017 - DNA, 22 bp, Homo sapiens
gggtccccatcatcccagctgc

SEQ ID NO: 3968018 - DNA, 23 bp, Homo sapiens
gggtccgcaccagctgctctgcc

SEQ ID NO: 3968019 - DNA, 14 bp, Homo sapiens
gggtctagggagag

SEQ ID NO: 3968020 - DNA, 23 bp, Homo sapiens
gggtctcactatgttgcccaggc

SEQ ID NO: 3968021 - DNA, 16 bp, Homo sapiens
gggtctccctctcctg

SEQ ID NO: 3968022 - DNA, 15 bp, Homo sapiens
gggtctccctggagt

SEQ ID NO: 3968023 - DNA, 23 bp, Homo sapiens
gggtctgaaggaatagccagaga

SEQ ID NO: 3968024 - DNA, 14 bp, Homo sapiens
gggtctggggaggg

SEQ ID NO: 3968025 - DNA, 21 bp, Homo sapiens
gggtcttgggctactggcagc

SEQ ID NO: 3968026 - DNA, 15 bp, Homo sapiens
gggtgacatcccagg

SEQ ID NO: 3968027 - DNA, 23 bp, Homo sapiens
gggtgacatcccaggaggggcct

SEQ ID NO: 3968028 - DNA, 22 bp, Homo sapiens
gggtgactgaatttgggcctct

SEQ ID NO: 3968029 - DNA, 18 bp, Homo sapiens
gggtgatatggacagcag

SEQ ID NO: 3968030 - DNA, 22 bp, Homo sapiens
gggtgatttcagagagggcaga

SEQ ID NO: 3968031 - DNA, 21 bp, Homo sapiens
gggtgcatttgagagaagcca

SEQ ID NO: 3968032 - DNA, 13 bp, Homo sapiens
gggtgcctcagag

SEQ ID NO: 3968033 - DNA, 23 bp, Homo sapiens
gggtggaccccctgagtcaactg

SEQ ID NO: 3968034 - DNA, 12 bp, Homo sapiens
gggtggcaggca

SEQ ID NO: 3968035 - DNA, 23 bp, Homo sapiens
gggtggcaggcacacagcagccc

SEQ ID NO: 3968036 - DNA, 21 bp, Homo sapiens
gggtggccaatccaggtggga

SEQ ID NO: 3968037 - DNA, 16 bp, Homo sapiens
gggtggccgacggcgg

SEQ ID NO: 3968038 - DNA, 20 bp, Homo sapiens
gggtggctactctgtgccag

SEQ ID NO: 3968039 - DNA, 16 bp, Homo sapiens
gggtggctagtcagag

SEQ ID NO: 3968040 - DNA, 15 bp, Homo sapiens
gggtgggaagaaaga

SEQ ID NO: 3968041 - DNA, 16 bp, Homo sapiens
gggtgggaagaaagaa

SEQ ID NO: 3968042 - DNA, 17 bp, Homo sapiens
gggtgggatggaggaga

SEQ ID NO: 3968043 - DNA, 15 bp, Homo sapiens
gggtgggccactctc

SEQ ID NO: 3968044 - DNA, 22 bp, Homo sapiens
gggtggggaatgtttgggcaga

SEQ ID NO: 3968045 - DNA, 14 bp, Homo sapiens
gggtggggctgctc

SEQ ID NO: 3968046 - DNA, 13 bp, Homo sapiens
gggtgggggaggg

SEQ ID NO: 3968047 - DNA, 16 bp, Homo sapiens
gggtggtctgagcacc

SEQ ID NO: 3968048 - DNA, 16 bp, Homo sapiens
gggtgtctggaagctg

SEQ ID NO: 3968049 - DNA, 22 bp, Homo sapiens
gggtgtctggaagctgagcagg

SEQ ID NO: 3968050 - DNA, 16 bp, Homo sapiens
gggtgtgcctgccctg

SEQ ID NO: 3968051 - DNA, 12 bp, Homo sapiens
gggtgtggcctc

SEQ ID NO: 3968052 - DNA, 13 bp, Homo sapiens
gggtgtggcctca

SEQ ID NO: 3968053 - DNA, 18 bp, Homo sapiens
gggttcactagagctggg

SEQ ID NO: 3968054 - DNA, 13 bp, Homo sapiens
gggttcagcccct

SEQ ID NO: 3968055 - DNA, 17 bp, Homo sapiens
gggttcccccagacaga

SEQ ID NO: 3968056 - DNA, 14 bp, Homo sapiens
gggttctttcttcc

SEQ ID NO: 3968057 - DNA, 16 bp, Homo sapiens
gggttctttggaagga

SEQ ID NO: 3968058 - DNA, 20 bp, Homo sapiens
gggttgcgggggagctggaa

SEQ ID NO: 3968059 - DNA, 15 bp, Homo sapiens
gggttgtgtgtctgt

SEQ ID NO: 3968060 - DNA, 20 bp, Homo sapiens
gggtttacccagtgggacag

SEQ ID NO: 3968061 - DNA, 20 bp, Homo sapiens
gggtttcactgtgttggcca

SEQ ID NO: 3968062 - DNA, 21 bp, Homo sapiens
gggtttcattgtgtgttagca

SEQ ID NO: 3968063 - DNA, 20 bp, Homo sapiens
gggtttcgtcatgttggcca

SEQ ID NO: 3968064 - DNA, 14 bp, Homo sapiens
gggttttatatttt

SEQ ID NO: 3968065 - DNA, 18 bp, Homo sapiens
gggttttctaactgtaaa

SEQ ID NO: 3968066 - DNA, 23 bp, Homo sapiens
gggttttctaactgtaaatcact

SEQ ID NO: 3968067 - DNA, 12 bp, Homo sapiens
gggttttgtatt

SEQ ID NO: 3968068 - DNA, 23 bp, Homo sapiens
gggtttttaatctttgtgacagg

SEQ ID NO: 3968069 - DNA, 20 bp, Homo sapiens
ggtaaataccaagtatttat

SEQ ID NO: 3968070 - DNA, 21 bp, Homo sapiens
ggtaaatatgactcctttctc

SEQ ID NO: 3968071 - DNA, 19 bp, Homo sapiens
ggtaaattgtaaacagcta

SEQ ID NO: 3968072 - DNA, 11 bp, Homo sapiens
ggtaagggaga

SEQ ID NO: 3968073 - DNA, 15 bp, Homo sapiens
ggtaataaacttaga

SEQ ID NO: 3968074 - DNA, 13 bp, Homo sapiens
ggtacagcagggt

SEQ ID NO: 3968075 - DNA, 14 bp, Homo sapiens
ggtacatttctctg

SEQ ID NO: 3968076 - DNA, 11 bp, Homo sapiens
ggtagaagcca

SEQ ID NO: 3968077 - DNA, 23 bp, Homo sapiens
ggtagaattgggaagctggggga

SEQ ID NO: 3968078 - DNA, 16 bp, Homo sapiens
ggtagatcgcttgagc

SEQ ID NO: 3968079 - DNA, 19 bp, Homo sapiens
ggtagatcgcttgagccca

SEQ ID NO: 3968080 - DNA, 21 bp, Homo sapiens
ggtagatcgcttgagcccagg

SEQ ID NO: 3968081 - DNA, 20 bp, Homo sapiens
ggtagcagataaagacagct

SEQ ID NO: 3968082 - DNA, 18 bp, Homo sapiens
ggtagcccatcaaaatgt

SEQ ID NO: 3968083 - DNA, 20 bp, Homo sapiens
ggtagcgagctgctctgcta

SEQ ID NO: 3968084 - DNA, 19 bp, Homo sapiens
ggtaggaggtttggatggg

SEQ ID NO: 3968085 - DNA, 12 bp, Homo sapiens
ggtaggcccttg

SEQ ID NO: 3968086 - DNA, 14 bp, Homo sapiens
ggtaggcccttgtc

SEQ ID NO: 3968087 - DNA, 22 bp, Homo sapiens
ggtaggcccttgtcctgccagc

SEQ ID NO: 3968088 - DNA, 20 bp, Homo sapiens
ggtataatggttgactgggt

SEQ ID NO: 3968089 - DNA, 17 bp, Homo sapiens
ggtatatttagaccctg

SEQ ID NO: 3968090 - DNA, 18 bp, Homo sapiens
ggtatatttgtgtatgtg

SEQ ID NO: 3968091 - DNA, 12 bp, Homo sapiens
ggtatctccagg

SEQ ID NO: 3968092 - DNA, 14 bp, Homo sapiens
ggtatctccaggat

SEQ ID NO: 3968093 - DNA, 16 bp, Homo sapiens
ggtatgaacttgagga

SEQ ID NO: 3968094 - DNA, 19 bp, Homo sapiens
ggtatgaacttgaggacac

SEQ ID NO: 3968095 - DNA, 21 bp, Homo sapiens
ggtatgaacttgaggacacat

SEQ ID NO: 3968096 - DNA, 23 bp, Homo sapiens
ggtatgaacttgaggacacatgt

SEQ ID NO: 3968097 - DNA, 14 bp, Homo sapiens
ggtatgctggccag

SEQ ID NO: 3968098 - DNA, 15 bp, Homo sapiens
ggtatgctggccagc

SEQ ID NO: 3968099 - DNA, 16 bp, Homo sapiens
ggtatgctggccagca

SEQ ID NO: 3968100 - DNA, 11 bp, Homo sapiens
ggtattaaact

SEQ ID NO: 3968101 - DNA, 14 bp, Homo sapiens
ggtatttataatat

SEQ ID NO: 3968102 - DNA, 22 bp, Homo sapiens
ggtattttaggcagggatttga

SEQ ID NO: 3968103 - DNA, 14 bp, Homo sapiens
ggtcaacagagaag

SEQ ID NO: 3968104 - DNA, 12 bp, Homo sapiens
ggtcaccaccct

SEQ ID NO: 3968105 - DNA, 17 bp, Homo sapiens
ggtcactggagtagttg

SEQ ID NO: 3968106 - DNA, 12 bp, Homo sapiens
ggtcagccaggg

SEQ ID NO: 3968107 - DNA, 18 bp, Homo sapiens
ggtcagccagggccaggg

SEQ ID NO: 3968108 - DNA, 15 bp, Homo sapiens
ggtcagtgtggagag

SEQ ID NO: 3968109 - DNA, 15 bp, Homo sapiens
ggtcatgtgtgcatg

SEQ ID NO: 3968110 - DNA, 16 bp, Homo sapiens
ggtcatgtgtgcatgt

SEQ ID NO: 3968111 - DNA, 20 bp, Homo sapiens
ggtccactcagggctgccac

SEQ ID NO: 3968112 - DNA, 14 bp, Homo sapiens
ggtccaggaaggca

SEQ ID NO: 3968113 - DNA, 16 bp, Homo sapiens
ggtccccacctgggac

SEQ ID NO: 3968114 - DNA, 16 bp, Homo sapiens
ggtccgcaccagctgc

SEQ ID NO: 3968115 - DNA, 20 bp, Homo sapiens
ggtccgcaccagctgctctg

SEQ ID NO: 3968116 - DNA, 21 bp, Homo sapiens
ggtccgcaccagctgctctgc

SEQ ID NO: 3968117 - DNA, 22 bp, Homo sapiens
ggtccgcaccagctgctctgcc

SEQ ID NO: 3968118 - DNA, 20 bp, Homo sapiens
ggtccgccttaatctggaag

SEQ ID NO: 3968119 - DNA, 21 bp, Homo sapiens
ggtcctcagagaatttctacc

SEQ ID NO: 3968120 - DNA, 21 bp, Homo sapiens
ggtcctccatttcaactccag

SEQ ID NO: 3968121 - DNA, 22 bp, Homo sapiens
ggtcctccatttcaactccaga

SEQ ID NO: 3968122 - DNA, 21 bp, Homo sapiens
ggtcctgagcactgccaggag

SEQ ID NO: 3968123 - DNA, 23 bp, Homo sapiens
ggtcctgagtcttggcctgcctc

SEQ ID NO: 3968124 - DNA, 23 bp, Homo sapiens
ggtcctgcaatctccagggctgc

SEQ ID NO: 3968125 - DNA, 22 bp, Homo sapiens
ggtcctgcccatgtgtcccctc

SEQ ID NO: 3968126 - DNA, 19 bp, Homo sapiens
ggtcctggtggggcagctc

SEQ ID NO: 3968127 - DNA, 22 bp, Homo sapiens
ggtccttcctttaggtctggtt

SEQ ID NO: 3968128 - DNA, 21 bp, Homo sapiens
ggtcctttaggcagcctgccg

SEQ ID NO: 3968129 - DNA, 15 bp, Homo sapiens
ggtcgccctaccctc

SEQ ID NO: 3968130 - DNA, 15 bp, Homo sapiens
ggtctcaggttcttt

SEQ ID NO: 3968131 - DNA, 16 bp, Homo sapiens
ggtctcccacgtggga

SEQ ID NO: 3968132 - DNA, 22 bp, Homo sapiens
ggtctccctctcctgcctactc

SEQ ID NO: 3968133 - DNA, 22 bp, Homo sapiens
ggtctccttactctgagcccag

SEQ ID NO: 3968134 - DNA, 16 bp, Homo sapiens
ggtctcgaactcctga

SEQ ID NO: 3968135 - DNA, 19 bp, Homo sapiens
ggtctctctctctctacaa

SEQ ID NO: 3968136 - DNA, 22 bp, Homo sapiens
ggtctgaaggaatagccagaga

SEQ ID NO: 3968137 - DNA, 23 bp, Homo sapiens
ggtctgaaggaatagccagagag

SEQ ID NO: 3968138 - DNA, 17 bp, Homo sapiens
ggtctgagcaccccctc

SEQ ID NO: 3968139 - DNA, 16 bp, Homo sapiens
ggtctgagccctggtg

SEQ ID NO: 3968140 - DNA, 22 bp, Homo sapiens
ggtctgaggggcaactgagtct

SEQ ID NO: 3968141 - DNA, 11 bp, Homo sapiens
ggtctggggag

SEQ ID NO: 3968142 - DNA, 16 bp, Homo sapiens
ggtctgtatatacatt

SEQ ID NO: 3968143 - DNA, 22 bp, Homo sapiens
ggtctgtgccaaagaagaatcc

SEQ ID NO: 3968144 - DNA, 15 bp, Homo sapiens
ggtctgtgctgtgcc

SEQ ID NO: 3968145 - DNA, 16 bp, Homo sapiens
ggtctgtgctgtgcct

SEQ ID NO: 3968146 - DNA, 17 bp, Homo sapiens
ggtctgtgctgtgcctg

SEQ ID NO: 3968147 - DNA, 21 bp, Homo sapiens
ggtctgttgtaaatgaccaag

SEQ ID NO: 3968148 - DNA, 16 bp, Homo sapiens
ggtcttcttggcagct

SEQ ID NO: 3968149 - DNA, 21 bp, Homo sapiens
ggtcttgggctactggcagct

SEQ ID NO: 3968150 - DNA, 19 bp, Homo sapiens
ggtctttcctatcatggag

SEQ ID NO: 3968151 - DNA, 21 bp, Homo sapiens
ggtgaaaacagcccaggtcct

SEQ ID NO: 3968152 - DNA, 23 bp, Homo sapiens
ggtgaaatttattagttaatata

SEQ ID NO: 3968153 - DNA, 14 bp, Homo sapiens
ggtgacatcccagg

SEQ ID NO: 3968154 - DNA, 13 bp, Homo sapiens
ggtgaccccaggg

SEQ ID NO: 3968155 - DNA, 14 bp, Homo sapiens
ggtgaccccagggc

SEQ ID NO: 3968156 - DNA, 15 bp, Homo sapiens
ggtgaccccagggca

SEQ ID NO: 3968157 - DNA, 17 bp, Homo sapiens
ggtgaccccagggcaca

SEQ ID NO: 3968158 - DNA, 20 bp, Homo sapiens
ggtgacccggcaccccctgc

SEQ ID NO: 3968159 - DNA, 21 bp, Homo sapiens
ggtgacccggcaccccctgca

SEQ ID NO: 3968160 - DNA, 15 bp, Homo sapiens
ggtgactgaacgagg

SEQ ID NO: 3968161 - DNA, 20 bp, Homo sapiens
ggtgactgaatttgggcctc

SEQ ID NO: 3968162 - DNA, 13 bp, Homo sapiens
ggtgactgtccca

SEQ ID NO: 3968163 - DNA, 16 bp, Homo sapiens
ggtgactgtcccaccg

SEQ ID NO: 3968164 - DNA, 18 bp, Homo sapiens
ggtgagaatcctgcctct

SEQ ID NO: 3968165 - DNA, 11 bp, Homo sapiens
ggtgagctggg

SEQ ID NO: 3968166 - DNA, 13 bp, Homo sapiens
ggtgaggcccagc

SEQ ID NO: 3968167 - DNA, 18 bp, Homo sapiens
ggtgataagtggaaaaaa

SEQ ID NO: 3968168 - DNA, 12 bp, Homo sapiens
ggtgatcagaag

SEQ ID NO: 3968169 - DNA, 13 bp, Homo sapiens
ggtgatcagaagg

SEQ ID NO: 3968170 - DNA, 16 bp, Homo sapiens
ggtgatcagaaggctg

SEQ ID NO: 3968171 - DNA, 13 bp, Homo sapiens
ggtgatgagggca

SEQ ID NO: 3968172 - DNA, 18 bp, Homo sapiens
ggtgcaaagttccctact

SEQ ID NO: 3968173 - DNA, 13 bp, Homo sapiens
ggtgcaagagaca

SEQ ID NO: 3968174 - DNA, 12 bp, Homo sapiens
ggtgcacaggag

SEQ ID NO: 3968175 - DNA, 13 bp, Homo sapiens
ggtgcacaggagg

SEQ ID NO: 3968176 - DNA, 15 bp, Homo sapiens
ggtgcacaggagggg

SEQ ID NO: 3968177 - DNA, 20 bp, Homo sapiens
ggtgcagttgacagcaggtg

SEQ ID NO: 3968178 - DNA, 17 bp, Homo sapiens
ggtgcatggcttgggga

SEQ ID NO: 3968179 - DNA, 19 bp, Homo sapiens
ggtgcatttgagagaagcc

SEQ ID NO: 3968180 - DNA, 18 bp, Homo sapiens
ggtgccaccaataaaaat

SEQ ID NO: 3968181 - DNA, 16 bp, Homo sapiens
ggtgccactccctgag

SEQ ID NO: 3968182 - DNA, 19 bp, Homo sapiens
ggtgccactccctgagctt

SEQ ID NO: 3968183 - DNA, 15 bp, Homo sapiens
ggtgccattcccagc

SEQ ID NO: 3968184 - DNA, 12 bp, Homo sapiens
ggtgcccaggag

SEQ ID NO: 3968185 - DNA, 14 bp, Homo sapiens
ggtgcccaggagaa

SEQ ID NO: 3968186 - DNA, 18 bp, Homo sapiens
ggtgcctatttattgggg

SEQ ID NO: 3968187 - DNA, 16 bp, Homo sapiens
ggtgcctgcctctgcc

SEQ ID NO: 3968188 - DNA, 18 bp, Homo sapiens
ggtgcctgcctctgccat

SEQ ID NO: 3968189 - DNA, 23 bp, Homo sapiens
ggtgcctgcctctgccatgccca

SEQ ID NO: 3968190 - DNA, 19 bp, Homo sapiens
ggtgcctgtgaggcagggg

SEQ ID NO: 3968191 - DNA, 19 bp, Homo sapiens
ggtgcggcaggagcaggaa

SEQ ID NO: 3968192 - DNA, 20 bp, Homo sapiens
ggtgctaagggtaagggaga

SEQ ID NO: 3968193 - DNA, 21 bp, Homo sapiens
ggtgctacaaaaacacagcaa

SEQ ID NO: 3968194 - DNA, 19 bp, Homo sapiens
ggtgctataggctggagaa

SEQ ID NO: 3968195 - DNA, 18 bp, Homo sapiens
ggtgctcacgactcttcc

SEQ ID NO: 3968196 - DNA, 16 bp, Homo sapiens
ggtgctgagcttagcc

SEQ ID NO: 3968197 - DNA, 14 bp, Homo sapiens
ggtgctggatgctt

SEQ ID NO: 3968198 - DNA, 19 bp, Homo sapiens
ggtgctgtggccagggtga

SEQ ID NO: 3968199 - DNA, 20 bp, Homo sapiens
ggtggaagccctccttccac

SEQ ID NO: 3968200 - DNA, 22 bp, Homo sapiens
ggtggaggaaggtgctgagctt

SEQ ID NO: 3968201 - DNA, 15 bp, Homo sapiens
ggtggaggaggagga

SEQ ID NO: 3968202 - DNA, 15 bp, Homo sapiens
ggtggatcacagagg

SEQ ID NO: 3968203 - DNA, 22 bp, Homo sapiens
ggtggattcctgggcaagaacc

SEQ ID NO: 3968204 - DNA, 13 bp, Homo sapiens
ggtggcacctcct

SEQ ID NO: 3968205 - DNA, 22 bp, Homo sapiens
ggtggcaggcacacagcagccc

SEQ ID NO: 3968206 - DNA, 21 bp, Homo sapiens
ggtggccactccagacccctg

SEQ ID NO: 3968207 - DNA, 22 bp, Homo sapiens
ggtggccactccagacccctgg

SEQ ID NO: 3968208 - DNA, 18 bp, Homo sapiens
ggtggccatccctgggcc

SEQ ID NO: 3968209 - DNA, 23 bp, Homo sapiens
ggtggccatccctgggcccctcc

SEQ ID NO: 3968210 - DNA, 21 bp, Homo sapiens
ggtggccccctgtgccagctc

SEQ ID NO: 3968211 - DNA, 16 bp, Homo sapiens
ggtggcccgacagcct

SEQ ID NO: 3968212 - DNA, 12 bp, Homo sapiens
ggtggcctcggg

SEQ ID NO: 3968213 - DNA, 22 bp, Homo sapiens
ggtggcctcgggacacctgccc

SEQ ID NO: 3968214 - DNA, 16 bp, Homo sapiens
ggtggctactctgtgc

SEQ ID NO: 3968215 - DNA, 19 bp, Homo sapiens
ggtggctactctgtgccag

SEQ ID NO: 3968216 - DNA, 22 bp, Homo sapiens
ggtggctactctgtgccagagc

SEQ ID NO: 3968217 - DNA, 23 bp, Homo sapiens
ggtggctgacccagtccctgggg

SEQ ID NO: 3968218 - DNA, 15 bp, Homo sapiens
ggtgggaaccctccc

SEQ ID NO: 3968219 - DNA, 20 bp, Homo sapiens
ggtgggagacgaacggaagg

SEQ ID NO: 3968220 - DNA, 13 bp, Homo sapiens
ggtgggagagaca

SEQ ID NO: 3968221 - DNA, 20 bp, Homo sapiens
ggtgggatggatgctgggga

SEQ ID NO: 3968222 - DNA, 12 bp, Homo sapiens
ggtgggcagctg

SEQ ID NO: 3968223 - DNA, 13 bp, Homo sapiens
ggtgggcctggcc

SEQ ID NO: 3968224 - DNA, 17 bp, Homo sapiens
ggtgggcctggcctgag

SEQ ID NO: 3968225 - DNA, 15 bp, Homo sapiens
ggtgggctggcccag

SEQ ID NO: 3968226 - DNA, 23 bp, Homo sapiens
ggtgggtccaggaaggcagctgc

SEQ ID NO: 3968227 - DNA, 19 bp, Homo sapiens
ggtgggttctttggaagga

SEQ ID NO: 3968228 - DNA, 17 bp, Homo sapiens
ggtggtcctgagacctg

SEQ ID NO: 3968229 - DNA, 13 bp, Homo sapiens
ggtggtctgcttt

SEQ ID NO: 3968230 - DNA, 15 bp, Homo sapiens
ggtggtgccagaggt

SEQ ID NO: 3968231 - DNA, 15 bp, Homo sapiens
ggtggtggaggagga

SEQ ID NO: 3968232 - DNA, 17 bp, Homo sapiens
ggtgtaaagttgttcgc

SEQ ID NO: 3968233 - DNA, 14 bp, Homo sapiens
ggtgtaatgcacaa

SEQ ID NO: 3968234 - DNA, 19 bp, Homo sapiens
ggtgtcaccctgcagagct

SEQ ID NO: 3968235 - DNA, 20 bp, Homo sapiens
ggtgtcaccctgcagagcta

SEQ ID NO: 3968236 - DNA, 13 bp, Homo sapiens
ggtgtcaggcagg

SEQ ID NO: 3968237 - DNA, 15 bp, Homo sapiens
ggtgtcatctgagga

SEQ ID NO: 3968238 - DNA, 18 bp, Homo sapiens
ggtgtcattgctgtagga

SEQ ID NO: 3968239 - DNA, 15 bp, Homo sapiens
ggtgtgccaaactac

SEQ ID NO: 3968240 - DNA, 16 bp, Homo sapiens
ggtgtgcctgccctgg

SEQ ID NO: 3968241 - DNA, 19 bp, Homo sapiens
ggtgtgcctgccctggagg

SEQ ID NO: 3968242 - DNA, 17 bp, Homo sapiens
ggtgtggataaggctta

SEQ ID NO: 3968243 - DNA, 16 bp, Homo sapiens
ggtgttacaaggcact

SEQ ID NO: 3968244 - DNA, 13 bp, Homo sapiens
ggtgtttatacag

SEQ ID NO: 3968245 - DNA, 19 bp, Homo sapiens
ggttaaggtgggtccagga

SEQ ID NO: 3968246 - DNA, 14 bp, Homo sapiens
ggttatctgcctgg

SEQ ID NO: 3968247 - DNA, 21 bp, Homo sapiens
ggttatttttgtccctgctcc

SEQ ID NO: 3968248 - DNA, 14 bp, Homo sapiens
ggttcaccttgccg

SEQ ID NO: 3968249 - DNA, 17 bp, Homo sapiens
ggttcactagagctggg

SEQ ID NO: 3968250 - DNA, 14 bp, Homo sapiens
ggttcagcccctcc

SEQ ID NO: 3968251 - DNA, 20 bp, Homo sapiens
ggttcagcccctcctctgcc

SEQ ID NO: 3968252 - DNA, 21 bp, Homo sapiens
ggttcagcccctcctctgcca

SEQ ID NO: 3968253 - DNA, 14 bp, Homo sapiens
ggttccatgcctga

SEQ ID NO: 3968254 - DNA, 18 bp, Homo sapiens
ggttccatgcctgagggt

SEQ ID NO: 3968255 - DNA, 14 bp, Homo sapiens
ggttcccaataaaa

SEQ ID NO: 3968256 - DNA, 14 bp, Homo sapiens
ggttcccagcagct

SEQ ID NO: 3968257 - DNA, 16 bp, Homo sapiens
ggttcctaagcctgtt

SEQ ID NO: 3968258 - DNA, 13 bp, Homo sapiens
ggttcctgtcctc

SEQ ID NO: 3968259 - DNA, 23 bp, Homo sapiens
ggttctggggaggaagggccagg

SEQ ID NO: 3968260 - DNA, 15 bp, Homo sapiens
ggttgaaggcagtct

SEQ ID NO: 3968261 - DNA, 19 bp, Homo sapiens
ggttgaggtggaagccctc

SEQ ID NO: 3968262 - DNA, 14 bp, Homo sapiens
ggttgcaaccactg

SEQ ID NO: 3968263 - DNA, 21 bp, Homo sapiens
ggttgcgggggagctggaaat

SEQ ID NO: 3968264 - DNA, 22 bp, Homo sapiens
ggttgctgttgatgaggcctct

SEQ ID NO: 3968265 - DNA, 21 bp, Homo sapiens
ggttgcttatttccctcatct

SEQ ID NO: 3968266 - DNA, 19 bp, Homo sapiens
ggttgcttcaccttggagc

SEQ ID NO: 3968267 - DNA, 14 bp, Homo sapiens
ggttggtgggctgg

SEQ ID NO: 3968268 - DNA, 15 bp, Homo sapiens
ggttggtgggctggc

SEQ ID NO: 3968269 - DNA, 19 bp, Homo sapiens
ggttggtgggctggcccag

SEQ ID NO: 3968270 - DNA, 21 bp, Homo sapiens
ggttgtctgtttttgtaactt

SEQ ID NO: 3968271 - DNA, 21 bp, Homo sapiens
ggttgttgcaccatctgcttg

SEQ ID NO: 3968272 - DNA, 22 bp, Homo sapiens
ggttgttgcaccatctgcttgg

SEQ ID NO: 3968273 - DNA, 14 bp, Homo sapiens
ggtttacatgaaca

SEQ ID NO: 3968274 - DNA, 16 bp, Homo sapiens
ggtttacatgaacaca

SEQ ID NO: 3968275 - DNA, 15 bp, Homo sapiens
ggtttccactactgt

SEQ ID NO: 3968276 - DNA, 17 bp, Homo sapiens
ggtttgccctgcctgca

SEQ ID NO: 3968277 - DNA, 12 bp, Homo sapiens
ggtttggggaga

SEQ ID NO: 3968278 - DNA, 13 bp, Homo sapiens
ggtttggggagaa

SEQ ID NO: 3968279 - DNA, 13 bp, Homo sapiens
ggtttgtatattg

SEQ ID NO: 3968280 - DNA, 17 bp, Homo sapiens
ggtttgtcatatattca

SEQ ID NO: 3968281 - DNA, 19 bp, Homo sapiens
ggtttgtgtttgagtttta

SEQ ID NO: 3968282 - DNA, 15 bp, Homo sapiens
ggttttatattttta

SEQ ID NO: 3968283 - DNA, 13 bp, Homo sapiens
ggttttatcagtg

SEQ ID NO: 3968284 - DNA, 22 bp, Homo sapiens
ggttttattctgacttcctctg

SEQ ID NO: 3968285 - DNA, 19 bp, Homo sapiens
ggttttattgtttaaaatc

SEQ ID NO: 3968286 - DNA, 18 bp, Homo sapiens
ggttttctaactgtaaat

SEQ ID NO: 3968287 - DNA, 20 bp, Homo sapiens
ggttttctaactgtaaatca

SEQ ID NO: 3968288 - DNA, 23 bp, Homo sapiens
ggttttctaactgtaaatcactt

SEQ ID NO: 3968289 - DNA, 14 bp, Homo sapiens
ggttttcttcccat

SEQ ID NO: 3968290 - DNA, 14 bp, Homo sapiens
ggttttggagtcag

SEQ ID NO: 3968291 - DNA, 15 bp, Homo sapiens
ggtttttggctcttt

SEQ ID NO: 3968292 - DNA, 20 bp, Homo sapiens
ggtttttggctctttcagag

SEQ ID NO: 3968293 - DNA, 20 bp, Homo sapiens
gtaaaacaaaaatgtaatga

SEQ ID NO: 3968294 - DNA, 11 bp, Homo sapiens
gtaaaacacag

SEQ ID NO: 3968295 - DNA, 15 bp, Homo sapiens
gtaaaaccacagcag

SEQ ID NO: 3968296 - DNA, 18 bp, Homo sapiens
gtaaacagtgcctgctga

SEQ ID NO: 3968297 - DNA, 23 bp, Homo sapiens
gtaaacataattcttgtatatta

SEQ ID NO: 3968298 - DNA, 15 bp, Homo sapiens
gtaaactataaacta

SEQ ID NO: 3968299 - DNA, 21 bp, Homo sapiens
gtaaactcaaaacttaacata

SEQ ID NO: 3968300 - DNA, 16 bp, Homo sapiens
gtaaactcaaaatatt

SEQ ID NO: 3968301 - DNA, 21 bp, Homo sapiens
gtaaactgtatcaaatctgta

SEQ ID NO: 3968302 - DNA, 16 bp, Homo sapiens
gtaaagaataaatgaa

SEQ ID NO: 3968303 - DNA, 16 bp, Homo sapiens
gtaaagtatgtaaaca

SEQ ID NO: 3968304 - DNA, 18 bp, Homo sapiens
gtaaagtgataatttctg

SEQ ID NO: 3968305 - DNA, 16 bp, Homo sapiens
gtaaagtttaaaaaat

SEQ ID NO: 3968306 - DNA, 14 bp, Homo sapiens
gtaaataaattgtt

SEQ ID NO: 3968307 - DNA, 18 bp, Homo sapiens
gtaaataaattgtttgac

SEQ ID NO: 3968308 - DNA, 21 bp, Homo sapiens
gtaaatacagtggatctcaat

SEQ ID NO: 3968309 - DNA, 15 bp, Homo sapiens
gtaaatacatgtgtg

SEQ ID NO: 3968310 - DNA, 17 bp, Homo sapiens
gtaaatacatgtgtgga

SEQ ID NO: 3968311 - DNA, 22 bp, Homo sapiens
gtaaatacatgtgtggatgtgt

SEQ ID NO: 3968312 - DNA, 23 bp, Homo sapiens
gtaaatatgactcctttctctat

SEQ ID NO: 3968313 - DNA, 12 bp, Homo sapiens
gtaaatcacttg

SEQ ID NO: 3968314 - DNA, 16 bp, Homo sapiens
gtaaatcacttgtaaa

SEQ ID NO: 3968315 - DNA, 23 bp, Homo sapiens
gtaaatcacttgtaaataaatag

SEQ ID NO: 3968316 - DNA, 16 bp, Homo sapiens
gtaaatccacagccaa

SEQ ID NO: 3968317 - DNA, 15 bp, Homo sapiens
gtaaatcctttttct

SEQ ID NO: 3968318 - DNA, 22 bp, Homo sapiens
gtaaatcctttttctttataaa

SEQ ID NO: 3968319 - DNA, 17 bp, Homo sapiens
gtaaatggagcttgtac

SEQ ID NO: 3968320 - DNA, 17 bp, Homo sapiens
gtaaatgggcagtgcct

SEQ ID NO: 3968321 - DNA, 19 bp, Homo sapiens
gtaaatgggcagtgcctcc

SEQ ID NO: 3968322 - DNA, 14 bp, Homo sapiens
gtaaattggaaaca

SEQ ID NO: 3968323 - DNA, 22 bp, Homo sapiens
gtaaatttgtccaatggctgta

SEQ ID NO: 3968324 - DNA, 13 bp, Homo sapiens
gtaacaaatgaac

SEQ ID NO: 3968325 - DNA, 19 bp, Homo sapiens
gtaacacaagccacagaag

SEQ ID NO: 3968326 - DNA, 17 bp, Homo sapiens
gtaacatcctttctatt

SEQ ID NO: 3968327 - DNA, 20 bp, Homo sapiens
gtaacatttggagtgtgtat

SEQ ID NO: 3968328 - DNA, 19 bp, Homo sapiens
gtaactactttttatactc

SEQ ID NO: 3968329 - DNA, 20 bp, Homo sapiens
gtaactactttttatactcc

SEQ ID NO: 3968330 - DNA, 15 bp, Homo sapiens
gtaactattgaattg

SEQ ID NO: 3968331 - DNA, 22 bp, Homo sapiens
gtaactctatagttattgtttt

SEQ ID NO: 3968332 - DNA, 14 bp, Homo sapiens
gtaactgctgagcc

SEQ ID NO: 3968333 - DNA, 17 bp, Homo sapiens
gtaactgctgagccact

SEQ ID NO: 3968334 - DNA, 18 bp, Homo sapiens
gtaactgctgagccactc

SEQ ID NO: 3968335 - DNA, 20 bp, Homo sapiens
gtaagcactgactgggacca

SEQ ID NO: 3968336 - DNA, 19 bp, Homo sapiens
gtaagcattctgagctggg

SEQ ID NO: 3968337 - DNA, 13 bp, Homo sapiens
gtaagctctggct

SEQ ID NO: 3968338 - DNA, 21 bp, Homo sapiens
gtaagggtctgttgtaaatga

SEQ ID NO: 3968339 - DNA, 12 bp, Homo sapiens
gtaaggtgcctt

SEQ ID NO: 3968340 - DNA, 13 bp, Homo sapiens
gtaagtcaggagt

SEQ ID NO: 3968341 - DNA, 22 bp, Homo sapiens
gtaagtggggttgcaaccactg

SEQ ID NO: 3968342 - DNA, 14 bp, Homo sapiens
gtaagttgtgtgca

SEQ ID NO: 3968343 - DNA, 12 bp, Homo sapiens
gtaagtttattt

SEQ ID NO: 3968344 - DNA, 19 bp, Homo sapiens
gtaataaaacccagcatgt

SEQ ID NO: 3968345 - DNA, 22 bp, Homo sapiens
gtaataagaaagtataaagtca

SEQ ID NO: 3968346 - DNA, 22 bp, Homo sapiens
gtaatataatggaagagaaatc

SEQ ID NO: 3968347 - DNA, 21 bp, Homo sapiens
gtaatatctattattataaaa

SEQ ID NO: 3968348 - DNA, 15 bp, Homo sapiens
gtaatatgtctgcca

SEQ ID NO: 3968349 - DNA, 17 bp, Homo sapiens
gtaatccatcactagcc

SEQ ID NO: 3968350 - DNA, 12 bp, Homo sapiens
gtaatcccagca

SEQ ID NO: 3968351 - DNA, 18 bp, Homo sapiens
gtaatcccagctactcag

SEQ ID NO: 3968352 - DNA, 21 bp, Homo sapiens
gtaatcccagctactcaggag

SEQ ID NO: 3968353 - DNA, 22 bp, Homo sapiens
gtaatctccacagtcaaagaag

SEQ ID NO: 3968354 - DNA, 15 bp, Homo sapiens
gtaatgagaacttca

SEQ ID NO: 3968355 - DNA, 18 bp, Homo sapiens
gtaatgattatatgacaa

SEQ ID NO: 3968356 - DNA, 14 bp, Homo sapiens
gtaatgcacaattt

SEQ ID NO: 3968357 - DNA, 15 bp, Homo sapiens
gtaatgcacaattta

SEQ ID NO: 3968358 - DNA, 17 bp, Homo sapiens
gtaatgcacaatttaga

SEQ ID NO: 3968359 - DNA, 21 bp, Homo sapiens
gtaatgcacaatttagaaaac

SEQ ID NO: 3968360 - DNA, 16 bp, Homo sapiens
gtaatgcttcaatcag

SEQ ID NO: 3968361 - DNA, 16 bp, Homo sapiens
gtaatgggccaattaa

SEQ ID NO: 3968362 - DNA, 14 bp, Homo sapiens
gtaatgggcctgcc

SEQ ID NO: 3968363 - DNA, 19 bp, Homo sapiens
gtaatgtcaccaccttccc

SEQ ID NO: 3968364 - DNA, 14 bp, Homo sapiens
gtaatgtttttgaa

SEQ ID NO: 3968365 - DNA, 22 bp, Homo sapiens
gtaattaagtgcaatttcccct

SEQ ID NO: 3968366 - DNA, 12 bp, Homo sapiens
gtaattgcttac

SEQ ID NO: 3968367 - DNA, 15 bp, Homo sapiens
gtaattgcttacatt

SEQ ID NO: 3968368 - DNA, 16 bp, Homo sapiens
gtaattgcttacattt

SEQ ID NO: 3968369 - DNA, 21 bp, Homo sapiens
gtaattgttgctaatcttctt

SEQ ID NO: 3968370 - DNA, 14 bp, Homo sapiens
gtaatttataaaat

SEQ ID NO: 3968371 - DNA, 12 bp, Homo sapiens
gtacaaaataaa

SEQ ID NO: 3968372 - DNA, 12 bp, Homo sapiens
gtacaaatactg

SEQ ID NO: 3968373 - DNA, 21 bp, Homo sapiens
gtacaaatattcctgtttctg

SEQ ID NO: 3968374 - DNA, 19 bp, Homo sapiens
gtacaatacataactagtt

SEQ ID NO: 3968375 - DNA, 17 bp, Homo sapiens
gtacaatcctttgagtt

SEQ ID NO: 3968376 - DNA, 13 bp, Homo sapiens
gtacaatgtttca

SEQ ID NO: 3968377 - DNA, 15 bp, Homo sapiens
gtacaattactaaat

SEQ ID NO: 3968378 - DNA, 13 bp, Homo sapiens
gtacacacacaga

SEQ ID NO: 3968379 - DNA, 14 bp, Homo sapiens
gtacagcagggtct

SEQ ID NO: 3968380 - DNA, 15 bp, Homo sapiens
gtacagcagggtctt

SEQ ID NO: 3968381 - DNA, 21 bp, Homo sapiens
gtacaggcaaaacacgcaagg

SEQ ID NO: 3968382 - DNA, 14 bp, Homo sapiens
gtacagtgaggagg

SEQ ID NO: 3968383 - DNA, 20 bp, Homo sapiens
ggcaaatgacatgcactgac

SEQ ID NO: 3968384 - DNA, 21 bp, Homo sapiens
ggcaaatgacatgcactgacc

SEQ ID NO: 3968385 - DNA, 21 bp, Homo sapiens
ggcaacacctccttgctttgc

SEQ ID NO: 3968386 - DNA, 13 bp, Homo sapiens
ggcaacagatgaa

SEQ ID NO: 3968387 - DNA, 20 bp, Homo sapiens
ggcaaccccagttctgctcc

SEQ ID NO: 3968388 - DNA, 23 bp, Homo sapiens
ggcaaccccagttctgctcctct

SEQ ID NO: 3968389 - DNA, 19 bp, Homo sapiens
ggcaactaagcagtccctg

SEQ ID NO: 3968390 - DNA, 16 bp, Homo sapiens
ggcaagagacagaatg

SEQ ID NO: 3968391 - DNA, 19 bp, Homo sapiens
ggcaagggccatgctgaag

SEQ ID NO: 3968392 - DNA, 13 bp, Homo sapiens
ggcaagggggcgg

SEQ ID NO: 3968393 - DNA, 13 bp, Homo sapiens
ggcacacagcagc

SEQ ID NO: 3968394 - DNA, 14 bp, Homo sapiens
ggcacacagcagcc

SEQ ID NO: 3968395 - DNA, 17 bp, Homo sapiens
ggcacacagcagccccc

SEQ ID NO: 3968396 - DNA, 19 bp, Homo sapiens
ggcacacagcagcccccca

SEQ ID NO: 3968397 - DNA, 13 bp, Homo sapiens
ggcacaccactgc

SEQ ID NO: 3968398 - DNA, 17 bp, Homo sapiens
ggcacaccactgccctg

SEQ ID NO: 3968399 - DNA, 23 bp, Homo sapiens
ggcacaccactgccctgcctgcc

SEQ ID NO: 3968400 - DNA, 21 bp, Homo sapiens
ggcacagaaacacaatatttt

SEQ ID NO: 3968401 - DNA, 22 bp, Homo sapiens
ggcacaggactgattctgggat

SEQ ID NO: 3968402 - DNA, 13 bp, Homo sapiens
ggcacaggagcta

SEQ ID NO: 3968403 - DNA, 14 bp, Homo sapiens
ggcacaggcaggaa

SEQ ID NO: 3968404 - DNA, 17 bp, Homo sapiens
ggcacaggcaggaagag

SEQ ID NO: 3968405 - DNA, 18 bp, Homo sapiens
ggcacaggcaggaagaga

SEQ ID NO: 3968406 - DNA, 18 bp, Homo sapiens
ggcacaggtgtaaatata

SEQ ID NO: 3968407 - DNA, 15 bp, Homo sapiens
ggcacatgaggaggg

SEQ ID NO: 3968408 - DNA, 13 bp, Homo sapiens
ggcaccagaatgc

SEQ ID NO: 3968409 - DNA, 17 bp, Homo sapiens
ggcaccagatgcaacct

SEQ ID NO: 3968410 - DNA, 18 bp, Homo sapiens
ggcaccagatgcaacctc

SEQ ID NO: 3968411 - DNA, 18 bp, Homo sapiens
ggcaccagccccctggat

SEQ ID NO: 3968412 - DNA, 14 bp, Homo sapiens
ggcaccatctccct

SEQ ID NO: 3968413 - DNA, 13 bp, Homo sapiens
ggcacccccagcc

SEQ ID NO: 3968414 - DNA, 14 bp, Homo sapiens
ggcaccccctgcag

SEQ ID NO: 3968415 - DNA, 18 bp, Homo sapiens
ggcaccccctgcagcttg

SEQ ID NO: 3968416 - DNA, 20 bp, Homo sapiens
ggcacccttctttcctcttc

SEQ ID NO: 3968417 - DNA, 22 bp, Homo sapiens
ggcacccttctttcctcttccc

SEQ ID NO: 3968418 - DNA, 17 bp, Homo sapiens
ggcaccggcgctgcagg

SEQ ID NO: 3968419 - DNA, 23 bp, Homo sapiens
ggcacctcctacgtcaaacatga

SEQ ID NO: 3968420 - DNA, 13 bp, Homo sapiens
ggcacctcctgag

SEQ ID NO: 3968421 - DNA, 12 bp, Homo sapiens
ggcacctggcct

SEQ ID NO: 3968422 - DNA, 13 bp, Homo sapiens
ggcacctggcctg

SEQ ID NO: 3968423 - DNA, 14 bp, Homo sapiens
ggcacctggcctgc

SEQ ID NO: 3968424 - DNA, 12 bp, Homo sapiens
ggcacctgggaa

SEQ ID NO: 3968425 - DNA, 16 bp, Homo sapiens
ggcacctgggccctgg

SEQ ID NO: 3968426 - DNA, 21 bp, Homo sapiens
ggcacgtcccatgtgcatgga

SEQ ID NO: 3968427 - DNA, 19 bp, Homo sapiens
ggcactgggatgagccgct

SEQ ID NO: 3968428 - DNA, 22 bp, Homo sapiens
ggcacttagcccaagaggtctg

SEQ ID NO: 3968429 - DNA, 16 bp, Homo sapiens
ggcacttgattccttg

SEQ ID NO: 3968430 - DNA, 23 bp, Homo sapiens
ggcacttgtcactatgctatttc

SEQ ID NO: 3968431 - DNA, 17 bp, Homo sapiens
ggcagaaaagaggagac

SEQ ID NO: 3968432 - DNA, 23 bp, Homo sapiens
ggcagaagaattgaacccaggag

SEQ ID NO: 3968433 - DNA, 16 bp, Homo sapiens
ggcagaaggggaagat

SEQ ID NO: 3968434 - DNA, 20 bp, Homo sapiens
ggcagacaagagctgctgtc

SEQ ID NO: 3968435 - DNA, 17 bp, Homo sapiens
ggcagaccgggggccag

SEQ ID NO: 3968436 - DNA, 20 bp, Homo sapiens
ggcagaccgggggccagaca

SEQ ID NO: 3968437 - DNA, 18 bp, Homo sapiens
ggcagagaaagaagagac

SEQ ID NO: 3968438 - DNA, 16 bp, Homo sapiens
ggcagagaaggcctct

SEQ ID NO: 3968439 - DNA, 15 bp, Homo sapiens
ggcagagaccccagg

SEQ ID NO: 3968440 - DNA, 22 bp, Homo sapiens
ggcagagcctttggatgaccag

SEQ ID NO: 3968441 - DNA, 22 bp, Homo sapiens
ggcagagcggggaggtgcctga

SEQ ID NO: 3968442 - DNA, 16 bp, Homo sapiens
ggcagaggatgttctg

SEQ ID NO: 3968443 - DNA, 12 bp, Homo sapiens
ggcagaggctgg

SEQ ID NO: 3968444 - DNA, 13 bp, Homo sapiens
ggcagaggctgga

SEQ ID NO: 3968445 - DNA, 20 bp, Homo sapiens
ggcagagggaatgttccctg

SEQ ID NO: 3968446 - DNA, 23 bp, Homo sapiens
ggcagagggaatgttccctgcac

SEQ ID NO: 3968447 - DNA, 16 bp, Homo sapiens
ggcagaggggcagccg

SEQ ID NO: 3968448 - DNA, 24 bp, Homo sapiens
ggcagatttagtgaaagctagaga

SEQ ID NO: 3968449 - DNA, 17 bp, Homo sapiens
ggcagcaaggcccgagc

SEQ ID NO: 3968450 - DNA, 20 bp, Homo sapiens
ggcagcaaggcccgagcagc

SEQ ID NO: 3968451 - DNA, 12 bp, Homo sapiens
ggcagcaccctc

SEQ ID NO: 3968452 - DNA, 14 bp, Homo sapiens
ggcagcagccagcc

SEQ ID NO: 3968453 - DNA, 17 bp, Homo sapiens
ggcagcagccagccctg

SEQ ID NO: 3968454 - DNA, 18 bp, Homo sapiens
ggcagcagccagccctgc

SEQ ID NO: 3968455 - DNA, 22 bp, Homo sapiens
ggcagcagccagccctgcctgg

SEQ ID NO: 3968456 - DNA, 15 bp, Homo sapiens
ggcagccatgcctca

SEQ ID NO: 3968457 - DNA, 17 bp, Homo sapiens
ggcagccgctaggagag

SEQ ID NO: 3968458 - DNA, 18 bp, Homo sapiens
ggcagccgtgccttcagc

SEQ ID NO: 3968459 - DNA, 19 bp, Homo sapiens
ggcagcctccagagccagc

SEQ ID NO: 3968460 - DNA, 21 bp, Homo sapiens
ggcagcctccagagccagcct

SEQ ID NO: 3968461 - DNA, 14 bp, Homo sapiens
ggcagcctgccgcc

SEQ ID NO: 3968462 - DNA, 22 bp, Homo sapiens
ggcagcctgccgccgtctctgt

SEQ ID NO: 3968463 - DNA, 19 bp, Homo sapiens
gcctggcccatagaaacat

SEQ ID NO: 3968464 - DNA, 15 bp, Homo sapiens
gcctggccggcaacc

SEQ ID NO: 3968465 - DNA, 13 bp, Homo sapiens
gcctggcctgagc

SEQ ID NO: 3968466 - DNA, 22 bp, Homo sapiens
gcctggcctgagctggggccac

SEQ ID NO: 3968467 - DNA, 13 bp, Homo sapiens
gcctggcctggct

SEQ ID NO: 3968468 - DNA, 20 bp, Homo sapiens
gcctggccttgtcaggaccc

SEQ ID NO: 3968469 - DNA, 23 bp, Homo sapiens
gcctggccttgtcaggacccagg

SEQ ID NO: 3968470 - DNA, 18 bp, Homo sapiens
gcctggcggggcaggagg

SEQ ID NO: 3968471 - DNA, 19 bp, Homo sapiens
gcctggcggggcaggaggc

SEQ ID NO: 3968472 - DNA, 22 bp, Homo sapiens
gcctggcggggcaggaggcctg

SEQ ID NO: 3968473 - DNA, 12 bp, Homo sapiens
gcctggctcccc

SEQ ID NO: 3968474 - DNA, 12 bp, Homo sapiens
gcctggctggct

SEQ ID NO: 3968475 - DNA, 15 bp, Homo sapiens
gcctggctggctgag

SEQ ID NO: 3968476 - DNA, 18 bp, Homo sapiens
gcctggctggctgagggc

SEQ ID NO: 3968477 - DNA, 13 bp, Homo sapiens
gcctggctgtgga

SEQ ID NO: 3968478 - DNA, 20 bp, Homo sapiens
gcctggctgtggaggcctga

SEQ ID NO: 3968479 - DNA, 21 bp, Homo sapiens
gcctggctgtggaggcctgat

SEQ ID NO: 3968480 - DNA, 16 bp, Homo sapiens
gcctggcttgctccag

SEQ ID NO: 3968481 - DNA, 18 bp, Homo sapiens
gcctggcttgctccaggg

SEQ ID NO: 3968482 - DNA, 18 bp, Homo sapiens
gcctgggaaatttctact

SEQ ID NO: 3968483 - DNA, 18 bp, Homo sapiens
gcctgggacccagctact

SEQ ID NO: 3968484 - DNA, 16 bp, Homo sapiens
gcctgggactcccagt

SEQ ID NO: 3968485 - DNA, 14 bp, Homo sapiens
gcctgggccagaga

SEQ ID NO: 3968486 - DNA, 16 bp, Homo sapiens
gcctgggccagagaag

SEQ ID NO: 3968487 - DNA, 19 bp, Homo sapiens
gcctgggcccaggctctgg

SEQ ID NO: 3968488 - DNA, 22 bp, Homo sapiens
gcctgggcccaggctctgggaa

SEQ ID NO: 3968489 - DNA, 18 bp, Homo sapiens
gcctgggcctatggagag

SEQ ID NO: 3968490 - DNA, 20 bp, Homo sapiens
gcctgggcctatggagagcc

SEQ ID NO: 3968491 - DNA, 23 bp, Homo sapiens
gcctgggcctatggagagccctg

SEQ ID NO: 3968492 - DNA, 13 bp, Homo sapiens
gcctgggcctgct

SEQ ID NO: 3968493 - DNA, 14 bp, Homo sapiens
gcctgggcctgtgc

SEQ ID NO: 3968494 - DNA, 15 bp, Homo sapiens
gcctgggcctgtgca

SEQ ID NO: 3968495 - DNA, 21 bp, Homo sapiens
gcctgggcctgtgcagcagcc

SEQ ID NO: 3968496 - DNA, 22 bp, Homo sapiens
gcctgggggcagggagaggagt

SEQ ID NO: 3968497 - DNA, 15 bp, Homo sapiens
gcctgggggcagtga

SEQ ID NO: 3968498 - DNA, 16 bp, Homo sapiens
gcctgggggcctggct

SEQ ID NO: 3968499 - DNA, 22 bp, Homo sapiens
gcctggggtgacccggcacccc

SEQ ID NO: 3968500 - DNA, 20 bp, Homo sapiens
gcctgggtgagaatcctgcc

SEQ ID NO: 3968501 - DNA, 18 bp, Homo sapiens
gcctgggtggggctgctc

SEQ ID NO: 3968502 - DNA, 18 bp, Homo sapiens
gcctgggttttctaactg

SEQ ID NO: 3968503 - DNA, 20 bp, Homo sapiens
gcctgggttttctaactgta

SEQ ID NO: 3968504 - DNA, 22 bp, Homo sapiens
gcctgggttttctaactgtaaa

SEQ ID NO: 3968505 - DNA, 16 bp, Homo sapiens
gcctgtaatcccagca

SEQ ID NO: 3968506 - DNA, 20 bp, Homo sapiens
gcctgtaatcccagcacttt

SEQ ID NO: 3968507 - DNA, 17 bp, Homo sapiens
gcctgtaatcccagcag

SEQ ID NO: 3968508 - DNA, 19 bp, Homo sapiens
gcctgtaatcccagctact

SEQ ID NO: 3968509 - DNA, 19 bp, Homo sapiens
gcctgtagtcccagccact

SEQ ID NO: 3968510 - DNA, 16 bp, Homo sapiens
gcctgtagttaggaaa

SEQ ID NO: 3968511 - DNA, 18 bp, Homo sapiens
gcctgtagttaggaaata

SEQ ID NO: 3968512 - DNA, 12 bp, Homo sapiens
gcctgtcctgcc

SEQ ID NO: 3968513 - DNA, 14 bp, Homo sapiens
gcctgtcctgcctc

SEQ ID NO: 3968514 - DNA, 16 bp, Homo sapiens
gcctgtgaacccagga

SEQ ID NO: 3968515 - DNA, 17 bp, Homo sapiens
gcctgtgaacccaggac

SEQ ID NO: 3968516 - DNA, 18 bp, Homo sapiens
gcctgtgaacccaggaca

SEQ ID NO: 3968517 - DNA, 14 bp, Homo sapiens
gcctgtgaggcagg

SEQ ID NO: 3968518 - DNA, 15 bp, Homo sapiens
gcctgtgattaactt

SEQ ID NO: 3968519 - DNA, 20 bp, Homo sapiens
gcctgtgattaacttgctta

SEQ ID NO: 3968520 - DNA, 13 bp, Homo sapiens
gcctgtgcagcag

SEQ ID NO: 3968521 - DNA, 15 bp, Homo sapiens
gcctgtgcagcagcc

SEQ ID NO: 3968522 - DNA, 18 bp, Homo sapiens
gcctgtgcagcagcccag

SEQ ID NO: 3968523 - DNA, 19 bp, Homo sapiens
gcctgtgcagcagcccagc

SEQ ID NO: 3968524 - DNA, 15 bp, Homo sapiens
gcctgtgctaaagaa

SEQ ID NO: 3968525 - DNA, 19 bp, Homo sapiens
gcctgtggcagaaaagagg

SEQ ID NO: 3968526 - DNA, 16 bp, Homo sapiens
gcctgtggcggtgcct

SEQ ID NO: 3968527 - DNA, 15 bp, Homo sapiens
gcctgtgggaagaga

SEQ ID NO: 3968528 - DNA, 11 bp, Homo sapiens
gcctgtgggag

SEQ ID NO: 3968529 - DNA, 20 bp, Homo sapiens
gcctgtgtagctgtgacctg

SEQ ID NO: 3968530 - DNA, 16 bp, Homo sapiens
gcctgtgtccagcagc

SEQ ID NO: 3968531 - DNA, 19 bp, Homo sapiens
gcctgtgtccagcagctgc

SEQ ID NO: 3968532 - DNA, 21 bp, Homo sapiens
gcctgtgtccagcagctgcgg

SEQ ID NO: 3968533 - DNA, 22 bp, Homo sapiens
gcctgtgtccagcagctgcggg

SEQ ID NO: 3968534 - DNA, 12 bp, Homo sapiens
gccttacctcct

SEQ ID NO: 3968535 - DNA, 13 bp, Homo sapiens
gccttacctcctg

SEQ ID NO: 3968536 - DNA, 14 bp, Homo sapiens
gccttacctcctgc

SEQ ID NO: 3968537 - DNA, 16 bp, Homo sapiens
gccttactcacctctc

SEQ ID NO: 3968538 - DNA, 16 bp, Homo sapiens
gccttagaacctttct

SEQ ID NO: 3968539 - DNA, 16 bp, Homo sapiens
gccttagcacttcttt

SEQ ID NO: 3968540 - DNA, 19 bp, Homo sapiens
gccttccccttttgcctgg

SEQ ID NO: 3968541 - DNA, 19 bp, Homo sapiens
gccttccctccccacagtc

SEQ ID NO: 3968542 - DNA, 15 bp, Homo sapiens
gccttcctcatcccc

SEQ ID NO: 3968543 - DNA, 16 bp, Homo sapiens
gcagctgggccccatg

SEQ ID NO: 3968544 - DNA, 21 bp, Homo sapiens
gcagctgggccccatgctctg

SEQ ID NO: 3968545 - DNA, 22 bp, Homo sapiens
gcagctgggccccatgctctgc

SEQ ID NO: 3968546 - DNA, 12 bp, Homo sapiens
gcagctgtcatg

SEQ ID NO: 3968547 - DNA, 17 bp, Homo sapiens
gcagctgtcattcagga

SEQ ID NO: 3968548 - DNA, 20 bp, Homo sapiens
gcagctgtcccctctccctg

SEQ ID NO: 3968549 - DNA, 15 bp, Homo sapiens
gcagctgtttctgga

SEQ ID NO: 3968550 - DNA, 16 bp, Homo sapiens
gcagcttgtagccagc

SEQ ID NO: 3968551 - DNA, 18 bp, Homo sapiens
gcagcttgtagccagccg

SEQ ID NO: 3968552 - DNA, 23 bp, Homo sapiens
gcagcttgtagccagccggggcg

SEQ ID NO: 3968553 - DNA, 14 bp, Homo sapiens
gcaggaacagagac

SEQ ID NO: 3968554 - DNA, 16 bp, Homo sapiens
gcaggaacagagactc

SEQ ID NO: 3968555 - DNA, 17 bp, Homo sapiens
gcaggaacctgtactgg

SEQ ID NO: 3968556 - DNA, 18 bp, Homo sapiens
gcaggaacgagcactggc

SEQ ID NO: 3968557 - DNA, 16 bp, Homo sapiens
gcctcgctccccactc

SEQ ID NO: 3968558 - DNA, 18 bp, Homo sapiens
gcctcgctccccactctg

SEQ ID NO: 3968559 - DNA, 24 bp, Homo sapiens
gcctcgctccccactctgctctga

SEQ ID NO: 3968560 - DNA, 21 bp, Homo sapiens
gcctctagaacacccactggc

SEQ ID NO: 3968561 - DNA, 13 bp, Homo sapiens
gcctctcacacac

SEQ ID NO: 3968562 - DNA, 14 bp, Homo sapiens
gcctctcccggctg

SEQ ID NO: 3968563 - DNA, 15 bp, Homo sapiens
gcctctcccggctgc

SEQ ID NO: 3968564 - DNA, 16 bp, Homo sapiens
gcctctcccggctgcc

SEQ ID NO: 3968565 - DNA, 18 bp, Homo sapiens
gcctctcccggctgcctg

SEQ ID NO: 3968566 - DNA, 22 bp, Homo sapiens
gcctctcccggctgcctgccgc

SEQ ID NO: 3968567 - DNA, 14 bp, Homo sapiens
gcctctctgctata

SEQ ID NO: 3968568 - DNA, 17 bp, Homo sapiens
gcctctctgctccagag

SEQ ID NO: 3968569 - DNA, 18 bp, Homo sapiens
gcctctctgctccagaga

SEQ ID NO: 3968570 - DNA, 19 bp, Homo sapiens
gcctctgaaatttcccaca

SEQ ID NO: 3968571 - DNA, 14 bp, Homo sapiens
gcctctgaggccag

SEQ ID NO: 3968572 - DNA, 21 bp, Homo sapiens
gcctctgaggccagcctggcc

SEQ ID NO: 3968573 - DNA, 17 bp, Homo sapiens
gcctctgatatgggact

SEQ ID NO: 3968574 - DNA, 19 bp, Homo sapiens
gcctctgatatgggactga

SEQ ID NO: 3968575 - DNA, 12 bp, Homo sapiens
gcctctgcattc

SEQ ID NO: 3968576 - DNA, 15 bp, Homo sapiens
gcctctgccatgccc

SEQ ID NO: 3968577 - DNA, 12 bp, Homo sapiens
gcctctgcccca

SEQ ID NO: 3968578 - DNA, 16 bp, Homo sapiens
gcctctgccccaaggg

SEQ ID NO: 3968579 - DNA, 17 bp, Homo sapiens
gcctctgccccaagggg

SEQ ID NO: 3968580 - DNA, 18 bp, Homo sapiens
gcctctgcccgcagagcc

SEQ ID NO: 3968581 - DNA, 22 bp, Homo sapiens
gcctctgcccgcagagcccacg

SEQ ID NO: 3968582 - DNA, 15 bp, Homo sapiens
gcctctgccctgcct

SEQ ID NO: 3968583 - DNA, 16 bp, Homo sapiens
gcctctgcctgtgcac

SEQ ID NO: 3968584 - DNA, 19 bp, Homo sapiens
gcctctggccaggcatggc

SEQ ID NO: 3968585 - DNA, 22 bp, Homo sapiens
gcctctgtcccggaagagtcat

SEQ ID NO: 3968586 - DNA, 14 bp, Homo sapiens
gcctctgtgtcctt

SEQ ID NO: 3968587 - DNA, 13 bp, Homo sapiens
gcctcttgttgca

SEQ ID NO: 3968588 - DNA, 21 bp, Homo sapiens
gcctgaaccacagcggaggag

SEQ ID NO: 3968589 - DNA, 20 bp, Homo sapiens
gcctgacaggttcccagcag

SEQ ID NO: 3968590 - DNA, 22 bp, Homo sapiens
gcctgacaggttcccagcagct

SEQ ID NO: 3968591 - DNA, 17 bp, Homo sapiens
gcctgagcccaggagct

SEQ ID NO: 3968592 - DNA, 20 bp, Homo sapiens
gcctgagcccagggaggccg

SEQ ID NO: 3968593 - DNA, 19 bp, Homo sapiens
gcctgagctggggccacaa

SEQ ID NO: 3968594 - DNA, 18 bp, Homo sapiens
gcctgagctggggcctgg

SEQ ID NO: 3968595 - DNA, 18 bp, Homo sapiens
gcctgaggctcaagaggc

SEQ ID NO: 3968596 - DNA, 19 bp, Homo sapiens
gcctgaggctcaagaggcc

SEQ ID NO: 3968597 - DNA, 21 bp, Homo sapiens
gcctgaggctcaagaggccca

SEQ ID NO: 3968598 - DNA, 23 bp, Homo sapiens
gcctgaggctcaagaggcccagg

SEQ ID NO: 3968599 - DNA, 12 bp, Homo sapiens
gcctgagggtgg

SEQ ID NO: 3968600 - DNA, 14 bp, Homo sapiens
gcctgagggtggag

SEQ ID NO: 3968601 - DNA, 15 bp, Homo sapiens
gcctgagtctcctgt

SEQ ID NO: 3968602 - DNA, 12 bp, Homo sapiens
gcctgatgacag

SEQ ID NO: 3968603 - DNA, 15 bp, Homo sapiens
gcctgatgctgcccc

SEQ ID NO: 3968604 - DNA, 14 bp, Homo sapiens
gcctgatggccaag

SEQ ID NO: 3968605 - DNA, 12 bp, Homo sapiens
gcctgcagagag

SEQ ID NO: 3968606 - DNA, 14 bp, Homo sapiens
gcctgcagcctccc

SEQ ID NO: 3968607 - DNA, 17 bp, Homo sapiens
gcctgccataccgctgg

SEQ ID NO: 3968608 - DNA, 21 bp, Homo sapiens
gcctgccataccgctggggaa

SEQ ID NO: 3968609 - DNA, 12 bp, Homo sapiens
gcctgccctccc

SEQ ID NO: 3968610 - DNA, 19 bp, Homo sapiens
gcctgccctccctggggtc

SEQ ID NO: 3968611 - DNA, 13 bp, Homo sapiens
gcctgccctggag

SEQ ID NO: 3968612 - DNA, 18 bp, Homo sapiens
gcctgccctggagggagg

SEQ ID NO: 3968613 - DNA, 17 bp, Homo sapiens
gcctgccgcccaaagag

SEQ ID NO: 3968614 - DNA, 17 bp, Homo sapiens
gcctgcggccgggctgc

SEQ ID NO: 3968615 - DNA, 19 bp, Homo sapiens
gcctgctaatagctgctag

SEQ ID NO: 3968616 - DNA, 18 bp, Homo sapiens
gcctgctagagcaacccc

SEQ ID NO: 3968617 - DNA, 17 bp, Homo sapiens
gcctgctcccagcagcc

SEQ ID NO: 3968618 - DNA, 17 bp, Homo sapiens
gcctgctgctgagaacc

SEQ ID NO: 3968619 - DNA, 18 bp, Homo sapiens
gcctgctgctgagaacct

SEQ ID NO: 3968620 - DNA, 20 bp, Homo sapiens
gcctgctgggaaccccgcag

SEQ ID NO: 3968621 - DNA, 17 bp, Homo sapiens
gcctgctgggctctcca

SEQ ID NO: 3968622 - DNA, 19 bp, Homo sapiens
gcctgctgggctctccacc

SEQ ID NO: 3968623 - DNA, 20 bp, Homo sapiens
gcctgctgggctctccacct

SEQ ID NO: 3968624 - DNA, 21 bp, Homo sapiens
gcctgctgggctctccacctc

SEQ ID NO: 3968625 - DNA, 23 bp, Homo sapiens
gcctgcttttccaggatcctgca

SEQ ID NO: 3968626 - DNA, 21 bp, Homo sapiens
gcctggaaccagggaggagag

SEQ ID NO: 3968627 - DNA, 22 bp, Homo sapiens
gcctggaccgcttcccagaggc

SEQ ID NO: 3968628 - DNA, 13 bp, Homo sapiens
gcctggagaagct

SEQ ID NO: 3968629 - DNA, 21 bp, Homo sapiens
gcctggagatgacttgaggcc

SEQ ID NO: 3968630 - DNA, 15 bp, Homo sapiens
gcctggaggacctga

SEQ ID NO: 3968631 - DNA, 18 bp, Homo sapiens
gcctggaggacctgagcc

SEQ ID NO: 3968632 - DNA, 21 bp, Homo sapiens
gcctggaggacctgagcctgc

SEQ ID NO: 3968633 - DNA, 17 bp, Homo sapiens
gcctggagggatgccac

SEQ ID NO: 3968634 - DNA, 16 bp, Homo sapiens
gcttttaataaaattg

SEQ ID NO: 3968635 - DNA, 15 bp, Homo sapiens
gcttttgccactttg

SEQ ID NO: 3968636 - DNA, 21 bp, Homo sapiens
gcttttgccactttggcttct

SEQ ID NO: 3968637 - DNA, 15 bp, Homo sapiens
gcttttgttgtgact

SEQ ID NO: 3968638 - DNA, 19 bp, Homo sapiens
gctttttccagattcttcc

SEQ ID NO: 3968639 - DNA, 15 bp, Homo sapiens
gctttttggcacagt

SEQ ID NO: 3968640 - DNA, 16 bp, Homo sapiens
ggaaaaaaaatatata

SEQ ID NO: 3968641 - DNA, 11 bp, Homo sapiens
ggaaaaaaagc

SEQ ID NO: 3968642 - DNA, 13 bp, Homo sapiens
ggaaaaagaaaga

SEQ ID NO: 3968643 - DNA, 19 bp, Homo sapiens
ggaaaaagaaagaaacact

SEQ ID NO: 3968644 - DNA, 22 bp, Homo sapiens
ggaaaaccaagccgtggcttcc

SEQ ID NO: 3968645 - DNA, 21 bp, Homo sapiens
ggaaaagaggagtttcgaggt

SEQ ID NO: 3968646 - DNA, 12 bp, Homo sapiens
ggaaaaggcctg

SEQ ID NO: 3968647 - DNA, 16 bp, Homo sapiens
ggaaaaggcctggggt

SEQ ID NO: 3968648 - DNA, 14 bp, Homo sapiens
ggaaaagtgcaatg

SEQ ID NO: 3968649 - DNA, 15 bp, Homo sapiens
ggaaaatgcttctgt

SEQ ID NO: 3968650 - DNA, 13 bp, Homo sapiens
ggaaacagggagc

SEQ ID NO: 3968651 - DNA, 12 bp, Homo sapiens
ggaaacagggca

SEQ ID NO: 3968652 - DNA, 13 bp, Homo sapiens
ggaaacagggcag

SEQ ID NO: 3968653 - DNA, 16 bp, Homo sapiens
ggaaacagggcagtga

SEQ ID NO: 3968654 - DNA, 18 bp, Homo sapiens
ggaaaccttgcagcattt

SEQ ID NO: 3968655 - DNA, 12 bp, Homo sapiens
ggaaagagacca

SEQ ID NO: 3968656 - DNA, 11 bp, Homo sapiens
ggaaagcaggt

SEQ ID NO: 3968657 - DNA, 19 bp, Homo sapiens
ggaaagcaggtggcatctc

SEQ ID NO: 3968658 - DNA, 21 bp, Homo sapiens
ggaaagcaggtggcatctcta

SEQ ID NO: 3968659 - DNA, 13 bp, Homo sapiens
ggaaagcagtgtg

SEQ ID NO: 3968660 - DNA, 19 bp, Homo sapiens
ggaaaggaaaaccagggat

SEQ ID NO: 3968661 - DNA, 12 bp, Homo sapiens
ggaaaggaccca

SEQ ID NO: 3968662 - DNA, 20 bp, Homo sapiens
ggaaaggctctgaaagccag

SEQ ID NO: 3968663 - DNA, 23 bp, Homo sapiens
ggaaaggtcattgtggctatctg

SEQ ID NO: 3968664 - DNA, 23 bp, Homo sapiens
ggaaaggtttcaagacttgatac

SEQ ID NO: 3968665 - DNA, 22 bp, Homo sapiens
ggaaagtccccgtcccccagaa

SEQ ID NO: 3968666 - DNA, 18 bp, Homo sapiens
ggaaataaaacctttcaa

SEQ ID NO: 3968667 - DNA, 18 bp, Homo sapiens
ggaaataaacctggagat

SEQ ID NO: 3968668 - DNA, 13 bp, Homo sapiens
ggaaataaatgat

SEQ ID NO: 3968669 - DNA, 16 bp, Homo sapiens
ggaaatcaaatatgca

SEQ ID NO: 3968670 - DNA, 22 bp, Homo sapiens
ggaaatgctattgttgtgggct

SEQ ID NO: 3968671 - DNA, 14 bp, Homo sapiens
ggaaatggagggtg

SEQ ID NO: 3968672 - DNA, 16 bp, Homo sapiens
ggaacagacaggagaa

SEQ ID NO: 3968673 - DNA, 22 bp, Homo sapiens
ggaacagagactctggaagccc

SEQ ID NO: 3968674 - DNA, 17 bp, Homo sapiens
ggaacagagcgggcctc

SEQ ID NO: 3968675 - DNA, 13 bp, Homo sapiens
ggaaccagggaga

SEQ ID NO: 3968676 - DNA, 17 bp, Homo sapiens
ggaacccagccctgggg

SEQ ID NO: 3968677 - DNA, 19 bp, Homo sapiens
ggaaccccgcagcccgtga

SEQ ID NO: 3968678 - DNA, 20 bp, Homo sapiens
ggaacctagtactctctgct

SEQ ID NO: 3968679 - DNA, 23 bp, Homo sapiens
ggaacctagtactctctgctcta

SEQ ID NO: 3968680 - DNA, 17 bp, Homo sapiens
ggaacctgtactgggtt

SEQ ID NO: 3968681 - DNA, 23 bp, Homo sapiens
ggaaccttaacctctctaagcca

SEQ ID NO: 3968682 - DNA, 12 bp, Homo sapiens
ggaaccttccct

SEQ ID NO: 3968683 - DNA, 14 bp, Homo sapiens
ggaacgactgggca

SEQ ID NO: 3968684 - DNA, 14 bp, Homo sapiens
ggaacgagcactgg

SEQ ID NO: 3968685 - DNA, 21 bp, Homo sapiens
ggaacgagcactggccagaga

SEQ ID NO: 3968686 - DNA, 22 bp, Homo sapiens
ggaacgagcactggccagagag

SEQ ID NO: 3968687 - DNA, 16 bp, Homo sapiens
ggaacgcagaggcgga

SEQ ID NO: 3968688 - DNA, 19 bp, Homo sapiens
ggaactccactctccttcg

SEQ ID NO: 3968689 - DNA, 22 bp, Homo sapiens
ggaactcccagcaacacaagct

SEQ ID NO: 3968690 - DNA, 11 bp, Homo sapiens
ggaactctgac

SEQ ID NO: 3968691 - DNA, 14 bp, Homo sapiens
ggaactctgacaag

SEQ ID NO: 3968692 - DNA, 16 bp, Homo sapiens
ggaactctgacaaggg

SEQ ID NO: 3968693 - DNA, 19 bp, Homo sapiens
ggaactctggcttccaggt

SEQ ID NO: 3968694 - DNA, 12 bp, Homo sapiens
ggaactgaaggg

SEQ ID NO: 3968695 - DNA, 15 bp, Homo sapiens
ggaactgaccccctc

SEQ ID NO: 3968696 - DNA, 19 bp, Homo sapiens
ggaactggccaagctgagg

SEQ ID NO: 3968697 - DNA, 15 bp, Homo sapiens
ggaactggttcaaga

SEQ ID NO: 3968698 - DNA, 16 bp, Homo sapiens
ggaagaaagagaagga

SEQ ID NO: 3968699 - DNA, 17 bp, Homo sapiens
ggaagacaaaatgtttt

SEQ ID NO: 3968700 - DNA, 19 bp, Homo sapiens
ggaagacttgaagcacaga

SEQ ID NO: 3968701 - DNA, 12 bp, Homo sapiens
ggaagagaaatc

SEQ ID NO: 3968702 - DNA, 15 bp, Homo sapiens
ggaagagaaattttt

SEQ ID NO: 3968703 - DNA, 17 bp, Homo sapiens
ggaagagaaggagcaga

SEQ ID NO: 3968704 - DNA, 18 bp, Homo sapiens
ggaagagagagagagagg

SEQ ID NO: 3968705 - DNA, 13 bp, Homo sapiens
ggaagagcagcct

SEQ ID NO: 3968706 - DNA, 23 bp, Homo sapiens
ggaagcacatgtttatttattct

SEQ ID NO: 3968707 - DNA, 13 bp, Homo sapiens
ggaagcaggcaga

SEQ ID NO: 3968708 - DNA, 17 bp, Homo sapiens
ggaagcatgtaggagaa

SEQ ID NO: 3968709 - DNA, 20 bp, Homo sapiens
ggaagcatgtaggagaatcc

SEQ ID NO: 3968710 - DNA, 20 bp, Homo sapiens
ggaagccatattcacacctc

SEQ ID NO: 3968711 - DNA, 11 bp, Homo sapiens
ggaagccctcc

SEQ ID NO: 3968712 - DNA, 15 bp, Homo sapiens
ggaagccctccttcc

SEQ ID NO: 3968713 - DNA, 15 bp, Homo sapiens
ggaagccgtctgact

SEQ ID NO: 3968714 - DNA, 22 bp, Homo sapiens
ggaagccgtctgactccagagt

SEQ ID NO: 3968715 - DNA, 20 bp, Homo sapiens
ggaagcctccgtcaggagag

SEQ ID NO: 3968716 - DNA, 17 bp, Homo sapiens
ggaagcgaaatattaca

SEQ ID NO: 3968717 - DNA, 13 bp, Homo sapiens
ggaagctgagcag

SEQ ID NO: 3968718 - DNA, 17 bp, Homo sapiens
ggaagctgccctgccca

SEQ ID NO: 3968719 - DNA, 17 bp, Homo sapiens
ggaagctgtactcagag

SEQ ID NO: 3968720 - DNA, 19 bp, Homo sapiens
ggaagctgtactcagagca

SEQ ID NO: 3968721 - DNA, 17 bp, Homo sapiens
ggacccctcccttgctc

SEQ ID NO: 3968722 - DNA, 20 bp, Homo sapiens
ggacccgaagcccaggctga

SEQ ID NO: 3968723 - DNA, 15 bp, Homo sapiens
ggacccgctctggac

SEQ ID NO: 3968724 - DNA, 14 bp, Homo sapiens
ggaccctcgcagca

SEQ ID NO: 3968725 - DNA, 18 bp, Homo sapiens
ggaccctgttttccacac

SEQ ID NO: 3968726 - DNA, 21 bp, Homo sapiens
ggaccgcgtagagagccgggc

SEQ ID NO: 3968727 - DNA, 20 bp, Homo sapiens
ggaccgctacaccactctgg

SEQ ID NO: 3968728 - DNA, 19 bp, Homo sapiens
ggaccgcttcccagaggcc

SEQ ID NO: 3968729 - DNA, 17 bp, Homo sapiens
ggacctatgtcctaagg

SEQ ID NO: 3968730 - DNA, 12 bp, Homo sapiens
ggacctctgctc

SEQ ID NO: 3968731 - DNA, 17 bp, Homo sapiens
ggacctctgctctgagg

SEQ ID NO: 3968732 - DNA, 13 bp, Homo sapiens
ggacctgagcctg

SEQ ID NO: 3968733 - DNA, 16 bp, Homo sapiens
ggacctgttttcttca

SEQ ID NO: 3968734 - DNA, 16 bp, Homo sapiens
ggacctttggggaagg

SEQ ID NO: 3968735 - DNA, 14 bp, Homo sapiens
ggacgcttccagac

SEQ ID NO: 3968736 - DNA, 17 bp, Homo sapiens
ggacgcttccagaccac

SEQ ID NO: 3968737 - DNA, 21 bp, Homo sapiens
ggacgcttccagaccacctgc

SEQ ID NO: 3968738 - DNA, 22 bp, Homo sapiens
ggacgcttccagaccacctgcc

SEQ ID NO: 3968739 - DNA, 21 bp, Homo sapiens
ggacgtcatcggaggctgggc

SEQ ID NO: 3968740 - DNA, 22 bp, Homo sapiens
ggacgtcatcggaggctgggcc

SEQ ID NO: 3968741 - DNA, 20 bp, Homo sapiens
ggacgtcctgctggcacctc

SEQ ID NO: 3968742 - DNA, 14 bp, Homo sapiens
ggacgttggttctg

SEQ ID NO: 3968743 - DNA, 19 bp, Homo sapiens
ggactaacactcagaagcc

SEQ ID NO: 3968744 - DNA, 18 bp, Homo sapiens
ggactaacataaaatctg

SEQ ID NO: 3968745 - DNA, 19 bp, Homo sapiens
ggactaacataaaatctgt

SEQ ID NO: 3968746 - DNA, 21 bp, Homo sapiens
ggactaacataaaatctgtga

SEQ ID NO: 3968747 - DNA, 22 bp, Homo sapiens
ggactaaccccaacgcacagga

SEQ ID NO: 3968748 - DNA, 16 bp, Homo sapiens
ggactagagctttctt

SEQ ID NO: 3968749 - DNA, 14 bp, Homo sapiens
ggactattataatt

SEQ ID NO: 3968750 - DNA, 19 bp, Homo sapiens
ggactgaattgtccccagt

SEQ ID NO: 3968751 - DNA, 13 bp, Homo sapiens
ggactgagcctgg

SEQ ID NO: 3968752 - DNA, 13 bp, Homo sapiens
ggactgaggacca

SEQ ID NO: 3968753 - DNA, 14 bp, Homo sapiens
ggactgaggagtgg

SEQ ID NO: 3968754 - DNA, 21 bp, Homo sapiens
ggactgccagtccccctgccc

SEQ ID NO: 3968755 - DNA, 11 bp, Homo sapiens
ggactggctca

SEQ ID NO: 3968756 - DNA, 14 bp, Homo sapiens
ggactgtcgctgct

SEQ ID NO: 3968757 - DNA, 16 bp, Homo sapiens
ggacttcctggggccc

SEQ ID NO: 3968758 - DNA, 14 bp, Homo sapiens
ggacttctgcagct

SEQ ID NO: 3968759 - DNA, 18 bp, Homo sapiens
ggacttgaggattttgag

SEQ ID NO: 3968760 - DNA, 14 bp, Homo sapiens
ggacttgtgccagc

SEQ ID NO: 3968761 - DNA, 12 bp, Homo sapiens
ggagaaaaacaa

SEQ ID NO: 3968762 - DNA, 13 bp, Homo sapiens
ggagaaacagaga

SEQ ID NO: 3968763 - DNA, 14 bp, Homo sapiens
ggagaaaggagccg

SEQ ID NO: 3968764 - DNA, 13 bp, Homo sapiens
ggagaaataaact

SEQ ID NO: 3968765 - DNA, 22 bp, Homo sapiens
ggagaactagaacctggagggc

SEQ ID NO: 3968766 - DNA, 20 bp, Homo sapiens
ggagaagaaagaggtgaccc

SEQ ID NO: 3968767 - DNA, 15 bp, Homo sapiens
ggagaagaaatccat

SEQ ID NO: 3968768 - DNA, 15 bp, Homo sapiens
ggagaagagctgttc

SEQ ID NO: 3968769 - DNA, 19 bp, Homo sapiens
ggagaagcagtgagccgca

SEQ ID NO: 3968770 - DNA, 15 bp, Homo sapiens
ggagaagggccagcc

SEQ ID NO: 3968771 - DNA, 16 bp, Homo sapiens
ggagaagggccagccc

SEQ ID NO: 3968772 - DNA, 14 bp, Homo sapiens
ggagaattgcctct

SEQ ID NO: 3968773 - DNA, 15 bp, Homo sapiens
ggagacaaggaacca

SEQ ID NO: 3968774 - DNA, 15 bp, Homo sapiens
ggagaccgcttcacc

SEQ ID NO: 3968775 - DNA, 19 bp, Homo sapiens
ggagaccgcttcacccctg

SEQ ID NO: 3968776 - DNA, 20 bp, Homo sapiens
ggagaccgcttcacccctgc

SEQ ID NO: 3968777 - DNA, 22 bp, Homo sapiens
ggagaccgcttcacccctgcac

SEQ ID NO: 3968778 - DNA, 19 bp, Homo sapiens
ggagactcacctctgcctc

SEQ ID NO: 3968779 - DNA, 17 bp, Homo sapiens
ggagagacactcccagg

SEQ ID NO: 3968780 - DNA, 21 bp, Homo sapiens
ggagagacactcccagggaca

SEQ ID NO: 3968781 - DNA, 22 bp, Homo sapiens
ggagagactctgaggacatgga

SEQ ID NO: 3968782 - DNA, 20 bp, Homo sapiens
ggagagactgaaagcagcag

SEQ ID NO: 3968783 - DNA, 22 bp, Homo sapiens
ggagagactgaaagcagcagct

SEQ ID NO: 3968784 - DNA, 19 bp, Homo sapiens
ggagagagacgtgtacata

SEQ ID NO: 3968785 - DNA, 14 bp, Homo sapiens
ggagagaggggaat

SEQ ID NO: 3968786 - DNA, 20 bp, Homo sapiens
ggagagcaccttaatattat

SEQ ID NO: 3968787 - DNA, 10 bp, Homo sapiens
ggagagcagc

SEQ ID NO: 3968788 - DNA, 13 bp, Homo sapiens
ggagagcagctgg

SEQ ID NO: 3968789 - DNA, 20 bp, Homo sapiens
ggagagccagaacctggagg

SEQ ID NO: 3968790 - DNA, 21 bp, Homo sapiens
ggagagccagaacctggaggg

SEQ ID NO: 3968791 - DNA, 14 bp, Homo sapiens
ggagagccagccct

SEQ ID NO: 3968792 - DNA, 14 bp, Homo sapiens
ggagagccagctct

SEQ ID NO: 3968793 - DNA, 15 bp, Homo sapiens
ggagagccagctctc

SEQ ID NO: 3968794 - DNA, 20 bp, Homo sapiens
ggagagctagaacccggcag

SEQ ID NO: 3968795 - DNA, 20 bp, Homo sapiens
ggagagctagaacctggagg

SEQ ID NO: 3968796 - DNA, 21 bp, Homo sapiens
ggagagctagaacctggaggg

SEQ ID NO: 3968797 - DNA, 12 bp, Homo sapiens
ggagagctagga

SEQ ID NO: 3968798 - DNA, 16 bp, Homo sapiens
ggagaggcggcctcgt

SEQ ID NO: 3968799 - DNA, 21 bp, Homo sapiens
ggagaggcggcctcgtgccat

SEQ ID NO: 3968800 - DNA, 21 bp, Homo sapiens
ggagaggctagaaccaagaag

SEQ ID NO: 3968801 - DNA, 22 bp, Homo sapiens
ggagaggggaagggccagtctg

SEQ ID NO: 3968802 - DNA, 12 bp, Homo sapiens
ggagaggggcct

SEQ ID NO: 3968803 - DNA, 19 bp, Homo sapiens
ggagaggggcctgggaaag

SEQ ID NO: 3968804 - DNA, 19 bp, Homo sapiens
ggagaggggtgcacccact

SEQ ID NO: 3968805 - DNA, 20 bp, Homo sapiens
ggagagggtctggagaagca

SEQ ID NO: 3968806 - DNA, 21 bp, Homo sapiens
ggagagggtctggagaagcag

SEQ ID NO: 3968807 - DNA, 13 bp, Homo sapiens
ggagcaaagcctg

SEQ ID NO: 3968808 - DNA, 13 bp, Homo sapiens
ggaggttgtggat

SEQ ID NO: 3968809 - DNA, 14 bp, Homo sapiens
ggaggttgtggatg

SEQ ID NO: 3968810 - DNA, 15 bp, Homo sapiens
ggagtagctgagagg

SEQ ID NO: 3968811 - DNA, 14 bp, Homo sapiens
ggagtagctgagct

SEQ ID NO: 3968812 - DNA, 15 bp, Homo sapiens
ggagtagctgagctc

SEQ ID NO: 3968813 - DNA, 21 bp, Homo sapiens
ggagtcagtaggtccaagggc

SEQ ID NO: 3968814 - DNA, 19 bp, Homo sapiens
ggagtctgaggtcctgagc

SEQ ID NO: 3968815 - DNA, 12 bp, Homo sapiens
ggagtctgagtc

SEQ ID NO: 3968816 - DNA, 16 bp, Homo sapiens
ggagtctgagtctgag

SEQ ID NO: 3968817 - DNA, 20 bp, Homo sapiens
ggagtgacgggagcctcctc

SEQ ID NO: 3968818 - DNA, 18 bp, Homo sapiens
ggagtgaggcttccaggc

SEQ ID NO: 3968819 - DNA, 19 bp, Homo sapiens
ggagtgaggcttccaggct

SEQ ID NO: 3968820 - DNA, 20 bp, Homo sapiens
ggagtgaggcttccaggctc

SEQ ID NO: 3968821 - DNA, 22 bp, Homo sapiens
ggagtgaggcttccaggctctt

SEQ ID NO: 3968822 - DNA, 13 bp, Homo sapiens
ggagtgggggctg

SEQ ID NO: 3968823 - DNA, 21 bp, Homo sapiens
ggagtgtgggtgatcagaagg

SEQ ID NO: 3968824 - DNA, 19 bp, Homo sapiens
ggagtgttctgtttcccat

SEQ ID NO: 3968825 - DNA, 22 bp, Homo sapiens
ggagttagaaatctccagtgtg

SEQ ID NO: 3968826 - DNA, 14 bp, Homo sapiens
ggagttccatgaag

SEQ ID NO: 3968827 - DNA, 14 bp, Homo sapiens
ggagttgagtacag

SEQ ID NO: 3968828 - DNA, 20 bp, Homo sapiens
ggagttgctcactcaggact

SEQ ID NO: 3968829 - DNA, 23 bp, Homo sapiens
ggagttgctcactcaggactttg

SEQ ID NO: 3968830 - DNA, 21 bp, Homo sapiens
ggagtttgagacaagccctgg

SEQ ID NO: 3968831 - DNA, 22 bp, Homo sapiens
ggatcaaaccccgaccacctgc

SEQ ID NO: 3968832 - DNA, 13 bp, Homo sapiens
ggatcacagggcc

SEQ ID NO: 3968833 - DNA, 16 bp, Homo sapiens
ggatcagaacagcaga

SEQ ID NO: 3968834 - DNA, 11 bp, Homo sapiens
ggatcagcctc

SEQ ID NO: 3968835 - DNA, 12 bp, Homo sapiens
ggatcagcctcc

SEQ ID NO: 3968836 - DNA, 22 bp, Homo sapiens
ggatcagcctccgccattccaa

SEQ ID NO: 3968837 - DNA, 13 bp, Homo sapiens
ggatcagcgtggc

SEQ ID NO: 3968838 - DNA, 18 bp, Homo sapiens
ggatcagcgtggccttgt

SEQ ID NO: 3968839 - DNA, 19 bp, Homo sapiens
ggatccagagacttgggga

SEQ ID NO: 3968840 - DNA, 12 bp, Homo sapiens
ggatccctccca

SEQ ID NO: 3968841 - DNA, 14 bp, Homo sapiens
ggatccgctgccac

SEQ ID NO: 3968842 - DNA, 20 bp, Homo sapiens
ggatcctattctcaccagga

SEQ ID NO: 3968843 - DNA, 23 bp, Homo sapiens
ggatcctattctcaccaggaagg

SEQ ID NO: 3968844 - DNA, 14 bp, Homo sapiens
ggatcctgctgtgg

SEQ ID NO: 3968845 - DNA, 21 bp, Homo sapiens
ggatcctgctgtggcctcact

SEQ ID NO: 3968846 - DNA, 21 bp, Homo sapiens
ggatctagcttcatgcctcag

SEQ ID NO: 3968847 - DNA, 18 bp, Homo sapiens
ggatctatgcaattttta

SEQ ID NO: 3968848 - DNA, 13 bp, Homo sapiens
ggatctccaagga

SEQ ID NO: 3968849 - DNA, 14 bp, Homo sapiens
ggatctccaaggac

SEQ ID NO: 3968850 - DNA, 13 bp, Homo sapiens
ggatctctcagga

SEQ ID NO: 3968851 - DNA, 22 bp, Homo sapiens
ggatctctcaggagcacaggca

SEQ ID NO: 3968852 - DNA, 18 bp, Homo sapiens
ggatctgcattccccgct

SEQ ID NO: 3968853 - DNA, 23 bp, Homo sapiens
ggatctgggaccctttccttcct

SEQ ID NO: 3968854 - DNA, 15 bp, Homo sapiens
ggatctgtccaagga

SEQ ID NO: 3968855 - DNA, 16 bp, Homo sapiens
ggatctgtccaaggaa

SEQ ID NO: 3968856 - DNA, 17 bp, Homo sapiens
ggatgaaattttctaga

SEQ ID NO: 3968857 - DNA, 23 bp, Homo sapiens
ggatgccaacaccttcttggctt

SEQ ID NO: 3968858 - DNA, 14 bp, Homo sapiens
ggatgccacagccc

SEQ ID NO: 3968859 - DNA, 21 bp, Homo sapiens
ggatgccacagccccacagca

SEQ ID NO: 3968860 - DNA, 22 bp, Homo sapiens
ggatgccacagccccacagcac

SEQ ID NO: 3968861 - DNA, 19 bp, Homo sapiens
ggatgctccagggcagcct

SEQ ID NO: 3968862 - DNA, 15 bp, Homo sapiens
ggatggaaggagact

SEQ ID NO: 3968863 - DNA, 19 bp, Homo sapiens
ggatggacagaatgatgga

SEQ ID NO: 3968864 - DNA, 19 bp, Homo sapiens
ggatggaccctcgcagcag

SEQ ID NO: 3968865 - DNA, 16 bp, Homo sapiens
ggatggaggagaaata

SEQ ID NO: 3968866 - DNA, 17 bp, Homo sapiens
ggatggaggagaaataa

SEQ ID NO: 3968867 - DNA, 14 bp, Homo sapiens
ggatggatggacag

SEQ ID NO: 3968868 - DNA, 16 bp, Homo sapiens
ggatggatggacagaa

SEQ ID NO: 3968869 - DNA, 12 bp, Homo sapiens
ggatgggaagat

SEQ ID NO: 3968870 - DNA, 15 bp, Homo sapiens
ggatgggaccaggga

SEQ ID NO: 3968871 - DNA, 23 bp, Homo sapiens
ggatgggcattgggctgacacct

SEQ ID NO: 3968872 - DNA, 17 bp, Homo sapiens
ggatgggggatgggcca

SEQ ID NO: 3968873 - DNA, 11 bp, Homo sapiens
ggatgtagaac

SEQ ID NO: 3968874 - DNA, 21 bp, Homo sapiens
ggatgtcccctgtcccaccaa

SEQ ID NO: 3968875 - DNA, 22 bp, Homo sapiens
ggatgtgaattgcctgcagaga

SEQ ID NO: 3968876 - DNA, 15 bp, Homo sapiens
ggatgtgggagggag

SEQ ID NO: 3968877 - DNA, 14 bp, Homo sapiens
ggattacaggcctt

SEQ ID NO: 3968878 - DNA, 17 bp, Homo sapiens
ggattagggagagaaga

SEQ ID NO: 3968879 - DNA, 17 bp, Homo sapiens
ggattattcatttaaaa

SEQ ID NO: 3968880 - DNA, 19 bp, Homo sapiens
ggattattcatttaaaatg

SEQ ID NO: 3968881 - DNA, 20 bp, Homo sapiens
ggattcaggaaaaggcctgg

SEQ ID NO: 3968882 - DNA, 21 bp, Homo sapiens
ggattcaggaaaaggcctggg

SEQ ID NO: 3968883 - DNA, 18 bp, Homo sapiens
ggattcctgggcaagaac

SEQ ID NO: 3968884 - DNA, 16 bp, Homo sapiens
ggatttcctattttaa

SEQ ID NO: 3968885 - DNA, 16 bp, Homo sapiens
gccttcctcctccaca

SEQ ID NO: 3968886 - DNA, 19 bp, Homo sapiens
gccttcctcctccacagtg

SEQ ID NO: 3968887 - DNA, 23 bp, Homo sapiens
gccttcgatacaccgggcctgga

SEQ ID NO: 3968888 - DNA, 19 bp, Homo sapiens
gccttcttattctcactcc

SEQ ID NO: 3968889 - DNA, 20 bp, Homo sapiens
gccttcttattctcactcca

SEQ ID NO: 3968890 - DNA, 21 bp, Homo sapiens
gccttcttattctcactccac

SEQ ID NO: 3968891 - DNA, 15 bp, Homo sapiens
gccttcttcacccag

SEQ ID NO: 3968892 - DNA, 12 bp, Homo sapiens
gccttgcccaga

SEQ ID NO: 3968893 - DNA, 14 bp, Homo sapiens
gccttgcccagaga

SEQ ID NO: 3968894 - DNA, 16 bp, Homo sapiens
gccttgcccgccagcc

SEQ ID NO: 3968895 - DNA, 16 bp, Homo sapiens
gccttggtgtccacct

SEQ ID NO: 3968896 - DNA, 17 bp, Homo sapiens
gccttggtgtccacctg

SEQ ID NO: 3968897 - DNA, 19 bp, Homo sapiens
gccttggtgtccacctggc

SEQ ID NO: 3968898 - DNA, 21 bp, Homo sapiens
gccttggtgtccacctggccc

SEQ ID NO: 3968899 - DNA, 14 bp, Homo sapiens
gccttgtcaggacc

SEQ ID NO: 3968900 - DNA, 19 bp, Homo sapiens
gccttgtcaggacccaggc

SEQ ID NO: 3968901 - DNA, 15 bp, Homo sapiens
gccttgtgccctgcc

SEQ ID NO: 3968902 - DNA, 22 bp, Homo sapiens
gccttgttttattcaaagacag

SEQ ID NO: 3968903 - DNA, 13 bp, Homo sapiens
gcctttcctgtgc

SEQ ID NO: 3968904 - DNA, 19 bp, Homo sapiens
gcctttcctgtgccaacct

SEQ ID NO: 3968905 - DNA, 21 bp, Homo sapiens
gcctttcctgtgccaacctga

SEQ ID NO: 3968906 - DNA, 22 bp, Homo sapiens
gcctttctcgtggtagaagcca

SEQ ID NO: 3968907 - DNA, 20 bp, Homo sapiens
gcctttctctggctccagaa

SEQ ID NO: 3968908 - DNA, 19 bp, Homo sapiens
gcctttgaaattcccccac

SEQ ID NO: 3968909 - DNA, 21 bp, Homo sapiens
gcctttgaaattcccccactt

SEQ ID NO: 3968910 - DNA, 16 bp, Homo sapiens
gcctttggaagaaaca

SEQ ID NO: 3968911 - DNA, 14 bp, Homo sapiens
gccttttgtttaaa

SEQ ID NO: 3968912 - DNA, 19 bp, Homo sapiens
gccttttttcacagcccgg

SEQ ID NO: 3968913 - DNA, 20 bp, Homo sapiens
gcgaaaacttgaatctgtta

SEQ ID NO: 3968914 - DNA, 23 bp, Homo sapiens
gcgaaaggatgtaaacagtgcct

SEQ ID NO: 3968915 - DNA, 17 bp, Homo sapiens
gcgaagtggctctcagg

SEQ ID NO: 3968916 - DNA, 11 bp, Homo sapiens
gcgaataaatg

SEQ ID NO: 3968917 - DNA, 15 bp, Homo sapiens
gcgaataaatgttca

SEQ ID NO: 3968918 - DNA, 16 bp, Homo sapiens
gcgaataaatgttcaa

SEQ ID NO: 3968919 - DNA, 19 bp, Homo sapiens
gcgaggtcaacagagaagg

SEQ ID NO: 3968920 - DNA, 22 bp, Homo sapiens
gcgaggtcaacagagaaggcag

SEQ ID NO: 3968921 - DNA, 23 bp, Homo sapiens
gcgaggtcaacagagaaggcagg

SEQ ID NO: 3968922 - DNA, 14 bp, Homo sapiens
gcgaggtgtaaagt

SEQ ID NO: 3968923 - DNA, 21 bp, Homo sapiens
gcgagtgccaggactccccag

SEQ ID NO: 3968924 - DNA, 22 bp, Homo sapiens
gcgataaaactaaatatatgtc

SEQ ID NO: 3968925 - DNA, 15 bp, Homo sapiens
gcgatcaagtccaga

SEQ ID NO: 3968926 - DNA, 17 bp, Homo sapiens
gcgatcaagtccagagc

SEQ ID NO: 3968927 - DNA, 14 bp, Homo sapiens
gcgattccctctca

SEQ ID NO: 3968928 - DNA, 18 bp, Homo sapiens
gcgattccctctcccagg

SEQ ID NO: 3968929 - DNA, 18 bp, Homo sapiens
gcgattcttgtgcctcag

SEQ ID NO: 3968930 - DNA, 18 bp, Homo sapiens
gcgcaacaacaaggaccc

SEQ ID NO: 3968931 - DNA, 17 bp, Homo sapiens
gcgcacaaggctgacca

SEQ ID NO: 3968932 - DNA, 23 bp, Homo sapiens
gcgcacctatcacccaggctgga

SEQ ID NO: 3968933 - DNA, 17 bp, Homo sapiens
gcgcagagtaaaataag

SEQ ID NO: 3968934 - DNA, 18 bp, Homo sapiens
gcgcagcgcgtgcacagc

SEQ ID NO: 3968935 - DNA, 21 bp, Homo sapiens
gcgcagggaggatgccacagc

SEQ ID NO: 3968936 - DNA, 22 bp, Homo sapiens
gcgcagggaggatgccacagcc

SEQ ID NO: 3968937 - DNA, 16 bp, Homo sapiens
gcgcatctcttcctga

SEQ ID NO: 3968938 - DNA, 16 bp, Homo sapiens
gcgcatgtgccagttg

SEQ ID NO: 3968939 - DNA, 14 bp, Homo sapiens
gcgccaccatcctg

SEQ ID NO: 3968940 - DNA, 21 bp, Homo sapiens
gcgccccaacccgtggaggct

SEQ ID NO: 3968941 - DNA, 18 bp, Homo sapiens
gcgcgggcggaggcggct

SEQ ID NO: 3968942 - DNA, 10 bp, Homo sapiens
gcgctcagga

SEQ ID NO: 3968943 - DNA, 14 bp, Homo sapiens
gcgctcaggaccca

SEQ ID NO: 3968944 - DNA, 19 bp, Homo sapiens
gcgctcaggacccaggccc

SEQ ID NO: 3968945 - DNA, 15 bp, Homo sapiens
gcgctctcttccaga

SEQ ID NO: 3968946 - DNA, 21 bp, Homo sapiens
gcgctggctcaggaagaaacc

SEQ ID NO: 3968947 - DNA, 22 bp, Homo sapiens
gcgctttctggaaaagaggagt

SEQ ID NO: 3968948 - DNA, 16 bp, Homo sapiens
gcggaaaccttgcagc

SEQ ID NO: 3968949 - DNA, 16 bp, Homo sapiens
gcggaaaggagatggg

SEQ ID NO: 3968950 - DNA, 18 bp, Homo sapiens
gcggagaccctgagtccg

SEQ ID NO: 3968951 - DNA, 16 bp, Homo sapiens
gcggagagtacagtga

SEQ ID NO: 3968952 - DNA, 19 bp, Homo sapiens
gcggagcttgcagtgagcc

SEQ ID NO: 3968953 - DNA, 20 bp, Homo sapiens
gcggagcttgcagtgagccg

SEQ ID NO: 3968954 - DNA, 16 bp, Homo sapiens
gcggaggagctccgct

SEQ ID NO: 3968955 - DNA, 23 bp, Homo sapiens
gcggcaggagcaggaacagagac

SEQ ID NO: 3968956 - DNA, 21 bp, Homo sapiens
gcggcagggtgggggagggag

SEQ ID NO: 3968957 - DNA, 15 bp, Homo sapiens
gcggccgcattccct

SEQ ID NO: 3968958 - DNA, 16 bp, Homo sapiens
gcggccgcattccctg

SEQ ID NO: 3968959 - DNA, 18 bp, Homo sapiens
gcggccgcattccctgag

SEQ ID NO: 3968960 - DNA, 16 bp, Homo sapiens
gcggccgggctgccct

SEQ ID NO: 3968961 - DNA, 18 bp, Homo sapiens
gcggcctatgacttgggc

SEQ ID NO: 3968962 - DNA, 22 bp, Homo sapiens
gcggcctcgtgccatgatctgt

SEQ ID NO: 3968963 - DNA, 12 bp, Homo sapiens
gcggcgcagagg

SEQ ID NO: 3968964 - DNA, 22 bp, Homo sapiens
gcggcggtggactgcgctggac

SEQ ID NO: 3968965 - DNA, 21 bp, Homo sapiens
gcggctactcagcagccctcc

SEQ ID NO: 3968966 - DNA, 22 bp, Homo sapiens
gcggctactcagcagccctcct

SEQ ID NO: 3968967 - DNA, 15 bp, Homo sapiens
gcggcttcctgtcca

SEQ ID NO: 3968968 - DNA, 22 bp, Homo sapiens
gcggcttcctgtccactctcgg

SEQ ID NO: 3968969 - DNA, 16 bp, Homo sapiens
gcggcttggccgccat

SEQ ID NO: 3968970 - DNA, 15 bp, Homo sapiens
gcgggaggcaccagc

SEQ ID NO: 3968971 - DNA, 18 bp, Homo sapiens
gcgggaggcaccagctct

SEQ ID NO: 3968972 - DNA, 17 bp, Homo sapiens
gcggggcaggaggcctg

SEQ ID NO: 3968973 - DNA, 21 bp, Homo sapiens
gcggggcaggaggcctggcct

SEQ ID NO: 3968974 - DNA, 17 bp, Homo sapiens
gcgggggagccaacagc

SEQ ID NO: 3968975 - DNA, 14 bp, Homo sapiens
gcgggggagctgga

SEQ ID NO: 3968976 - DNA, 13 bp, Homo sapiens
gcggggtgcagaa

SEQ ID NO: 3968977 - DNA, 19 bp, Homo sapiens
gcggtcatgtgtgcatgtg

SEQ ID NO: 3968978 - DNA, 12 bp, Homo sapiens
gcggtgctctgg

SEQ ID NO: 3968979 - DNA, 21 bp, Homo sapiens
gcggtgctctggcggcttcct

SEQ ID NO: 3968980 - DNA, 22 bp, Homo sapiens
gcggtgctctggcggcttcctg

SEQ ID NO: 3968981 - DNA, 17 bp, Homo sapiens
gcggtggtgccagaggt

SEQ ID NO: 3968982 - DNA, 15 bp, Homo sapiens
gcgtagagagccggg

SEQ ID NO: 3968983 - DNA, 20 bp, Homo sapiens
gcgtatatgtgcgtctctct

SEQ ID NO: 3968984 - DNA, 20 bp, Homo sapiens
gcgtcccctgctactcctgt

SEQ ID NO: 3968985 - DNA, 16 bp, Homo sapiens
gcgtccctagcagtga

SEQ ID NO: 3968986 - DNA, 18 bp, Homo sapiens
gcgtcctgacgccctgcg

SEQ ID NO: 3968987 - DNA, 13 bp, Homo sapiens
gcgtcctgcagag

SEQ ID NO: 3968988 - DNA, 20 bp, Homo sapiens
gcgtcgctggacaacccaga

SEQ ID NO: 3968989 - DNA, 21 bp, Homo sapiens
gcgtctctctttctccctcac

SEQ ID NO: 3968990 - DNA, 22 bp, Homo sapiens
gcgtctctctttctccctcacc

SEQ ID NO: 3968991 - DNA, 23 bp, Homo sapiens
gcgtctctctttctccctcaccc

SEQ ID NO: 3968992 - DNA, 15 bp, Homo sapiens
gcgtctgccccaccc

SEQ ID NO: 3968993 - DNA, 13 bp, Homo sapiens
gcgtgactcaccc

SEQ ID NO: 3968994 - DNA, 16 bp, Homo sapiens
gcgtgactcacccaag

SEQ ID NO: 3968995 - DNA, 18 bp, Homo sapiens
gcgtgcaaggggctcagc

SEQ ID NO: 3968996 - DNA, 16 bp, Homo sapiens
gcgtgcaccaccatgc

SEQ ID NO: 3968997 - DNA, 23 bp, Homo sapiens
gcgtgcgtgttagtgtgtgtgca

SEQ ID NO: 3968998 - DNA, 22 bp, Homo sapiens
gcgtggaccacccgccctggca

SEQ ID NO: 3968999 - DNA, 19 bp, Homo sapiens
gcgtggctgtggcacagac

SEQ ID NO: 3969000 - DNA, 13 bp, Homo sapiens
gcgtgtgcacgtg

SEQ ID NO: 3969001 - DNA, 21 bp, Homo sapiens
gcgtgttagtgtgtgtgcatg

SEQ ID NO: 3969002 - DNA, 22 bp, Homo sapiens
gcgtgttagtgtgtgtgcatgt

SEQ ID NO: 3969003 - DNA, 17 bp, Homo sapiens
gcgttacaacagtaaca

SEQ ID NO: 3969004 - DNA, 14 bp, Homo sapiens
gcgttggagccact

SEQ ID NO: 3969005 - DNA, 15 bp, Homo sapiens
gcgttggagccactc

SEQ ID NO: 3969006 - DNA, 21 bp, Homo sapiens
gcgttggagccactcctgtcc

SEQ ID NO: 3969007 - DNA, 23 bp, Homo sapiens
gcgttggtgccacttcttaaagg

SEQ ID NO: 3969008 - DNA, 21 bp, Homo sapiens
gcgtttagtttctagaggcct

SEQ ID NO: 3969009 - DNA, 23 bp, Homo sapiens
gcgtttagtttctagaggcctca

SEQ ID NO: 3969010 - DNA, 14 bp, Homo sapiens
gctaaaacctgagc

SEQ ID NO: 3969011 - DNA, 16 bp, Homo sapiens
gctaaaacctgagcta

SEQ ID NO: 3969012 - DNA, 20 bp, Homo sapiens
gctaaacgactccgagaaca

SEQ ID NO: 3969013 - DNA, 15 bp, Homo sapiens
gctaaatactgtaca

SEQ ID NO: 3969014 - DNA, 18 bp, Homo sapiens
gctaaatactgtacatag

SEQ ID NO: 3969015 - DNA, 19 bp, Homo sapiens
gctaaatactgtacataga

SEQ ID NO: 3969016 - DNA, 12 bp, Homo sapiens
gctaaatgcaaa

SEQ ID NO: 3969017 - DNA, 13 bp, Homo sapiens
gctaaatgcaaac

SEQ ID NO: 3969018 - DNA, 19 bp, Homo sapiens
gctaacacgtgaaaccccg

SEQ ID NO: 3969019 - DNA, 18 bp, Homo sapiens
gctaacagggaaggcagg

SEQ ID NO: 3969020 - DNA, 21 bp, Homo sapiens
gctaactccagtctcctgaca

SEQ ID NO: 3969021 - DNA, 13 bp, Homo sapiens
gctaactggaagc

SEQ ID NO: 3969022 - DNA, 18 bp, Homo sapiens
gctaagacctccccaccc

SEQ ID NO: 3969023 - DNA, 20 bp, Homo sapiens
gctaagagctagcgctgccg

SEQ ID NO: 3969024 - DNA, 15 bp, Homo sapiens
gctaagctaggaatg

SEQ ID NO: 3969025 - DNA, 19 bp, Homo sapiens
gctaagctaggaatgaaat

SEQ ID NO: 3969026 - DNA, 13 bp, Homo sapiens
gctaagttctaag

SEQ ID NO: 3969027 - DNA, 14 bp, Homo sapiens
gctaatcagcattc

SEQ ID NO: 3969028 - DNA, 16 bp, Homo sapiens
gctaatcagcattctc

SEQ ID NO: 3969029 - DNA, 22 bp, Homo sapiens
gctaatctgtagggctggacct

SEQ ID NO: 3969030 - DNA, 21 bp, Homo sapiens
gctaattaaggtttgccctgc

SEQ ID NO: 3969031 - DNA, 15 bp, Homo sapiens
gctaatttttatatt

SEQ ID NO: 3969032 - DNA, 15 bp, Homo sapiens
gctacaataaatgct

SEQ ID NO: 3969033 - DNA, 22 bp, Homo sapiens
gctacaccactctggcagccac

SEQ ID NO: 3969034 - DNA, 11 bp, Homo sapiens
gctacattcct

SEQ ID NO: 3969035 - DNA, 19 bp, Homo sapiens
gctacattcctcagctgcc

SEQ ID NO: 3969036 - DNA, 20 bp, Homo sapiens
gctaccaaagcaccttagct

SEQ ID NO: 3969037 - DNA, 17 bp, Homo sapiens
gctacctgtgtggacag

SEQ ID NO: 3969038 - DNA, 19 bp, Homo sapiens
gctactacccgagcccagc

SEQ ID NO: 3969039 - DNA, 22 bp, Homo sapiens
gctactcagcagccctcctcac

SEQ ID NO: 3969040 - DNA, 15 bp, Homo sapiens
gctactcaggaggct

SEQ ID NO: 3969041 - DNA, 14 bp, Homo sapiens
gctactctcttgcc

SEQ ID NO: 3969042 - DNA, 17 bp, Homo sapiens
gctactctgtccaggcc

SEQ ID NO: 3969043 - DNA, 18 bp, Homo sapiens
gctactctgtccaggcca

SEQ ID NO: 3969044 - DNA, 21 bp, Homo sapiens
gctactctgtccaggccactg

SEQ ID NO: 3969045 - DNA, 17 bp, Homo sapiens
gctactctgtgccagag

SEQ ID NO: 3969046 - DNA, 18 bp, Homo sapiens
gctactctgtgccagagc

SEQ ID NO: 3969047 - DNA, 21 bp, Homo sapiens
gctactctgtgccagagcctg

SEQ ID NO: 3969048 - DNA, 14 bp, Homo sapiens
gctactcttcagaa

SEQ ID NO: 3969049 - DNA, 17 bp, Homo sapiens
gctactgatttttgtga

SEQ ID NO: 3969050 - DNA, 18 bp, Homo sapiens
gctactgcagctttacat

SEQ ID NO: 3969051 - DNA, 19 bp, Homo sapiens
gctactgcagctttacatg

SEQ ID NO: 3969052 - DNA, 15 bp, Homo sapiens
gctactggcagctcc

SEQ ID NO: 3969053 - DNA, 17 bp, Homo sapiens
gctactggcagctcctc

SEQ ID NO: 3969054 - DNA, 19 bp, Homo sapiens
gctactggcagctcctctc

SEQ ID NO: 3969055 - DNA, 15 bp, Homo sapiens
gctactgtcagctcc

SEQ ID NO: 3969056 - DNA, 21 bp, Homo sapiens
gctacttaagagaaatggcaa

SEQ ID NO: 3969057 - DNA, 15 bp, Homo sapiens
gctagaacctggagg

SEQ ID NO: 3969058 - DNA, 20 bp, Homo sapiens
gctagaacctgtagagctag

SEQ ID NO: 3969059 - DNA, 14 bp, Homo sapiens
gctagaagctggag

SEQ ID NO: 3969060 - DNA, 17 bp, Homo sapiens
gctagaaggccacatgt

SEQ ID NO: 3969061 - DNA, 20 bp, Homo sapiens
gctagaagtgggccaggaca

SEQ ID NO: 3969062 - DNA, 21 bp, Homo sapiens
gctagaagtgggccaggacag

SEQ ID NO: 3969063 - DNA, 20 bp, Homo sapiens
gctagagcaacccctgtacc

SEQ ID NO: 3969064 - DNA, 21 bp, Homo sapiens
gctagagcaacccctgtaccc

SEQ ID NO: 3969065 - DNA, 23 bp, Homo sapiens
gctagagcagcccaaatttttct

SEQ ID NO: 3969066 - DNA, 14 bp, Homo sapiens
gctagcgctgccgc

SEQ ID NO: 3969067 - DNA, 13 bp, Homo sapiens
gctagctgtagaa

SEQ ID NO: 3969068 - DNA, 13 bp, Homo sapiens
gctaggaatgaaa

SEQ ID NO: 3969069 - DNA, 18 bp, Homo sapiens
gctaggaatgaaatcctg

SEQ ID NO: 3969070 - DNA, 18 bp, Homo sapiens
gctaggactgaggagtgg

SEQ ID NO: 3969071 - DNA, 16 bp, Homo sapiens
gctaggagcaaagcct

SEQ ID NO: 3969072 - DNA, 16 bp, Homo sapiens
gctaggcgagtgccag

SEQ ID NO: 3969073 - DNA, 12 bp, Homo sapiens
gctagggctgga

SEQ ID NO: 3969074 - DNA, 18 bp, Homo sapiens
gctaggggctggtccttc

SEQ ID NO: 3969075 - DNA, 20 bp, Homo sapiens
gctagtaccctatagagagg

SEQ ID NO: 3969076 - DNA, 20 bp, Homo sapiens
gctagtgtgagtggcagcca

SEQ ID NO: 3969077 - DNA, 21 bp, Homo sapiens
gctagtgtgagtggcagccat

SEQ ID NO: 3969078 - DNA, 13 bp, Homo sapiens
gctatatatataa

SEQ ID NO: 3969079 - DNA, 14 bp, Homo sapiens
gctatatatataaa

SEQ ID NO: 3969080 - DNA, 16 bp, Homo sapiens
gctatatatataaata

SEQ ID NO: 3969081 - DNA, 22 bp, Homo sapiens
gctatattttcatgacttttcc

SEQ ID NO: 3969082 - DNA, 23 bp, Homo sapiens
gctatcaaaataaattgaaatat

SEQ ID NO: 3969083 - DNA, 13 bp, Homo sapiens
gctatcacacagt

SEQ ID NO: 3969084 - DNA, 18 bp, Homo sapiens
gctatcctagagaggctg

SEQ ID NO: 3969085 - DNA, 21 bp, Homo sapiens
gctatctgcatttataaatgt

SEQ ID NO: 3969086 - DNA, 14 bp, Homo sapiens
gctatgacatgcaa

SEQ ID NO: 3969087 - DNA, 20 bp, Homo sapiens
gctatgattatgccactgct

SEQ ID NO: 3969088 - DNA, 15 bp, Homo sapiens
gctatggcaaggggg

SEQ ID NO: 3969089 - DNA, 18 bp, Homo sapiens
gctattattttcactgta

SEQ ID NO: 3969090 - DNA, 12 bp, Homo sapiens
gctattctgtgt

SEQ ID NO: 3969091 - DNA, 12 bp, Homo sapiens
gctattgaaatt

SEQ ID NO: 3969092 - DNA, 21 bp, Homo sapiens
gctattgcatgtaaaatgcag

SEQ ID NO: 3969093 - DNA, 22 bp, Homo sapiens
gctatttgtttacatgcagatt

SEQ ID NO: 3969094 - DNA, 17 bp, Homo sapiens
gctattttatttgtatt

SEQ ID NO: 3969095 - DNA, 21 bp, Homo sapiens
gctattttcttacagtggagt

SEQ ID NO: 3969096 - DNA, 13 bp, Homo sapiens
gctcaaaaagttt

SEQ ID NO: 3969097 - DNA, 14 bp, Homo sapiens
gctcaaatctattc

SEQ ID NO: 3969098 - DNA, 17 bp, Homo sapiens
gctcaaatctattcaga

SEQ ID NO: 3969099 - DNA, 20 bp, Homo sapiens
gctcaaatctattcagacaa

SEQ ID NO: 3969100 - DNA, 21 bp, Homo sapiens
gctcaagaagacatggagact

SEQ ID NO: 3969101 - DNA, 15 bp, Homo sapiens
gctcaagaggcccag

SEQ ID NO: 3969102 - DNA, 17 bp, Homo sapiens
gctcaagaggcccaggg

SEQ ID NO: 3969103 - DNA, 19 bp, Homo sapiens
gctcaagaggcccagggag

SEQ ID NO: 3969104 - DNA, 21 bp, Homo sapiens
gctcaagaggcccagggagca

SEQ ID NO: 3969105 - DNA, 17 bp, Homo sapiens
gctcaagtcttccctga

SEQ ID NO: 3969106 - DNA, 20 bp, Homo sapiens
gctcaagtcttccctgatca

SEQ ID NO: 3969107 - DNA, 14 bp, Homo sapiens
gctcacaagcccag

SEQ ID NO: 3969108 - DNA, 16 bp, Homo sapiens
gctcacaagcccaggc

SEQ ID NO: 3969109 - DNA, 18 bp, Homo sapiens
gctcacaagcccaggctg

SEQ ID NO: 3969110 - DNA, 13 bp, Homo sapiens
gctcacaaggcag

SEQ ID NO: 3969111 - DNA, 15 bp, Homo sapiens
gctcacaaggcagca

SEQ ID NO: 3969112 - DNA, 20 bp, Homo sapiens
gctcacaaggcagcaaggcc

SEQ ID NO: 3969113 - DNA, 22 bp, Homo sapiens
gctcacagaacccttggagcca

SEQ ID NO: 3969114 - DNA, 20 bp, Homo sapiens
gctcacagtacaatgtttca

SEQ ID NO: 3969115 - DNA, 13 bp, Homo sapiens
gctcacagttcct

SEQ ID NO: 3969116 - DNA, 16 bp, Homo sapiens
gctcacagttcctcgc

SEQ ID NO: 3969117 - DNA, 14 bp, Homo sapiens
gctcacctctgaag

SEQ ID NO: 3969118 - DNA, 13 bp, Homo sapiens
gctcacctttgtt

SEQ ID NO: 3969119 - DNA, 21 bp, Homo sapiens
gctcacgcctgtaatcccagc

SEQ ID NO: 3969120 - DNA, 22 bp, Homo sapiens
gctcacgcctgtaatcccagca

SEQ ID NO: 3969121 - DNA, 18 bp, Homo sapiens
gctcacgctcccccgcag

SEQ ID NO: 3969122 - DNA, 22 bp, Homo sapiens
gctcacgctcccccgcagtccc

SEQ ID NO: 3969123 - DNA, 21 bp, Homo sapiens
gctcagaatagatctgatggt

SEQ ID NO: 3969124 - DNA, 17 bp, Homo sapiens
gctcagagatgaaacta

SEQ ID NO: 3969125 - DNA, 12 bp, Homo sapiens
gctcagccctcc

SEQ ID NO: 3969126 - DNA, 19 bp, Homo sapiens
gctcagccctccctgcccc

SEQ ID NO: 3969127 - DNA, 19 bp, Homo sapiens
gctcagccctgactggtgc

SEQ ID NO: 3969128 - DNA, 21 bp, Homo sapiens
gctcagccctgactggtgcta

SEQ ID NO: 3969129 - DNA, 21 bp, Homo sapiens
gctcagctttttgtcttttct

SEQ ID NO: 3969130 - DNA, 21 bp, Homo sapiens
gctcaggaagaaaccccaagc

SEQ ID NO: 3969131 - DNA, 14 bp, Homo sapiens
gctcaggacccagg

SEQ ID NO: 3969132 - DNA, 16 bp, Homo sapiens
gctcaggacccaggcc

SEQ ID NO: 3969133 - DNA, 18 bp, Homo sapiens
gctcaggacccaggccct

SEQ ID NO: 3969134 - DNA, 23 bp, Homo sapiens
gctcaggaggcgaataaatgttc

SEQ ID NO: 3969135 - DNA, 13 bp, Homo sapiens
gctcaggcaagcc

SEQ ID NO: 3969136 - DNA, 18 bp, Homo sapiens
gctcaggcaagcccctca

SEQ ID NO: 3969137 - DNA, 19 bp, Homo sapiens
gctcaggcaagcccctcag

SEQ ID NO: 3969138 - DNA, 20 bp, Homo sapiens
gctcaggcaagcccctcagc

SEQ ID NO: 3969139 - DNA, 16 bp, Homo sapiens
gctcagtaatttgagg

SEQ ID NO: 3969140 - DNA, 21 bp, Homo sapiens
gctcagtaatttgaggacaac

SEQ ID NO: 3969141 - DNA, 15 bp, Homo sapiens
gctcagtgcctcctg

SEQ ID NO: 3969142 - DNA, 22 bp, Homo sapiens
gctcataacatctttgaaaaga

SEQ ID NO: 3969143 - DNA, 21 bp, Homo sapiens
gctcatcacccagtcctggcc

SEQ ID NO: 3969144 - DNA, 22 bp, Homo sapiens
gctcatcacccagtcctggcca

SEQ ID NO: 3969145 - DNA, 23 bp, Homo sapiens
gctcatcacccagtcctggccat

SEQ ID NO: 3969146 - DNA, 15 bp, Homo sapiens
gctcatccagggtgt

SEQ ID NO: 3969147 - DNA, 21 bp, Homo sapiens
gctcatggcgtaatgggcctg

SEQ ID NO: 3969148 - DNA, 23 bp, Homo sapiens
gctcatggcgtaatgggcctgcc

SEQ ID NO: 3969149 - DNA, 18 bp, Homo sapiens
gctcattttaggcctcct

SEQ ID NO: 3969150 - DNA, 23 bp, Homo sapiens
gctccaccctcaccaggatgaag

SEQ ID NO: 3969151 - DNA, 18 bp, Homo sapiens
gctccactgtcaccctcc

SEQ ID NO: 3969152 - DNA, 15 bp, Homo sapiens
gctccagatctgcac

SEQ ID NO: 3969153 - DNA, 17 bp, Homo sapiens
gctccagatctgcactg

SEQ ID NO: 3969154 - DNA, 17 bp, Homo sapiens
gctccagcatccagcct

SEQ ID NO: 3969155 - DNA, 20 bp, Homo sapiens
gctccagcatccagcctgtg

SEQ ID NO: 3969156 - DNA, 22 bp, Homo sapiens
gctccagcatccagcctgtgtg

SEQ ID NO: 3969157 - DNA, 19 bp, Homo sapiens
gctccagggtcttgggcta

SEQ ID NO: 3969158 - DNA, 14 bp, Homo sapiens
gctccaggtccgga

SEQ ID NO: 3969159 - DNA, 14 bp, Homo sapiens
gctccatctccact

SEQ ID NO: 3969160 - DNA, 16 bp, Homo sapiens
gctccatggggaagtg

SEQ ID NO: 3969161 - DNA, 18 bp, Homo sapiens
gctcccaccccaccccct

SEQ ID NO: 3969162 - DNA, 16 bp, Homo sapiens
gctcccatctcctgat

SEQ ID NO: 3969163 - DNA, 21 bp, Homo sapiens
gctccccacgagtcacctgca

SEQ ID NO: 3969164 - DNA, 17 bp, Homo sapiens
gctccccactctgctct

SEQ ID NO: 3969165 - DNA, 19 bp, Homo sapiens
gctccccactctgctctga

SEQ ID NO: 3969166 - DNA, 20 bp, Homo sapiens
gctccccactctgctctgat

SEQ ID NO: 3969167 - DNA, 14 bp, Homo sapiens
gctccccagccctg

SEQ ID NO: 3969168 - DNA, 22 bp, Homo sapiens
gctccccagccctggctctgca

SEQ ID NO: 3969169 - DNA, 22 bp, Homo sapiens
gctcccccaccccctccccagg

SEQ ID NO: 3969170 - DNA, 16 bp, Homo sapiens
gctcccccttcccagt

SEQ ID NO: 3969171 - DNA, 21 bp, Homo sapiens
gctcccctcggagaagagctg

SEQ ID NO: 3969172 - DNA, 19 bp, Homo sapiens
gctccctcctggagcatcc

SEQ ID NO: 3969173 - DNA, 19 bp, Homo sapiens
gctccctgtagctctgcct

SEQ ID NO: 3969174 - DNA, 18 bp, Homo sapiens
gctcccttccacctgtca

SEQ ID NO: 3969175 - DNA, 21 bp, Homo sapiens
gctcccttctacagcctcaga

SEQ ID NO: 3969176 - DNA, 14 bp, Homo sapiens
gctcccttcttccc

SEQ ID NO: 3969177 - DNA, 24 bp, Homo sapiens
gctcctaaacccccgctccagatc

SEQ ID NO: 3969178 - DNA, 14 bp, Homo sapiens
gctcctccagggcc

SEQ ID NO: 3969179 - DNA, 15 bp, Homo sapiens
gctcctccagggcca

SEQ ID NO: 3969180 - DNA, 18 bp, Homo sapiens
gctcctccagggccacgt

SEQ ID NO: 3969181 - DNA, 22 bp, Homo sapiens
gctcctccagggccacgtgcca

SEQ ID NO: 3969182 - DNA, 23 bp, Homo sapiens
gctcctccagggccacgtgccag

SEQ ID NO: 3969183 - DNA, 17 bp, Homo sapiens
gctcctccttctgctgc

SEQ ID NO: 3969184 - DNA, 22 bp, Homo sapiens
gctcctctccaggcacccttct

SEQ ID NO: 3969185 - DNA, 20 bp, Homo sapiens
gctcctctccttgggctcct

SEQ ID NO: 3969186 - DNA, 22 bp, Homo sapiens
gctcctctccttgggctcctgg

SEQ ID NO: 3969187 - DNA, 16 bp, Homo sapiens
gctcctctgctgctcc

SEQ ID NO: 3969188 - DNA, 22 bp, Homo sapiens
gctcctggaaccaatcccgtga

SEQ ID NO: 3969189 - DNA, 11 bp, Homo sapiens
gctcctggctg

SEQ ID NO: 3969190 - DNA, 13 bp, Homo sapiens
gctcctggctgcc

SEQ ID NO: 3969191 - DNA, 15 bp, Homo sapiens
gctcctggctgccag

SEQ ID NO: 3969192 - DNA, 18 bp, Homo sapiens
gctcctggctgccaggcg

SEQ ID NO: 3969193 - DNA, 23 bp, Homo sapiens
gctcctgggggttctttcttcct

SEQ ID NO: 3969194 - DNA, 13 bp, Homo sapiens
gctcctgtcccta

SEQ ID NO: 3969195 - DNA, 19 bp, Homo sapiens
gctcctgtccctacccact

SEQ ID NO: 3969196 - DNA, 13 bp, Homo sapiens
gctcctgtcctcc

SEQ ID NO: 3969197 - DNA, 21 bp, Homo sapiens
gctcctgtgctactttgcctt

SEQ ID NO: 3969198 - DNA, 23 bp, Homo sapiens
gctccttcccaggagtggaggag

SEQ ID NO: 3969199 - DNA, 15 bp, Homo sapiens
gctccttgactcctt

SEQ ID NO: 3969200 - DNA, 16 bp, Homo sapiens
gctccttgggtcctgc

SEQ ID NO: 3969201 - DNA, 14 bp, Homo sapiens
gctcctttctccag

SEQ ID NO: 3969202 - DNA, 18 bp, Homo sapiens
gctccttttgtccccagg

SEQ ID NO: 3969203 - DNA, 21 bp, Homo sapiens
gctccttttgtccccagggcc

SEQ ID NO: 3969204 - DNA, 22 bp, Homo sapiens
gctccttttgtccccagggccc

SEQ ID NO: 3969205 - DNA, 23 bp, Homo sapiens
gctccttttgtccccagggcccc

SEQ ID NO: 3969206 - DNA, 21 bp, Homo sapiens
gctcgcagcctggcggggcag

SEQ ID NO: 3969207 - DNA, 23 bp, Homo sapiens
gctcgcagcctggcggggcagga

SEQ ID NO: 3969208 - DNA, 18 bp, Homo sapiens
gctcgccccacccagggc

SEQ ID NO: 3969209 - DNA, 16 bp, Homo sapiens
gctcgcttctcctcca

SEQ ID NO: 3969210 - DNA, 20 bp, Homo sapiens
gctcggggtgcacaggaggg

SEQ ID NO: 3969211 - DNA, 21 bp, Homo sapiens
gctcggggtgcacaggagggg

SEQ ID NO: 3969212 - DNA, 22 bp, Homo sapiens
gctcgtaaatattccctgacga

SEQ ID NO: 3969213 - DNA, 15 bp, Homo sapiens
gctcgtggccttccc

SEQ ID NO: 3969214 - DNA, 16 bp, Homo sapiens
gctctaacgcctgagc

SEQ ID NO: 3969215 - DNA, 22 bp, Homo sapiens
gctctaacgcctgagcccaggg

SEQ ID NO: 3969216 - DNA, 20 bp, Homo sapiens
gctctacagctaatcagcat

SEQ ID NO: 3969217 - DNA, 22 bp, Homo sapiens
gctctacagctaatcagcattc

SEQ ID NO: 3969218 - DNA, 21 bp, Homo sapiens
gctctactggtcttgtggaat

SEQ ID NO: 3969219 - DNA, 13 bp, Homo sapiens
gctctagccagga

SEQ ID NO: 3969220 - DNA, 14 bp, Homo sapiens
gctctagccaggag

SEQ ID NO: 3969221 - DNA, 15 bp, Homo sapiens
gctctagccaggagt

SEQ ID NO: 3969222 - DNA, 19 bp, Homo sapiens
gctctagccaggagtctgt

SEQ ID NO: 3969223 - DNA, 20 bp, Homo sapiens
gctctagccaggagtctgtg

SEQ ID NO: 3969224 - DNA, 15 bp, Homo sapiens
gctctagctggcagg

SEQ ID NO: 3969225 - DNA, 20 bp, Homo sapiens
gctctagctggcaggacaca

SEQ ID NO: 3969226 - DNA, 22 bp, Homo sapiens
gctctagttttcagccttggga

SEQ ID NO: 3969227 - DNA, 21 bp, Homo sapiens
gctctcaggggccagtgaggg

SEQ ID NO: 3969228 - DNA, 12 bp, Homo sapiens
gctctcatgcct

SEQ ID NO: 3969229 - DNA, 17 bp, Homo sapiens
gctctccaaaggggctg

SEQ ID NO: 3969230 - DNA, 22 bp, Homo sapiens
gctctccaaaggggctgctggg

SEQ ID NO: 3969231 - DNA, 14 bp, Homo sapiens
gctctccacctcag

SEQ ID NO: 3969232 - DNA, 15 bp, Homo sapiens
gctctccacctcagc

SEQ ID NO: 3969233 - DNA, 16 bp, Homo sapiens
gctctccacctcagcc

SEQ ID NO: 3969234 - DNA, 19 bp, Homo sapiens
gctctccacctcagccttg

SEQ ID NO: 3969235 - DNA, 13 bp, Homo sapiens
gctctccaccttg

SEQ ID NO: 3969236 - DNA, 11 bp, Homo sapiens
gctctccctct

SEQ ID NO: 3969237 - DNA, 15 bp, Homo sapiens
gctctccctctggcc

SEQ ID NO: 3969238 - DNA, 19 bp, Homo sapiens
gctctccctctggccctgc

SEQ ID NO: 3969239 - DNA, 20 bp, Homo sapiens
gctctccctctggccctgcc

SEQ ID NO: 3969240 - DNA, 15 bp, Homo sapiens
gctctcctcttgcca

SEQ ID NO: 3969241 - DNA, 22 bp, Homo sapiens
gctctcctcttgccactgcctc

SEQ ID NO: 3969242 - DNA, 14 bp, Homo sapiens
gctctcctggcttc

SEQ ID NO: 3969243 - DNA, 23 bp, Homo sapiens
gctctcctggcttcccatcccca

SEQ ID NO: 3969244 - DNA, 16 bp, Homo sapiens
gctctcctttctttct

SEQ ID NO: 3969245 - DNA, 19 bp, Homo sapiens
gctctcgggttgtgtgtct

SEQ ID NO: 3969246 - DNA, 22 bp, Homo sapiens
gctctctctacccggcccagag

SEQ ID NO: 3969247 - DNA, 13 bp, Homo sapiens
gctctctgcagcc

SEQ ID NO: 3969248 - DNA, 14 bp, Homo sapiens
gctctctgcagcca

SEQ ID NO: 3969249 - DNA, 17 bp, Homo sapiens
gctctctgcagccagcc

SEQ ID NO: 3969250 - DNA, 18 bp, Homo sapiens
gctctctggccttttcct

SEQ ID NO: 3969251 - DNA, 12 bp, Homo sapiens
gctctcttcagg

SEQ ID NO: 3969252 - DNA, 22 bp, Homo sapiens
gctctcttcaggaggccctggt

SEQ ID NO: 3969253 - DNA, 23 bp, Homo sapiens
gctctcttccagaagatgccctc

SEQ ID NO: 3969254 - DNA, 15 bp, Homo sapiens
gctctgaaagccagc

SEQ ID NO: 3969255 - DNA, 13 bp, Homo sapiens
gctctgaaatctt

SEQ ID NO: 3969256 - DNA, 17 bp, Homo sapiens
gctctgaatattttgta

SEQ ID NO: 3969257 - DNA, 17 bp, Homo sapiens
gctctgacccagtgaga

SEQ ID NO: 3969258 - DNA, 17 bp, Homo sapiens
gctctgagaggccctgg

SEQ ID NO: 3969259 - DNA, 21 bp, Homo sapiens
gctctgagcaaatgtggctcc

SEQ ID NO: 3969260 - DNA, 9 bp, Homo sapiens
gctctgagg

SEQ ID NO: 3969261 - DNA, 23 bp, Homo sapiens
gctctgaggcgccccaacccgtg

SEQ ID NO: 3969262 - DNA, 16 bp, Homo sapiens
gctctgaggcttccag

SEQ ID NO: 3969263 - DNA, 16 bp, Homo sapiens
gctctgatgcatcaga

SEQ ID NO: 3969264 - DNA, 19 bp, Homo sapiens
gctctgatgcatcagaaag

SEQ ID NO: 3969265 - DNA, 20 bp, Homo sapiens
gctctgatgcatcagaaagg

SEQ ID NO: 3969266 - DNA, 23 bp, Homo sapiens
gctctgcaatgggcactgggatg

SEQ ID NO: 3969267 - DNA, 16 bp, Homo sapiens
gctctgcccactgtga

SEQ ID NO: 3969268 - DNA, 14 bp, Homo sapiens
gctctgccccaagc

SEQ ID NO: 3969269 - DNA, 18 bp, Homo sapiens
gctctgccccaagccccc

SEQ ID NO: 3969270 - DNA, 16 bp, Homo sapiens
gctctgccccagaggc

SEQ ID NO: 3969271 - DNA, 21 bp, Homo sapiens
gctctgccccagaggcctctc

SEQ ID NO: 3969272 - DNA, 14 bp, Homo sapiens
gctctgccccttgg

SEQ ID NO: 3969273 - DNA, 23 bp, Homo sapiens
gctctgcctccctctccatatct

SEQ ID NO: 3969274 - DNA, 15 bp, Homo sapiens
gctctgctggcctgg

SEQ ID NO: 3969275 - DNA, 18 bp, Homo sapiens
gctctgctggcctggccg

SEQ ID NO: 3969276 - DNA, 17 bp, Homo sapiens
gctctggcggcttcctg

SEQ ID NO: 3969277 - DNA, 21 bp, Homo sapiens
gctctggcggcttcctgtcca

SEQ ID NO: 3969278 - DNA, 23 bp, Homo sapiens
gctctggcggcttcctgtccact

SEQ ID NO: 3969279 - DNA, 13 bp, Homo sapiens
gctctgggaaggg

SEQ ID NO: 3969280 - DNA, 18 bp, Homo sapiens
gctctgggaaggggtgcc

SEQ ID NO: 3969281 - DNA, 11 bp, Homo sapiens
gctctgggctc

SEQ ID NO: 3969282 - DNA, 15 bp, Homo sapiens
gctctgggctcaggg

SEQ ID NO: 3969283 - DNA, 16 bp, Homo sapiens
gctctgggctcagggc

SEQ ID NO: 3969284 - DNA, 11 bp, Homo sapiens
gctctggggat

SEQ ID NO: 3969285 - DNA, 14 bp, Homo sapiens
gctctggggatgca

SEQ ID NO: 3969286 - DNA, 12 bp, Homo sapiens
gctctgtggcct

SEQ ID NO: 3969287 - DNA, 13 bp, Homo sapiens
gctctgtggcctg

SEQ ID NO: 3969288 - DNA, 14 bp, Homo sapiens
gctctgtggcctgt

SEQ ID NO: 3969289 - DNA, 22 bp, Homo sapiens
gctctgtggcctgtgtccagca

SEQ ID NO: 3969290 - DNA, 16 bp, Homo sapiens
gctcttagtgcccgcc

SEQ ID NO: 3969291 - DNA, 16 bp, Homo sapiens
gctcttcaagctgtcc

SEQ ID NO: 3969292 - DNA, 23 bp, Homo sapiens
gctcttcaagctgtcccctctgt

SEQ ID NO: 3969293 - DNA, 19 bp, Homo sapiens
gctcttcactcagccacac

SEQ ID NO: 3969294 - DNA, 13 bp, Homo sapiens
gctcttcctggac

SEQ ID NO: 3969295 - DNA, 14 bp, Homo sapiens
gctcttcctggacc

SEQ ID NO: 3969296 - DNA, 15 bp, Homo sapiens
gctcttcctggacct

SEQ ID NO: 3969297 - DNA, 18 bp, Homo sapiens
gctcttcctggacctgag

SEQ ID NO: 3969298 - DNA, 22 bp, Homo sapiens
gctcttctatttaaaaaataaa

SEQ ID NO: 3969299 - DNA, 21 bp, Homo sapiens
gctcttctcctttcacaacct

SEQ ID NO: 3969300 - DNA, 16 bp, Homo sapiens
gctcttctgttctcaa

SEQ ID NO: 3969301 - DNA, 12 bp, Homo sapiens
gctcttctttct

SEQ ID NO: 3969302 - DNA, 14 bp, Homo sapiens
gctcttgaattcct

SEQ ID NO: 3969303 - DNA, 18 bp, Homo sapiens
gctcttgaattcctgggc

SEQ ID NO: 3969304 - DNA, 17 bp, Homo sapiens
gctcttggaagagctct

SEQ ID NO: 3969305 - DNA, 19 bp, Homo sapiens
gctcttggcaggtactcag

SEQ ID NO: 3969306 - DNA, 17 bp, Homo sapiens
gctcttggtccctggtc

SEQ ID NO: 3969307 - DNA, 20 bp, Homo sapiens
gctcttggtccctggtccct

SEQ ID NO: 3969308 - DNA, 13 bp, Homo sapiens
gctctttcagaga

SEQ ID NO: 3969309 - DNA, 15 bp, Homo sapiens
gctctttcagagagg

SEQ ID NO: 3969310 - DNA, 18 bp, Homo sapiens
gctctttggggtcagcca

SEQ ID NO: 3969311 - DNA, 22 bp, Homo sapiens
gctctttggggtcagccagggc

SEQ ID NO: 3969312 - DNA, 13 bp, Homo sapiens
gctctttggtaga

SEQ ID NO: 3969313 - DNA, 20 bp, Homo sapiens
gctcttttggtggggagcac

SEQ ID NO: 3969314 - DNA, 20 bp, Homo sapiens
gctgaaacattccgaagagg

SEQ ID NO: 3969315 - DNA, 13 bp, Homo sapiens
gctgaaagccatt

SEQ ID NO: 3969316 - DNA, 22 bp, Homo sapiens
gctgaacccattttgagtgact

SEQ ID NO: 3969317 - DNA, 18 bp, Homo sapiens
gctgaagacaaaccactg

SEQ ID NO: 3969318 - DNA, 21 bp, Homo sapiens
gctgaagaggcaagagacaga

SEQ ID NO: 3969319 - DNA, 19 bp, Homo sapiens
gctgaagtgaaggagaaag

SEQ ID NO: 3969320 - DNA, 13 bp, Homo sapiens
gctgacagataca

SEQ ID NO: 3969321 - DNA, 22 bp, Homo sapiens
gctgacagatacatagatggac

SEQ ID NO: 3969322 - DNA, 12 bp, Homo sapiens
gctgacagctgc

SEQ ID NO: 3969323 - DNA, 23 bp, Homo sapiens
gctgacatggctttgctttgtgt

SEQ ID NO: 3969324 - DNA, 15 bp, Homo sapiens
gctgaccaagagaga

SEQ ID NO: 3969325 - DNA, 17 bp, Homo sapiens
gctgacccagtccctgg

SEQ ID NO: 3969326 - DNA, 18 bp, Homo sapiens
gctgaccccaaagagcct

SEQ ID NO: 3969327 - DNA, 16 bp, Homo sapiens
gctgacctctggtggc

SEQ ID NO: 3969328 - DNA, 15 bp, Homo sapiens
gctgacctgcctctc

SEQ ID NO: 3969329 - DNA, 14 bp, Homo sapiens
gctgacctgttttt

SEQ ID NO: 3969330 - DNA, 14 bp, Homo sapiens
gctgactcagtcca

SEQ ID NO: 3969331 - DNA, 18 bp, Homo sapiens
gctgactgtactcctccc

SEQ ID NO: 3969332 - DNA, 19 bp, Homo sapiens
gctgactgtactcctccca

SEQ ID NO: 3969333 - DNA, 18 bp, Homo sapiens
gctgactttgctctttct

SEQ ID NO: 3969334 - DNA, 13 bp, Homo sapiens
gctgagaagaagc

SEQ ID NO: 3969335 - DNA, 18 bp, Homo sapiens
gctgagaagaagctgagg

SEQ ID NO: 3969336 - DNA, 19 bp, Homo sapiens
gctgagaagaagctgagga

SEQ ID NO: 3969337 - DNA, 15 bp, Homo sapiens
gctgagacaggagaa

SEQ ID NO: 3969338 - DNA, 15 bp, Homo sapiens
gctgagagacccaag

SEQ ID NO: 3969339 - DNA, 20 bp, Homo sapiens
gctgagagacccaaggagga

SEQ ID NO: 3969340 - DNA, 14 bp, Homo sapiens
gctgagagactttt

SEQ ID NO: 3969341 - DNA, 13 bp, Homo sapiens
gctgagagccctg

SEQ ID NO: 3969342 - DNA, 13 bp, Homo sapiens
gctgagaggaaga

SEQ ID NO: 3969343 - DNA, 22 bp, Homo sapiens
gctgagaggaagatgaagagaa

SEQ ID NO: 3969344 - DNA, 24 bp, Homo sapiens
gctgagaggaagatgaagagaagc

SEQ ID NO: 3969345 - DNA, 14 bp, Homo sapiens
gctgagcagggccg

SEQ ID NO: 3969346 - DNA, 12 bp, Homo sapiens
gctgagccactc

SEQ ID NO: 3969347 - DNA, 13 bp, Homo sapiens
gctgagccactcg

SEQ ID NO: 3969348 - DNA, 19 bp, Homo sapiens
gctgagctcacaaggcagc

SEQ ID NO: 3969349 - DNA, 21 bp, Homo sapiens
gctgagctcacaaggcagcaa

SEQ ID NO: 3969350 - DNA, 22 bp, Homo sapiens
gctgagctcacaaggcagcaag

SEQ ID NO: 3969351 - DNA, 15 bp, Homo sapiens
gctgagctctgagag

SEQ ID NO: 3969352 - DNA, 16 bp, Homo sapiens
gctgagctctgagagg

SEQ ID NO: 3969353 - DNA, 17 bp, Homo sapiens
gctgagctctgagaggc

SEQ ID NO: 3969354 - DNA, 23 bp, Homo sapiens
gctgaggatcctcacaggagcag

SEQ ID NO: 3969355 - DNA, 17 bp, Homo sapiens
gctgaggtgcccaggag

SEQ ID NO: 3969356 - DNA, 16 bp, Homo sapiens
gctgagtcacctcctc

SEQ ID NO: 3969357 - DNA, 18 bp, Homo sapiens
gctgagtcacctcctcca

SEQ ID NO: 3969358 - DNA, 22 bp, Homo sapiens
gctgagtgaaaaatctgtggaa

SEQ ID NO: 3969359 - DNA, 21 bp, Homo sapiens
gctgagtgactgtaggcaggg

SEQ ID NO: 3969360 - DNA, 16 bp, Homo sapiens
gctgatcaatgaaatg

SEQ ID NO: 3969361 - DNA, 12 bp, Homo sapiens
gctgatgaaact

SEQ ID NO: 3969362 - DNA, 22 bp, Homo sapiens
gctgatgaaactcctgattttg

SEQ ID NO: 3969363 - DNA, 23 bp, Homo sapiens
gctgatggataacctatatgatt

SEQ ID NO: 3969364 - DNA, 18 bp, Homo sapiens
gctgatttccaggcccct

SEQ ID NO: 3969365 - DNA, 19 bp, Homo sapiens
gctgcaaagtgcaaatact

SEQ ID NO: 3969366 - DNA, 20 bp, Homo sapiens
gctgcaagtgacatctcttt

SEQ ID NO: 3969367 - DNA, 13 bp, Homo sapiens
gctgcacattcct

SEQ ID NO: 3969368 - DNA, 18 bp, Homo sapiens
gctgcacattcctggccc

SEQ ID NO: 3969369 - DNA, 20 bp, Homo sapiens
gctgcacattcctggccccg

SEQ ID NO: 3969370 - DNA, 13 bp, Homo sapiens
gctgcaccagagt

SEQ ID NO: 3969371 - DNA, 14 bp, Homo sapiens
gctgcaccagagtg

SEQ ID NO: 3969372 - DNA, 16 bp, Homo sapiens
gctgcagaaggccaag

SEQ ID NO: 3969373 - DNA, 17 bp, Homo sapiens
gctgcagaaggccaaga

SEQ ID NO: 3969374 - DNA, 17 bp, Homo sapiens
gctgcagagctgaccca

SEQ ID NO: 3969375 - DNA, 14 bp, Homo sapiens
gctgcagctgggcc

SEQ ID NO: 3969376 - DNA, 16 bp, Homo sapiens
gctgcagctgggcccc

SEQ ID NO: 3969377 - DNA, 22 bp, Homo sapiens
gctgcagctgggccccatgctc

SEQ ID NO: 3969378 - DNA, 12 bp, Homo sapiens
gctgcagcttcc

SEQ ID NO: 3969379 - DNA, 20 bp, Homo sapiens
gctgcaggtacttcctcctg

SEQ ID NO: 3969380 - DNA, 15 bp, Homo sapiens
gctgcatgctctgga

SEQ ID NO: 3969381 - DNA, 19 bp, Homo sapiens
gctgcatgctctggaagcc

SEQ ID NO: 3969382 - DNA, 17 bp, Homo sapiens
gctgccacacttcaggc

SEQ ID NO: 3969383 - DNA, 21 bp, Homo sapiens
gctgccacacttcaggctctt

SEQ ID NO: 3969384 - DNA, 19 bp, Homo sapiens
gctgccaccacgtctgcca

SEQ ID NO: 3969385 - DNA, 15 bp, Homo sapiens
gctgccagccgggca

SEQ ID NO: 3969386 - DNA, 13 bp, Homo sapiens
gctgccaggacac

SEQ ID NO: 3969387 - DNA, 20 bp, Homo sapiens
gctgccaggacacctgcccc

SEQ ID NO: 3969388 - DNA, 18 bp, Homo sapiens
gctgccccgttccctgtc

SEQ ID NO: 3969389 - DNA, 19 bp, Homo sapiens
gctgccccgttccctgtca

SEQ ID NO: 3969390 - DNA, 15 bp, Homo sapiens
gctgccctggtgctg

SEQ ID NO: 3969391 - DNA, 23 bp, Homo sapiens
gctgccctggtgctgccacactt

SEQ ID NO: 3969392 - DNA, 16 bp, Homo sapiens
gctgcccttcgctgcc

SEQ ID NO: 3969393 - DNA, 19 bp, Homo sapiens
gctgcccttcgctgccagg

SEQ ID NO: 3969394 - DNA, 21 bp, Homo sapiens
gctgcccttcgctgccaggac

SEQ ID NO: 3969395 - DNA, 16 bp, Homo sapiens
gctgccgaccagagcc

SEQ ID NO: 3969396 - DNA, 18 bp, Homo sapiens
gctgccgcaccccagagt

SEQ ID NO: 3969397 - DNA, 13 bp, Homo sapiens
gctgccgctgcac

SEQ ID NO: 3969398 - DNA, 15 bp, Homo sapiens
gctgccgctgcacca

SEQ ID NO: 3969399 - DNA, 17 bp, Homo sapiens
gctgcctaagtggctgc

SEQ ID NO: 3969400 - DNA, 18 bp, Homo sapiens
gctgcctaagtggctgct

SEQ ID NO: 3969401 - DNA, 13 bp, Homo sapiens
gctgcctgccgcc

SEQ ID NO: 3969402 - DNA, 15 bp, Homo sapiens
gctgcctgccgccca

SEQ ID NO: 3969403 - DNA, 15 bp, Homo sapiens
gctgccttcctcatc

SEQ ID NO: 3969404 - DNA, 16 bp, Homo sapiens
gctgccttcctcatcc

SEQ ID NO: 3969405 - DNA, 16 bp, Homo sapiens
gctgcgggtctgaagg

SEQ ID NO: 3969406 - DNA, 17 bp, Homo sapiens
gctgctactacccgagc

SEQ ID NO: 3969407 - DNA, 14 bp, Homo sapiens
gctgctagagaagg

SEQ ID NO: 3969408 - DNA, 17 bp, Homo sapiens
gctgctagagaaggggg

SEQ ID NO: 3969409 - DNA, 14 bp, Homo sapiens
gctgctcaaatcat

SEQ ID NO: 3969410 - DNA, 16 bp, Homo sapiens
gctgctcatcacccag

SEQ ID NO: 3969411 - DNA, 21 bp, Homo sapiens
gctgctcatcacccagtcctg

SEQ ID NO: 3969412 - DNA, 21 bp, Homo sapiens
gctgctcggggtgcacaggag

SEQ ID NO: 3969413 - DNA, 22 bp, Homo sapiens
gctgctctgccccttgggcatc

SEQ ID NO: 3969414 - DNA, 12 bp, Homo sapiens
gctgctctgcta

SEQ ID NO: 3969415 - DNA, 14 bp, Homo sapiens
gctgctctggaaaa

SEQ ID NO: 3969416 - DNA, 16 bp, Homo sapiens
gctgctgaagaggcaa

SEQ ID NO: 3969417 - DNA, 20 bp, Homo sapiens
gctgctgagaacctggcctt

SEQ ID NO: 3969418 - DNA, 22 bp, Homo sapiens
gctgctgagaacctggccttca

SEQ ID NO: 3969419 - DNA, 12 bp, Homo sapiens
gctgctggggca

SEQ ID NO: 3969420 - DNA, 20 bp, Homo sapiens
gctgctgtaactgctgagcc

SEQ ID NO: 3969421 - DNA, 21 bp, Homo sapiens
gctgctgtaactgctgagcca

SEQ ID NO: 3969422 - DNA, 19 bp, Homo sapiens
gctgcttgtcctgctctct

SEQ ID NO: 3969423 - DNA, 14 bp, Homo sapiens
gctgcttgtgggcc

SEQ ID NO: 3969424 - DNA, 17 bp, Homo sapiens
gctgctttttggcacag

SEQ ID NO: 3969425 - DNA, 14 bp, Homo sapiens
gctggaaataaacc

SEQ ID NO: 3969426 - DNA, 22 bp, Homo sapiens
gctggaaataaacctggagatg

SEQ ID NO: 3969427 - DNA, 16 bp, Homo sapiens
gctggaagctgggagg

SEQ ID NO: 3969428 - DNA, 20 bp, Homo sapiens
gctggaatcaatttcccaga

SEQ ID NO: 3969429 - DNA, 21 bp, Homo sapiens
gctggaatcaatttcccagaa

SEQ ID NO: 3969430 - DNA, 23 bp, Homo sapiens
gctggaatcaatttcccagaagg

SEQ ID NO: 3969431 - DNA, 16 bp, Homo sapiens
gctggaatctggagag

SEQ ID NO: 3969432 - DNA, 18 bp, Homo sapiens
gctggacaagaagctgct

SEQ ID NO: 3969433 - DNA, 17 bp, Homo sapiens
gctggacatgctttggc

SEQ ID NO: 3969434 - DNA, 13 bp, Homo sapiens
gctggacctgcac

SEQ ID NO: 3969435 - DNA, 21 bp, Homo sapiens
gctggacggggactggggatg

SEQ ID NO: 3969436 - DNA, 15 bp, Homo sapiens
gctggactctggcac

SEQ ID NO: 3969437 - DNA, 19 bp, Homo sapiens
gctggactctggcacccag

SEQ ID NO: 3969438 - DNA, 15 bp, Homo sapiens
gctggactgaggacc

SEQ ID NO: 3969439 - DNA, 13 bp, Homo sapiens
gctggagctcttg

SEQ ID NO: 3969440 - DNA, 12 bp, Homo sapiens
gctggagctggc

SEQ ID NO: 3969441 - DNA, 21 bp, Homo sapiens
gctggaggactagaacctgga

SEQ ID NO: 3969442 - DNA, 12 bp, Homo sapiens
gctggaggcagg

SEQ ID NO: 3969443 - DNA, 16 bp, Homo sapiens
gctggaggcagggcct

SEQ ID NO: 3969444 - DNA, 16 bp, Homo sapiens
gctggatattttacta

SEQ ID NO: 3969445 - DNA, 15 bp, Homo sapiens
gctggcaaaggtggc

SEQ ID NO: 3969446 - DNA, 14 bp, Homo sapiens
gctggcaagcaggg

SEQ ID NO: 3969447 - DNA, 16 bp, Homo sapiens
gctggcaagcagggaa

SEQ ID NO: 3969448 - DNA, 12 bp, Homo sapiens
gctggcacctca

SEQ ID NO: 3969449 - DNA, 23 bp, Homo sapiens
gctggcagctgtcattcaggacc

SEQ ID NO: 3969450 - DNA, 23 bp, Homo sapiens
gctggcagtgctgattcagcctg

SEQ ID NO: 3969451 - DNA, 15 bp, Homo sapiens
gctggccagcaccct

SEQ ID NO: 3969452 - DNA, 21 bp, Homo sapiens
gctggcccagccaactgcccc

SEQ ID NO: 3969453 - DNA, 23 bp, Homo sapiens
gctggcccagccaactgccccgg

SEQ ID NO: 3969454 - DNA, 19 bp, Homo sapiens
gctggccctggctcccaca

SEQ ID NO: 3969455 - DNA, 16 bp, Homo sapiens
gctggcctcaggctgc

SEQ ID NO: 3969456 - DNA, 20 bp, Homo sapiens
gctggcctcccaataaagct

SEQ ID NO: 3969457 - DNA, 14 bp, Homo sapiens
gctggcctggatct

SEQ ID NO: 3969458 - DNA, 17 bp, Homo sapiens
gctggcctggccggcaa

SEQ ID NO: 3969459 - DNA, 16 bp, Homo sapiens
gctggcggctactcag

SEQ ID NO: 3969460 - DNA, 11 bp, Homo sapiens
gctggctgcct

SEQ ID NO: 3969461 - DNA, 20 bp, Homo sapiens
gctggctgccttagaacctt

SEQ ID NO: 3969462 - DNA, 14 bp, Homo sapiens
gctggcttctgttg

SEQ ID NO: 3969463 - DNA, 22 bp, Homo sapiens
gctggcttctgttgcgccactg

SEQ ID NO: 3969464 - DNA, 17 bp, Homo sapiens
gctgggaaacagggagc

SEQ ID NO: 3969465 - DNA, 20 bp, Homo sapiens
gctgggaaccccgcagcccg

SEQ ID NO: 3969466 - DNA, 22 bp, Homo sapiens
gctgggaccccagctagggctg

SEQ ID NO: 3969467 - DNA, 15 bp, Homo sapiens
gctgggagctctgca

SEQ ID NO: 3969468 - DNA, 14 bp, Homo sapiens
gctgggaggcatgg

SEQ ID NO: 3969469 - DNA, 22 bp, Homo sapiens
gctgggatttcttcgctgctct

SEQ ID NO: 3969470 - DNA, 21 bp, Homo sapiens
gctgggcagctgattttgtca

SEQ ID NO: 3969471 - DNA, 14 bp, Homo sapiens
gctgggccagcctc

SEQ ID NO: 3969472 - DNA, 15 bp, Homo sapiens
gctgggccccaccta

SEQ ID NO: 3969473 - DNA, 23 bp, Homo sapiens
gctgggccccatgctctgcccca

SEQ ID NO: 3969474 - DNA, 12 bp, Homo sapiens
gctgggcccctg

SEQ ID NO: 3969475 - DNA, 13 bp, Homo sapiens
gctgggcccctgg

SEQ ID NO: 3969476 - DNA, 15 bp, Homo sapiens
gctgggcccctggga

SEQ ID NO: 3969477 - DNA, 19 bp, Homo sapiens
gctgggccgagtaccttaa

SEQ ID NO: 3969478 - DNA, 15 bp, Homo sapiens
gctgggccggccagc

SEQ ID NO: 3969479 - DNA, 15 bp, Homo sapiens
gctgggctctccacc

SEQ ID NO: 3969480 - DNA, 16 bp, Homo sapiens
gctggggaacagagcg

SEQ ID NO: 3969481 - DNA, 20 bp, Homo sapiens
gctggggcagaggggcagcc

SEQ ID NO: 3969482 - DNA, 24 bp, Homo sapiens
gctggggcagaggggcagccgcta

SEQ ID NO: 3969483 - DNA, 12 bp, Homo sapiens
gctggggccagt

SEQ ID NO: 3969484 - DNA, 17 bp, Homo sapiens
gctggggcctggagagg

SEQ ID NO: 3969485 - DNA, 19 bp, Homo sapiens
gctgggtccaattgtggca

SEQ ID NO: 3969486 - DNA, 23 bp, Homo sapiens
gctggtaatttgtatctgaagga

SEQ ID NO: 3969487 - DNA, 13 bp, Homo sapiens
gctggtccagggc

SEQ ID NO: 3969488 - DNA, 21 bp, Homo sapiens
gctggtgggaagcgtctgtcc

SEQ ID NO: 3969489 - DNA, 14 bp, Homo sapiens
gctggttagaaatg

SEQ ID NO: 3969490 - DNA, 17 bp, Homo sapiens
gctggttggagagctag

SEQ ID NO: 3969491 - DNA, 20 bp, Homo sapiens
gctgtaaatacatgtgtgga

SEQ ID NO: 3969492 - DNA, 17 bp, Homo sapiens
gctgtaactgctgagcc

SEQ ID NO: 3969493 - DNA, 13 bp, Homo sapiens
gctgtactcagag

SEQ ID NO: 3969494 - DNA, 20 bp, Homo sapiens
gctgtactcagagcagagca

SEQ ID NO: 3969495 - DNA, 13 bp, Homo sapiens
gctgtaggtgtgc

SEQ ID NO: 3969496 - DNA, 21 bp, Homo sapiens
gctgtagtagccctttctgtg

SEQ ID NO: 3969497 - DNA, 16 bp, Homo sapiens
gctgtatctgtaatta

SEQ ID NO: 3969498 - DNA, 17 bp, Homo sapiens
gctgtcatggaaaagcc

SEQ ID NO: 3969499 - DNA, 21 bp, Homo sapiens
gctgtcatggaaaagcccagt

SEQ ID NO: 3969500 - DNA, 15 bp, Homo sapiens
gctgtcgccccaggc

SEQ ID NO: 3969501 - DNA, 17 bp, Homo sapiens
gctgtcgccccaggccc

SEQ ID NO: 3969502 - DNA, 20 bp, Homo sapiens
gctgtcgccccaggccctcc

SEQ ID NO: 3969503 - DNA, 21 bp, Homo sapiens
gctgtcgccccaggccctccc

SEQ ID NO: 3969504 - DNA, 21 bp, Homo sapiens
gctgtctccataatgccactg

SEQ ID NO: 3969505 - DNA, 12 bp, Homo sapiens
gctgtctgtcac

SEQ ID NO: 3969506 - DNA, 13 bp, Homo sapiens
gctgtctgtcacc

SEQ ID NO: 3969507 - DNA, 14 bp, Homo sapiens
gctgtctttctcta

SEQ ID NO: 3969508 - DNA, 18 bp, Homo sapiens
gctgtgaacatggactct

SEQ ID NO: 3969509 - DNA, 17 bp, Homo sapiens
gctgtgacctgctgagc

SEQ ID NO: 3969510 - DNA, 18 bp, Homo sapiens
gctgtgacctgctgagct

SEQ ID NO: 3969511 - DNA, 20 bp, Homo sapiens
gctgtgagcccctggtcctg

SEQ ID NO: 3969512 - DNA, 20 bp, Homo sapiens
gctgtgcaccttacattcct

SEQ ID NO: 3969513 - DNA, 15 bp, Homo sapiens
gctgtgcctcgctcc

SEQ ID NO: 3969514 - DNA, 18 bp, Homo sapiens
gctgtgcctcgctcccca

SEQ ID NO: 3969515 - DNA, 14 bp, Homo sapiens
gctgtgcctctgcc

SEQ ID NO: 3969516 - DNA, 13 bp, Homo sapiens
gctgtgcctgcta

SEQ ID NO: 3969517 - DNA, 17 bp, Homo sapiens
gctgtgcctgctagagc

SEQ ID NO: 3969518 - DNA, 20 bp, Homo sapiens
gctgtgcctgctagagcaac

SEQ ID NO: 3969519 - DNA, 14 bp, Homo sapiens
gctgtgctgtgtct

SEQ ID NO: 3969520 - DNA, 15 bp, Homo sapiens
gctgtggcacagact

SEQ ID NO: 3969521 - DNA, 14 bp, Homo sapiens
gctgtggccagggt

SEQ ID NO: 3969522 - DNA, 22 bp, Homo sapiens
gctgtggccagggtgagagctg

SEQ ID NO: 3969523 - DNA, 12 bp, Homo sapiens
gctgtggcctca

SEQ ID NO: 3969524 - DNA, 14 bp, Homo sapiens
gctgtggcctcact

SEQ ID NO: 3969525 - DNA, 22 bp, Homo sapiens
gctgtggcctcacttccctggg

SEQ ID NO: 3969526 - DNA, 15 bp, Homo sapiens
gctgtgggcagcacc

SEQ ID NO: 3969527 - DNA, 18 bp, Homo sapiens
gctgtgggcagcaccctc

SEQ ID NO: 3969528 - DNA, 20 bp, Homo sapiens
gctgtgggcagcaccctccc

SEQ ID NO: 3969529 - DNA, 21 bp, Homo sapiens
gctgtgtccttgcacctgcat

SEQ ID NO: 3969530 - DNA, 15 bp, Homo sapiens
gctgttcacagccag

SEQ ID NO: 3969531 - DNA, 20 bp, Homo sapiens
gctgttcacccacagggcta

SEQ ID NO: 3969532 - DNA, 13 bp, Homo sapiens
gctgttctgcact

SEQ ID NO: 3969533 - DNA, 14 bp, Homo sapiens
gctgttctgcactg

SEQ ID NO: 3969534 - DNA, 17 bp, Homo sapiens
gctgttctgcactgaaa

SEQ ID NO: 3969535 - DNA, 17 bp, Homo sapiens
gctgttgccatagcccc

SEQ ID NO: 3969536 - DNA, 15 bp, Homo sapiens
gctgttgcctcatct

SEQ ID NO: 3969537 - DNA, 17 bp, Homo sapiens
gctgttgctggactgag

SEQ ID NO: 3969538 - DNA, 12 bp, Homo sapiens
gctgttggcctc

SEQ ID NO: 3969539 - DNA, 13 bp, Homo sapiens
gctgttggcctcg

SEQ ID NO: 3969540 - DNA, 13 bp, Homo sapiens
gctgtttctggaa

SEQ ID NO: 3969541 - DNA, 13 bp, Homo sapiens
gcttaaaagacat

SEQ ID NO: 3969542 - DNA, 14 bp, Homo sapiens
gcttaaaatatgta

SEQ ID NO: 3969543 - DNA, 18 bp, Homo sapiens
gcttacatttttacaata

SEQ ID NO: 3969544 - DNA, 19 bp, Homo sapiens
gcttacatttttacaataa

SEQ ID NO: 3969545 - DNA, 14 bp, Homo sapiens
gcttacctgacaca

SEQ ID NO: 3969546 - DNA, 19 bp, Homo sapiens
gcttactaatgtgccccat

SEQ ID NO: 3969547 - DNA, 21 bp, Homo sapiens
gcttagacttcgactcaggat

SEQ ID NO: 3969548 - DNA, 19 bp, Homo sapiens
gcttagccttgtgccctgc

SEQ ID NO: 3969549 - DNA, 20 bp, Homo sapiens
gcttagccttgtgccctgcc

SEQ ID NO: 3969550 - DNA, 21 bp, Homo sapiens
gcttagccttgtgccctgccc

SEQ ID NO: 3969551 - DNA, 19 bp, Homo sapiens
gcttaggctgcttattgga

SEQ ID NO: 3969552 - DNA, 15 bp, Homo sapiens
gcttagttctcactg

SEQ ID NO: 3969553 - DNA, 16 bp, Homo sapiens
gcttagttctcactgt

SEQ ID NO: 3969554 - DNA, 13 bp, Homo sapiens
gcttatcaaaatc

SEQ ID NO: 3969555 - DNA, 15 bp, Homo sapiens
gcttattggccactg

SEQ ID NO: 3969556 - DNA, 15 bp, Homo sapiens
gcttatttccctcat

SEQ ID NO: 3969557 - DNA, 21 bp, Homo sapiens
gcttcaagtgatatatgtatt

SEQ ID NO: 3969558 - DNA, 19 bp, Homo sapiens
gcttcaagtgttgctcttg

SEQ ID NO: 3969559 - DNA, 15 bp, Homo sapiens
gcttcaattaataaa

SEQ ID NO: 3969560 - DNA, 16 bp, Homo sapiens
gcttcacccctgcact

SEQ ID NO: 3969561 - DNA, 21 bp, Homo sapiens
gcttcacccctgcacttcaga

SEQ ID NO: 3969562 - DNA, 12 bp, Homo sapiens
gcttcagagcct

SEQ ID NO: 3969563 - DNA, 16 bp, Homo sapiens
gcttcagagcctagcc

SEQ ID NO: 3969564 - DNA, 21 bp, Homo sapiens
gcttcagagcctagccacctc

SEQ ID NO: 3969565 - DNA, 24 bp, Homo sapiens
gcttcagagcctagccacctccca

SEQ ID NO: 3969566 - DNA, 13 bp, Homo sapiens
gcttcatcaattt

SEQ ID NO: 3969567 - DNA, 17 bp, Homo sapiens
gcttcatcaatttttat

SEQ ID NO: 3969568 - DNA, 20 bp, Homo sapiens
gcttcatcaatttttataca

SEQ ID NO: 3969569 - DNA, 15 bp, Homo sapiens
gcttcatgcctcagt

SEQ ID NO: 3969570 - DNA, 17 bp, Homo sapiens
gcttcatgcctcagttt

SEQ ID NO: 3969571 - DNA, 20 bp, Homo sapiens
gcttcatgcctcagtttccc

SEQ ID NO: 3969572 - DNA, 14 bp, Homo sapiens
gcttcatgctcagc

SEQ ID NO: 3969573 - DNA, 12 bp, Homo sapiens
gcttccagacca

SEQ ID NO: 3969574 - DNA, 23 bp, Homo sapiens
gcttccagaccacctgccagcca

SEQ ID NO: 3969575 - DNA, 19 bp, Homo sapiens
gcttccagagagtcctctg

SEQ ID NO: 3969576 - DNA, 13 bp, Homo sapiens
gcttccaggctct

SEQ ID NO: 3969577 - DNA, 20 bp, Homo sapiens
gcttccaggtatctccagga

SEQ ID NO: 3969578 - DNA, 21 bp, Homo sapiens
gcttccaggtatctccaggat

SEQ ID NO: 3969579 - DNA, 12 bp, Homo sapiens
gcttcccagagg

SEQ ID NO: 3969580 - DNA, 16 bp, Homo sapiens
gcttcccatccccagc

SEQ ID NO: 3969581 - DNA, 17 bp, Homo sapiens
gcttcccatccccagcg

SEQ ID NO: 3969582 - DNA, 23 bp, Homo sapiens
gcttcccgctcagccctccctgc

SEQ ID NO: 3969583 - DNA, 19 bp, Homo sapiens
gcttccctaggctgagctg

SEQ ID NO: 3969584 - DNA, 21 bp, Homo sapiens
gcttcctccgtccacccaggc

SEQ ID NO: 3969585 - DNA, 23 bp, Homo sapiens
gcttcctccgtccacccaggctg

SEQ ID NO: 3969586 - DNA, 13 bp, Homo sapiens
gcttcctgtccac

SEQ ID NO: 3969587 - DNA, 19 bp, Homo sapiens
gcttcctgtgggccaggag

SEQ ID NO: 3969588 - DNA, 20 bp, Homo sapiens
gcttcctgtgggccaggagc

SEQ ID NO: 3969589 - DNA, 18 bp, Homo sapiens
gcttctattaaatgtata

SEQ ID NO: 3969590 - DNA, 14 bp, Homo sapiens
gcttctcatcccca

SEQ ID NO: 3969591 - DNA, 12 bp, Homo sapiens
gcttctccaggc

SEQ ID NO: 3969592 - DNA, 14 bp, Homo sapiens
gcttctcctgaccc

SEQ ID NO: 3969593 - DNA, 15 bp, Homo sapiens
gcttctcctgtgacc

SEQ ID NO: 3969594 - DNA, 14 bp, Homo sapiens
gcttctctacagac

SEQ ID NO: 3969595 - DNA, 15 bp, Homo sapiens
gcttctgcagcaact

SEQ ID NO: 3969596 - DNA, 19 bp, Homo sapiens
gcttctgcagcaactccca

SEQ ID NO: 3969597 - DNA, 21 bp, Homo sapiens
gcttctgcagcaactcccacg

SEQ ID NO: 3969598 - DNA, 14 bp, Homo sapiens
gcttctgtccagga

SEQ ID NO: 3969599 - DNA, 15 bp, Homo sapiens
gcttctgtccaggac

SEQ ID NO: 3969600 - DNA, 18 bp, Homo sapiens
gcttctgtgcactagcct

SEQ ID NO: 3969601 - DNA, 21 bp, Homo sapiens
gcttcttcaagcacctgcaga

SEQ ID NO: 3969602 - DNA, 13 bp, Homo sapiens
gcttcttcatctt

SEQ ID NO: 3969603 - DNA, 13 bp, Homo sapiens
gcttgaccagacc

SEQ ID NO: 3969604 - DNA, 14 bp, Homo sapiens
gcttgaccagacct

SEQ ID NO: 3969605 - DNA, 21 bp, Homo sapiens
gcttgaccagacctagacctg

SEQ ID NO: 3969606 - DNA, 23 bp, Homo sapiens
gcttgaccagacctagacctggg

SEQ ID NO: 3969607 - DNA, 22 bp, Homo sapiens
gcttgcactttgtaacatgttt

SEQ ID NO: 3969608 - DNA, 18 bp, Homo sapiens
gcttgcatcacttggggt

SEQ ID NO: 3969609 - DNA, 16 bp, Homo sapiens
gcttgccaccggggaa

SEQ ID NO: 3969610 - DNA, 13 bp, Homo sapiens
gcttgctccaggg

SEQ ID NO: 3969611 - DNA, 12 bp, Homo sapiens
gcttgctggctt

SEQ ID NO: 3969612 - DNA, 13 bp, Homo sapiens
gcttgcttctgca

SEQ ID NO: 3969613 - DNA, 21 bp, Homo sapiens
gcttgcttctgcagcaactcc

SEQ ID NO: 3969614 - DNA, 17 bp, Homo sapiens
gcttggacttcctgggg

SEQ ID NO: 3969615 - DNA, 16 bp, Homo sapiens
gcttggagggatggag

SEQ ID NO: 3969616 - DNA, 15 bp, Homo sapiens
gcttggccgccatcc

SEQ ID NO: 3969617 - DNA, 20 bp, Homo sapiens
gcttggccgccatccgggac

SEQ ID NO: 3969618 - DNA, 22 bp, Homo sapiens
gcttggccgccatccgggacgc

SEQ ID NO: 3969619 - DNA, 16 bp, Homo sapiens
gcttggggagcagagt

SEQ ID NO: 3969620 - DNA, 22 bp, Homo sapiens
gcttggggagcagagtatagga

SEQ ID NO: 3969621 - DNA, 22 bp, Homo sapiens
gcttggggggtgatgagggcag

SEQ ID NO: 3969622 - DNA, 16 bp, Homo sapiens
gcttggtggctgagct

SEQ ID NO: 3969623 - DNA, 15 bp, Homo sapiens
gcttgtaactccacc

SEQ ID NO: 3969624 - DNA, 14 bp, Homo sapiens
gcttgtatagtgta

SEQ ID NO: 3969625 - DNA, 22 bp, Homo sapiens
gcttgtatatacatattataaa

SEQ ID NO: 3969626 - DNA, 15 bp, Homo sapiens
gcttgtccctgccca

SEQ ID NO: 3969627 - DNA, 21 bp, Homo sapiens
gcttgtcctgctctcttcagg

SEQ ID NO: 3969628 - DNA, 18 bp, Homo sapiens
gcttgtgagagctggttg

SEQ ID NO: 3969629 - DNA, 18 bp, Homo sapiens
gcttgtgattctgggatg

SEQ ID NO: 3969630 - DNA, 17 bp, Homo sapiens
gctttaaactaccctcc

SEQ ID NO: 3969631 - DNA, 15 bp, Homo sapiens
gctttaaagtgtaat

SEQ ID NO: 3969632 - DNA, 17 bp, Homo sapiens
gctttaacaaaacaaga

SEQ ID NO: 3969633 - DNA, 23 bp, Homo sapiens
gctttaacaaaacaagaaagaaa

SEQ ID NO: 3969634 - DNA, 12 bp, Homo sapiens
gctttacacaca

SEQ ID NO: 3969635 - DNA, 16 bp, Homo sapiens
gctttacacacacaga

SEQ ID NO: 3969636 - DNA, 15 bp, Homo sapiens
gctttacattttatt

SEQ ID NO: 3969637 - DNA, 14 bp, Homo sapiens
gctttatgctgtgt

SEQ ID NO: 3969638 - DNA, 23 bp, Homo sapiens
gctttatttatggcttataaatg

SEQ ID NO: 3969639 - DNA, 22 bp, Homo sapiens
gctttccccgggggaggaaggg

SEQ ID NO: 3969640 - DNA, 19 bp, Homo sapiens
gctttcctaaagtctctgc

SEQ ID NO: 3969641 - DNA, 20 bp, Homo sapiens
gctttccttttcttccttct

SEQ ID NO: 3969642 - DNA, 18 bp, Homo sapiens
gctttctccggggtctgt

SEQ ID NO: 3969643 - DNA, 21 bp, Homo sapiens
gctttctccggggtctgtgct

SEQ ID NO: 3969644 - DNA, 23 bp, Homo sapiens
gctttctccggggtctgtgctgt

SEQ ID NO: 3969645 - DNA, 20 bp, Homo sapiens
gctttgaatacccccagaga

SEQ ID NO: 3969646 - DNA, 21 bp, Homo sapiens
gctttgaatacccccagagac

SEQ ID NO: 3969647 - DNA, 22 bp, Homo sapiens
gctttgaatacccccagagacc

SEQ ID NO: 3969648 - DNA, 18 bp, Homo sapiens
gctttgacatgaaaagat

SEQ ID NO: 3969649 - DNA, 20 bp, Homo sapiens
gctttgcattcctacaaaga

SEQ ID NO: 3969650 - DNA, 19 bp, Homo sapiens
gctttgccatgggcctgct

SEQ ID NO: 3969651 - DNA, 21 bp, Homo sapiens
gctttgccatgggcctgctgc

SEQ ID NO: 3969652 - DNA, 15 bp, Homo sapiens
gctttgggagaatgt

SEQ ID NO: 3969653 - DNA, 14 bp, Homo sapiens
gctttgggaggcca

SEQ ID NO: 3969654 - DNA, 21 bp, Homo sapiens
gctttgggaggccaaggcagg

SEQ ID NO: 3969655 - DNA, 14 bp, Homo sapiens
gctttgggctgccc

SEQ ID NO: 3969656 - DNA, 16 bp, Homo sapiens
gctttgggctgccctg

SEQ ID NO: 3969657 - DNA, 19 bp, Homo sapiens
gcacctgggaaaacagagg

SEQ ID NO: 3969658 - DNA, 21 bp, Homo sapiens
gcacctgggaaaacagaggaa

SEQ ID NO: 3969659 - DNA, 20 bp, Homo sapiens
gcacctgggccctggggcct

SEQ ID NO: 3969660 - DNA, 22 bp, Homo sapiens
gcacctgggccctggggcctgt

SEQ ID NO: 3969661 - DNA, 23 bp, Homo sapiens
gcacctgggccctggggcctgta

SEQ ID NO: 3969662 - DNA, 19 bp, Homo sapiens
gcaccttaatattattggg

SEQ ID NO: 3969663 - DNA, 20 bp, Homo sapiens
gcaccttaatattattgggg

SEQ ID NO: 3969664 - DNA, 18 bp, Homo sapiens
gcaccttacattcctaga

SEQ ID NO: 3969665 - DNA, 20 bp, Homo sapiens
gcaccttaccaactttctgt

SEQ ID NO: 3969666 - DNA, 16 bp, Homo sapiens
gcaccttagtggcttt

SEQ ID NO: 3969667 - DNA, 21 bp, Homo sapiens
gcaccttttataccagagacc

SEQ ID NO: 3969668 - DNA, 21 bp, Homo sapiens
gcacgatcttggctcactgca

SEQ ID NO: 3969669 - DNA, 21 bp, Homo sapiens
gcacgcaacccttgctgctgc

SEQ ID NO: 3969670 - DNA, 13 bp, Homo sapiens
gcacgcacatgcc

SEQ ID NO: 3969671 - DNA, 20 bp, Homo sapiens
gcactaaagtatgtaaagta

SEQ ID NO: 3969672 - DNA, 20 bp, Homo sapiens
gcactaaggccgtgtctctg

SEQ ID NO: 3969673 - DNA, 17 bp, Homo sapiens
gcactaattgacccaaa

SEQ ID NO: 3969674 - DNA, 20 bp, Homo sapiens
gcactagcattttcttgaac

SEQ ID NO: 3969675 - DNA, 19 bp, Homo sapiens
gcactaggttcaattccct

SEQ ID NO: 3969676 - DNA, 17 bp, Homo sapiens
gcactcacccatgtgcc

SEQ ID NO: 3969677 - DNA, 20 bp, Homo sapiens
gcactcacccatgtgccaag

SEQ ID NO: 3969678 - DNA, 23 bp, Homo sapiens
gcactcacccatgtgccaaggtg

SEQ ID NO: 3969679 - DNA, 23 bp, Homo sapiens
gcactcagtctagtgaagatgtt

SEQ ID NO: 3969680 - DNA, 16 bp, Homo sapiens
gcactccatggccacc

SEQ ID NO: 3969681 - DNA, 20 bp, Homo sapiens
gcactgaaaataccatcagg

SEQ ID NO: 3969682 - DNA, 12 bp, Homo sapiens
gcactgacaaga

SEQ ID NO: 3969683 - DNA, 20 bp, Homo sapiens
gcactgacccttccagacat

SEQ ID NO: 3969684 - DNA, 20 bp, Homo sapiens
gcactgactgggaccaggca

SEQ ID NO: 3969685 - DNA, 13 bp, Homo sapiens
gcactgagggcca

SEQ ID NO: 3969686 - DNA, 14 bp, Homo sapiens
gcactgagggccac

SEQ ID NO: 3969687 - DNA, 24 bp, Homo sapiens
gcactgagggccacactattacca

SEQ ID NO: 3969688 - DNA, 15 bp, Homo sapiens
gcactgatttcacaa

SEQ ID NO: 3969689 - DNA, 22 bp, Homo sapiens
gcactgcagatagccagacaca

SEQ ID NO: 3969690 - DNA, 23 bp, Homo sapiens
gcactgcagatagccagacacat

SEQ ID NO: 3969691 - DNA, 13 bp, Homo sapiens
gcactgccaggag

SEQ ID NO: 3969692 - DNA, 15 bp, Homo sapiens
gcactgccaggaggg

SEQ ID NO: 3969693 - DNA, 18 bp, Homo sapiens
gcactgccaggagggaca

SEQ ID NO: 3969694 - DNA, 22 bp, Homo sapiens
gcactgctaggcgagtgccagg

SEQ ID NO: 3969695 - DNA, 23 bp, Homo sapiens
gcactgctaggcgagtgccagga

SEQ ID NO: 3969696 - DNA, 18 bp, Homo sapiens
gcactgctgcccagcctc

SEQ ID NO: 3969697 - DNA, 14 bp, Homo sapiens
gcactggagtgcag

SEQ ID NO: 3969698 - DNA, 15 bp, Homo sapiens
gcactggagtgcagg

SEQ ID NO: 3969699 - DNA, 14 bp, Homo sapiens
gcactggccagaga

SEQ ID NO: 3969700 - DNA, 16 bp, Homo sapiens
gcactggccagagagg

SEQ ID NO: 3969701 - DNA, 15 bp, Homo sapiens
gcactggccccaccc

SEQ ID NO: 3969702 - DNA, 18 bp, Homo sapiens
gcactgggttgactttca

SEQ ID NO: 3969703 - DNA, 22 bp, Homo sapiens
gcactggtggcccgacagcctg

SEQ ID NO: 3969704 - DNA, 16 bp, Homo sapiens
gcactgtcttaaggca

SEQ ID NO: 3969705 - DNA, 16 bp, Homo sapiens
gcactgtgggggctgg

SEQ ID NO: 3969706 - DNA, 16 bp, Homo sapiens
gcactgttacttttta

SEQ ID NO: 3969707 - DNA, 19 bp, Homo sapiens
gcacttagctatcagaaga

SEQ ID NO: 3969708 - DNA, 15 bp, Homo sapiens
gcacttgcgtcctgc

SEQ ID NO: 3969709 - DNA, 13 bp, Homo sapiens
gcacttggctcct

SEQ ID NO: 3969710 - DNA, 17 bp, Homo sapiens
gcacttggggcaccttg

SEQ ID NO: 3969711 - DNA, 19 bp, Homo sapiens
gcacttgttccttctgctt

SEQ ID NO: 3969712 - DNA, 16 bp, Homo sapiens
gcactttaaccctctc

SEQ ID NO: 3969713 - DNA, 20 bp, Homo sapiens
gcactttaaccctctcttcc

SEQ ID NO: 3969714 - DNA, 22 bp, Homo sapiens
gcactttaaccctctcttccct

SEQ ID NO: 3969715 - DNA, 21 bp, Homo sapiens
gcagaaaagaggagaccctgg

SEQ ID NO: 3969716 - DNA, 22 bp, Homo sapiens
gcagaaaagaggagaccctgga

SEQ ID NO: 3969717 - DNA, 22 bp, Homo sapiens
gcagaacatgtgggaggaagaa

SEQ ID NO: 3969718 - DNA, 13 bp, Homo sapiens
gcagaacggagcc

SEQ ID NO: 3969719 - DNA, 21 bp, Homo sapiens
gcagaacgtattggtccagct

SEQ ID NO: 3969720 - DNA, 22 bp, Homo sapiens
gcagaaggaaggcagggaggag

SEQ ID NO: 3969721 - DNA, 14 bp, Homo sapiens
gcagaaggccaaga

SEQ ID NO: 3969722 - DNA, 17 bp, Homo sapiens
gcagaatgtttttaaaa

SEQ ID NO: 3969723 - DNA, 14 bp, Homo sapiens
gcagacaagagctg

SEQ ID NO: 3969724 - DNA, 15 bp, Homo sapiens
gcagacaagagctgc

SEQ ID NO: 3969725 - DNA, 12 bp, Homo sapiens
gcagacagagaa

SEQ ID NO: 3969726 - DNA, 13 bp, Homo sapiens
gcagacagagaaa

SEQ ID NO: 3969727 - DNA, 17 bp, Homo sapiens
gcagacaggaggaatca

SEQ ID NO: 3969728 - DNA, 23 bp, Homo sapiens
gcagaccgggggccagacacaga

SEQ ID NO: 3969729 - DNA, 18 bp, Homo sapiens
gcagacgcagcagctggg

SEQ ID NO: 3969730 - DNA, 21 bp, Homo sapiens
gcagacgcagcagctgggacc

SEQ ID NO: 3969731 - DNA, 15 bp, Homo sapiens
gcagagaaagaagag

SEQ ID NO: 3969732 - DNA, 16 bp, Homo sapiens
gcagagaaagaagaga

SEQ ID NO: 3969733 - DNA, 14 bp, Homo sapiens
gcagagagaagcct

SEQ ID NO: 3969734 - DNA, 15 bp, Homo sapiens
gcagagccatgggcc

SEQ ID NO: 3969735 - DNA, 22 bp, Homo sapiens
gcagagccatgggcctgggcct

SEQ ID NO: 3969736 - DNA, 19 bp, Homo sapiens
gcagagcggggaggtgcct

SEQ ID NO: 3969737 - DNA, 22 bp, Homo sapiens
gcagagcggggaggtgcctgag

SEQ ID NO: 3969738 - DNA, 14 bp, Homo sapiens
gcagagctctgccg

SEQ ID NO: 3969739 - DNA, 21 bp, Homo sapiens
gcagagctgatggagaaggaa

SEQ ID NO: 3969740 - DNA, 23 bp, Homo sapiens
gcagagctgatggagaaggaagg

SEQ ID NO: 3969741 - DNA, 23 bp, Homo sapiens
gcagaggatgttctggacctccc

SEQ ID NO: 3969742 - DNA, 19 bp, Homo sapiens
gcagaggcggaaaccttgc

SEQ ID NO: 3969743 - DNA, 21 bp, Homo sapiens
gcagaggcggaaaccttgcag

SEQ ID NO: 3969744 - DNA, 22 bp, Homo sapiens
gcagaggcggaaaccttgcagc

SEQ ID NO: 3969745 - DNA, 11 bp, Homo sapiens
gcagaggctgg

SEQ ID NO: 3969746 - DNA, 18 bp, Homo sapiens
gcagaggggcagccgcta

SEQ ID NO: 3969747 - DNA, 21 bp, Homo sapiens
gcagaggggcagccgctagga

SEQ ID NO: 3969748 - DNA, 22 bp, Homo sapiens
gcagaggggcagccgctaggag

SEQ ID NO: 3969749 - DNA, 19 bp, Homo sapiens
gcagaggggtaggcagagc

SEQ ID NO: 3969750 - DNA, 19 bp, Homo sapiens
gcagaggggtgctgctcct

SEQ ID NO: 3969751 - DNA, 23 bp, Homo sapiens
gcagaggtaaaagtgtgagcagt

SEQ ID NO: 3969752 - DNA, 15 bp, Homo sapiens
gcagaggtgagcaga

SEQ ID NO: 3969753 - DNA, 18 bp, Homo sapiens
gcagaggtgagcagagga

SEQ ID NO: 3969754 - DNA, 19 bp, Homo sapiens
gcagaggtgagcagaggag

SEQ ID NO: 3969755 - DNA, 14 bp, Homo sapiens
gcagaggtggccag

SEQ ID NO: 3969756 - DNA, 16 bp, Homo sapiens
gcagagtataggatgg

SEQ ID NO: 3969757 - DNA, 15 bp, Homo sapiens
gcagataaagacagc

SEQ ID NO: 3969758 - DNA, 16 bp, Homo sapiens
gcagataaagacagct

SEQ ID NO: 3969759 - DNA, 17 bp, Homo sapiens
gcagatagccagacaca

SEQ ID NO: 3969760 - DNA, 14 bp, Homo sapiens
gcagatgtaggagg

SEQ ID NO: 3969761 - DNA, 14 bp, Homo sapiens
gcagattcctgggc

SEQ ID NO: 3969762 - DNA, 14 bp, Homo sapiens
gcagcaactcccac

SEQ ID NO: 3969763 - DNA, 16 bp, Homo sapiens
gcagcaaggcccgagc

SEQ ID NO: 3969764 - DNA, 11 bp, Homo sapiens
gcagcacttta

SEQ ID NO: 3969765 - DNA, 17 bp, Homo sapiens
gcagcagccagccctgc

SEQ ID NO: 3969766 - DNA, 20 bp, Homo sapiens
gcagcagccagccctgcctg

SEQ ID NO: 3969767 - DNA, 12 bp, Homo sapiens
gcagcagcccag

SEQ ID NO: 3969768 - DNA, 13 bp, Homo sapiens
gcagcagcccagc

SEQ ID NO: 3969769 - DNA, 16 bp, Homo sapiens
gcagcagctaggactg

SEQ ID NO: 3969770 - DNA, 15 bp, Homo sapiens
gcagcagctgggacc

SEQ ID NO: 3969771 - DNA, 23 bp, Homo sapiens
gcagcagctgggacccctcccaa

SEQ ID NO: 3969772 - DNA, 18 bp, Homo sapiens
gcagcaggtgcaagagac

SEQ ID NO: 3969773 - DNA, 21 bp, Homo sapiens
gcagcaggtgcaagagacaga

SEQ ID NO: 3969774 - DNA, 18 bp, Homo sapiens
gcagcagttccatgaaga

SEQ ID NO: 3969775 - DNA, 20 bp, Homo sapiens
gcagcagttccatgaagaca

SEQ ID NO: 3969776 - DNA, 21 bp, Homo sapiens
gcagcagttccatgaagacac

SEQ ID NO: 3969777 - DNA, 15 bp, Homo sapiens
gcagcattcagcaca

SEQ ID NO: 3969778 - DNA, 20 bp, Homo sapiens
gcagcattcagcacacccca

SEQ ID NO: 3969779 - DNA, 21 bp, Homo sapiens
gcagcattcagcacaccccaa

SEQ ID NO: 3969780 - DNA, 21 bp, Homo sapiens
gcagccacacttctcaggaca

SEQ ID NO: 3969781 - DNA, 14 bp, Homo sapiens
gcagccaccctgag

SEQ ID NO: 3969782 - DNA, 16 bp, Homo sapiens
gcagccaccctgagga

SEQ ID NO: 3969783 - DNA, 12 bp, Homo sapiens
gcagccagccag

SEQ ID NO: 3969784 - DNA, 15 bp, Homo sapiens
gcagccagcccagcc

SEQ ID NO: 3969785 - DNA, 13 bp, Homo sapiens
gcagccagccctg

SEQ ID NO: 3969786 - DNA, 19 bp, Homo sapiens
gcagccagccctgcctgga

SEQ ID NO: 3969787 - DNA, 23 bp, Homo sapiens
gcagccatgaccagttctggcca

SEQ ID NO: 3969788 - DNA, 11 bp, Homo sapiens
gcagccatgcc

SEQ ID NO: 3969789 - DNA, 14 bp, Homo sapiens
gcagccatgcctca

SEQ ID NO: 3969790 - DNA, 13 bp, Homo sapiens
gcagcccagcttc

SEQ ID NO: 3969791 - DNA, 17 bp, Homo sapiens
gcagcccagcttcctgg

SEQ ID NO: 3969792 - DNA, 15 bp, Homo sapiens
gcagcccccactttc

SEQ ID NO: 3969793 - DNA, 17 bp, Homo sapiens
gcagcccgaagcccagt

SEQ ID NO: 3969794 - DNA, 20 bp, Homo sapiens
gcagcccgtgaagcagtgcc

SEQ ID NO: 3969795 - DNA, 22 bp, Homo sapiens
gcagcccgtgaagcagtgcctc

SEQ ID NO: 3969796 - DNA, 23 bp, Homo sapiens
gcagccctaaggatctctcagga

SEQ ID NO: 3969797 - DNA, 18 bp, Homo sapiens
gcagccctcctcaccccg

SEQ ID NO: 3969798 - DNA, 19 bp, Homo sapiens
gcagccctgggggccagct

SEQ ID NO: 3969799 - DNA, 17 bp, Homo sapiens
gcagcccttcctcctga

SEQ ID NO: 3969800 - DNA, 16 bp, Homo sapiens
gcagccgctaggagag

SEQ ID NO: 3969801 - DNA, 19 bp, Homo sapiens
gcagccgctaggagagact

SEQ ID NO: 3969802 - DNA, 18 bp, Homo sapiens
gcagccgtgccttcagct

SEQ ID NO: 3969803 - DNA, 14 bp, Homo sapiens
gcagcctccagagc

SEQ ID NO: 3969804 - DNA, 15 bp, Homo sapiens
gcagcctccagagcc

SEQ ID NO: 3969805 - DNA, 18 bp, Homo sapiens
gcagcctccagagccagc

SEQ ID NO: 3969806 - DNA, 23 bp, Homo sapiens
gcagcctccagagccagcctggg

SEQ ID NO: 3969807 - DNA, 14 bp, Homo sapiens
gcagcctcctgggc

SEQ ID NO: 3969808 - DNA, 15 bp, Homo sapiens
gcagcctctctgcta

SEQ ID NO: 3969809 - DNA, 14 bp, Homo sapiens
gcagcctgatggcc

SEQ ID NO: 3969810 - DNA, 19 bp, Homo sapiens
gcagcctgatggccaaggg

SEQ ID NO: 3969811 - DNA, 21 bp, Homo sapiens
gcagcctgatggccaaggggg

SEQ ID NO: 3969812 - DNA, 11 bp, Homo sapiens
gcagcctggcg

SEQ ID NO: 3969813 - DNA, 21 bp, Homo sapiens
gcagcctggcggggcaggagg

SEQ ID NO: 3969814 - DNA, 22 bp, Homo sapiens
gcagcctggcggggcaggaggc

SEQ ID NO: 3969815 - DNA, 16 bp, Homo sapiens
gcagccttcttttcaa

SEQ ID NO: 3969816 - DNA, 21 bp, Homo sapiens
gcagctagactggagtgaggc

SEQ ID NO: 3969817 - DNA, 21 bp, Homo sapiens
gcagctaggactgaggagtgg

SEQ ID NO: 3969818 - DNA, 17 bp, Homo sapiens
gcagctcctctccttgg

SEQ ID NO: 3969819 - DNA, 16 bp, Homo sapiens
gcagctcctctgtctc

SEQ ID NO: 3969820 - DNA, 20 bp, Homo sapiens
gcagctcctctgtctcgagc

SEQ ID NO: 3969821 - DNA, 12 bp, Homo sapiens
gcagctgagcag

SEQ ID NO: 3969822 - DNA, 18 bp, Homo sapiens
gcagctgagcagggccgg

SEQ ID NO: 3969823 - DNA, 19 bp, Homo sapiens
gcagctgagcagggccggg

SEQ ID NO: 3969824 - DNA, 19 bp, Homo sapiens
gcagctgcgggtctgaagg

SEQ ID NO: 3969825 - DNA, 20 bp, Homo sapiens
gcagctgcgggtctgaagga

SEQ ID NO: 3969826 - DNA, 22 bp, Homo sapiens
gcagctgctgaagttctgagcc

SEQ ID NO: 3969827 - DNA, 13 bp, Homo sapiens
gcagctggctctc

SEQ ID NO: 3969828 - DNA, 15 bp, Homo sapiens
gatctgcctgggcct

SEQ ID NO: 3969829 - DNA, 16 bp, Homo sapiens
gatctgcctgggcctg

SEQ ID NO: 3969830 - DNA, 18 bp, Homo sapiens
gatctgcctgggcctgtg

SEQ ID NO: 3969831 - DNA, 17 bp, Homo sapiens
gatctgggaccctttcc

SEQ ID NO: 3969832 - DNA, 11 bp, Homo sapiens
gatctgggagg

SEQ ID NO: 3969833 - DNA, 14 bp, Homo sapiens
gatctgtactgtaa

SEQ ID NO: 3969834 - DNA, 15 bp, Homo sapiens
gatctgtatatacaa

SEQ ID NO: 3969835 - DNA, 20 bp, Homo sapiens
gatctgtatttaatggtttt

SEQ ID NO: 3969836 - DNA, 13 bp, Homo sapiens
gatctttaaaata

SEQ ID NO: 3969837 - DNA, 14 bp, Homo sapiens
gatctttaaaatac

SEQ ID NO: 3969838 - DNA, 15 bp, Homo sapiens
gatctttcaggaaag

SEQ ID NO: 3969839 - DNA, 14 bp, Homo sapiens
gatgaaagaggagg

SEQ ID NO: 3969840 - DNA, 15 bp, Homo sapiens
gatgaagagaagctg

SEQ ID NO: 3969841 - DNA, 21 bp, Homo sapiens
gatgaagagtgagagggcatg

SEQ ID NO: 3969842 - DNA, 21 bp, Homo sapiens
gatgaaggcgtgcaaggggct

SEQ ID NO: 3969843 - DNA, 16 bp, Homo sapiens
gatgaagggcccgaga

SEQ ID NO: 3969844 - DNA, 15 bp, Homo sapiens
gatgaatagatgtga

SEQ ID NO: 3969845 - DNA, 16 bp, Homo sapiens
gatgacaaagaacagt

SEQ ID NO: 3969846 - DNA, 20 bp, Homo sapiens
gatgacacctccatttctct

SEQ ID NO: 3969847 - DNA, 13 bp, Homo sapiens
gatgaccagaaca

SEQ ID NO: 3969848 - DNA, 11 bp, Homo sapiens
gatgagaggca

SEQ ID NO: 3969849 - DNA, 15 bp, Homo sapiens
gatgagaggcagagg

SEQ ID NO: 3969850 - DNA, 17 bp, Homo sapiens
gatgagatttgccagca

SEQ ID NO: 3969851 - DNA, 12 bp, Homo sapiens
gatgagggcagc

SEQ ID NO: 3969852 - DNA, 22 bp, Homo sapiens
gatgatggttgcaaaagactaa

SEQ ID NO: 3969853 - DNA, 14 bp, Homo sapiens
gatgattaaacacc

SEQ ID NO: 3969854 - DNA, 16 bp, Homo sapiens
gatgattaaacacctg

SEQ ID NO: 3969855 - DNA, 17 bp, Homo sapiens
gatgattaaacacctga

SEQ ID NO: 3969856 - DNA, 18 bp, Homo sapiens
gatgcaacctcactatgg

SEQ ID NO: 3969857 - DNA, 20 bp, Homo sapiens
gatgcacacgcacatagaga

SEQ ID NO: 3969858 - DNA, 14 bp, Homo sapiens
gatgcacggcggca

SEQ ID NO: 3969859 - DNA, 19 bp, Homo sapiens
gatgcacggcggcagggtg

SEQ ID NO: 3969860 - DNA, 12 bp, Homo sapiens
gatgcagagggg

SEQ ID NO: 3969861 - DNA, 20 bp, Homo sapiens
gatgcatcagaaagggaggg

SEQ ID NO: 3969862 - DNA, 18 bp, Homo sapiens
gatgcatttccacactgt

SEQ ID NO: 3969863 - DNA, 12 bp, Homo sapiens
gatgccacagcc

SEQ ID NO: 3969864 - DNA, 19 bp, Homo sapiens
gatgccacagccccacagc

SEQ ID NO: 3969865 - DNA, 12 bp, Homo sapiens
gatgcctccacc

SEQ ID NO: 3969866 - DNA, 23 bp, Homo sapiens
gatgccttgagtctttaatccca

SEQ ID NO: 3969867 - DNA, 20 bp, Homo sapiens
gatgctgactgtactcctcc

SEQ ID NO: 3969868 - DNA, 20 bp, Homo sapiens
gatgctggggagaatgaaga

SEQ ID NO: 3969869 - DNA, 23 bp, Homo sapiens
gatggaccctcgcagcaggtgca

SEQ ID NO: 3969870 - DNA, 15 bp, Homo sapiens
gatggaccgggtggg

SEQ ID NO: 3969871 - DNA, 19 bp, Homo sapiens
gatggaccgggtgggcctg

SEQ ID NO: 3969872 - DNA, 22 bp, Homo sapiens
gatggaccgggtgggcctggcc

SEQ ID NO: 3969873 - DNA, 15 bp, Homo sapiens
gatggagaaggaagg

SEQ ID NO: 3969874 - DNA, 22 bp, Homo sapiens
gatggagactggtcctgtgtgc

SEQ ID NO: 3969875 - DNA, 14 bp, Homo sapiens
gatggagagagggg

SEQ ID NO: 3969876 - DNA, 15 bp, Homo sapiens
gatggagaggcggcc

SEQ ID NO: 3969877 - DNA, 23 bp, Homo sapiens
gatggaggaaaaccaagccgtgg

SEQ ID NO: 3969878 - DNA, 18 bp, Homo sapiens
gatggataacctatatga

SEQ ID NO: 3969879 - DNA, 14 bp, Homo sapiens
gatggatggacaga

SEQ ID NO: 3969880 - DNA, 14 bp, Homo sapiens
gatggcaccagagg

SEQ ID NO: 3969881 - DNA, 22 bp, Homo sapiens
gatggccaagggggtggacgca

SEQ ID NO: 3969882 - DNA, 15 bp, Homo sapiens
gatggcccttcccac

SEQ ID NO: 3969883 - DNA, 21 bp, Homo sapiens
gatggcgattccctctcaccc

SEQ ID NO: 3969884 - DNA, 22 bp, Homo sapiens
gatggcgcgggaggcaccagct

SEQ ID NO: 3969885 - DNA, 13 bp, Homo sapiens
gatggctgtgcct

SEQ ID NO: 3969886 - DNA, 19 bp, Homo sapiens
gatggctgtgcctctgcct

SEQ ID NO: 3969887 - DNA, 20 bp, Homo sapiens
gatggctgtgcctctgcctg

SEQ ID NO: 3969888 - DNA, 22 bp, Homo sapiens
gatgggacattccaaagaacag

SEQ ID NO: 3969889 - DNA, 16 bp, Homo sapiens
gatgggcattgggctg

SEQ ID NO: 3969890 - DNA, 12 bp, Homo sapiens
gatgggccaggg

SEQ ID NO: 3969891 - DNA, 11 bp, Homo sapiens
gatggggagaa

SEQ ID NO: 3969892 - DNA, 14 bp, Homo sapiens
gatggggagaaagg

SEQ ID NO: 3969893 - DNA, 16 bp, Homo sapiens
gatgggggatgggcca

SEQ ID NO: 3969894 - DNA, 23 bp, Homo sapiens
gatggtagcagataaagacagct

SEQ ID NO: 3969895 - DNA, 14 bp, Homo sapiens
gatggtgagctggg

SEQ ID NO: 3969896 - DNA, 13 bp, Homo sapiens
gatggttcccctg

SEQ ID NO: 3969897 - DNA, 21 bp, Homo sapiens
gatgtaaacagtgcctgctga

SEQ ID NO: 3969898 - DNA, 13 bp, Homo sapiens
gatgtaggaggga

SEQ ID NO: 3969899 - DNA, 14 bp, Homo sapiens
gatgtaggagggac

SEQ ID NO: 3969900 - DNA, 19 bp, Homo sapiens
gatgtagggtaaggtgcct

SEQ ID NO: 3969901 - DNA, 20 bp, Homo sapiens
gatgtagggtaaggtgcctt

SEQ ID NO: 3969902 - DNA, 22 bp, Homo sapiens
gatgtcagccgagccgggcctg

SEQ ID NO: 3969903 - DNA, 20 bp, Homo sapiens
gatgtcatccccttgtgtca

SEQ ID NO: 3969904 - DNA, 16 bp, Homo sapiens
gatgtcccctgtccca

SEQ ID NO: 3969905 - DNA, 22 bp, Homo sapiens
gatgtcccctgtcccaccaact

SEQ ID NO: 3969906 - DNA, 16 bp, Homo sapiens
gatgtgctggagctgg

SEQ ID NO: 3969907 - DNA, 21 bp, Homo sapiens
gatgtggccctggcctgctgg

SEQ ID NO: 3969908 - DNA, 18 bp, Homo sapiens
gatgttctggacctcccc

SEQ ID NO: 3969909 - DNA, 22 bp, Homo sapiens
gatgtttccagaaaatataaat

SEQ ID NO: 3969910 - DNA, 16 bp, Homo sapiens
gatgttttagaatgat

SEQ ID NO: 3969911 - DNA, 13 bp, Homo sapiens
gattaaacacctg

SEQ ID NO: 3969912 - DNA, 15 bp, Homo sapiens
gattaaacacctgac

SEQ ID NO: 3969913 - DNA, 16 bp, Homo sapiens
gattaaacacctgaca

SEQ ID NO: 3969914 - DNA, 14 bp, Homo sapiens
gattaatggcactg

SEQ ID NO: 3969915 - DNA, 16 bp, Homo sapiens
gattaatttatggttt

SEQ ID NO: 3969916 - DNA, 20 bp, Homo sapiens
gattaatttgagaattattc

SEQ ID NO: 3969917 - DNA, 23 bp, Homo sapiens
gattacaggccttttgactcttt

SEQ ID NO: 3969918 - DNA, 20 bp, Homo sapiens
gattacataatcaaagctac

SEQ ID NO: 3969919 - DNA, 20 bp, Homo sapiens
gattacctcctgtgtggaag

SEQ ID NO: 3969920 - DNA, 21 bp, Homo sapiens
gattacctgatcatggtcagc

SEQ ID NO: 3969921 - DNA, 22 bp, Homo sapiens
gattagaatgaaaattgtatgt

SEQ ID NO: 3969922 - DNA, 12 bp, Homo sapiens
gattagctctgg

SEQ ID NO: 3969923 - DNA, 14 bp, Homo sapiens
gattagctctggac

SEQ ID NO: 3969924 - DNA, 16 bp, Homo sapiens
gattagctctggacca

SEQ ID NO: 3969925 - DNA, 13 bp, Homo sapiens
gattattcattta

SEQ ID NO: 3969926 - DNA, 14 bp, Homo sapiens
gattattcatttaa

SEQ ID NO: 3969927 - DNA, 16 bp, Homo sapiens
gattattcatttaaaa

SEQ ID NO: 3969928 - DNA, 21 bp, Homo sapiens
gattattcatttaaaatgatt

SEQ ID NO: 3969929 - DNA, 22 bp, Homo sapiens
gattattcatttaaaatgatta

SEQ ID NO: 3969930 - DNA, 21 bp, Homo sapiens
gattatttgttatttgtacag

SEQ ID NO: 3969931 - DNA, 22 bp, Homo sapiens
gattatttgttatttgtacagt

SEQ ID NO: 3969932 - DNA, 18 bp, Homo sapiens
gattcacaatgaaatgct

SEQ ID NO: 3969933 - DNA, 22 bp, Homo sapiens
gattcacaatgaaatgctctcc

SEQ ID NO: 3969934 - DNA, 16 bp, Homo sapiens
gattcactattagaga

SEQ ID NO: 3969935 - DNA, 19 bp, Homo sapiens
gattcaggaaaaggcctgg

SEQ ID NO: 3969936 - DNA, 21 bp, Homo sapiens
gattcaggaaaaggcctgggg

SEQ ID NO: 3969937 - DNA, 15 bp, Homo sapiens
gattcataacaatgt

SEQ ID NO: 3969938 - DNA, 11 bp, Homo sapiens
gattcatgtgg

SEQ ID NO: 3969939 - DNA, 20 bp, Homo sapiens
gattccagagagtggctcct

SEQ ID NO: 3969940 - DNA, 19 bp, Homo sapiens
gattccagagcactgctcc

SEQ ID NO: 3969941 - DNA, 22 bp, Homo sapiens
gattcccaccaaggtcttcagc

SEQ ID NO: 3969942 - DNA, 13 bp, Homo sapiens
gattcccagagca

SEQ ID NO: 3969943 - DNA, 14 bp, Homo sapiens
gattccctctccca

SEQ ID NO: 3969944 - DNA, 20 bp, Homo sapiens
gattccctctcccaggcccc

SEQ ID NO: 3969945 - DNA, 17 bp, Homo sapiens
gattcctcccccagagc

SEQ ID NO: 3969946 - DNA, 20 bp, Homo sapiens
gattcctcttgcctctctca

SEQ ID NO: 3969947 - DNA, 16 bp, Homo sapiens
gattcctgggcaagaa

SEQ ID NO: 3969948 - DNA, 23 bp, Homo sapiens
gattccttttgatggggagaaag

SEQ ID NO: 3969949 - DNA, 20 bp, Homo sapiens
gattctagccaaactattct

SEQ ID NO: 3969950 - DNA, 11 bp, Homo sapiens
gattctcatgt

SEQ ID NO: 3969951 - DNA, 23 bp, Homo sapiens
gattctgggatggaccctcgcag

SEQ ID NO: 3969952 - DNA, 22 bp, Homo sapiens
gattgaggcctgccctcaggga

SEQ ID NO: 3969953 - DNA, 15 bp, Homo sapiens
gattgccccagagcc

SEQ ID NO: 3969954 - DNA, 16 bp, Homo sapiens
gattgccccagagccc

SEQ ID NO: 3969955 - DNA, 17 bp, Homo sapiens
gattggattattcattt

SEQ ID NO: 3969956 - DNA, 12 bp, Homo sapiens
gattggctcacc

SEQ ID NO: 3969957 - DNA, 16 bp, Homo sapiens
gattgttaaaataact

SEQ ID NO: 3969958 - DNA, 17 bp, Homo sapiens
gatttaacagtcattta

SEQ ID NO: 3969959 - DNA, 18 bp, Homo sapiens
gatttaacagtcatttaa

SEQ ID NO: 3969960 - DNA, 12 bp, Homo sapiens
gatttaatgttt

SEQ ID NO: 3969961 - DNA, 16 bp, Homo sapiens
gatttagatatgcaaa

SEQ ID NO: 3969962 - DNA, 18 bp, Homo sapiens
gatttagggaagcaggga

SEQ ID NO: 3969963 - DNA, 17 bp, Homo sapiens
gatttatagtttgtaca

SEQ ID NO: 3969964 - DNA, 14 bp, Homo sapiens
gatttatatctata

SEQ ID NO: 3969965 - DNA, 22 bp, Homo sapiens
gatttcaagaaaaaataaatgg

SEQ ID NO: 3969966 - DNA, 21 bp, Homo sapiens
gatttcagaaagagcaagtct

SEQ ID NO: 3969967 - DNA, 20 bp, Homo sapiens
gatttcagggaaatggaggg

SEQ ID NO: 3969968 - DNA, 20 bp, Homo sapiens
gatttcatgctatctctgtg

SEQ ID NO: 3969969 - DNA, 15 bp, Homo sapiens
gatttccaagtaata

SEQ ID NO: 3969970 - DNA, 18 bp, Homo sapiens
gatttccaggcccctgag

SEQ ID NO: 3969971 - DNA, 17 bp, Homo sapiens
gatttcctattttaaaa

SEQ ID NO: 3969972 - DNA, 22 bp, Homo sapiens
gatttcctattttaaaaccatg

SEQ ID NO: 3969973 - DNA, 14 bp, Homo sapiens
gatttctctgaaca

SEQ ID NO: 3969974 - DNA, 15 bp, Homo sapiens
gatttctctgaacag

SEQ ID NO: 3969975 - DNA, 16 bp, Homo sapiens
gatttcttttaaagaa

SEQ ID NO: 3969976 - DNA, 16 bp, Homo sapiens
gatttgaagcaaagca

SEQ ID NO: 3969977 - DNA, 22 bp, Homo sapiens
gatttgaggagcagcttcagtt

SEQ ID NO: 3969978 - DNA, 14 bp, Homo sapiens
gatttgccagcaca

SEQ ID NO: 3969979 - DNA, 20 bp, Homo sapiens
gatttgccagcacaggggcc

SEQ ID NO: 3969980 - DNA, 21 bp, Homo sapiens
gatttgctatcaaaataaatt

SEQ ID NO: 3969981 - DNA, 14 bp, Homo sapiens
gatttgtactgaaa

SEQ ID NO: 3969982 - DNA, 21 bp, Homo sapiens
gattttacctgggatatgaca

SEQ ID NO: 3969983 - DNA, 18 bp, Homo sapiens
gattttcaaagctttttc

SEQ ID NO: 3969984 - DNA, 11 bp, Homo sapiens
gattttgcaca

SEQ ID NO: 3969985 - DNA, 13 bp, Homo sapiens
gattttgtacaga

SEQ ID NO: 3969986 - DNA, 16 bp, Homo sapiens
gattttgtacagaatt

SEQ ID NO: 3969987 - DNA, 12 bp, Homo sapiens
gattttgtagtt

SEQ ID NO: 3969988 - DNA, 16 bp, Homo sapiens
gattttgtcactgtct

SEQ ID NO: 3969989 - DNA, 20 bp, Homo sapiens
gattttgtgttttttcgttc

SEQ ID NO: 3969990 - DNA, 13 bp, Homo sapiens
gcaaaaatataaa

SEQ ID NO: 3969991 - DNA, 18 bp, Homo sapiens
gcaaaacacgcaagggca

SEQ ID NO: 3969992 - DNA, 17 bp, Homo sapiens
gcaaaccatttcaaatg

SEQ ID NO: 3969993 - DNA, 16 bp, Homo sapiens
gcaaacccttctcttc

SEQ ID NO: 3969994 - DNA, 23 bp, Homo sapiens
gcaaacccttctcttctcccccc

SEQ ID NO: 3969995 - DNA, 22 bp, Homo sapiens
gcaaacctcagtcatattctta

SEQ ID NO: 3969996 - DNA, 15 bp, Homo sapiens
gcaaagaactgcccc

SEQ ID NO: 3969997 - DNA, 19 bp, Homo sapiens
gcaaagcctgttcatggca

SEQ ID NO: 3969998 - DNA, 15 bp, Homo sapiens
gcaaaggaaaccaaa

SEQ ID NO: 3969999 - DNA, 16 bp, Homo sapiens
gcaaaggaaaccaaag

SEQ ID NO: 3970000 - DNA, 18 bp, Homo sapiens
gcaaaggaaaccaaagga

SEQ ID NO: 3970001 - DNA, 18 bp, Homo sapiens
gcaaagggagcactgggt

SEQ ID NO: 3970002 - DNA, 20 bp, Homo sapiens
gcaaagggagcactgggttg

SEQ ID NO: 3970003 - DNA, 20 bp, Homo sapiens
gcaaagtaaaaaaatatgaa

SEQ ID NO: 3970004 - DNA, 16 bp, Homo sapiens
gcaaagtctaaagttt

SEQ ID NO: 3970005 - DNA, 21 bp, Homo sapiens
gcaaagtctaaagtttacagt

SEQ ID NO: 3970006 - DNA, 22 bp, Homo sapiens
gcaaagtgaagttgcttcttct

SEQ ID NO: 3970007 - DNA, 14 bp, Homo sapiens
gcaaagtgccctca

SEQ ID NO: 3970008 - DNA, 16 bp, Homo sapiens
gcaaagtgctgtaccc

SEQ ID NO: 3970009 - DNA, 23 bp, Homo sapiens
gcaaagtgctgtacccttccacc

SEQ ID NO: 3970010 - DNA, 23 bp, Homo sapiens
gcaaagttccctacttcctgtga

SEQ ID NO: 3970011 - DNA, 14 bp, Homo sapiens
gcaaatactccaag

SEQ ID NO: 3970012 - DNA, 22 bp, Homo sapiens
gcaaatactccaagcttcaagt

SEQ ID NO: 3970013 - DNA, 17 bp, Homo sapiens
gcaaatataagctggga

SEQ ID NO: 3970014 - DNA, 15 bp, Homo sapiens
gcaaatcaaccccag

SEQ ID NO: 3970015 - DNA, 20 bp, Homo sapiens
gcaaatcaaccccagactca

SEQ ID NO: 3970016 - DNA, 16 bp, Homo sapiens
gcaaatgacatgcact

SEQ ID NO: 3970017 - DNA, 19 bp, Homo sapiens
gcaaatgacatgcactgac

SEQ ID NO: 3970018 - DNA, 15 bp, Homo sapiens
gcaaatgtggctcct

SEQ ID NO: 3970019 - DNA, 13 bp, Homo sapiens
gcaaattagtaat

SEQ ID NO: 3970020 - DNA, 23 bp, Homo sapiens
gcaaatttcaaaagacatgttgt

SEQ ID NO: 3970021 - DNA, 15 bp, Homo sapiens
gcaaattttgcattt

SEQ ID NO: 3970022 - DNA, 18 bp, Homo sapiens
gcaacaagagcaaaatga

SEQ ID NO: 3970023 - DNA, 20 bp, Homo sapiens
gcaacaggttttataatttt

SEQ ID NO: 3970024 - DNA, 22 bp, Homo sapiens
gcaaccccagttctgctcctct

SEQ ID NO: 3970025 - DNA, 20 bp, Homo sapiens
gcaacccctgtacccagctc

SEQ ID NO: 3970026 - DNA, 19 bp, Homo sapiens
gcaacccgtgccaagtcca

SEQ ID NO: 3970027 - DNA, 22 bp, Homo sapiens
gcaacccttagagattgcccca

SEQ ID NO: 3970028 - DNA, 19 bp, Homo sapiens
gcaaccgtggcccttcctg

SEQ ID NO: 3970029 - DNA, 24 bp, Homo sapiens
gcaaccgtggcccttcctggacag

SEQ ID NO: 3970030 - DNA, 18 bp, Homo sapiens
gcaacctcttcctcctgg

SEQ ID NO: 3970031 - DNA, 14 bp, Homo sapiens
gcaactagccaagg

SEQ ID NO: 3970032 - DNA, 18 bp, Homo sapiens
gcaactcagaatgctcta

SEQ ID NO: 3970033 - DNA, 17 bp, Homo sapiens
gcaactctccactccat

SEQ ID NO: 3970034 - DNA, 11 bp, Homo sapiens
gcaagaaagcc

SEQ ID NO: 3970035 - DNA, 16 bp, Homo sapiens
gcaagagacagaatga

SEQ ID NO: 3970036 - DNA, 16 bp, Homo sapiens
gcaagagacagagccc

SEQ ID NO: 3970037 - DNA, 19 bp, Homo sapiens
gcaagagacagagccccca

SEQ ID NO: 3970038 - DNA, 15 bp, Homo sapiens
gcaagatatttatat

SEQ ID NO: 3970039 - DNA, 17 bp, Homo sapiens
gcaagatgaattttatc

SEQ ID NO: 3970040 - DNA, 13 bp, Homo sapiens
gcaagcagggaaa

SEQ ID NO: 3970041 - DNA, 22 bp, Homo sapiens
gcaagcagggaaagctccacgg

SEQ ID NO: 3970042 - DNA, 13 bp, Homo sapiens
gcaagccccaggg

SEQ ID NO: 3970043 - DNA, 14 bp, Homo sapiens
gcaagccccagggc

SEQ ID NO: 3970044 - DNA, 18 bp, Homo sapiens
gcaagccccagggcctgg

SEQ ID NO: 3970045 - DNA, 20 bp, Homo sapiens
gcaagccccagggcctgggg

SEQ ID NO: 3970046 - DNA, 21 bp, Homo sapiens
gcaagccccagggcctggggg

SEQ ID NO: 3970047 - DNA, 15 bp, Homo sapiens
gcaagcccctcagcc

SEQ ID NO: 3970048 - DNA, 15 bp, Homo sapiens
gcaagcgcagggagg

SEQ ID NO: 3970049 - DNA, 22 bp, Homo sapiens
gcaaggactacgttaagggaag

SEQ ID NO: 3970050 - DNA, 22 bp, Homo sapiens
gcaaggagttcgtggctgcaaa

SEQ ID NO: 3970051 - DNA, 16 bp, Homo sapiens
gcaaggcccgagcagc

SEQ ID NO: 3970052 - DNA, 20 bp, Homo sapiens
gcaaggcccgagcagctgag

SEQ ID NO: 3970053 - DNA, 21 bp, Homo sapiens
gcaaggccgctgttcacccac

SEQ ID NO: 3970054 - DNA, 15 bp, Homo sapiens
gcaagggagaagaaa

SEQ ID NO: 3970055 - DNA, 18 bp, Homo sapiens
gcaagggcatcaggcact

SEQ ID NO: 3970056 - DNA, 11 bp, Homo sapiens
gcaagggctcc

SEQ ID NO: 3970057 - DNA, 20 bp, Homo sapiens
gcaagggctccagcatccag

SEQ ID NO: 3970058 - DNA, 14 bp, Homo sapiens
gcaagtcatactta

SEQ ID NO: 3970059 - DNA, 21 bp, Homo sapiens
gcaagtctgcagcccggcgcc

SEQ ID NO: 3970060 - DNA, 22 bp, Homo sapiens
gcaagtgctatgccaagccatg

SEQ ID NO: 3970061 - DNA, 18 bp, Homo sapiens
gcaagttcagggaagcag

SEQ ID NO: 3970062 - DNA, 20 bp, Homo sapiens
gcaagttctagagaagaggc

SEQ ID NO: 3970063 - DNA, 14 bp, Homo sapiens
gcaataaaatagta

SEQ ID NO: 3970064 - DNA, 23 bp, Homo sapiens
gcaataatgtgcaaattttgcat

SEQ ID NO: 3970065 - DNA, 23 bp, Homo sapiens
gcaataattaggatctatgcaat

SEQ ID NO: 3970066 - DNA, 13 bp, Homo sapiens
gcaatccatgtta

SEQ ID NO: 3970067 - DNA, 21 bp, Homo sapiens
gcaatccatgttagtttttac

SEQ ID NO: 3970068 - DNA, 13 bp, Homo sapiens
gcaatctccaggg

SEQ ID NO: 3970069 - DNA, 15 bp, Homo sapiens
gcaatgaaaaattct

SEQ ID NO: 3970070 - DNA, 16 bp, Homo sapiens
gcaatgaaaccaaagc

SEQ ID NO: 3970071 - DNA, 17 bp, Homo sapiens
gcaatgatgtccagaag

SEQ ID NO: 3970072 - DNA, 17 bp, Homo sapiens
gcaatgggagggggctc

SEQ ID NO: 3970073 - DNA, 16 bp, Homo sapiens
gcaatgggcactggga

SEQ ID NO: 3970074 - DNA, 20 bp, Homo sapiens
gcaatggtgttgccctgagt

SEQ ID NO: 3970075 - DNA, 13 bp, Homo sapiens
gcaattgccctgt

SEQ ID NO: 3970076 - DNA, 15 bp, Homo sapiens
gcaattgcttaggat

SEQ ID NO: 3970077 - DNA, 18 bp, Homo sapiens
gcaatttccttttttgtt

SEQ ID NO: 3970078 - DNA, 19 bp, Homo sapiens
gcaattttaattgattatt

SEQ ID NO: 3970079 - DNA, 18 bp, Homo sapiens
gcaattttgcatttgaat

SEQ ID NO: 3970080 - DNA, 14 bp, Homo sapiens
gcacaaatatttat

SEQ ID NO: 3970081 - DNA, 19 bp, Homo sapiens
gcacaagcttgtatataca

SEQ ID NO: 3970082 - DNA, 21 bp, Homo sapiens
gcacaagcttgtatatacata

SEQ ID NO: 3970083 - DNA, 15 bp, Homo sapiens
gcacaatttagaaaa

SEQ ID NO: 3970084 - DNA, 16 bp, Homo sapiens
gcacaatttagaaaac

SEQ ID NO: 3970085 - DNA, 18 bp, Homo sapiens
gcacaatttagaaaacat

SEQ ID NO: 3970086 - DNA, 18 bp, Homo sapiens
gcacacaaacacctccta

SEQ ID NO: 3970087 - DNA, 14 bp, Homo sapiens
gcacacacacagag

SEQ ID NO: 3970088 - DNA, 21 bp, Homo sapiens
gcacacacaccgatgctgact

SEQ ID NO: 3970089 - DNA, 17 bp, Homo sapiens
gcacacacacggatgca

SEQ ID NO: 3970090 - DNA, 14 bp, Homo sapiens
gcacacacagctcc

SEQ ID NO: 3970091 - DNA, 13 bp, Homo sapiens
gcacacacatgga

SEQ ID NO: 3970092 - DNA, 14 bp, Homo sapiens
gcacacagaaatat

SEQ ID NO: 3970093 - DNA, 16 bp, Homo sapiens
gcacacagcagccccc

SEQ ID NO: 3970094 - DNA, 19 bp, Homo sapiens
gcacacagcagccccccag

SEQ ID NO: 3970095 - DNA, 13 bp, Homo sapiens
gcacaccaaaaaa

SEQ ID NO: 3970096 - DNA, 14 bp, Homo sapiens
gcacaccactgccc

SEQ ID NO: 3970097 - DNA, 18 bp, Homo sapiens
gcacaccactgccctgcc

SEQ ID NO: 3970098 - DNA, 14 bp, Homo sapiens
gcacaccccaaggg

SEQ ID NO: 3970099 - DNA, 15 bp, Homo sapiens
gcacaccccaaggga

SEQ ID NO: 3970100 - DNA, 15 bp, Homo sapiens
gcacagacttctgga

SEQ ID NO: 3970101 - DNA, 19 bp, Homo sapiens
gcacagacttctggaaggc

SEQ ID NO: 3970102 - DNA, 23 bp, Homo sapiens
gcacagacttctggaaggctggc

SEQ ID NO: 3970103 - DNA, 18 bp, Homo sapiens
gcacagagatatgcacac

SEQ ID NO: 3970104 - DNA, 19 bp, Homo sapiens
gcacagagggctagggagg

SEQ ID NO: 3970105 - DNA, 22 bp, Homo sapiens
gcacagcagtggagagtgttcc

SEQ ID NO: 3970106 - DNA, 11 bp, Homo sapiens
gcacagccctg

SEQ ID NO: 3970107 - DNA, 13 bp, Homo sapiens
gcacagccctggg

SEQ ID NO: 3970108 - DNA, 14 bp, Homo sapiens
gcacagccctggga

SEQ ID NO: 3970109 - DNA, 18 bp, Homo sapiens
gcacagcgcgggcggagg

SEQ ID NO: 3970110 - DNA, 23 bp, Homo sapiens
gcacagcgcgggcggaggcggct

SEQ ID NO: 3970111 - DNA, 12 bp, Homo sapiens
gcacagctgctt

SEQ ID NO: 3970112 - DNA, 16 bp, Homo sapiens
gcacaggagctacctg

SEQ ID NO: 3970113 - DNA, 20 bp, Homo sapiens
gcacaggagctacctgtgtg

SEQ ID NO: 3970114 - DNA, 18 bp, Homo sapiens
gcacaggcaggaagagag

SEQ ID NO: 3970115 - DNA, 20 bp, Homo sapiens
gcacaggcaggaagagagag

SEQ ID NO: 3970116 - DNA, 14 bp, Homo sapiens
gcacaggtgtaaat

SEQ ID NO: 3970117 - DNA, 19 bp, Homo sapiens
gcacagtgcatctcagccc

SEQ ID NO: 3970118 - DNA, 20 bp, Homo sapiens
gcacagtgcatctcagccca

SEQ ID NO: 3970119 - DNA, 21 bp, Homo sapiens
gcacagtgcatctcagcccac

SEQ ID NO: 3970120 - DNA, 20 bp, Homo sapiens
gcacagttttctgagaaaga

SEQ ID NO: 3970121 - DNA, 15 bp, Homo sapiens
gcacatccattccca

SEQ ID NO: 3970122 - DNA, 21 bp, Homo sapiens
gcacatccattcccaagaaat

SEQ ID NO: 3970123 - DNA, 23 bp, Homo sapiens
gcacatccattcccaagaaatgc

SEQ ID NO: 3970124 - DNA, 18 bp, Homo sapiens
gcacatgtgtctgtgtgg

SEQ ID NO: 3970125 - DNA, 13 bp, Homo sapiens
gcacattcctggc

SEQ ID NO: 3970126 - DNA, 15 bp, Homo sapiens
gcacattcctggccc

SEQ ID NO: 3970127 - DNA, 16 bp, Homo sapiens
gcacattcctggcccc

SEQ ID NO: 3970128 - DNA, 20 bp, Homo sapiens
gcacattcttaaaggaaaag

SEQ ID NO: 3970129 - DNA, 16 bp, Homo sapiens
gcacatttatatatat

SEQ ID NO: 3970130 - DNA, 20 bp, Homo sapiens
gcaccaattgtacattccct

SEQ ID NO: 3970131 - DNA, 14 bp, Homo sapiens
gcaccagccccctg

SEQ ID NO: 3970132 - DNA, 16 bp, Homo sapiens
gcaccagccccctgga

SEQ ID NO: 3970133 - DNA, 17 bp, Homo sapiens
gcaccagccccctggat

SEQ ID NO: 3970134 - DNA, 17 bp, Homo sapiens
gcaccagcccttccctg

SEQ ID NO: 3970135 - DNA, 18 bp, Homo sapiens
gcaccagcccttccctgc

SEQ ID NO: 3970136 - DNA, 12 bp, Homo sapiens
gcaccagctctg

SEQ ID NO: 3970137 - DNA, 16 bp, Homo sapiens
gcaccagctctgtggc

SEQ ID NO: 3970138 - DNA, 19 bp, Homo sapiens
gcaccagctctgtggcctg

SEQ ID NO: 3970139 - DNA, 14 bp, Homo sapiens
gcaccagctgctct

SEQ ID NO: 3970140 - DNA, 17 bp, Homo sapiens
gcaccagctgctctgcc

SEQ ID NO: 3970141 - DNA, 19 bp, Homo sapiens
gcaccagcttctccaggct

SEQ ID NO: 3970142 - DNA, 20 bp, Homo sapiens
gcaccagcttctccaggctc

SEQ ID NO: 3970143 - DNA, 21 bp, Homo sapiens
gcaccaggcacgaacccacct

SEQ ID NO: 3970144 - DNA, 20 bp, Homo sapiens
gcaccatctctgattttcaa

SEQ ID NO: 3970145 - DNA, 17 bp, Homo sapiens
gcacccacctccacccc

SEQ ID NO: 3970146 - DNA, 18 bp, Homo sapiens
gcacccactcaccagggt

SEQ ID NO: 3970147 - DNA, 19 bp, Homo sapiens
gcacccactcaccagggtc

SEQ ID NO: 3970148 - DNA, 17 bp, Homo sapiens
gcacccagaaattcctt

SEQ ID NO: 3970149 - DNA, 14 bp, Homo sapiens
gcacccaggctcca

SEQ ID NO: 3970150 - DNA, 14 bp, Homo sapiens
gcacccccagcctg

SEQ ID NO: 3970151 - DNA, 16 bp, Homo sapiens
gcacccccagcctggg

SEQ ID NO: 3970152 - DNA, 18 bp, Homo sapiens
gcacccccagcctgggcc

SEQ ID NO: 3970153 - DNA, 19 bp, Homo sapiens
gcaccccggatcgaggaca

SEQ ID NO: 3970154 - DNA, 16 bp, Homo sapiens
gcaccctcccccgcag

SEQ ID NO: 3970155 - DNA, 23 bp, Homo sapiens
gcaccctggaaaggggagttgag

SEQ ID NO: 3970156 - DNA, 12 bp, Homo sapiens
gcaccctgggtg

SEQ ID NO: 3970157 - DNA, 13 bp, Homo sapiens
gcaccctgggtgc

SEQ ID NO: 3970158 - DNA, 19 bp, Homo sapiens
gcacccttctttcctcttc

SEQ ID NO: 3970159 - DNA, 19 bp, Homo sapiens
gcacctaaaccaccagtgc

SEQ ID NO: 3970160 - DNA, 12 bp, Homo sapiens
gcacctcagaca

SEQ ID NO: 3970161 - DNA, 14 bp, Homo sapiens
gcacctcagacaat

SEQ ID NO: 3970162 - DNA, 21 bp, Homo sapiens
gcacctcagacaatccactct

SEQ ID NO: 3970163 - DNA, 19 bp, Homo sapiens
gcacctccccccactgcag

SEQ ID NO: 3970164 - DNA, 15 bp, Homo sapiens
gcacctcctgagaag

SEQ ID NO: 3970165 - DNA, 20 bp, Homo sapiens
gcacctgaaccccatgggct

SEQ ID NO: 3970166 - DNA, 23 bp, Homo sapiens
gcacctgcatccgtagttccctg

SEQ ID NO: 3970167 - DNA, 21 bp, Homo sapiens
gcacctgcgagaggtccctgc

SEQ ID NO: 3970168 - DNA, 15 bp, Homo sapiens
gcacctgctggaaac

SEQ ID NO: 3970169 - DNA, 20 bp, Homo sapiens
gcacctgcttcatgctcagc

SEQ ID NO: 3970170 - DNA, 15 bp, Homo sapiens
gcacctggcctgctg

SEQ ID NO: 3970171 - DNA, 22 bp, Homo sapiens
gaggatctagcttcatgcctca

SEQ ID NO: 3970172 - DNA, 14 bp, Homo sapiens
gaggatgcagaggg

SEQ ID NO: 3970173 - DNA, 14 bp, Homo sapiens
gaggatgccacagc

SEQ ID NO: 3970174 - DNA, 16 bp, Homo sapiens
gaggatgccacagccc

SEQ ID NO: 3970175 - DNA, 22 bp, Homo sapiens
gaggatgccacagccccacagc

SEQ ID NO: 3970176 - DNA, 23 bp, Homo sapiens
gaggatgccacagccccacagca

SEQ ID NO: 3970177 - DNA, 12 bp, Homo sapiens
gaggatggagag

SEQ ID NO: 3970178 - DNA, 12 bp, Homo sapiens
gaggatgttctg

SEQ ID NO: 3970179 - DNA, 23 bp, Homo sapiens
gaggattgcttcttgtgaaacca

SEQ ID NO: 3970180 - DNA, 18 bp, Homo sapiens
gaggatttaactgtgaac

SEQ ID NO: 3970181 - DNA, 15 bp, Homo sapiens
gaggatttcaagcct

SEQ ID NO: 3970182 - DNA, 14 bp, Homo sapiens
gaggattttccagt

SEQ ID NO: 3970183 - DNA, 17 bp, Homo sapiens
gaggcaaaggccagcag

SEQ ID NO: 3970184 - DNA, 18 bp, Homo sapiens
gaggcaaggttatatgca

SEQ ID NO: 3970185 - DNA, 14 bp, Homo sapiens
gaggcaccagctct

SEQ ID NO: 3970186 - DNA, 23 bp, Homo sapiens
gaggcaccagctctgtggcctgt

SEQ ID NO: 3970187 - DNA, 15 bp, Homo sapiens
gaggcaccggcgctg

SEQ ID NO: 3970188 - DNA, 23 bp, Homo sapiens
gaggcagaagaattgaacccagg

SEQ ID NO: 3970189 - DNA, 18 bp, Homo sapiens
gaggcagaggcagacagg

SEQ ID NO: 3970190 - DNA, 23 bp, Homo sapiens
gaggcagcgtgaaagcagatgag

SEQ ID NO: 3970191 - DNA, 14 bp, Homo sapiens
gaggcagctccaac

SEQ ID NO: 3970192 - DNA, 15 bp, Homo sapiens
gaggcagggagggga

SEQ ID NO: 3970193 - DNA, 17 bp, Homo sapiens
gaggcagggccttgccc

SEQ ID NO: 3970194 - DNA, 20 bp, Homo sapiens
gaggcagggccttgcccaga

SEQ ID NO: 3970195 - DNA, 22 bp, Homo sapiens
gaggcagggccttgcccagaga

SEQ ID NO: 3970196 - DNA, 23 bp, Homo sapiens
gaggcagggccttgcccagagat

SEQ ID NO: 3970197 - DNA, 15 bp, Homo sapiens
gaggcatggccctgg

SEQ ID NO: 3970198 - DNA, 14 bp, Homo sapiens
gaggccaaggcagg

SEQ ID NO: 3970199 - DNA, 13 bp, Homo sapiens
gaggccaaggtgg

SEQ ID NO: 3970200 - DNA, 11 bp, Homo sapiens
gaggccagcct

SEQ ID NO: 3970201 - DNA, 19 bp, Homo sapiens
gaggccagcctggcctcct

SEQ ID NO: 3970202 - DNA, 18 bp, Homo sapiens
gaggccaggaatctgcca

SEQ ID NO: 3970203 - DNA, 19 bp, Homo sapiens
gaggccaggaatctgccat

SEQ ID NO: 3970204 - DNA, 16 bp, Homo sapiens
gaggcccagcctgtcc

SEQ ID NO: 3970205 - DNA, 13 bp, Homo sapiens
gaggcccagggag

SEQ ID NO: 3970206 - DNA, 13 bp, Homo sapiens
gaggccctggatc

SEQ ID NO: 3970207 - DNA, 14 bp, Homo sapiens
gaggccctggatca

SEQ ID NO: 3970208 - DNA, 22 bp, Homo sapiens
gaggccctggatcagcgtggcc

SEQ ID NO: 3970209 - DNA, 20 bp, Homo sapiens
gaggccctggtgtcaggcag

SEQ ID NO: 3970210 - DNA, 20 bp, Homo sapiens
gaggcctcacacccagaggg

SEQ ID NO: 3970211 - DNA, 14 bp, Homo sapiens
gaggcctcatccct

SEQ ID NO: 3970212 - DNA, 19 bp, Homo sapiens
gaggcctcgtaccagccag

SEQ ID NO: 3970213 - DNA, 14 bp, Homo sapiens
gaggcctgatgctg

SEQ ID NO: 3970214 - DNA, 20 bp, Homo sapiens
gaggcctgccctcagggatc

SEQ ID NO: 3970215 - DNA, 15 bp, Homo sapiens
gaggcctggccaggc

SEQ ID NO: 3970216 - DNA, 16 bp, Homo sapiens
gaggcctggccaggca

SEQ ID NO: 3970217 - DNA, 15 bp, Homo sapiens
gaggcgaataaatgt

SEQ ID NO: 3970218 - DNA, 16 bp, Homo sapiens
gaggcgaataaatgtt

SEQ ID NO: 3970219 - DNA, 17 bp, Homo sapiens
gaggcgaataaatgttc

SEQ ID NO: 3970220 - DNA, 22 bp, Homo sapiens
gaggcgcagcccgaagcccagt

SEQ ID NO: 3970221 - DNA, 17 bp, Homo sapiens
gaggcgccccaacccgt

SEQ ID NO: 3970222 - DNA, 16 bp, Homo sapiens
gaggcggaaaccttgc

SEQ ID NO: 3970223 - DNA, 20 bp, Homo sapiens
gaggcggaaaccttgcagca

SEQ ID NO: 3970224 - DNA, 20 bp, Homo sapiens
gaggcggctccaggtccgga

SEQ ID NO: 3970225 - DNA, 21 bp, Homo sapiens
gaggctagaaccaagaagggc

SEQ ID NO: 3970226 - DNA, 17 bp, Homo sapiens
gaggctcaagaggccca

SEQ ID NO: 3970227 - DNA, 18 bp, Homo sapiens
gaggctcaagaggcccag

SEQ ID NO: 3970228 - DNA, 20 bp, Homo sapiens
gaggctcaagaggcccaggg

SEQ ID NO: 3970229 - DNA, 14 bp, Homo sapiens
gaggctgaggcaga

SEQ ID NO: 3970230 - DNA, 15 bp, Homo sapiens
gaggctgaggcagga

SEQ ID NO: 3970231 - DNA, 22 bp, Homo sapiens
gaggctgctcggggtgcacagg

SEQ ID NO: 3970232 - DNA, 14 bp, Homo sapiens
gaggctggaggcag

SEQ ID NO: 3970233 - DNA, 19 bp, Homo sapiens
gaggctggaggcagggcct

SEQ ID NO: 3970234 - DNA, 15 bp, Homo sapiens
gaggctgggccagcc

SEQ ID NO: 3970235 - DNA, 22 bp, Homo sapiens
gaggctgggccagcctcagctc

SEQ ID NO: 3970236 - DNA, 19 bp, Homo sapiens
gaggctgggcccctgggat

SEQ ID NO: 3970237 - DNA, 13 bp, Homo sapiens
gaggctggggctc

SEQ ID NO: 3970238 - DNA, 13 bp, Homo sapiens
gaggcttccaggc

SEQ ID NO: 3970239 - DNA, 15 bp, Homo sapiens
gaggcttccaggctc

SEQ ID NO: 3970240 - DNA, 20 bp, Homo sapiens
gaggcttccaggctcttcct

SEQ ID NO: 3970241 - DNA, 18 bp, Homo sapiens
gagggaacagacaggaga

SEQ ID NO: 3970242 - DNA, 21 bp, Homo sapiens
gagggaatgttccctgcaccc

SEQ ID NO: 3970243 - DNA, 16 bp, Homo sapiens
gagggacaaaggagcc

SEQ ID NO: 3970244 - DNA, 21 bp, Homo sapiens
gagggacaaaggagcctgtga

SEQ ID NO: 3970245 - DNA, 15 bp, Homo sapiens
gagggacgaagaaag

SEQ ID NO: 3970246 - DNA, 15 bp, Homo sapiens
gagggactgtcgctg

SEQ ID NO: 3970247 - DNA, 20 bp, Homo sapiens
gagggagacagagacagaaa

SEQ ID NO: 3970248 - DNA, 12 bp, Homo sapiens
gagggagcagac

SEQ ID NO: 3970249 - DNA, 19 bp, Homo sapiens
gagggagccatcccttccc

SEQ ID NO: 3970250 - DNA, 14 bp, Homo sapiens
gagggagggagagg

SEQ ID NO: 3970251 - DNA, 22 bp, Homo sapiens
gagggaggttcctcgcaggtct

SEQ ID NO: 3970252 - DNA, 13 bp, Homo sapiens
gagggatggagag

SEQ ID NO: 3970253 - DNA, 21 bp, Homo sapiens
gagggatggagaggcggcctc

SEQ ID NO: 3970254 - DNA, 21 bp, Homo sapiens
gagggatgtaactattgaatt

SEQ ID NO: 3970255 - DNA, 14 bp, Homo sapiens
gagggcagagccat

SEQ ID NO: 3970256 - DNA, 16 bp, Homo sapiens
gagggcagagccatgg

SEQ ID NO: 3970257 - DNA, 17 bp, Homo sapiens
gagggcagagccatggg

SEQ ID NO: 3970258 - DNA, 20 bp, Homo sapiens
gagggcagagccatgggcct

SEQ ID NO: 3970259 - DNA, 21 bp, Homo sapiens
gagggcagagccatgggcctg

SEQ ID NO: 3970260 - DNA, 13 bp, Homo sapiens
gagggcagcagcc

SEQ ID NO: 3970261 - DNA, 20 bp, Homo sapiens
gagggcagcagccagccctg

SEQ ID NO: 3970262 - DNA, 22 bp, Homo sapiens
gagggcagcagccagccctgcc

SEQ ID NO: 3970263 - DNA, 16 bp, Homo sapiens
gagggcagtacctggg

SEQ ID NO: 3970264 - DNA, 17 bp, Homo sapiens
gagggcagtggggagca

SEQ ID NO: 3970265 - DNA, 18 bp, Homo sapiens
gagggcagttcgcagcca

SEQ ID NO: 3970266 - DNA, 18 bp, Homo sapiens
gagggcatgggagggagg

SEQ ID NO: 3970267 - DNA, 13 bp, Homo sapiens
gagggcccagctg

SEQ ID NO: 3970268 - DNA, 14 bp, Homo sapiens
gagggcccagctgt

SEQ ID NO: 3970269 - DNA, 18 bp, Homo sapiens
gagggctagaacctggag

SEQ ID NO: 3970270 - DNA, 19 bp, Homo sapiens
gagggctagaactggagag

SEQ ID NO: 3970271 - DNA, 18 bp, Homo sapiens
gagggctagaatctggag

SEQ ID NO: 3970272 - DNA, 19 bp, Homo sapiens
gagggctagaatctggaga

SEQ ID NO: 3970273 - DNA, 14 bp, Homo sapiens
gagggctctgaggc

SEQ ID NO: 3970274 - DNA, 15 bp, Homo sapiens
gagggctctgaggcg

SEQ ID NO: 3970275 - DNA, 18 bp, Homo sapiens
gagggctggaatctggag

SEQ ID NO: 3970276 - DNA, 19 bp, Homo sapiens
gagggctggaatctggaga

SEQ ID NO: 3970277 - DNA, 21 bp, Homo sapiens
gagggctggaatctggagagc

SEQ ID NO: 3970278 - DNA, 14 bp, Homo sapiens
gagggctgggcagc

SEQ ID NO: 3970279 - DNA, 21 bp, Homo sapiens
gagggctgttggacagctgct

SEQ ID NO: 3970280 - DNA, 14 bp, Homo sapiens
gaggggaagggcca

SEQ ID NO: 3970281 - DNA, 19 bp, Homo sapiens
gaggggaataatagaagaa

SEQ ID NO: 3970282 - DNA, 22 bp, Homo sapiens
gaggggactatttatgaaggca

SEQ ID NO: 3970283 - DNA, 17 bp, Homo sapiens
gaggggcaggggagtgc

SEQ ID NO: 3970284 - DNA, 14 bp, Homo sapiens
gaggggcctctgaa

SEQ ID NO: 3970285 - DNA, 14 bp, Homo sapiens
gaggggcctggcag

SEQ ID NO: 3970286 - DNA, 18 bp, Homo sapiens
gaggggcctggcagccgt

SEQ ID NO: 3970287 - DNA, 20 bp, Homo sapiens
gaggggcctggcagccgtgc

SEQ ID NO: 3970288 - DNA, 21 bp, Homo sapiens
gagggggacgcgcacacacac

SEQ ID NO: 3970289 - DNA, 20 bp, Homo sapiens
gagggggcgctcaggaccca

SEQ ID NO: 3970290 - DNA, 19 bp, Homo sapiens
gagggggctatttctctcc

SEQ ID NO: 3970291 - DNA, 20 bp, Homo sapiens
gagggggctccatggaggag

SEQ ID NO: 3970292 - DNA, 12 bp, Homo sapiens
gagggggctctc

SEQ ID NO: 3970293 - DNA, 19 bp, Homo sapiens
gagggggtcgtggagagct

SEQ ID NO: 3970294 - DNA, 19 bp, Homo sapiens
gagggtaagacaatatgaa

SEQ ID NO: 3970295 - DNA, 19 bp, Homo sapiens
gagggtcagggcagtatct

SEQ ID NO: 3970296 - DNA, 19 bp, Homo sapiens
gagggtccccacctgggac

SEQ ID NO: 3970297 - DNA, 18 bp, Homo sapiens
gaggtaactatcaatatt

SEQ ID NO: 3970298 - DNA, 23 bp, Homo sapiens
gaggtagagtttgaaggaggtga

SEQ ID NO: 3970299 - DNA, 16 bp, Homo sapiens
gaggtcaacagagaag

SEQ ID NO: 3970300 - DNA, 22 bp, Homo sapiens
gaggtcaacagagaaggcagga

SEQ ID NO: 3970301 - DNA, 16 bp, Homo sapiens
gaggtcacattcagga

SEQ ID NO: 3970302 - DNA, 12 bp, Homo sapiens
gaggtcctcctc

SEQ ID NO: 3970303 - DNA, 14 bp, Homo sapiens
gaggtcctgagcac

SEQ ID NO: 3970304 - DNA, 21 bp, Homo sapiens
gaggtcctgagcactgccagg

SEQ ID NO: 3970305 - DNA, 23 bp, Homo sapiens
gaggtcctgagcactgccaggag

SEQ ID NO: 3970306 - DNA, 22 bp, Homo sapiens
gaggtctccactgaggatgtga

SEQ ID NO: 3970307 - DNA, 14 bp, Homo sapiens
gaggtctgagccct

SEQ ID NO: 3970308 - DNA, 20 bp, Homo sapiens
gaggtctgagccctggtgtg

SEQ ID NO: 3970309 - DNA, 15 bp, Homo sapiens
gaggtgaccccaggg

SEQ ID NO: 3970310 - DNA, 16 bp, Homo sapiens
gaggtgaccccagggc

SEQ ID NO: 3970311 - DNA, 21 bp, Homo sapiens
gaggtgaccccagggcacagg

SEQ ID NO: 3970312 - DNA, 13 bp, Homo sapiens
gaggtgcccagga

SEQ ID NO: 3970313 - DNA, 16 bp, Homo sapiens
gaggtgcccaggagaa

SEQ ID NO: 3970314 - DNA, 18 bp, Homo sapiens
gaggtgcctgagctgggg

SEQ ID NO: 3970315 - DNA, 22 bp, Homo sapiens
gaggtgcctgagctggggcctg

SEQ ID NO: 3970316 - DNA, 23 bp, Homo sapiens
gaggtgcctgagctggggcctgg

SEQ ID NO: 3970317 - DNA, 20 bp, Homo sapiens
gaggtggatcacagaggctt

SEQ ID NO: 3970318 - DNA, 21 bp, Homo sapiens
gaggtggattcctgggcaaga

SEQ ID NO: 3970319 - DNA, 17 bp, Homo sapiens
gaggtggccagagctgg

SEQ ID NO: 3970320 - DNA, 19 bp, Homo sapiens
gaggtggccagagctggga

SEQ ID NO: 3970321 - DNA, 21 bp, Homo sapiens
gaggtggccagagctgggagg

SEQ ID NO: 3970322 - DNA, 23 bp, Homo sapiens
gaggtggccagagctgggaggca

SEQ ID NO: 3970323 - DNA, 14 bp, Homo sapiens
gaggtgggcagctg

SEQ ID NO: 3970324 - DNA, 16 bp, Homo sapiens
gaggtgggcagctggg

SEQ ID NO: 3970325 - DNA, 18 bp, Homo sapiens
gaggtgtcaccctgcaga

SEQ ID NO: 3970326 - DNA, 21 bp, Homo sapiens
gaggtgtcaccctgcagagct

SEQ ID NO: 3970327 - DNA, 14 bp, Homo sapiens
gaggtgtcccaagc

SEQ ID NO: 3970328 - DNA, 13 bp, Homo sapiens
gaggttaaaatat

SEQ ID NO: 3970329 - DNA, 21 bp, Homo sapiens
gaggttaaggtgggtccagga

SEQ ID NO: 3970330 - DNA, 13 bp, Homo sapiens
gaggttatctgcc

SEQ ID NO: 3970331 - DNA, 20 bp, Homo sapiens
gaggttatctgcctggcctg

SEQ ID NO: 3970332 - DNA, 22 bp, Homo sapiens
gaggttatctgcctggcctggc

SEQ ID NO: 3970333 - DNA, 23 bp, Homo sapiens
gaggttatctgcctggcctggct

SEQ ID NO: 3970334 - DNA, 15 bp, Homo sapiens
gaggttctggggagg

SEQ ID NO: 3970335 - DNA, 19 bp, Homo sapiens
gaggttgcagtgagctgag

SEQ ID NO: 3970336 - DNA, 14 bp, Homo sapiens
gaggttgtggatgc

SEQ ID NO: 3970337 - DNA, 15 bp, Homo sapiens
gagtaatcaggcagc

SEQ ID NO: 3970338 - DNA, 21 bp, Homo sapiens
gagtaccaaatccacaagcca

SEQ ID NO: 3970339 - DNA, 20 bp, Homo sapiens
gagtactagaatttgtattt

SEQ ID NO: 3970340 - DNA, 18 bp, Homo sapiens
gagtagccgagagcctgc

SEQ ID NO: 3970341 - DNA, 21 bp, Homo sapiens
gagtagccgagagcctgctcc

SEQ ID NO: 3970342 - DNA, 17 bp, Homo sapiens
gagtagctgagaggaag

SEQ ID NO: 3970343 - DNA, 18 bp, Homo sapiens
gagtagctgagaggaaga

SEQ ID NO: 3970344 - DNA, 19 bp, Homo sapiens
gagtagctgagaggaagat

SEQ ID NO: 3970345 - DNA, 23 bp, Homo sapiens
gagtatctcggacctttcagctg

SEQ ID NO: 3970346 - DNA, 16 bp, Homo sapiens
gagtcaaaagcctggg

SEQ ID NO: 3970347 - DNA, 19 bp, Homo sapiens
gagtcaatcccctcattca

SEQ ID NO: 3970348 - DNA, 20 bp, Homo sapiens
gagtcaatcccctcattcag

SEQ ID NO: 3970349 - DNA, 14 bp, Homo sapiens
gagtcaccaggaat

SEQ ID NO: 3970350 - DNA, 18 bp, Homo sapiens
gagtcatgatctccctgc

SEQ ID NO: 3970351 - DNA, 20 bp, Homo sapiens
gagtccagggcgggagtggg

SEQ ID NO: 3970352 - DNA, 21 bp, Homo sapiens
gagtcctacagtggctgtcac

SEQ ID NO: 3970353 - DNA, 12 bp, Homo sapiens
gagtcctctgga

SEQ ID NO: 3970354 - DNA, 20 bp, Homo sapiens
gagtcctgtctctgcctgcg

SEQ ID NO: 3970355 - DNA, 19 bp, Homo sapiens
gagtcgtcatcacttttca

SEQ ID NO: 3970356 - DNA, 14 bp, Homo sapiens
gagtctcttctcca

SEQ ID NO: 3970357 - DNA, 17 bp, Homo sapiens
gagtctcttctccactg

SEQ ID NO: 3970358 - DNA, 23 bp, Homo sapiens
gagtctcttggtgatggagtgtg

SEQ ID NO: 3970359 - DNA, 13 bp, Homo sapiens
gagtctgaggtcc

SEQ ID NO: 3970360 - DNA, 16 bp, Homo sapiens
gagtctgaggtcctga

SEQ ID NO: 3970361 - DNA, 13 bp, Homo sapiens
gagtctgagtcct

SEQ ID NO: 3970362 - DNA, 15 bp, Homo sapiens
gagtctgagtcctgt

SEQ ID NO: 3970363 - DNA, 18 bp, Homo sapiens
gagtctgctatattttca

SEQ ID NO: 3970364 - DNA, 23 bp, Homo sapiens
gagtctgggcaatgaaaccaaag

SEQ ID NO: 3970365 - DNA, 21 bp, Homo sapiens
gagtcttggcctgcctcccag

SEQ ID NO: 3970366 - DNA, 23 bp, Homo sapiens
gagtgagcagtagaagcctgcag

SEQ ID NO: 3970367 - DNA, 17 bp, Homo sapiens
gagtgcaggcctgctca

SEQ ID NO: 3970368 - DNA, 13 bp, Homo sapiens
gagtgccaggact

SEQ ID NO: 3970369 - DNA, 20 bp, Homo sapiens
gagtgccaggactccccagg

SEQ ID NO: 3970370 - DNA, 13 bp, Homo sapiens
gagtggaatgcag

SEQ ID NO: 3970371 - DNA, 16 bp, Homo sapiens
gagtggatctccaagg

SEQ ID NO: 3970372 - DNA, 17 bp, Homo sapiens
gagtggatctccaagga

SEQ ID NO: 3970373 - DNA, 19 bp, Homo sapiens
gagtggatctccaaggacc

SEQ ID NO: 3970374 - DNA, 15 bp, Homo sapiens
gagtggcagccatgc

SEQ ID NO: 3970375 - DNA, 19 bp, Homo sapiens
gagtggcagccatgcctca

SEQ ID NO: 3970376 - DNA, 23 bp, Homo sapiens
gagtggcccctcacctgggcctt

SEQ ID NO: 3970377 - DNA, 15 bp, Homo sapiens
gagtggctcctcccg

SEQ ID NO: 3970378 - DNA, 23 bp, Homo sapiens
gagtggcttgtgattctgggatg

SEQ ID NO: 3970379 - DNA, 15 bp, Homo sapiens
gagtggttgttgcca

SEQ ID NO: 3970380 - DNA, 23 bp, Homo sapiens
gagtgtgggtgatcagaaggctg

SEQ ID NO: 3970381 - DNA, 22 bp, Homo sapiens
gagtgttctgtgggcttggcct

SEQ ID NO: 3970382 - DNA, 21 bp, Homo sapiens
gagttattgaatcttaatttt

SEQ ID NO: 3970383 - DNA, 19 bp, Homo sapiens
gagttcaagaccagcctgg

SEQ ID NO: 3970384 - DNA, 21 bp, Homo sapiens
gagttcttaaggattgtgata

SEQ ID NO: 3970385 - DNA, 14 bp, Homo sapiens
gagttgatgtctcc

SEQ ID NO: 3970386 - DNA, 19 bp, Homo sapiens
gagttgctcactcaggact

SEQ ID NO: 3970387 - DNA, 15 bp, Homo sapiens
gagttggacacactg

SEQ ID NO: 3970388 - DNA, 16 bp, Homo sapiens
gagttggctcaggcag

SEQ ID NO: 3970389 - DNA, 20 bp, Homo sapiens
gagttgttttggtgcctgcc

SEQ ID NO: 3970390 - DNA, 19 bp, Homo sapiens
gagtttcattctcctgcct

SEQ ID NO: 3970391 - DNA, 17 bp, Homo sapiens
gagtttgagacaagccc

SEQ ID NO: 3970392 - DNA, 18 bp, Homo sapiens
gagtttttatggggctga

SEQ ID NO: 3970393 - DNA, 19 bp, Homo sapiens
gataaacattaaacactgt

SEQ ID NO: 3970394 - DNA, 15 bp, Homo sapiens
gataaactaaaagca

SEQ ID NO: 3970395 - DNA, 18 bp, Homo sapiens
gataaagacagctgacag

SEQ ID NO: 3970396 - DNA, 12 bp, Homo sapiens
gataaagatgat

SEQ ID NO: 3970397 - DNA, 21 bp, Homo sapiens
gataaagatgtcaaatatctc

SEQ ID NO: 3970398 - DNA, 12 bp, Homo sapiens
gataaatattta

SEQ ID NO: 3970399 - DNA, 13 bp, Homo sapiens
gataacaaaatca

SEQ ID NO: 3970400 - DNA, 15 bp, Homo sapiens
gataacaaaatcaca

SEQ ID NO: 3970401 - DNA, 17 bp, Homo sapiens
gataacaacctggagac

SEQ ID NO: 3970402 - DNA, 11 bp, Homo sapiens
gataactctcc

SEQ ID NO: 3970403 - DNA, 18 bp, Homo sapiens
gataactgcaattttaat

SEQ ID NO: 3970404 - DNA, 21 bp, Homo sapiens
gataatcaattattacattta

SEQ ID NO: 3970405 - DNA, 22 bp, Homo sapiens
gataatcaattattacatttat

SEQ ID NO: 3970406 - DNA, 12 bp, Homo sapiens
gatacaaaatgc

SEQ ID NO: 3970407 - DNA, 14 bp, Homo sapiens
gatacactcctgct

SEQ ID NO: 3970408 - DNA, 20 bp, Homo sapiens
gatacactgaagttaacaga

SEQ ID NO: 3970409 - DNA, 15 bp, Homo sapiens
gatacagaatgaatc

SEQ ID NO: 3970410 - DNA, 20 bp, Homo sapiens
gatacagccccaaaccaggg

SEQ ID NO: 3970411 - DNA, 15 bp, Homo sapiens
gatacatagatggac

SEQ ID NO: 3970412 - DNA, 22 bp, Homo sapiens
gatacatagatggaccagtaga

SEQ ID NO: 3970413 - DNA, 18 bp, Homo sapiens
gatacatggggaactgca

SEQ ID NO: 3970414 - DNA, 12 bp, Homo sapiens
gatacattccct

SEQ ID NO: 3970415 - DNA, 17 bp, Homo sapiens
gatacggttgtctagag

SEQ ID NO: 3970416 - DNA, 22 bp, Homo sapiens
gatactaaaagttcttctccaa

SEQ ID NO: 3970417 - DNA, 17 bp, Homo sapiens
gatagcatttttgattt

SEQ ID NO: 3970418 - DNA, 16 bp, Homo sapiens
gatagccagacacatg

SEQ ID NO: 3970419 - DNA, 14 bp, Homo sapiens
gataggaaaagaag

SEQ ID NO: 3970420 - DNA, 16 bp, Homo sapiens
gatataaatggctggt

SEQ ID NO: 3970421 - DNA, 13 bp, Homo sapiens
gatatatatcata

SEQ ID NO: 3970422 - DNA, 11 bp, Homo sapiens
gatatatgtat

SEQ ID NO: 3970423 - DNA, 13 bp, Homo sapiens
gatatatgtattt

SEQ ID NO: 3970424 - DNA, 22 bp, Homo sapiens
gatatatgtatttattgtcatt

SEQ ID NO: 3970425 - DNA, 18 bp, Homo sapiens
gatatcacctctcttcag

SEQ ID NO: 3970426 - DNA, 21 bp, Homo sapiens
gatatccctgatcctaactga

SEQ ID NO: 3970427 - DNA, 15 bp, Homo sapiens
gatatctgaacacat

SEQ ID NO: 3970428 - DNA, 22 bp, Homo sapiens
gatatgagtatacaatatataa

SEQ ID NO: 3970429 - DNA, 20 bp, Homo sapiens
gatatgggactgagcctggc

SEQ ID NO: 3970430 - DNA, 19 bp, Homo sapiens
gatatgtaaacataattct

SEQ ID NO: 3970431 - DNA, 16 bp, Homo sapiens
gatattaaaggagtta

SEQ ID NO: 3970432 - DNA, 16 bp, Homo sapiens
gatattatggcaagtg

SEQ ID NO: 3970433 - DNA, 17 bp, Homo sapiens
gatattatttaaatgtt

SEQ ID NO: 3970434 - DNA, 13 bp, Homo sapiens
gatatttatatat

SEQ ID NO: 3970435 - DNA, 16 bp, Homo sapiens
gatatttatatatatt

SEQ ID NO: 3970436 - DNA, 19 bp, Homo sapiens
gatatttatggggggagaa

SEQ ID NO: 3970437 - DNA, 22 bp, Homo sapiens
gatattttcaacgcagccctgc

SEQ ID NO: 3970438 - DNA, 12 bp, Homo sapiens
gatatttttgta

SEQ ID NO: 3970439 - DNA, 21 bp, Homo sapiens
gatattttttcagaaatatgt

SEQ ID NO: 3970440 - DNA, 13 bp, Homo sapiens
gatcaaaaataaa

SEQ ID NO: 3970441 - DNA, 14 bp, Homo sapiens
gatcaaaaataaac

SEQ ID NO: 3970442 - DNA, 16 bp, Homo sapiens
gatcaaaaataaacta

SEQ ID NO: 3970443 - DNA, 23 bp, Homo sapiens
gatcaaattcatttttttcactg

SEQ ID NO: 3970444 - DNA, 13 bp, Homo sapiens
gatcaagtccaga

SEQ ID NO: 3970445 - DNA, 13 bp, Homo sapiens
gatcacagggccc

SEQ ID NO: 3970446 - DNA, 22 bp, Homo sapiens
gatcacagtgactttacaggag

SEQ ID NO: 3970447 - DNA, 20 bp, Homo sapiens
gatcaccagcccggcctgct

SEQ ID NO: 3970448 - DNA, 19 bp, Homo sapiens
gatcacttgagttcaggag

SEQ ID NO: 3970449 - DNA, 17 bp, Homo sapiens
gatcagaaggctggggc

SEQ ID NO: 3970450 - DNA, 11 bp, Homo sapiens
gatcagcctcc

SEQ ID NO: 3970451 - DNA, 21 bp, Homo sapiens
gatcagcctccgccattccaa

SEQ ID NO: 3970452 - DNA, 13 bp, Homo sapiens
gatcagcgtggcc

SEQ ID NO: 3970453 - DNA, 16 bp, Homo sapiens
gatcagcgtggccttg

SEQ ID NO: 3970454 - DNA, 17 bp, Homo sapiens
gatcaggaagagaagga

SEQ ID NO: 3970455 - DNA, 18 bp, Homo sapiens
gatcagttataagtagca

SEQ ID NO: 3970456 - DNA, 13 bp, Homo sapiens
gatcattttctta

SEQ ID NO: 3970457 - DNA, 17 bp, Homo sapiens
gatccacacacagagga

SEQ ID NO: 3970458 - DNA, 18 bp, Homo sapiens
gatccacacacagaggaa

SEQ ID NO: 3970459 - DNA, 18 bp, Homo sapiens
gatccaccctcaaatgtc

SEQ ID NO: 3970460 - DNA, 20 bp, Homo sapiens
gatccatttggacaaaatgg

SEQ ID NO: 3970461 - DNA, 21 bp, Homo sapiens
gatccatttggacaaaatgga

SEQ ID NO: 3970462 - DNA, 16 bp, Homo sapiens
gatcccaggccaggga

SEQ ID NO: 3970463 - DNA, 12 bp, Homo sapiens
gatcccatctct

SEQ ID NO: 3970464 - DNA, 21 bp, Homo sapiens
gatcccgtgaaattgatgcca

SEQ ID NO: 3970465 - DNA, 18 bp, Homo sapiens
gatccctgttacccagag

SEQ ID NO: 3970466 - DNA, 15 bp, Homo sapiens
gatccgctgccacca

SEQ ID NO: 3970467 - DNA, 16 bp, Homo sapiens
gatccgctgccaccac

SEQ ID NO: 3970468 - DNA, 19 bp, Homo sapiens
gatcctaactgagaatttt

SEQ ID NO: 3970469 - DNA, 19 bp, Homo sapiens
gatcctattctcaccagga

SEQ ID NO: 3970470 - DNA, 12 bp, Homo sapiens
gatcctgcagga

SEQ ID NO: 3970471 - DNA, 15 bp, Homo sapiens
gatcctgctgtggcc

SEQ ID NO: 3970472 - DNA, 17 bp, Homo sapiens
gatcctggattcactca

SEQ ID NO: 3970473 - DNA, 18 bp, Homo sapiens
gatcctggattcactcac

SEQ ID NO: 3970474 - DNA, 13 bp, Homo sapiens
gatcgaggacaag

SEQ ID NO: 3970475 - DNA, 18 bp, Homo sapiens
gatcgcttgagcccagga

SEQ ID NO: 3970476 - DNA, 20 bp, Homo sapiens
gatcggagcctcctctctca

SEQ ID NO: 3970477 - DNA, 12 bp, Homo sapiens
gatctagaaagt

SEQ ID NO: 3970478 - DNA, 19 bp, Homo sapiens
gatctagcttcatgcctca

SEQ ID NO: 3970479 - DNA, 21 bp, Homo sapiens
gatctagttctcaatcactgc

SEQ ID NO: 3970480 - DNA, 22 bp, Homo sapiens
gatctagttctcaatcactgct

SEQ ID NO: 3970481 - DNA, 16 bp, Homo sapiens
gatctatcaatagtca

SEQ ID NO: 3970482 - DNA, 13 bp, Homo sapiens
gatctatgcaatt

SEQ ID NO: 3970483 - DNA, 14 bp, Homo sapiens
gatctatgcaattt

SEQ ID NO: 3970484 - DNA, 15 bp, Homo sapiens
gatctatgcaatttt

SEQ ID NO: 3970485 - DNA, 19 bp, Homo sapiens
gatctccaaggaccaggtt

SEQ ID NO: 3970486 - DNA, 20 bp, Homo sapiens
gatctccctgccgcctcaat

SEQ ID NO: 3970487 - DNA, 13 bp, Homo sapiens
gatctctcaggag

SEQ ID NO: 3970488 - DNA, 17 bp, Homo sapiens
gatctctcaggagcaca

SEQ ID NO: 3970489 - DNA, 21 bp, Homo sapiens
gatctctcaggagcacaggca

SEQ ID NO: 3970490 - DNA, 24 bp, Homo sapiens
gatctctcaggagcacaggcagct

SEQ ID NO: 3970491 - DNA, 11 bp, Homo sapiens
gatctctgctt

SEQ ID NO: 3970492 - DNA, 22 bp, Homo sapiens
gatctgaaaggcacactttgat

SEQ ID NO: 3970493 - DNA, 22 bp, Homo sapiens
gatctgatggtgagctgggaag

SEQ ID NO: 3970494 - DNA, 20 bp, Homo sapiens
gatctgcagggggtgtgtct

SEQ ID NO: 3970495 - DNA, 17 bp, Homo sapiens
gatctgcattccccgct

SEQ ID NO: 3970496 - DNA, 11 bp, Homo sapiens
gatctgcctgg

SEQ ID NO: 3970497 - DNA, 20 bp, Homo sapiens
gaaattcagcttttgcagaa

SEQ ID NO: 3970498 - DNA, 22 bp, Homo sapiens
gaaattcccccacttgggagct

SEQ ID NO: 3970499 - DNA, 15 bp, Homo sapiens
gaaattgaacctggt

SEQ ID NO: 3970500 - DNA, 19 bp, Homo sapiens
gaaattgcatttcctgaca

SEQ ID NO: 3970501 - DNA, 22 bp, Homo sapiens
gaaattgcctccttatttatca

SEQ ID NO: 3970502 - DNA, 23 bp, Homo sapiens
gaaattgcctccttatttatcaa

SEQ ID NO: 3970503 - DNA, 15 bp, Homo sapiens
gaaattgttcctgat

SEQ ID NO: 3970504 - DNA, 23 bp, Homo sapiens
gaacaaacactgaatcatgttaa

SEQ ID NO: 3970505 - DNA, 12 bp, Homo sapiens
gaacaaactgat

SEQ ID NO: 3970506 - DNA, 18 bp, Homo sapiens
gaacaaactgatgcgaaa

SEQ ID NO: 3970507 - DNA, 20 bp, Homo sapiens
gaacaaatcacacctctggg

SEQ ID NO: 3970508 - DNA, 14 bp, Homo sapiens
gaacaacaacaaca

SEQ ID NO: 3970509 - DNA, 19 bp, Homo sapiens
gaacaacaacaacaataac

SEQ ID NO: 3970510 - DNA, 15 bp, Homo sapiens
gaacaactactgtga

SEQ ID NO: 3970511 - DNA, 19 bp, Homo sapiens
gaacaactaggcttcagca

SEQ ID NO: 3970512 - DNA, 18 bp, Homo sapiens
gaacaagtcacagctgca

SEQ ID NO: 3970513 - DNA, 13 bp, Homo sapiens
gaacaatgaatgc

SEQ ID NO: 3970514 - DNA, 20 bp, Homo sapiens
gaacacagcagttctgcaga

SEQ ID NO: 3970515 - DNA, 16 bp, Homo sapiens
gaacacccactggcca

SEQ ID NO: 3970516 - DNA, 17 bp, Homo sapiens
gaacacccactggccag

SEQ ID NO: 3970517 - DNA, 15 bp, Homo sapiens
gaacacccctgtgca

SEQ ID NO: 3970518 - DNA, 17 bp, Homo sapiens
gaacagacaggagaaat

SEQ ID NO: 3970519 - DNA, 11 bp, Homo sapiens
gaacagagact

SEQ ID NO: 3970520 - DNA, 12 bp, Homo sapiens
gaacagagactc

SEQ ID NO: 3970521 - DNA, 22 bp, Homo sapiens
gaacagagactctggaagcccc

SEQ ID NO: 3970522 - DNA, 17 bp, Homo sapiens
gaacagagcgggcctct

SEQ ID NO: 3970523 - DNA, 23 bp, Homo sapiens
gaacagagcgggcctcttccctc

SEQ ID NO: 3970524 - DNA, 21 bp, Homo sapiens
gaacagctcttcactcagcca

SEQ ID NO: 3970525 - DNA, 12 bp, Homo sapiens
gaacagtaaaca

SEQ ID NO: 3970526 - DNA, 13 bp, Homo sapiens
gaacagtaaacat

SEQ ID NO: 3970527 - DNA, 21 bp, Homo sapiens
gaacagtcacccttctgggca

SEQ ID NO: 3970528 - DNA, 12 bp, Homo sapiens
gaacatccaagg

SEQ ID NO: 3970529 - DNA, 20 bp, Homo sapiens
gaacatccaaggagaaacag

SEQ ID NO: 3970530 - DNA, 17 bp, Homo sapiens
gaacatctgtcctgtga

SEQ ID NO: 3970531 - DNA, 19 bp, Homo sapiens
gaacatggcctaagggcca

SEQ ID NO: 3970532 - DNA, 20 bp, Homo sapiens
gaaccaaagagactggagca

SEQ ID NO: 3970533 - DNA, 15 bp, Homo sapiens
gaaccaagcttcaga

SEQ ID NO: 3970534 - DNA, 16 bp, Homo sapiens
gaaccaagcttcagag

SEQ ID NO: 3970535 - DNA, 13 bp, Homo sapiens
gaaccaaggcagc

SEQ ID NO: 3970536 - DNA, 14 bp, Homo sapiens
gaaccaaggcagcc

SEQ ID NO: 3970537 - DNA, 16 bp, Homo sapiens
gaaccaaggcagcctc

SEQ ID NO: 3970538 - DNA, 18 bp, Homo sapiens
gaaccaaggcagcctcca

SEQ ID NO: 3970539 - DNA, 22 bp, Homo sapiens
gaaccaaggcagcctccagagc

SEQ ID NO: 3970540 - DNA, 12 bp, Homo sapiens
gaaccagagggt

SEQ ID NO: 3970541 - DNA, 16 bp, Homo sapiens
gaacccaagtccaagc

SEQ ID NO: 3970542 - DNA, 17 bp, Homo sapiens
gaacccaagtccaagca

SEQ ID NO: 3970543 - DNA, 11 bp, Homo sapiens
gaacccaggac

SEQ ID NO: 3970544 - DNA, 17 bp, Homo sapiens
gaaccccatgggcttgg

SEQ ID NO: 3970545 - DNA, 19 bp, Homo sapiens
gaaccccatgggcttggac

SEQ ID NO: 3970546 - DNA, 14 bp, Homo sapiens
gaaccccgcagccc

SEQ ID NO: 3970547 - DNA, 16 bp, Homo sapiens
gaaccccgcagcccgt

SEQ ID NO: 3970548 - DNA, 19 bp, Homo sapiens
gaacccctgtgtccctttt

SEQ ID NO: 3970549 - DNA, 16 bp, Homo sapiens
gaacccgactgtgaaa

SEQ ID NO: 3970550 - DNA, 16 bp, Homo sapiens
gaaccctgcccactcc

SEQ ID NO: 3970551 - DNA, 11 bp, Homo sapiens
gaacctcacct

SEQ ID NO: 3970552 - DNA, 12 bp, Homo sapiens
gaacctcagttt

SEQ ID NO: 3970553 - DNA, 14 bp, Homo sapiens
gaacctcagtttcc

SEQ ID NO: 3970554 - DNA, 22 bp, Homo sapiens
gaacctcagtttcctcatctgc

SEQ ID NO: 3970555 - DNA, 12 bp, Homo sapiens
gaacctggagag

SEQ ID NO: 3970556 - DNA, 15 bp, Homo sapiens
gaacctggagagcta

SEQ ID NO: 3970557 - DNA, 21 bp, Homo sapiens
gaacctggagggctggaatct

SEQ ID NO: 3970558 - DNA, 12 bp, Homo sapiens
gaacctggcctt

SEQ ID NO: 3970559 - DNA, 16 bp, Homo sapiens
gaacctggccttcagt

SEQ ID NO: 3970560 - DNA, 22 bp, Homo sapiens
gaacgagcactggccagagagg

SEQ ID NO: 3970561 - DNA, 18 bp, Homo sapiens
gaacgatatgtagcagaa

SEQ ID NO: 3970562 - DNA, 15 bp, Homo sapiens
gaacggggagaaaag

SEQ ID NO: 3970563 - DNA, 15 bp, Homo sapiens
gaactaataaaagca

SEQ ID NO: 3970564 - DNA, 16 bp, Homo sapiens
gaactcagagcccctc

SEQ ID NO: 3970565 - DNA, 11 bp, Homo sapiens
gaactcatcct

SEQ ID NO: 3970566 - DNA, 17 bp, Homo sapiens
ctgggtggctactctgt

SEQ ID NO: 3970567 - DNA, 20 bp, Homo sapiens
ctgggtggctactctgtgcc

SEQ ID NO: 3970568 - DNA, 17 bp, Homo sapiens
ctgggtggggctgctcc

SEQ ID NO: 3970569 - DNA, 21 bp, Homo sapiens
ctgggtggggctgctcctcca

SEQ ID NO: 3970570 - DNA, 20 bp, Homo sapiens
ctgggttatttttgtccctg

SEQ ID NO: 3970571 - DNA, 18 bp, Homo sapiens
ctgggtttctctgtatag

SEQ ID NO: 3970572 - DNA, 15 bp, Homo sapiens
ctgggttttctaact

SEQ ID NO: 3970573 - DNA, 22 bp, Homo sapiens
ctgggttttctaactgtaaatc

SEQ ID NO: 3970574 - DNA, 23 bp, Homo sapiens
ctgggttttctaactgtaaatca

SEQ ID NO: 3970575 - DNA, 15 bp, Homo sapiens
ctgggttttgtctct

SEQ ID NO: 3970576 - DNA, 21 bp, Homo sapiens
ctgggttttgtctctgcatct

SEQ ID NO: 3970577 - DNA, 16 bp, Homo sapiens
ctggtaaactatttgt

SEQ ID NO: 3970578 - DNA, 17 bp, Homo sapiens
ctggtaatttgtatctg

SEQ ID NO: 3970579 - DNA, 23 bp, Homo sapiens
ctggtacagcagggtcttgctgt

SEQ ID NO: 3970580 - DNA, 18 bp, Homo sapiens
ctggtagaattgggaagc

SEQ ID NO: 3970581 - DNA, 20 bp, Homo sapiens
ctggtagaattgggaagctg

SEQ ID NO: 3970582 - DNA, 20 bp, Homo sapiens
ctggtatgaacttgaggaca

SEQ ID NO: 3970583 - DNA, 16 bp, Homo sapiens
ctggtatttggagcaa

SEQ ID NO: 3970584 - DNA, 18 bp, Homo sapiens
ctggtccactcagggctg

SEQ ID NO: 3970585 - DNA, 19 bp, Homo sapiens
ctggtcgtgaactcctgag

SEQ ID NO: 3970586 - DNA, 17 bp, Homo sapiens
ctggtctgtgctgccct

SEQ ID NO: 3970587 - DNA, 20 bp, Homo sapiens
ctggtctgtgctgccctgct

SEQ ID NO: 3970588 - DNA, 15 bp, Homo sapiens
ctggtcttcactgcc

SEQ ID NO: 3970589 - DNA, 20 bp, Homo sapiens
ctggtcttgtggaattggga

SEQ ID NO: 3970590 - DNA, 22 bp, Homo sapiens
ctggtgactgcgatcttcagag

SEQ ID NO: 3970591 - DNA, 19 bp, Homo sapiens
ctggtgcagaggtgagcag

SEQ ID NO: 3970592 - DNA, 22 bp, Homo sapiens
ctggtgcctatttattcattca

SEQ ID NO: 3970593 - DNA, 19 bp, Homo sapiens
ctggtgctataggctggag

SEQ ID NO: 3970594 - DNA, 20 bp, Homo sapiens
ctggtgctataggctggaga

SEQ ID NO: 3970595 - DNA, 14 bp, Homo sapiens
cttccacccattcc

SEQ ID NO: 3970596 - DNA, 20 bp, Homo sapiens
cttccaccgggcctgaacca

SEQ ID NO: 3970597 - DNA, 22 bp, Homo sapiens
cttccacctcctagaggtgggc

SEQ ID NO: 3970598 - DNA, 20 bp, Homo sapiens
cttccagaagatgccctcca

SEQ ID NO: 3970599 - DNA, 14 bp, Homo sapiens
cttccagaccacct

SEQ ID NO: 3970600 - DNA, 16 bp, Homo sapiens
cttccagaccacctgc

SEQ ID NO: 3970601 - DNA, 21 bp, Homo sapiens
cttccagaccacctgccagcc

SEQ ID NO: 3970602 - DNA, 18 bp, Homo sapiens
cttccagagagtcctctg

SEQ ID NO: 3970603 - DNA, 20 bp, Homo sapiens
cttccagagagtcctctgga

SEQ ID NO: 3970604 - DNA, 18 bp, Homo sapiens
cttccagagcctaagaaa

SEQ ID NO: 3970605 - DNA, 16 bp, Homo sapiens
cttccagctagtgacc

SEQ ID NO: 3970606 - DNA, 18 bp, Homo sapiens
cttccagctagtgaccca

SEQ ID NO: 3970607 - DNA, 22 bp, Homo sapiens
cttccagctagtgacccacatg

SEQ ID NO: 3970608 - DNA, 17 bp, Homo sapiens
cttccaggctcttcctg

SEQ ID NO: 3970609 - DNA, 22 bp, Homo sapiens
cttccaggctcttcctggacct

SEQ ID NO: 3970610 - DNA, 21 bp, Homo sapiens
cttccaggtagggccagctca

SEQ ID NO: 3970611 - DNA, 23 bp, Homo sapiens
cttccagtgttggctgtgtgaca

SEQ ID NO: 3970612 - DNA, 11 bp, Homo sapiens
cttccataatc

SEQ ID NO: 3970613 - DNA, 15 bp, Homo sapiens
cttccatgtcgcctc

SEQ ID NO: 3970614 - DNA, 17 bp, Homo sapiens
cttcccaatcagcactg

SEQ ID NO: 3970615 - DNA, 10 bp, Homo sapiens
cttcccagag

SEQ ID NO: 3970616 - DNA, 12 bp, Homo sapiens
cttcccagaggc

SEQ ID NO: 3970617 - DNA, 15 bp, Homo sapiens
cttcccagaggcaga

SEQ ID NO: 3970618 - DNA, 20 bp, Homo sapiens
cttcccagctctccctctgg

SEQ ID NO: 3970619 - DNA, 22 bp, Homo sapiens
cttcccccatcccctttcctcc

SEQ ID NO: 3970620 - DNA, 14 bp, Homo sapiens
cttccccttctgtg

SEQ ID NO: 3970621 - DNA, 17 bp, Homo sapiens
cttccccttgcccttgc

SEQ ID NO: 3970622 - DNA, 13 bp, Homo sapiens
cttcccctttccc

SEQ ID NO: 3970623 - DNA, 18 bp, Homo sapiens
cttccccttttgcctggc

SEQ ID NO: 3970624 - DNA, 19 bp, Homo sapiens
cttccccttttgcctggct

SEQ ID NO: 3970625 - DNA, 17 bp, Homo sapiens
cttcccgctcagccctc

SEQ ID NO: 3970626 - DNA, 15 bp, Homo sapiens
cttccctccttccct

SEQ ID NO: 3970627 - DNA, 21 bp, Homo sapiens
cttccctctttccccacctct

SEQ ID NO: 3970628 - DNA, 13 bp, Homo sapiens
cttccctgggaac

SEQ ID NO: 3970629 - DNA, 17 bp, Homo sapiens
cttccgctcctttacct

SEQ ID NO: 3970630 - DNA, 22 bp, Homo sapiens
cttccgctcctttacctaccac

SEQ ID NO: 3970631 - DNA, 23 bp, Homo sapiens
cttcctacacccttggacttgag

SEQ ID NO: 3970632 - DNA, 17 bp, Homo sapiens
cttcctaccaaatataa

SEQ ID NO: 3970633 - DNA, 22 bp, Homo sapiens
cttcctaccaaatataaacttg

SEQ ID NO: 3970634 - DNA, 15 bp, Homo sapiens
cttcctagttttctc

SEQ ID NO: 3970635 - DNA, 22 bp, Homo sapiens
cttcctagttttctcctcccag

SEQ ID NO: 3970636 - DNA, 14 bp, Homo sapiens
cttcctcatcccct

SEQ ID NO: 3970637 - DNA, 13 bp, Homo sapiens
cttcctccctcat

SEQ ID NO: 3970638 - DNA, 22 bp, Homo sapiens
cttcctccgtccacccaggctg

SEQ ID NO: 3970639 - DNA, 23 bp, Homo sapiens
cttcctccgtccacccaggctgc

SEQ ID NO: 3970640 - DNA, 15 bp, Homo sapiens
cttcctcctccacag

SEQ ID NO: 3970641 - DNA, 15 bp, Homo sapiens
cttcctcctgaagcc

SEQ ID NO: 3970642 - DNA, 20 bp, Homo sapiens
cttcctcctgaagcctctgc

SEQ ID NO: 3970643 - DNA, 15 bp, Homo sapiens
cttcctcctgatggc

SEQ ID NO: 3970644 - DNA, 21 bp, Homo sapiens
cttcctcctgatggccaagag

SEQ ID NO: 3970645 - DNA, 22 bp, Homo sapiens
cttcctcctgatggccaagagc

SEQ ID NO: 3970646 - DNA, 13 bp, Homo sapiens
cttcctctccact

SEQ ID NO: 3970647 - DNA, 12 bp, Homo sapiens
cttcctctgctg

SEQ ID NO: 3970648 - DNA, 14 bp, Homo sapiens
cttcctgctgctgt

SEQ ID NO: 3970649 - DNA, 15 bp, Homo sapiens
cttcctgctgctgta

SEQ ID NO: 3970650 - DNA, 22 bp, Homo sapiens
cttcctgctgctgtaactgctg

SEQ ID NO: 3970651 - DNA, 21 bp, Homo sapiens
cttcctggacagctgtgcctc

SEQ ID NO: 3970652 - DNA, 12 bp, Homo sapiens
cttcctggacct

SEQ ID NO: 3970653 - DNA, 16 bp, Homo sapiens
cttcctggacctgagt

SEQ ID NO: 3970654 - DNA, 13 bp, Homo sapiens
cttcctggcctca

SEQ ID NO: 3970655 - DNA, 18 bp, Homo sapiens
cttcctggcctcactggc

SEQ ID NO: 3970656 - DNA, 22 bp, Homo sapiens
cttcctggggccccgctgggat

SEQ ID NO: 3970657 - DNA, 10 bp, Homo sapiens
cttcctgggt

SEQ ID NO: 3970658 - DNA, 18 bp, Homo sapiens
cttcctggtgaggcccag

SEQ ID NO: 3970659 - DNA, 24 bp, Homo sapiens
cttcctggtgaggcccagcctgtc

SEQ ID NO: 3970660 - DNA, 22 bp, Homo sapiens
cttcctgtaacacaagccacag

SEQ ID NO: 3970661 - DNA, 15 bp, Homo sapiens
cttcctgtgggagca

SEQ ID NO: 3970662 - DNA, 18 bp, Homo sapiens
cttcctgtgggccaggag

SEQ ID NO: 3970663 - DNA, 14 bp, Homo sapiens
cttccttccctggc

SEQ ID NO: 3970664 - DNA, 15 bp, Homo sapiens
cttccttccctggct

SEQ ID NO: 3970665 - DNA, 17 bp, Homo sapiens
cttccttccctggcttg

SEQ ID NO: 3970666 - DNA, 13 bp, Homo sapiens
cttccttctgcac

SEQ ID NO: 3970667 - DNA, 16 bp, Homo sapiens
cttccttctgcaccca

SEQ ID NO: 3970668 - DNA, 21 bp, Homo sapiens
cttccttctttctcttccctc

SEQ ID NO: 3970669 - DNA, 11 bp, Homo sapiens
cttcctttcct

SEQ ID NO: 3970670 - DNA, 12 bp, Homo sapiens
cttcctttcctc

SEQ ID NO: 3970671 - DNA, 18 bp, Homo sapiens
cttcgactcaggatccag

SEQ ID NO: 3970672 - DNA, 21 bp, Homo sapiens
cttcgaggttgccccttcccc

SEQ ID NO: 3970673 - DNA, 16 bp, Homo sapiens
cttcgatacaccgggc

SEQ ID NO: 3970674 - DNA, 17 bp, Homo sapiens
cttcgcaaactgatgga

SEQ ID NO: 3970675 - DNA, 12 bp, Homo sapiens
cttcgctgccag

SEQ ID NO: 3970676 - DNA, 14 bp, Homo sapiens
cttcgctgccagga

SEQ ID NO: 3970677 - DNA, 16 bp, Homo sapiens
cttcgctgccaggaca

SEQ ID NO: 3970678 - DNA, 21 bp, Homo sapiens
cttcgctgccaggacacctgc

SEQ ID NO: 3970679 - DNA, 20 bp, Homo sapiens
cttcgctgctagagaagggg

SEQ ID NO: 3970680 - DNA, 13 bp, Homo sapiens
cttcgctgctcta

SEQ ID NO: 3970681 - DNA, 19 bp, Homo sapiens
ctttggcagaccatctcca

SEQ ID NO: 3970682 - DNA, 17 bp, Homo sapiens
ctttggccattccaaca

SEQ ID NO: 3970683 - DNA, 14 bp, Homo sapiens
ctttggcttctcct

SEQ ID NO: 3970684 - DNA, 21 bp, Homo sapiens
ctttggcttctcctgtgaccc

SEQ ID NO: 3970685 - DNA, 23 bp, Homo sapiens
ctttgggaggccaaggcaggtag

SEQ ID NO: 3970686 - DNA, 19 bp, Homo sapiens
ctttgggattctaggaaac

SEQ ID NO: 3970687 - DNA, 17 bp, Homo sapiens
ctttggggaagggggag

SEQ ID NO: 3970688 - DNA, 21 bp, Homo sapiens
ctttggggacagttggcagag

SEQ ID NO: 3970689 - DNA, 17 bp, Homo sapiens
ctttggggtcagccagg

SEQ ID NO: 3970690 - DNA, 19 bp, Homo sapiens
ctttgggtactactgctgc

SEQ ID NO: 3970691 - DNA, 16 bp, Homo sapiens
ctttggtgaaagggag

SEQ ID NO: 3970692 - DNA, 19 bp, Homo sapiens
ctttggtgttacacagccc

SEQ ID NO: 3970693 - DNA, 14 bp, Homo sapiens
ctttggttcagcta

SEQ ID NO: 3970694 - DNA, 14 bp, Homo sapiens
ctttgtaaaggtca

SEQ ID NO: 3970695 - DNA, 17 bp, Homo sapiens
ctttgtaatgtcaccac

SEQ ID NO: 3970696 - DNA, 17 bp, Homo sapiens
ctttgtgtagctttgct

SEQ ID NO: 3970697 - DNA, 21 bp, Homo sapiens
ctttgttgcaagtactgctgt

SEQ ID NO: 3970698 - DNA, 18 bp, Homo sapiens
cttttaaaacacttccat

SEQ ID NO: 3970699 - DNA, 18 bp, Homo sapiens
cttttaaaatgaaatgtt

SEQ ID NO: 3970700 - DNA, 20 bp, Homo sapiens
cttttaaagaagtaaatttg

SEQ ID NO: 3970701 - DNA, 23 bp, Homo sapiens
cttttaaaggggcagaaaaactc

SEQ ID NO: 3970702 - DNA, 21 bp, Homo sapiens
cttttaagcaaagttgggtgt

SEQ ID NO: 3970703 - DNA, 13 bp, Homo sapiens
cttttacaaaaca

SEQ ID NO: 3970704 - DNA, 15 bp, Homo sapiens
cttttactacagtga

SEQ ID NO: 3970705 - DNA, 12 bp, Homo sapiens
cttttactcctt

SEQ ID NO: 3970706 - DNA, 17 bp, Homo sapiens
cttttactcctttgcat

SEQ ID NO: 3970707 - DNA, 20 bp, Homo sapiens
cttttagggagctggtctga

SEQ ID NO: 3970708 - DNA, 22 bp, Homo sapiens
cttttataactagtcctttact

SEQ ID NO: 3970709 - DNA, 11 bp, Homo sapiens
cttttatacca

SEQ ID NO: 3970710 - DNA, 16 bp, Homo sapiens
cttttatcaaaatccc

SEQ ID NO: 3970711 - DNA, 19 bp, Homo sapiens
cttttatcacgatattatt

SEQ ID NO: 3970712 - DNA, 19 bp, Homo sapiens
cttttatctgtagcagaaa

SEQ ID NO: 3970713 - DNA, 20 bp, Homo sapiens
cttttatgttatttatatat

SEQ ID NO: 3970714 - DNA, 13 bp, Homo sapiens
cttttattgtata

SEQ ID NO: 3970715 - DNA, 18 bp, Homo sapiens
cttttcaaacaagaatgt

SEQ ID NO: 3970716 - DNA, 19 bp, Homo sapiens
cttttcacgggaactctcc

SEQ ID NO: 3970717 - DNA, 12 bp, Homo sapiens
cttttcactgct

SEQ ID NO: 3970718 - DNA, 18 bp, Homo sapiens
cttttcactgctggctgc

SEQ ID NO: 3970719 - DNA, 15 bp, Homo sapiens
cttttcatggaagtg

SEQ ID NO: 3970720 - DNA, 19 bp, Homo sapiens
cttttccaggatcctgcag

SEQ ID NO: 3970721 - DNA, 17 bp, Homo sapiens
cttttcccaggaatatc

SEQ ID NO: 3970722 - DNA, 20 bp, Homo sapiens
cttttcccaggaatatccca

SEQ ID NO: 3970723 - DNA, 14 bp, Homo sapiens
cttttccccggtcc

SEQ ID NO: 3970724 - DNA, 18 bp, Homo sapiens
cttttcgcttgcttctgc

SEQ ID NO: 3970725 - DNA, 13 bp, Homo sapiens
cttttctctccca

SEQ ID NO: 3970726 - DNA, 15 bp, Homo sapiens
cttttctctcccata

SEQ ID NO: 3970727 - DNA, 22 bp, Homo sapiens
cttttgaagtagtttgtataac

SEQ ID NO: 3970728 - DNA, 14 bp, Homo sapiens
cttttgatggggag

SEQ ID NO: 3970729 - DNA, 18 bp, Homo sapiens
cttttgatggggagaaag

SEQ ID NO: 3970730 - DNA, 14 bp, Homo sapiens
cttttgatgtgaaa

SEQ ID NO: 3970731 - DNA, 14 bp, Homo sapiens
cttttgcaaacttt

SEQ ID NO: 3970732 - DNA, 20 bp, Homo sapiens
cttttgcccttcacagtgtt

SEQ ID NO: 3970733 - DNA, 13 bp, Homo sapiens
cttttgcctggct

SEQ ID NO: 3970734 - DNA, 14 bp, Homo sapiens
cttttgcctggctg

SEQ ID NO: 3970735 - DNA, 19 bp, Homo sapiens
cttttgctgtctttctcta

SEQ ID NO: 3970736 - DNA, 23 bp, Homo sapiens
cttttgctgtttggatgtttcca

SEQ ID NO: 3970737 - DNA, 13 bp, Homo sapiens
cttttggccttgt

SEQ ID NO: 3970738 - DNA, 12 bp, Homo sapiens
cttttgggggtt

SEQ ID NO: 3970739 - DNA, 13 bp, Homo sapiens
cttttgtaaatgt

SEQ ID NO: 3970740 - DNA, 20 bp, Homo sapiens
cttttgtaagacaaaggttt

SEQ ID NO: 3970741 - DNA, 19 bp, Homo sapiens
cttttgtatttaaaacctt

SEQ ID NO: 3970742 - DNA, 15 bp, Homo sapiens
cttttgtccccaggg

SEQ ID NO: 3970743 - DNA, 16 bp, Homo sapiens
cttttgtccccagggc

SEQ ID NO: 3970744 - DNA, 17 bp, Homo sapiens
cttttgtccccagggcc

SEQ ID NO: 3970745 - DNA, 19 bp, Homo sapiens
cttttgtgtaataagaaag

SEQ ID NO: 3970746 - DNA, 15 bp, Homo sapiens
ctttttagtctttta

SEQ ID NO: 3970747 - DNA, 13 bp, Homo sapiens
ctttttatactcc

SEQ ID NO: 3970748 - DNA, 17 bp, Homo sapiens
ctttttcaacttggaaa

SEQ ID NO: 3970749 - DNA, 17 bp, Homo sapiens
ctttttccccaaagtct

SEQ ID NO: 3970750 - DNA, 14 bp, Homo sapiens
ctttttctaccttt

SEQ ID NO: 3970751 - DNA, 14 bp, Homo sapiens
ctttttctgtctct

SEQ ID NO: 3970752 - DNA, 21 bp, Homo sapiens
ctttttctttttttctttggt

SEQ ID NO: 3970753 - DNA, 19 bp, Homo sapiens
ctttttgaatgttatttgt

SEQ ID NO: 3970754 - DNA, 19 bp, Homo sapiens
gaaaaaaaagtttcagaga

SEQ ID NO: 3970755 - DNA, 13 bp, Homo sapiens
gaaaaaaaatata

SEQ ID NO: 3970756 - DNA, 16 bp, Homo sapiens
gaaaaaaaatatatat

SEQ ID NO: 3970757 - DNA, 18 bp, Homo sapiens
gaaaaaaagttgctttgt

SEQ ID NO: 3970758 - DNA, 13 bp, Homo sapiens
gaaaaaaatgact

SEQ ID NO: 3970759 - DNA, 15 bp, Homo sapiens
gaaaaaagagaaaaa

SEQ ID NO: 3970760 - DNA, 22 bp, Homo sapiens
gaaaaaattaagagatacattc

SEQ ID NO: 3970761 - DNA, 23 bp, Homo sapiens
gaaaaaccaatgattcataacaa

SEQ ID NO: 3970762 - DNA, 19 bp, Homo sapiens
gaaaaactgatcaaaaata

SEQ ID NO: 3970763 - DNA, 19 bp, Homo sapiens
gaaaaagaaaaaaaaagca

SEQ ID NO: 3970764 - DNA, 21 bp, Homo sapiens
gaaaaatatgttgagtgttca

SEQ ID NO: 3970765 - DNA, 15 bp, Homo sapiens
gaaaaatgtcagtct

SEQ ID NO: 3970766 - DNA, 23 bp, Homo sapiens
gaaaacaaatcttcaaggtgtaa

SEQ ID NO: 3970767 - DNA, 14 bp, Homo sapiens
gaaaacagaggaat

SEQ ID NO: 3970768 - DNA, 19 bp, Homo sapiens
gaaaacctcatttaccata

SEQ ID NO: 3970769 - DNA, 16 bp, Homo sapiens
gaaaagaatacagaaa

SEQ ID NO: 3970770 - DNA, 21 bp, Homo sapiens
gaaaagaatccctgcagcctg

SEQ ID NO: 3970771 - DNA, 14 bp, Homo sapiens
gaaaagaccctgag

SEQ ID NO: 3970772 - DNA, 16 bp, Homo sapiens
gaaaagactccaaaga

SEQ ID NO: 3970773 - DNA, 21 bp, Homo sapiens
gaaaagactccaaagaaatgt

SEQ ID NO: 3970774 - DNA, 21 bp, Homo sapiens
gaaaagaggagtttcgaggta

SEQ ID NO: 3970775 - DNA, 18 bp, Homo sapiens
gaaaagataggtttgagt

SEQ ID NO: 3970776 - DNA, 18 bp, Homo sapiens
gaaaagatgagaggcaga

SEQ ID NO: 3970777 - DNA, 19 bp, Homo sapiens
gaaaaggagaaaggagctc

SEQ ID NO: 3970778 - DNA, 16 bp, Homo sapiens
gaaaaggcctggggtg

SEQ ID NO: 3970779 - DNA, 14 bp, Homo sapiens
gaaaagggtcttct

SEQ ID NO: 3970780 - DNA, 19 bp, Homo sapiens
gaaaagggtcttcttggca

SEQ ID NO: 3970781 - DNA, 23 bp, Homo sapiens
gaaaaggttcttcatccctttcc

SEQ ID NO: 3970782 - DNA, 14 bp, Homo sapiens
gaaaagtagaatta

SEQ ID NO: 3970783 - DNA, 23 bp, Homo sapiens
gaaaagtgcttagaaagttattg

SEQ ID NO: 3970784 - DNA, 19 bp, Homo sapiens
gaaaatagctctttcaggg

SEQ ID NO: 3970785 - DNA, 16 bp, Homo sapiens
gaaaatataaatgcat

SEQ ID NO: 3970786 - DNA, 23 bp, Homo sapiens
gaaaatctaatattaaaaatatg

SEQ ID NO: 3970787 - DNA, 22 bp, Homo sapiens
gaaaattcatttcacattaatg

SEQ ID NO: 3970788 - DNA, 19 bp, Homo sapiens
gaaacaaaaacactaaaaa

SEQ ID NO: 3970789 - DNA, 15 bp, Homo sapiens
gaaacacaatatttt

SEQ ID NO: 3970790 - DNA, 13 bp, Homo sapiens
gaaacactcttat

SEQ ID NO: 3970791 - DNA, 22 bp, Homo sapiens
gaaacagaaacaaaaacactaa

SEQ ID NO: 3970792 - DNA, 20 bp, Homo sapiens
gaaacagatgataaatattt

SEQ ID NO: 3970793 - DNA, 22 bp, Homo sapiens
gaaacagatgataaatatttat

SEQ ID NO: 3970794 - DNA, 12 bp, Homo sapiens
gaaacagggagc

SEQ ID NO: 3970795 - DNA, 23 bp, Homo sapiens
gaaacagggcagtgacaagtgga

SEQ ID NO: 3970796 - DNA, 16 bp, Homo sapiens
gaaacatgacactgac

SEQ ID NO: 3970797 - DNA, 11 bp, Homo sapiens
gaaacatttac

SEQ ID NO: 3970798 - DNA, 22 bp, Homo sapiens
gaaaccaaagatatatacacag

SEQ ID NO: 3970799 - DNA, 15 bp, Homo sapiens
gaaaccaaagccagg

SEQ ID NO: 3970800 - DNA, 13 bp, Homo sapiens
gaaaccacacttc

SEQ ID NO: 3970801 - DNA, 17 bp, Homo sapiens
gaaaccacacttcttga

SEQ ID NO: 3970802 - DNA, 17 bp, Homo sapiens
gaaaccacaggcccttg

SEQ ID NO: 3970803 - DNA, 18 bp, Homo sapiens
gaaaccacaggcccttgg

SEQ ID NO: 3970804 - DNA, 22 bp, Homo sapiens
gaaaccagtatggaagggaggg

SEQ ID NO: 3970805 - DNA, 23 bp, Homo sapiens
gaaacctatcaatcctgccccca

SEQ ID NO: 3970806 - DNA, 18 bp, Homo sapiens
gaaacctgaaaaaaagtt

SEQ ID NO: 3970807 - DNA, 17 bp, Homo sapiens
gaaaccttgcagcattt

SEQ ID NO: 3970808 - DNA, 22 bp, Homo sapiens
gaaaccttgcagcatttttatt

SEQ ID NO: 3970809 - DNA, 19 bp, Homo sapiens
gaaacgaatgtttcaaatc

SEQ ID NO: 3970810 - DNA, 18 bp, Homo sapiens
gaaactccgtcttagaag

SEQ ID NO: 3970811 - DNA, 20 bp, Homo sapiens
gaaactccttttgctgtctt

SEQ ID NO: 3970812 - DNA, 23 bp, Homo sapiens
gaaactgaggagtagctgagagg

SEQ ID NO: 3970813 - DNA, 13 bp, Homo sapiens
gaaactgccagca

SEQ ID NO: 3970814 - DNA, 19 bp, Homo sapiens
gaaactggggcttgcaaga

SEQ ID NO: 3970815 - DNA, 19 bp, Homo sapiens
gaaactttgatctctgctt

SEQ ID NO: 3970816 - DNA, 16 bp, Homo sapiens
gaaagaaaaaacaaaa

SEQ ID NO: 3970817 - DNA, 20 bp, Homo sapiens
gaaagacgtttttgtgctgt

SEQ ID NO: 3970818 - DNA, 15 bp, Homo sapiens
gaaagactattcaaa

SEQ ID NO: 3970819 - DNA, 23 bp, Homo sapiens
gaaagactattcaaacagtctca

SEQ ID NO: 3970820 - DNA, 17 bp, Homo sapiens
gaaagccgtactgtcta

SEQ ID NO: 3970821 - DNA, 14 bp, Homo sapiens
gaaagcctctggaa

SEQ ID NO: 3970822 - DNA, 21 bp, Homo sapiens
gaaagctgtttatttattcac

SEQ ID NO: 3970823 - DNA, 17 bp, Homo sapiens
gaaagcttcaaactgca

SEQ ID NO: 3970824 - DNA, 16 bp, Homo sapiens
gaaaggaaaaccaggg

SEQ ID NO: 3970825 - DNA, 18 bp, Homo sapiens
gaaaggaggcatgcctct

SEQ ID NO: 3970826 - DNA, 14 bp, Homo sapiens
gaaaggattcatgt

SEQ ID NO: 3970827 - DNA, 15 bp, Homo sapiens
gaaaggctctgaaag

SEQ ID NO: 3970828 - DNA, 19 bp, Homo sapiens
gaaaggctctgaaagccag

SEQ ID NO: 3970829 - DNA, 19 bp, Homo sapiens
gaaagggacccgaagccca

SEQ ID NO: 3970830 - DNA, 19 bp, Homo sapiens
gaaagggagggcccctcat

SEQ ID NO: 3970831 - DNA, 20 bp, Homo sapiens
gaaagggtctgataaacaca

SEQ ID NO: 3970832 - DNA, 13 bp, Homo sapiens
gaaaggtttcaag

SEQ ID NO: 3970833 - DNA, 18 bp, Homo sapiens
gaaagtccttgtttttgc

SEQ ID NO: 3970834 - DNA, 13 bp, Homo sapiens
gaaagtctgtgtc

SEQ ID NO: 3970835 - DNA, 15 bp, Homo sapiens
gaaagtgaataaact

SEQ ID NO: 3970836 - DNA, 16 bp, Homo sapiens
gaaagtgccagaaagt

SEQ ID NO: 3970837 - DNA, 22 bp, Homo sapiens
gaaagtgggttcactagagctg

SEQ ID NO: 3970838 - DNA, 14 bp, Homo sapiens
gaaagttattgtgt

SEQ ID NO: 3970839 - DNA, 20 bp, Homo sapiens
gaaagttattgtgttgcctt

SEQ ID NO: 3970840 - DNA, 14 bp, Homo sapiens
gaaataaaaccttt

SEQ ID NO: 3970841 - DNA, 16 bp, Homo sapiens
gaaataaaacctttca

SEQ ID NO: 3970842 - DNA, 17 bp, Homo sapiens
gaaataaaacctttcaa

SEQ ID NO: 3970843 - DNA, 21 bp, Homo sapiens
gaaataaatgtatcatagaaa

SEQ ID NO: 3970844 - DNA, 22 bp, Homo sapiens
gaaataaattggtgataagtgg

SEQ ID NO: 3970845 - DNA, 23 bp, Homo sapiens
gaaataaattggtgataagtgga

SEQ ID NO: 3970846 - DNA, 14 bp, Homo sapiens
gaaatactgctctg

SEQ ID NO: 3970847 - DNA, 21 bp, Homo sapiens
gaaatatatatacatatgtag

SEQ ID NO: 3970848 - DNA, 20 bp, Homo sapiens
gaaatatcagttactcagcc

SEQ ID NO: 3970849 - DNA, 22 bp, Homo sapiens
gaaatatcagttactcagccct

SEQ ID NO: 3970850 - DNA, 16 bp, Homo sapiens
gaaatcaaatatgcaa

SEQ ID NO: 3970851 - DNA, 19 bp, Homo sapiens
gaaatcaaatatgcaaagc

SEQ ID NO: 3970852 - DNA, 17 bp, Homo sapiens
cttcgctgctctagctg

SEQ ID NO: 3970853 - DNA, 20 bp, Homo sapiens
cttcgctgctctagctggca

SEQ ID NO: 3970854 - DNA, 14 bp, Homo sapiens
cttcggtttctgag

SEQ ID NO: 3970855 - DNA, 16 bp, Homo sapiens
cttcgtgtctctccca

SEQ ID NO: 3970856 - DNA, 17 bp, Homo sapiens
cttcgtgtctctcccac

SEQ ID NO: 3970857 - DNA, 14 bp, Homo sapiens
cttctaacctcagc

SEQ ID NO: 3970858 - DNA, 23 bp, Homo sapiens
cttctaagtaaaaccacagcagt

SEQ ID NO: 3970859 - DNA, 12 bp, Homo sapiens
cttctaatatat

SEQ ID NO: 3970860 - DNA, 14 bp, Homo sapiens
cttctaatatattt

SEQ ID NO: 3970861 - DNA, 16 bp, Homo sapiens
cttctacaaccagagc

SEQ ID NO: 3970862 - DNA, 19 bp, Homo sapiens
cttctacaaccagagcccc

SEQ ID NO: 3970863 - DNA, 23 bp, Homo sapiens
cttctacaggcccggcccagcct

SEQ ID NO: 3970864 - DNA, 15 bp, Homo sapiens
cttctatgcagtatt

SEQ ID NO: 3970865 - DNA, 19 bp, Homo sapiens
cttctattatagccacatc

SEQ ID NO: 3970866 - DNA, 20 bp, Homo sapiens
cttctatttaaaaaataaaa

SEQ ID NO: 3970867 - DNA, 15 bp, Homo sapiens
cttctattttgtaaa

SEQ ID NO: 3970868 - DNA, 16 bp, Homo sapiens
cttctattttgtaaac

SEQ ID NO: 3970869 - DNA, 17 bp, Homo sapiens
cttctattttgtaaact

SEQ ID NO: 3970870 - DNA, 17 bp, Homo sapiens
cttctcaggacacaggc

SEQ ID NO: 3970871 - DNA, 22 bp, Homo sapiens
cttctcaggacacaggcctgtg

SEQ ID NO: 3970872 - DNA, 20 bp, Homo sapiens
cttctcattccaacagtgag

SEQ ID NO: 3970873 - DNA, 14 bp, Homo sapiens
cttctccatctggc

SEQ ID NO: 3970874 - DNA, 23 bp, Homo sapiens
cttctccattctagatgcttccc

SEQ ID NO: 3970875 - DNA, 14 bp, Homo sapiens
cttctccctggctg

SEQ ID NO: 3970876 - DNA, 15 bp, Homo sapiens
cttctccctggctga

SEQ ID NO: 3970877 - DNA, 17 bp, Homo sapiens
cttctctattcctgacc

SEQ ID NO: 3970878 - DNA, 23 bp, Homo sapiens
cttctctattcctgaccctccct

SEQ ID NO: 3970879 - DNA, 20 bp, Homo sapiens
cttctcttgggaactccact

SEQ ID NO: 3970880 - DNA, 14 bp, Homo sapiens
cttctgacctcccc

SEQ ID NO: 3970881 - DNA, 16 bp, Homo sapiens
cttctgcagcaactcc

SEQ ID NO: 3970882 - DNA, 18 bp, Homo sapiens
cttctgcagcaactccca

SEQ ID NO: 3970883 - DNA, 21 bp, Homo sapiens
cttctgcagcaactcccacga

SEQ ID NO: 3970884 - DNA, 22 bp, Homo sapiens
cttctgcagcaactcccacgac

SEQ ID NO: 3970885 - DNA, 10 bp, Homo sapiens
cttctgcagt

SEQ ID NO: 3970886 - DNA, 14 bp, Homo sapiens
cttctgccaagaga

SEQ ID NO: 3970887 - DNA, 21 bp, Homo sapiens
cttctgctaaatttaataaaa

SEQ ID NO: 3970888 - DNA, 14 bp, Homo sapiens
cttctggaaggctg

SEQ ID NO: 3970889 - DNA, 17 bp, Homo sapiens
cttctggcacttggaga

SEQ ID NO: 3970890 - DNA, 11 bp, Homo sapiens
cttctggctcc

SEQ ID NO: 3970891 - DNA, 22 bp, Homo sapiens
cttctggctcctccttcccctg

SEQ ID NO: 3970892 - DNA, 14 bp, Homo sapiens
cttctggcttcctt

SEQ ID NO: 3970893 - DNA, 21 bp, Homo sapiens
cttctgggaagacaactagga

SEQ ID NO: 3970894 - DNA, 17 bp, Homo sapiens
cttctggttgcttcaga

SEQ ID NO: 3970895 - DNA, 18 bp, Homo sapiens
cttctgtatactgtggag

SEQ ID NO: 3970896 - DNA, 21 bp, Homo sapiens
cttctgtcttcacaacagatt

SEQ ID NO: 3970897 - DNA, 22 bp, Homo sapiens
cttctgtcttcacaacagatta

SEQ ID NO: 3970898 - DNA, 13 bp, Homo sapiens
cttctgtgtcaca

SEQ ID NO: 3970899 - DNA, 12 bp, Homo sapiens
cttctgttctca

SEQ ID NO: 3970900 - DNA, 14 bp, Homo sapiens
cttctgttgtaata

SEQ ID NO: 3970901 - DNA, 21 bp, Homo sapiens
cttcttacttggaactgaagg

SEQ ID NO: 3970902 - DNA, 15 bp, Homo sapiens
cttcttatgtttgct

SEQ ID NO: 3970903 - DNA, 14 bp, Homo sapiens
cttcttattctcac

SEQ ID NO: 3970904 - DNA, 16 bp, Homo sapiens
cttcttcacccagcta

SEQ ID NO: 3970905 - DNA, 18 bp, Homo sapiens
cttcttcagatcagtgct

SEQ ID NO: 3970906 - DNA, 21 bp, Homo sapiens
cttcttcagccacctctcttt

SEQ ID NO: 3970907 - DNA, 21 bp, Homo sapiens
cttcttccctaatcagctccc

SEQ ID NO: 3970908 - DNA, 19 bp, Homo sapiens
cttcttcgctgctagagaa

SEQ ID NO: 3970909 - DNA, 13 bp, Homo sapiens
cttcttggcttct

SEQ ID NO: 3970910 - DNA, 16 bp, Homo sapiens
cttcttggcttctggg

SEQ ID NO: 3970911 - DNA, 18 bp, Homo sapiens
cttcttgtgtcctgatga

SEQ ID NO: 3970912 - DNA, 12 bp, Homo sapiens
cttctttaaatc

SEQ ID NO: 3970913 - DNA, 14 bp, Homo sapiens
cttctttcctcttc

SEQ ID NO: 3970914 - DNA, 14 bp, Homo sapiens
cttctttctcttcc

SEQ ID NO: 3970915 - DNA, 17 bp, Homo sapiens
cttctttctcttccctc

SEQ ID NO: 3970916 - DNA, 18 bp, Homo sapiens
cttctttctcttccctcc

SEQ ID NO: 3970917 - DNA, 22 bp, Homo sapiens
cttctttgaatttcctatctgt

SEQ ID NO: 3970918 - DNA, 23 bp, Homo sapiens
cttctttgaatttcctatctgta

SEQ ID NO: 3970919 - DNA, 13 bp, Homo sapiens
cttcttttgctct

SEQ ID NO: 3970920 - DNA, 14 bp, Homo sapiens
cttcttttgctctt

SEQ ID NO: 3970921 - DNA, 23 bp, Homo sapiens
cttcttttttgtctcaagattat

SEQ ID NO: 3970922 - DNA, 17 bp, Homo sapiens
cttctttttttgtgatg

SEQ ID NO: 3970923 - DNA, 22 bp, Homo sapiens
cttgaaaacctcatttaccata

SEQ ID NO: 3970924 - DNA, 14 bp, Homo sapiens
cttgaaacagcctg

SEQ ID NO: 3970925 - DNA, 16 bp, Homo sapiens
cttgaaacagcctggg

SEQ ID NO: 3970926 - DNA, 13 bp, Homo sapiens
cttgaactttcca

SEQ ID NO: 3970927 - DNA, 24 bp, Homo sapiens
cttgaatatctgccccagtagtca

SEQ ID NO: 3970928 - DNA, 18 bp, Homo sapiens
cttgaatctgttactgaa

SEQ ID NO: 3970929 - DNA, 19 bp, Homo sapiens
cttgaatctgttactgaaa

SEQ ID NO: 3970930 - DNA, 20 bp, Homo sapiens
cttgaatctgttactgaaat

SEQ ID NO: 3970931 - DNA, 17 bp, Homo sapiens
cttgacaacagactgaa

SEQ ID NO: 3970932 - DNA, 20 bp, Homo sapiens
cttgacacggtgaaatccag

SEQ ID NO: 3970933 - DNA, 22 bp, Homo sapiens
cttgacagtatatttgaaactg

SEQ ID NO: 3970934 - DNA, 22 bp, Homo sapiens
cttgacattccttgtcaccagc

SEQ ID NO: 3970935 - DNA, 14 bp, Homo sapiens
cttgaccagaccta

SEQ ID NO: 3970936 - DNA, 22 bp, Homo sapiens
cttgaccagacctagacctggg

SEQ ID NO: 3970937 - DNA, 13 bp, Homo sapiens
cttgacccatctc

SEQ ID NO: 3970938 - DNA, 16 bp, Homo sapiens
cttgacccatctcccc

SEQ ID NO: 3970939 - DNA, 20 bp, Homo sapiens
cttgactaaaaaaaaaagaa

SEQ ID NO: 3970940 - DNA, 20 bp, Homo sapiens
cttgagcactcagtctagtg

SEQ ID NO: 3970941 - DNA, 11 bp, Homo sapiens
cttgagcccag

SEQ ID NO: 3970942 - DNA, 12 bp, Homo sapiens
cttgagcccagg

SEQ ID NO: 3970943 - DNA, 14 bp, Homo sapiens
cttgagctgtatat

SEQ ID NO: 3970944 - DNA, 17 bp, Homo sapiens
cttgaggacacatgtcc

SEQ ID NO: 3970945 - DNA, 22 bp, Homo sapiens
cttgaggagtgtgagaatcaaa

SEQ ID NO: 3970946 - DNA, 17 bp, Homo sapiens
cttgagtagatctgctt

SEQ ID NO: 3970947 - DNA, 19 bp, Homo sapiens
cttgagtagatctgcttct

SEQ ID NO: 3970948 - DNA, 23 bp, Homo sapiens
cttgatactaaaagttcttctcc

SEQ ID NO: 3970949 - DNA, 17 bp, Homo sapiens
cttgatgtcatgtactt

SEQ ID NO: 3970950 - DNA, 23 bp, Homo sapiens
cttgcacaagcttgtatatacat

SEQ ID NO: 3970951 - DNA, 14 bp, Homo sapiens
cttgcacccctcac

SEQ ID NO: 3970952 - DNA, 14 bp, Homo sapiens
cttgcacctgcatc

SEQ ID NO: 3970953 - DNA, 11 bp, Homo sapiens
cttgcattaga

SEQ ID NO: 3970954 - DNA, 14 bp, Homo sapiens
cttgcattcccagt

SEQ ID NO: 3970955 - DNA, 15 bp, Homo sapiens
cttgccactgcctct

SEQ ID NO: 3970956 - DNA, 13 bp, Homo sapiens
cttgcccagagat

SEQ ID NO: 3970957 - DNA, 23 bp, Homo sapiens
cttgcccctccagagacaggaaa

SEQ ID NO: 3970958 - DNA, 15 bp, Homo sapiens
cttgcccgccagcct

SEQ ID NO: 3970959 - DNA, 19 bp, Homo sapiens
cttgcccgccagcctcagt

SEQ ID NO: 3970960 - DNA, 20 bp, Homo sapiens
cttgtatatacatattataa

SEQ ID NO: 3970961 - DNA, 22 bp, Homo sapiens
cttgtatatacatattataaat

SEQ ID NO: 3970962 - DNA, 16 bp, Homo sapiens
cttgtatattccacca

SEQ ID NO: 3970963 - DNA, 20 bp, Homo sapiens
cttgtcactatgctatttct

SEQ ID NO: 3970964 - DNA, 22 bp, Homo sapiens
cttgtcactggtagaccaaaat

SEQ ID NO: 3970965 - DNA, 20 bp, Homo sapiens
cttgtcaggacccaggccgc

SEQ ID NO: 3970966 - DNA, 14 bp, Homo sapiens
cttgtcatgtgaca

SEQ ID NO: 3970967 - DNA, 19 bp, Homo sapiens
cttgtccacagtctcccat

SEQ ID NO: 3970968 - DNA, 15 bp, Homo sapiens
cttgtccctgcccag

SEQ ID NO: 3970969 - DNA, 14 bp, Homo sapiens
cttgtcctctcccg

SEQ ID NO: 3970970 - DNA, 14 bp, Homo sapiens
cttgtcctgccagc

SEQ ID NO: 3970971 - DNA, 15 bp, Homo sapiens
cttgtcctgccagct

SEQ ID NO: 3970972 - DNA, 22 bp, Homo sapiens
cttgtcctgccagctgccttcc

SEQ ID NO: 3970973 - DNA, 14 bp, Homo sapiens
cttgtcctgctctc

SEQ ID NO: 3970974 - DNA, 19 bp, Homo sapiens
cttgtcctgctctcttcag

SEQ ID NO: 3970975 - DNA, 21 bp, Homo sapiens
cttgtctctcattctctttct

SEQ ID NO: 3970976 - DNA, 17 bp, Homo sapiens
cttgtctgaggcctcat

SEQ ID NO: 3970977 - DNA, 20 bp, Homo sapiens
cttgtctgaggcctcatccc

SEQ ID NO: 3970978 - DNA, 17 bp, Homo sapiens
cttgtctttactgacaa

SEQ ID NO: 3970979 - DNA, 17 bp, Homo sapiens
cttgtgaaaccacaggc

SEQ ID NO: 3970980 - DNA, 12 bp, Homo sapiens
cttgtgactgaa

SEQ ID NO: 3970981 - DNA, 14 bp, Homo sapiens
cttgtgactgaagg

SEQ ID NO: 3970982 - DNA, 18 bp, Homo sapiens
cttgtgactgaaggggca

SEQ ID NO: 3970983 - DNA, 15 bp, Homo sapiens
cttgtgagagctggt

SEQ ID NO: 3970984 - DNA, 16 bp, Homo sapiens
cttgtgagagctggtt

SEQ ID NO: 3970985 - DNA, 19 bp, Homo sapiens
cttgtgattctgggatgga

SEQ ID NO: 3970986 - DNA, 19 bp, Homo sapiens
cttgtgcatgtttacttta

SEQ ID NO: 3970987 - DNA, 23 bp, Homo sapiens
cttgtgccctgcccccatctccc

SEQ ID NO: 3970988 - DNA, 12 bp, Homo sapiens
cttgtgcctcag

SEQ ID NO: 3970989 - DNA, 14 bp, Homo sapiens
cttgtgcctcagcc

SEQ ID NO: 3970990 - DNA, 16 bp, Homo sapiens
cttgtgctcacgctcc

SEQ ID NO: 3970991 - DNA, 17 bp, Homo sapiens
cttgtgctcacgctccc

SEQ ID NO: 3970992 - DNA, 18 bp, Homo sapiens
cttgtgcttggtggggct

SEQ ID NO: 3970993 - DNA, 18 bp, Homo sapiens
cttgtggaattgggagct

SEQ ID NO: 3970994 - DNA, 22 bp, Homo sapiens
cttgtggaggatgaatagatgt

SEQ ID NO: 3970995 - DNA, 16 bp, Homo sapiens
cttgtggataagggag

SEQ ID NO: 3970996 - DNA, 20 bp, Homo sapiens
cttgtgtactgataaaatac

SEQ ID NO: 3970997 - DNA, 12 bp, Homo sapiens
cttgtgtcctga

SEQ ID NO: 3970998 - DNA, 17 bp, Homo sapiens
cttgtgtctctgtgctt

SEQ ID NO: 3970999 - DNA, 17 bp, Homo sapiens
cttgttaatgctttctg

SEQ ID NO: 3971000 - DNA, 15 bp, Homo sapiens
cttgttgtttttaag

SEQ ID NO: 3971001 - DNA, 22 bp, Homo sapiens
cttgttgtttttaagtcctgta

SEQ ID NO: 3971002 - DNA, 20 bp, Homo sapiens
cttgtttgattttagctgca

SEQ ID NO: 3971003 - DNA, 22 bp, Homo sapiens
cttgtttgattttagctgcaga

SEQ ID NO: 3971004 - DNA, 19 bp, Homo sapiens
cttgttttttttttccact

SEQ ID NO: 3971005 - DNA, 21 bp, Homo sapiens
ctttaaagacttaagattaaa

SEQ ID NO: 3971006 - DNA, 18 bp, Homo sapiens
ctttaaagggatggcaag

SEQ ID NO: 3971007 - DNA, 13 bp, Homo sapiens
ctttaaagtaaag

SEQ ID NO: 3971008 - DNA, 17 bp, Homo sapiens
ctttaaagtaaaggcct

SEQ ID NO: 3971009 - DNA, 23 bp, Homo sapiens
ctttaaagtacctgtagtgagaa

SEQ ID NO: 3971010 - DNA, 12 bp, Homo sapiens
ctttaaagtctt

SEQ ID NO: 3971011 - DNA, 17 bp, Homo sapiens
ctttaaagtgtaataat

SEQ ID NO: 3971012 - DNA, 19 bp, Homo sapiens
ctttaaagtgtaataatat

SEQ ID NO: 3971013 - DNA, 13 bp, Homo sapiens
ctttaaatcaaaa

SEQ ID NO: 3971014 - DNA, 16 bp, Homo sapiens
ctttaaatcaaaagct

SEQ ID NO: 3971015 - DNA, 20 bp, Homo sapiens
ctttaaatcaaaagctgctt

SEQ ID NO: 3971016 - DNA, 17 bp, Homo sapiens
ctttaatagtttctgat

SEQ ID NO: 3971017 - DNA, 20 bp, Homo sapiens
ctttaattctcatgtgatcc

SEQ ID NO: 3971018 - DNA, 17 bp, Homo sapiens
ctttacatgcaatttat

SEQ ID NO: 3971019 - DNA, 22 bp, Homo sapiens
ctttacatgctgtgctctttga

SEQ ID NO: 3971020 - DNA, 14 bp, Homo sapiens
ctttacattttatt

SEQ ID NO: 3971021 - DNA, 18 bp, Homo sapiens
ctttacctaccaccttcc

SEQ ID NO: 3971022 - DNA, 19 bp, Homo sapiens
ctttacctaccaccttccc

SEQ ID NO: 3971023 - DNA, 11 bp, Homo sapiens
ctttaccttta

SEQ ID NO: 3971024 - DNA, 15 bp, Homo sapiens
ctttacctttaaaat

SEQ ID NO: 3971025 - DNA, 15 bp, Homo sapiens
ctttaggcagcctgc

SEQ ID NO: 3971026 - DNA, 19 bp, Homo sapiens
ctttaggcagcctgccgcc

SEQ ID NO: 3971027 - DNA, 20 bp, Homo sapiens
ctttaggcagcctgccgccg

SEQ ID NO: 3971028 - DNA, 14 bp, Homo sapiens
ctttaggtctggtt

SEQ ID NO: 3971029 - DNA, 13 bp, Homo sapiens
ctttataaacttt

SEQ ID NO: 3971030 - DNA, 14 bp, Homo sapiens
ctttatacagaact

SEQ ID NO: 3971031 - DNA, 12 bp, Homo sapiens
ctttatatttag

SEQ ID NO: 3971032 - DNA, 14 bp, Homo sapiens
ctttatctgtcaca

SEQ ID NO: 3971033 - DNA, 16 bp, Homo sapiens
ctttatgctgtgttta

SEQ ID NO: 3971034 - DNA, 21 bp, Homo sapiens
ctttattcaataaaaaaaaga

SEQ ID NO: 3971035 - DNA, 13 bp, Homo sapiens
ctttatttatggc

SEQ ID NO: 3971036 - DNA, 17 bp, Homo sapiens
ctttatttatggcttat

SEQ ID NO: 3971037 - DNA, 14 bp, Homo sapiens
ctttatttctgtca

SEQ ID NO: 3971038 - DNA, 15 bp, Homo sapiens
ctttcaaagaaggaa

SEQ ID NO: 3971039 - DNA, 14 bp, Homo sapiens
ctttcaaatttcac

SEQ ID NO: 3971040 - DNA, 15 bp, Homo sapiens
ctttcaaatttcaca

SEQ ID NO: 3971041 - DNA, 17 bp, Homo sapiens
ctttcacaaaattttat

SEQ ID NO: 3971042 - DNA, 18 bp, Homo sapiens
ctttcagagccagtgaag

SEQ ID NO: 3971043 - DNA, 12 bp, Homo sapiens
ctttcaggtact

SEQ ID NO: 3971044 - DNA, 16 bp, Homo sapiens
ctttcatccccacctt

SEQ ID NO: 3971045 - DNA, 22 bp, Homo sapiens
ctttccaaaacctaaagaggaa

SEQ ID NO: 3971046 - DNA, 16 bp, Homo sapiens
ctttccagcctgggca

SEQ ID NO: 3971047 - DNA, 23 bp, Homo sapiens
ctgttcatggcagatgtaggagg

SEQ ID NO: 3971048 - DNA, 15 bp, Homo sapiens
ctgttctcaaatgct

SEQ ID NO: 3971049 - DNA, 16 bp, Homo sapiens
ctgttctggcctcaga

SEQ ID NO: 3971050 - DNA, 14 bp, Homo sapiens
ctgttctgtgtggg

SEQ ID NO: 3971051 - DNA, 21 bp, Homo sapiens
ctgttctgtgtgggtctgggg

SEQ ID NO: 3971052 - DNA, 23 bp, Homo sapiens
ctgttctgtgtgggtctggggag

SEQ ID NO: 3971053 - DNA, 22 bp, Homo sapiens
ctgttgaaaattattttaaaca

SEQ ID NO: 3971054 - DNA, 16 bp, Homo sapiens
ctgttgagttggacac

SEQ ID NO: 3971055 - DNA, 19 bp, Homo sapiens
ctgttgatcccacttcact

SEQ ID NO: 3971056 - DNA, 21 bp, Homo sapiens
ctgttgatgaggcctcttgga

SEQ ID NO: 3971057 - DNA, 17 bp, Homo sapiens
ctgttgcactgatgtcc

SEQ ID NO: 3971058 - DNA, 15 bp, Homo sapiens
ctgttgccatagccc

SEQ ID NO: 3971059 - DNA, 14 bp, Homo sapiens
ctgttgcccaggct

SEQ ID NO: 3971060 - DNA, 12 bp, Homo sapiens
ctgttgcctcat

SEQ ID NO: 3971061 - DNA, 15 bp, Homo sapiens
ctgttgcgccactga

SEQ ID NO: 3971062 - DNA, 16 bp, Homo sapiens
ctgttgctgaagtcat

SEQ ID NO: 3971063 - DNA, 13 bp, Homo sapiens
ctgttggacagct

SEQ ID NO: 3971064 - DNA, 15 bp, Homo sapiens
ctgttggacagctgc

SEQ ID NO: 3971065 - DNA, 20 bp, Homo sapiens
ctgttggacagctgcttgtg

SEQ ID NO: 3971066 - DNA, 19 bp, Homo sapiens
ctgttggacccgctctgga

SEQ ID NO: 3971067 - DNA, 22 bp, Homo sapiens
ctgttggcctcgcctgggccca

SEQ ID NO: 3971068 - DNA, 19 bp, Homo sapiens
ctgttggttagctggacat

SEQ ID NO: 3971069 - DNA, 23 bp, Homo sapiens
ctgttgtaaatgaccaagaaaaa

SEQ ID NO: 3971070 - DNA, 17 bp, Homo sapiens
ctgttgtaatagtccat

SEQ ID NO: 3971071 - DNA, 15 bp, Homo sapiens
ctgttgttgcaggga

SEQ ID NO: 3971072 - DNA, 16 bp, Homo sapiens
ctgttgttttgtttta

SEQ ID NO: 3971073 - DNA, 18 bp, Homo sapiens
ctgtttaatatttaaaca

SEQ ID NO: 3971074 - DNA, 20 bp, Homo sapiens
ctgtttaatatttaaacagc

SEQ ID NO: 3971075 - DNA, 19 bp, Homo sapiens
ctgtttcaatgacctgtat

SEQ ID NO: 3971076 - DNA, 15 bp, Homo sapiens
ctgtttccttttatg

SEQ ID NO: 3971077 - DNA, 22 bp, Homo sapiens
ctgtttcgtgtagtggaagagc

SEQ ID NO: 3971078 - DNA, 20 bp, Homo sapiens
ctgtttctattctctcctca

SEQ ID NO: 3971079 - DNA, 22 bp, Homo sapiens
ctgtttggtgtaggtaaatcta

SEQ ID NO: 3971080 - DNA, 12 bp, Homo sapiens
ctgttttaaatt

SEQ ID NO: 3971081 - DNA, 22 bp, Homo sapiens
ctgttttaaatttatttcaaaa

SEQ ID NO: 3971082 - DNA, 15 bp, Homo sapiens
ctgttttgtatatga

SEQ ID NO: 3971083 - DNA, 19 bp, Homo sapiens
ctgttttgtatatgatcta

SEQ ID NO: 3971084 - DNA, 22 bp, Homo sapiens
ctgttttgtcctttgagaaaga

SEQ ID NO: 3971085 - DNA, 23 bp, Homo sapiens
ctgttttgtcctttgagaaagaa

SEQ ID NO: 3971086 - DNA, 17 bp, Homo sapiens
cttaaaaaaatgacaga

SEQ ID NO: 3971087 - DNA, 12 bp, Homo sapiens
cttaaaaaactt

SEQ ID NO: 3971088 - DNA, 20 bp, Homo sapiens
cttaaaatattcctgcattt

SEQ ID NO: 3971089 - DNA, 14 bp, Homo sapiens
cttaaaatatttta

SEQ ID NO: 3971090 - DNA, 23 bp, Homo sapiens
cttaaaggaaaagtcaacatctt

SEQ ID NO: 3971091 - DNA, 13 bp, Homo sapiens
cttaaaggcctgg

SEQ ID NO: 3971092 - DNA, 15 bp, Homo sapiens
cttaaaggcctggaa

SEQ ID NO: 3971093 - DNA, 15 bp, Homo sapiens
cttaacatatttact

SEQ ID NO: 3971094 - DNA, 17 bp, Homo sapiens
cttaacatatttactaa

SEQ ID NO: 3971095 - DNA, 14 bp, Homo sapiens
cttaacggctccag

SEQ ID NO: 3971096 - DNA, 16 bp, Homo sapiens
cttaacggctccagga

SEQ ID NO: 3971097 - DNA, 11 bp, Homo sapiens
cttaactgtgt

SEQ ID NO: 3971098 - DNA, 16 bp, Homo sapiens
cttaagattaaattat

SEQ ID NO: 3971099 - DNA, 20 bp, Homo sapiens
cttaagccttttgctcacaa

SEQ ID NO: 3971100 - DNA, 22 bp, Homo sapiens
cttaaggagaggagaaactgag

SEQ ID NO: 3971101 - DNA, 21 bp, Homo sapiens
cttaaggatggagccagctct

SEQ ID NO: 3971102 - DNA, 19 bp, Homo sapiens
cttaagggttgaaggcagt

SEQ ID NO: 3971103 - DNA, 20 bp, Homo sapiens
cttaagggttgaaggcagtc

SEQ ID NO: 3971104 - DNA, 12 bp, Homo sapiens
cttaataaattc

SEQ ID NO: 3971105 - DNA, 13 bp, Homo sapiens
cttaataggcttt

SEQ ID NO: 3971106 - DNA, 23 bp, Homo sapiens
cttaatgtttattcctgataata

SEQ ID NO: 3971107 - DNA, 16 bp, Homo sapiens
cttaattttttttaat

SEQ ID NO: 3971108 - DNA, 18 bp, Homo sapiens
cttacacttggagcccgt

SEQ ID NO: 3971109 - DNA, 22 bp, Homo sapiens
cttacataattttttattcaag

SEQ ID NO: 3971110 - DNA, 13 bp, Homo sapiens
cttacattttccc

SEQ ID NO: 3971111 - DNA, 14 bp, Homo sapiens
cttaccaactttct

SEQ ID NO: 3971112 - DNA, 15 bp, Homo sapiens
cttaccaactttctg

SEQ ID NO: 3971113 - DNA, 16 bp, Homo sapiens
cttaccaactttctgt

SEQ ID NO: 3971114 - DNA, 22 bp, Homo sapiens
cttacccaaactgttcaagaaa

SEQ ID NO: 3971115 - DNA, 13 bp, Homo sapiens
cttacctttacat

SEQ ID NO: 3971116 - DNA, 16 bp, Homo sapiens
cttactattggtaata

SEQ ID NO: 3971117 - DNA, 18 bp, Homo sapiens
cttactcacctctctcta

SEQ ID NO: 3971118 - DNA, 19 bp, Homo sapiens
cttactcacctctctctaa

SEQ ID NO: 3971119 - DNA, 18 bp, Homo sapiens
cttactctgagcccaggc

SEQ ID NO: 3971120 - DNA, 12 bp, Homo sapiens
cttacttaaaaa

SEQ ID NO: 3971121 - DNA, 19 bp, Homo sapiens
cttacttggaactgaaggg

SEQ ID NO: 3971122 - DNA, 17 bp, Homo sapiens
cttagaaattgcatttc

SEQ ID NO: 3971123 - DNA, 17 bp, Homo sapiens
cttagaagtggaccagg

SEQ ID NO: 3971124 - DNA, 20 bp, Homo sapiens
cttagaagtggaccaggaca

SEQ ID NO: 3971125 - DNA, 22 bp, Homo sapiens
cttagaagtggaccaggacagg

SEQ ID NO: 3971126 - DNA, 20 bp, Homo sapiens
cttagaataaaattgtaaaa

SEQ ID NO: 3971127 - DNA, 19 bp, Homo sapiens
cttagatgagggtgactgt

SEQ ID NO: 3971128 - DNA, 18 bp, Homo sapiens
cttagattagctctggac

SEQ ID NO: 3971129 - DNA, 23 bp, Homo sapiens
cttagcccaagaggtctgagccc

SEQ ID NO: 3971130 - DNA, 22 bp, Homo sapiens
cttagccgtccatggcaccagc

SEQ ID NO: 3971131 - DNA, 17 bp, Homo sapiens
cttagcctcctgacctg

SEQ ID NO: 3971132 - DNA, 22 bp, Homo sapiens
cttagcctcctgacctgaggct

SEQ ID NO: 3971133 - DNA, 15 bp, Homo sapiens
cttagcctggagcac

SEQ ID NO: 3971134 - DNA, 17 bp, Homo sapiens
cttagcctggagcacct

SEQ ID NO: 3971135 - DNA, 15 bp, Homo sapiens
cttagccttgtgccc

SEQ ID NO: 3971136 - DNA, 14 bp, Homo sapiens
cttagctgtctgct

SEQ ID NO: 3971137 - DNA, 23 bp, Homo sapiens
cttagcttctattatagccacat

SEQ ID NO: 3971138 - DNA, 18 bp, Homo sapiens
cttaggaaaatgcttctg

SEQ ID NO: 3971139 - DNA, 15 bp, Homo sapiens
cttaggaacagctct

SEQ ID NO: 3971140 - DNA, 17 bp, Homo sapiens
cttagtatggttctcag

SEQ ID NO: 3971141 - DNA, 19 bp, Homo sapiens
cttagtgcccgcctaggag

SEQ ID NO: 3971142 - DNA, 23 bp, Homo sapiens
cttagtgcccgcctaggagttga

SEQ ID NO: 3971143 - DNA, 14 bp, Homo sapiens
cttataaatgtgta

SEQ ID NO: 3971144 - DNA, 16 bp, Homo sapiens
cttataaatgtgtatt

SEQ ID NO: 3971145 - DNA, 22 bp, Homo sapiens
cttatcagctacttaagagaaa

SEQ ID NO: 3971146 - DNA, 15 bp, Homo sapiens
cttatccaggactct

SEQ ID NO: 3971147 - DNA, 17 bp, Homo sapiens
cttatcccttctttttc

SEQ ID NO: 3971148 - DNA, 12 bp, Homo sapiens
cttatgaaatgg

SEQ ID NO: 3971149 - DNA, 17 bp, Homo sapiens
cttatgaaatgggcttt

SEQ ID NO: 3971150 - DNA, 21 bp, Homo sapiens
cttatgacatcacttgtacaa

SEQ ID NO: 3971151 - DNA, 21 bp, Homo sapiens
cttatgctagtttattggaag

SEQ ID NO: 3971152 - DNA, 18 bp, Homo sapiens
cttatgggatccttgtct

SEQ ID NO: 3971153 - DNA, 19 bp, Homo sapiens
cttatgtattattttctat

SEQ ID NO: 3971154 - DNA, 20 bp, Homo sapiens
cttattcccaaactacagaa

SEQ ID NO: 3971155 - DNA, 21 bp, Homo sapiens
cttatttacttgtagaaatct

SEQ ID NO: 3971156 - DNA, 11 bp, Homo sapiens
cttatttgagt

SEQ ID NO: 3971157 - DNA, 13 bp, Homo sapiens
cttatttgagtga

SEQ ID NO: 3971158 - DNA, 23 bp, Homo sapiens
cttatttgctgccacacctgagc

SEQ ID NO: 3971159 - DNA, 15 bp, Homo sapiens
cttattttcaagaaa

SEQ ID NO: 3971160 - DNA, 15 bp, Homo sapiens
cttattttgtattac

SEQ ID NO: 3971161 - DNA, 17 bp, Homo sapiens
cttcaactgaccagcct

SEQ ID NO: 3971162 - DNA, 23 bp, Homo sapiens
cttcaactgaccagcctccatgc

SEQ ID NO: 3971163 - DNA, 18 bp, Homo sapiens
cttcaagggaagaaacac

SEQ ID NO: 3971164 - DNA, 23 bp, Homo sapiens
cttcaagtgatatatgtatttat

SEQ ID NO: 3971165 - DNA, 22 bp, Homo sapiens
cttcaagtgcatgctctctgca

SEQ ID NO: 3971166 - DNA, 20 bp, Homo sapiens
cttcaagtgttgctcttgga

SEQ ID NO: 3971167 - DNA, 13 bp, Homo sapiens
cttcacaaaatgc

SEQ ID NO: 3971168 - DNA, 14 bp, Homo sapiens
cttcacaaaatgca

SEQ ID NO: 3971169 - DNA, 12 bp, Homo sapiens
cttcacaacaga

SEQ ID NO: 3971170 - DNA, 12 bp, Homo sapiens
cttcacactgca

SEQ ID NO: 3971171 - DNA, 13 bp, Homo sapiens
cttcacactgcaa

SEQ ID NO: 3971172 - DNA, 15 bp, Homo sapiens
cttcacactgcaaga

SEQ ID NO: 3971173 - DNA, 17 bp, Homo sapiens
cttcacataccctcccc

SEQ ID NO: 3971174 - DNA, 24 bp, Homo sapiens
cttcacccagctaatctgtagggc

SEQ ID NO: 3971175 - DNA, 15 bp, Homo sapiens
cttcaccccccactc

SEQ ID NO: 3971176 - DNA, 13 bp, Homo sapiens
cttcacccctgca

SEQ ID NO: 3971177 - DNA, 21 bp, Homo sapiens
cttcaccctgaatggttccat

SEQ ID NO: 3971178 - DNA, 18 bp, Homo sapiens
cttcaccttggagcctga

SEQ ID NO: 3971179 - DNA, 23 bp, Homo sapiens
cttcaccttggagcctgaacatg

SEQ ID NO: 3971180 - DNA, 13 bp, Homo sapiens
cttcactcacttt

SEQ ID NO: 3971181 - DNA, 22 bp, Homo sapiens
cttcactgtgaggggaaggcct

SEQ ID NO: 3971182 - DNA, 16 bp, Homo sapiens
cttcactgttgaaaat

SEQ ID NO: 3971183 - DNA, 19 bp, Homo sapiens
cttcagacacaaaagtcca

SEQ ID NO: 3971184 - DNA, 19 bp, Homo sapiens
cttcagacttttatcaaaa

SEQ ID NO: 3971185 - DNA, 12 bp, Homo sapiens
cttcagagccta

SEQ ID NO: 3971186 - DNA, 16 bp, Homo sapiens
cttcagagcctagcca

SEQ ID NO: 3971187 - DNA, 17 bp, Homo sapiens
cttcagagcctagccac

SEQ ID NO: 3971188 - DNA, 20 bp, Homo sapiens
cttcagatcagtgcttgagt

SEQ ID NO: 3971189 - DNA, 14 bp, Homo sapiens
cttcagccatcaac

SEQ ID NO: 3971190 - DNA, 12 bp, Homo sapiens
cttcagcccagc

SEQ ID NO: 3971191 - DNA, 20 bp, Homo sapiens
cttcagcctccccaccttct

SEQ ID NO: 3971192 - DNA, 13 bp, Homo sapiens
cttcagcctctcc

SEQ ID NO: 3971193 - DNA, 14 bp, Homo sapiens
cttcagctcccata

SEQ ID NO: 3971194 - DNA, 22 bp, Homo sapiens
cttcagctcccatagcgctggc

SEQ ID NO: 3971195 - DNA, 16 bp, Homo sapiens
cttcaggaggccctgg

SEQ ID NO: 3971196 - DNA, 23 bp, Homo sapiens
cttcagggactcaagggtccaga

SEQ ID NO: 3971197 - DNA, 22 bp, Homo sapiens
cttcagggccagaaggagggca

SEQ ID NO: 3971198 - DNA, 18 bp, Homo sapiens
cttcaggttgttctgtat

SEQ ID NO: 3971199 - DNA, 19 bp, Homo sapiens
cttcagtgcatctgggaag

SEQ ID NO: 3971200 - DNA, 15 bp, Homo sapiens
cttcagtgcctagct

SEQ ID NO: 3971201 - DNA, 14 bp, Homo sapiens
cttcagttgttttc

SEQ ID NO: 3971202 - DNA, 21 bp, Homo sapiens
cttcatactttttttcacagt

SEQ ID NO: 3971203 - DNA, 20 bp, Homo sapiens
cttcataggcggtcatgtgt

SEQ ID NO: 3971204 - DNA, 21 bp, Homo sapiens
cttcataggcggtcatgtgtg

SEQ ID NO: 3971205 - DNA, 16 bp, Homo sapiens
cttcatcaatttttat

SEQ ID NO: 3971206 - DNA, 19 bp, Homo sapiens
cttcatcaatttttataca

SEQ ID NO: 3971207 - DNA, 20 bp, Homo sapiens
cttcatcaatttttatacat

SEQ ID NO: 3971208 - DNA, 24 bp, Homo sapiens
cttcatcaatttttatacatatca

SEQ ID NO: 3971209 - DNA, 13 bp, Homo sapiens
cttcatccctttc

SEQ ID NO: 3971210 - DNA, 15 bp, Homo sapiens
cttcatccctttcca

SEQ ID NO: 3971211 - DNA, 16 bp, Homo sapiens
cttcatcttgacatgt

SEQ ID NO: 3971212 - DNA, 16 bp, Homo sapiens
cttcatgcctcagttt

SEQ ID NO: 3971213 - DNA, 21 bp, Homo sapiens
cttcatgcctcagtttcccca

SEQ ID NO: 3971214 - DNA, 17 bp, Homo sapiens
cttcatgctcagccctg

SEQ ID NO: 3971215 - DNA, 13 bp, Homo sapiens
cttcatttggaga

SEQ ID NO: 3971216 - DNA, 14 bp, Homo sapiens
cttcatttggagat

SEQ ID NO: 3971217 - DNA, 15 bp, Homo sapiens
cttccaaccccagct

SEQ ID NO: 3971218 - DNA, 19 bp, Homo sapiens
cttccaaccccagctggcc

SEQ ID NO: 3971219 - DNA, 19 bp, Homo sapiens
ctgcctgttcccattcttg

SEQ ID NO: 3971220 - DNA, 12 bp, Homo sapiens
ctgccttcctca

SEQ ID NO: 3971221 - DNA, 16 bp, Homo sapiens
ctgccttcctcatccc

SEQ ID NO: 3971222 - DNA, 14 bp, Homo sapiens
ctgccttgtgtaca

SEQ ID NO: 3971223 - DNA, 20 bp, Homo sapiens
ctgcctttgaaattccccca

SEQ ID NO: 3971224 - DNA, 21 bp, Homo sapiens
ctgccttttttaacactagaa

SEQ ID NO: 3971225 - DNA, 14 bp, Homo sapiens
ctgcgatcttcaga

SEQ ID NO: 3971226 - DNA, 19 bp, Homo sapiens
ctgcgatcttcagagcagg

SEQ ID NO: 3971227 - DNA, 20 bp, Homo sapiens
ctgcgatcttcagagcaggg

SEQ ID NO: 3971228 - DNA, 17 bp, Homo sapiens
ctgcgattttgcctgtg

SEQ ID NO: 3971229 - DNA, 20 bp, Homo sapiens
ctgcgctggacgatagcttg

SEQ ID NO: 3971230 - DNA, 17 bp, Homo sapiens
ctgcggctgctgtgtgc

SEQ ID NO: 3971231 - DNA, 19 bp, Homo sapiens
ctgcggctgctgtgtgcct

SEQ ID NO: 3971232 - DNA, 16 bp, Homo sapiens
ctgcgggtctgaagga

SEQ ID NO: 3971233 - DNA, 17 bp, Homo sapiens
ctgcgggtctgaaggaa

SEQ ID NO: 3971234 - DNA, 21 bp, Homo sapiens
ctgcgtcagaccagtactggg

SEQ ID NO: 3971235 - DNA, 18 bp, Homo sapiens
ctgcgtcctgacgccctg

SEQ ID NO: 3971236 - DNA, 23 bp, Homo sapiens
ctgcgttggagccactcctgtcc

SEQ ID NO: 3971237 - DNA, 18 bp, Homo sapiens
ctgctaaatactgtacat

SEQ ID NO: 3971238 - DNA, 16 bp, Homo sapiens
ctgctactacccgagc

SEQ ID NO: 3971239 - DNA, 19 bp, Homo sapiens
ctgctactacccgagccca

SEQ ID NO: 3971240 - DNA, 21 bp, Homo sapiens
ctgctactacccgagcccagc

SEQ ID NO: 3971241 - DNA, 22 bp, Homo sapiens
ctgctactacccgagcccagct

SEQ ID NO: 3971242 - DNA, 14 bp, Homo sapiens
ctgctagagcaacc

SEQ ID NO: 3971243 - DNA, 15 bp, Homo sapiens
ctgctagagcaaccc

SEQ ID NO: 3971244 - DNA, 19 bp, Homo sapiens
ctgctagagcaacccctgt

SEQ ID NO: 3971245 - DNA, 16 bp, Homo sapiens
ctgctagctgtagaaa

SEQ ID NO: 3971246 - DNA, 23 bp, Homo sapiens
ctgctaggcgagtgccaggactc

SEQ ID NO: 3971247 - DNA, 23 bp, Homo sapiens
ctgctatattttcatgacttttc

SEQ ID NO: 3971248 - DNA, 22 bp, Homo sapiens
ctgctattatgtaacatccaga

SEQ ID NO: 3971249 - DNA, 23 bp, Homo sapiens
ctgctcaagaagacatggagact

SEQ ID NO: 3971250 - DNA, 17 bp, Homo sapiens
ctgctcagcaggcccta

SEQ ID NO: 3971251 - DNA, 19 bp, Homo sapiens
ctggctgcaagggccagag

SEQ ID NO: 3971252 - DNA, 17 bp, Homo sapiens
ctggctgccaggcgttg

SEQ ID NO: 3971253 - DNA, 24 bp, Homo sapiens
ctggctgctctcatgcctgcctga

SEQ ID NO: 3971254 - DNA, 15 bp, Homo sapiens
ctggctggctgaggg

SEQ ID NO: 3971255 - DNA, 16 bp, Homo sapiens
ctggctggctgagggc

SEQ ID NO: 3971256 - DNA, 17 bp, Homo sapiens
ctggctggctgagggca

SEQ ID NO: 3971257 - DNA, 18 bp, Homo sapiens
ctggctggggcagagggg

SEQ ID NO: 3971258 - DNA, 22 bp, Homo sapiens
ctggctggggcagaggggcagc

SEQ ID NO: 3971259 - DNA, 23 bp, Homo sapiens
ctggctggggcagaggggcagcc

SEQ ID NO: 3971260 - DNA, 19 bp, Homo sapiens
ctggctgtggaggcctgat

SEQ ID NO: 3971261 - DNA, 20 bp, Homo sapiens
ctggctgtggaggcctgatg

SEQ ID NO: 3971262 - DNA, 20 bp, Homo sapiens
ctggctgtttgatagcagaa

SEQ ID NO: 3971263 - DNA, 15 bp, Homo sapiens
ctggcttccaggtat

SEQ ID NO: 3971264 - DNA, 23 bp, Homo sapiens
ctggcttccaggtatctccagga

SEQ ID NO: 3971265 - DNA, 16 bp, Homo sapiens
ctggcttcccatcccc

SEQ ID NO: 3971266 - DNA, 18 bp, Homo sapiens
ctggcttcccatccccag

SEQ ID NO: 3971267 - DNA, 13 bp, Homo sapiens
ctggcttctagat

SEQ ID NO: 3971268 - DNA, 17 bp, Homo sapiens
ctggcttctagatctgg

SEQ ID NO: 3971269 - DNA, 12 bp, Homo sapiens
ctggcttctgtg

SEQ ID NO: 3971270 - DNA, 20 bp, Homo sapiens
ctggcttgcttgccgagcct

SEQ ID NO: 3971271 - DNA, 19 bp, Homo sapiens
ctggcttgtaactccacca

SEQ ID NO: 3971272 - DNA, 18 bp, Homo sapiens
ctggctttacattttatt

SEQ ID NO: 3971273 - DNA, 14 bp, Homo sapiens
ctggctttgacatg

SEQ ID NO: 3971274 - DNA, 23 bp, Homo sapiens
ctggctttgacatgaaaagatag

SEQ ID NO: 3971275 - DNA, 14 bp, Homo sapiens
ctggctttgtctct

SEQ ID NO: 3971276 - DNA, 20 bp, Homo sapiens
ctggcttttcactgctggct

SEQ ID NO: 3971277 - DNA, 22 bp, Homo sapiens
ctggcttttcactgctggctgc

SEQ ID NO: 3971278 - DNA, 15 bp, Homo sapiens
ctgggaaacagggag

SEQ ID NO: 3971279 - DNA, 16 bp, Homo sapiens
ctgggaaacagggagc

SEQ ID NO: 3971280 - DNA, 20 bp, Homo sapiens
ctgggaaaggaaaaccaggg

SEQ ID NO: 3971281 - DNA, 21 bp, Homo sapiens
ctgggaaaggaaaaccaggga

SEQ ID NO: 3971282 - DNA, 22 bp, Homo sapiens
ctgggaaaggaaaaccagggat

SEQ ID NO: 3971283 - DNA, 16 bp, Homo sapiens
ctgggaaaggacccac

SEQ ID NO: 3971284 - DNA, 22 bp, Homo sapiens
ctgggaacccaagtccaagcat

SEQ ID NO: 3971285 - DNA, 13 bp, Homo sapiens
ctgggaaccccgc

SEQ ID NO: 3971286 - DNA, 22 bp, Homo sapiens
ctgggaacccgactgtgaaagt

SEQ ID NO: 3971287 - DNA, 15 bp, Homo sapiens
ctgggaactcatcct

SEQ ID NO: 3971288 - DNA, 14 bp, Homo sapiens
ctgggaaggctaag

SEQ ID NO: 3971289 - DNA, 13 bp, Homo sapiens
ctgggaagggaag

SEQ ID NO: 3971290 - DNA, 12 bp, Homo sapiens
ctgggaaggggt

SEQ ID NO: 3971291 - DNA, 15 bp, Homo sapiens
ctgggaaggggtgcc

SEQ ID NO: 3971292 - DNA, 19 bp, Homo sapiens
ctgggaccatggacacatt

SEQ ID NO: 3971293 - DNA, 12 bp, Homo sapiens
ctgggacccagc

SEQ ID NO: 3971294 - DNA, 19 bp, Homo sapiens
ctgggacccagctactctg

SEQ ID NO: 3971295 - DNA, 23 bp, Homo sapiens
ctgggaccctttccttccttccc

SEQ ID NO: 3971296 - DNA, 23 bp, Homo sapiens
ctgggaccgctacaccactctgg

SEQ ID NO: 3971297 - DNA, 15 bp, Homo sapiens
ctgggacctgtgttc

SEQ ID NO: 3971298 - DNA, 18 bp, Homo sapiens
ctgggactacaggtgcaa

SEQ ID NO: 3971299 - DNA, 13 bp, Homo sapiens
ctgggactcccag

SEQ ID NO: 3971300 - DNA, 13 bp, Homo sapiens
ctgggaggaaaag

SEQ ID NO: 3971301 - DNA, 19 bp, Homo sapiens
ctgggaggcatggccctgg

SEQ ID NO: 3971302 - DNA, 18 bp, Homo sapiens
ctgggagtgttctgtttc

SEQ ID NO: 3971303 - DNA, 21 bp, Homo sapiens
ctgggatgagccgctgtgagc

SEQ ID NO: 3971304 - DNA, 22 bp, Homo sapiens
ctgggatggaccctcgcagcag

SEQ ID NO: 3971305 - DNA, 17 bp, Homo sapiens
ctgggatgtagaacttc

SEQ ID NO: 3971306 - DNA, 22 bp, Homo sapiens
ctgggattcaggaaaaggcctg

SEQ ID NO: 3971307 - DNA, 17 bp, Homo sapiens
ctgggattcccaccaag

SEQ ID NO: 3971308 - DNA, 14 bp, Homo sapiens
ctgggcacccacct

SEQ ID NO: 3971309 - DNA, 15 bp, Homo sapiens
ctgggcatctcgtgc

SEQ ID NO: 3971310 - DNA, 12 bp, Homo sapiens
ctgggcattttc

SEQ ID NO: 3971311 - DNA, 17 bp, Homo sapiens
ctgggccaaaagggcag

SEQ ID NO: 3971312 - DNA, 22 bp, Homo sapiens
ctgggccaaaagggcagccagg

SEQ ID NO: 3971313 - DNA, 19 bp, Homo sapiens
ctgggccaactcacctgag

SEQ ID NO: 3971314 - DNA, 14 bp, Homo sapiens
ctgggccagcctca

SEQ ID NO: 3971315 - DNA, 18 bp, Homo sapiens
ctgggccagcctcagctc

SEQ ID NO: 3971316 - DNA, 20 bp, Homo sapiens
ctgggccagcctcagctcag

SEQ ID NO: 3971317 - DNA, 23 bp, Homo sapiens
ctgggccagcctcagctcagcct

SEQ ID NO: 3971318 - DNA, 20 bp, Homo sapiens
ctgggcccacagagatgcat

SEQ ID NO: 3971319 - DNA, 11 bp, Homo sapiens
ctgggcccagg

SEQ ID NO: 3971320 - DNA, 21 bp, Homo sapiens
ctgggcccaggctctgggaag

SEQ ID NO: 3971321 - DNA, 18 bp, Homo sapiens
ctgggccccaccacctag

SEQ ID NO: 3971322 - DNA, 16 bp, Homo sapiens
ctgggccccacctact

SEQ ID NO: 3971323 - DNA, 20 bp, Homo sapiens
ctgggccccatgctctgccc

SEQ ID NO: 3971324 - DNA, 21 bp, Homo sapiens
ctgggccccatgctctgcccc

SEQ ID NO: 3971325 - DNA, 16 bp, Homo sapiens
ctgggcccctccacgc

SEQ ID NO: 3971326 - DNA, 20 bp, Homo sapiens
ctgggcccctccacgcctcc

SEQ ID NO: 3971327 - DNA, 21 bp, Homo sapiens
ctgggcccctccacgcctcct

SEQ ID NO: 3971328 - DNA, 12 bp, Homo sapiens
ctgggccctggg

SEQ ID NO: 3971329 - DNA, 14 bp, Homo sapiens
ctgggccctggggc

SEQ ID NO: 3971330 - DNA, 14 bp, Homo sapiens
ctgggccggccagc

SEQ ID NO: 3971331 - DNA, 16 bp, Homo sapiens
ctgggccggccagcct

SEQ ID NO: 3971332 - DNA, 17 bp, Homo sapiens
ctgggcctatggagagc

SEQ ID NO: 3971333 - DNA, 18 bp, Homo sapiens
ctgggcctatggagagcc

SEQ ID NO: 3971334 - DNA, 22 bp, Homo sapiens
ctgggcctatggagagccctgg

SEQ ID NO: 3971335 - DNA, 15 bp, Homo sapiens
ctgggcctgctgctg

SEQ ID NO: 3971336 - DNA, 12 bp, Homo sapiens
ctgggcctgctt

SEQ ID NO: 3971337 - DNA, 17 bp, Homo sapiens
ctgagtggaatgcaggg

SEQ ID NO: 3971338 - DNA, 16 bp, Homo sapiens
ctgagttacttgtctg

SEQ ID NO: 3971339 - DNA, 19 bp, Homo sapiens
ctgagttacttgtctgagg

SEQ ID NO: 3971340 - DNA, 17 bp, Homo sapiens
ctgagtttcattctcct

SEQ ID NO: 3971341 - DNA, 19 bp, Homo sapiens
ctgagtttcattctcctgc

SEQ ID NO: 3971342 - DNA, 18 bp, Homo sapiens
ctgataacaacctggaga

SEQ ID NO: 3971343 - DNA, 14 bp, Homo sapiens
ctgataagcttcaa

SEQ ID NO: 3971344 - DNA, 14 bp, Homo sapiens
ctgataataattga

SEQ ID NO: 3971345 - DNA, 14 bp, Homo sapiens
ctgatacccagagc

SEQ ID NO: 3971346 - DNA, 15 bp, Homo sapiens
ctgatatgggactga

SEQ ID NO: 3971347 - DNA, 15 bp, Homo sapiens
ctgatcaaaaataaa

SEQ ID NO: 3971348 - DNA, 18 bp, Homo sapiens
ctgatcaaaaataaacta

SEQ ID NO: 3971349 - DNA, 22 bp, Homo sapiens
ctgatcaaaaataaactagttt

SEQ ID NO: 3971350 - DNA, 22 bp, Homo sapiens
ctgatcaagtcaccggagcttt

SEQ ID NO: 3971351 - DNA, 23 bp, Homo sapiens
ctgatcacctctggctttgtctc

SEQ ID NO: 3971352 - DNA, 17 bp, Homo sapiens
ctgatcgggataacaaa

SEQ ID NO: 3971353 - DNA, 14 bp, Homo sapiens
ctgatgaaaatgaa

SEQ ID NO: 3971354 - DNA, 14 bp, Homo sapiens
ctgatgacttgctt

SEQ ID NO: 3971355 - DNA, 13 bp, Homo sapiens
ctgatgatgtctc

SEQ ID NO: 3971356 - DNA, 22 bp, Homo sapiens
ctgatgatgtctcttgtagaag

SEQ ID NO: 3971357 - DNA, 18 bp, Homo sapiens
ctgatgcatcagaaaggg

SEQ ID NO: 3971358 - DNA, 23 bp, Homo sapiens
ctgatgcatcagaaagggagggc

SEQ ID NO: 3971359 - DNA, 14 bp, Homo sapiens
ctgatgccatgttt

SEQ ID NO: 3971360 - DNA, 15 bp, Homo sapiens
ctgatgccccttccc

SEQ ID NO: 3971361 - DNA, 17 bp, Homo sapiens
ctgatgcgaaaacttga

SEQ ID NO: 3971362 - DNA, 11 bp, Homo sapiens
ctgatgctgcc

SEQ ID NO: 3971363 - DNA, 17 bp, Homo sapiens
ctgatgctttgcttcaa

SEQ ID NO: 3971364 - DNA, 14 bp, Homo sapiens
ctgatggagaagga

SEQ ID NO: 3971365 - DNA, 15 bp, Homo sapiens
ctgatggagaaggaa

SEQ ID NO: 3971366 - DNA, 13 bp, Homo sapiens
ctgatggccaaga

SEQ ID NO: 3971367 - DNA, 23 bp, Homo sapiens
ctgatggtgctcacgactcttcc

SEQ ID NO: 3971368 - DNA, 13 bp, Homo sapiens
ctgatgttcctag

SEQ ID NO: 3971369 - DNA, 22 bp, Homo sapiens
ctgattatcctataggcagacg

SEQ ID NO: 3971370 - DNA, 16 bp, Homo sapiens
ctgattggctcaccca

SEQ ID NO: 3971371 - DNA, 12 bp, Homo sapiens
ctgatttcagga

SEQ ID NO: 3971372 - DNA, 14 bp, Homo sapiens
ctgatttcagggaa

SEQ ID NO: 3971373 - DNA, 13 bp, Homo sapiens
ctgatttccaggc

SEQ ID NO: 3971374 - DNA, 14 bp, Homo sapiens
ctgatttccaggcc

SEQ ID NO: 3971375 - DNA, 19 bp, Homo sapiens
ctgatttccaggcccctga

SEQ ID NO: 3971376 - DNA, 14 bp, Homo sapiens
ctgatttctctgaa

SEQ ID NO: 3971377 - DNA, 17 bp, Homo sapiens
ctgatttttttgttgtt

SEQ ID NO: 3971378 - DNA, 19 bp, Homo sapiens
ctgatttttttgttgttgt

SEQ ID NO: 3971379 - DNA, 16 bp, Homo sapiens
ctgcaaactcactgct

SEQ ID NO: 3971380 - DNA, 16 bp, Homo sapiens
ctgcaaagtgcaaata

SEQ ID NO: 3971381 - DNA, 18 bp, Homo sapiens
ctgcaaagtgcaaatact

SEQ ID NO: 3971382 - DNA, 19 bp, Homo sapiens
ctgcaacctccacctcctg

SEQ ID NO: 3971383 - DNA, 20 bp, Homo sapiens
ctgcaacctccacctcctga

SEQ ID NO: 3971384 - DNA, 13 bp, Homo sapiens
ctgcaactagcca

SEQ ID NO: 3971385 - DNA, 15 bp, Homo sapiens
ctgcaactagccaag

SEQ ID NO: 3971386 - DNA, 16 bp, Homo sapiens
ctgcaactagccaagg

SEQ ID NO: 3971387 - DNA, 14 bp, Homo sapiens
ctgcaagagccttg

SEQ ID NO: 3971388 - DNA, 18 bp, Homo sapiens
ctgcaagagccttggtgt

SEQ ID NO: 3971389 - DNA, 21 bp, Homo sapiens
ctgcaagagccttggtgtcca

SEQ ID NO: 3971390 - DNA, 14 bp, Homo sapiens
ctgcaagatttcac

SEQ ID NO: 3971391 - DNA, 20 bp, Homo sapiens
ctgcaagatttcacatcagc

SEQ ID NO: 3971392 - DNA, 13 bp, Homo sapiens
ctgcaagccccag

SEQ ID NO: 3971393 - DNA, 15 bp, Homo sapiens
ctgcaagccccaggg

SEQ ID NO: 3971394 - DNA, 17 bp, Homo sapiens
ctgcaagccccagggcc

SEQ ID NO: 3971395 - DNA, 16 bp, Homo sapiens
ctgcaagggccagagt

SEQ ID NO: 3971396 - DNA, 17 bp, Homo sapiens
ctgcaagggccagagtt

SEQ ID NO: 3971397 - DNA, 20 bp, Homo sapiens
ctgcaataaattatggctct

SEQ ID NO: 3971398 - DNA, 13 bp, Homo sapiens
ctgcaatctccag

SEQ ID NO: 3971399 - DNA, 17 bp, Homo sapiens
ctgcaatctccagggct

SEQ ID NO: 3971400 - DNA, 16 bp, Homo sapiens
ctgcaatgttttcctt

SEQ ID NO: 3971401 - DNA, 15 bp, Homo sapiens
ctgcacacacagctc

SEQ ID NO: 3971402 - DNA, 21 bp, Homo sapiens
ctgcacagtgcatctcagccc

SEQ ID NO: 3971403 - DNA, 14 bp, Homo sapiens
ctgcaccagagtga

SEQ ID NO: 3971404 - DNA, 15 bp, Homo sapiens
ctgcaccagagtgaa

SEQ ID NO: 3971405 - DNA, 18 bp, Homo sapiens
ctgcaccagcccttccct

SEQ ID NO: 3971406 - DNA, 18 bp, Homo sapiens
ctgcaccatcacacatgc

SEQ ID NO: 3971407 - DNA, 12 bp, Homo sapiens
ctgcacccagaa

SEQ ID NO: 3971408 - DNA, 12 bp, Homo sapiens
ctgcacccaggg

SEQ ID NO: 3971409 - DNA, 11 bp, Homo sapiens
ctgcacctccc

SEQ ID NO: 3971410 - DNA, 19 bp, Homo sapiens
ctgcacctccccccactgc

SEQ ID NO: 3971411 - DNA, 20 bp, Homo sapiens
ctgcacctccccccactgca

SEQ ID NO: 3971412 - DNA, 13 bp, Homo sapiens
ctgcacctgtgca

SEQ ID NO: 3971413 - DNA, 14 bp, Homo sapiens
ctgcacctgtgcag

SEQ ID NO: 3971414 - DNA, 20 bp, Homo sapiens
ctgcacgccaccgctgcctt

SEQ ID NO: 3971415 - DNA, 13 bp, Homo sapiens
ctgcactccagaa

SEQ ID NO: 3971416 - DNA, 18 bp, Homo sapiens
ctgcactccagcctgggc

SEQ ID NO: 3971417 - DNA, 15 bp, Homo sapiens
ctgcactccatggcc

SEQ ID NO: 3971418 - DNA, 17 bp, Homo sapiens
ctgcactccatggccac

SEQ ID NO: 3971419 - DNA, 21 bp, Homo sapiens
ctgcactccatggccaccccg

SEQ ID NO: 3971420 - DNA, 20 bp, Homo sapiens
ctgcactccggcctgatgac

SEQ ID NO: 3971421 - DNA, 18 bp, Homo sapiens
ctgcactgaaaaggttct

SEQ ID NO: 3971422 - DNA, 15 bp, Homo sapiens
ctgcacttcagacac

SEQ ID NO: 3971423 - DNA, 23 bp, Homo sapiens
ctgcagaacgtattggtccagct

SEQ ID NO: 3971424 - DNA, 19 bp, Homo sapiens
ctgcagaaggccaagaatc

SEQ ID NO: 3971425 - DNA, 15 bp, Homo sapiens
ctgcagaccctgccc

SEQ ID NO: 3971426 - DNA, 21 bp, Homo sapiens
ctgcagaccctgcccttgttt

SEQ ID NO: 3971427 - DNA, 21 bp, Homo sapiens
ctgcagagctatggtgaggtg

SEQ ID NO: 3971428 - DNA, 13 bp, Homo sapiens
ctgcagaggacag

SEQ ID NO: 3971429 - DNA, 19 bp, Homo sapiens
ctgcagaggacagagctgg

SEQ ID NO: 3971430 - DNA, 21 bp, Homo sapiens
ctgcagaggaccacagtgggt

SEQ ID NO: 3971431 - DNA, 18 bp, Homo sapiens
ctgcagatagccagacac

SEQ ID NO: 3971432 - DNA, 23 bp, Homo sapiens
ctgcagccagcccagcccagctg

SEQ ID NO: 3971433 - DNA, 17 bp, Homo sapiens
ctgcagcctcccccaca

SEQ ID NO: 3971434 - DNA, 18 bp, Homo sapiens
ctgcagcctcctcctgac

SEQ ID NO: 3971435 - DNA, 20 bp, Homo sapiens
ctgcagcctggtagaattgg

SEQ ID NO: 3971436 - DNA, 11 bp, Homo sapiens
ctgcagctgct

SEQ ID NO: 3971437 - DNA, 11 bp, Homo sapiens
ctgcagcttcc

SEQ ID NO: 3971438 - DNA, 20 bp, Homo sapiens
ctgcagcttgtagccagccg

SEQ ID NO: 3971439 - DNA, 12 bp, Homo sapiens
ctgcagctttac

SEQ ID NO: 3971440 - DNA, 14 bp, Homo sapiens
ctgcagctttacat

SEQ ID NO: 3971441 - DNA, 20 bp, Homo sapiens
ctgcaggaacgagcactggc

SEQ ID NO: 3971442 - DNA, 23 bp, Homo sapiens
ctgcaggaacgagcactggccag

SEQ ID NO: 3971443 - DNA, 20 bp, Homo sapiens
ctgcaggcaccttagtggct

SEQ ID NO: 3971444 - DNA, 17 bp, Homo sapiens
ctgcagggggtgtgtct

SEQ ID NO: 3971445 - DNA, 16 bp, Homo sapiens
ctgcaggtacttcctc

SEQ ID NO: 3971446 - DNA, 20 bp, Homo sapiens
ctgcaggtacttcctcctga

SEQ ID NO: 3971447 - DNA, 14 bp, Homo sapiens
ctgcagtccgcagt

SEQ ID NO: 3971448 - DNA, 21 bp, Homo sapiens
ctgcagtccgcagtctggcct

SEQ ID NO: 3971449 - DNA, 18 bp, Homo sapiens
ctgcagtgatggcgcggg

SEQ ID NO: 3971450 - DNA, 22 bp, Homo sapiens
ctgcagtgatggcgcgggaggc

SEQ ID NO: 3971451 - DNA, 21 bp, Homo sapiens
ctgcatatcggaggtggtgga

SEQ ID NO: 3971452 - DNA, 12 bp, Homo sapiens
ctgcatcccctt

SEQ ID NO: 3971453 - DNA, 22 bp, Homo sapiens
ctgcatccccttggctgtgagg

SEQ ID NO: 3971454 - DNA, 20 bp, Homo sapiens
ctgcatccgtagttccctga

SEQ ID NO: 3971455 - DNA, 21 bp, Homo sapiens
ctgcatctgggattcccacca

SEQ ID NO: 3971456 - DNA, 15 bp, Homo sapiens
ctgcatgctctggaa

SEQ ID NO: 3971457 - DNA, 20 bp, Homo sapiens
ctgcattcaggatcaaaccc

SEQ ID NO: 3971458 - DNA, 22 bp, Homo sapiens
ctgcattccccgctgcccaatc

SEQ ID NO: 3971459 - DNA, 15 bp, Homo sapiens
ctgcattgttattgt

SEQ ID NO: 3971460 - DNA, 20 bp, Homo sapiens
ctgcatttataaatgtgtgg

SEQ ID NO: 3971461 - DNA, 14 bp, Homo sapiens
ctgcatttctgagt

SEQ ID NO: 3971462 - DNA, 13 bp, Homo sapiens
ctgcatttgtgaa

SEQ ID NO: 3971463 - DNA, 22 bp, Homo sapiens
ctgcatttgtgaaatgatggtg

SEQ ID NO: 3971464 - DNA, 19 bp, Homo sapiens
ctgccaagcactcgagacc

SEQ ID NO: 3971465 - DNA, 19 bp, Homo sapiens
ctgccaccacgtctgccag

SEQ ID NO: 3971466 - DNA, 14 bp, Homo sapiens
ctgccaccagtcac

SEQ ID NO: 3971467 - DNA, 19 bp, Homo sapiens
ctgccaccatcctgctgct

SEQ ID NO: 3971468 - DNA, 23 bp, Homo sapiens
ctgccacccgcttcctgtttctt

SEQ ID NO: 3971469 - DNA, 13 bp, Homo sapiens
ctgccacctcccc

SEQ ID NO: 3971470 - DNA, 16 bp, Homo sapiens
ctgccacctgtctgtc

SEQ ID NO: 3971471 - DNA, 23 bp, Homo sapiens
ctgccacttccaggagcccagag

SEQ ID NO: 3971472 - DNA, 23 bp, Homo sapiens
ctgccagagcccaagtgccatcc

SEQ ID NO: 3971473 - DNA, 24 bp, Homo sapiens
ctgccagagcccaagtgccatccc

SEQ ID NO: 3971474 - DNA, 15 bp, Homo sapiens
ctgccagccatcaca

SEQ ID NO: 3971475 - DNA, 21 bp, Homo sapiens
ctgccagccatcacaagggga

SEQ ID NO: 3971476 - DNA, 16 bp, Homo sapiens
ctgccagctgccttcc

SEQ ID NO: 3971477 - DNA, 19 bp, Homo sapiens
ctgccagctgccttcctca

SEQ ID NO: 3971478 - DNA, 23 bp, Homo sapiens
ctgccagctgccttcctcatccc

SEQ ID NO: 3971479 - DNA, 12 bp, Homo sapiens
ctgccaggacac

SEQ ID NO: 3971480 - DNA, 21 bp, Homo sapiens
ctgccaggagggacaaaggag

SEQ ID NO: 3971481 - DNA, 22 bp, Homo sapiens
ctgccaggagggacaaaggagc

SEQ ID NO: 3971482 - DNA, 19 bp, Homo sapiens
ctgccaggcacctggcctg

SEQ ID NO: 3971483 - DNA, 16 bp, Homo sapiens
ctgccaggcccatctc

SEQ ID NO: 3971484 - DNA, 18 bp, Homo sapiens
ctgccaggcccatctcag

SEQ ID NO: 3971485 - DNA, 22 bp, Homo sapiens
ctgccaggcgttggtgccactt

SEQ ID NO: 3971486 - DNA, 17 bp, Homo sapiens
ctgccagtccccctgcc

SEQ ID NO: 3971487 - DNA, 17 bp, Homo sapiens
ctgccagtgccttacct

SEQ ID NO: 3971488 - DNA, 18 bp, Homo sapiens
ctgccagtgccttacctc

SEQ ID NO: 3971489 - DNA, 15 bp, Homo sapiens
ctgccataaagccat

SEQ ID NO: 3971490 - DNA, 16 bp, Homo sapiens
ctgccataccgctggg

SEQ ID NO: 3971491 - DNA, 15 bp, Homo sapiens
ctgccatgccactgc

SEQ ID NO: 3971492 - DNA, 17 bp, Homo sapiens
ctgccatgccactgcca

SEQ ID NO: 3971493 - DNA, 20 bp, Homo sapiens
ctgccatgccactgccaggc

SEQ ID NO: 3971494 - DNA, 21 bp, Homo sapiens
ctgccatgccactgccaggca

SEQ ID NO: 3971495 - DNA, 22 bp, Homo sapiens
ctgccatgccactgccaggcac

SEQ ID NO: 3971496 - DNA, 13 bp, Homo sapiens
ctgccatgcccag

SEQ ID NO: 3971497 - DNA, 16 bp, Homo sapiens
ctgccatgcccagaga

SEQ ID NO: 3971498 - DNA, 22 bp, Homo sapiens
ctgcccaatgctttgggaggcc

SEQ ID NO: 3971499 - DNA, 21 bp, Homo sapiens
ctgcccaattttgcagggagc

SEQ ID NO: 3971500 - DNA, 17 bp, Homo sapiens
ctgcccactcccaggac

SEQ ID NO: 3971501 - DNA, 23 bp, Homo sapiens
ctgcccacttagccgtccatggc

SEQ ID NO: 3971502 - DNA, 24 bp, Homo sapiens
ctgcccacttagccgtccatggca

SEQ ID NO: 3971503 - DNA, 19 bp, Homo sapiens
ctgcccacttcagcccagc

SEQ ID NO: 3971504 - DNA, 23 bp, Homo sapiens
ctgcccagaacccttcctgagac

SEQ ID NO: 3971505 - DNA, 17 bp, Homo sapiens
ctgcccagcctccaagc

SEQ ID NO: 3971506 - DNA, 11 bp, Homo sapiens
ctgcccaggag

SEQ ID NO: 3971507 - DNA, 23 bp, Homo sapiens
ctgcccaggagagccagccctcc

SEQ ID NO: 3971508 - DNA, 17 bp, Homo sapiens
ctgcccaggcctgcctg

SEQ ID NO: 3971509 - DNA, 19 bp, Homo sapiens
ctgcccaggcctgcctgtt

SEQ ID NO: 3971510 - DNA, 17 bp, Homo sapiens
ctgcccatacccctgcc

SEQ ID NO: 3971511 - DNA, 24 bp, Homo sapiens
ctgccccaactccttccagctagt

SEQ ID NO: 3971512 - DNA, 16 bp, Homo sapiens
ctgccccaagcagcca

SEQ ID NO: 3971513 - DNA, 17 bp, Homo sapiens
ctgccccaagcagccag

SEQ ID NO: 3971514 - DNA, 18 bp, Homo sapiens
ctgccccaagcagccagc

SEQ ID NO: 3971515 - DNA, 20 bp, Homo sapiens
ctgccccaagcagccagcca

SEQ ID NO: 3971516 - DNA, 20 bp, Homo sapiens
ctgccccaaggggcccacaa

SEQ ID NO: 3971517 - DNA, 22 bp, Homo sapiens
ctgccccagcgcggcttggccg

SEQ ID NO: 3971518 - DNA, 18 bp, Homo sapiens
ctgcccccatctccccag

SEQ ID NO: 3971519 - DNA, 20 bp, Homo sapiens
ctgcccccatctccccaggc

SEQ ID NO: 3971520 - DNA, 21 bp, Homo sapiens
ctgcccccatctccccaggcc

SEQ ID NO: 3971521 - DNA, 22 bp, Homo sapiens
ctgcccccatctccccaggcct

SEQ ID NO: 3971522 - DNA, 23 bp, Homo sapiens
ctgcccccatctccccaggcctc

SEQ ID NO: 3971523 - DNA, 17 bp, Homo sapiens
ctgcccccgacagccca

SEQ ID NO: 3971524 - DNA, 21 bp, Homo sapiens
ctgccccgggtgcctcagagc

SEQ ID NO: 3971525 - DNA, 16 bp, Homo sapiens
ctgccccgttccctgt

SEQ ID NO: 3971526 - DNA, 18 bp, Homo sapiens
ctgccccgttccctgtca

SEQ ID NO: 3971527 - DNA, 19 bp, Homo sapiens
ctgccccgttccctgtcag

SEQ ID NO: 3971528 - DNA, 20 bp, Homo sapiens
ctgccccgttccctgtcaga

SEQ ID NO: 3971529 - DNA, 13 bp, Homo sapiens
ctgcccctccctt

SEQ ID NO: 3971530 - DNA, 14 bp, Homo sapiens
ctgcccctcccttc

SEQ ID NO: 3971531 - DNA, 14 bp, Homo sapiens
ctgcccctcgcctt

SEQ ID NO: 3971532 - DNA, 17 bp, Homo sapiens
ctgcccctgtaggttgc

SEQ ID NO: 3971533 - DNA, 16 bp, Homo sapiens
ctgccccttctgtttc

SEQ ID NO: 3971534 - DNA, 14 bp, Homo sapiens
ctgccccttgggca

SEQ ID NO: 3971535 - DNA, 13 bp, Homo sapiens
ctgcccgcagagc

SEQ ID NO: 3971536 - DNA, 15 bp, Homo sapiens
ctgcccgcagagccc

SEQ ID NO: 3971537 - DNA, 17 bp, Homo sapiens
ctgccctctccttcctt

SEQ ID NO: 3971538 - DNA, 13 bp, Homo sapiens
ctgccctctctca

SEQ ID NO: 3971539 - DNA, 15 bp, Homo sapiens
ctgccctctctcagt

SEQ ID NO: 3971540 - DNA, 11 bp, Homo sapiens
ctgccctgcca

SEQ ID NO: 3971541 - DNA, 17 bp, Homo sapiens
ctgccctgccacctgtc

SEQ ID NO: 3971542 - DNA, 17 bp, Homo sapiens
ctgccctgcctgcccac

SEQ ID NO: 3971543 - DNA, 18 bp, Homo sapiens
ctgccctgcctgcccact

SEQ ID NO: 3971544 - DNA, 13 bp, Homo sapiens
ctctgccacctcc

SEQ ID NO: 3971545 - DNA, 18 bp, Homo sapiens
ctctgccacctcccctat

SEQ ID NO: 3971546 - DNA, 17 bp, Homo sapiens
ctctgccatgcccagag

SEQ ID NO: 3971547 - DNA, 18 bp, Homo sapiens
ctctgccatgcccagaga

SEQ ID NO: 3971548 - DNA, 14 bp, Homo sapiens
ctctgccccaagca

SEQ ID NO: 3971549 - DNA, 16 bp, Homo sapiens
ctctgccccaagcagc

SEQ ID NO: 3971550 - DNA, 20 bp, Homo sapiens
ctctgccccaagcagccagc

SEQ ID NO: 3971551 - DNA, 15 bp, Homo sapiens
ctctgccccaagccc

SEQ ID NO: 3971552 - DNA, 18 bp, Homo sapiens
ctctgccccaagccccca

SEQ ID NO: 3971553 - DNA, 13 bp, Homo sapiens
ctctgccccaagg

SEQ ID NO: 3971554 - DNA, 15 bp, Homo sapiens
ctctgccccaagggg

SEQ ID NO: 3971555 - DNA, 18 bp, Homo sapiens
ctctgccccaaggggccc

SEQ ID NO: 3971556 - DNA, 19 bp, Homo sapiens
ctctgccccaaggggccca

SEQ ID NO: 3971557 - DNA, 22 bp, Homo sapiens
ctctgccccaaggggcccacaa

SEQ ID NO: 3971558 - DNA, 14 bp, Homo sapiens
ctctgccccagagg

SEQ ID NO: 3971559 - DNA, 22 bp, Homo sapiens
ctctgccccttgggcatccacc

SEQ ID NO: 3971560 - DNA, 14 bp, Homo sapiens
ctctgccctgtata

SEQ ID NO: 3971561 - DNA, 15 bp, Homo sapiens
ctctgccctgtatat

SEQ ID NO: 3971562 - DNA, 13 bp, Homo sapiens
ctctgcctccctc

SEQ ID NO: 3971563 - DNA, 15 bp, Homo sapiens
ctctgcctcctcttc

SEQ ID NO: 3971564 - DNA, 13 bp, Homo sapiens
ctctgctctagcc

SEQ ID NO: 3971565 - DNA, 23 bp, Homo sapiens
ctctgctctagccaggagtctgt

SEQ ID NO: 3971566 - DNA, 14 bp, Homo sapiens
ctctgctctgatgc

SEQ ID NO: 3971567 - DNA, 12 bp, Homo sapiens
ctctgctgctcc

SEQ ID NO: 3971568 - DNA, 13 bp, Homo sapiens
ctctgctgctccc

SEQ ID NO: 3971569 - DNA, 15 bp, Homo sapiens
ctctgctggcctggc

SEQ ID NO: 3971570 - DNA, 16 bp, Homo sapiens
ctctgctggcctggcc

SEQ ID NO: 3971571 - DNA, 21 bp, Homo sapiens
ctctggaaaactcaggattct

SEQ ID NO: 3971572 - DNA, 19 bp, Homo sapiens
ctctggaagccccccacct

SEQ ID NO: 3971573 - DNA, 22 bp, Homo sapiens
ctctggaagccccccacctttc

SEQ ID NO: 3971574 - DNA, 14 bp, Homo sapiens
ctctggaccagcct

SEQ ID NO: 3971575 - DNA, 15 bp, Homo sapiens
ctctggagccagaga

SEQ ID NO: 3971576 - DNA, 16 bp, Homo sapiens
ctctggagccagagag

SEQ ID NO: 3971577 - DNA, 13 bp, Homo sapiens
ctctggatccctg

SEQ ID NO: 3971578 - DNA, 16 bp, Homo sapiens
ctctggatggcaccag

SEQ ID NO: 3971579 - DNA, 13 bp, Homo sapiens
ctctggcagccac

SEQ ID NO: 3971580 - DNA, 17 bp, Homo sapiens
ctctggcagccacactt

SEQ ID NO: 3971581 - DNA, 12 bp, Homo sapiens
ctctggccaccc

SEQ ID NO: 3971582 - DNA, 13 bp, Homo sapiens
ctctggccctgcc

SEQ ID NO: 3971583 - DNA, 15 bp, Homo sapiens
ctctggccctgcctt

SEQ ID NO: 3971584 - DNA, 22 bp, Homo sapiens
ctctggcctctcgagttctcct

SEQ ID NO: 3971585 - DNA, 16 bp, Homo sapiens
ctctggcggcttcctg

SEQ ID NO: 3971586 - DNA, 23 bp, Homo sapiens
ctctggctggctaactggaagca

SEQ ID NO: 3971587 - DNA, 14 bp, Homo sapiens
ctctggcttccagg

SEQ ID NO: 3971588 - DNA, 14 bp, Homo sapiens
ctctggctttgtct

SEQ ID NO: 3971589 - DNA, 17 bp, Homo sapiens
ctctgggaaggggtgcc

SEQ ID NO: 3971590 - DNA, 21 bp, Homo sapiens
ctctgggaaggggtgccctct

SEQ ID NO: 3971591 - DNA, 18 bp, Homo sapiens
ctctgggcagctgtcatg

SEQ ID NO: 3971592 - DNA, 12 bp, Homo sapiens
ctctgggctcag

SEQ ID NO: 3971593 - DNA, 17 bp, Homo sapiens
ctctgggctcagggctg

SEQ ID NO: 3971594 - DNA, 22 bp, Homo sapiens
ctctgggctcagggctggagtg

SEQ ID NO: 3971595 - DNA, 14 bp, Homo sapiens
ctctggggccctgg

SEQ ID NO: 3971596 - DNA, 18 bp, Homo sapiens
ctctggggccctgggcct

SEQ ID NO: 3971597 - DNA, 16 bp, Homo sapiens
ctctggggttcatcta

SEQ ID NO: 3971598 - DNA, 21 bp, Homo sapiens
ctctgggtaggtgttgaaaat

SEQ ID NO: 3971599 - DNA, 21 bp, Homo sapiens
ctctgggtttcatatccagct

SEQ ID NO: 3971600 - DNA, 15 bp, Homo sapiens
ctctggtgctgtcct

SEQ ID NO: 3971601 - DNA, 13 bp, Homo sapiens
ctctggtggtgct

SEQ ID NO: 3971602 - DNA, 15 bp, Homo sapiens
ctctgtcagccagcc

SEQ ID NO: 3971603 - DNA, 17 bp, Homo sapiens
ctctgtcagccagccgc

SEQ ID NO: 3971604 - DNA, 21 bp, Homo sapiens
ctctgtcagccagccgccctg

SEQ ID NO: 3971605 - DNA, 16 bp, Homo sapiens
ctctgtcatcactccc

SEQ ID NO: 3971606 - DNA, 17 bp, Homo sapiens
ctctgtcatcactccct

SEQ ID NO: 3971607 - DNA, 22 bp, Homo sapiens
ctctgtcatcactccctggatg

SEQ ID NO: 3971608 - DNA, 12 bp, Homo sapiens
ctctgtccaggc

SEQ ID NO: 3971609 - DNA, 15 bp, Homo sapiens
ctctgtccaggccac

SEQ ID NO: 3971610 - DNA, 21 bp, Homo sapiens
ctctgtcccggttcaccttgc

SEQ ID NO: 3971611 - DNA, 22 bp, Homo sapiens
ctctgtcccggttcaccttgcc

SEQ ID NO: 3971612 - DNA, 14 bp, Homo sapiens
ctctgtgccagagc

SEQ ID NO: 3971613 - DNA, 17 bp, Homo sapiens
ctctgtgccagagcctg

SEQ ID NO: 3971614 - DNA, 20 bp, Homo sapiens
ctctgtgccagagcctgggg

SEQ ID NO: 3971615 - DNA, 22 bp, Homo sapiens
ctctgtggcctgtgtccagcag

SEQ ID NO: 3971616 - DNA, 14 bp, Homo sapiens
ctctgtgtccttcc

SEQ ID NO: 3971617 - DNA, 16 bp, Homo sapiens
ctctgtgtccttccct

SEQ ID NO: 3971618 - DNA, 17 bp, Homo sapiens
ctctgtgtccttccctg

SEQ ID NO: 3971619 - DNA, 17 bp, Homo sapiens
ctctgtgtgcacaaata

SEQ ID NO: 3971620 - DNA, 14 bp, Homo sapiens
ctctgttctttata

SEQ ID NO: 3971621 - DNA, 22 bp, Homo sapiens
ctctgttgcccaggctggagtg

SEQ ID NO: 3971622 - DNA, 16 bp, Homo sapiens
ctctgtttctccttct

SEQ ID NO: 3971623 - DNA, 17 bp, Homo sapiens
ctcttagggaaaccaat

SEQ ID NO: 3971624 - DNA, 21 bp, Homo sapiens
ctcttagtgcccgcctaggag

SEQ ID NO: 3971625 - DNA, 13 bp, Homo sapiens
ctcttcactcagc

SEQ ID NO: 3971626 - DNA, 17 bp, Homo sapiens
ctcttcactcccaataa

SEQ ID NO: 3971627 - DNA, 21 bp, Homo sapiens
ctcttcattttgagtctcagg

SEQ ID NO: 3971628 - DNA, 20 bp, Homo sapiens
ctcttccagaagatgccctc

SEQ ID NO: 3971629 - DNA, 22 bp, Homo sapiens
ctcttccagaagatgccctcca

SEQ ID NO: 3971630 - DNA, 13 bp, Homo sapiens
ctcttccctcagt

SEQ ID NO: 3971631 - DNA, 12 bp, Homo sapiens
ctcttcctaccc

SEQ ID NO: 3971632 - DNA, 15 bp, Homo sapiens
ctcttcctacccaac

SEQ ID NO: 3971633 - DNA, 12 bp, Homo sapiens
ctcttcctgatt

SEQ ID NO: 3971634 - DNA, 15 bp, Homo sapiens
ctcttcctggacctg

SEQ ID NO: 3971635 - DNA, 18 bp, Homo sapiens
ctcttcctggacctgagt

SEQ ID NO: 3971636 - DNA, 12 bp, Homo sapiens
ctcttccttccc

SEQ ID NO: 3971637 - DNA, 13 bp, Homo sapiens
ctcttccttcccc

SEQ ID NO: 3971638 - DNA, 22 bp, Homo sapiens
ctcttccttcccccatcccctt

SEQ ID NO: 3971639 - DNA, 16 bp, Homo sapiens
ctcttcggtttctgag

SEQ ID NO: 3971640 - DNA, 15 bp, Homo sapiens
ctcttctaacctcag

SEQ ID NO: 3971641 - DNA, 16 bp, Homo sapiens
ctcttctaacctcagc

SEQ ID NO: 3971642 - DNA, 21 bp, Homo sapiens
ctcttctatgcaagccttgct

SEQ ID NO: 3971643 - DNA, 16 bp, Homo sapiens
ctcttctatttaaaaa

SEQ ID NO: 3971644 - DNA, 17 bp, Homo sapiens
ctcttctatttaaaaaa

SEQ ID NO: 3971645 - DNA, 13 bp, Homo sapiens
ctcttctccactg

SEQ ID NO: 3971646 - DNA, 15 bp, Homo sapiens
ctcttctccactgga

SEQ ID NO: 3971647 - DNA, 19 bp, Homo sapiens
ctcttctccactggatgga

SEQ ID NO: 3971648 - DNA, 16 bp, Homo sapiens
ctcttctcctttcaca

SEQ ID NO: 3971649 - DNA, 20 bp, Homo sapiens
ctcttctctattcctgaccc

SEQ ID NO: 3971650 - DNA, 17 bp, Homo sapiens
ctcttctgccagcctcc

SEQ ID NO: 3971651 - DNA, 16 bp, Homo sapiens
ctcttctgttctcaaa

SEQ ID NO: 3971652 - DNA, 19 bp, Homo sapiens
ctcttctgttctcaaatgc

SEQ ID NO: 3971653 - DNA, 15 bp, Homo sapiens
ctcttcttcttcaga

SEQ ID NO: 3971654 - DNA, 18 bp, Homo sapiens
ctcttcttcttcagaaga

SEQ ID NO: 3971655 - DNA, 13 bp, Homo sapiens
ctcttctttctga

SEQ ID NO: 3971656 - DNA, 16 bp, Homo sapiens
ctcttgccactgcctc

SEQ ID NO: 3971657 - DNA, 16 bp, Homo sapiens
ctcttgctattggaat

SEQ ID NO: 3971658 - DNA, 18 bp, Homo sapiens
ctcttgctattggaatgt

SEQ ID NO: 3971659 - DNA, 19 bp, Homo sapiens
ctcttgctcaaaaatctgt

SEQ ID NO: 3971660 - DNA, 18 bp, Homo sapiens
ctcttggacctctgctct

SEQ ID NO: 3971661 - DNA, 19 bp, Homo sapiens
ctcttggacctctgctctg

SEQ ID NO: 3971662 - DNA, 23 bp, Homo sapiens
ctcttgtacagttaactctccca

SEQ ID NO: 3971663 - DNA, 12 bp, Homo sapiens
ctcttgtagaag

SEQ ID NO: 3971664 - DNA, 19 bp, Homo sapiens
ctcttgtgctcacgctccc

SEQ ID NO: 3971665 - DNA, 20 bp, Homo sapiens
ctctttactcccttcctggc

SEQ ID NO: 3971666 - DNA, 22 bp, Homo sapiens
ctctttactcccttcctggcct

SEQ ID NO: 3971667 - DNA, 23 bp, Homo sapiens
ctctttctctccttcttccctgt

SEQ ID NO: 3971668 - DNA, 13 bp, Homo sapiens
ctctttcttcttt

SEQ ID NO: 3971669 - DNA, 15 bp, Homo sapiens
ctctttgctacaata

SEQ ID NO: 3971670 - DNA, 18 bp, Homo sapiens
ctctttgctacaataaat

SEQ ID NO: 3971671 - DNA, 23 bp, Homo sapiens
ctctttgctacaataaatgctga

SEQ ID NO: 3971672 - DNA, 15 bp, Homo sapiens
ctcttttccctctct

SEQ ID NO: 3971673 - DNA, 15 bp, Homo sapiens
ctcttttggccttgt

SEQ ID NO: 3971674 - DNA, 16 bp, Homo sapiens
ctcttttttattctgt

SEQ ID NO: 3971675 - DNA, 15 bp, Homo sapiens
ctgaaaacccagaga

SEQ ID NO: 3971676 - DNA, 15 bp, Homo sapiens
ctgaaaactgtaaat

SEQ ID NO: 3971677 - DNA, 21 bp, Homo sapiens
ctgaaaagcaattgccctgta

SEQ ID NO: 3971678 - DNA, 15 bp, Homo sapiens
ctgaaaatctaatat

SEQ ID NO: 3971679 - DNA, 16 bp, Homo sapiens
ctgaaaatctaatatt

SEQ ID NO: 3971680 - DNA, 20 bp, Homo sapiens
ctgaaaatctaatattaaaa

SEQ ID NO: 3971681 - DNA, 13 bp, Homo sapiens
ctgaaacggcccc

SEQ ID NO: 3971682 - DNA, 16 bp, Homo sapiens
ctgaaagcacaggaga

SEQ ID NO: 3971683 - DNA, 12 bp, Homo sapiens
ctgaaagccacg

SEQ ID NO: 3971684 - DNA, 23 bp, Homo sapiens
ctgaaagccagctgccgaccaga

SEQ ID NO: 3971685 - DNA, 18 bp, Homo sapiens
ctgaaagtggctcttcta

SEQ ID NO: 3971686 - DNA, 22 bp, Homo sapiens
ctgaaatcggaagggacttcct

SEQ ID NO: 3971687 - DNA, 12 bp, Homo sapiens
ctgaaatttccc

SEQ ID NO: 3971688 - DNA, 14 bp, Homo sapiens
ctgaaatttcccac

SEQ ID NO: 3971689 - DNA, 22 bp, Homo sapiens
ctgaacaaacactgaatcatgt

SEQ ID NO: 3971690 - DNA, 13 bp, Homo sapiens
ctgaacaagaatt

SEQ ID NO: 3971691 - DNA, 18 bp, Homo sapiens
ctgaacacatactagaaa

SEQ ID NO: 3971692 - DNA, 17 bp, Homo sapiens
ctgaacatgacatttct

SEQ ID NO: 3971693 - DNA, 21 bp, Homo sapiens
ctgaacatttgctttgttttc

SEQ ID NO: 3971694 - DNA, 12 bp, Homo sapiens
ctgaaccattac

SEQ ID NO: 3971695 - DNA, 13 bp, Homo sapiens
ctgaacctcagtt

SEQ ID NO: 3971696 - DNA, 23 bp, Homo sapiens
ctgaagacaaaccactgtacata

SEQ ID NO: 3971697 - DNA, 22 bp, Homo sapiens
ctgaagacttacttattcttcc

SEQ ID NO: 3971698 - DNA, 16 bp, Homo sapiens
ctgaagaggcaagaga

SEQ ID NO: 3971699 - DNA, 18 bp, Homo sapiens
ctgaagaggcaagagaca

SEQ ID NO: 3971700 - DNA, 11 bp, Homo sapiens
ctgaagccaga

SEQ ID NO: 3971701 - DNA, 16 bp, Homo sapiens
ctgaagcctatttatt

SEQ ID NO: 3971702 - DNA, 17 bp, Homo sapiens
ctgaagcctctgccctg

SEQ ID NO: 3971703 - DNA, 20 bp, Homo sapiens
ctgaagcctctgccctgcct

SEQ ID NO: 3971704 - DNA, 21 bp, Homo sapiens
ctgaagcttcactcactgtca

SEQ ID NO: 3971705 - DNA, 14 bp, Homo sapiens
ctgaagctttacca

SEQ ID NO: 3971706 - DNA, 22 bp, Homo sapiens
ctgaaggaataaattgctcctt

SEQ ID NO: 3971707 - DNA, 19 bp, Homo sapiens
ctgaaggaatagccagaga

SEQ ID NO: 3971708 - DNA, 21 bp, Homo sapiens
ctgaaggaatagccagagagg

SEQ ID NO: 3971709 - DNA, 12 bp, Homo sapiens
ctgaaggagaag

SEQ ID NO: 3971710 - DNA, 14 bp, Homo sapiens
ctgaaggggcacac

SEQ ID NO: 3971711 - DNA, 22 bp, Homo sapiens
ctgaaggggcacaccactgccc

SEQ ID NO: 3971712 - DNA, 15 bp, Homo sapiens
ctgaagggggcggcc

SEQ ID NO: 3971713 - DNA, 16 bp, Homo sapiens
ctgaagggggcggcct

SEQ ID NO: 3971714 - DNA, 18 bp, Homo sapiens
ctgaagggtgacatccca

SEQ ID NO: 3971715 - DNA, 14 bp, Homo sapiens
ctgaagtcactgca

SEQ ID NO: 3971716 - DNA, 18 bp, Homo sapiens
ctgaagtgaaggagaaag

SEQ ID NO: 3971717 - DNA, 20 bp, Homo sapiens
ctgaagtgaaggagaaagga

SEQ ID NO: 3971718 - DNA, 20 bp, Homo sapiens
ctgaataacatttgtgtggt

SEQ ID NO: 3971719 - DNA, 14 bp, Homo sapiens
ctgaatattttgta

SEQ ID NO: 3971720 - DNA, 21 bp, Homo sapiens
ctgaatctgataggaaaagaa

SEQ ID NO: 3971721 - DNA, 22 bp, Homo sapiens
ctgaatgcctcaatgtgaccag

SEQ ID NO: 3971722 - DNA, 18 bp, Homo sapiens
ctgaatggtccagggttg

SEQ ID NO: 3971723 - DNA, 18 bp, Homo sapiens
ctgaatggttccatgcct

SEQ ID NO: 3971724 - DNA, 22 bp, Homo sapiens
ctgaatggttccatgcctgagg

SEQ ID NO: 3971725 - DNA, 13 bp, Homo sapiens
ctgaatgtgccta

SEQ ID NO: 3971726 - DNA, 14 bp, Homo sapiens
ctgaattattttgt

SEQ ID NO: 3971727 - DNA, 15 bp, Homo sapiens
ctgaattattttgtt

SEQ ID NO: 3971728 - DNA, 22 bp, Homo sapiens
ctgaattattttgttgtgattt

SEQ ID NO: 3971729 - DNA, 16 bp, Homo sapiens
ctgaattgtccccagt

SEQ ID NO: 3971730 - DNA, 15 bp, Homo sapiens
ctgaatttgggcctc

SEQ ID NO: 3971731 - DNA, 18 bp, Homo sapiens
ctgaattttaaatgttca

SEQ ID NO: 3971732 - DNA, 13 bp, Homo sapiens
ctgacaagggctg

SEQ ID NO: 3971733 - DNA, 14 bp, Homo sapiens
ctgacaagggctga

SEQ ID NO: 3971734 - DNA, 20 bp, Homo sapiens
ctgacaagggctgacctgcc

SEQ ID NO: 3971735 - DNA, 15 bp, Homo sapiens
ctgacaatggcagct

SEQ ID NO: 3971736 - DNA, 16 bp, Homo sapiens
ctgacaatggcagcta

SEQ ID NO: 3971737 - DNA, 17 bp, Homo sapiens
ctgacaatggcagctag

SEQ ID NO: 3971738 - DNA, 23 bp, Homo sapiens
ctgacaatggcagctagactgga

SEQ ID NO: 3971739 - DNA, 13 bp, Homo sapiens
ctgacacaggaaa

SEQ ID NO: 3971740 - DNA, 17 bp, Homo sapiens
ctgacaccgtccctcag

SEQ ID NO: 3971741 - DNA, 19 bp, Homo sapiens
ctgacacctaccatgctgc

SEQ ID NO: 3971742 - DNA, 20 bp, Homo sapiens
ctgacacctaccatgctgct

SEQ ID NO: 3971743 - DNA, 14 bp, Homo sapiens
ctgacagaaggact

SEQ ID NO: 3971744 - DNA, 12 bp, Homo sapiens
ctgacagaggag

SEQ ID NO: 3971745 - DNA, 20 bp, Homo sapiens
ctgacaggttcccagcagct

SEQ ID NO: 3971746 - DNA, 14 bp, Homo sapiens
ctgacatctcctct

SEQ ID NO: 3971747 - DNA, 14 bp, Homo sapiens
ctgacatggctttg

SEQ ID NO: 3971748 - DNA, 22 bp, Homo sapiens
ctgacatttctaacatatgtat

SEQ ID NO: 3971749 - DNA, 14 bp, Homo sapiens
ctgaccaacaggct

SEQ ID NO: 3971750 - DNA, 17 bp, Homo sapiens
ctgaccaagagagaaag

SEQ ID NO: 3971751 - DNA, 16 bp, Homo sapiens
ctgacccagagtggag

SEQ ID NO: 3971752 - DNA, 22 bp, Homo sapiens
ctgacccagagtggagtctgag

SEQ ID NO: 3971753 - DNA, 23 bp, Homo sapiens
ctgacccagagtggagtctgagt

SEQ ID NO: 3971754 - DNA, 11 bp, Homo sapiens
ctgacccagtc

SEQ ID NO: 3971755 - DNA, 14 bp, Homo sapiens
ctgacccagtccct

SEQ ID NO: 3971756 - DNA, 17 bp, Homo sapiens
ctgacccagtccctggg

SEQ ID NO: 3971757 - DNA, 18 bp, Homo sapiens
ctgacccagtccctgggg

SEQ ID NO: 3971758 - DNA, 13 bp, Homo sapiens
ctgacccagtgag

SEQ ID NO: 3971759 - DNA, 16 bp, Homo sapiens
ctgaccccatcaccta

SEQ ID NO: 3971760 - DNA, 20 bp, Homo sapiens
ctgaccctcctccactccac

SEQ ID NO: 3971761 - DNA, 22 bp, Homo sapiens
ctgaccctcctccactccacct

SEQ ID NO: 3971762 - DNA, 14 bp, Homo sapiens
ctgaccggcacctg

SEQ ID NO: 3971763 - DNA, 17 bp, Homo sapiens
ctgacctcccagcccta

SEQ ID NO: 3971764 - DNA, 22 bp, Homo sapiens
ctgacctcccagccctatggat

SEQ ID NO: 3971765 - DNA, 12 bp, Homo sapiens
ctgacctctggt

SEQ ID NO: 3971766 - DNA, 13 bp, Homo sapiens
ctgacctgaggct

SEQ ID NO: 3971767 - DNA, 21 bp, Homo sapiens
ctgacctgatcacctctggct

SEQ ID NO: 3971768 - DNA, 22 bp, Homo sapiens
ctgacctgatcacctctggctt

SEQ ID NO: 3971769 - DNA, 12 bp, Homo sapiens
ctgacctgtttt

SEQ ID NO: 3971770 - DNA, 14 bp, Homo sapiens
ctgaccttggagag

SEQ ID NO: 3971771 - DNA, 13 bp, Homo sapiens
ctgacgacactga

SEQ ID NO: 3971772 - DNA, 21 bp, Homo sapiens
ctgacgacactgaagaatcaa

SEQ ID NO: 3971773 - DNA, 13 bp, Homo sapiens
ctgacgccctgcg

SEQ ID NO: 3971774 - DNA, 23 bp, Homo sapiens
ctgacggaagccaacttggcttt

SEQ ID NO: 3971775 - DNA, 20 bp, Homo sapiens
ctgacggacgtcctgctggc

SEQ ID NO: 3971776 - DNA, 17 bp, Homo sapiens
ctgactcacaagaagac

SEQ ID NO: 3971777 - DNA, 21 bp, Homo sapiens
ctgactcacaagaagaccaga

SEQ ID NO: 3971778 - DNA, 22 bp, Homo sapiens
ctgactccagagtctgagcccc

SEQ ID NO: 3971779 - DNA, 16 bp, Homo sapiens
ctgactccagtgagct

SEQ ID NO: 3971780 - DNA, 15 bp, Homo sapiens
ctgactccatgtgtg

SEQ ID NO: 3971781 - DNA, 16 bp, Homo sapiens
ctgactccctgtgggg

SEQ ID NO: 3971782 - DNA, 21 bp, Homo sapiens
ctgactccctgtgggggtggc

SEQ ID NO: 3971783 - DNA, 13 bp, Homo sapiens
ctgacttctaagt

SEQ ID NO: 3971784 - DNA, 10 bp, Homo sapiens
ctgagaaaag

SEQ ID NO: 3971785 - DNA, 18 bp, Homo sapiens
ctgagaaagactattcaa

SEQ ID NO: 3971786 - DNA, 22 bp, Homo sapiens
ctgagaaagactattcaaacag

SEQ ID NO: 3971787 - DNA, 22 bp, Homo sapiens
ctgagaaatgaatgctgagacc

SEQ ID NO: 3971788 - DNA, 12 bp, Homo sapiens
ctgagaacctgg

SEQ ID NO: 3971789 - DNA, 16 bp, Homo sapiens
ctgagaacctggcctt

SEQ ID NO: 3971790 - DNA, 19 bp, Homo sapiens
ctgagaacctggccttcag

SEQ ID NO: 3971791 - DNA, 14 bp, Homo sapiens
ctgagaagaagctg

SEQ ID NO: 3971792 - DNA, 15 bp, Homo sapiens
ctgagaagaagctga

SEQ ID NO: 3971793 - DNA, 15 bp, Homo sapiens
ctgagaataagaaag

SEQ ID NO: 3971794 - DNA, 16 bp, Homo sapiens
ctgagaattccaagga

SEQ ID NO: 3971795 - DNA, 22 bp, Homo sapiens
ctgagaatttaaaaataagaaa

SEQ ID NO: 3971796 - DNA, 13 bp, Homo sapiens
ctgagacaggaga

SEQ ID NO: 3971797 - DNA, 15 bp, Homo sapiens
ctgagacaggagaat

SEQ ID NO: 3971798 - DNA, 14 bp, Homo sapiens
ctgagaccagttgg

SEQ ID NO: 3971799 - DNA, 14 bp, Homo sapiens
ctgagacggcagag

SEQ ID NO: 3971800 - DNA, 23 bp, Homo sapiens
ctgagacggcagagaccccagga

SEQ ID NO: 3971801 - DNA, 17 bp, Homo sapiens
ctgagactccagaatct

SEQ ID NO: 3971802 - DNA, 17 bp, Homo sapiens
ctgagactctcttagga

SEQ ID NO: 3971803 - DNA, 21 bp, Homo sapiens
ctgagactctcttaggagcag

SEQ ID NO: 3971804 - DNA, 20 bp, Homo sapiens
ctgagactggcacttagccc

SEQ ID NO: 3971805 - DNA, 17 bp, Homo sapiens
ctgagagacccaaggag

SEQ ID NO: 3971806 - DNA, 16 bp, Homo sapiens
ctgagagacttttaat

SEQ ID NO: 3971807 - DNA, 16 bp, Homo sapiens
ctgagagcagatggtc

SEQ ID NO: 3971808 - DNA, 20 bp, Homo sapiens
ctgagaggaagatgaagaga

SEQ ID NO: 3971809 - DNA, 21 bp, Homo sapiens
ctgagatgtgaacacatcagc

SEQ ID NO: 3971810 - DNA, 17 bp, Homo sapiens
ctgagcaaatgtggctc

SEQ ID NO: 3971811 - DNA, 16 bp, Homo sapiens
ctgagcaccccctcat

SEQ ID NO: 3971812 - DNA, 21 bp, Homo sapiens
ctgagcaccccctcattcccc

SEQ ID NO: 3971813 - DNA, 15 bp, Homo sapiens
ctgagcaccctctcc

SEQ ID NO: 3971814 - DNA, 16 bp, Homo sapiens
ctgagcacctgcttca

SEQ ID NO: 3971815 - DNA, 17 bp, Homo sapiens
ctgagcacctgcttcat

SEQ ID NO: 3971816 - DNA, 23 bp, Homo sapiens
ctgagcacctgcttcatgctcag

SEQ ID NO: 3971817 - DNA, 14 bp, Homo sapiens
ctgagcactgccag

SEQ ID NO: 3971818 - DNA, 18 bp, Homo sapiens
ctgagcactgccaggagg

SEQ ID NO: 3971819 - DNA, 19 bp, Homo sapiens
ctgagcaggcccgacagag

SEQ ID NO: 3971820 - DNA, 23 bp, Homo sapiens
ctgagcagggccggggaactggc

SEQ ID NO: 3971821 - DNA, 16 bp, Homo sapiens
ctgagcataatgctcc

SEQ ID NO: 3971822 - DNA, 23 bp, Homo sapiens
ctgagccaaacacactgtaaata

SEQ ID NO: 3971823 - DNA, 17 bp, Homo sapiens
ctgagccactcgcagtc

SEQ ID NO: 3971824 - DNA, 23 bp, Homo sapiens
ctgagcccaggagctgagtcacc

SEQ ID NO: 3971825 - DNA, 13 bp, Homo sapiens
ctgagcccaggcc

SEQ ID NO: 3971826 - DNA, 14 bp, Homo sapiens
ctgagcccaggccg

SEQ ID NO: 3971827 - DNA, 14 bp, Homo sapiens
ctgagcccccggct

SEQ ID NO: 3971828 - DNA, 12 bp, Homo sapiens
ctgagcctgccg

SEQ ID NO: 3971829 - DNA, 13 bp, Homo sapiens
ctgagcctgccga

SEQ ID NO: 3971830 - DNA, 19 bp, Homo sapiens
ctgagcctgccgagcaacc

SEQ ID NO: 3971831 - DNA, 18 bp, Homo sapiens
ctgagctcacaaggcagc

SEQ ID NO: 3971832 - DNA, 20 bp, Homo sapiens
ctgagctcccccttcccagt

SEQ ID NO: 3971833 - DNA, 14 bp, Homo sapiens
ctgagctctgagag

SEQ ID NO: 3971834 - DNA, 20 bp, Homo sapiens
ctgagctctgagaggccctg

SEQ ID NO: 3971835 - DNA, 12 bp, Homo sapiens
ctgagctgggct

SEQ ID NO: 3971836 - DNA, 19 bp, Homo sapiens
ctgagctggggcctggaga

SEQ ID NO: 3971837 - DNA, 23 bp, Homo sapiens
ctgagctggggcctggagagggg

SEQ ID NO: 3971838 - DNA, 18 bp, Homo sapiens
ctgagcttagccttgtgc

SEQ ID NO: 3971839 - DNA, 19 bp, Homo sapiens
ctgagcttagccttgtgcc

SEQ ID NO: 3971840 - DNA, 20 bp, Homo sapiens
ctgagcttagccttgtgccc

SEQ ID NO: 3971841 - DNA, 20 bp, Homo sapiens
ctgagcttttcatggaagtg

SEQ ID NO: 3971842 - DNA, 16 bp, Homo sapiens
ctgaggaattttcttt

SEQ ID NO: 3971843 - DNA, 23 bp, Homo sapiens
ctgaggacatggagagagactca

SEQ ID NO: 3971844 - DNA, 15 bp, Homo sapiens
ctgaggactccctcc

SEQ ID NO: 3971845 - DNA, 16 bp, Homo sapiens
ctgaggactccctcca

SEQ ID NO: 3971846 - DNA, 20 bp, Homo sapiens
ctgaggactccctccatgtg

SEQ ID NO: 3971847 - DNA, 14 bp, Homo sapiens
ctgaggagtagctg

SEQ ID NO: 3971848 - DNA, 17 bp, Homo sapiens
ctgaggagtctgaggtc

SEQ ID NO: 3971849 - DNA, 21 bp, Homo sapiens
ctgaggatcctcacaggagca

SEQ ID NO: 3971850 - DNA, 23 bp, Homo sapiens
ctgaggatcctcacaggagcaga

SEQ ID NO: 3971851 - DNA, 17 bp, Homo sapiens
ctgaggatttcaagcct

SEQ ID NO: 3971852 - DNA, 18 bp, Homo sapiens
ctgaggatttcaagcctg

SEQ ID NO: 3971853 - DNA, 15 bp, Homo sapiens
ctgaggccagcctgg

SEQ ID NO: 3971854 - DNA, 17 bp, Homo sapiens
ctgaggccagcctggcc

SEQ ID NO: 3971855 - DNA, 19 bp, Homo sapiens
ctgaggccagcctggcctc

SEQ ID NO: 3971856 - DNA, 23 bp, Homo sapiens
ctgaggccagcctggcctcctgc

SEQ ID NO: 3971857 - DNA, 21 bp, Homo sapiens
ctgaggcctaaaagtaaacat

SEQ ID NO: 3971858 - DNA, 23 bp, Homo sapiens
ctgaggcctaaaagtaaacatta

SEQ ID NO: 3971859 - DNA, 15 bp, Homo sapiens
ctgaggcctcatccc

SEQ ID NO: 3971860 - DNA, 23 bp, Homo sapiens
ctgaggcgccccaacccgtggag

SEQ ID NO: 3971861 - DNA, 17 bp, Homo sapiens
ctgaggctcctgtgcta

SEQ ID NO: 3971862 - DNA, 23 bp, Homo sapiens
ctgaggctctgacccagtgagat

SEQ ID NO: 3971863 - DNA, 22 bp, Homo sapiens
ctgaggctgggggcgggggagc

SEQ ID NO: 3971864 - DNA, 14 bp, Homo sapiens
ctgagggccacact

SEQ ID NO: 3971865 - DNA, 16 bp, Homo sapiens
ctgagggccacactat

SEQ ID NO: 3971866 - DNA, 16 bp, Homo sapiens
ctgaggggggccgtgc

SEQ ID NO: 3971867 - DNA, 21 bp, Homo sapiens
ctgaggggggccgtgcccagg

SEQ ID NO: 3971868 - DNA, 22 bp, Homo sapiens
ctgaggggggccgtgcccaggg

SEQ ID NO: 3971869 - DNA, 15 bp, Homo sapiens
ctgaggtcctgagca

SEQ ID NO: 3971870 - DNA, 14 bp, Homo sapiens
ctgaggtgcccagg

SEQ ID NO: 3971871 - DNA, 15 bp, Homo sapiens
ctgaggtgcccagga

SEQ ID NO: 3971872 - DNA, 12 bp, Homo sapiens
ctgagtaaattg

SEQ ID NO: 3971873 - DNA, 20 bp, Homo sapiens
ctgagtaaattggaaacatt

SEQ ID NO: 3971874 - DNA, 21 bp, Homo sapiens
ctgagtaccttctacaggccc

SEQ ID NO: 3971875 - DNA, 17 bp, Homo sapiens
ctgagtcaactggagca

SEQ ID NO: 3971876 - DNA, 17 bp, Homo sapiens
ctgagtcacctcctcca

SEQ ID NO: 3971877 - DNA, 20 bp, Homo sapiens
ctgagtcatgatctccctgc

SEQ ID NO: 3971878 - DNA, 21 bp, Homo sapiens
ctgagtcatgatctccctgcc

SEQ ID NO: 3971879 - DNA, 16 bp, Homo sapiens
ctgagtccgggaggca

SEQ ID NO: 3971880 - DNA, 18 bp, Homo sapiens
ctgagtcctgtctctgcc

SEQ ID NO: 3971881 - DNA, 19 bp, Homo sapiens
ctgagtcctgtctctgcct

SEQ ID NO: 3971882 - DNA, 21 bp, Homo sapiens
ctgagtcctgtctctgcctgc

SEQ ID NO: 3971883 - DNA, 22 bp, Homo sapiens
ctgagtctgagtcctgtctctg

SEQ ID NO: 3971884 - DNA, 19 bp, Homo sapiens
ctgagtcttggcctgcctc

SEQ ID NO: 3971885 - DNA, 14 bp, Homo sapiens
ctgagtgaaaaatc

SEQ ID NO: 3971886 - DNA, 21 bp, Homo sapiens
ctgagtgactgtaggcaggga

SEQ ID NO: 3971887 - DNA, 16 bp, Homo sapiens
ctccttcttccctgtt

SEQ ID NO: 3971888 - DNA, 17 bp, Homo sapiens
ctccttgctctgcaggc

SEQ ID NO: 3971889 - DNA, 13 bp, Homo sapiens
ctccttgggctcc

SEQ ID NO: 3971890 - DNA, 14 bp, Homo sapiens
ctccttgggctcct

SEQ ID NO: 3971891 - DNA, 17 bp, Homo sapiens
ctccttgggctcctggc

SEQ ID NO: 3971892 - DNA, 18 bp, Homo sapiens
ctccttgggctcctggct

SEQ ID NO: 3971893 - DNA, 20 bp, Homo sapiens
ctcctttagcaggtggtcct

SEQ ID NO: 3971894 - DNA, 13 bp, Homo sapiens
ctcctttcctctg

SEQ ID NO: 3971895 - DNA, 14 bp, Homo sapiens
ctcctttcctctga

SEQ ID NO: 3971896 - DNA, 18 bp, Homo sapiens
ctcctttgcactgagggc

SEQ ID NO: 3971897 - DNA, 21 bp, Homo sapiens
ctcctttgcactgagggccac

SEQ ID NO: 3971898 - DNA, 15 bp, Homo sapiens
ctcctttgcattcca

SEQ ID NO: 3971899 - DNA, 21 bp, Homo sapiens
ctcctttgcattccatgattt

SEQ ID NO: 3971900 - DNA, 16 bp, Homo sapiens
ctcctttggaccctgt

SEQ ID NO: 3971901 - DNA, 13 bp, Homo sapiens
ctccttttgctgt

SEQ ID NO: 3971902 - DNA, 15 bp, Homo sapiens
ctcgaaccaaggcag

SEQ ID NO: 3971903 - DNA, 18 bp, Homo sapiens
ctcgaaccaaggcagcct

SEQ ID NO: 3971904 - DNA, 16 bp, Homo sapiens
ctcgagaccatcctgg

SEQ ID NO: 3971905 - DNA, 22 bp, Homo sapiens
ctcgagaccatcctggcccctc

SEQ ID NO: 3971906 - DNA, 15 bp, Homo sapiens
ctcgagccccctgga

SEQ ID NO: 3971907 - DNA, 16 bp, Homo sapiens
ctcgagcgccctgcag

SEQ ID NO: 3971908 - DNA, 21 bp, Homo sapiens
ctcgagcgccctgcagaccct

SEQ ID NO: 3971909 - DNA, 21 bp, Homo sapiens
ctcgaggcaccggcgctgcag

SEQ ID NO: 3971910 - DNA, 15 bp, Homo sapiens
ctcgaggctcttcca

SEQ ID NO: 3971911 - DNA, 17 bp, Homo sapiens
ctcgaggctcttccatc

SEQ ID NO: 3971912 - DNA, 12 bp, Homo sapiens
ctcgcaacccgt

SEQ ID NO: 3971913 - DNA, 16 bp, Homo sapiens
ctcgcaacccgtgcca

SEQ ID NO: 3971914 - DNA, 19 bp, Homo sapiens
ctcgcagcaggtgcaagag

SEQ ID NO: 3971915 - DNA, 12 bp, Homo sapiens
ctcgcagcctgg

SEQ ID NO: 3971916 - DNA, 14 bp, Homo sapiens
ctcgcagcctggcg

SEQ ID NO: 3971917 - DNA, 23 bp, Homo sapiens
ctcgcagcctggcggggcaggag

SEQ ID NO: 3971918 - DNA, 17 bp, Homo sapiens
ctcgcccacaaactgat

SEQ ID NO: 3971919 - DNA, 15 bp, Homo sapiens
ctcgccgtctgtgaa

SEQ ID NO: 3971920 - DNA, 14 bp, Homo sapiens
ctcgcctctcccac

SEQ ID NO: 3971921 - DNA, 12 bp, Homo sapiens
ctcgcctgggcc

SEQ ID NO: 3971922 - DNA, 17 bp, Homo sapiens
ctcgcctgggcccaggc

SEQ ID NO: 3971923 - DNA, 20 bp, Homo sapiens
ctcgcctgggcccaggctct

SEQ ID NO: 3971924 - DNA, 15 bp, Homo sapiens
ctcgctccctgtagc

SEQ ID NO: 3971925 - DNA, 21 bp, Homo sapiens
ctcgctccctgtagctctgcc

SEQ ID NO: 3971926 - DNA, 14 bp, Homo sapiens
ctcgctgctgctac

SEQ ID NO: 3971927 - DNA, 18 bp, Homo sapiens
ctcggaagccgtctgact

SEQ ID NO: 3971928 - DNA, 13 bp, Homo sapiens
ctcggagaagagc

SEQ ID NO: 3971929 - DNA, 21 bp, Homo sapiens
ctcggcaactaagcagtccct

SEQ ID NO: 3971930 - DNA, 20 bp, Homo sapiens
ctcgggaggctgaggcagga

SEQ ID NO: 3971931 - DNA, 19 bp, Homo sapiens
ctcggggtgcacaggaggg

SEQ ID NO: 3971932 - DNA, 21 bp, Homo sapiens
ctcgggtggctagtcagagag

SEQ ID NO: 3971933 - DNA, 16 bp, Homo sapiens
ctcggtgtaaaaccat

SEQ ID NO: 3971934 - DNA, 21 bp, Homo sapiens
ctcggtgtaaaaccatgtagt

SEQ ID NO: 3971935 - DNA, 23 bp, Homo sapiens
ctcggtgtaaaaccatgtagttt

SEQ ID NO: 3971936 - DNA, 15 bp, Homo sapiens
ctcgtaccagccagg

SEQ ID NO: 3971937 - DNA, 13 bp, Homo sapiens
ctcgtcctgtccc

SEQ ID NO: 3971938 - DNA, 14 bp, Homo sapiens
ctcgtcctgtccca

SEQ ID NO: 3971939 - DNA, 15 bp, Homo sapiens
ctcgtggacacctgc

SEQ ID NO: 3971940 - DNA, 20 bp, Homo sapiens
ctcgtggacacctgccctgc

SEQ ID NO: 3971941 - DNA, 21 bp, Homo sapiens
ctcgtggacacctgccctgcc

SEQ ID NO: 3971942 - DNA, 20 bp, Homo sapiens
ctcgtggtagaagccagtac

SEQ ID NO: 3971943 - DNA, 21 bp, Homo sapiens
ctcgtttttcttcttaagact

SEQ ID NO: 3971944 - DNA, 16 bp, Homo sapiens
ctctaaaaataaaatg

SEQ ID NO: 3971945 - DNA, 20 bp, Homo sapiens
ctctaaaaataaaatgatgt

SEQ ID NO: 3971946 - DNA, 20 bp, Homo sapiens
ctctaacccccagtgccaca

SEQ ID NO: 3971947 - DNA, 22 bp, Homo sapiens
ctctaacccccagtgccacaga

SEQ ID NO: 3971948 - DNA, 17 bp, Homo sapiens
ctctaacgcctgagccc

SEQ ID NO: 3971949 - DNA, 20 bp, Homo sapiens
ctctaacgcctgagcccagg

SEQ ID NO: 3971950 - DNA, 20 bp, Homo sapiens
ctctaagctggagctcttgg

SEQ ID NO: 3971951 - DNA, 22 bp, Homo sapiens
ctctaccccaaagaattcctga

SEQ ID NO: 3971952 - DNA, 23 bp, Homo sapiens
ctctaccccaaagaattcctgaa

SEQ ID NO: 3971953 - DNA, 22 bp, Homo sapiens
ctctacgccaaagtgcagccct

SEQ ID NO: 3971954 - DNA, 23 bp, Homo sapiens
ctctacgccaaagtgcagccctt

SEQ ID NO: 3971955 - DNA, 23 bp, Homo sapiens
ctctactacttttactacagtga

SEQ ID NO: 3971956 - DNA, 12 bp, Homo sapiens
ctctactgggaa

SEQ ID NO: 3971957 - DNA, 15 bp, Homo sapiens
ctctagaacacccac

SEQ ID NO: 3971958 - DNA, 18 bp, Homo sapiens
ctctagaacatgcacatt

SEQ ID NO: 3971959 - DNA, 23 bp, Homo sapiens
ctctagaacatgcacatttatat

SEQ ID NO: 3971960 - DNA, 21 bp, Homo sapiens
ctctagacactgccacacagg

SEQ ID NO: 3971961 - DNA, 15 bp, Homo sapiens
ctctagccaggagtc

SEQ ID NO: 3971962 - DNA, 20 bp, Homo sapiens
ctctagccaggagtctgtgc

SEQ ID NO: 3971963 - DNA, 23 bp, Homo sapiens
ctctagccaggagtctgtgctct

SEQ ID NO: 3971964 - DNA, 21 bp, Homo sapiens
ctctagcctgggccagagaag

SEQ ID NO: 3971965 - DNA, 19 bp, Homo sapiens
ctctagctggcaggacaca

SEQ ID NO: 3971966 - DNA, 17 bp, Homo sapiens
ctctaggggtcaggctc

SEQ ID NO: 3971967 - DNA, 22 bp, Homo sapiens
ctctagtcttgctttgctgtct

SEQ ID NO: 3971968 - DNA, 15 bp, Homo sapiens
ctctagtgacttcct

SEQ ID NO: 3971969 - DNA, 20 bp, Homo sapiens
ctctagtttctttctgttat

SEQ ID NO: 3971970 - DNA, 11 bp, Homo sapiens
ctctatattta

SEQ ID NO: 3971971 - DNA, 16 bp, Homo sapiens
ctctatgccccaaata

SEQ ID NO: 3971972 - DNA, 18 bp, Homo sapiens
ctctattcctgaccctcc

SEQ ID NO: 3971973 - DNA, 23 bp, Homo sapiens
ctctattcctgaccctccctacc

SEQ ID NO: 3971974 - DNA, 12 bp, Homo sapiens
ctctatttaata

SEQ ID NO: 3971975 - DNA, 15 bp, Homo sapiens
ctctatttcattttt

SEQ ID NO: 3971976 - DNA, 19 bp, Homo sapiens
ctctcaatattcaataaag

SEQ ID NO: 3971977 - DNA, 12 bp, Homo sapiens
ctctcacacaca

SEQ ID NO: 3971978 - DNA, 15 bp, Homo sapiens
ctctcaggagcacag

SEQ ID NO: 3971979 - DNA, 12 bp, Homo sapiens
ctctcaggaggc

SEQ ID NO: 3971980 - DNA, 15 bp, Homo sapiens
ctctcaggggccagt

SEQ ID NO: 3971981 - DNA, 15 bp, Homo sapiens
ctctcaggtcactcc

SEQ ID NO: 3971982 - DNA, 16 bp, Homo sapiens
ctctcaggtcactcca

SEQ ID NO: 3971983 - DNA, 15 bp, Homo sapiens
ctctcattctctttc

SEQ ID NO: 3971984 - DNA, 22 bp, Homo sapiens
ctctcattctctttctttttct

SEQ ID NO: 3971985 - DNA, 20 bp, Homo sapiens
ctctccaaaggggctgctgg

SEQ ID NO: 3971986 - DNA, 16 bp, Homo sapiens
ctctccaacctggaca

SEQ ID NO: 3971987 - DNA, 17 bp, Homo sapiens
ctctccaattgtaaaaa

SEQ ID NO: 3971988 - DNA, 18 bp, Homo sapiens
ctctccacctcagccttg

SEQ ID NO: 3971989 - DNA, 14 bp, Homo sapiens
ctctccaggcacca

SEQ ID NO: 3971990 - DNA, 24 bp, Homo sapiens
ctctcccaggccccatgacctcca

SEQ ID NO: 3971991 - DNA, 13 bp, Homo sapiens
ctctcccatacca

SEQ ID NO: 3971992 - DNA, 15 bp, Homo sapiens
ctctcccctccctct

SEQ ID NO: 3971993 - DNA, 19 bp, Homo sapiens
ctctcccctccctcttcct

SEQ ID NO: 3971994 - DNA, 15 bp, Homo sapiens
ctctcccggctgcct

SEQ ID NO: 3971995 - DNA, 16 bp, Homo sapiens
ctctcccggctgcctg

SEQ ID NO: 3971996 - DNA, 17 bp, Homo sapiens
ctctcccggctgcctgc

SEQ ID NO: 3971997 - DNA, 15 bp, Homo sapiens
ctctccggtctctct

SEQ ID NO: 3971998 - DNA, 17 bp, Homo sapiens
ctctcctcttgccactg

SEQ ID NO: 3971999 - DNA, 13 bp, Homo sapiens
ctctcctgctgca

SEQ ID NO: 3972000 - DNA, 16 bp, Homo sapiens
ctctcctggcttccca

SEQ ID NO: 3972001 - DNA, 22 bp, Homo sapiens
ctctcctggcttcccatcccca

SEQ ID NO: 3972002 - DNA, 20 bp, Homo sapiens
ctctcctgggggtggcaggc

SEQ ID NO: 3972003 - DNA, 12 bp, Homo sapiens
ctctcctgtcca

SEQ ID NO: 3972004 - DNA, 17 bp, Homo sapiens
ctctccttccttaccca

SEQ ID NO: 3972005 - DNA, 22 bp, Homo sapiens
ctctccttcgtgtctctcccac

SEQ ID NO: 3972006 - DNA, 20 bp, Homo sapiens
ctctccttgggctcctggct

SEQ ID NO: 3972007 - DNA, 21 bp, Homo sapiens
ctctccttgggctcctggctg

SEQ ID NO: 3972008 - DNA, 19 bp, Homo sapiens
ctctcctttggccattcca

SEQ ID NO: 3972009 - DNA, 12 bp, Homo sapiens
ctctcgagccca

SEQ ID NO: 3972010 - DNA, 19 bp, Homo sapiens
ctctcgggttcaagcaatt

SEQ ID NO: 3972011 - DNA, 21 bp, Homo sapiens
ctctcggttccacgtccccct

SEQ ID NO: 3972012 - DNA, 16 bp, Homo sapiens
ctctctaaaaataaaa

SEQ ID NO: 3972013 - DNA, 17 bp, Homo sapiens
ctctctaaaaataaaat

SEQ ID NO: 3972014 - DNA, 18 bp, Homo sapiens
ctctctaaaaataaaatg

SEQ ID NO: 3972015 - DNA, 21 bp, Homo sapiens
ctctctaagccacagcttctt

SEQ ID NO: 3972016 - DNA, 19 bp, Homo sapiens
ctctctacaaactcccact

SEQ ID NO: 3972017 - DNA, 15 bp, Homo sapiens
ctctctcttcccagc

SEQ ID NO: 3972018 - DNA, 16 bp, Homo sapiens
ctctctgcagccagcc

SEQ ID NO: 3972019 - DNA, 15 bp, Homo sapiens
ctctctgctccagag

SEQ ID NO: 3972020 - DNA, 16 bp, Homo sapiens
ctctctgctccagaga

SEQ ID NO: 3972021 - DNA, 12 bp, Homo sapiens
ctctctgctcta

SEQ ID NO: 3972022 - DNA, 14 bp, Homo sapiens
ctctctgctctagc

SEQ ID NO: 3972023 - DNA, 18 bp, Homo sapiens
ctctctggggccctgggc

SEQ ID NO: 3972024 - DNA, 19 bp, Homo sapiens
ctctctggggccctgggcc

SEQ ID NO: 3972025 - DNA, 23 bp, Homo sapiens
ctctctggggccctgggcctcag

SEQ ID NO: 3972026 - DNA, 16 bp, Homo sapiens
ctctctgtataaacat

SEQ ID NO: 3972027 - DNA, 20 bp, Homo sapiens
ctctcttaggagcagagctc

SEQ ID NO: 3972028 - DNA, 11 bp, Homo sapiens
ctctcttcagc

SEQ ID NO: 3972029 - DNA, 22 bp, Homo sapiens
ctctcttcagcccctagtgcta

SEQ ID NO: 3972030 - DNA, 24 bp, Homo sapiens
ctctcttcaggaggccctggtgtc

SEQ ID NO: 3972031 - DNA, 17 bp, Homo sapiens
ctctgaaatttcccaca

SEQ ID NO: 3972032 - DNA, 14 bp, Homo sapiens
ctctgacaagggct

SEQ ID NO: 3972033 - DNA, 16 bp, Homo sapiens
ctctgacaagggctga

SEQ ID NO: 3972034 - DNA, 16 bp, Homo sapiens
ctctgaccaacaggct

SEQ ID NO: 3972035 - DNA, 13 bp, Homo sapiens
ctctgagaacaga

SEQ ID NO: 3972036 - DNA, 14 bp, Homo sapiens
ctctgagaggccct

SEQ ID NO: 3972037 - DNA, 16 bp, Homo sapiens
ctctgagaggccctgg

SEQ ID NO: 3972038 - DNA, 17 bp, Homo sapiens
ctctgagaggccctgga

SEQ ID NO: 3972039 - DNA, 14 bp, Homo sapiens
ctctgagcagtcag

SEQ ID NO: 3972040 - DNA, 13 bp, Homo sapiens
ctctgagcccagg

SEQ ID NO: 3972041 - DNA, 16 bp, Homo sapiens
ctctgagcccaggccg

SEQ ID NO: 3972042 - DNA, 17 bp, Homo sapiens
ctctgagcccaggccgt

SEQ ID NO: 3972043 - DNA, 14 bp, Homo sapiens
ctctgaggccagcc

SEQ ID NO: 3972044 - DNA, 17 bp, Homo sapiens
ctctgaggccagcctgg

SEQ ID NO: 3972045 - DNA, 21 bp, Homo sapiens
ctctgaggcgccccaacccgt

SEQ ID NO: 3972046 - DNA, 16 bp, Homo sapiens
ctctgaggcttccaga

SEQ ID NO: 3972047 - DNA, 15 bp, Homo sapiens
ctctgatatgggact

SEQ ID NO: 3972048 - DNA, 16 bp, Homo sapiens
ctctgatatgggactg

SEQ ID NO: 3972049 - DNA, 19 bp, Homo sapiens
ctctgatatgggactgagc

SEQ ID NO: 3972050 - DNA, 20 bp, Homo sapiens
ctctgattatcaggtactgg

SEQ ID NO: 3972051 - DNA, 18 bp, Homo sapiens
ctctgattttcaaagctt

SEQ ID NO: 3972052 - DNA, 20 bp, Homo sapiens
ctctgcactccatggccacc

SEQ ID NO: 3972053 - DNA, 22 bp, Homo sapiens
ctctgcactccatggccacccc

SEQ ID NO: 3972054 - DNA, 14 bp, Homo sapiens
ctctgcagccagcc

SEQ ID NO: 3972055 - DNA, 19 bp, Homo sapiens
ctctgcagccagcccagcc

SEQ ID NO: 3972056 - DNA, 15 bp, Homo sapiens
ctctgcaggcacctt

SEQ ID NO: 3972057 - DNA, 15 bp, Homo sapiens
ctctgcatctcattg

SEQ ID NO: 3972058 - DNA, 17 bp, Homo sapiens
ctctgcatctcattgta

SEQ ID NO: 3972059 - DNA, 13 bp, Homo sapiens
ctccatgtggccc

SEQ ID NO: 3972060 - DNA, 21 bp, Homo sapiens
ctccatgtggccccaggtgcc

SEQ ID NO: 3972061 - DNA, 13 bp, Homo sapiens
ctccatgtgtgct

SEQ ID NO: 3972062 - DNA, 16 bp, Homo sapiens
ctccatttcaactcca

SEQ ID NO: 3972063 - DNA, 17 bp, Homo sapiens
ctccatttcaactccag

SEQ ID NO: 3972064 - DNA, 18 bp, Homo sapiens
ctccatttcaactccaga

SEQ ID NO: 3972065 - DNA, 22 bp, Homo sapiens
ctcccaacccaattcaggactg

SEQ ID NO: 3972066 - DNA, 14 bp, Homo sapiens
ctcccacaatctgg

SEQ ID NO: 3972067 - DNA, 23 bp, Homo sapiens
ctcccacaatctgggactttcac

SEQ ID NO: 3972068 - DNA, 15 bp, Homo sapiens
ctcccacaggccctt

SEQ ID NO: 3972069 - DNA, 16 bp, Homo sapiens
ctcccacaggcccttc

SEQ ID NO: 3972070 - DNA, 12 bp, Homo sapiens
ctcccaccccac

SEQ ID NO: 3972071 - DNA, 13 bp, Homo sapiens
ctcccaccccacc

SEQ ID NO: 3972072 - DNA, 19 bp, Homo sapiens
ctcccaccccacccccttc

SEQ ID NO: 3972073 - DNA, 13 bp, Homo sapiens
ctcccaccccact

SEQ ID NO: 3972074 - DNA, 20 bp, Homo sapiens
ctcccaccccggcctccact

SEQ ID NO: 3972075 - DNA, 23 bp, Homo sapiens
ctcccacgactgttgtacaagct

SEQ ID NO: 3972076 - DNA, 23 bp, Homo sapiens
ctcccacgatgtcaaggactcct

SEQ ID NO: 3972077 - DNA, 16 bp, Homo sapiens
ctcccagagtgctagg

SEQ ID NO: 3972078 - DNA, 13 bp, Homo sapiens
ctcccagatgctg

SEQ ID NO: 3972079 - DNA, 21 bp, Homo sapiens
ctcccagcaacacaagctgga

SEQ ID NO: 3972080 - DNA, 18 bp, Homo sapiens
ctcccagcaagtttcacc

SEQ ID NO: 3972081 - DNA, 22 bp, Homo sapiens
ctcccagcaagtttcaccttgg

SEQ ID NO: 3972082 - DNA, 14 bp, Homo sapiens
ctcccagccccagg

SEQ ID NO: 3972083 - DNA, 16 bp, Homo sapiens
ctcccagccccagggg

SEQ ID NO: 3972084 - DNA, 18 bp, Homo sapiens
ctcccagccccaggggtg

SEQ ID NO: 3972085 - DNA, 16 bp, Homo sapiens
ctcccagccctatgga

SEQ ID NO: 3972086 - DNA, 19 bp, Homo sapiens
ctcccagccctatggatgt

SEQ ID NO: 3972087 - DNA, 18 bp, Homo sapiens
ctcccagccctgccagga

SEQ ID NO: 3972088 - DNA, 16 bp, Homo sapiens
ctcccaggagacagtt

SEQ ID NO: 3972089 - DNA, 12 bp, Homo sapiens
ctcccagggaca

SEQ ID NO: 3972090 - DNA, 16 bp, Homo sapiens
ctcccatagcgctggc

SEQ ID NO: 3972091 - DNA, 20 bp, Homo sapiens
ctcccatagcgctggctcag

SEQ ID NO: 3972092 - DNA, 16 bp, Homo sapiens
ctcccatcccctggac

SEQ ID NO: 3972093 - DNA, 13 bp, Homo sapiens
ctcccatctcctg

SEQ ID NO: 3972094 - DNA, 23 bp, Homo sapiens
ctccccacacgtgctcgcagcct

SEQ ID NO: 3972095 - DNA, 19 bp, Homo sapiens
ctccccacccccgctgggg

SEQ ID NO: 3972096 - DNA, 20 bp, Homo sapiens
ctccccacccccgctggggg

SEQ ID NO: 3972097 - DNA, 16 bp, Homo sapiens
ctccccaccttcccca

SEQ ID NO: 3972098 - DNA, 22 bp, Homo sapiens
ctccccacgagtcacctgcaag

SEQ ID NO: 3972099 - DNA, 12 bp, Homo sapiens
ctccccactctg

SEQ ID NO: 3972100 - DNA, 13 bp, Homo sapiens
ctccccactctgc

SEQ ID NO: 3972101 - DNA, 17 bp, Homo sapiens
ctccccactctgctctg

SEQ ID NO: 3972102 - DNA, 19 bp, Homo sapiens
ctccccactctgctctgat

SEQ ID NO: 3972103 - DNA, 20 bp, Homo sapiens
ctccccactgaaaacatttc

SEQ ID NO: 3972104 - DNA, 12 bp, Homo sapiens
ctccccagccct

SEQ ID NO: 3972105 - DNA, 15 bp, Homo sapiens
ctccccaggccaggc

SEQ ID NO: 3972106 - DNA, 21 bp, Homo sapiens
ctccccaggccaggccaccag

SEQ ID NO: 3972107 - DNA, 15 bp, Homo sapiens
ctccccaggcctcca

SEQ ID NO: 3972108 - DNA, 18 bp, Homo sapiens
ctccccaggcctccagcc

SEQ ID NO: 3972109 - DNA, 14 bp, Homo sapiens
ctcccccacaaata

SEQ ID NO: 3972110 - DNA, 15 bp, Homo sapiens
ctccccccactgcag

SEQ ID NO: 3972111 - DNA, 16 bp, Homo sapiens
ctccccccactgcagg

SEQ ID NO: 3972112 - DNA, 17 bp, Homo sapiens
ctcccccgacactgctg

SEQ ID NO: 3972113 - DNA, 18 bp, Homo sapiens
ctcccccgcagtccccag

SEQ ID NO: 3972114 - DNA, 22 bp, Homo sapiens
ctcccccgcagtccccagccct

SEQ ID NO: 3972115 - DNA, 12 bp, Homo sapiens
ctccccctcaga

SEQ ID NO: 3972116 - DNA, 14 bp, Homo sapiens
ctccccctcttggt

SEQ ID NO: 3972117 - DNA, 17 bp, Homo sapiens
ctccccctgccagtgcc

SEQ ID NO: 3972118 - DNA, 19 bp, Homo sapiens
ctccccctgccagtgcctt

SEQ ID NO: 3972119 - DNA, 13 bp, Homo sapiens
ctccccctgcctt

SEQ ID NO: 3972120 - DNA, 16 bp, Homo sapiens
ctccccctgctgctca

SEQ ID NO: 3972121 - DNA, 23 bp, Homo sapiens
ctcccccttccccttctgtgtca

SEQ ID NO: 3972122 - DNA, 19 bp, Homo sapiens
ctcccctatccacccagcc

SEQ ID NO: 3972123 - DNA, 14 bp, Homo sapiens
ctcccctattttaa

SEQ ID NO: 3972124 - DNA, 19 bp, Homo sapiens
ctcccctccctcttccttc

SEQ ID NO: 3972125 - DNA, 20 bp, Homo sapiens
ctcccctccctcttccttcc

SEQ ID NO: 3972126 - DNA, 14 bp, Homo sapiens
ctcccctctgccct

SEQ ID NO: 3972127 - DNA, 13 bp, Homo sapiens
ctcccctcttgag

SEQ ID NO: 3972128 - DNA, 22 bp, Homo sapiens
ctcccctgcccccatcccacat

SEQ ID NO: 3972129 - DNA, 23 bp, Homo sapiens
ctcccctgggcatcttctggctt

SEQ ID NO: 3972130 - DNA, 14 bp, Homo sapiens
ctcccggctgcctg

SEQ ID NO: 3972131 - DNA, 16 bp, Homo sapiens
ctcccggctgcctgcc

SEQ ID NO: 3972132 - DNA, 17 bp, Homo sapiens
ctcccggctgcctgccg

SEQ ID NO: 3972133 - DNA, 18 bp, Homo sapiens
ctcccgggagcacagagg

SEQ ID NO: 3972134 - DNA, 14 bp, Homo sapiens
ctccctaaaataaa

SEQ ID NO: 3972135 - DNA, 20 bp, Homo sapiens
ctccctaaaataaaaaccag

SEQ ID NO: 3972136 - DNA, 14 bp, Homo sapiens
ctccctaaactgta

SEQ ID NO: 3972137 - DNA, 19 bp, Homo sapiens
ctccctaagaaaccccagg

SEQ ID NO: 3972138 - DNA, 18 bp, Homo sapiens
ctccctcacccccaggtg

SEQ ID NO: 3972139 - DNA, 16 bp, Homo sapiens
ctccctccatgtggcc

SEQ ID NO: 3972140 - DNA, 22 bp, Homo sapiens
ctccctccccacacctccctac

SEQ ID NO: 3972141 - DNA, 19 bp, Homo sapiens
ctccctcctggagcatccc

SEQ ID NO: 3972142 - DNA, 12 bp, Homo sapiens
ctccctctcctg

SEQ ID NO: 3972143 - DNA, 14 bp, Homo sapiens
ctccctctcctgcc

SEQ ID NO: 3972144 - DNA, 17 bp, Homo sapiens
ctccctctcctgcctac

SEQ ID NO: 3972145 - DNA, 12 bp, Homo sapiens
ctccctctgccc

SEQ ID NO: 3972146 - DNA, 13 bp, Homo sapiens
ctccctctgcccc

SEQ ID NO: 3972147 - DNA, 17 bp, Homo sapiens
ctccctctggccctgcc

SEQ ID NO: 3972148 - DNA, 16 bp, Homo sapiens
ctccctgaacctcagt

SEQ ID NO: 3972149 - DNA, 17 bp, Homo sapiens
ctccctgaacctcagtt

SEQ ID NO: 3972150 - DNA, 18 bp, Homo sapiens
ctccctgaacctcagttt

SEQ ID NO: 3972151 - DNA, 17 bp, Homo sapiens
ctccctgacatttctaa

SEQ ID NO: 3972152 - DNA, 16 bp, Homo sapiens
ctccctgagctttggg

SEQ ID NO: 3972153 - DNA, 14 bp, Homo sapiens
ctccctgcccctcc

SEQ ID NO: 3972154 - DNA, 16 bp, Homo sapiens
ctccctgccgcctcaa

SEQ ID NO: 3972155 - DNA, 18 bp, Homo sapiens
ctccctgccgcctcaatg

SEQ ID NO: 3972156 - DNA, 19 bp, Homo sapiens
ctccctgccgcctcaatgt

SEQ ID NO: 3972157 - DNA, 15 bp, Homo sapiens
ctccctgctaccaag

SEQ ID NO: 3972158 - DNA, 18 bp, Homo sapiens
ctccctggatcagaacag

SEQ ID NO: 3972159 - DNA, 20 bp, Homo sapiens
ctccctggcatgtcagagcc

SEQ ID NO: 3972160 - DNA, 23 bp, Homo sapiens
ctccctggggatatgcaaccctt

SEQ ID NO: 3972161 - DNA, 22 bp, Homo sapiens
ctccctgtgggggtggccatcc

SEQ ID NO: 3972162 - DNA, 23 bp, Homo sapiens
ctccctgtgggggtggccatccc

SEQ ID NO: 3972163 - DNA, 19 bp, Homo sapiens
ctcccttaggcattattta

SEQ ID NO: 3972164 - DNA, 23 bp, Homo sapiens
ctcccttcaaccattccccatgg

SEQ ID NO: 3972165 - DNA, 17 bp, Homo sapiens
ctcccttcctggcctca

SEQ ID NO: 3972166 - DNA, 16 bp, Homo sapiens
ctcccttgctcagtgc

SEQ ID NO: 3972167 - DNA, 22 bp, Homo sapiens
ctcccttgctcagtgcctcctg

SEQ ID NO: 3972168 - DNA, 23 bp, Homo sapiens
ctcccttgctcagtgcctcctgg

SEQ ID NO: 3972169 - DNA, 15 bp, Homo sapiens
ctccctttccctgag

SEQ ID NO: 3972170 - DNA, 14 bp, Homo sapiens
ctccctttctggga

SEQ ID NO: 3972171 - DNA, 16 bp, Homo sapiens
ctccgactgctaggga

SEQ ID NO: 3972172 - DNA, 16 bp, Homo sapiens
ctccgcacttggaaag

SEQ ID NO: 3972173 - DNA, 18 bp, Homo sapiens
ctccgcacttggaaaggt

SEQ ID NO: 3972174 - DNA, 21 bp, Homo sapiens
ctccgctaagacctccccacc

SEQ ID NO: 3972175 - DNA, 22 bp, Homo sapiens
ctccgggaccattgacctcagc

SEQ ID NO: 3972176 - DNA, 19 bp, Homo sapiens
ctccggggagagcagaggg

SEQ ID NO: 3972177 - DNA, 18 bp, Homo sapiens
ctccggggtctgtgctgt

SEQ ID NO: 3972178 - DNA, 15 bp, Homo sapiens
ctccgggtgtggcct

SEQ ID NO: 3972179 - DNA, 17 bp, Homo sapiens
ctccgggtgtggcctca

SEQ ID NO: 3972180 - DNA, 20 bp, Homo sapiens
ctccgggtgtggcctcagcc

SEQ ID NO: 3972181 - DNA, 22 bp, Homo sapiens
ctccgggtgtggcctcagccct

SEQ ID NO: 3972182 - DNA, 14 bp, Homo sapiens
ctccgtcaggagag

SEQ ID NO: 3972183 - DNA, 18 bp, Homo sapiens
ctccgtcatgaatgcctt

SEQ ID NO: 3972184 - DNA, 20 bp, Homo sapiens
ctccgtcatgaatgccttcc

SEQ ID NO: 3972185 - DNA, 15 bp, Homo sapiens
ctccgtccacccagg

SEQ ID NO: 3972186 - DNA, 17 bp, Homo sapiens
ctccgtccacccaggct

SEQ ID NO: 3972187 - DNA, 20 bp, Homo sapiens
ctccgtccacccaggctgca

SEQ ID NO: 3972188 - DNA, 22 bp, Homo sapiens
ctccgtccacccaggctgcact

SEQ ID NO: 3972189 - DNA, 22 bp, Homo sapiens
ctccgtcttagaagtggaccag

SEQ ID NO: 3972190 - DNA, 14 bp, Homo sapiens
ctccgtgctgggct

SEQ ID NO: 3972191 - DNA, 15 bp, Homo sapiens
ctccgtttatgggcc

SEQ ID NO: 3972192 - DNA, 17 bp, Homo sapiens
ctccgtttatgggcctt

SEQ ID NO: 3972193 - DNA, 14 bp, Homo sapiens
ctcctaagcagctg

SEQ ID NO: 3972194 - DNA, 16 bp, Homo sapiens
ctcctaagcagctggg

SEQ ID NO: 3972195 - DNA, 17 bp, Homo sapiens
ctcctaagcagctggga

SEQ ID NO: 3972196 - DNA, 21 bp, Homo sapiens
ctcctaatttgatcacagtgg

SEQ ID NO: 3972197 - DNA, 13 bp, Homo sapiens
ctcctagaggtgg

SEQ ID NO: 3972198 - DNA, 17 bp, Homo sapiens
ctcctagaggtgggcag

SEQ ID NO: 3972199 - DNA, 18 bp, Homo sapiens
ctcctagaggtgggcagc

SEQ ID NO: 3972200 - DNA, 20 bp, Homo sapiens
ctcctagaggtgggcagctg

SEQ ID NO: 3972201 - DNA, 23 bp, Homo sapiens
ctcctagaggtgggcagctgggc

SEQ ID NO: 3972202 - DNA, 15 bp, Homo sapiens
ctcctatccttggag

SEQ ID NO: 3972203 - DNA, 22 bp, Homo sapiens
ctcctattctcttaatttttct

SEQ ID NO: 3972204 - DNA, 13 bp, Homo sapiens
ctcctattttaat

SEQ ID NO: 3972205 - DNA, 15 bp, Homo sapiens
ctcctcacccccagc

SEQ ID NO: 3972206 - DNA, 21 bp, Homo sapiens
ctcctcacccccagctttgct

SEQ ID NO: 3972207 - DNA, 15 bp, Homo sapiens
ctcctccaaaggaag

SEQ ID NO: 3972208 - DNA, 18 bp, Homo sapiens
ctcctccaaaggaagtct

SEQ ID NO: 3972209 - DNA, 13 bp, Homo sapiens
ctcctccacagtg

SEQ ID NO: 3972210 - DNA, 16 bp, Homo sapiens
ctcctccacagtgctg

SEQ ID NO: 3972211 - DNA, 12 bp, Homo sapiens
ctcctccactca

SEQ ID NO: 3972212 - DNA, 14 bp, Homo sapiens
ctcctccactccac

SEQ ID NO: 3972213 - DNA, 11 bp, Homo sapiens
ctcctccaggg

SEQ ID NO: 3972214 - DNA, 19 bp, Homo sapiens
ctcctccagggccacgtgc

SEQ ID NO: 3972215 - DNA, 23 bp, Homo sapiens
ctcctcccaggcgccccttcccc

SEQ ID NO: 3972216 - DNA, 16 bp, Homo sapiens
ctcctcccatggcctt

SEQ ID NO: 3972217 - DNA, 15 bp, Homo sapiens
ctcctcccggtgccc

SEQ ID NO: 3972218 - DNA, 17 bp, Homo sapiens
ctcctcccggtgcccaa

SEQ ID NO: 3972219 - DNA, 13 bp, Homo sapiens
ctcctctccaggc

SEQ ID NO: 3972220 - DNA, 17 bp, Homo sapiens
ctcctctgattatcagg

SEQ ID NO: 3972221 - DNA, 11 bp, Homo sapiens
ctcctctgcca

SEQ ID NO: 3972222 - DNA, 14 bp, Homo sapiens
ctcctctgccacct

SEQ ID NO: 3972223 - DNA, 16 bp, Homo sapiens
ctcctctgccacctcc

SEQ ID NO: 3972224 - DNA, 12 bp, Homo sapiens
ctcctctgcttg

SEQ ID NO: 3972225 - DNA, 20 bp, Homo sapiens
ctcctcttaccgtagcctcc

SEQ ID NO: 3972226 - DNA, 15 bp, Homo sapiens
ctcctcttgccactg

SEQ ID NO: 3972227 - DNA, 16 bp, Homo sapiens
ctcctcttgccactgc

SEQ ID NO: 3972228 - DNA, 20 bp, Homo sapiens
ctcctgaagcctctgccctg

SEQ ID NO: 3972229 - DNA, 22 bp, Homo sapiens
ctcctgacattaagacacacct

SEQ ID NO: 3972230 - DNA, 16 bp, Homo sapiens
ctcctgacccagtccc

SEQ ID NO: 3972231 - DNA, 15 bp, Homo sapiens
ctcctgacctgaggc

SEQ ID NO: 3972232 - DNA, 22 bp, Homo sapiens
ctcctgagaaggcgaggagagt

SEQ ID NO: 3972233 - DNA, 19 bp, Homo sapiens
ctcctgagttcaagcgatt

SEQ ID NO: 3972234 - DNA, 19 bp, Homo sapiens
ctcctgatggccaagagca

SEQ ID NO: 3972235 - DNA, 16 bp, Homo sapiens
ctcctgcccaggagag

SEQ ID NO: 3972236 - DNA, 13 bp, Homo sapiens
ctcctgcctactc

SEQ ID NO: 3972237 - DNA, 18 bp, Homo sapiens
ctcctgcctgtagcagtg

SEQ ID NO: 3972238 - DNA, 19 bp, Homo sapiens
ctcctgcctgtagcagtga

SEQ ID NO: 3972239 - DNA, 14 bp, Homo sapiens
ctcctgcctgtgtt

SEQ ID NO: 3972240 - DNA, 15 bp, Homo sapiens
ctcctgcctgtgttt

SEQ ID NO: 3972241 - DNA, 11 bp, Homo sapiens
ctcctgctgtg

SEQ ID NO: 3972242 - DNA, 11 bp, Homo sapiens
ctcctggaaat

SEQ ID NO: 3972243 - DNA, 12 bp, Homo sapiens
ctcctggccaga

SEQ ID NO: 3972244 - DNA, 23 bp, Homo sapiens
ctcctggctgaggggcttcaacc

SEQ ID NO: 3972245 - DNA, 15 bp, Homo sapiens
ctcctggctgccagg

SEQ ID NO: 3972246 - DNA, 18 bp, Homo sapiens
ctcctggctgccaggcgt

SEQ ID NO: 3972247 - DNA, 19 bp, Homo sapiens
ctcctggctgccaggcgtt

SEQ ID NO: 3972248 - DNA, 14 bp, Homo sapiens
ctcctggcttccca

SEQ ID NO: 3972249 - DNA, 23 bp, Homo sapiens
ctcctggcttcccatccccagcg

SEQ ID NO: 3972250 - DNA, 21 bp, Homo sapiens
ctcctgggaccatggacacat

SEQ ID NO: 3972251 - DNA, 22 bp, Homo sapiens
ctcctgggaccatggacacatt

SEQ ID NO: 3972252 - DNA, 16 bp, Homo sapiens
ctcctgggggtggcag

SEQ ID NO: 3972253 - DNA, 19 bp, Homo sapiens
ctcctgggggtggcaggca

SEQ ID NO: 3972254 - DNA, 21 bp, Homo sapiens
ctcctgggggtggcaggcaca

SEQ ID NO: 3972255 - DNA, 23 bp, Homo sapiens
ctcctgggggttctttcttcctc

SEQ ID NO: 3972256 - DNA, 18 bp, Homo sapiens
ctcctggttcaagcgatt

SEQ ID NO: 3972257 - DNA, 13 bp, Homo sapiens
ctcctgtcccgcc

SEQ ID NO: 3972258 - DNA, 17 bp, Homo sapiens
ctcctgtccctacccac

SEQ ID NO: 3972259 - DNA, 20 bp, Homo sapiens
ctcctgtccctacccactct

SEQ ID NO: 3972260 - DNA, 18 bp, Homo sapiens
ctcctgtcccttcttggg

SEQ ID NO: 3972261 - DNA, 17 bp, Homo sapiens
ctcctgtgcaactttcc

SEQ ID NO: 3972262 - DNA, 21 bp, Homo sapiens
ctcctgtgcccacatcccagg

SEQ ID NO: 3972263 - DNA, 17 bp, Homo sapiens
ctcctgtgcccctcaga

SEQ ID NO: 3972264 - DNA, 22 bp, Homo sapiens
ctcctgtgcccctcagagaggc

SEQ ID NO: 3972265 - DNA, 14 bp, Homo sapiens
ctcctgtgtacagg

SEQ ID NO: 3972266 - DNA, 14 bp, Homo sapiens
ctccttactctgag

SEQ ID NO: 3972267 - DNA, 15 bp, Homo sapiens
ctccttactctgagc

SEQ ID NO: 3972268 - DNA, 18 bp, Homo sapiens
ctccttactctgagccca

SEQ ID NO: 3972269 - DNA, 19 bp, Homo sapiens
ctccttactctgagcccag

SEQ ID NO: 3972270 - DNA, 20 bp, Homo sapiens
ctccttactctgagcccagg

SEQ ID NO: 3972271 - DNA, 17 bp, Homo sapiens
ctccttataagcccagc

SEQ ID NO: 3972272 - DNA, 15 bp, Homo sapiens
ctccttattttgtat

SEQ ID NO: 3972273 - DNA, 11 bp, Homo sapiens
ctccttcctgc

SEQ ID NO: 3972274 - DNA, 19 bp, Homo sapiens
ctccttccttacccaaact

SEQ ID NO: 3972275 - DNA, 23 bp, Homo sapiens
ctccttccttacccaaactgttc

SEQ ID NO: 3972276 - DNA, 19 bp, Homo sapiens
ctccttcgtgtctctccca

SEQ ID NO: 3972277 - DNA, 13 bp, Homo sapiens
ctccttcttccct

SEQ ID NO: 3972278 - DNA, 15 bp, Homo sapiens
tggatgggaagatgg

SEQ ID NO: 3972279 - DNA, 18 bp, Homo sapiens
tggatgtagtctgaggcc

SEQ ID NO: 3972280 - DNA, 17 bp, Homo sapiens
tggatgtgtaaatggag

SEQ ID NO: 3972281 - DNA, 14 bp, Homo sapiens
tggatgtgtggggc

SEQ ID NO: 3972282 - DNA, 12 bp, Homo sapiens
tggattccagag

SEQ ID NO: 3972283 - DNA, 13 bp, Homo sapiens
tggattcctaagc

SEQ ID NO: 3972284 - DNA, 15 bp, Homo sapiens
tggatttcctatttt

SEQ ID NO: 3972285 - DNA, 23 bp, Homo sapiens
tggatttcctattttaaaaccat

SEQ ID NO: 3972286 - DNA, 17 bp, Homo sapiens
tggatttctgaatggct

SEQ ID NO: 3972287 - DNA, 13 bp, Homo sapiens
tggatttgaagca

SEQ ID NO: 3972288 - DNA, 19 bp, Homo sapiens
tggattttcccctgaagac

SEQ ID NO: 3972289 - DNA, 20 bp, Homo sapiens
tggcaaagcggttgcttctg

SEQ ID NO: 3972290 - DNA, 21 bp, Homo sapiens
tggcaagcagggaaagctcca

SEQ ID NO: 3972291 - DNA, 22 bp, Homo sapiens
tggcaagttttgatatgagtat

SEQ ID NO: 3972292 - DNA, 16 bp, Homo sapiens
tggcaattgtccccag

SEQ ID NO: 3972293 - DNA, 23 bp, Homo sapiens
tggcacaatggctaattcccaga

SEQ ID NO: 3972294 - DNA, 21 bp, Homo sapiens
tggcacagacttctggaaggc

SEQ ID NO: 3972295 - DNA, 13 bp, Homo sapiens
tggcacaggactg

SEQ ID NO: 3972296 - DNA, 15 bp, Homo sapiens
tggcacagggcagtg

SEQ ID NO: 3972297 - DNA, 16 bp, Homo sapiens
tggcacagggcagtgg

SEQ ID NO: 3972298 - DNA, 14 bp, Homo sapiens
tggcaccagaggct

SEQ ID NO: 3972299 - DNA, 23 bp, Homo sapiens
tggcaccagaggctgcagaaggc

SEQ ID NO: 3972300 - DNA, 14 bp, Homo sapiens
tggcaccagatgca

SEQ ID NO: 3972301 - DNA, 15 bp, Homo sapiens
tggcaccagccccct

SEQ ID NO: 3972302 - DNA, 16 bp, Homo sapiens
tggcaccagccccctg

SEQ ID NO: 3972303 - DNA, 12 bp, Homo sapiens
tggcacctccta

SEQ ID NO: 3972304 - DNA, 18 bp, Homo sapiens
tggcacctcctgagaagg

SEQ ID NO: 3972305 - DNA, 15 bp, Homo sapiens
tggcacggagagaag

SEQ ID NO: 3972306 - DNA, 20 bp, Homo sapiens
tggcacggagagaaggccca

SEQ ID NO: 3972307 - DNA, 21 bp, Homo sapiens
tggcacttagctatcagaaga

SEQ ID NO: 3972308 - DNA, 13 bp, Homo sapiens
tggcagaaaagag

SEQ ID NO: 3972309 - DNA, 24 bp, Homo sapiens
tggcagaaaagaggagaccctgga

SEQ ID NO: 3972310 - DNA, 16 bp, Homo sapiens
tggcagaccgggggcc

SEQ ID NO: 3972311 - DNA, 16 bp, Homo sapiens
tggcagagaaggcctc

SEQ ID NO: 3972312 - DNA, 23 bp, Homo sapiens
tggcagagaaggcctcttgtgct

SEQ ID NO: 3972313 - DNA, 20 bp, Homo sapiens
tggcagagcccccaaggact

SEQ ID NO: 3972314 - DNA, 17 bp, Homo sapiens
tggcagatgtaggaggg

SEQ ID NO: 3972315 - DNA, 19 bp, Homo sapiens
tggcagatgtaggagggac

SEQ ID NO: 3972316 - DNA, 22 bp, Homo sapiens
tggcagcagttccatgaagaca

SEQ ID NO: 3972317 - DNA, 18 bp, Homo sapiens
tggcagccacacttctca

SEQ ID NO: 3972318 - DNA, 13 bp, Homo sapiens
tggcagccatgcc

SEQ ID NO: 3972319 - DNA, 18 bp, Homo sapiens
tggcagccatgcctcatg

SEQ ID NO: 3972320 - DNA, 17 bp, Homo sapiens
tggcagccgtgccttca

SEQ ID NO: 3972321 - DNA, 21 bp, Homo sapiens
tggcagccgtgccttcagctc

SEQ ID NO: 3972322 - DNA, 22 bp, Homo sapiens
tggcagccgtgccttcagctct

SEQ ID NO: 3972323 - DNA, 16 bp, Homo sapiens
tggcagctagactgga

SEQ ID NO: 3972324 - DNA, 14 bp, Homo sapiens
tggcagctcctctc

SEQ ID NO: 3972325 - DNA, 17 bp, Homo sapiens
tggcagctcctctcctt

SEQ ID NO: 3972326 - DNA, 18 bp, Homo sapiens
tggcagctgagagccctg

SEQ ID NO: 3972327 - DNA, 17 bp, Homo sapiens
tggcagcttaacattga

SEQ ID NO: 3972328 - DNA, 11 bp, Homo sapiens
tggcaggacca

SEQ ID NO: 3972329 - DNA, 17 bp, Homo sapiens
tggcagggtgggatgga

SEQ ID NO: 3972330 - DNA, 18 bp, Homo sapiens
tggcatcccctttattaa

SEQ ID NO: 3972331 - DNA, 20 bp, Homo sapiens
tggcatgatttatatatggc

SEQ ID NO: 3972332 - DNA, 16 bp, Homo sapiens
tggcatggatttctgt

SEQ ID NO: 3972333 - DNA, 23 bp, Homo sapiens
tggcatggtgctttcaggtctgg

SEQ ID NO: 3972334 - DNA, 15 bp, Homo sapiens
tggcatgtcagagcc

SEQ ID NO: 3972335 - DNA, 16 bp, Homo sapiens
tggcattaattattaa

SEQ ID NO: 3972336 - DNA, 17 bp, Homo sapiens
tggcattaattattaat

SEQ ID NO: 3972337 - DNA, 19 bp, Homo sapiens
tggcattacagctggagaa

SEQ ID NO: 3972338 - DNA, 17 bp, Homo sapiens
tggccaagctgaggtgc

SEQ ID NO: 3972339 - DNA, 23 bp, Homo sapiens
aaaactatacttgtactccttaa

SEQ ID NO: 3972340 - DNA, 13 bp, Homo sapiens
aaaactcaggatt

SEQ ID NO: 3972341 - DNA, 19 bp, Homo sapiens
aaaactgaaaaattttatt

SEQ ID NO: 3972342 - DNA, 18 bp, Homo sapiens
aaaactgaaaatctaata

SEQ ID NO: 3972343 - DNA, 19 bp, Homo sapiens
aaaactgaaaatctaatat

SEQ ID NO: 3972344 - DNA, 15 bp, Homo sapiens
aaaactgatcaaaaa

SEQ ID NO: 3972345 - DNA, 15 bp, Homo sapiens
aaaacttcagaaaaa

SEQ ID NO: 3972346 - DNA, 22 bp, Homo sapiens
aaaacttgtactatgttaataa

SEQ ID NO: 3972347 - DNA, 12 bp, Homo sapiens
aaaactttcatt

SEQ ID NO: 3972348 - DNA, 11 bp, Homo sapiens
aaaagaaaacc

SEQ ID NO: 3972349 - DNA, 18 bp, Homo sapiens
aaaagaaaccgtaatttt

SEQ ID NO: 3972350 - DNA, 14 bp, Homo sapiens
aaaagaatattcag

SEQ ID NO: 3972351 - DNA, 21 bp, Homo sapiens
aaaagacagtggatcatgaaa

SEQ ID NO: 3972352 - DNA, 16 bp, Homo sapiens
aaaagagaaaaaccaa

SEQ ID NO: 3972353 - DNA, 17 bp, Homo sapiens
aaaagatgaaaatattt

SEQ ID NO: 3972354 - DNA, 17 bp, Homo sapiens
aaaagattctgtaagaa

SEQ ID NO: 3972355 - DNA, 14 bp, Homo sapiens
aaaagcaaatgaga

SEQ ID NO: 3972356 - DNA, 12 bp, Homo sapiens
aaaagcaagact

SEQ ID NO: 3972357 - DNA, 18 bp, Homo sapiens
aaaagcaattatattgtc

SEQ ID NO: 3972358 - DNA, 14 bp, Homo sapiens
aaaagctcatattt

SEQ ID NO: 3972359 - DNA, 13 bp, Homo sapiens
aaaagctcctgtc

SEQ ID NO: 3972360 - DNA, 22 bp, Homo sapiens
aaaagctgcttgactatcacat

SEQ ID NO: 3972361 - DNA, 13 bp, Homo sapiens
aaaaggagagaag

SEQ ID NO: 3972362 - DNA, 20 bp, Homo sapiens
aaaagggaagttgtgccttt

SEQ ID NO: 3972363 - DNA, 11 bp, Homo sapiens
aaaagtaaaca

SEQ ID NO: 3972364 - DNA, 18 bp, Homo sapiens
aaaagtggattttcctga

SEQ ID NO: 3972365 - DNA, 19 bp, Homo sapiens
aaaagtgttgattacataa

SEQ ID NO: 3972366 - DNA, 14 bp, Homo sapiens
aaaagttagctgag

SEQ ID NO: 3972367 - DNA, 18 bp, Homo sapiens
aaaagttgcagtctcaga

SEQ ID NO: 3972368 - DNA, 18 bp, Homo sapiens
aaaataaaaacataaaat

SEQ ID NO: 3972369 - DNA, 15 bp, Homo sapiens
aaaataaaaaccaga

SEQ ID NO: 3972370 - DNA, 20 bp, Homo sapiens
aaaataaaaaccagaatcat

SEQ ID NO: 3972371 - DNA, 16 bp, Homo sapiens
aaaataaaattatggt

SEQ ID NO: 3972372 - DNA, 15 bp, Homo sapiens
aaaataaactagttt

SEQ ID NO: 3972373 - DNA, 19 bp, Homo sapiens
aaaataaactagtttccag

SEQ ID NO: 3972374 - DNA, 12 bp, Homo sapiens
aaaataaagcct

SEQ ID NO: 3972375 - DNA, 22 bp, Homo sapiens
aaaataaagcctatttttcaaa

SEQ ID NO: 3972376 - DNA, 18 bp, Homo sapiens
aaaataaattttgaatgt

SEQ ID NO: 3972377 - DNA, 14 bp, Homo sapiens
aaaataagtatttc

SEQ ID NO: 3972378 - DNA, 21 bp, Homo sapiens
aaaataagtgaataataatta

SEQ ID NO: 3972379 - DNA, 17 bp, Homo sapiens
aaaataatagccatcct

SEQ ID NO: 3972380 - DNA, 18 bp, Homo sapiens
aaaataatagccatcctt

SEQ ID NO: 3972381 - DNA, 13 bp, Homo sapiens
aaaataatttaac

SEQ ID NO: 3972382 - DNA, 15 bp, Homo sapiens
aaaataatttaacta

SEQ ID NO: 3972383 - DNA, 18 bp, Homo sapiens
aaaataatttaactaatt

SEQ ID NO: 3972384 - DNA, 19 bp, Homo sapiens
aaaataatttaactaattt

SEQ ID NO: 3972385 - DNA, 20 bp, Homo sapiens
aaaataattttaaacaaagg

SEQ ID NO: 3972386 - DNA, 13 bp, Homo sapiens
aaaatacaaacaa

SEQ ID NO: 3972387 - DNA, 14 bp, Homo sapiens
aaaatacacactca

SEQ ID NO: 3972388 - DNA, 19 bp, Homo sapiens
aaaatactatgaaatgaaa

SEQ ID NO: 3972389 - DNA, 17 bp, Homo sapiens
aaaatacttgagctgta

SEQ ID NO: 3972390 - DNA, 13 bp, Homo sapiens
aaaatagcttgta

SEQ ID NO: 3972391 - DNA, 18 bp, Homo sapiens
aaaatagtattgaaagtg

SEQ ID NO: 3972392 - DNA, 22 bp, Homo sapiens
aaaatataaaatagttgtccat

SEQ ID NO: 3972393 - DNA, 13 bp, Homo sapiens
aaaatataaatgc

SEQ ID NO: 3972394 - DNA, 14 bp, Homo sapiens
aaaatatatataaa

SEQ ID NO: 3972395 - DNA, 20 bp, Homo sapiens
aaaatatatatagtgctata

SEQ ID NO: 3972396 - DNA, 13 bp, Homo sapiens
aaaatatatatat

SEQ ID NO: 3972397 - DNA, 22 bp, Homo sapiens
aaaatatatatgtgcagtattt

SEQ ID NO: 3972398 - DNA, 16 bp, Homo sapiens
aaaatatggaacttct

SEQ ID NO: 3972399 - DNA, 14 bp, Homo sapiens
aaaatatgtatgtc

SEQ ID NO: 3972400 - DNA, 22 bp, Homo sapiens
aaaatatgtatgtctaattgag

SEQ ID NO: 3972401 - DNA, 16 bp, Homo sapiens
aaaatattataactta

SEQ ID NO: 3972402 - DNA, 17 bp, Homo sapiens
aaaatattctgtaagaa

SEQ ID NO: 3972403 - DNA, 15 bp, Homo sapiens
aaaatatttgtacat

SEQ ID NO: 3972404 - DNA, 18 bp, Homo sapiens
aaaatattttataatttt

SEQ ID NO: 3972405 - DNA, 16 bp, Homo sapiens
aaaatattttctgaat

SEQ ID NO: 3972406 - DNA, 15 bp, Homo sapiens
aaaatcaaaacaaaa

SEQ ID NO: 3972407 - DNA, 15 bp, Homo sapiens
aaaatcaacttgtgt

SEQ ID NO: 3972408 - DNA, 16 bp, Homo sapiens
aaaatcaacttgtgta

SEQ ID NO: 3972409 - DNA, 20 bp, Homo sapiens
aaaatcacaagcaataatta

SEQ ID NO: 3972410 - DNA, 22 bp, Homo sapiens
aaaatcacaagcaataattagg

SEQ ID NO: 3972411 - DNA, 17 bp, Homo sapiens
aaaatccctatttaatt

SEQ ID NO: 3972412 - DNA, 22 bp, Homo sapiens
aaaatctagatcaattaattct

SEQ ID NO: 3972413 - DNA, 23 bp, Homo sapiens
aaaatctagatcaattaattctt

SEQ ID NO: 3972414 - DNA, 19 bp, Homo sapiens
aaaatctagttttttttgt

SEQ ID NO: 3972415 - DNA, 17 bp, Homo sapiens
aaaatctggaaatctgt

SEQ ID NO: 3972416 - DNA, 19 bp, Homo sapiens
aaaatctgtttgatccctg

SEQ ID NO: 3972417 - DNA, 17 bp, Homo sapiens
aaaatcttggcacagaa

SEQ ID NO: 3972418 - DNA, 15 bp, Homo sapiens
aaaatcttgggcaag

SEQ ID NO: 3972419 - DNA, 12 bp, Homo sapiens
aaaatctttcag

SEQ ID NO: 3972420 - DNA, 15 bp, Homo sapiens
aaaatgacagatgtt

SEQ ID NO: 3972421 - DNA, 21 bp, Homo sapiens
aaaatgactaaaaatattata

SEQ ID NO: 3972422 - DNA, 15 bp, Homo sapiens
aaaatgaggaggatt

SEQ ID NO: 3972423 - DNA, 16 bp, Homo sapiens
aaaatgcaaaatgaaa

SEQ ID NO: 3972424 - DNA, 19 bp, Homo sapiens
aaaatgcagtccagaataa

SEQ ID NO: 3972425 - DNA, 22 bp, Homo sapiens
aaaatgctgaggtaataattat

SEQ ID NO: 3972426 - DNA, 18 bp, Homo sapiens
aaacccagcatgtacaaa

SEQ ID NO: 3972427 - DNA, 12 bp, Homo sapiens
aaaccccaagca

SEQ ID NO: 3972428 - DNA, 13 bp, Homo sapiens
aaaccccaagcag

SEQ ID NO: 3972429 - DNA, 16 bp, Homo sapiens
aaacccccgctccaga

SEQ ID NO: 3972430 - DNA, 13 bp, Homo sapiens
aaaccccgtctct

SEQ ID NO: 3972431 - DNA, 17 bp, Homo sapiens
aaaccctggcttgcttg

SEQ ID NO: 3972432 - DNA, 12 bp, Homo sapiens
aaaccctgtctc

SEQ ID NO: 3972433 - DNA, 21 bp, Homo sapiens
aaaccctgtggggcctgatgg

SEQ ID NO: 3972434 - DNA, 23 bp, Homo sapiens
aaacctaaagaggaaaagtgcaa

SEQ ID NO: 3972435 - DNA, 18 bp, Homo sapiens
aaacctagaacttcaaaa

SEQ ID NO: 3972436 - DNA, 21 bp, Homo sapiens
aaacctagaacttcaaaatgt

SEQ ID NO: 3972437 - DNA, 22 bp, Homo sapiens
aaacctatcaatcctgccccca

SEQ ID NO: 3972438 - DNA, 19 bp, Homo sapiens
aaacctcagggacaacatt

SEQ ID NO: 3972439 - DNA, 12 bp, Homo sapiens
aaacctggagat

SEQ ID NO: 3972440 - DNA, 15 bp, Homo sapiens
aaacctggagatgat

SEQ ID NO: 3972441 - DNA, 18 bp, Homo sapiens
aaacctggagatgatgat

SEQ ID NO: 3972442 - DNA, 19 bp, Homo sapiens
aaacctggagatgatgatg

SEQ ID NO: 3972443 - DNA, 22 bp, Homo sapiens
aaaccttttcatgcctttagat

SEQ ID NO: 3972444 - DNA, 20 bp, Homo sapiens
aaacgaacccactgtgctta

SEQ ID NO: 3972445 - DNA, 19 bp, Homo sapiens
aaacgactccgagaacaac

SEQ ID NO: 3972446 - DNA, 15 bp, Homo sapiens
aaacgatcgctgtga

SEQ ID NO: 3972447 - DNA, 19 bp, Homo sapiens
aaacgcaaagggctgaaag

SEQ ID NO: 3972448 - DNA, 13 bp, Homo sapiens
aaacgggaaagaa

SEQ ID NO: 3972449 - DNA, 13 bp, Homo sapiens
aaactaaatatat

SEQ ID NO: 3972450 - DNA, 17 bp, Homo sapiens
aaactaaatctctaata

SEQ ID NO: 3972451 - DNA, 18 bp, Homo sapiens
aaactaaatctctaatat

SEQ ID NO: 3972452 - DNA, 17 bp, Homo sapiens
aaactacaaagctgaag

SEQ ID NO: 3972453 - DNA, 17 bp, Homo sapiens
aaactacagaataatgt

SEQ ID NO: 3972454 - DNA, 17 bp, Homo sapiens
aaactaccctccagagt

SEQ ID NO: 3972455 - DNA, 13 bp, Homo sapiens
aaactactgtaat

SEQ ID NO: 3972456 - DNA, 14 bp, Homo sapiens
aaactagtaatggg

SEQ ID NO: 3972457 - DNA, 19 bp, Homo sapiens
aaactataaactactgtaa

SEQ ID NO: 3972458 - DNA, 21 bp, Homo sapiens
aaactataaactactgtaatt

SEQ ID NO: 3972459 - DNA, 17 bp, Homo sapiens
aaactatccaattaaaa

SEQ ID NO: 3972460 - DNA, 20 bp, Homo sapiens
aaactatccaattaaaatta

SEQ ID NO: 3972461 - DNA, 17 bp, Homo sapiens
aaactatggttcccaat

SEQ ID NO: 3972462 - DNA, 18 bp, Homo sapiens
aaactatggttcccaata

SEQ ID NO: 3972463 - DNA, 19 bp, Homo sapiens
aaactcaaaacttaacata

SEQ ID NO: 3972464 - DNA, 22 bp, Homo sapiens
aaactcaaaacttaacatattt

SEQ ID NO: 3972465 - DNA, 16 bp, Homo sapiens
aaactcaccatgtaaa

SEQ ID NO: 3972466 - DNA, 18 bp, Homo sapiens
aaactcaccatgtaaaag

SEQ ID NO: 3972467 - DNA, 20 bp, Homo sapiens
aaactcactgctcaagaaga

SEQ ID NO: 3972468 - DNA, 16 bp, Homo sapiens
aaactcagttaaaatg

SEQ ID NO: 3972469 - DNA, 23 bp, Homo sapiens
aaactcccacttgtcatgtgaca

SEQ ID NO: 3972470 - DNA, 19 bp, Homo sapiens
aaactcctgattttgtagt

SEQ ID NO: 3972471 - DNA, 12 bp, Homo sapiens
aaactcctgcct

SEQ ID NO: 3972472 - DNA, 22 bp, Homo sapiens
aaactctgggaaataagagaga

SEQ ID NO: 3972473 - DNA, 17 bp, Homo sapiens
aaactgaaaactgtaaa

SEQ ID NO: 3972474 - DNA, 12 bp, Homo sapiens
aaactgaaaatc

SEQ ID NO: 3972475 - DNA, 17 bp, Homo sapiens
aaactgaaaatctaata

SEQ ID NO: 3972476 - DNA, 18 bp, Homo sapiens
aaactgaaaatctaatat

SEQ ID NO: 3972477 - DNA, 20 bp, Homo sapiens
aaactgagaaatgaatgctg

SEQ ID NO: 3972478 - DNA, 18 bp, Homo sapiens
aaactgaggaattttctt

SEQ ID NO: 3972479 - DNA, 19 bp, Homo sapiens
aaactgatcaaaaataaac

SEQ ID NO: 3972480 - DNA, 20 bp, Homo sapiens
aaactgatgcgaaaacttga

SEQ ID NO: 3972481 - DNA, 21 bp, Homo sapiens
aaactgatggaccgggtgggc

SEQ ID NO: 3972482 - DNA, 17 bp, Homo sapiens
aaactgcattagaaatt

SEQ ID NO: 3972483 - DNA, 19 bp, Homo sapiens
aaactgccagcaacgcagg

SEQ ID NO: 3972484 - DNA, 18 bp, Homo sapiens
aaactgtaaatacaaaat

SEQ ID NO: 3972485 - DNA, 21 bp, Homo sapiens
aaactgtatcaaatctgtata

SEQ ID NO: 3972486 - DNA, 22 bp, Homo sapiens
aaactgttcaagaaataataaa

SEQ ID NO: 3972487 - DNA, 22 bp, Homo sapiens
aaacttagaataaaattgtaaa

SEQ ID NO: 3972488 - DNA, 18 bp, Homo sapiens
aaacttatgctagtttat

SEQ ID NO: 3972489 - DNA, 13 bp, Homo sapiens
aaacttcagcacc

SEQ ID NO: 3972490 - DNA, 22 bp, Homo sapiens
aaacttgaatctgttactgaaa

SEQ ID NO: 3972491 - DNA, 13 bp, Homo sapiens
aaacttgtcagaa

SEQ ID NO: 3972492 - DNA, 20 bp, Homo sapiens
aaactttacccaaaaactaa

SEQ ID NO: 3972493 - DNA, 13 bp, Homo sapiens
aaagaaaaagtat

SEQ ID NO: 3972494 - DNA, 14 bp, Homo sapiens
aaagaaaaccattt

SEQ ID NO: 3972495 - DNA, 16 bp, Homo sapiens
aaagaaaaccatttta

SEQ ID NO: 3972496 - DNA, 13 bp, Homo sapiens
aaagaaatgcaaa

SEQ ID NO: 3972497 - DNA, 14 bp, Homo sapiens
aaagaacaagaaat

SEQ ID NO: 3972498 - DNA, 15 bp, Homo sapiens
aaagaacagtaaaca

SEQ ID NO: 3972499 - DNA, 18 bp, Homo sapiens
aaagaacggcatgtgaat

SEQ ID NO: 3972500 - DNA, 14 bp, Homo sapiens
aaagaagactggaa

SEQ ID NO: 3972501 - DNA, 12 bp, Homo sapiens
aaagaagagaca

SEQ ID NO: 3972502 - DNA, 13 bp, Homo sapiens
aaagaagtaaaag

SEQ ID NO: 3972503 - DNA, 16 bp, Homo sapiens
aaagaagtaaaagcta

SEQ ID NO: 3972504 - DNA, 17 bp, Homo sapiens
aaagaataaatgaatct

SEQ ID NO: 3972505 - DNA, 15 bp, Homo sapiens
aaagaatacagaaag

SEQ ID NO: 3972506 - DNA, 20 bp, Homo sapiens
aaagaatataaagttaaaaa

SEQ ID NO: 3972507 - DNA, 21 bp, Homo sapiens
aaagaatataaagttaaaaaa

SEQ ID NO: 3972508 - DNA, 19 bp, Homo sapiens
aaagaatccctgcagcctg

SEQ ID NO: 3972509 - DNA, 13 bp, Homo sapiens
aaagacacctact

SEQ ID NO: 3972510 - DNA, 12 bp, Homo sapiens
aaagacagaatg

SEQ ID NO: 3972511 - DNA, 16 bp, Homo sapiens
aaagacagaatgtcac

SEQ ID NO: 3972512 - DNA, 16 bp, Homo sapiens
aaagacagtgtgtgtg

SEQ ID NO: 3972513 - DNA, 21 bp, Homo sapiens
aaccatgtagttttaacagaa

SEQ ID NO: 3972514 - DNA, 13 bp, Homo sapiens
aaccattaagaaa

SEQ ID NO: 3972515 - DNA, 20 bp, Homo sapiens
aaccattacatgtttaaatt

SEQ ID NO: 3972516 - DNA, 15 bp, Homo sapiens
aaccatttaattcat

SEQ ID NO: 3972517 - DNA, 20 bp, Homo sapiens
aaccatttaattcataatta

SEQ ID NO: 3972518 - DNA, 21 bp, Homo sapiens
aaccatttaattcataattag

SEQ ID NO: 3972519 - DNA, 22 bp, Homo sapiens
aaccatttaattcataattaga

SEQ ID NO: 3972520 - DNA, 23 bp, Homo sapiens
aacccactgtgcttacagtgact

SEQ ID NO: 3972521 - DNA, 15 bp, Homo sapiens
aacccagccctgggg

SEQ ID NO: 3972522 - DNA, 11 bp, Homo sapiens
aacccaggagg

SEQ ID NO: 3972523 - DNA, 20 bp, Homo sapiens
aacccaggttggcgactgca

SEQ ID NO: 3972524 - DNA, 17 bp, Homo sapiens
aacccatcagaaggaga

SEQ ID NO: 3972525 - DNA, 19 bp, Homo sapiens
aacccatcagaaggagaag

SEQ ID NO: 3972526 - DNA, 15 bp, Homo sapiens
aacccatcagacagg

SEQ ID NO: 3972527 - DNA, 14 bp, Homo sapiens
aaccccaagcagca

SEQ ID NO: 3972528 - DNA, 17 bp, Homo sapiens
aaccccagctggcctct

SEQ ID NO: 3972529 - DNA, 22 bp, Homo sapiens
aaccccatcatatgacatgcca

SEQ ID NO: 3972530 - DNA, 13 bp, Homo sapiens
aaccccatgggct

SEQ ID NO: 3972531 - DNA, 17 bp, Homo sapiens
aacccccagtgccacag

SEQ ID NO: 3972532 - DNA, 13 bp, Homo sapiens
aacccccatcttt

SEQ ID NO: 3972533 - DNA, 14 bp, Homo sapiens
aacccccgctccag

SEQ ID NO: 3972534 - DNA, 22 bp, Homo sapiens
aacccccgctccagatctgcac

SEQ ID NO: 3972535 - DNA, 15 bp, Homo sapiens
aaccccgcagcccgt

SEQ ID NO: 3972536 - DNA, 18 bp, Homo sapiens
aaccccgcggtgctctgg

SEQ ID NO: 3972537 - DNA, 22 bp, Homo sapiens
aaccccgcggtgctctggcggc

SEQ ID NO: 3972538 - DNA, 21 bp, Homo sapiens
aacccctgtacccagctcctt

SEQ ID NO: 3972539 - DNA, 10 bp, Homo sapiens
aacccctgtg

SEQ ID NO: 3972540 - DNA, 12 bp, Homo sapiens
aacccctgtgtc

SEQ ID NO: 3972541 - DNA, 14 bp, Homo sapiens
aacccgtggaggct

SEQ ID NO: 3972542 - DNA, 15 bp, Homo sapiens
aacccgtggaggctg

SEQ ID NO: 3972543 - DNA, 13 bp, Homo sapiens
aaccctgtttcct

SEQ ID NO: 3972544 - DNA, 14 bp, Homo sapiens
aacccttgctgctg

SEQ ID NO: 3972545 - DNA, 16 bp, Homo sapiens
aacccttttcctccag

SEQ ID NO: 3972546 - DNA, 18 bp, Homo sapiens
aacctaaagaggaaaagt

SEQ ID NO: 3972547 - DNA, 15 bp, Homo sapiens
aacctactagacaat

SEQ ID NO: 3972548 - DNA, 15 bp, Homo sapiens
aacctagaacttcaa

SEQ ID NO: 3972549 - DNA, 20 bp, Homo sapiens
aacctagtactctctgctct

SEQ ID NO: 3972550 - DNA, 21 bp, Homo sapiens
aacctagtactctctgctcta

SEQ ID NO: 3972551 - DNA, 16 bp, Homo sapiens
aacctatatgatttat

SEQ ID NO: 3972552 - DNA, 13 bp, Homo sapiens
aacctcaaactgg

SEQ ID NO: 3972553 - DNA, 18 bp, Homo sapiens
aacctcagccaaacacag

SEQ ID NO: 3972554 - DNA, 16 bp, Homo sapiens
aacctcagtttcctca

SEQ ID NO: 3972555 - DNA, 17 bp, Homo sapiens
aacctcagtttcctcat

SEQ ID NO: 3972556 - DNA, 15 bp, Homo sapiens
aacctctctaagcca

SEQ ID NO: 3972557 - DNA, 20 bp, Homo sapiens
aacctctctaagccacagct

SEQ ID NO: 3972558 - DNA, 21 bp, Homo sapiens
aacctgaaaaaaagtttacaa

SEQ ID NO: 3972559 - DNA, 22 bp, Homo sapiens
aacctgcagttcctgagtacct

SEQ ID NO: 3972560 - DNA, 15 bp, Homo sapiens
aacctgctctcctct

SEQ ID NO: 3972561 - DNA, 17 bp, Homo sapiens
aacctggagatgatgat

SEQ ID NO: 3972562 - DNA, 19 bp, Homo sapiens
aacctggagatgatgatga

SEQ ID NO: 3972563 - DNA, 10 bp, Homo sapiens
aacctggagg

SEQ ID NO: 3972564 - DNA, 21 bp, Homo sapiens
aacctggcatggtgctttcag

SEQ ID NO: 3972565 - DNA, 10 bp, Homo sapiens
aacctggctt

SEQ ID NO: 3972566 - DNA, 17 bp, Homo sapiens
aacctggtggcaccaga

SEQ ID NO: 3972567 - DNA, 13 bp, Homo sapiens
aacctggttcctg

SEQ ID NO: 3972568 - DNA, 22 bp, Homo sapiens
aacctggtttttgtatatttat

SEQ ID NO: 3972569 - DNA, 20 bp, Homo sapiens
aacctgtactgggttatttt

SEQ ID NO: 3972570 - DNA, 23 bp, Homo sapiens
aacctgtgcagtcccgtggaggg

SEQ ID NO: 3972571 - DNA, 20 bp, Homo sapiens
aacctgttcttcctaccaaa

SEQ ID NO: 3972572 - DNA, 19 bp, Homo sapiens
aaccttagagcttggacag

SEQ ID NO: 3972573 - DNA, 14 bp, Homo sapiens
aaccttccctccaa

SEQ ID NO: 3972574 - DNA, 11 bp, Homo sapiens
aaccttgcagc

SEQ ID NO: 3972575 - DNA, 18 bp, Homo sapiens
aacctttcaaatttcaca

SEQ ID NO: 3972576 - DNA, 18 bp, Homo sapiens
aacctttccccagacaca

SEQ ID NO: 3972577 - DNA, 16 bp, Homo sapiens
aacgaacccactgtgc

SEQ ID NO: 3972578 - DNA, 21 bp, Homo sapiens
aacgaacccactgtgcttaca

SEQ ID NO: 3972579 - DNA, 18 bp, Homo sapiens
aacgactgggcactgcca

SEQ ID NO: 3972580 - DNA, 14 bp, Homo sapiens
aacgagcactggcc

SEQ ID NO: 3972581 - DNA, 18 bp, Homo sapiens
aacgagcactggccagag

SEQ ID NO: 3972582 - DNA, 16 bp, Homo sapiens
aacgagtcaatcccct

SEQ ID NO: 3972583 - DNA, 15 bp, Homo sapiens
aacgcagacactgag

SEQ ID NO: 3972584 - DNA, 12 bp, Homo sapiens
aacgcagccctg

SEQ ID NO: 3972585 - DNA, 22 bp, Homo sapiens
aacgcctcttttccctctctag

SEQ ID NO: 3972586 - DNA, 17 bp, Homo sapiens
aacgcctgagcccaggg

SEQ ID NO: 3972587 - DNA, 19 bp, Homo sapiens
aacgggaaagaatataaag

SEQ ID NO: 3972588 - DNA, 12 bp, Homo sapiens
aacggggagaaa

SEQ ID NO: 3972589 - DNA, 20 bp, Homo sapiens
aacgggggtgcggcaggagc

SEQ ID NO: 3972590 - DNA, 18 bp, Homo sapiens
aacgtgggtatttcctgc

SEQ ID NO: 3972591 - DNA, 22 bp, Homo sapiens
aacgtgggtatttcctgctaca

SEQ ID NO: 3972592 - DNA, 17 bp, Homo sapiens
aacgttaaaagacagtg

SEQ ID NO: 3972593 - DNA, 20 bp, Homo sapiens
aacgttttgaactaataaaa

SEQ ID NO: 3972594 - DNA, 14 bp, Homo sapiens
aactaaatatatgt

SEQ ID NO: 3972595 - DNA, 18 bp, Homo sapiens
aactaagcagtccctgag

SEQ ID NO: 3972596 - DNA, 23 bp, Homo sapiens
aactaagttttttacttccacag

SEQ ID NO: 3972597 - DNA, 14 bp, Homo sapiens
aactaataaaagca

SEQ ID NO: 3972598 - DNA, 21 bp, Homo sapiens
aactaatcaagagtgagtgaa

SEQ ID NO: 3972599 - DNA, 15 bp, Homo sapiens
aactaatttaaacca

SEQ ID NO: 3972600 - DNA, 13 bp, Homo sapiens
aagcagcctcctg

SEQ ID NO: 3972601 - DNA, 12 bp, Homo sapiens
aagcaggcagag

SEQ ID NO: 3972602 - DNA, 20 bp, Homo sapiens
aagcagggaaagctccacgg

SEQ ID NO: 3972603 - DNA, 22 bp, Homo sapiens
aagcagtgtgtccttggggcac

SEQ ID NO: 3972604 - DNA, 16 bp, Homo sapiens
aagcatgtaggagaat

SEQ ID NO: 3972605 - DNA, 15 bp, Homo sapiens
aagcatgtgtttgca

SEQ ID NO: 3972606 - DNA, 19 bp, Homo sapiens
aagccaacttgtaaataca

SEQ ID NO: 3972607 - DNA, 18 bp, Homo sapiens
aagccacaagaaatttga

SEQ ID NO: 3972608 - DNA, 16 bp, Homo sapiens
aagccacgctgtcctc

SEQ ID NO: 3972609 - DNA, 22 bp, Homo sapiens
aagccacgctgtcctctcgagc

SEQ ID NO: 3972610 - DNA, 19 bp, Homo sapiens
aagccactatgtccagcta

SEQ ID NO: 3972611 - DNA, 20 bp, Homo sapiens
aagccagaagctaagctgca

SEQ ID NO: 3972612 - DNA, 12 bp, Homo sapiens
aagccagagcct

SEQ ID NO: 3972613 - DNA, 15 bp, Homo sapiens
aagccagctgccgac

SEQ ID NO: 3972614 - DNA, 23 bp, Homo sapiens
aagccagctgccgaccagagccc

SEQ ID NO: 3972615 - DNA, 16 bp, Homo sapiens
aagcccaacctcctga

SEQ ID NO: 3972616 - DNA, 17 bp, Homo sapiens
aagcccaacctcctgac

SEQ ID NO: 3972617 - DNA, 14 bp, Homo sapiens
aagcccagtttccc

SEQ ID NO: 3972618 - DNA, 19 bp, Homo sapiens
aagccccccacctttctcg

SEQ ID NO: 3972619 - DNA, 13 bp, Homo sapiens
aagcccctcagcc

SEQ ID NO: 3972620 - DNA, 19 bp, Homo sapiens
aagcccctcagcccttgcc

SEQ ID NO: 3972621 - DNA, 20 bp, Homo sapiens
aagcccctcagcccttgccc

SEQ ID NO: 3972622 - DNA, 13 bp, Homo sapiens
aagccctccttcc

SEQ ID NO: 3972623 - DNA, 21 bp, Homo sapiens
aagccctcgaaccaaggcagc

SEQ ID NO: 3972624 - DNA, 14 bp, Homo sapiens
aagccctggcaaca

SEQ ID NO: 3972625 - DNA, 20 bp, Homo sapiens
aagccctgtcgagacacttg

SEQ ID NO: 3972626 - DNA, 20 bp, Homo sapiens
aagcccttccatgtcgcctc

SEQ ID NO: 3972627 - DNA, 16 bp, Homo sapiens
aagccgtactgtctat

SEQ ID NO: 3972628 - DNA, 19 bp, Homo sapiens
aagccgtctgactccagag

SEQ ID NO: 3972629 - DNA, 20 bp, Homo sapiens
aagccgtctgactccagagt

SEQ ID NO: 3972630 - DNA, 13 bp, Homo sapiens
aagccgtggcttc

SEQ ID NO: 3972631 - DNA, 15 bp, Homo sapiens
aagccgtggcttccc

SEQ ID NO: 3972632 - DNA, 14 bp, Homo sapiens
aagcctccctcctc

SEQ ID NO: 3972633 - DNA, 20 bp, Homo sapiens
aagcctccggtttccactac

SEQ ID NO: 3972634 - DNA, 17 bp, Homo sapiens
aagcctctgccccaagg

SEQ ID NO: 3972635 - DNA, 20 bp, Homo sapiens
aagcctctgccctgcctccc

SEQ ID NO: 3972636 - DNA, 22 bp, Homo sapiens
aagcctctgccctgcctccctt

SEQ ID NO: 3972637 - DNA, 17 bp, Homo sapiens
aagcctgggggcctggc

SEQ ID NO: 3972638 - DNA, 19 bp, Homo sapiens
aagcctgggggcctggctg

SEQ ID NO: 3972639 - DNA, 21 bp, Homo sapiens
aagcctgggggcctggctggc

SEQ ID NO: 3972640 - DNA, 17 bp, Homo sapiens
aagcctgtaatcccagc

SEQ ID NO: 3972641 - DNA, 23 bp, Homo sapiens
aagcctgtgaataaaaaccctgt

SEQ ID NO: 3972642 - DNA, 16 bp, Homo sapiens
aagcctttttccccaa

SEQ ID NO: 3972643 - DNA, 15 bp, Homo sapiens
aagcctttttttagt

SEQ ID NO: 3972644 - DNA, 22 bp, Homo sapiens
aagcctttttttagtaaatcct

SEQ ID NO: 3972645 - DNA, 18 bp, Homo sapiens
aagcgagatcccatctct

SEQ ID NO: 3972646 - DNA, 18 bp, Homo sapiens
aagcgaggtcaacagaga

SEQ ID NO: 3972647 - DNA, 17 bp, Homo sapiens
aagctagaacctggagg

SEQ ID NO: 3972648 - DNA, 18 bp, Homo sapiens
aagctagtggcttcaaaa

SEQ ID NO: 3972649 - DNA, 19 bp, Homo sapiens
aagctagtggcttcaaaat

SEQ ID NO: 3972650 - DNA, 16 bp, Homo sapiens
aagctattgagaaaga

SEQ ID NO: 3972651 - DNA, 18 bp, Homo sapiens
aagctattgatgtttcca

SEQ ID NO: 3972652 - DNA, 15 bp, Homo sapiens
aagctcacagttcct

SEQ ID NO: 3972653 - DNA, 23 bp, Homo sapiens
aagctcaggaggcgaataaatgt

SEQ ID NO: 3972654 - DNA, 12 bp, Homo sapiens
aagctcatattt

SEQ ID NO: 3972655 - DNA, 19 bp, Homo sapiens
aagctccacggtgcgtggc

SEQ ID NO: 3972656 - DNA, 21 bp, Homo sapiens
aagctccacggtgcgtggctg

SEQ ID NO: 3972657 - DNA, 23 bp, Homo sapiens
aagctccacggtgcgtggctgtg

SEQ ID NO: 3972658 - DNA, 19 bp, Homo sapiens
aagctccactgtcaccctc

SEQ ID NO: 3972659 - DNA, 19 bp, Homo sapiens
aagctcccagatgctgggg

SEQ ID NO: 3972660 - DNA, 15 bp, Homo sapiens
aagctcccagggcct

SEQ ID NO: 3972661 - DNA, 14 bp, Homo sapiens
aagctcctgtcctc

SEQ ID NO: 3972662 - DNA, 12 bp, Homo sapiens
aagctcttcctt

SEQ ID NO: 3972663 - DNA, 13 bp, Homo sapiens
aagctgaagaaaa

SEQ ID NO: 3972664 - DNA, 14 bp, Homo sapiens
aagctgaagaaaat

SEQ ID NO: 3972665 - DNA, 13 bp, Homo sapiens
aagctgagaagaa

SEQ ID NO: 3972666 - DNA, 23 bp, Homo sapiens
aagctgagcaggcccgacagaga

SEQ ID NO: 3972667 - DNA, 19 bp, Homo sapiens
aagctgaggtgcccaggag

SEQ ID NO: 3972668 - DNA, 23 bp, Homo sapiens
aagctgagtgactgtaggcaggg

SEQ ID NO: 3972669 - DNA, 21 bp, Homo sapiens
aagctgagttacttgtctgag

SEQ ID NO: 3972670 - DNA, 23 bp, Homo sapiens
aagctgagttacttgtctgaggc

SEQ ID NO: 3972671 - DNA, 15 bp, Homo sapiens
aagctgcctgtagtt

SEQ ID NO: 3972672 - DNA, 13 bp, Homo sapiens
aagctgcttgact

SEQ ID NO: 3972673 - DNA, 15 bp, Homo sapiens
aagctgcttgactat

SEQ ID NO: 3972674 - DNA, 11 bp, Homo sapiens
aagctggaagc

SEQ ID NO: 3972675 - DNA, 22 bp, Homo sapiens
aagctgggaaaaaagttttgat

SEQ ID NO: 3972676 - DNA, 19 bp, Homo sapiens
aagctgggcatgaacgcac

SEQ ID NO: 3972677 - DNA, 20 bp, Homo sapiens
aagctgggcatgaacgcact

SEQ ID NO: 3972678 - DNA, 17 bp, Homo sapiens
aagctgtaaaaagagag

SEQ ID NO: 3972679 - DNA, 23 bp, Homo sapiens
aagctgtgaactcagagcccctc

SEQ ID NO: 3972680 - DNA, 12 bp, Homo sapiens
aagctgtgtcct

SEQ ID NO: 3972681 - DNA, 18 bp, Homo sapiens
aagcttcaagtgatatat

SEQ ID NO: 3972682 - DNA, 12 bp, Homo sapiens
aagcttcagagc

SEQ ID NO: 3972683 - DNA, 13 bp, Homo sapiens
aagcttcagagcc

SEQ ID NO: 3972684 - DNA, 15 bp, Homo sapiens
aagcttcagagccta

SEQ ID NO: 3972685 - DNA, 22 bp, Homo sapiens
aagcttgtatatacatattata

SEQ ID NO: 3972686 - DNA, 19 bp, Homo sapiens
aagtggaccaggacaggac

SEQ ID NO: 3972687 - DNA, 14 bp, Homo sapiens
aagtggagggggtg

SEQ ID NO: 3972688 - DNA, 18 bp, Homo sapiens
aagtgggaagtgaagccc

SEQ ID NO: 3972689 - DNA, 21 bp, Homo sapiens
aagtgggccaggacaggcccg

SEQ ID NO: 3972690 - DNA, 17 bp, Homo sapiens
aagtgggttcactagag

SEQ ID NO: 3972691 - DNA, 15 bp, Homo sapiens
aagtgtaaaatagaa

SEQ ID NO: 3972692 - DNA, 15 bp, Homo sapiens
aagtgtaataatatg

SEQ ID NO: 3972693 - DNA, 20 bp, Homo sapiens
aagtgtagatagttaaaaga

SEQ ID NO: 3972694 - DNA, 22 bp, Homo sapiens
aagtgtcatatgtaggtgtctg

SEQ ID NO: 3972695 - DNA, 24 bp, Homo sapiens
aagtgtcatatgtaggtgtctgca

SEQ ID NO: 3972696 - DNA, 18 bp, Homo sapiens
aagtgtcgaaagcaactc

SEQ ID NO: 3972697 - DNA, 23 bp, Homo sapiens
aagtgtgtggtcccaagttggaa

SEQ ID NO: 3972698 - DNA, 18 bp, Homo sapiens
aagtgttcaagaaataaa

SEQ ID NO: 3972699 - DNA, 17 bp, Homo sapiens
aagtgttgtaaatattt

SEQ ID NO: 3972700 - DNA, 22 bp, Homo sapiens
aagtgttgtaaatatttatgta

SEQ ID NO: 3972701 - DNA, 23 bp, Homo sapiens
aagttacttcactttaattctca

SEQ ID NO: 3972702 - DNA, 17 bp, Homo sapiens
aagttagagaatatatt

SEQ ID NO: 3972703 - DNA, 22 bp, Homo sapiens
aagttaggtcattactaaccat

SEQ ID NO: 3972704 - DNA, 23 bp, Homo sapiens
aagttattaacgggcatgtatta

SEQ ID NO: 3972705 - DNA, 11 bp, Homo sapiens
aagttattgta

SEQ ID NO: 3972706 - DNA, 12 bp, Homo sapiens
aagttattgtac

SEQ ID NO: 3972707 - DNA, 18 bp, Homo sapiens
aagttattgtgttgcctt

SEQ ID NO: 3972708 - DNA, 19 bp, Homo sapiens
aagttcagggaagcaggca

SEQ ID NO: 3972709 - DNA, 20 bp, Homo sapiens
aagttcagggaagcaggcag

SEQ ID NO: 3972710 - DNA, 21 bp, Homo sapiens
aagttcagggaagcaggcaga

SEQ ID NO: 3972711 - DNA, 20 bp, Homo sapiens
aagttcatgtttgtaaatta

SEQ ID NO: 3972712 - DNA, 18 bp, Homo sapiens
aagttcctgcactccaga

SEQ ID NO: 3972713 - DNA, 23 bp, Homo sapiens
aagttcctgttcaccttatgtat

SEQ ID NO: 3972714 - DNA, 18 bp, Homo sapiens
aagttctagagaagaggc

SEQ ID NO: 3972715 - DNA, 15 bp, Homo sapiens
aagttctgagtgttt

SEQ ID NO: 3972716 - DNA, 16 bp, Homo sapiens
aagtttaaaaaataca

SEQ ID NO: 3972717 - DNA, 12 bp, Homo sapiens
aagtttacagta

SEQ ID NO: 3972718 - DNA, 19 bp, Homo sapiens
aagtttacagtaaataaat

SEQ ID NO: 3972719 - DNA, 22 bp, Homo sapiens
aagtttacagtaaataaattgt

SEQ ID NO: 3972720 - DNA, 16 bp, Homo sapiens
aagtttatgtctaaag

SEQ ID NO: 3972721 - DNA, 17 bp, Homo sapiens
aagtttatgtctaaaga

SEQ ID NO: 3972722 - DNA, 17 bp, Homo sapiens
aagtttattttttctac

SEQ ID NO: 3972723 - DNA, 22 bp, Homo sapiens
aagtttcaccttgggtttgtat

SEQ ID NO: 3972724 - DNA, 21 bp, Homo sapiens
aagtttctagctagaaatatg

SEQ ID NO: 3972725 - DNA, 15 bp, Homo sapiens
aagtttgatcaaatc

SEQ ID NO: 3972726 - DNA, 17 bp, Homo sapiens
aagtttgtgctatctat

SEQ ID NO: 3972727 - DNA, 14 bp, Homo sapiens
aagtttgtttttaa

SEQ ID NO: 3972728 - DNA, 13 bp, Homo sapiens
aagttttgatgaa

SEQ ID NO: 3972729 - DNA, 12 bp, Homo sapiens
aagttttgtata

SEQ ID NO: 3972730 - DNA, 20 bp, Homo sapiens
aataaaaaaaagaaatgaaa

SEQ ID NO: 3972731 - DNA, 15 bp, Homo sapiens
aataaaaaaatacag

SEQ ID NO: 3972732 - DNA, 13 bp, Homo sapiens
aataaaaaccaga

SEQ ID NO: 3972733 - DNA, 16 bp, Homo sapiens
aataaaaaccagaatc

SEQ ID NO: 3972734 - DNA, 20 bp, Homo sapiens
aataaaacccagcatgtaca

SEQ ID NO: 3972735 - DNA, 16 bp, Homo sapiens
aataaaacctttcaaa

SEQ ID NO: 3972736 - DNA, 22 bp, Homo sapiens
aataaaacctttcaaatttcac

SEQ ID NO: 3972737 - DNA, 12 bp, Homo sapiens
aataaaagtgac

SEQ ID NO: 3972738 - DNA, 18 bp, Homo sapiens
aataaaatagtattgaaa

SEQ ID NO: 3972739 - DNA, 12 bp, Homo sapiens
aataaaatgatg

SEQ ID NO: 3972740 - DNA, 12 bp, Homo sapiens
aataaaattgta

SEQ ID NO: 3972741 - DNA, 13 bp, Homo sapiens
aataaacaaataa

SEQ ID NO: 3972742 - DNA, 21 bp, Homo sapiens
aataaacctggagatgatgat

SEQ ID NO: 3972743 - DNA, 16 bp, Homo sapiens
aataaactagtttcca

SEQ ID NO: 3972744 - DNA, 15 bp, Homo sapiens
aataaactctaaaca

SEQ ID NO: 3972745 - DNA, 17 bp, Homo sapiens
aataaacttagaataaa

SEQ ID NO: 3972746 - DNA, 22 bp, Homo sapiens
aataaacttagaataaaattgt

SEQ ID NO: 3972747 - DNA, 20 bp, Homo sapiens
aataaagaactccttatttt

SEQ ID NO: 3972748 - DNA, 21 bp, Homo sapiens
aataaagaactccttattttg

SEQ ID NO: 3972749 - DNA, 15 bp, Homo sapiens
aataaagcctgcttt

SEQ ID NO: 3972750 - DNA, 14 bp, Homo sapiens
aataaagctgctga

SEQ ID NO: 3972751 - DNA, 13 bp, Homo sapiens
aataaagctggac

SEQ ID NO: 3972752 - DNA, 22 bp, Homo sapiens
aataaagctggacaagaagctg

SEQ ID NO: 3972753 - DNA, 16 bp, Homo sapiens
aataaaggtctttgca

SEQ ID NO: 3972754 - DNA, 16 bp, Homo sapiens
aataaagtatcatgca

SEQ ID NO: 3972755 - DNA, 17 bp, Homo sapiens
aataaagtatcatgcat

SEQ ID NO: 3972756 - DNA, 13 bp, Homo sapiens
aataaatagattt

SEQ ID NO: 3972757 - DNA, 18 bp, Homo sapiens
aataaatctgagcctaaa

SEQ ID NO: 3972758 - DNA, 15 bp, Homo sapiens
aataaatggaaatca

SEQ ID NO: 3972759 - DNA, 11 bp, Homo sapiens
aataaatgttc

SEQ ID NO: 3972760 - DNA, 12 bp, Homo sapiens
aataaatgttca

SEQ ID NO: 3972761 - DNA, 18 bp, Homo sapiens
aataaatgttcaaactgt

SEQ ID NO: 3972762 - DNA, 15 bp, Homo sapiens
aataaattatattaa

SEQ ID NO: 3972763 - DNA, 18 bp, Homo sapiens
aataaattggtgataagt

SEQ ID NO: 3972764 - DNA, 20 bp, Homo sapiens
aataaattggtgataagtgg

SEQ ID NO: 3972765 - DNA, 13 bp, Homo sapiens
aataacaatgtgc

SEQ ID NO: 3972766 - DNA, 21 bp, Homo sapiens
aataactaatgctaagaaatg

SEQ ID NO: 3972767 - DNA, 22 bp, Homo sapiens
aataactaatgctaagaaatgc

SEQ ID NO: 3972768 - DNA, 15 bp, Homo sapiens
aataagaaagtttca

SEQ ID NO: 3972769 - DNA, 20 bp, Homo sapiens
aataaggctccttcatgtgg

SEQ ID NO: 3972770 - DNA, 21 bp, Homo sapiens
aataataattatccagagttt

SEQ ID NO: 3972771 - DNA, 13 bp, Homo sapiens
aataatatgattt

SEQ ID NO: 3972772 - DNA, 18 bp, Homo sapiens
aataatgtgcaaattttg

SEQ ID NO: 3972773 - DNA, 15 bp, Homo sapiens
aatgtaagaaaattt

SEQ ID NO: 3972774 - DNA, 20 bp, Homo sapiens
aatgtaagggaaactgccag

SEQ ID NO: 3972775 - DNA, 19 bp, Homo sapiens
aatgtaagggtctgttgta

SEQ ID NO: 3972776 - DNA, 23 bp, Homo sapiens
aatgtaattatgaggtgaaacaa

SEQ ID NO: 3972777 - DNA, 14 bp, Homo sapiens
aatgtatatacaca

SEQ ID NO: 3972778 - DNA, 15 bp, Homo sapiens
aatgtatatacacat

SEQ ID NO: 3972779 - DNA, 22 bp, Homo sapiens
aatgtatcatagaaatgtaact

SEQ ID NO: 3972780 - DNA, 14 bp, Homo sapiens
aatgtatcctgata

SEQ ID NO: 3972781 - DNA, 12 bp, Homo sapiens
aatgtatgtgaa

SEQ ID NO: 3972782 - DNA, 17 bp, Homo sapiens
aatgtatgtgaaagtgt

SEQ ID NO: 3972783 - DNA, 13 bp, Homo sapiens
aatgtatttatat

SEQ ID NO: 3972784 - DNA, 23 bp, Homo sapiens
aatgtcagagctatgttccctcc

SEQ ID NO: 3972785 - DNA, 14 bp, Homo sapiens
aatgtcatcaaata

SEQ ID NO: 3972786 - DNA, 18 bp, Homo sapiens
aatgtcattatgtagaaa

SEQ ID NO: 3972787 - DNA, 23 bp, Homo sapiens
aatgtgaactaagttttttactt

SEQ ID NO: 3972788 - DNA, 17 bp, Homo sapiens
aatgtgaccaggggtga

SEQ ID NO: 3972789 - DNA, 17 bp, Homo sapiens
aatgtgattccttttga

SEQ ID NO: 3972790 - DNA, 12 bp, Homo sapiens
aatgtgcaaatt

SEQ ID NO: 3972791 - DNA, 14 bp, Homo sapiens
aatgtgcaaatttt

SEQ ID NO: 3972792 - DNA, 22 bp, Homo sapiens
aatgtggatttcctattttaaa

SEQ ID NO: 3972793 - DNA, 12 bp, Homo sapiens
aatgtgtgtatg

SEQ ID NO: 3972794 - DNA, 22 bp, Homo sapiens
aatgttaaggacttctgcagct

SEQ ID NO: 3972795 - DNA, 15 bp, Homo sapiens
aatgttccctgcacc

SEQ ID NO: 3972796 - DNA, 18 bp, Homo sapiens
aatgttccctgcaccctg

SEQ ID NO: 3972797 - DNA, 20 bp, Homo sapiens
aatgttccctgcaccctgga

SEQ ID NO: 3972798 - DNA, 20 bp, Homo sapiens
aatgttcgtattctattcaa

SEQ ID NO: 3972799 - DNA, 17 bp, Homo sapiens
aatgttgggatttatat

SEQ ID NO: 3972800 - DNA, 18 bp, Homo sapiens
aatgttgggatttatatc

SEQ ID NO: 3972801 - DNA, 20 bp, Homo sapiens
aatgttgggatttatatcta

SEQ ID NO: 3972802 - DNA, 14 bp, Homo sapiens
aatgtttaaatata

SEQ ID NO: 3972803 - DNA, 23 bp, Homo sapiens
aatgtttgggcagaagggagaag

SEQ ID NO: 3972804 - DNA, 23 bp, Homo sapiens
aatgttttacaagaattgtccat

SEQ ID NO: 3972805 - DNA, 10 bp, Homo sapiens
aatgttttct

SEQ ID NO: 3972806 - DNA, 12 bp, Homo sapiens
aatgttttgtac

SEQ ID NO: 3972807 - DNA, 13 bp, Homo sapiens
aatgttttgtaca

SEQ ID NO: 3972808 - DNA, 14 bp, Homo sapiens
aatgttttgtacaa

SEQ ID NO: 3972809 - DNA, 17 bp, Homo sapiens
aatgttttgtacaatta

SEQ ID NO: 3972810 - DNA, 18 bp, Homo sapiens
aatgttttgtacaattac

SEQ ID NO: 3972811 - DNA, 18 bp, Homo sapiens
aattaaaaaaaagaagag

SEQ ID NO: 3972812 - DNA, 16 bp, Homo sapiens
aattaactatgtgatg

SEQ ID NO: 3972813 - DNA, 19 bp, Homo sapiens
aattaactatgtgatgtta

SEQ ID NO: 3972814 - DNA, 17 bp, Homo sapiens
aattaaggtttgccctg

SEQ ID NO: 3972815 - DNA, 18 bp, Homo sapiens
aattaagtaaaccaaaaa

SEQ ID NO: 3972816 - DNA, 14 bp, Homo sapiens
aattaagtgcaatt

SEQ ID NO: 3972817 - DNA, 12 bp, Homo sapiens
aattaagttatt

SEQ ID NO: 3972818 - DNA, 23 bp, Homo sapiens
aattaataaaaaatggaaagaat

SEQ ID NO: 3972819 - DNA, 14 bp, Homo sapiens
aattaatagctttt

SEQ ID NO: 3972820 - DNA, 21 bp, Homo sapiens
aattaatgtgtgtctgaagac

SEQ ID NO: 3972821 - DNA, 21 bp, Homo sapiens
aattaccttagattagctctg

SEQ ID NO: 3972822 - DNA, 16 bp, Homo sapiens
aattactaaattgtat

SEQ ID NO: 3972823 - DNA, 14 bp, Homo sapiens
aattagaacaatag

SEQ ID NO: 3972824 - DNA, 19 bp, Homo sapiens
aattagaacaatagctatt

SEQ ID NO: 3972825 - DNA, 15 bp, Homo sapiens
aattaggatctatgc

SEQ ID NO: 3972826 - DNA, 18 bp, Homo sapiens
aattaggatctatgcaat

SEQ ID NO: 3972827 - DNA, 19 bp, Homo sapiens
aattaggatctatgcaatt

SEQ ID NO: 3972828 - DNA, 20 bp, Homo sapiens
aattaggatctatgcaattt

SEQ ID NO: 3972829 - DNA, 22 bp, Homo sapiens
aattagtacagtagcttaaata

SEQ ID NO: 3972830 - DNA, 15 bp, Homo sapiens
aattataagatgtca

SEQ ID NO: 3972831 - DNA, 13 bp, Homo sapiens
aattatatctaat

SEQ ID NO: 3972832 - DNA, 15 bp, Homo sapiens
aattatatctaattt

SEQ ID NO: 3972833 - DNA, 19 bp, Homo sapiens
aattatatctaatttatac

SEQ ID NO: 3972834 - DNA, 20 bp, Homo sapiens
aattatatctaatttataca

SEQ ID NO: 3972835 - DNA, 12 bp, Homo sapiens
aattatggtgaa

SEQ ID NO: 3972836 - DNA, 18 bp, Homo sapiens
aattatgtatgtttacat

SEQ ID NO: 3972837 - DNA, 19 bp, Homo sapiens
aattattaataccaaatat

SEQ ID NO: 3972838 - DNA, 18 bp, Homo sapiens
aattattacatttataca

SEQ ID NO: 3972839 - DNA, 20 bp, Homo sapiens
aattattatgtctcaaaata

SEQ ID NO: 3972840 - DNA, 15 bp, Homo sapiens
aattattgtacacta

SEQ ID NO: 3972841 - DNA, 18 bp, Homo sapiens
aattattgtacactaaca

SEQ ID NO: 3972842 - DNA, 12 bp, Homo sapiens
aattattgtata

SEQ ID NO: 3972843 - DNA, 14 bp, Homo sapiens
aattatttaataaa

SEQ ID NO: 3972844 - DNA, 14 bp, Homo sapiens
aattatttgtgtaa

SEQ ID NO: 3972845 - DNA, 15 bp, Homo sapiens
aattatttgtgtaat

SEQ ID NO: 3972846 - DNA, 18 bp, Homo sapiens
aattattttaaacaaaat

SEQ ID NO: 3972847 - DNA, 22 bp, Homo sapiens
aattattttctttttgtaatta

SEQ ID NO: 3972848 - DNA, 12 bp, Homo sapiens
aattatttttgt

SEQ ID NO: 3972849 - DNA, 19 bp, Homo sapiens
aattatttttgtgtttcta

SEQ ID NO: 3972850 - DNA, 15 bp, Homo sapiens
aattcaaaccattta

SEQ ID NO: 3972851 - DNA, 17 bp, Homo sapiens
aattcaaaccatttaat

SEQ ID NO: 3972852 - DNA, 17 bp, Homo sapiens
aattcaacacattactt

SEQ ID NO: 3972853 - DNA, 19 bp, Homo sapiens
aattcaacacattacttgc

SEQ ID NO: 3972854 - DNA, 19 bp, Homo sapiens
aattcaaggagatataaaa

SEQ ID NO: 3972855 - DNA, 12 bp, Homo sapiens
aattcacacctt

SEQ ID NO: 3972856 - DNA, 14 bp, Homo sapiens
aattcagcaccctg

SEQ ID NO: 3972857 - DNA, 15 bp, Homo sapiens
aattcagcaccctgg

SEQ ID NO: 3972858 - DNA, 13 bp, Homo sapiens
aattcaggactgg

SEQ ID NO: 3972859 - DNA, 16 bp, Homo sapiens
aattcagtgctgtact

SEQ ID NO: 3972860 - DNA, 22 bp, Homo sapiens
acagaatgatatccagtaagca

SEQ ID NO: 3972861 - DNA, 13 bp, Homo sapiens
acagaatgatgga

SEQ ID NO: 3972862 - DNA, 16 bp, Homo sapiens
acagaatgctgtttta

SEQ ID NO: 3972863 - DNA, 16 bp, Homo sapiens
acagaatgtcaccagt

SEQ ID NO: 3972864 - DNA, 13 bp, Homo sapiens
acagaatttttaa

SEQ ID NO: 3972865 - DNA, 14 bp, Homo sapiens
acagaatttttaat

SEQ ID NO: 3972866 - DNA, 15 bp, Homo sapiens
acagaatttttaatg

SEQ ID NO: 3972867 - DNA, 18 bp, Homo sapiens
acagacactaagttatag

SEQ ID NO: 3972868 - DNA, 13 bp, Homo sapiens
acagacaggagaa

SEQ ID NO: 3972869 - DNA, 14 bp, Homo sapiens
acagacaggagaaa

SEQ ID NO: 3972870 - DNA, 21 bp, Homo sapiens
acagacaggagaaatgcatcc

SEQ ID NO: 3972871 - DNA, 17 bp, Homo sapiens
acagacattttcaataa

SEQ ID NO: 3972872 - DNA, 12 bp, Homo sapiens
acagacccacac

SEQ ID NO: 3972873 - DNA, 19 bp, Homo sapiens
acagacgtctcaagactga

SEQ ID NO: 3972874 - DNA, 16 bp, Homo sapiens
acagactccctcccct

SEQ ID NO: 3972875 - DNA, 23 bp, Homo sapiens
acagacttctggaaggctggctg

SEQ ID NO: 3972876 - DNA, 19 bp, Homo sapiens
acagagaatctgaagctat

SEQ ID NO: 3972877 - DNA, 17 bp, Homo sapiens
acagagacagagagaga

SEQ ID NO: 3972878 - DNA, 20 bp, Homo sapiens
acagagaggagttgccaggg

SEQ ID NO: 3972879 - DNA, 17 bp, Homo sapiens
acagagagtcctttggg

SEQ ID NO: 3972880 - DNA, 19 bp, Homo sapiens
acagagatgcatgcgcagg

SEQ ID NO: 3972881 - DNA, 21 bp, Homo sapiens
acagagatgcatgcgcaggct

SEQ ID NO: 3972882 - DNA, 23 bp, Homo sapiens
acagagatgcatgcgcaggctca

SEQ ID NO: 3972883 - DNA, 15 bp, Homo sapiens
acagagcccccaagc

SEQ ID NO: 3972884 - DNA, 16 bp, Homo sapiens
acagagcccccaagcc

SEQ ID NO: 3972885 - DNA, 15 bp, Homo sapiens
acagagctggctgtc

SEQ ID NO: 3972886 - DNA, 16 bp, Homo sapiens
acagagctggctgtct

SEQ ID NO: 3972887 - DNA, 16 bp, Homo sapiens
acagaggaagagcagg

SEQ ID NO: 3972888 - DNA, 17 bp, Homo sapiens
acagagtggagccctca

SEQ ID NO: 3972889 - DNA, 18 bp, Homo sapiens
acagatacatagatggac

SEQ ID NO: 3972890 - DNA, 12 bp, Homo sapiens
acagataccata

SEQ ID NO: 3972891 - DNA, 23 bp, Homo sapiens
acagatagtcaaaccataaactt

SEQ ID NO: 3972892 - DNA, 17 bp, Homo sapiens
acagatataaatggctg

SEQ ID NO: 3972893 - DNA, 23 bp, Homo sapiens
acagatcccatccatcagctccc

SEQ ID NO: 3972894 - DNA, 18 bp, Homo sapiens
acagatgataaatattta

SEQ ID NO: 3972895 - DNA, 19 bp, Homo sapiens
acagatgataaatatttat

SEQ ID NO: 3972896 - DNA, 18 bp, Homo sapiens
acagatgggtattaaact

SEQ ID NO: 3972897 - DNA, 23 bp, Homo sapiens
acagatgggtattaaacttgtca

SEQ ID NO: 3972898 - DNA, 19 bp, Homo sapiens
acagatggtcacacagaga

SEQ ID NO: 3972899 - DNA, 22 bp, Homo sapiens
acagatgtgggctttgatttcc

SEQ ID NO: 3972900 - DNA, 12 bp, Homo sapiens
acagatgttgaa

SEQ ID NO: 3972901 - DNA, 22 bp, Homo sapiens
acagattctagccaaactattc

SEQ ID NO: 3972902 - DNA, 22 bp, Homo sapiens
acagcaagccggccccccctct

SEQ ID NO: 3972903 - DNA, 15 bp, Homo sapiens
acagcacccaggctc

SEQ ID NO: 3972904 - DNA, 20 bp, Homo sapiens
acagcacccaggctccatgg

SEQ ID NO: 3972905 - DNA, 21 bp, Homo sapiens
acagcacccaggctccatggg

SEQ ID NO: 3972906 - DNA, 20 bp, Homo sapiens
acagcagccccccagcacta

SEQ ID NO: 3972907 - DNA, 19 bp, Homo sapiens
acagcagtatgaatgatgt

SEQ ID NO: 3972908 - DNA, 14 bp, Homo sapiens
acagcagtcttctt

SEQ ID NO: 3972909 - DNA, 19 bp, Homo sapiens
acagcagtgttccccatct

SEQ ID NO: 3972910 - DNA, 21 bp, Homo sapiens
acagcagttgaaaagactcca

SEQ ID NO: 3972911 - DNA, 13 bp, Homo sapiens
acagccaacaggt

SEQ ID NO: 3972912 - DNA, 13 bp, Homo sapiens
acagccagactgg

SEQ ID NO: 3972913 - DNA, 15 bp, Homo sapiens
acagccagactggca

SEQ ID NO: 3972914 - DNA, 16 bp, Homo sapiens
acagccagactggcac

SEQ ID NO: 3972915 - DNA, 17 bp, Homo sapiens
acagcccaggtcctccc

SEQ ID NO: 3972916 - DNA, 19 bp, Homo sapiens
acagccccacagcacccag

SEQ ID NO: 3972917 - DNA, 14 bp, Homo sapiens
acagccccagggcc

SEQ ID NO: 3972918 - DNA, 13 bp, Homo sapiens
acagcctctccct

SEQ ID NO: 3972919 - DNA, 11 bp, Homo sapiens
acagcctggca

SEQ ID NO: 3972920 - DNA, 12 bp, Homo sapiens
acagcctggcac

SEQ ID NO: 3972921 - DNA, 15 bp, Homo sapiens
acagcctggcacagg

SEQ ID NO: 3972922 - DNA, 14 bp, Homo sapiens
acagcgagaggcag

SEQ ID NO: 3972923 - DNA, 19 bp, Homo sapiens
acagcgagaggcagagaaa

SEQ ID NO: 3972924 - DNA, 22 bp, Homo sapiens
acagcgagaggcagagaaagaa

SEQ ID NO: 3972925 - DNA, 17 bp, Homo sapiens
acagcgcgggcggaggc

SEQ ID NO: 3972926 - DNA, 13 bp, Homo sapiens
acagcgctatgca

SEQ ID NO: 3972927 - DNA, 19 bp, Homo sapiens
acagcggcccctgcatccc

SEQ ID NO: 3972928 - DNA, 14 bp, Homo sapiens
acagctcccacccc

SEQ ID NO: 3972929 - DNA, 15 bp, Homo sapiens
acagctcccacccca

SEQ ID NO: 3972930 - DNA, 22 bp, Homo sapiens
acagctcccaccccaccccctt

SEQ ID NO: 3972931 - DNA, 23 bp, Homo sapiens
acagctcctcttaccgtagcctc

SEQ ID NO: 3972932 - DNA, 19 bp, Homo sapiens
acagctcttcactcagcca

SEQ ID NO: 3972933 - DNA, 16 bp, Homo sapiens
acagctcttggcattt

SEQ ID NO: 3972934 - DNA, 20 bp, Homo sapiens
acagctcttggcattttcct

SEQ ID NO: 3972935 - DNA, 12 bp, Homo sapiens
acagctgcagct

SEQ ID NO: 3972936 - DNA, 13 bp, Homo sapiens
acagctgcagctg

SEQ ID NO: 3972937 - DNA, 12 bp, Homo sapiens
acagctgcctgc

SEQ ID NO: 3972938 - DNA, 19 bp, Homo sapiens
acagctgcttgtcctgctc

SEQ ID NO: 3972939 - DNA, 21 bp, Homo sapiens
acagctgcttgtcctgctctc

SEQ ID NO: 3972940 - DNA, 15 bp, Homo sapiens
acagctgtgcctcgc

SEQ ID NO: 3972941 - DNA, 14 bp, Homo sapiens
acagcttgaccaga

SEQ ID NO: 3972942 - DNA, 15 bp, Homo sapiens
acagcttgaccagac

SEQ ID NO: 3972943 - DNA, 17 bp, Homo sapiens
acagcttgaccagacct

SEQ ID NO: 3972944 - DNA, 20 bp, Homo sapiens
acagcttgaccagacctaga

SEQ ID NO: 3972945 - DNA, 16 bp, Homo sapiens
acagctttacacacac

SEQ ID NO: 3972946 - DNA, 11 bp, Homo sapiens
acaggaaaaaa

SEQ ID NO: 3972947 - DNA, 13 bp, Homo sapiens
acccacagggcta

SEQ ID NO: 3972948 - DNA, 23 bp, Homo sapiens
acccacccatcttcctgctgctg

SEQ ID NO: 3972949 - DNA, 16 bp, Homo sapiens
acccaccgggccactc

SEQ ID NO: 3972950 - DNA, 18 bp, Homo sapiens
acccaccgggccactcct

SEQ ID NO: 3972951 - DNA, 13 bp, Homo sapiens
acccacctgctga

SEQ ID NO: 3972952 - DNA, 14 bp, Homo sapiens
acccactcaccagg

SEQ ID NO: 3972953 - DNA, 15 bp, Homo sapiens
acccactcaccaggg

SEQ ID NO: 3972954 - DNA, 17 bp, Homo sapiens
acccactcaccagggtc

SEQ ID NO: 3972955 - DNA, 18 bp, Homo sapiens
acccactcaccagggtcc

SEQ ID NO: 3972956 - DNA, 14 bp, Homo sapiens
acccactctttgct

SEQ ID NO: 3972957 - DNA, 12 bp, Homo sapiens
acccactggcca

SEQ ID NO: 3972958 - DNA, 17 bp, Homo sapiens
acccactggccagtcct

SEQ ID NO: 3972959 - DNA, 18 bp, Homo sapiens
acccactgtccgcctctg

SEQ ID NO: 3972960 - DNA, 18 bp, Homo sapiens
acccagaaattccttccc

SEQ ID NO: 3972961 - DNA, 19 bp, Homo sapiens
acccagaaattccttccca

SEQ ID NO: 3972962 - DNA, 23 bp, Homo sapiens
acccagagcattacgtgagccag

SEQ ID NO: 3972963 - DNA, 14 bp, Homo sapiens
acccagaggaggca

SEQ ID NO: 3972964 - DNA, 20 bp, Homo sapiens
acccagagtggagtctgagt

SEQ ID NO: 3972965 - DNA, 16 bp, Homo sapiens
acccagcatgtacaaa

SEQ ID NO: 3972966 - DNA, 18 bp, Homo sapiens
acccagctactctgtcca

SEQ ID NO: 3972967 - DNA, 19 bp, Homo sapiens
acccagctactctgtccag

SEQ ID NO: 3972968 - DNA, 20 bp, Homo sapiens
acccagctcccttcttccct

SEQ ID NO: 3972969 - DNA, 20 bp, Homo sapiens
acccaggccctccatgggct

SEQ ID NO: 3972970 - DNA, 21 bp, Homo sapiens
acccaggctctggagccagag

SEQ ID NO: 3972971 - DNA, 12 bp, Homo sapiens
acccaggctgca

SEQ ID NO: 3972972 - DNA, 20 bp, Homo sapiens
acccaggctggagtggagtg

SEQ ID NO: 3972973 - DNA, 13 bp, Homo sapiens
acccaggggtggg

SEQ ID NO: 3972974 - DNA, 12 bp, Homo sapiens
acccagtcctgg

SEQ ID NO: 3972975 - DNA, 15 bp, Homo sapiens
acccagtcctggcca

SEQ ID NO: 3972976 - DNA, 16 bp, Homo sapiens
acccagtcctggccat

SEQ ID NO: 3972977 - DNA, 22 bp, Homo sapiens
acccagtcctggccattttctt

SEQ ID NO: 3972978 - DNA, 16 bp, Homo sapiens
acccagtctgttcccc

SEQ ID NO: 3972979 - DNA, 17 bp, Homo sapiens
acccagtgctgccatgc

SEQ ID NO: 3972980 - DNA, 14 bp, Homo sapiens
acccagtgtaaaga

SEQ ID NO: 3972981 - DNA, 14 bp, Homo sapiens
acccatcagaagga

SEQ ID NO: 3972982 - DNA, 21 bp, Homo sapiens
acccatcctaccaatgcatgc

SEQ ID NO: 3972983 - DNA, 17 bp, Homo sapiens
acccatcttcctgctgc

SEQ ID NO: 3972984 - DNA, 18 bp, Homo sapiens
acccatcttcctgctgct

SEQ ID NO: 3972985 - DNA, 19 bp, Homo sapiens
acccatcttcctgctgctg

SEQ ID NO: 3972986 - DNA, 23 bp, Homo sapiens
acccatgtaaatgtccaaaatgt

SEQ ID NO: 3972987 - DNA, 22 bp, Homo sapiens
acccatgtttctgggtgggtga

SEQ ID NO: 3972988 - DNA, 19 bp, Homo sapiens
acccattcccccatgtggc

SEQ ID NO: 3972989 - DNA, 14 bp, Homo sapiens
accccaaagagcct

SEQ ID NO: 3972990 - DNA, 15 bp, Homo sapiens
accccaaagagcctg

SEQ ID NO: 3972991 - DNA, 19 bp, Homo sapiens
accccaaagagcctggaga

SEQ ID NO: 3972992 - DNA, 22 bp, Homo sapiens
accccaaagagcctggagaagc

SEQ ID NO: 3972993 - DNA, 16 bp, Homo sapiens
accccaaagccccttg

SEQ ID NO: 3972994 - DNA, 16 bp, Homo sapiens
accccaacgcacagga

SEQ ID NO: 3972995 - DNA, 14 bp, Homo sapiens
accccaagcagcat

SEQ ID NO: 3972996 - DNA, 19 bp, Homo sapiens
accccacctcatgcctggc

SEQ ID NO: 3972997 - DNA, 22 bp, Homo sapiens
accccacctcatgcctggcccc

SEQ ID NO: 3972998 - DNA, 17 bp, Homo sapiens
accccacgttctatata

SEQ ID NO: 3972999 - DNA, 13 bp, Homo sapiens
accccactccagc

SEQ ID NO: 3973000 - DNA, 17 bp, Homo sapiens
accccactccagccctg

SEQ ID NO: 3973001 - DNA, 18 bp, Homo sapiens
accccactccagccctgt

SEQ ID NO: 3973002 - DNA, 18 bp, Homo sapiens
accccagctagggctgga

SEQ ID NO: 3973003 - DNA, 16 bp, Homo sapiens
accccaggcatcccat

SEQ ID NO: 3973004 - DNA, 15 bp, Homo sapiens
accccagggcacagg

SEQ ID NO: 3973005 - DNA, 16 bp, Homo sapiens
accccagttctgctcc

SEQ ID NO: 3973006 - DNA, 23 bp, Homo sapiens
accccagttctgctcctctccag

SEQ ID NO: 3973007 - DNA, 15 bp, Homo sapiens
accccagtttttgtt

SEQ ID NO: 3973008 - DNA, 23 bp, Homo sapiens
accccatcacctactcacacagg

SEQ ID NO: 3973009 - DNA, 15 bp, Homo sapiens
accccatcccttcct

SEQ ID NO: 3973010 - DNA, 15 bp, Homo sapiens
accccatctctcttc

SEQ ID NO: 3973011 - DNA, 16 bp, Homo sapiens
accccatctctcttcc

SEQ ID NO: 3973012 - DNA, 17 bp, Homo sapiens
accccatgggcttggac

SEQ ID NO: 3973013 - DNA, 13 bp, Homo sapiens
acccccactctca

SEQ ID NO: 3973014 - DNA, 18 bp, Homo sapiens
acccccactctcattccc

SEQ ID NO: 3973015 - DNA, 21 bp, Homo sapiens
acccccactctcattccccag

SEQ ID NO: 3973016 - DNA, 13 bp, Homo sapiens
acccccagagacc

SEQ ID NO: 3973017 - DNA, 19 bp, Homo sapiens
acccccagagaccttttct

SEQ ID NO: 3973018 - DNA, 12 bp, Homo sapiens
acccccagcctg

SEQ ID NO: 3973019 - DNA, 13 bp, Homo sapiens
acccccagcctgg

SEQ ID NO: 3973020 - DNA, 14 bp, Homo sapiens
acccccagcctggg

SEQ ID NO: 3973021 - DNA, 16 bp, Homo sapiens
acccccagcctgggcc

SEQ ID NO: 3973022 - DNA, 15 bp, Homo sapiens
acccccagtgccaca

SEQ ID NO: 3973023 - DNA, 22 bp, Homo sapiens
acccccgagtttggtccctggg

SEQ ID NO: 3973024 - DNA, 14 bp, Homo sapiens
acccccgccacggc

SEQ ID NO: 3973025 - DNA, 20 bp, Homo sapiens
acccccgccacggccaccct

SEQ ID NO: 3973026 - DNA, 14 bp, Homo sapiens
acccccgctccaga

SEQ ID NO: 3973027 - DNA, 18 bp, Homo sapiens
accccctcattcccctcg

SEQ ID NO: 3973028 - DNA, 14 bp, Homo sapiens
accccctccagctc

SEQ ID NO: 3973029 - DNA, 15 bp, Homo sapiens
accccctccagctcc

SEQ ID NO: 3973030 - DNA, 13 bp, Homo sapiens
accccctccccag

SEQ ID NO: 3973031 - DNA, 16 bp, Homo sapiens
accccctccccagggg

SEQ ID NO: 3973032 - DNA, 12 bp, Homo sapiens
accccctggaga

SEQ ID NO: 3973033 - DNA, 20 bp, Homo sapiens
accccgcctcccagccccag

SEQ ID NO: 3973034 - DNA, 14 bp, Homo sapiens
accttttataccag

SEQ ID NO: 3973035 - DNA, 22 bp, Homo sapiens
accttttccaggagttctgaag

SEQ ID NO: 3973036 - DNA, 14 bp, Homo sapiens
accttttctctccc

SEQ ID NO: 3973037 - DNA, 18 bp, Homo sapiens
acctttttttctctccta

SEQ ID NO: 3973038 - DNA, 17 bp, Homo sapiens
acgaacccactgtgctt

SEQ ID NO: 3973039 - DNA, 19 bp, Homo sapiens
acgaatttggtgtggctgt

SEQ ID NO: 3973040 - DNA, 17 bp, Homo sapiens
acgactccgagaacaac

SEQ ID NO: 3973041 - DNA, 17 bp, Homo sapiens
acgagtcaatcccctca

SEQ ID NO: 3973042 - DNA, 13 bp, Homo sapiens
acgagtcacctgc

SEQ ID NO: 3973043 - DNA, 16 bp, Homo sapiens
acgagtcacctgcaag

SEQ ID NO: 3973044 - DNA, 14 bp, Homo sapiens
acgatgaaaaactt

SEQ ID NO: 3973045 - DNA, 23 bp, Homo sapiens
acgcaagggagaagaaatccata

SEQ ID NO: 3973046 - DNA, 18 bp, Homo sapiens
acgcaagggcatcaggca

SEQ ID NO: 3973047 - DNA, 15 bp, Homo sapiens
acgcacacatggaca

SEQ ID NO: 3973048 - DNA, 20 bp, Homo sapiens
acgcacgcaacccttgctgc

SEQ ID NO: 3973049 - DNA, 22 bp, Homo sapiens
acgcagccctgctttgggctgc

SEQ ID NO: 3973050 - DNA, 23 bp, Homo sapiens
acgcagccctgctttgggctgcc

SEQ ID NO: 3973051 - DNA, 16 bp, Homo sapiens
acgcaggaactcccag

SEQ ID NO: 3973052 - DNA, 17 bp, Homo sapiens
acgccaaagtgcagccc

SEQ ID NO: 3973053 - DNA, 18 bp, Homo sapiens
acgccaaagtgcagccct

SEQ ID NO: 3973054 - DNA, 19 bp, Homo sapiens
acgccaaagtgcagccctt

SEQ ID NO: 3973055 - DNA, 22 bp, Homo sapiens
acgccaaagtgcagcccttcct

SEQ ID NO: 3973056 - DNA, 14 bp, Homo sapiens
acgccaacagcccc

SEQ ID NO: 3973057 - DNA, 13 bp, Homo sapiens
acgccctattttt

SEQ ID NO: 3973058 - DNA, 12 bp, Homo sapiens
acgcctcctggc

SEQ ID NO: 3973059 - DNA, 16 bp, Homo sapiens
acgcctcctggccaga

SEQ ID NO: 3973060 - DNA, 19 bp, Homo sapiens
acgcctcttttccctctct

SEQ ID NO: 3973061 - DNA, 11 bp, Homo sapiens
acgcctgagcc

SEQ ID NO: 3973062 - DNA, 12 bp, Homo sapiens
acgcctgagccc

SEQ ID NO: 3973063 - DNA, 17 bp, Homo sapiens
acgcctgagcccaggga

SEQ ID NO: 3973064 - DNA, 16 bp, Homo sapiens
acgcctgtaatcccag

SEQ ID NO: 3973065 - DNA, 17 bp, Homo sapiens
acgcctgtaatcccagc

SEQ ID NO: 3973066 - DNA, 19 bp, Homo sapiens
acgcctgtaatcccagcag

SEQ ID NO: 3973067 - DNA, 14 bp, Homo sapiens
acgcgcacacacac

SEQ ID NO: 3973068 - DNA, 17 bp, Homo sapiens
acgcgggctgtgcctta

SEQ ID NO: 3973069 - DNA, 18 bp, Homo sapiens
acgcgggctgtgccttac

SEQ ID NO: 3973070 - DNA, 22 bp, Homo sapiens
acgctctcctttctttctaact

SEQ ID NO: 3973071 - DNA, 13 bp, Homo sapiens
acgctctggacat

SEQ ID NO: 3973072 - DNA, 12 bp, Homo sapiens
acgctcttagct

SEQ ID NO: 3973073 - DNA, 22 bp, Homo sapiens
acgctgccgctgccgctgcacc

SEQ ID NO: 3973074 - DNA, 20 bp, Homo sapiens
acgcttaacctttccgctgt

SEQ ID NO: 3973075 - DNA, 15 bp, Homo sapiens
acgcttccagaccac

SEQ ID NO: 3973076 - DNA, 16 bp, Homo sapiens
acgcttccagaccacc

SEQ ID NO: 3973077 - DNA, 17 bp, Homo sapiens
acgcttccagaccacct

SEQ ID NO: 3973078 - DNA, 22 bp, Homo sapiens
acggaagaagagatcaggaaga

SEQ ID NO: 3973079 - DNA, 16 bp, Homo sapiens
acggacgtttccatca

SEQ ID NO: 3973080 - DNA, 22 bp, Homo sapiens
acggagagtgcttgggtggtgg

SEQ ID NO: 3973081 - DNA, 11 bp, Homo sapiens
acggcagctgt

SEQ ID NO: 3973082 - DNA, 23 bp, Homo sapiens
acggcatgtgaattctgtgaaga

SEQ ID NO: 3973083 - DNA, 21 bp, Homo sapiens
acggccttcaactgaaaagac

SEQ ID NO: 3973084 - DNA, 23 bp, Homo sapiens
acggcgcacctatcacccaggct

SEQ ID NO: 3973085 - DNA, 13 bp, Homo sapiens
acggcgttttttt

SEQ ID NO: 3973086 - DNA, 14 bp, Homo sapiens
acggctggacctgc

SEQ ID NO: 3973087 - DNA, 13 bp, Homo sapiens
acggcttcaggcc

SEQ ID NO: 3973088 - DNA, 19 bp, Homo sapiens
acgggaagcaacctcccaa

SEQ ID NO: 3973089 - DNA, 16 bp, Homo sapiens
acgggagcctcctctg

SEQ ID NO: 3973090 - DNA, 15 bp, Homo sapiens
acgggaggcctcagt

SEQ ID NO: 3973091 - DNA, 14 bp, Homo sapiens
acgggcctcagttt

SEQ ID NO: 3973092 - DNA, 16 bp, Homo sapiens
acgggcctcagtttcc

SEQ ID NO: 3973093 - DNA, 13 bp, Homo sapiens
acggggaggggga

SEQ ID NO: 3973094 - DNA, 18 bp, Homo sapiens
acgggggtgcggcaggag

SEQ ID NO: 3973095 - DNA, 21 bp, Homo sapiens
acgggggtgcggcaggagcag

SEQ ID NO: 3973096 - DNA, 23 bp, Homo sapiens
acgggtctcacttataccaaagg

SEQ ID NO: 3973097 - DNA, 18 bp, Homo sapiens
acggtcctttaggcagcc

SEQ ID NO: 3973098 - DNA, 21 bp, Homo sapiens
acggtggggcgtagacttgac

SEQ ID NO: 3973099 - DNA, 18 bp, Homo sapiens
acggttaacttgtatatt

SEQ ID NO: 3973100 - DNA, 23 bp, Homo sapiens
acgtaatgtatttatatgttaat

SEQ ID NO: 3973101 - DNA, 18 bp, Homo sapiens
acgtataaatatgaaatg

SEQ ID NO: 3973102 - DNA, 16 bp, Homo sapiens
acgtattggtccagct

SEQ ID NO: 3973103 - DNA, 17 bp, Homo sapiens
acgtatttatatttgga

SEQ ID NO: 3973104 - DNA, 22 bp, Homo sapiens
acgtatttatatttggaaagag

SEQ ID NO: 3973105 - DNA, 21 bp, Homo sapiens
acgtcctgctggcacctcaga

SEQ ID NO: 3973106 - DNA, 23 bp, Homo sapiens
acgtcctgctggcacctcagaca

SEQ ID NO: 3973107 - DNA, 15 bp, Homo sapiens
acgtctcaagactga

SEQ ID NO: 3973108 - DNA, 17 bp, Homo sapiens
acgtctcaagactgaaa

SEQ ID NO: 3973109 - DNA, 12 bp, Homo sapiens
acgtctgccagg

SEQ ID NO: 3973110 - DNA, 19 bp, Homo sapiens
acgtctgccaggcccatct

SEQ ID NO: 3973111 - DNA, 19 bp, Homo sapiens
acgtgaaagatgcaagcac

SEQ ID NO: 3973112 - DNA, 15 bp, Homo sapiens
acgtgaaatatttaa

SEQ ID NO: 3973113 - DNA, 18 bp, Homo sapiens
acgtgactgccccaactc

SEQ ID NO: 3973114 - DNA, 20 bp, Homo sapiens
acgtgactgccccaactcct

SEQ ID NO: 3973115 - DNA, 14 bp, Homo sapiens
acgtgccaggcccg

SEQ ID NO: 3973116 - DNA, 23 bp, Homo sapiens
acgtgcctgtgatcccagctact

SEQ ID NO: 3973117 - DNA, 11 bp, Homo sapiens
acgtgggagac

SEQ ID NO: 3973118 - DNA, 18 bp, Homo sapiens
acgtgggtatttcctgct

SEQ ID NO: 3973119 - DNA, 19 bp, Homo sapiens
acgtgggtatttcctgcta

SEQ ID NO: 3973120 - DNA, 14 bp, Homo sapiens
acgttaaaagacag

SEQ ID NO: 3973121 - DNA, 18 bp, Homo sapiens
actgcagatagccagaca

SEQ ID NO: 3973122 - DNA, 15 bp, Homo sapiens
actgcaggccccgct

SEQ ID NO: 3973123 - DNA, 16 bp, Homo sapiens
actgcagggactgcca

SEQ ID NO: 3973124 - DNA, 19 bp, Homo sapiens
actgcatatcggaggtggt

SEQ ID NO: 3973125 - DNA, 17 bp, Homo sapiens
actgccaggcacctggc

SEQ ID NO: 3973126 - DNA, 18 bp, Homo sapiens
actgccaggcacctggcc

SEQ ID NO: 3973127 - DNA, 19 bp, Homo sapiens
actgccagtccccctgccc

SEQ ID NO: 3973128 - DNA, 19 bp, Homo sapiens
actgcccaggcctgcctgt

SEQ ID NO: 3973129 - DNA, 16 bp, Homo sapiens
actgcccagtttcttt

SEQ ID NO: 3973130 - DNA, 12 bp, Homo sapiens
actgccctgcct

SEQ ID NO: 3973131 - DNA, 17 bp, Homo sapiens
actgccctgcctgccca

SEQ ID NO: 3973132 - DNA, 13 bp, Homo sapiens
actgcctagtgta

SEQ ID NO: 3973133 - DNA, 14 bp, Homo sapiens
actgcctgcttggg

SEQ ID NO: 3973134 - DNA, 12 bp, Homo sapiens
actgcctttgga

SEQ ID NO: 3973135 - DNA, 19 bp, Homo sapiens
actgctaaatactgtacat

SEQ ID NO: 3973136 - DNA, 21 bp, Homo sapiens
actgctctgaatattttgtaa

SEQ ID NO: 3973137 - DNA, 11 bp, Homo sapiens
actgctctgcc

SEQ ID NO: 3973138 - DNA, 14 bp, Homo sapiens
actgctgagccact

SEQ ID NO: 3973139 - DNA, 20 bp, Homo sapiens
actgctgcaaagtgcaaata

SEQ ID NO: 3973140 - DNA, 16 bp, Homo sapiens
actgctgcccagcctc

SEQ ID NO: 3973141 - DNA, 13 bp, Homo sapiens
actgctggctgcc

SEQ ID NO: 3973142 - DNA, 15 bp, Homo sapiens
actgctggctgcctt

SEQ ID NO: 3973143 - DNA, 15 bp, Homo sapiens
actgctttccagcct

SEQ ID NO: 3973144 - DNA, 20 bp, Homo sapiens
actgctttccagcctgggca

SEQ ID NO: 3973145 - DNA, 21 bp, Homo sapiens
actggaagcatgtaggagaat

SEQ ID NO: 3973146 - DNA, 16 bp, Homo sapiens
actggaccactgggca

SEQ ID NO: 3973147 - DNA, 13 bp, Homo sapiens
actggagcaccag

SEQ ID NO: 3973148 - DNA, 13 bp, Homo sapiens
actggagcactga

SEQ ID NO: 3973149 - DNA, 13 bp, Homo sapiens
actggagcatctg

SEQ ID NO: 3973150 - DNA, 14 bp, Homo sapiens
actggagcatctga

SEQ ID NO: 3973151 - DNA, 17 bp, Homo sapiens
actggagcatctgactc

SEQ ID NO: 3973152 - DNA, 19 bp, Homo sapiens
actggagtgaggcttccag

SEQ ID NO: 3973153 - DNA, 18 bp, Homo sapiens
actggagtgcagggagga

SEQ ID NO: 3973154 - DNA, 17 bp, Homo sapiens
actggagttacattaat

SEQ ID NO: 3973155 - DNA, 13 bp, Homo sapiens
actggcacagttt

SEQ ID NO: 3973156 - DNA, 19 bp, Homo sapiens
actggcacagttttctgag

SEQ ID NO: 3973157 - DNA, 20 bp, Homo sapiens
actggcacagttttctgaga

SEQ ID NO: 3973158 - DNA, 13 bp, Homo sapiens
actggcagctcct

SEQ ID NO: 3973159 - DNA, 12 bp, Homo sapiens
actggcaggtgc

SEQ ID NO: 3973160 - DNA, 18 bp, Homo sapiens
actggcattaattattaa

SEQ ID NO: 3973161 - DNA, 20 bp, Homo sapiens
actggcattaattattaata

SEQ ID NO: 3973162 - DNA, 18 bp, Homo sapiens
actggccagtcctagagc

SEQ ID NO: 3973163 - DNA, 19 bp, Homo sapiens
actggccagtcctagagct

SEQ ID NO: 3973164 - DNA, 21 bp, Homo sapiens
actggccagtcctagagctcc

SEQ ID NO: 3973165 - DNA, 22 bp, Homo sapiens
actggctcacccctctcccccg

SEQ ID NO: 3973166 - DNA, 11 bp, Homo sapiens
actggctgggg

SEQ ID NO: 3973167 - DNA, 14 bp, Homo sapiens
actggctggggcag

SEQ ID NO: 3973168 - DNA, 17 bp, Homo sapiens
actggctggggcagagg

SEQ ID NO: 3973169 - DNA, 11 bp, Homo sapiens
actgggaaggc

SEQ ID NO: 3973170 - DNA, 15 bp, Homo sapiens
actgggaccaggcac

SEQ ID NO: 3973171 - DNA, 17 bp, Homo sapiens
actggggatgtgggagg

SEQ ID NO: 3973172 - DNA, 16 bp, Homo sapiens
actgggtctcactcct

SEQ ID NO: 3973173 - DNA, 23 bp, Homo sapiens
actgggttatttttgtccctgct

SEQ ID NO: 3973174 - DNA, 13 bp, Homo sapiens
actgggttgactt

SEQ ID NO: 3973175 - DNA, 15 bp, Homo sapiens
actgggttgtccagg

SEQ ID NO: 3973176 - DNA, 18 bp, Homo sapiens
actggtccactcagggct

SEQ ID NO: 3973177 - DNA, 23 bp, Homo sapiens
actggtccactcagggctgccac

SEQ ID NO: 3973178 - DNA, 20 bp, Homo sapiens
actggtggcccgacagcctg

SEQ ID NO: 3973179 - DNA, 18 bp, Homo sapiens
actggtgttaagatatat

SEQ ID NO: 3973180 - DNA, 18 bp, Homo sapiens
actggttcaagagacact

SEQ ID NO: 3973181 - DNA, 22 bp, Homo sapiens
actggtttatccacccacaaca

SEQ ID NO: 3973182 - DNA, 23 bp, Homo sapiens
actgtaaatatgtttgtgcctta

SEQ ID NO: 3973183 - DNA, 14 bp, Homo sapiens
actgtaaatcactt

SEQ ID NO: 3973184 - DNA, 23 bp, Homo sapiens
actgtaaatcacttgtaaataaa

SEQ ID NO: 3973185 - DNA, 21 bp, Homo sapiens
actgtaagactcattccctag

SEQ ID NO: 3973186 - DNA, 22 bp, Homo sapiens
actgtaagtttattttttctac

SEQ ID NO: 3973187 - DNA, 14 bp, Homo sapiens
actgtaatcttaaa

SEQ ID NO: 3973188 - DNA, 18 bp, Homo sapiens
actgtaatcttaaaagtg

SEQ ID NO: 3973189 - DNA, 20 bp, Homo sapiens
actgtaattttgtttgtaat

SEQ ID NO: 3973190 - DNA, 17 bp, Homo sapiens
actgtacatagatgtat

SEQ ID NO: 3973191 - DNA, 20 bp, Homo sapiens
actgtactcctcccaggcgc

SEQ ID NO: 3973192 - DNA, 22 bp, Homo sapiens
actgtagcctcgccgtctgtga

SEQ ID NO: 3973193 - DNA, 16 bp, Homo sapiens
actgtatcaaatctgt

SEQ ID NO: 3973194 - DNA, 23 bp, Homo sapiens
actgtcaagtcatgatggagact

SEQ ID NO: 3973195 - DNA, 14 bp, Homo sapiens
actgtcaccctcca

SEQ ID NO: 3973196 - DNA, 13 bp, Homo sapiens
actgtcagagctg

SEQ ID NO: 3973197 - DNA, 23 bp, Homo sapiens
actgtcagctcccctcggagaag

SEQ ID NO: 3973198 - DNA, 15 bp, Homo sapiens
actgtccgcctctgc

SEQ ID NO: 3973199 - DNA, 19 bp, Homo sapiens
actgtcgtgtttacaaaag

SEQ ID NO: 3973200 - DNA, 23 bp, Homo sapiens
actgtctcaagagggcactggtg

SEQ ID NO: 3973201 - DNA, 17 bp, Homo sapiens
actgtctggttttaaca

SEQ ID NO: 3973202 - DNA, 14 bp, Homo sapiens
actgtcttcacaac

SEQ ID NO: 3973203 - DNA, 23 bp, Homo sapiens
actgtgactctttttagggccag

SEQ ID NO: 3973204 - DNA, 11 bp, Homo sapiens
actgtgactga

SEQ ID NO: 3973205 - DNA, 16 bp, Homo sapiens
actgtggccagagctg

SEQ ID NO: 3973206 - DNA, 21 bp, Homo sapiens
actgtggccagagctggaagg

SEQ ID NO: 3973207 - DNA, 20 bp, Homo sapiens
actgtgttggccaggctggt

SEQ ID NO: 3973208 - DNA, 12 bp, Homo sapiens
acttggagcccg

SEQ ID NO: 3973209 - DNA, 14 bp, Homo sapiens
acttggagcccgtg

SEQ ID NO: 3973210 - DNA, 21 bp, Homo sapiens
acttgggaggctgaggcagga

SEQ ID NO: 3973211 - DNA, 20 bp, Homo sapiens
acttgggcacccccagcctg

SEQ ID NO: 3973212 - DNA, 23 bp, Homo sapiens
acttgggcacccccagcctgggc

SEQ ID NO: 3973213 - DNA, 15 bp, Homo sapiens
acttgggtcttccct

SEQ ID NO: 3973214 - DNA, 20 bp, Homo sapiens
acttggtttttggctctttc

SEQ ID NO: 3973215 - DNA, 19 bp, Homo sapiens
acttgtaaataaatagatt

SEQ ID NO: 3973216 - DNA, 20 bp, Homo sapiens
acttgtacaaaataaacaaa

SEQ ID NO: 3973217 - DNA, 18 bp, Homo sapiens
acttgtactatgttaata

SEQ ID NO: 3973218 - DNA, 13 bp, Homo sapiens
acttgtagaaatc

SEQ ID NO: 3973219 - DNA, 16 bp, Homo sapiens
acttgtagaaatctgt

SEQ ID NO: 3973220 - DNA, 19 bp, Homo sapiens
acttgtagaaatctgtaat

SEQ ID NO: 3973221 - DNA, 14 bp, Homo sapiens
acttgtataaatgt

SEQ ID NO: 3973222 - DNA, 14 bp, Homo sapiens
acttgtatattcca

SEQ ID NO: 3973223 - DNA, 20 bp, Homo sapiens
acttgtatattccaccattc

SEQ ID NO: 3973224 - DNA, 22 bp, Homo sapiens
acttgtcactatgctatttctg

SEQ ID NO: 3973225 - DNA, 16 bp, Homo sapiens
acttgtgactgaaggg

SEQ ID NO: 3973226 - DNA, 15 bp, Homo sapiens
acttgtgttctatta

SEQ ID NO: 3973227 - DNA, 17 bp, Homo sapiens
acttgttacctttccca

SEQ ID NO: 3973228 - DNA, 16 bp, Homo sapiens
actttaaaataaaaaa

SEQ ID NO: 3973229 - DNA, 12 bp, Homo sapiens
actttaaagtct

SEQ ID NO: 3973230 - DNA, 21 bp, Homo sapiens
actttaaagtctttccgtctc

SEQ ID NO: 3973231 - DNA, 15 bp, Homo sapiens
actttaaccctctct

SEQ ID NO: 3973232 - DNA, 18 bp, Homo sapiens
actttaaccctctcttcc

SEQ ID NO: 3973233 - DNA, 17 bp, Homo sapiens
actttaagactgagcac

SEQ ID NO: 3973234 - DNA, 15 bp, Homo sapiens
actttaagagagaaa

SEQ ID NO: 3973235 - DNA, 19 bp, Homo sapiens
actttaatactcacctcct

SEQ ID NO: 3973236 - DNA, 20 bp, Homo sapiens
actttaatactcacctcctc

SEQ ID NO: 3973237 - DNA, 19 bp, Homo sapiens
actttaattctcatgtgat

SEQ ID NO: 3973238 - DNA, 21 bp, Homo sapiens
actttacactctctgtacaaa

SEQ ID NO: 3973239 - DNA, 14 bp, Homo sapiens
actttacaggaggt

SEQ ID NO: 3973240 - DNA, 15 bp, Homo sapiens
actttagaatgagag

SEQ ID NO: 3973241 - DNA, 15 bp, Homo sapiens
actttagagtagcat

SEQ ID NO: 3973242 - DNA, 22 bp, Homo sapiens
actttatctgtgaccacacgct

SEQ ID NO: 3973243 - DNA, 18 bp, Homo sapiens
actttcaggtactaaata

SEQ ID NO: 3973244 - DNA, 16 bp, Homo sapiens
actttcctacaaaatg

SEQ ID NO: 3973245 - DNA, 18 bp, Homo sapiens
actttcctacaaaatgga

SEQ ID NO: 3973246 - DNA, 18 bp, Homo sapiens
actttctgtaaactcaaa

SEQ ID NO: 3973247 - DNA, 19 bp, Homo sapiens
actttctgtaaactcaaaa

SEQ ID NO: 3973248 - DNA, 16 bp, Homo sapiens
actttgaggtgtctca

SEQ ID NO: 3973249 - DNA, 18 bp, Homo sapiens
actttgatctctgcttac

SEQ ID NO: 3973250 - DNA, 17 bp, Homo sapiens
actttgctctttcttga

SEQ ID NO: 3973251 - DNA, 17 bp, Homo sapiens
actttggaatgactata

SEQ ID NO: 3973252 - DNA, 18 bp, Homo sapiens
actttggccaagcaagag

SEQ ID NO: 3973253 - DNA, 15 bp, Homo sapiens
actttgggaggccaa

SEQ ID NO: 3973254 - DNA, 14 bp, Homo sapiens
actttgtgcctttg

SEQ ID NO: 3973255 - DNA, 21 bp, Homo sapiens
acttttccatgtatctacctc

SEQ ID NO: 3973256 - DNA, 20 bp, Homo sapiens
acttttggataatatccact

SEQ ID NO: 3973257 - DNA, 18 bp, Homo sapiens
acttttgttctgtatttt

SEQ ID NO: 3973258 - DNA, 21 bp, Homo sapiens
actttttatactccatacata

SEQ ID NO: 3973259 - DNA, 21 bp, Homo sapiens
actttttcagagttgctttaa

SEQ ID NO: 3973260 - DNA, 21 bp, Homo sapiens
acttttttttttttttttaaa

SEQ ID NO: 3973261 - DNA, 13 bp, Homo sapiens
agaaaaaataaat

SEQ ID NO: 3973262 - DNA, 14 bp, Homo sapiens
agaaaaagaaatgc

SEQ ID NO: 3973263 - DNA, 20 bp, Homo sapiens
agaaaaagctcctgtcctcc

SEQ ID NO: 3973264 - DNA, 16 bp, Homo sapiens
agaaaaccattttagt

SEQ ID NO: 3973265 - DNA, 13 bp, Homo sapiens
agaaaactaacaa

SEQ ID NO: 3973266 - DNA, 15 bp, Homo sapiens
agaaaactgaaaatc

SEQ ID NO: 3973267 - DNA, 20 bp, Homo sapiens
agaaaagaacgtattttaaa

SEQ ID NO: 3973268 - DNA, 13 bp, Homo sapiens
agaaaagaccctg

SEQ ID NO: 3973269 - DNA, 14 bp, Homo sapiens
agaaaagaccctga

SEQ ID NO: 3973270 - DNA, 15 bp, Homo sapiens
agaaaagataaagat

SEQ ID NO: 3973271 - DNA, 17 bp, Homo sapiens
agaaaagataaagatga

SEQ ID NO: 3973272 - DNA, 15 bp, Homo sapiens
agaaaagcacctgcc

SEQ ID NO: 3973273 - DNA, 23 bp, Homo sapiens
agaaaagtagaattatatctaat

SEQ ID NO: 3973274 - DNA, 12 bp, Homo sapiens
agaaaatataaa

SEQ ID NO: 3973275 - DNA, 14 bp, Homo sapiens
agaaaatataaatg

SEQ ID NO: 3973276 - DNA, 16 bp, Homo sapiens
agaaaatgaagcccta

SEQ ID NO: 3973277 - DNA, 14 bp, Homo sapiens
agaaaattagtaat

SEQ ID NO: 3973278 - DNA, 21 bp, Homo sapiens
agaaaatttgaagtaaaggat

SEQ ID NO: 3973279 - DNA, 15 bp, Homo sapiens
agaaacagagacagg

SEQ ID NO: 3973280 - DNA, 19 bp, Homo sapiens
agaaacagagacaggccca

SEQ ID NO: 3973281 - DNA, 15 bp, Homo sapiens
agaaacagagagaga

SEQ ID NO: 3973282 - DNA, 17 bp, Homo sapiens
agaaacagagagagaca

SEQ ID NO: 3973283 - DNA, 21 bp, Homo sapiens
agaaacagataccatactcat

SEQ ID NO: 3973284 - DNA, 12 bp, Homo sapiens
agaaacatgaca

SEQ ID NO: 3973285 - DNA, 15 bp, Homo sapiens
agaaacatgacactg

SEQ ID NO: 3973286 - DNA, 13 bp, Homo sapiens
agaaaccccaggg

SEQ ID NO: 3973287 - DNA, 23 bp, Homo sapiens
agaaacctgaggatgcaacaaat

SEQ ID NO: 3973288 - DNA, 20 bp, Homo sapiens
agaaactccttttgctgtct

SEQ ID NO: 3973289 - DNA, 21 bp, Homo sapiens
agaaactccttttgctgtctt

SEQ ID NO: 3973290 - DNA, 22 bp, Homo sapiens
agaaactccttttgctgtcttt

SEQ ID NO: 3973291 - DNA, 16 bp, Homo sapiens
agaaactgaggaattt

SEQ ID NO: 3973292 - DNA, 18 bp, Homo sapiens
agaaactgaggaattttc

SEQ ID NO: 3973293 - DNA, 13 bp, Homo sapiens
agaaactgaggag

SEQ ID NO: 3973294 - DNA, 19 bp, Homo sapiens
agaaagaaaagaccctgag

SEQ ID NO: 3973295 - DNA, 18 bp, Homo sapiens
agacgctcaagaatcctc

SEQ ID NO: 3973296 - DNA, 16 bp, Homo sapiens
agacgctgccgctgcc

SEQ ID NO: 3973297 - DNA, 13 bp, Homo sapiens
agacggctggacc

SEQ ID NO: 3973298 - DNA, 23 bp, Homo sapiens
agacgggatttgaagctgtaccc

SEQ ID NO: 3973299 - DNA, 15 bp, Homo sapiens
agacggtgctcgctt

SEQ ID NO: 3973300 - DNA, 18 bp, Homo sapiens
agacgtgaatgtctcagc

SEQ ID NO: 3973301 - DNA, 13 bp, Homo sapiens
agacgtgtacata

SEQ ID NO: 3973302 - DNA, 21 bp, Homo sapiens
agacgtttttgtgctgtgggc

SEQ ID NO: 3973303 - DNA, 12 bp, Homo sapiens
agactaaatgaa

SEQ ID NO: 3973304 - DNA, 13 bp, Homo sapiens
agactaagccctg

SEQ ID NO: 3973305 - DNA, 14 bp, Homo sapiens
agactaagccctgt

SEQ ID NO: 3973306 - DNA, 19 bp, Homo sapiens
agactaattcctgccctgc

SEQ ID NO: 3973307 - DNA, 15 bp, Homo sapiens
agactaatttaaaaa

SEQ ID NO: 3973308 - DNA, 19 bp, Homo sapiens
agactataaagcagtagac

SEQ ID NO: 3973309 - DNA, 13 bp, Homo sapiens
agactatatacat

SEQ ID NO: 3973310 - DNA, 15 bp, Homo sapiens
agactatatacatgt

SEQ ID NO: 3973311 - DNA, 16 bp, Homo sapiens
agactattaagagcaa

SEQ ID NO: 3973312 - DNA, 15 bp, Homo sapiens
agactattcaaacag

SEQ ID NO: 3973313 - DNA, 21 bp, Homo sapiens
agactattcaaacagtctcag

SEQ ID NO: 3973314 - DNA, 14 bp, Homo sapiens
agactcacctctgc

SEQ ID NO: 3973315 - DNA, 15 bp, Homo sapiens
agactcacctctgcc

SEQ ID NO: 3973316 - DNA, 16 bp, Homo sapiens
agactcacctctgcct

SEQ ID NO: 3973317 - DNA, 15 bp, Homo sapiens
agactcagctccaga

SEQ ID NO: 3973318 - DNA, 17 bp, Homo sapiens
agactcagctccagaat

SEQ ID NO: 3973319 - DNA, 12 bp, Homo sapiens
agactccaaaga

SEQ ID NO: 3973320 - DNA, 22 bp, Homo sapiens
agactccagaatctgctgttgc

SEQ ID NO: 3973321 - DNA, 15 bp, Homo sapiens
agactcctgccctgt

SEQ ID NO: 3973322 - DNA, 14 bp, Homo sapiens
agactctcttagga

SEQ ID NO: 3973323 - DNA, 13 bp, Homo sapiens
agactctggaagc

SEQ ID NO: 3973324 - DNA, 20 bp, Homo sapiens
agactctgggtccctcggag

SEQ ID NO: 3973325 - DNA, 13 bp, Homo sapiens
agactgagaggca

SEQ ID NO: 3973326 - DNA, 17 bp, Homo sapiens
agactgagggagagact

SEQ ID NO: 3973327 - DNA, 21 bp, Homo sapiens
agactgcaagaggctcctgtc

SEQ ID NO: 3973328 - DNA, 11 bp, Homo sapiens
agactgcagct

SEQ ID NO: 3973329 - DNA, 15 bp, Homo sapiens
agactgcagctgctg

SEQ ID NO: 3973330 - DNA, 18 bp, Homo sapiens
agactggagcatctgact

SEQ ID NO: 3973331 - DNA, 16 bp, Homo sapiens
agactggagtgaggct

SEQ ID NO: 3973332 - DNA, 15 bp, Homo sapiens
agactggcacagttt

SEQ ID NO: 3973333 - DNA, 20 bp, Homo sapiens
agactgggaccttagaaatc

SEQ ID NO: 3973334 - DNA, 17 bp, Homo sapiens
agactggtcctgtgtgc

SEQ ID NO: 3973335 - DNA, 14 bp, Homo sapiens
agactgtctcaaga

SEQ ID NO: 3973336 - DNA, 19 bp, Homo sapiens
agacttccaaacctgacag

SEQ ID NO: 3973337 - DNA, 20 bp, Homo sapiens
agacttccaaacctgacaga

SEQ ID NO: 3973338 - DNA, 19 bp, Homo sapiens
agacttctggaaggctggc

SEQ ID NO: 3973339 - DNA, 20 bp, Homo sapiens
agacttctggaaggctggct

SEQ ID NO: 3973340 - DNA, 23 bp, Homo sapiens
agacttctggaaggctggctgag

SEQ ID NO: 3973341 - DNA, 19 bp, Homo sapiens
agacttgacaacatcccac

SEQ ID NO: 3973342 - DNA, 20 bp, Homo sapiens
agacttgacaacatcccaca

SEQ ID NO: 3973343 - DNA, 14 bp, Homo sapiens
agacttgccaggct

SEQ ID NO: 3973344 - DNA, 18 bp, Homo sapiens
agacttggcaacagaagc

SEQ ID NO: 3973345 - DNA, 18 bp, Homo sapiens
agacttgtatgaaagatg

SEQ ID NO: 3973346 - DNA, 10 bp, Homo sapiens
agactttaaa

SEQ ID NO: 3973347 - DNA, 17 bp, Homo sapiens
agactttctacacctgt

SEQ ID NO: 3973348 - DNA, 18 bp, Homo sapiens
agacttttaatcagacaa

SEQ ID NO: 3973349 - DNA, 13 bp, Homo sapiens
agagaaaaagaaa

SEQ ID NO: 3973350 - DNA, 14 bp, Homo sapiens
agagaaaaagaaat

SEQ ID NO: 3973351 - DNA, 21 bp, Homo sapiens
agagaaaaagaaatgcaaaaa

SEQ ID NO: 3973352 - DNA, 15 bp, Homo sapiens
agagaaagaaaatga

SEQ ID NO: 3973353 - DNA, 16 bp, Homo sapiens
agagaaagaaaatgaa

SEQ ID NO: 3973354 - DNA, 14 bp, Homo sapiens
agagaaagaagaga

SEQ ID NO: 3973355 - DNA, 22 bp, Homo sapiens
agagaaatttttatttttgaac

SEQ ID NO: 3973356 - DNA, 13 bp, Homo sapiens
agagaagaaagaa

SEQ ID NO: 3973357 - DNA, 12 bp, Homo sapiens
agagaagaggct

SEQ ID NO: 3973358 - DNA, 19 bp, Homo sapiens
agagaagatgtgatttatt

SEQ ID NO: 3973359 - DNA, 15 bp, Homo sapiens
agagaagccacgctg

SEQ ID NO: 3973360 - DNA, 13 bp, Homo sapiens
agagaaggagcag

SEQ ID NO: 3973361 - DNA, 12 bp, Homo sapiens
agagaaggcagg

SEQ ID NO: 3973362 - DNA, 20 bp, Homo sapiens
agagaaggcctcttgtgctc

SEQ ID NO: 3973363 - DNA, 15 bp, Homo sapiens
agagaatcagggcag

SEQ ID NO: 3973364 - DNA, 19 bp, Homo sapiens
agagaatctgaagctattg

SEQ ID NO: 3973365 - DNA, 19 bp, Homo sapiens
agagacaaacacctcccag

SEQ ID NO: 3973366 - DNA, 13 bp, Homo sapiens
agagacacctgca

SEQ ID NO: 3973367 - DNA, 19 bp, Homo sapiens
agagacacctgcacctccc

SEQ ID NO: 3973368 - DNA, 21 bp, Homo sapiens
agagacacctgcacctccccc

SEQ ID NO: 3973369 - DNA, 17 bp, Homo sapiens
agagacactcccaggga

SEQ ID NO: 3973370 - DNA, 20 bp, Homo sapiens
agagacactcccagggacaa

SEQ ID NO: 3973371 - DNA, 21 bp, Homo sapiens
agagacactcccagggacaag

SEQ ID NO: 3973372 - DNA, 14 bp, Homo sapiens
agagacagagcccc

SEQ ID NO: 3973373 - DNA, 21 bp, Homo sapiens
agagacagagcccccaagcct

SEQ ID NO: 3973374 - DNA, 16 bp, Homo sapiens
agagacaggaaagaat

SEQ ID NO: 3973375 - DNA, 15 bp, Homo sapiens
agagacaggagggca

SEQ ID NO: 3973376 - DNA, 22 bp, Homo sapiens
agagacagttatttatagtcat

SEQ ID NO: 3973377 - DNA, 23 bp, Homo sapiens
agagaccacagcaattggctcct

SEQ ID NO: 3973378 - DNA, 12 bp, Homo sapiens
agagacccaagg

SEQ ID NO: 3973379 - DNA, 20 bp, Homo sapiens
agagaccccttcctttcctc

SEQ ID NO: 3973380 - DNA, 14 bp, Homo sapiens
agagacctgaggca

SEQ ID NO: 3973381 - DNA, 22 bp, Homo sapiens
agagactatggagcctggcaca

SEQ ID NO: 3973382 - DNA, 21 bp, Homo sapiens
agatgcctccaccgctgccta

SEQ ID NO: 3973383 - DNA, 20 bp, Homo sapiens
agatgctgactgtactcctc

SEQ ID NO: 3973384 - DNA, 23 bp, Homo sapiens
agatgctgactgtactcctccca

SEQ ID NO: 3973385 - DNA, 12 bp, Homo sapiens
agatggaccagt

SEQ ID NO: 3973386 - DNA, 17 bp, Homo sapiens
agatggaccagtagaca

SEQ ID NO: 3973387 - DNA, 15 bp, Homo sapiens
agatggactctgaaa

SEQ ID NO: 3973388 - DNA, 20 bp, Homo sapiens
agatggcgagcatcctggcc

SEQ ID NO: 3973389 - DNA, 14 bp, Homo sapiens
agatggctgtgcct

SEQ ID NO: 3973390 - DNA, 19 bp, Homo sapiens
agatggctgtgcctctgcc

SEQ ID NO: 3973391 - DNA, 18 bp, Homo sapiens
agatgggtattaaacttg

SEQ ID NO: 3973392 - DNA, 24 bp, Homo sapiens
agatgggtctccgcacttggaaag

SEQ ID NO: 3973393 - DNA, 13 bp, Homo sapiens
agatggtagcaga

SEQ ID NO: 3973394 - DNA, 13 bp, Homo sapiens
agatgtaggaggg

SEQ ID NO: 3973395 - DNA, 14 bp, Homo sapiens
agatgtaggaggga

SEQ ID NO: 3973396 - DNA, 17 bp, Homo sapiens
agatgtatcattaatgt

SEQ ID NO: 3973397 - DNA, 15 bp, Homo sapiens
agatgtcaaatatct

SEQ ID NO: 3973398 - DNA, 18 bp, Homo sapiens
agatgtctaatagttatt

SEQ ID NO: 3973399 - DNA, 14 bp, Homo sapiens
agatgtttcacgaa

SEQ ID NO: 3973400 - DNA, 18 bp, Homo sapiens
agattaaaaagtaaaaga

SEQ ID NO: 3973401 - DNA, 21 bp, Homo sapiens
agattaccccctcattgttta

SEQ ID NO: 3973402 - DNA, 13 bp, Homo sapiens
agattacctgcca

SEQ ID NO: 3973403 - DNA, 15 bp, Homo sapiens
agattacctgccact

SEQ ID NO: 3973404 - DNA, 15 bp, Homo sapiens
agattactttgtccc

SEQ ID NO: 3973405 - DNA, 17 bp, Homo sapiens
agattagctctggacca

SEQ ID NO: 3973406 - DNA, 14 bp, Homo sapiens
agattatattataa

SEQ ID NO: 3973407 - DNA, 22 bp, Homo sapiens
agattatattataataatgttc

SEQ ID NO: 3973408 - DNA, 19 bp, Homo sapiens
agattccagagagtggctc

SEQ ID NO: 3973409 - DNA, 14 bp, Homo sapiens
agattcccagagac

SEQ ID NO: 3973410 - DNA, 21 bp, Homo sapiens
agattcctcttgcctctctca

SEQ ID NO: 3973411 - DNA, 23 bp, Homo sapiens
agattcctcttgcctctctcagg

SEQ ID NO: 3973412 - DNA, 13 bp, Homo sapiens
agattcctgggcc

SEQ ID NO: 3973413 - DNA, 17 bp, Homo sapiens
agattctccaaatgatt

SEQ ID NO: 3973414 - DNA, 15 bp, Homo sapiens
agattctcctgtgct

SEQ ID NO: 3973415 - DNA, 12 bp, Homo sapiens
agattgacaagg

SEQ ID NO: 3973416 - DNA, 14 bp, Homo sapiens
agattgacaaggta

SEQ ID NO: 3973417 - DNA, 19 bp, Homo sapiens
agattgagagaagagacaa

SEQ ID NO: 3973418 - DNA, 22 bp, Homo sapiens
agattgaggcctgccctcaggg

SEQ ID NO: 3973419 - DNA, 15 bp, Homo sapiens
agattgcttaaaata

SEQ ID NO: 3973420 - DNA, 21 bp, Homo sapiens
agattgtccagtgcaaccaca

SEQ ID NO: 3973421 - DNA, 21 bp, Homo sapiens
agattgtgtaacaattttaat

SEQ ID NO: 3973422 - DNA, 22 bp, Homo sapiens
agattgttttatcatgacatgt

SEQ ID NO: 3973423 - DNA, 23 bp, Homo sapiens
agattgttttatcatgacatgtt

SEQ ID NO: 3973424 - DNA, 20 bp, Homo sapiens
agatttaccagggatgtaga

SEQ ID NO: 3973425 - DNA, 15 bp, Homo sapiens
agatttcaacatatc

SEQ ID NO: 3973426 - DNA, 18 bp, Homo sapiens
agatttcaagaaaaaata

SEQ ID NO: 3973427 - DNA, 13 bp, Homo sapiens
agatttgccagca

SEQ ID NO: 3973428 - DNA, 12 bp, Homo sapiens
agattttagaca

SEQ ID NO: 3973429 - DNA, 17 bp, Homo sapiens
agattttttttgtaact

SEQ ID NO: 3973430 - DNA, 18 bp, Homo sapiens
agattttttttgtaactt

SEQ ID NO: 3973431 - DNA, 22 bp, Homo sapiens
agcaaagagtgggctgcatctg

SEQ ID NO: 3973432 - DNA, 21 bp, Homo sapiens
agcaaagcctgttcatggcag

SEQ ID NO: 3973433 - DNA, 16 bp, Homo sapiens
agcaaaggaaaccaaa

SEQ ID NO: 3973434 - DNA, 15 bp, Homo sapiens
agcaaagtctaaagt

SEQ ID NO: 3973435 - DNA, 20 bp, Homo sapiens
agcaaagtctaaagtttaca

SEQ ID NO: 3973436 - DNA, 22 bp, Homo sapiens
agcaaagtctaaagtttacagt

SEQ ID NO: 3973437 - DNA, 16 bp, Homo sapiens
agcaaatgtggctcct

SEQ ID NO: 3973438 - DNA, 14 bp, Homo sapiens
agcaaatttcaaaa

SEQ ID NO: 3973439 - DNA, 20 bp, Homo sapiens
agcaacacaagctggaagca

SEQ ID NO: 3973440 - DNA, 13 bp, Homo sapiens
agcaacacagagc

SEQ ID NO: 3973441 - DNA, 12 bp, Homo sapiens
agcaacatttta

SEQ ID NO: 3973442 - DNA, 19 bp, Homo sapiens
agcaacccctgtacccagc

SEQ ID NO: 3973443 - DNA, 16 bp, Homo sapiens
agcaaccgtggccctt

SEQ ID NO: 3973444 - DNA, 23 bp, Homo sapiens
agcaaccgtggcccttcctggac

SEQ ID NO: 3973445 - DNA, 23 bp, Homo sapiens
agcaacgcaggcccccaggtgcc

SEQ ID NO: 3973446 - DNA, 11 bp, Homo sapiens
agcaactccca

SEQ ID NO: 3973447 - DNA, 21 bp, Homo sapiens
agcaactctccactccatatt

SEQ ID NO: 3973448 - DNA, 17 bp, Homo sapiens
agcaagactgttagccc

SEQ ID NO: 3973449 - DNA, 16 bp, Homo sapiens
agcaagactgttgctc

SEQ ID NO: 3973450 - DNA, 20 bp, Homo sapiens
agcaagcatttatgtttatt

SEQ ID NO: 3973451 - DNA, 12 bp, Homo sapiens
agcaaggcccga

SEQ ID NO: 3973452 - DNA, 19 bp, Homo sapiens
agcaaggcccgagcagctg

SEQ ID NO: 3973453 - DNA, 22 bp, Homo sapiens
agcaaggcccgagcagctgagc

SEQ ID NO: 3973454 - DNA, 16 bp, Homo sapiens
agcaagggctccagca

SEQ ID NO: 3973455 - DNA, 18 bp, Homo sapiens
agcaagggctccagcatc

SEQ ID NO: 3973456 - DNA, 16 bp, Homo sapiens
agcaagggtgatggga

SEQ ID NO: 3973457 - DNA, 17 bp, Homo sapiens
agcaagtttcaccttgg

SEQ ID NO: 3973458 - DNA, 13 bp, Homo sapiens
agcaataattagg

SEQ ID NO: 3973459 - DNA, 18 bp, Homo sapiens
agcaatgatgtccagaag

SEQ ID NO: 3973460 - DNA, 21 bp, Homo sapiens
agcaatggacctttggggaag

SEQ ID NO: 3973461 - DNA, 22 bp, Homo sapiens
agcaatgggagggggctccatg

SEQ ID NO: 3973462 - DNA, 16 bp, Homo sapiens
agcaattcatttcact

SEQ ID NO: 3973463 - DNA, 17 bp, Homo sapiens
agcaattcatttcactt

SEQ ID NO: 3973464 - DNA, 19 bp, Homo sapiens
agcaattcatttcacttta

SEQ ID NO: 3973465 - DNA, 23 bp, Homo sapiens
agcaattcatttcactttaaagt

SEQ ID NO: 3973466 - DNA, 15 bp, Homo sapiens
agcaattgccctgta

SEQ ID NO: 3973467 - DNA, 14 bp, Homo sapiens
agcaattttcgaac

SEQ ID NO: 3973468 - DNA, 12 bp, Homo sapiens
agccctccccct

SEQ ID NO: 3973469 - DNA, 21 bp, Homo sapiens
agccctcccccttccccttct

SEQ ID NO: 3973470 - DNA, 22 bp, Homo sapiens
agccctcccccttccccttctg

SEQ ID NO: 3973471 - DNA, 15 bp, Homo sapiens
agccctccctgcccc

SEQ ID NO: 3973472 - DNA, 23 bp, Homo sapiens
agccctccctggcatgtcagagc

SEQ ID NO: 3973473 - DNA, 15 bp, Homo sapiens
agccctccctgtcct

SEQ ID NO: 3973474 - DNA, 20 bp, Homo sapiens
agccctccctgtcctcctcg

SEQ ID NO: 3973475 - DNA, 13 bp, Homo sapiens
agccctcctcacc

SEQ ID NO: 3973476 - DNA, 20 bp, Homo sapiens
agccctcgaaccaaggcagc

SEQ ID NO: 3973477 - DNA, 21 bp, Homo sapiens
agccctcgaaccaaggcagcc

SEQ ID NO: 3973478 - DNA, 17 bp, Homo sapiens
agccctgactggtgcta

SEQ ID NO: 3973479 - DNA, 12 bp, Homo sapiens
agccctgcctgg

SEQ ID NO: 3973480 - DNA, 14 bp, Homo sapiens
agccctgcctggag

SEQ ID NO: 3973481 - DNA, 23 bp, Homo sapiens
agccctgcctggaggacctgagc

SEQ ID NO: 3973482 - DNA, 21 bp, Homo sapiens
agccctgctgggcccatgtga

SEQ ID NO: 3973483 - DNA, 17 bp, Homo sapiens
agccctgctttgggctg

SEQ ID NO: 3973484 - DNA, 20 bp, Homo sapiens
agccctgctttgggctgccc

SEQ ID NO: 3973485 - DNA, 23 bp, Homo sapiens
agccctgctttgggctgccctgg

SEQ ID NO: 3973486 - DNA, 18 bp, Homo sapiens
agccctggcccagagctg

SEQ ID NO: 3973487 - DNA, 15 bp, Homo sapiens
agccctggctctgca

SEQ ID NO: 3973488 - DNA, 11 bp, Homo sapiens
agccctgggac

SEQ ID NO: 3973489 - DNA, 17 bp, Homo sapiens
agccctgggccccacca

SEQ ID NO: 3973490 - DNA, 21 bp, Homo sapiens
agccctgggccccaccaccta

SEQ ID NO: 3973491 - DNA, 23 bp, Homo sapiens
agccctgggccccaccacctagg

SEQ ID NO: 3973492 - DNA, 12 bp, Homo sapiens
agccctgggggc

SEQ ID NO: 3973493 - DNA, 16 bp, Homo sapiens
agccctgggggccagc

SEQ ID NO: 3973494 - DNA, 22 bp, Homo sapiens
agccctggggtatgagctgcca

SEQ ID NO: 3973495 - DNA, 17 bp, Homo sapiens
agcccttccctgctttg

SEQ ID NO: 3973496 - DNA, 22 bp, Homo sapiens
agcccttcctcctgaagcctct

SEQ ID NO: 3973497 - DNA, 15 bp, Homo sapiens
agcccttctgccttt

SEQ ID NO: 3973498 - DNA, 19 bp, Homo sapiens
agcccttgcccccatccct

SEQ ID NO: 3973499 - DNA, 17 bp, Homo sapiens
agccctttctgtgtgca

SEQ ID NO: 3973500 - DNA, 20 bp, Homo sapiens
agccctttgcaggcccagca

SEQ ID NO: 3973501 - DNA, 21 bp, Homo sapiens
agcccttttacagctcttggc

SEQ ID NO: 3973502 - DNA, 13 bp, Homo sapiens
agccgagagcctg

SEQ ID NO: 3973503 - DNA, 16 bp, Homo sapiens
agccgagagcctgctc

SEQ ID NO: 3973504 - DNA, 19 bp, Homo sapiens
agccgagattgcgccactg

SEQ ID NO: 3973505 - DNA, 21 bp, Homo sapiens
agccgagccgggcctggggct

SEQ ID NO: 3973506 - DNA, 17 bp, Homo sapiens
agccgccgggcaggcct

SEQ ID NO: 3973507 - DNA, 15 bp, Homo sapiens
agccgctaggagaga

SEQ ID NO: 3973508 - DNA, 16 bp, Homo sapiens
agccgctgtgagcccc

SEQ ID NO: 3973509 - DNA, 13 bp, Homo sapiens
agccgggcaagtc

SEQ ID NO: 3973510 - DNA, 22 bp, Homo sapiens
agccggtgcctggcgcccctgc

SEQ ID NO: 3973511 - DNA, 15 bp, Homo sapiens
agccgtactgtctat

SEQ ID NO: 3973512 - DNA, 12 bp, Homo sapiens
agccgtagaggg

SEQ ID NO: 3973513 - DNA, 17 bp, Homo sapiens
agccgtagagggtggcc

SEQ ID NO: 3973514 - DNA, 15 bp, Homo sapiens
agccgtccatggcac

SEQ ID NO: 3973515 - DNA, 17 bp, Homo sapiens
agccgtccatggcacca

SEQ ID NO: 3973516 - DNA, 22 bp, Homo sapiens
agccgtccatggcaccagcccc

SEQ ID NO: 3973517 - DNA, 17 bp, Homo sapiens
agccgtctgactccaga

SEQ ID NO: 3973518 - DNA, 18 bp, Homo sapiens
agccgtgatgctcaggct

SEQ ID NO: 3973519 - DNA, 14 bp, Homo sapiens
agccgtggcttccc

SEQ ID NO: 3973520 - DNA, 21 bp, Homo sapiens
agccgttttcatgagctgagt

SEQ ID NO: 3973521 - DNA, 16 bp, Homo sapiens
agcctaaatctaatca

SEQ ID NO: 3973522 - DNA, 12 bp, Homo sapiens
agcctaatgaaa

SEQ ID NO: 3973523 - DNA, 22 bp, Homo sapiens
agcctacccttgtaccccatcc

SEQ ID NO: 3973524 - DNA, 23 bp, Homo sapiens
agcctacccttgtaccccatccc

SEQ ID NO: 3973525 - DNA, 14 bp, Homo sapiens
agcctagccacctc

SEQ ID NO: 3973526 - DNA, 20 bp, Homo sapiens
agcctagccacctcccaccc

SEQ ID NO: 3973527 - DNA, 22 bp, Homo sapiens
agcctcactattacttgaactt

SEQ ID NO: 3973528 - DNA, 23 bp, Homo sapiens
agcctcactattacttgaacttt

SEQ ID NO: 3973529 - DNA, 16 bp, Homo sapiens
agcctcagctcagcct

SEQ ID NO: 3973530 - DNA, 13 bp, Homo sapiens
agcctcagtgcca

SEQ ID NO: 3973531 - DNA, 15 bp, Homo sapiens
agcctcagtgccact

SEQ ID NO: 3973532 - DNA, 23 bp, Homo sapiens
agcctcagtgccacttgacattc

SEQ ID NO: 3973533 - DNA, 15 bp, Homo sapiens
agcctcatatttaaa

SEQ ID NO: 3973534 - DNA, 16 bp, Homo sapiens
agcctcatatttaaag

SEQ ID NO: 3973535 - DNA, 12 bp, Homo sapiens
agcctccagagc

SEQ ID NO: 3973536 - DNA, 20 bp, Homo sapiens
agcctccagagccagcctgg

SEQ ID NO: 3973537 - DNA, 18 bp, Homo sapiens
agcctccatgctgcctcc

SEQ ID NO: 3973538 - DNA, 17 bp, Homo sapiens
agcctcccaagtagctg

SEQ ID NO: 3973539 - DNA, 14 bp, Homo sapiens
agcctccccctcag

SEQ ID NO: 3973540 - DNA, 15 bp, Homo sapiens
agcctccccctgctg

SEQ ID NO: 3973541 - DNA, 19 bp, Homo sapiens
agcctccccctgctgctca

SEQ ID NO: 3973542 - DNA, 21 bp, Homo sapiens
agcctccctcctcgtcccctg

SEQ ID NO: 3973543 - DNA, 13 bp, Homo sapiens
agcctcctcctga

SEQ ID NO: 3973544 - DNA, 18 bp, Homo sapiens
agcctcgcaacccgtgcc

SEQ ID NO: 3973545 - DNA, 20 bp, Homo sapiens
agcctcgccgtctgtgaatt

SEQ ID NO: 3973546 - DNA, 23 bp, Homo sapiens
agcctctccaggaatgcctcctc

SEQ ID NO: 3973547 - DNA, 23 bp, Homo sapiens
agcctctccaggcaccatctccc

SEQ ID NO: 3973548 - DNA, 13 bp, Homo sapiens
agcctctcccggc

SEQ ID NO: 3973549 - DNA, 15 bp, Homo sapiens
agcctctcccggctg

SEQ ID NO: 3973550 - DNA, 16 bp, Homo sapiens
agcctctcccggctgc

SEQ ID NO: 3973551 - DNA, 20 bp, Homo sapiens
agcctctcccggctgcctgc

SEQ ID NO: 3973552 - DNA, 15 bp, Homo sapiens
agcctctctgctata

SEQ ID NO: 3973553 - DNA, 13 bp, Homo sapiens
agcctctgcccca

SEQ ID NO: 3973554 - DNA, 17 bp, Homo sapiens
agctgaaagttgggact

SEQ ID NO: 3973555 - DNA, 16 bp, Homo sapiens
agctgaacaatgaatg

SEQ ID NO: 3973556 - DNA, 19 bp, Homo sapiens
agctgaacccattttgagt

SEQ ID NO: 3973557 - DNA, 14 bp, Homo sapiens
agctgaagacaaac

SEQ ID NO: 3973558 - DNA, 15 bp, Homo sapiens
agctgaagtgaagga

SEQ ID NO: 3973559 - DNA, 18 bp, Homo sapiens
agctgaagtgaaggagaa

SEQ ID NO: 3973560 - DNA, 18 bp, Homo sapiens
agctgagaagaagctgag

SEQ ID NO: 3973561 - DNA, 19 bp, Homo sapiens
agctgagaagaagctgagg

SEQ ID NO: 3973562 - DNA, 14 bp, Homo sapiens
agctgagagacttt

SEQ ID NO: 3973563 - DNA, 19 bp, Homo sapiens
agctgagaggaagatgaag

SEQ ID NO: 3973564 - DNA, 16 bp, Homo sapiens
agctgagagtctgaaa

SEQ ID NO: 3973565 - DNA, 13 bp, Homo sapiens
agctgagcagggc

SEQ ID NO: 3973566 - DNA, 14 bp, Homo sapiens
agctgagcagggcc

SEQ ID NO: 3973567 - DNA, 16 bp, Homo sapiens
agctgaggatgacaga

SEQ ID NO: 3973568 - DNA, 13 bp, Homo sapiens
agctgaggggggc

SEQ ID NO: 3973569 - DNA, 16 bp, Homo sapiens
agctgaggtgcccagg

SEQ ID NO: 3973570 - DNA, 22 bp, Homo sapiens
agctgaggtgcccaggagaaga

SEQ ID NO: 3973571 - DNA, 13 bp, Homo sapiens
agctgagtcacct

SEQ ID NO: 3973572 - DNA, 19 bp, Homo sapiens
agctgagtcacctcctcca

SEQ ID NO: 3973573 - DNA, 20 bp, Homo sapiens
agctgagtcacctcctccac

SEQ ID NO: 3973574 - DNA, 15 bp, Homo sapiens
agctgagtgaaaaat

SEQ ID NO: 3973575 - DNA, 23 bp, Homo sapiens
agctgagttacttgtctgaggcc

SEQ ID NO: 3973576 - DNA, 21 bp, Homo sapiens
agctgatgatgtctcttgtag

SEQ ID NO: 3973577 - DNA, 16 bp, Homo sapiens
agctgatggagaagga

SEQ ID NO: 3973578 - DNA, 14 bp, Homo sapiens
agctgatttccagg

SEQ ID NO: 3973579 - DNA, 15 bp, Homo sapiens
agctgatttccaggc

SEQ ID NO: 3973580 - DNA, 19 bp, Homo sapiens
agctgatttccaggcccct

SEQ ID NO: 3973581 - DNA, 20 bp, Homo sapiens
agctgatttccaggcccctg

SEQ ID NO: 3973582 - DNA, 23 bp, Homo sapiens
agctgatttccaggcccctgagg

SEQ ID NO: 3973583 - DNA, 15 bp, Homo sapiens
agctgcacattcctg

SEQ ID NO: 3973584 - DNA, 19 bp, Homo sapiens
agctgcaccatcacacatg

SEQ ID NO: 3973585 - DNA, 14 bp, Homo sapiens
agctgcagctgggc

SEQ ID NO: 3973586 - DNA, 19 bp, Homo sapiens
agctgcagctgggccccat

SEQ ID NO: 3973587 - DNA, 21 bp, Homo sapiens
agctgcagctgggccccatgc

SEQ ID NO: 3973588 - DNA, 11 bp, Homo sapiens
agctgcagctt

SEQ ID NO: 3973589 - DNA, 13 bp, Homo sapiens
agctgcagcttcc

SEQ ID NO: 3973590 - DNA, 16 bp, Homo sapiens
agctgcagcttcctgt

SEQ ID NO: 3973591 - DNA, 14 bp, Homo sapiens
agctgccaagcact

SEQ ID NO: 3973592 - DNA, 18 bp, Homo sapiens
agctgccgaccagagccc

SEQ ID NO: 3973593 - DNA, 11 bp, Homo sapiens
agctgcctggg

SEQ ID NO: 3973594 - DNA, 20 bp, Homo sapiens
agctgcctgtagttaggaaa

SEQ ID NO: 3973595 - DNA, 23 bp, Homo sapiens
agctgcctgtagttaggaaataa

SEQ ID NO: 3973596 - DNA, 14 bp, Homo sapiens
agctgcgggtctga

SEQ ID NO: 3973597 - DNA, 23 bp, Homo sapiens
agctgctcctggctgaggggctt

SEQ ID NO: 3973598 - DNA, 13 bp, Homo sapiens
agctgctctgccc

SEQ ID NO: 3973599 - DNA, 17 bp, Homo sapiens
agctgctctgccccttg

SEQ ID NO: 3973600 - DNA, 20 bp, Homo sapiens
agctgctcttagtgcccgcc

SEQ ID NO: 3973601 - DNA, 20 bp, Homo sapiens
agctgctgaaacaacaaata

SEQ ID NO: 3973602 - DNA, 12 bp, Homo sapiens
agctgctgaaga

SEQ ID NO: 3973603 - DNA, 18 bp, Homo sapiens
agctgctgaagttctgag

SEQ ID NO: 3973604 - DNA, 19 bp, Homo sapiens
agctgctgaagttctgagc

SEQ ID NO: 3973605 - DNA, 12 bp, Homo sapiens
agctgcttgtcc

SEQ ID NO: 3973606 - DNA, 24 bp, Homo sapiens
agctgcttgtcctgctctcttcag

SEQ ID NO: 3973607 - DNA, 17 bp, Homo sapiens
agctggaaataaacctg

SEQ ID NO: 3973608 - DNA, 24 bp, Homo sapiens
agctggaaataaacctggagatga

SEQ ID NO: 3973609 - DNA, 21 bp, Homo sapiens
agctggaaggcagggcagagg

SEQ ID NO: 3973610 - DNA, 15 bp, Homo sapiens
agctggagctcttgg

SEQ ID NO: 3973611 - DNA, 20 bp, Homo sapiens
agctggaggactagaacctg

SEQ ID NO: 3973612 - DNA, 13 bp, Homo sapiens
agctggcaggaca

SEQ ID NO: 3973613 - DNA, 17 bp, Homo sapiens
agctggcaggacacatc

SEQ ID NO: 3973614 - DNA, 19 bp, Homo sapiens
agctggcaggacacatccc

SEQ ID NO: 3973615 - DNA, 21 bp, Homo sapiens
agctggcattacagctggaga

SEQ ID NO: 3973616 - DNA, 20 bp, Homo sapiens
agctggcctctagaacaccc

SEQ ID NO: 3973617 - DNA, 23 bp, Homo sapiens
agctggcctctagaacacccact

SEQ ID NO: 3973618 - DNA, 20 bp, Homo sapiens
agctgggaaaaaagttttga

SEQ ID NO: 3973619 - DNA, 13 bp, Homo sapiens
agctgggaaacag

SEQ ID NO: 3973620 - DNA, 14 bp, Homo sapiens
agctgggaaacagg

SEQ ID NO: 3973621 - DNA, 15 bp, Homo sapiens
agctgggaaacaggg

SEQ ID NO: 3973622 - DNA, 18 bp, Homo sapiens
agctgggaaacagggagc

SEQ ID NO: 3973623 - DNA, 22 bp, Homo sapiens
agctgggaacccgactgtgaaa

SEQ ID NO: 3973624 - DNA, 18 bp, Homo sapiens
agctgggaggaaaagaaa

SEQ ID NO: 3973625 - DNA, 16 bp, Homo sapiens
agctgggaggcatggc

SEQ ID NO: 3973626 - DNA, 16 bp, Homo sapiens
agctgggccccaccta

SEQ ID NO: 3973627 - DNA, 19 bp, Homo sapiens
agctgggccccatgctctg

SEQ ID NO: 3973628 - DNA, 12 bp, Homo sapiens
agctgggccggc

SEQ ID NO: 3973629 - DNA, 16 bp, Homo sapiens
agctggggcctggaga

SEQ ID NO: 3973630 - DNA, 18 bp, Homo sapiens
agctggggcctggagagg

SEQ ID NO: 3973631 - DNA, 23 bp, Homo sapiens
agctggggcctggagaggggcct

SEQ ID NO: 3973632 - DNA, 15 bp, Homo sapiens
agctgggggaagggt

SEQ ID NO: 3973633 - DNA, 15 bp, Homo sapiens
agctggtgggaagcg

SEQ ID NO: 3973634 - DNA, 14 bp, Homo sapiens
agctgtactcagag

SEQ ID NO: 3973635 - DNA, 16 bp, Homo sapiens
agctgtactcagagca

SEQ ID NO: 3973636 - DNA, 18 bp, Homo sapiens
agctgtactcagagcaga

SEQ ID NO: 3973637 - DNA, 20 bp, Homo sapiens
agctgtagccatggctcagg

SEQ ID NO: 3973638 - DNA, 21 bp, Homo sapiens
agctgtagccatggctcaggc

SEQ ID NO: 3973639 - DNA, 16 bp, Homo sapiens
agctgtagctcccgag

SEQ ID NO: 3973640 - DNA, 17 bp, Homo sapiens
agctgtagctcccgagc

SEQ ID NO: 3973641 - DNA, 19 bp, Homo sapiens
aggatgccacagccccaca

SEQ ID NO: 3973642 - DNA, 20 bp, Homo sapiens
aggatgccacagccccacag

SEQ ID NO: 3973643 - DNA, 21 bp, Homo sapiens
aggatgccacagccccacagc

SEQ ID NO: 3973644 - DNA, 19 bp, Homo sapiens
aggatggagagaggggaat

SEQ ID NO: 3973645 - DNA, 21 bp, Homo sapiens
aggatggtgcaggatggcttt

SEQ ID NO: 3973646 - DNA, 18 bp, Homo sapiens
aggatgtaaacagtgcct

SEQ ID NO: 3973647 - DNA, 15 bp, Homo sapiens
aggatgtgttttgca

SEQ ID NO: 3973648 - DNA, 14 bp, Homo sapiens
aggatgtttttcat

SEQ ID NO: 3973649 - DNA, 15 bp, Homo sapiens
aggattacaggcctt

SEQ ID NO: 3973650 - DNA, 21 bp, Homo sapiens
aggatttaacagtcatttaaa

SEQ ID NO: 3973651 - DNA, 14 bp, Homo sapiens
aggatttcaagcct

SEQ ID NO: 3973652 - DNA, 16 bp, Homo sapiens
aggatttcaagcctgc

SEQ ID NO: 3973653 - DNA, 19 bp, Homo sapiens
aggattttaacaaaagcaa

SEQ ID NO: 3973654 - DNA, 17 bp, Homo sapiens
aggattttgtgtttttt

SEQ ID NO: 3973655 - DNA, 17 bp, Homo sapiens
aggcaaaatccttgctt

SEQ ID NO: 3973656 - DNA, 19 bp, Homo sapiens
aggcaaaatccttgcttat

SEQ ID NO: 3973657 - DNA, 19 bp, Homo sapiens
aggcaaatataagctggga

SEQ ID NO: 3973658 - DNA, 15 bp, Homo sapiens
aggcaagcccctcag

SEQ ID NO: 3973659 - DNA, 17 bp, Homo sapiens
aggcaagcccctcagcc

SEQ ID NO: 3973660 - DNA, 18 bp, Homo sapiens
aggcaagcccctcagccc

SEQ ID NO: 3973661 - DNA, 19 bp, Homo sapiens
aggcaagcccctcagccct

SEQ ID NO: 3973662 - DNA, 21 bp, Homo sapiens
aggcaagcccctcagcccttg

SEQ ID NO: 3973663 - DNA, 23 bp, Homo sapiens
aggcaagcccctcagcccttgcc

SEQ ID NO: 3973664 - DNA, 13 bp, Homo sapiens
aggcaagtgaaga

SEQ ID NO: 3973665 - DNA, 17 bp, Homo sapiens
aggcaagtgaagaaaag

SEQ ID NO: 3973666 - DNA, 19 bp, Homo sapiens
aggcacaggcaggaagaga

SEQ ID NO: 3973667 - DNA, 14 bp, Homo sapiens
aggcacatggagga

SEQ ID NO: 3973668 - DNA, 17 bp, Homo sapiens
aggcacatggaggagct

SEQ ID NO: 3973669 - DNA, 15 bp, Homo sapiens
aggcaccagctctgt

SEQ ID NO: 3973670 - DNA, 17 bp, Homo sapiens
aggcaccagctctgtgg

SEQ ID NO: 3973671 - DNA, 16 bp, Homo sapiens
aggcaccggcgctgca

SEQ ID NO: 3973672 - DNA, 18 bp, Homo sapiens
aggcaccggcgctgcagg

SEQ ID NO: 3973673 - DNA, 20 bp, Homo sapiens
aggcaccggcgctgcaggta

SEQ ID NO: 3973674 - DNA, 17 bp, Homo sapiens
aggcacctagcaattcc

SEQ ID NO: 3973675 - DNA, 13 bp, Homo sapiens
aggcacctgctgg

SEQ ID NO: 3973676 - DNA, 14 bp, Homo sapiens
aggcacctgctgga

SEQ ID NO: 3973677 - DNA, 16 bp, Homo sapiens
aggcacctgctggaaa

SEQ ID NO: 3973678 - DNA, 16 bp, Homo sapiens
aggcacctggcctgct

SEQ ID NO: 3973679 - DNA, 18 bp, Homo sapiens
aggcacctggcctgctgg

SEQ ID NO: 3973680 - DNA, 22 bp, Homo sapiens
aggcacctggcctgctgggaac

SEQ ID NO: 3973681 - DNA, 17 bp, Homo sapiens
aggcacgaacccacctg

SEQ ID NO: 3973682 - DNA, 22 bp, Homo sapiens
aggcacgccagtttcaccattt

SEQ ID NO: 3973683 - DNA, 16 bp, Homo sapiens
aggcactggtggcatc

SEQ ID NO: 3973684 - DNA, 21 bp, Homo sapiens
aggcacttgtcactatgctat

SEQ ID NO: 3973685 - DNA, 23 bp, Homo sapiens
aggcagaagaattgaacccagga

SEQ ID NO: 3973686 - DNA, 20 bp, Homo sapiens
aggcagacaagagctgctgt

SEQ ID NO: 3973687 - DNA, 18 bp, Homo sapiens
aggcagagaaagaagaga

SEQ ID NO: 3973688 - DNA, 21 bp, Homo sapiens
aggcagagaaagaagagacag

SEQ ID NO: 3973689 - DNA, 17 bp, Homo sapiens
aggcagagcggggaggt

SEQ ID NO: 3973690 - DNA, 18 bp, Homo sapiens
aggcagcaaggcccgagc

SEQ ID NO: 3973691 - DNA, 23 bp, Homo sapiens
aggcagcaaggcccgagcagctg

SEQ ID NO: 3973692 - DNA, 20 bp, Homo sapiens
aggcagcctccagagccagc

SEQ ID NO: 3973693 - DNA, 22 bp, Homo sapiens
aggcagcctccagagccagcct

SEQ ID NO: 3973694 - DNA, 14 bp, Homo sapiens
aggcagcctctctg

SEQ ID NO: 3973695 - DNA, 11 bp, Homo sapiens
aggcagcctgc

SEQ ID NO: 3973696 - DNA, 14 bp, Homo sapiens
aggcagcctgccgc

SEQ ID NO: 3973697 - DNA, 18 bp, Homo sapiens
aggcagctccaacagctt

SEQ ID NO: 3973698 - DNA, 13 bp, Homo sapiens
aggcagctgctct

SEQ ID NO: 3973699 - DNA, 14 bp, Homo sapiens
aggcagctgctctt

SEQ ID NO: 3973700 - DNA, 16 bp, Homo sapiens
aggcaggaagagagag

SEQ ID NO: 3973701 - DNA, 15 bp, Homo sapiens
aggcaggagtggcag

SEQ ID NO: 3973702 - DNA, 13 bp, Homo sapiens
aggcaggcagggc

SEQ ID NO: 3973703 - DNA, 15 bp, Homo sapiens
aggcaggcagggctc

SEQ ID NO: 3973704 - DNA, 16 bp, Homo sapiens
aggcaggcagggctct

SEQ ID NO: 3973705 - DNA, 18 bp, Homo sapiens
aggcaggcagggctctcc

SEQ ID NO: 3973706 - DNA, 16 bp, Homo sapiens
aggcaggctccccctg

SEQ ID NO: 3973707 - DNA, 22 bp, Homo sapiens
aggcagggaaaggctctgaaag

SEQ ID NO: 3973708 - DNA, 16 bp, Homo sapiens
aggcagggatttgagg

SEQ ID NO: 3973709 - DNA, 16 bp, Homo sapiens
aggcagggcaaatgac

SEQ ID NO: 3973710 - DNA, 13 bp, Homo sapiens
aggcagggcagag

SEQ ID NO: 3973711 - DNA, 14 bp, Homo sapiens
aggcagggcagagg

SEQ ID NO: 3973712 - DNA, 16 bp, Homo sapiens
aggcagggcagaggga

SEQ ID NO: 3973713 - DNA, 19 bp, Homo sapiens
aggcagggcagagggaatg

SEQ ID NO: 3973714 - DNA, 21 bp, Homo sapiens
aggcagggctctcctggcttc

SEQ ID NO: 3973715 - DNA, 13 bp, Homo sapiens
aggcaggtgcctg

SEQ ID NO: 3973716 - DNA, 21 bp, Homo sapiens
aggcaggtttgccagtgaaga

SEQ ID NO: 3973717 - DNA, 22 bp, Homo sapiens
aggcaggtttgccagtgaagac

SEQ ID NO: 3973718 - DNA, 11 bp, Homo sapiens
aggcagtctga

SEQ ID NO: 3973719 - DNA, 21 bp, Homo sapiens
aggcagtgaacacactcagca

SEQ ID NO: 3973720 - DNA, 22 bp, Homo sapiens
aggcagtgcaagagactctggc

SEQ ID NO: 3973721 - DNA, 18 bp, Homo sapiens
aggcagttcaaagcagga

SEQ ID NO: 3973722 - DNA, 23 bp, Homo sapiens
aggcatcccaggggaccacacct

SEQ ID NO: 3973723 - DNA, 13 bp, Homo sapiens
aggcatcccatcc

SEQ ID NO: 3973724 - DNA, 20 bp, Homo sapiens
aggcatgagggatcacaggg

SEQ ID NO: 3973725 - DNA, 23 bp, Homo sapiens
aggcatgagggatcacagggccc

SEQ ID NO: 3973726 - DNA, 13 bp, Homo sapiens
aggcatgcctctg

SEQ ID NO: 3973727 - DNA, 16 bp, Homo sapiens
aggggagtgtgggtga

SEQ ID NO: 3973728 - DNA, 18 bp, Homo sapiens
aggggcaaagaactgccc

SEQ ID NO: 3973729 - DNA, 19 bp, Homo sapiens
aggggcaaagaactgcccc

SEQ ID NO: 3973730 - DNA, 11 bp, Homo sapiens
aggggcacacc

SEQ ID NO: 3973731 - DNA, 19 bp, Homo sapiens
aggggcacaccactgccct

SEQ ID NO: 3973732 - DNA, 23 bp, Homo sapiens
aggggcacaccactgccctgcct

SEQ ID NO: 3973733 - DNA, 17 bp, Homo sapiens
aggggcagaaaaactct

SEQ ID NO: 3973734 - DNA, 12 bp, Homo sapiens
aggggcaggcct

SEQ ID NO: 3973735 - DNA, 14 bp, Homo sapiens
aggggcaggcctgg

SEQ ID NO: 3973736 - DNA, 22 bp, Homo sapiens
aggggcaggcctgggacccagc

SEQ ID NO: 3973737 - DNA, 17 bp, Homo sapiens
aggggccagtgagggct

SEQ ID NO: 3973738 - DNA, 21 bp, Homo sapiens
aggggccagtgagggctgggc

SEQ ID NO: 3973739 - DNA, 13 bp, Homo sapiens
aggggcccacaaa

SEQ ID NO: 3973740 - DNA, 18 bp, Homo sapiens
aggggcccacaaagggga

SEQ ID NO: 3973741 - DNA, 20 bp, Homo sapiens
aggggcccacaaaggggaga

SEQ ID NO: 3973742 - DNA, 15 bp, Homo sapiens
aggggccccagatct

SEQ ID NO: 3973743 - DNA, 19 bp, Homo sapiens
aggggccccagatctgcct

SEQ ID NO: 3973744 - DNA, 16 bp, Homo sapiens
aggggccccggggctg

SEQ ID NO: 3973745 - DNA, 18 bp, Homo sapiens
aggggcctggcagccgtg

SEQ ID NO: 3973746 - DNA, 14 bp, Homo sapiens
aggggcggggcagg

SEQ ID NO: 3973747 - DNA, 20 bp, Homo sapiens
aggggctgctcatcacccag

SEQ ID NO: 3973748 - DNA, 12 bp, Homo sapiens
aggggctgctgg

SEQ ID NO: 3973749 - DNA, 16 bp, Homo sapiens
aggggctgctggggca

SEQ ID NO: 3973750 - DNA, 15 bp, Homo sapiens
aggggcttcctgggt

SEQ ID NO: 3973751 - DNA, 17 bp, Homo sapiens
agggggaagagaaattt

SEQ ID NO: 3973752 - DNA, 21 bp, Homo sapiens
agggggacgcgcacacacacc

SEQ ID NO: 3973753 - DNA, 18 bp, Homo sapiens
agggggcgctcaggaccc

SEQ ID NO: 3973754 - DNA, 19 bp, Homo sapiens
agggggcgctcaggaccca

SEQ ID NO: 3973755 - DNA, 23 bp, Homo sapiens
agggggcgctcaggacccaggcc

SEQ ID NO: 3973756 - DNA, 12 bp, Homo sapiens
agggggcggcct

SEQ ID NO: 3973757 - DNA, 15 bp, Homo sapiens
agggggcggcctatg

SEQ ID NO: 3973758 - DNA, 15 bp, Homo sapiens
agggggcggggcggg

SEQ ID NO: 3973759 - DNA, 12 bp, Homo sapiens
agggggctccat

SEQ ID NO: 3973760 - DNA, 18 bp, Homo sapiens
agggggctccatggagga

SEQ ID NO: 3973761 - DNA, 21 bp, Homo sapiens
agggggctctccaaaggggct

SEQ ID NO: 3973762 - DNA, 15 bp, Homo sapiens
agggggtcgtggaga

SEQ ID NO: 3973763 - DNA, 19 bp, Homo sapiens
aggggtaatatattgctgc

SEQ ID NO: 3973764 - DNA, 22 bp, Homo sapiens
aggggtacatttccctgtgctg

SEQ ID NO: 3973765 - DNA, 13 bp, Homo sapiens
aggggtcaggctc

SEQ ID NO: 3973766 - DNA, 15 bp, Homo sapiens
aggggtcaggctcca

SEQ ID NO: 3973767 - DNA, 16 bp, Homo sapiens
aggggtcaggctccat

SEQ ID NO: 3973768 - DNA, 21 bp, Homo sapiens
aggggtcctgatttcagggaa

SEQ ID NO: 3973769 - DNA, 16 bp, Homo sapiens
aggggtccttggtgtg

SEQ ID NO: 3973770 - DNA, 13 bp, Homo sapiens
aggggtctccctg

SEQ ID NO: 3973771 - DNA, 13 bp, Homo sapiens
aggggtgatttca

SEQ ID NO: 3973772 - DNA, 14 bp, Homo sapiens
aggggtggagaagt

SEQ ID NO: 3973773 - DNA, 15 bp, Homo sapiens
aggggtgggagagcc

SEQ ID NO: 3973774 - DNA, 18 bp, Homo sapiens
aggggtgggagagccagc

SEQ ID NO: 3973775 - DNA, 21 bp, Homo sapiens
aggggttgcgggggagctgga

SEQ ID NO: 3973776 - DNA, 15 bp, Homo sapiens
agggtaaggtgcctt

SEQ ID NO: 3973777 - DNA, 15 bp, Homo sapiens
agggtagcaggtacc

SEQ ID NO: 3973778 - DNA, 21 bp, Homo sapiens
agggtatcccagacccctctc

SEQ ID NO: 3973779 - DNA, 15 bp, Homo sapiens
agggtccccagctgg

SEQ ID NO: 3973780 - DNA, 15 bp, Homo sapiens
agggtccgcaccagc

SEQ ID NO: 3973781 - DNA, 18 bp, Homo sapiens
agggtccgcaccagctgc

SEQ ID NO: 3973782 - DNA, 19 bp, Homo sapiens
agggtccgcaccagctgct

SEQ ID NO: 3973783 - DNA, 20 bp, Homo sapiens
agggtccgcaccagctgctc

SEQ ID NO: 3973784 - DNA, 22 bp, Homo sapiens
agggtccgcaccagctgctctg

SEQ ID NO: 3973785 - DNA, 23 bp, Homo sapiens
agggtccgcaccagctgctctgc

SEQ ID NO: 3973786 - DNA, 23 bp, Homo sapiens
agggtctagggagagacccttgt

SEQ ID NO: 3973787 - DNA, 19 bp, Homo sapiens
agggtctgttgtaaatgac

SEQ ID NO: 3973788 - DNA, 18 bp, Homo sapiens
agggtcttgggctactgg

SEQ ID NO: 3973789 - DNA, 21 bp, Homo sapiens
agggtcttgggctactggcag

SEQ ID NO: 3973790 - DNA, 22 bp, Homo sapiens
agggtcttgggctactggcagc

SEQ ID NO: 3973791 - DNA, 18 bp, Homo sapiens
agggtgacatcccaggag

SEQ ID NO: 3973792 - DNA, 22 bp, Homo sapiens
agggtgatgggaaagcattgta

SEQ ID NO: 3973793 - DNA, 23 bp, Homo sapiens
agggtgctacgtacatgtgaggc

SEQ ID NO: 3973794 - DNA, 22 bp, Homo sapiens
agggtggaggaaggtgctgagc

SEQ ID NO: 3973795 - DNA, 19 bp, Homo sapiens
agggtggccccctgtgcca

SEQ ID NO: 3973796 - DNA, 17 bp, Homo sapiens
agggtgggatggaggag

SEQ ID NO: 3973797 - DNA, 22 bp, Homo sapiens
agggtgggccactctcccctcc

SEQ ID NO: 3973798 - DNA, 12 bp, Homo sapiens
agggtggggccg

SEQ ID NO: 3973799 - DNA, 15 bp, Homo sapiens
agggtgggggaggga

SEQ ID NO: 3973800 - DNA, 23 bp, Homo sapiens
agggtggggttttatgtgtggga

SEQ ID NO: 3973801 - DNA, 18 bp, Homo sapiens
agggttactatgcacaat

SEQ ID NO: 3973802 - DNA, 16 bp, Homo sapiens
agggttggtgggctgg

SEQ ID NO: 3973803 - DNA, 20 bp, Homo sapiens
aggtaactatcaatatttaa

SEQ ID NO: 3973804 - DNA, 22 bp, Homo sapiens
aggtaactatcaatatttaagt

SEQ ID NO: 3973805 - DNA, 20 bp, Homo sapiens
aggtaactgagagcagatgg

SEQ ID NO: 3973806 - DNA, 17 bp, Homo sapiens
aggtaatgagggactgg

SEQ ID NO: 3973807 - DNA, 16 bp, Homo sapiens
aggtaattctccctaa

SEQ ID NO: 3973808 - DNA, 17 bp, Homo sapiens
aggtactatctgtgaag

SEQ ID NO: 3973809 - DNA, 16 bp, Homo sapiens
aggtacttcctcctga

SEQ ID NO: 3973810 - DNA, 21 bp, Homo sapiens
aggtagagtttgaaggaggtg

SEQ ID NO: 3973811 - DNA, 23 bp, Homo sapiens
aggtagagtttgaaggaggtgag

SEQ ID NO: 3973812 - DNA, 17 bp, Homo sapiens
aggtagcgagctgctct

SEQ ID NO: 3973813 - DNA, 18 bp, Homo sapiens
agttatagtttcagatat

SEQ ID NO: 3973814 - DNA, 15 bp, Homo sapiens
agttatattctttaa

SEQ ID NO: 3973815 - DNA, 15 bp, Homo sapiens
agttatattgaatat

SEQ ID NO: 3973816 - DNA, 19 bp, Homo sapiens
agttatattgaatatatca

SEQ ID NO: 3973817 - DNA, 23 bp, Homo sapiens
agttatgccgtataggatgtcag

SEQ ID NO: 3973818 - DNA, 20 bp, Homo sapiens
agttattaacgggcatgtat

SEQ ID NO: 3973819 - DNA, 16 bp, Homo sapiens
agttattaatcttatg

SEQ ID NO: 3973820 - DNA, 19 bp, Homo sapiens
agttattgaatcttaattt

SEQ ID NO: 3973821 - DNA, 22 bp, Homo sapiens
agttattgatttttgtaataaa

SEQ ID NO: 3973822 - DNA, 18 bp, Homo sapiens
agttattgtacagctgtt

SEQ ID NO: 3973823 - DNA, 19 bp, Homo sapiens
agttattgtacagctgttt

SEQ ID NO: 3973824 - DNA, 22 bp, Homo sapiens
agttattgtacagctgtttaag

SEQ ID NO: 3973825 - DNA, 22 bp, Homo sapiens
agttattgtgttgccttagcac

SEQ ID NO: 3973826 - DNA, 21 bp, Homo sapiens
agttattgttttatgttctag

SEQ ID NO: 3973827 - DNA, 23 bp, Homo sapiens
agttattgttttatgttctagtg

SEQ ID NO: 3973828 - DNA, 21 bp, Homo sapiens
agttatttatttattggagat

SEQ ID NO: 3973829 - DNA, 15 bp, Homo sapiens
agttattttaggaga

SEQ ID NO: 3973830 - DNA, 23 bp, Homo sapiens
agttcaaatcctcaccatccaca

SEQ ID NO: 3973831 - DNA, 14 bp, Homo sapiens
agttcaaattttgc

SEQ ID NO: 3973832 - DNA, 16 bp, Homo sapiens
agttcaagcctgtggg

SEQ ID NO: 3973833 - DNA, 16 bp, Homo sapiens
agttcagttcctcttt

SEQ ID NO: 3973834 - DNA, 18 bp, Homo sapiens
agttcatcccagccccaa

SEQ ID NO: 3973835 - DNA, 13 bp, Homo sapiens
agttcatgagaat

SEQ ID NO: 3973836 - DNA, 18 bp, Homo sapiens
agttccaaaatgccaaat

SEQ ID NO: 3973837 - DNA, 16 bp, Homo sapiens
agttccagctggtctt

SEQ ID NO: 3973838 - DNA, 21 bp, Homo sapiens
agttcccggagcacagccctg

SEQ ID NO: 3973839 - DNA, 15 bp, Homo sapiens
agttccctacttcct

SEQ ID NO: 3973840 - DNA, 12 bp, Homo sapiens
agttcctcgccc

SEQ ID NO: 3973841 - DNA, 17 bp, Homo sapiens
agttcctgcactccaga

SEQ ID NO: 3973842 - DNA, 18 bp, Homo sapiens
agttcctgcactccagaa

SEQ ID NO: 3973843 - DNA, 20 bp, Homo sapiens
agttccttcagcttccattt

SEQ ID NO: 3973844 - DNA, 18 bp, Homo sapiens
agttcgagaccaacctga

SEQ ID NO: 3973845 - DNA, 14 bp, Homo sapiens
agttcgcagccacc

SEQ ID NO: 3973846 - DNA, 22 bp, Homo sapiens
agttctaagttcatgtttgtaa

SEQ ID NO: 3973847 - DNA, 20 bp, Homo sapiens
agttctacaagcatatttga

SEQ ID NO: 3973848 - DNA, 21 bp, Homo sapiens
agttctacaagcatatttgag

SEQ ID NO: 3973849 - DNA, 13 bp, Homo sapiens
agttctagagaag

SEQ ID NO: 3973850 - DNA, 15 bp, Homo sapiens
agttctagagaagag

SEQ ID NO: 3973851 - DNA, 20 bp, Homo sapiens
agttctagagaagaggctgg

SEQ ID NO: 3973852 - DNA, 22 bp, Homo sapiens
agttctagtccttggtctgctg

SEQ ID NO: 3973853 - DNA, 16 bp, Homo sapiens
agttctctcgtaactg

SEQ ID NO: 3973854 - DNA, 18 bp, Homo sapiens
agttctgacattcatttt

SEQ ID NO: 3973855 - DNA, 15 bp, Homo sapiens
agttctgagtgtttt

SEQ ID NO: 3973856 - DNA, 22 bp, Homo sapiens
agttctgagtgtttttactaca

SEQ ID NO: 3973857 - DNA, 18 bp, Homo sapiens
agttctgctcctctccag

SEQ ID NO: 3973858 - DNA, 12 bp, Homo sapiens
agttctgctcta

SEQ ID NO: 3973859 - DNA, 17 bp, Homo sapiens
agttcttggacccctga

SEQ ID NO: 3973860 - DNA, 19 bp, Homo sapiens
agttcttggtgactgtccc

SEQ ID NO: 3973861 - DNA, 20 bp, Homo sapiens
agttcttggtgactgtccca

SEQ ID NO: 3973862 - DNA, 21 bp, Homo sapiens
agttgaatgacaacagaagct

SEQ ID NO: 3973863 - DNA, 22 bp, Homo sapiens
agttgaccgttttcatcctggc

SEQ ID NO: 3973864 - DNA, 21 bp, Homo sapiens
agttgagtacagtgaggaggg

SEQ ID NO: 3973865 - DNA, 20 bp, Homo sapiens
agttgagtcgtcatcacttt

SEQ ID NO: 3973866 - DNA, 17 bp, Homo sapiens
agttgcaataaaatagt

SEQ ID NO: 3973867 - DNA, 20 bp, Homo sapiens
agttgcagtctcagaaagcc

SEQ ID NO: 3973868 - DNA, 20 bp, Homo sapiens
agttgctactcttcagaata

SEQ ID NO: 3973869 - DNA, 20 bp, Homo sapiens
agttgctagtactggggaga

SEQ ID NO: 3973870 - DNA, 15 bp, Homo sapiens
agttgctcactcagg

SEQ ID NO: 3973871 - DNA, 15 bp, Homo sapiens
agttggagaccaggc

SEQ ID NO: 3973872 - DNA, 15 bp, Homo sapiens
agttggctcaggcag

SEQ ID NO: 3973873 - DNA, 16 bp, Homo sapiens
agttggctcaggcaga

SEQ ID NO: 3973874 - DNA, 18 bp, Homo sapiens
agttggctggatgaaatt

SEQ ID NO: 3973875 - DNA, 15 bp, Homo sapiens
agttgggagcactgg

SEQ ID NO: 3973876 - DNA, 16 bp, Homo sapiens
agttgggagcactgga

SEQ ID NO: 3973877 - DNA, 18 bp, Homo sapiens
agttgtctattctgagcc

SEQ ID NO: 3973878 - DNA, 13 bp, Homo sapiens
agttgtgatcatc

SEQ ID NO: 3973879 - DNA, 15 bp, Homo sapiens
agttgttgccctggg

SEQ ID NO: 3973880 - DNA, 12 bp, Homo sapiens
agtttaaaaaat

SEQ ID NO: 3973881 - DNA, 14 bp, Homo sapiens
agtttaaaaaatac

SEQ ID NO: 3973882 - DNA, 19 bp, Homo sapiens
agtttaactttgggcccag

SEQ ID NO: 3973883 - DNA, 20 bp, Homo sapiens
agtttaactttgggcccaga

SEQ ID NO: 3973884 - DNA, 15 bp, Homo sapiens
agtttacaagtgtat

SEQ ID NO: 3973885 - DNA, 19 bp, Homo sapiens
agtttacaagtgtatatca

SEQ ID NO: 3973886 - DNA, 18 bp, Homo sapiens
agtttacagtaaataaat

SEQ ID NO: 3973887 - DNA, 21 bp, Homo sapiens
agtttatgtctaaagagcttt

SEQ ID NO: 3973888 - DNA, 17 bp, Homo sapiens
agtttattttgttacac

SEQ ID NO: 3973889 - DNA, 16 bp, Homo sapiens
agtttattttttctac

SEQ ID NO: 3973890 - DNA, 23 bp, Homo sapiens
agtttattttttctacacagtaa

SEQ ID NO: 3973891 - DNA, 16 bp, Homo sapiens
agtttcaattcagtgc

SEQ ID NO: 3973892 - DNA, 17 bp, Homo sapiens
agtttcaattcagtgct

SEQ ID NO: 3973893 - DNA, 12 bp, Homo sapiens
agtttcagagaa

SEQ ID NO: 3973894 - DNA, 17 bp, Homo sapiens
agtttcagatatatatc

SEQ ID NO: 3973895 - DNA, 17 bp, Homo sapiens
agtttcctcatctgcag

SEQ ID NO: 3973896 - DNA, 16 bp, Homo sapiens
agtttctagaggcctc

SEQ ID NO: 3973897 - DNA, 16 bp, Homo sapiens
agtttctagctagaaa

SEQ ID NO: 3973898 - DNA, 15 bp, Homo sapiens
agtttctttctgtta

SEQ ID NO: 3973899 - DNA, 20 bp, Homo sapiens
ataaatgtatatacacatat

SEQ ID NO: 3973900 - DNA, 13 bp, Homo sapiens
ataaatgtatcat

SEQ ID NO: 3973901 - DNA, 17 bp, Homo sapiens
ataaatgtatcatagaa

SEQ ID NO: 3973902 - DNA, 13 bp, Homo sapiens
ataaatgtgtaaa

SEQ ID NO: 3973903 - DNA, 14 bp, Homo sapiens
ataaatgtgtaaat

SEQ ID NO: 3973904 - DNA, 21 bp, Homo sapiens
ataaatgtgtaaatgtggaca

SEQ ID NO: 3973905 - DNA, 14 bp, Homo sapiens
ataaatgtgtattc

SEQ ID NO: 3973906 - DNA, 11 bp, Homo sapiens
ataaatgtgtg

SEQ ID NO: 3973907 - DNA, 11 bp, Homo sapiens
ataaatgttca

SEQ ID NO: 3973908 - DNA, 12 bp, Homo sapiens
ataaatgtttaa

SEQ ID NO: 3973909 - DNA, 14 bp, Homo sapiens
ataaatgtttgtct

SEQ ID NO: 3973910 - DNA, 19 bp, Homo sapiens
ataaattatttttaagaaa

SEQ ID NO: 3973911 - DNA, 22 bp, Homo sapiens
ataaattcacataggcaatatc

SEQ ID NO: 3973912 - DNA, 22 bp, Homo sapiens
ataaattcagatatatttttca

SEQ ID NO: 3973913 - DNA, 16 bp, Homo sapiens
ataaattgctccttga

SEQ ID NO: 3973914 - DNA, 18 bp, Homo sapiens
ataaattgctccttgaca

SEQ ID NO: 3973915 - DNA, 21 bp, Homo sapiens
ataaattggtgataagtggaa

SEQ ID NO: 3973916 - DNA, 17 bp, Homo sapiens
ataaattgtttgaccat

SEQ ID NO: 3973917 - DNA, 20 bp, Homo sapiens
ataaattgtttggcttcctc

SEQ ID NO: 3973918 - DNA, 14 bp, Homo sapiens
ataaattttgtttc

SEQ ID NO: 3973919 - DNA, 12 bp, Homo sapiens
ataacaacaatg

SEQ ID NO: 3973920 - DNA, 15 bp, Homo sapiens
ataacaacctggaga

SEQ ID NO: 3973921 - DNA, 16 bp, Homo sapiens
ataacaagatctttca

SEQ ID NO: 3973922 - DNA, 17 bp, Homo sapiens
ataacaagatctttcag

SEQ ID NO: 3973923 - DNA, 19 bp, Homo sapiens
ataaccagctgtaacacag

SEQ ID NO: 3973924 - DNA, 18 bp, Homo sapiens
ataacctatatgatttat

SEQ ID NO: 3973925 - DNA, 12 bp, Homo sapiens
ataactgagaat

SEQ ID NO: 3973926 - DNA, 16 bp, Homo sapiens
ataacttaaaaaaatg

SEQ ID NO: 3973927 - DNA, 12 bp, Homo sapiens
ataacttaaaat

SEQ ID NO: 3973928 - DNA, 16 bp, Homo sapiens
ataactttagaaataa

SEQ ID NO: 3973929 - DNA, 15 bp, Homo sapiens
ataagaaagtttcac

SEQ ID NO: 3973930 - DNA, 14 bp, Homo sapiens
ataagagaaagaaa

SEQ ID NO: 3973931 - DNA, 23 bp, Homo sapiens
ataagcaaagggagcactgggtt

SEQ ID NO: 3973932 - DNA, 22 bp, Homo sapiens
ataagctgggaaaaaagttttg

SEQ ID NO: 3973933 - DNA, 16 bp, Homo sapiens
ataaggccagaaactc

SEQ ID NO: 3973934 - DNA, 21 bp, Homo sapiens
ataaggcttaggtgccaggct

SEQ ID NO: 3973935 - DNA, 17 bp, Homo sapiens
ataaggtttaaaaagat

SEQ ID NO: 3973936 - DNA, 14 bp, Homo sapiens
ataagtctaaataa

SEQ ID NO: 3973937 - DNA, 16 bp, Homo sapiens
ataagtgctgtttgag

SEQ ID NO: 3973938 - DNA, 17 bp, Homo sapiens
ataagtgctgtttgaga

SEQ ID NO: 3973939 - DNA, 22 bp, Homo sapiens
ataagtgctgtttgagatgtga

SEQ ID NO: 3973940 - DNA, 11 bp, Homo sapiens
ataagtggaaa

SEQ ID NO: 3973941 - DNA, 14 bp, Homo sapiens
ataagtggaaaaaa

SEQ ID NO: 3973942 - DNA, 13 bp, Homo sapiens
ataataaaaagac

SEQ ID NO: 3973943 - DNA, 14 bp, Homo sapiens
ataataaagtgttt

SEQ ID NO: 3973944 - DNA, 17 bp, Homo sapiens
ataataatgttctctgg

SEQ ID NO: 3973945 - DNA, 22 bp, Homo sapiens
ataatacactaattcctttcta

SEQ ID NO: 3973946 - DNA, 19 bp, Homo sapiens
ataatatccactgcaatac

SEQ ID NO: 3973947 - DNA, 14 bp, Homo sapiens
ataatatgtttgag

SEQ ID NO: 3973948 - DNA, 13 bp, Homo sapiens
ataatcagcctct

SEQ ID NO: 3973949 - DNA, 22 bp, Homo sapiens
ataatcggcccacagctcccac

SEQ ID NO: 3973950 - DNA, 12 bp, Homo sapiens
ataatctagaac

SEQ ID NO: 3973951 - DNA, 14 bp, Homo sapiens
ataatctatttaca

SEQ ID NO: 3973952 - DNA, 19 bp, Homo sapiens
ataatctggactcctctgt

SEQ ID NO: 3973953 - DNA, 14 bp, Homo sapiens
ataatgaacagcag

SEQ ID NO: 3973954 - DNA, 17 bp, Homo sapiens
ataatggaaacatttac

SEQ ID NO: 3973955 - DNA, 16 bp, Homo sapiens
ataatggaagagaaat

SEQ ID NO: 3973956 - DNA, 18 bp, Homo sapiens
ataatggaagagaaatct

SEQ ID NO: 3973957 - DNA, 20 bp, Homo sapiens
ataatggaagagaaatctca

SEQ ID NO: 3973958 - DNA, 21 bp, Homo sapiens
ataatggaagagaaatctcat

SEQ ID NO: 3973959 - DNA, 17 bp, Homo sapiens
ataatggaatctatatt

SEQ ID NO: 3973960 - DNA, 15 bp, Homo sapiens
ataatgtgtgtatgt

SEQ ID NO: 3973961 - DNA, 16 bp, Homo sapiens
ataatgtgtgtatgtg

SEQ ID NO: 3973962 - DNA, 19 bp, Homo sapiens
ataatgtgtgtatgtgtat

SEQ ID NO: 3973963 - DNA, 12 bp, Homo sapiens
ataatgtgttaa

SEQ ID NO: 3973964 - DNA, 21 bp, Homo sapiens
ataatgttctttaatgttgtc

SEQ ID NO: 3973965 - DNA, 15 bp, Homo sapiens
ataattaaaaaccac

SEQ ID NO: 3973966 - DNA, 15 bp, Homo sapiens
ataattaatgtgtgt

SEQ ID NO: 3973967 - DNA, 13 bp, Homo sapiens
ataattagaacaa

SEQ ID NO: 3973968 - DNA, 14 bp, Homo sapiens
ataattaggatcta

SEQ ID NO: 3973969 - DNA, 20 bp, Homo sapiens
ataattaggatctatgcaat

SEQ ID NO: 3973970 - DNA, 22 bp, Homo sapiens
ataattaggatctatgcaattt

SEQ ID NO: 3973971 - DNA, 17 bp, Homo sapiens
ataattaggttaacatt

SEQ ID NO: 3973972 - DNA, 14 bp, Homo sapiens
ataattcttgtata

SEQ ID NO: 3973973 - DNA, 19 bp, Homo sapiens
ataattcttgtatattatg

SEQ ID NO: 3973974 - DNA, 14 bp, Homo sapiens
ataattgatcaaat

SEQ ID NO: 3973975 - DNA, 13 bp, Homo sapiens
ataatttaacagt

SEQ ID NO: 3973976 - DNA, 15 bp, Homo sapiens
ataatttaatgcatg

SEQ ID NO: 3973977 - DNA, 20 bp, Homo sapiens
ataattttcaagagaagaaa

SEQ ID NO: 3973978 - DNA, 15 bp, Homo sapiens
ataatttttaaagta

SEQ ID NO: 3973979 - DNA, 21 bp, Homo sapiens
ataatttttaaagtatatatt

SEQ ID NO: 3973980 - DNA, 17 bp, Homo sapiens
ataattttttattcaag

SEQ ID NO: 3973981 - DNA, 13 bp, Homo sapiens
atacaaaataatt

SEQ ID NO: 3973982 - DNA, 20 bp, Homo sapiens
atacaaaataatttaactaa

SEQ ID NO: 3973983 - DNA, 14 bp, Homo sapiens
atacaacaagaaca

SEQ ID NO: 3973984 - DNA, 15 bp, Homo sapiens
atacaacaagaacaa

SEQ ID NO: 3973985 - DNA, 15 bp, Homo sapiens
atacaacacaaagag

SEQ ID NO: 3973986 - DNA, 20 bp, Homo sapiens
atattatggtgtaatgcaca

SEQ ID NO: 3973987 - DNA, 19 bp, Homo sapiens
atattattcaagtgcctct

SEQ ID NO: 3973988 - DNA, 16 bp, Homo sapiens
atattatttaaatgtt

SEQ ID NO: 3973989 - DNA, 20 bp, Homo sapiens
atattcaataaagctgctga

SEQ ID NO: 3973990 - DNA, 20 bp, Homo sapiens
atattcatgcttcttcctta

SEQ ID NO: 3973991 - DNA, 15 bp, Homo sapiens
atattcatgtaataa

SEQ ID NO: 3973992 - DNA, 17 bp, Homo sapiens
atattccaccattcaca

SEQ ID NO: 3973993 - DNA, 18 bp, Homo sapiens
atattccaccattcacat

SEQ ID NO: 3973994 - DNA, 19 bp, Homo sapiens
atattccaccattcacatt

SEQ ID NO: 3973995 - DNA, 22 bp, Homo sapiens
atattctcacgggcagtagctg

SEQ ID NO: 3973996 - DNA, 15 bp, Homo sapiens
atattctggaaaaaa

SEQ ID NO: 3973997 - DNA, 13 bp, Homo sapiens
atattggtattca

SEQ ID NO: 3973998 - DNA, 18 bp, Homo sapiens
atattgtatattctggaa

SEQ ID NO: 3973999 - DNA, 16 bp, Homo sapiens
atattgtattaagggc

SEQ ID NO: 3974000 - DNA, 15 bp, Homo sapiens
atattgtcagatatt

SEQ ID NO: 3974001 - DNA, 19 bp, Homo sapiens
atattgtgcttaaattatt

SEQ ID NO: 3974002 - DNA, 18 bp, Homo sapiens
atatttaaacagcagtgt

SEQ ID NO: 3974003 - DNA, 14 bp, Homo sapiens
atatttaaagacag

SEQ ID NO: 3974004 - DNA, 18 bp, Homo sapiens
atatttaagccttttgtg

SEQ ID NO: 3974005 - DNA, 20 bp, Homo sapiens
atatttaatttttacatgac

SEQ ID NO: 3974006 - DNA, 21 bp, Homo sapiens
atatttagttatagtttcaga

SEQ ID NO: 3974007 - DNA, 12 bp, Homo sapiens
atatttatattg

SEQ ID NO: 3974008 - DNA, 13 bp, Homo sapiens
atatttatgctta

SEQ ID NO: 3974009 - DNA, 18 bp, Homo sapiens
atatttatgtctatttaa

SEQ ID NO: 3974010 - DNA, 19 bp, Homo sapiens
atatttatgtctatttaag

SEQ ID NO: 3974011 - DNA, 17 bp, Homo sapiens
atatttcaaatgaacac

SEQ ID NO: 3974012 - DNA, 15 bp, Homo sapiens
atatttctgatataa

SEQ ID NO: 3974013 - DNA, 16 bp, Homo sapiens
atatttggaaagagac

SEQ ID NO: 3974014 - DNA, 15 bp, Homo sapiens
atatttgtgtatgtg

SEQ ID NO: 3974015 - DNA, 21 bp, Homo sapiens
atattttagatgcaatgtgat

SEQ ID NO: 3974016 - DNA, 14 bp, Homo sapiens
atattttataattt

SEQ ID NO: 3974017 - DNA, 23 bp, Homo sapiens
atattttcttccaagcaaaggtg

SEQ ID NO: 3974018 - DNA, 13 bp, Homo sapiens
atattttgtatat

SEQ ID NO: 3974019 - DNA, 21 bp, Homo sapiens
atattttgtatatatctgctt

SEQ ID NO: 3974020 - DNA, 15 bp, Homo sapiens
atatttttcaaccag

SEQ ID NO: 3974021 - DNA, 16 bp, Homo sapiens
atatttttgatggtaa

SEQ ID NO: 3974022 - DNA, 18 bp, Homo sapiens
atattttttcagaaatat

SEQ ID NO: 3974023 - DNA, 19 bp, Homo sapiens
atcaaaacatatcaattca

SEQ ID NO: 3974024 - DNA, 19 bp, Homo sapiens
atcaaaagctgcttgacta

SEQ ID NO: 3974025 - DNA, 17 bp, Homo sapiens
atcaaaataaattgaaa

SEQ ID NO: 3974026 - DNA, 19 bp, Homo sapiens
atcaaaataaattgaaata

SEQ ID NO: 3974027 - DNA, 14 bp, Homo sapiens
atcaaagcaagggc

SEQ ID NO: 3974028 - DNA, 14 bp, Homo sapiens
atcaaagtaaaaaa

SEQ ID NO: 3974029 - DNA, 17 bp, Homo sapiens
atcaaatatgcaaagca

SEQ ID NO: 3974030 - DNA, 22 bp, Homo sapiens
atcaaatgctgtagaatgcttg

SEQ ID NO: 3974031 - DNA, 17 bp, Homo sapiens
atcaaatttgccaccac

SEQ ID NO: 3974032 - DNA, 22 bp, Homo sapiens
atcaagagtgagtgaacaacta

SEQ ID NO: 3974033 - DNA, 18 bp, Homo sapiens
atcaagctgtacatttgg

SEQ ID NO: 3974034 - DNA, 15 bp, Homo sapiens
atcaaggatgttctg

SEQ ID NO: 3974035 - DNA, 12 bp, Homo sapiens
atcaagtcaccg

SEQ ID NO: 3974036 - DNA, 14 bp, Homo sapiens
atcaatggaaacag

SEQ ID NO: 3974037 - DNA, 15 bp, Homo sapiens
atcaatggaaacagg

SEQ ID NO: 3974038 - DNA, 17 bp, Homo sapiens
atcaattattacattta

SEQ ID NO: 3974039 - DNA, 23 bp, Homo sapiens
atcaatttaaaatcattcaatat

SEQ ID NO: 3974040 - DNA, 15 bp, Homo sapiens
atcaatttcccagaa

SEQ ID NO: 3974041 - DNA, 14 bp, Homo sapiens
atcaatttttatac

SEQ ID NO: 3974042 - DNA, 17 bp, Homo sapiens
atcaatttttatacata

SEQ ID NO: 3974043 - DNA, 21 bp, Homo sapiens
atcaatttttatacatatcag

SEQ ID NO: 3974044 - DNA, 22 bp, Homo sapiens
atcaatttttatacatatcaga

SEQ ID NO: 3974045 - DNA, 23 bp, Homo sapiens
atcaatttttatacatatcagaa

SEQ ID NO: 3974046 - DNA, 19 bp, Homo sapiens
atcaatttttcttatttca

SEQ ID NO: 3974047 - DNA, 13 bp, Homo sapiens
atcacaagcaata

SEQ ID NO: 3974048 - DNA, 15 bp, Homo sapiens
atcacaagcaataat

SEQ ID NO: 3974049 - DNA, 13 bp, Homo sapiens
atcacacctctgg

SEQ ID NO: 3974050 - DNA, 18 bp, Homo sapiens
atcacacctctgggcttc

SEQ ID NO: 3974051 - DNA, 20 bp, Homo sapiens
atcacaggggcggggcagga

SEQ ID NO: 3974052 - DNA, 23 bp, Homo sapiens
atcacagtgactttacaggaggt

SEQ ID NO: 3974053 - DNA, 22 bp, Homo sapiens
atcacagtggcgagaggagagg

SEQ ID NO: 3974054 - DNA, 14 bp, Homo sapiens
atcacatacaattt

SEQ ID NO: 3974055 - DNA, 15 bp, Homo sapiens
atcaccagcccggcc

SEQ ID NO: 3974056 - DNA, 14 bp, Homo sapiens
atcaccatgtaaca

SEQ ID NO: 3974057 - DNA, 13 bp, Homo sapiens
atcacccaggctg

SEQ ID NO: 3974058 - DNA, 12 bp, Homo sapiens
atcacccagtcc

SEQ ID NO: 3974059 - DNA, 14 bp, Homo sapiens
atcacccagtcctg

SEQ ID NO: 3974060 - DNA, 17 bp, Homo sapiens
atcacccagtcctggcc

SEQ ID NO: 3974061 - DNA, 22 bp, Homo sapiens
atcaccgacgcgtctcctgttt

SEQ ID NO: 3974062 - DNA, 20 bp, Homo sapiens
atcacctctgtaatttttca

SEQ ID NO: 3974063 - DNA, 14 bp, Homo sapiens
atcacctggagggc

SEQ ID NO: 3974064 - DNA, 18 bp, Homo sapiens
atcacctttttgactttt

SEQ ID NO: 3974065 - DNA, 12 bp, Homo sapiens
atcactccctgg

SEQ ID NO: 3974066 - DNA, 13 bp, Homo sapiens
atcactccctgga

SEQ ID NO: 3974067 - DNA, 15 bp, Homo sapiens
atcactgattgggtg

SEQ ID NO: 3974068 - DNA, 19 bp, Homo sapiens
atcactggagcaccaggca

SEQ ID NO: 3974069 - DNA, 22 bp, Homo sapiens
atcactggcaatgaaaaattct

SEQ ID NO: 3974070 - DNA, 13 bp, Homo sapiens
atcacttgtaaat

SEQ ID NO: 3974071 - DNA, 14 bp, Homo sapiens
atcacttgtaaata

SEQ ID NO: 3974072 - DNA, 15 bp, Homo sapiens
atcacttgtaaataa

SEQ ID NO: 3974073 - DNA, 18 bp, Homo sapiens
atctgagcctaaatctaa

SEQ ID NO: 3974074 - DNA, 21 bp, Homo sapiens
atctgatcgggataacaaaat

SEQ ID NO: 3974075 - DNA, 17 bp, Homo sapiens
atctgatctgagtgaga

SEQ ID NO: 3974076 - DNA, 16 bp, Homo sapiens
atctgatggtgagctg

SEQ ID NO: 3974077 - DNA, 17 bp, Homo sapiens
atctgatggtgagctgg

SEQ ID NO: 3974078 - DNA, 13 bp, Homo sapiens
atctgatttaatg

SEQ ID NO: 3974079 - DNA, 14 bp, Homo sapiens
atctgatttaatgt

SEQ ID NO: 3974080 - DNA, 15 bp, Homo sapiens
atctgatttaatgtt

SEQ ID NO: 3974081 - DNA, 16 bp, Homo sapiens
atctgatttaatgttt

SEQ ID NO: 3974082 - DNA, 17 bp, Homo sapiens
atctgatttaatgtttt

SEQ ID NO: 3974083 - DNA, 19 bp, Homo sapiens
atctgatttaatgttttct

SEQ ID NO: 3974084 - DNA, 21 bp, Homo sapiens
atctgcaccctcgatgaagcc

SEQ ID NO: 3974085 - DNA, 20 bp, Homo sapiens
atctgcagggggtgtgtctg

SEQ ID NO: 3974086 - DNA, 21 bp, Homo sapiens
atctgcattccccgctgccca

SEQ ID NO: 3974087 - DNA, 22 bp, Homo sapiens
atctgcatttataaatgtgtgg

SEQ ID NO: 3974088 - DNA, 17 bp, Homo sapiens
atctgccattactctgc

SEQ ID NO: 3974089 - DNA, 12 bp, Homo sapiens
atctgcctggcc

SEQ ID NO: 3974090 - DNA, 12 bp, Homo sapiens
atctgcctgggc

SEQ ID NO: 3974091 - DNA, 13 bp, Homo sapiens
atctgcctgggcc

SEQ ID NO: 3974092 - DNA, 14 bp, Homo sapiens
atctgcctgggcct

SEQ ID NO: 3974093 - DNA, 15 bp, Homo sapiens
atctgcctgggcctg

SEQ ID NO: 3974094 - DNA, 19 bp, Homo sapiens
atctgcctgggcctgtgca

SEQ ID NO: 3974095 - DNA, 20 bp, Homo sapiens
atctgcctgggcctgtgcag

SEQ ID NO: 3974096 - DNA, 18 bp, Homo sapiens
atctgcctgtggccttgc

SEQ ID NO: 3974097 - DNA, 12 bp, Homo sapiens
atctgcttcagt

SEQ ID NO: 3974098 - DNA, 21 bp, Homo sapiens
atctgcttggttggctggcag

SEQ ID NO: 3974099 - DNA, 16 bp, Homo sapiens
atctggaaggcccctc

SEQ ID NO: 3974100 - DNA, 15 bp, Homo sapiens
atctggactcctctg

SEQ ID NO: 3974101 - DNA, 16 bp, Homo sapiens
atctggactcctctgt

SEQ ID NO: 3974102 - DNA, 18 bp, Homo sapiens
atctggactcctctgtcc

SEQ ID NO: 3974103 - DNA, 19 bp, Homo sapiens
atctggactcctctgtcca

SEQ ID NO: 3974104 - DNA, 23 bp, Homo sapiens
atctggagagctagaacctggag

SEQ ID NO: 3974105 - DNA, 14 bp, Homo sapiens
atctggctcctgtt

SEQ ID NO: 3974106 - DNA, 18 bp, Homo sapiens
atctggctcctgtttcca

SEQ ID NO: 3974107 - DNA, 23 bp, Homo sapiens
atctggcttttcgcttgcttctg

SEQ ID NO: 3974108 - DNA, 16 bp, Homo sapiens
atctgggaccctttcc

SEQ ID NO: 3974109 - DNA, 17 bp, Homo sapiens
atctgggaccctttcct

SEQ ID NO: 3974110 - DNA, 21 bp, Homo sapiens
atctgggaggcagaacaggct

SEQ ID NO: 3974111 - DNA, 12 bp, Homo sapiens
atctgtactgta

SEQ ID NO: 3974112 - DNA, 13 bp, Homo sapiens
atctgtactgtaa

SEQ ID NO: 3974113 - DNA, 17 bp, Homo sapiens
atctgtagggctggacc

SEQ ID NO: 3974114 - DNA, 21 bp, Homo sapiens
atctgtatatacaataacata

SEQ ID NO: 3974115 - DNA, 20 bp, Homo sapiens
atctgtatatgttgtaataa

SEQ ID NO: 3974116 - DNA, 16 bp, Homo sapiens
atctgtcatctctctg

SEQ ID NO: 3974117 - DNA, 16 bp, Homo sapiens
atctgtcccctctccc

SEQ ID NO: 3974118 - DNA, 17 bp, Homo sapiens
atctgtcccctctcccc

SEQ ID NO: 3974119 - DNA, 18 bp, Homo sapiens
atctgtcccctctcccct

SEQ ID NO: 3974120 - DNA, 17 bp, Homo sapiens
atctgtgataattttct

SEQ ID NO: 3974121 - DNA, 22 bp, Homo sapiens
atctgtgcaaatccttgatact

SEQ ID NO: 3974122 - DNA, 15 bp, Homo sapiens
atctgttactgaaat

SEQ ID NO: 3974123 - DNA, 16 bp, Homo sapiens
atctgttactgaaatg

SEQ ID NO: 3974124 - DNA, 22 bp, Homo sapiens
atctgttatcctgctagctgta

SEQ ID NO: 3974125 - DNA, 15 bp, Homo sapiens
atctgttgttttgtt

SEQ ID NO: 3974126 - DNA, 22 bp, Homo sapiens
atctgttttaaatttatttcaa

SEQ ID NO: 3974127 - DNA, 17 bp, Homo sapiens
atctgttttgtatatga

SEQ ID NO: 3974128 - DNA, 20 bp, Homo sapiens
atctgttttgtatatgatct

SEQ ID NO: 3974129 - DNA, 15 bp, Homo sapiens
atcttaaaagtgtaa

SEQ ID NO: 3974130 - DNA, 19 bp, Homo sapiens
atcttaattttttttaatg

SEQ ID NO: 3974131 - DNA, 13 bp, Homo sapiens
atcttacatctgc

SEQ ID NO: 3974132 - DNA, 19 bp, Homo sapiens
atcttcaaggtgtaaaata

SEQ ID NO: 3974133 - DNA, 14 bp, Homo sapiens
atcttcagagcagg

SEQ ID NO: 3974134 - DNA, 14 bp, Homo sapiens
atcttcctgctgct

SEQ ID NO: 3974135 - DNA, 15 bp, Homo sapiens
atcttcctgctgctg

SEQ ID NO: 3974136 - DNA, 18 bp, Homo sapiens
atcttcggggtgtgatga

SEQ ID NO: 3974137 - DNA, 12 bp, Homo sapiens
atcttctctctt

SEQ ID NO: 3974138 - DNA, 18 bp, Homo sapiens
atcttctgcagacactgt

SEQ ID NO: 3974139 - DNA, 20 bp, Homo sapiens
atcttcttatgcaatttcct

SEQ ID NO: 3974140 - DNA, 23 bp, Homo sapiens
atcttgacacggtgaaatccagg

SEQ ID NO: 3974141 - DNA, 14 bp, Homo sapiens
atcttgacatgtaa

SEQ ID NO: 3974142 - DNA, 17 bp, Homo sapiens
atcttgacattcaaggc

SEQ ID NO: 3974143 - DNA, 13 bp, Homo sapiens
atcttgccccctc

SEQ ID NO: 3974144 - DNA, 17 bp, Homo sapiens
atcttgccccctcatct

SEQ ID NO: 3974145 - DNA, 14 bp, Homo sapiens
atcttggctcactg

SEQ ID NO: 3974146 - DNA, 15 bp, Homo sapiens
atcttgtccacagtc

SEQ ID NO: 3974147 - DNA, 12 bp, Homo sapiens
atctttaaaata

SEQ ID NO: 3974148 - DNA, 19 bp, Homo sapiens
atctttcagcactcagaaa

SEQ ID NO: 3974149 - DNA, 12 bp, Homo sapiens
atctttcctgtc

SEQ ID NO: 3974150 - DNA, 16 bp, Homo sapiens
atctttccttgtctct

SEQ ID NO: 3974151 - DNA, 18 bp, Homo sapiens
atctttccttgtctctca

SEQ ID NO: 3974152 - DNA, 11 bp, Homo sapiens
atctttcttct

SEQ ID NO: 3974153 - DNA, 21 bp, Homo sapiens
atctttctttacctgagacca

SEQ ID NO: 3974154 - DNA, 14 bp, Homo sapiens
atctttgaaaagaa

SEQ ID NO: 3974155 - DNA, 15 bp, Homo sapiens
atctttgaaaagaaa

SEQ ID NO: 3974156 - DNA, 16 bp, Homo sapiens
atctttgttttaacca

SEQ ID NO: 3974157 - DNA, 18 bp, Homo sapiens
atctttgttttaaccagt

SEQ ID NO: 3974158 - DNA, 13 bp, Homo sapiens
atctttttcctcc

SEQ ID NO: 3974159 - DNA, 17 bp, Homo sapiens
atgaaacacttctcatc

SEQ ID NO: 3974160 - DNA, 17 bp, Homo sapiens
atgtatatgtatatata

SEQ ID NO: 3974161 - DNA, 15 bp, Homo sapiens
atgtatcctgataaa

SEQ ID NO: 3974162 - DNA, 20 bp, Homo sapiens
atgtatggaatacagtgtta

SEQ ID NO: 3974163 - DNA, 19 bp, Homo sapiens
atgtattaagccaaacatg

SEQ ID NO: 3974164 - DNA, 20 bp, Homo sapiens
atgtatttatatgttaattt

SEQ ID NO: 3974165 - DNA, 16 bp, Homo sapiens
atgtcaaggactcctg

SEQ ID NO: 3974166 - DNA, 18 bp, Homo sapiens
atgtcaaggactcctgtc

SEQ ID NO: 3974167 - DNA, 14 bp, Homo sapiens
atgtcaatttgtat

SEQ ID NO: 3974168 - DNA, 15 bp, Homo sapiens
atgtcaccaccttcc

SEQ ID NO: 3974169 - DNA, 23 bp, Homo sapiens
atgtcaccaccttcccagctctc

SEQ ID NO: 3974170 - DNA, 13 bp, Homo sapiens
atgtcacctcagc

SEQ ID NO: 3974171 - DNA, 21 bp, Homo sapiens
atgtcagagccaggctctgcc

SEQ ID NO: 3974172 - DNA, 11 bp, Homo sapiens
atgtcagcctt

SEQ ID NO: 3974173 - DNA, 22 bp, Homo sapiens
atgtcatcaaatattaccaaaa

SEQ ID NO: 3974174 - DNA, 18 bp, Homo sapiens
atgtcatgtacttcctgt

SEQ ID NO: 3974175 - DNA, 15 bp, Homo sapiens
atgtcattaatgtgt

SEQ ID NO: 3974176 - DNA, 17 bp, Homo sapiens
atgtcattaatgtgttg

SEQ ID NO: 3974177 - DNA, 17 bp, Homo sapiens
atgtcattatgtagaaa

SEQ ID NO: 3974178 - DNA, 23 bp, Homo sapiens
atgtcattatgtagaaatattat

SEQ ID NO: 3974179 - DNA, 12 bp, Homo sapiens
atgtccagaaga

SEQ ID NO: 3974180 - DNA, 22 bp, Homo sapiens
atgtccagaagaatattcagga

SEQ ID NO: 3974181 - DNA, 22 bp, Homo sapiens
atgtccagctagccaactcctc

SEQ ID NO: 3974182 - DNA, 21 bp, Homo sapiens
atgtcctaaggacacactaat

SEQ ID NO: 3974183 - DNA, 14 bp, Homo sapiens
atgtcgcctctgca

SEQ ID NO: 3974184 - DNA, 15 bp, Homo sapiens
atgtcgcctctgcat

SEQ ID NO: 3974185 - DNA, 20 bp, Homo sapiens
atgtcggcacgtcccatgtg

SEQ ID NO: 3974186 - DNA, 11 bp, Homo sapiens
atgtctaaaga

SEQ ID NO: 3974187 - DNA, 13 bp, Homo sapiens
atgtctaattgag

SEQ ID NO: 3974188 - DNA, 21 bp, Homo sapiens
atgtctctcagaattcttcag

SEQ ID NO: 3974189 - DNA, 16 bp, Homo sapiens
atgtctcttcctctgt

SEQ ID NO: 3974190 - DNA, 20 bp, Homo sapiens
atgtctcttcctctgttcta

SEQ ID NO: 3974191 - DNA, 15 bp, Homo sapiens
atgtctcttgtagaa

SEQ ID NO: 3974192 - DNA, 13 bp, Homo sapiens
atgtctgcttctg

SEQ ID NO: 3974193 - DNA, 15 bp, Homo sapiens
atgtgaaagtgtaaa

SEQ ID NO: 3974194 - DNA, 16 bp, Homo sapiens
atgtgaagggtggggt

SEQ ID NO: 3974195 - DNA, 12 bp, Homo sapiens
atgtgaatcaga

SEQ ID NO: 3974196 - DNA, 16 bp, Homo sapiens
atgtgaatcagaccct

SEQ ID NO: 3974197 - DNA, 21 bp, Homo sapiens
atgtgaatcagaccctacccc

SEQ ID NO: 3974198 - DNA, 18 bp, Homo sapiens
atgtgaattgcctgcaga

SEQ ID NO: 3974199 - DNA, 14 bp, Homo sapiens
atgtgacacattct

SEQ ID NO: 3974200 - DNA, 16 bp, Homo sapiens
atgtgacaggtaaact

SEQ ID NO: 3974201 - DNA, 18 bp, Homo sapiens
atgtgaccacatacgtgt

SEQ ID NO: 3974202 - DNA, 13 bp, Homo sapiens
atgtgatcactga

SEQ ID NO: 3974203 - DNA, 16 bp, Homo sapiens
atgtgatccttttatg

SEQ ID NO: 3974204 - DNA, 17 bp, Homo sapiens
atgtgatccttttatgt

SEQ ID NO: 3974205 - DNA, 14 bp, Homo sapiens
atgtgatgctggta

SEQ ID NO: 3974206 - DNA, 17 bp, Homo sapiens
atgtgatgttaactatt

SEQ ID NO: 3974207 - DNA, 15 bp, Homo sapiens
atgtgattccttttg

SEQ ID NO: 3974208 - DNA, 14 bp, Homo sapiens
atgtgcaaattttg

SEQ ID NO: 3974209 - DNA, 15 bp, Homo sapiens
atgtgcacatgtgtc

SEQ ID NO: 3974210 - DNA, 14 bp, Homo sapiens
atgtgcagtatttt

SEQ ID NO: 3974211 - DNA, 16 bp, Homo sapiens
atgtgcgcacacacag

SEQ ID NO: 3974212 - DNA, 15 bp, Homo sapiens
atgtgctattgaact

SEQ ID NO: 3974213 - DNA, 18 bp, Homo sapiens
atgtgctattgaactgag

SEQ ID NO: 3974214 - DNA, 21 bp, Homo sapiens
atgtgctattgaactgagcca

SEQ ID NO: 3974215 - DNA, 21 bp, Homo sapiens
atgtgcttccctaggctgagc

SEQ ID NO: 3974216 - DNA, 18 bp, Homo sapiens
atgtggaatggattatag

SEQ ID NO: 3974217 - DNA, 23 bp, Homo sapiens
atgtggattagctagaatgcaca

SEQ ID NO: 3974218 - DNA, 16 bp, Homo sapiens
atgtggccccaggtgc

SEQ ID NO: 3974219 - DNA, 17 bp, Homo sapiens
atgtggccccaggtgcc

SEQ ID NO: 3974220 - DNA, 22 bp, Homo sapiens
atgtggcccctgaacaagaatt

SEQ ID NO: 3974221 - DNA, 15 bp, Homo sapiens
atgtggccctggcct

SEQ ID NO: 3974222 - DNA, 16 bp, Homo sapiens
atgtggccctggcctg

SEQ ID NO: 3974223 - DNA, 10 bp, Homo sapiens
atgtggctga

SEQ ID NO: 3974224 - DNA, 11 bp, Homo sapiens
atgtggctgaa

SEQ ID NO: 3974225 - DNA, 18 bp, Homo sapiens
atgtgggcagtgatgtca

SEQ ID NO: 3974226 - DNA, 19 bp, Homo sapiens
atgtgtaaatggagcttgt

SEQ ID NO: 3974227 - DNA, 16 bp, Homo sapiens
atgtgtatatatacat

SEQ ID NO: 3974228 - DNA, 17 bp, Homo sapiens
atgtgtatatatacata

SEQ ID NO: 3974229 - DNA, 18 bp, Homo sapiens
atgtgtgaattctgcaac

SEQ ID NO: 3974230 - DNA, 11 bp, Homo sapiens
atgtgtgcatg

SEQ ID NO: 3974231 - DNA, 12 bp, Homo sapiens
atgtgtgcatgt

SEQ ID NO: 3974232 - DNA, 17 bp, Homo sapiens
atgtgtgcatgtgagca

SEQ ID NO: 3974233 - DNA, 18 bp, Homo sapiens
atgtgtgccatagagttt

SEQ ID NO: 3974234 - DNA, 12 bp, Homo sapiens
atgtgtgcctgt

SEQ ID NO: 3974235 - DNA, 15 bp, Homo sapiens
atgtgtggatgtgta

SEQ ID NO: 3974236 - DNA, 18 bp, Homo sapiens
atgtgtggatgtgtaaat

SEQ ID NO: 3974237 - DNA, 15 bp, Homo sapiens
atgtgtggcagattt

SEQ ID NO: 3974238 - DNA, 20 bp, Homo sapiens
atgtgtggtgctaactgtat

SEQ ID NO: 3974239 - DNA, 20 bp, Homo sapiens
atgtgtgtggtgtgtgtgct

SEQ ID NO: 3974240 - DNA, 12 bp, Homo sapiens
atgtgtgtttaa

SEQ ID NO: 3974241 - DNA, 20 bp, Homo sapiens
atgtgttaaacatgctaaat

SEQ ID NO: 3974242 - DNA, 23 bp, Homo sapiens
atgtgttcaaggaccacatgtgt

SEQ ID NO: 3974243 - DNA, 14 bp, Homo sapiens
atgtgttgaaaaaa

SEQ ID NO: 3974244 - DNA, 20 bp, Homo sapiens
atgtgtttaaaacatgcacg

SEQ ID NO: 3974245 - DNA, 23 bp, Homo sapiens
atgtgttttgcacgtcttgctat

SEQ ID NO: 3974246 - DNA, 23 bp, Homo sapiens
atgttaaccagaataaagttctg

SEQ ID NO: 3974247 - DNA, 15 bp, Homo sapiens
attctgtgaagaatg

SEQ ID NO: 3974248 - DNA, 13 bp, Homo sapiens
attctgtgttgaa

SEQ ID NO: 3974249 - DNA, 14 bp, Homo sapiens
attctgttgcccag

SEQ ID NO: 3974250 - DNA, 20 bp, Homo sapiens
attctgttgcccaggctggc

SEQ ID NO: 3974251 - DNA, 12 bp, Homo sapiens
attctgttttct

SEQ ID NO: 3974252 - DNA, 13 bp, Homo sapiens
attctgttttctt

SEQ ID NO: 3974253 - DNA, 21 bp, Homo sapiens
attcttccagtgcaacaaaat

SEQ ID NO: 3974254 - DNA, 17 bp, Homo sapiens
attcttcctagttttct

SEQ ID NO: 3974255 - DNA, 12 bp, Homo sapiens
attcttgtatat

SEQ ID NO: 3974256 - DNA, 14 bp, Homo sapiens
attcttgtcaaaaa

SEQ ID NO: 3974257 - DNA, 12 bp, Homo sapiens
attctttaaatt

SEQ ID NO: 3974258 - DNA, 21 bp, Homo sapiens
attctttatttctgtcattca

SEQ ID NO: 3974259 - DNA, 16 bp, Homo sapiens
attctttttaaagtat

SEQ ID NO: 3974260 - DNA, 20 bp, Homo sapiens
attgaaatataatgcaaacc

SEQ ID NO: 3974261 - DNA, 16 bp, Homo sapiens
attgaagaaaagcact

SEQ ID NO: 3974262 - DNA, 21 bp, Homo sapiens
attgaagagatttcaacatat

SEQ ID NO: 3974263 - DNA, 15 bp, Homo sapiens
attgaatatatcaga

SEQ ID NO: 3974264 - DNA, 22 bp, Homo sapiens
attgaatatatcagaatctgtg

SEQ ID NO: 3974265 - DNA, 20 bp, Homo sapiens
attgacaacattttattacc

SEQ ID NO: 3974266 - DNA, 13 bp, Homo sapiens
attgacctcagct

SEQ ID NO: 3974267 - DNA, 16 bp, Homo sapiens
attgacctcagctgca

SEQ ID NO: 3974268 - DNA, 20 bp, Homo sapiens
attgaccttctccctcactc

SEQ ID NO: 3974269 - DNA, 21 bp, Homo sapiens
attgaggcctgccctcaggga

SEQ ID NO: 3974270 - DNA, 13 bp, Homo sapiens
attgatgtttcca

SEQ ID NO: 3974271 - DNA, 19 bp, Homo sapiens
attgatgtttccagaaaat

SEQ ID NO: 3974272 - DNA, 13 bp, Homo sapiens
attgatttcaaga

SEQ ID NO: 3974273 - DNA, 16 bp, Homo sapiens
attgatttcaagacct

SEQ ID NO: 3974274 - DNA, 14 bp, Homo sapiens
attgatttgaccca

SEQ ID NO: 3974275 - DNA, 16 bp, Homo sapiens
attgatttgacccact

SEQ ID NO: 3974276 - DNA, 12 bp, Homo sapiens
attgcaatattt

SEQ ID NO: 3974277 - DNA, 15 bp, Homo sapiens
attgcacaatttgag

SEQ ID NO: 3974278 - DNA, 19 bp, Homo sapiens
attgcagttcaaatcctca

SEQ ID NO: 3974279 - DNA, 18 bp, Homo sapiens
attgcatcacctctgtaa

SEQ ID NO: 3974280 - DNA, 13 bp, Homo sapiens
attgcatgtaaaa

SEQ ID NO: 3974281 - DNA, 19 bp, Homo sapiens
attgccacaatgcctctcc

SEQ ID NO: 3974282 - DNA, 20 bp, Homo sapiens
attgccacaatgcctctccc

SEQ ID NO: 3974283 - DNA, 20 bp, Homo sapiens
attgcctccacctctccttg

SEQ ID NO: 3974284 - DNA, 14 bp, Homo sapiens
attgcctgcagaga

SEQ ID NO: 3974285 - DNA, 23 bp, Homo sapiens
attgcgaaacaacttgtgttcta

SEQ ID NO: 3974286 - DNA, 15 bp, Homo sapiens
attgcgaatgtgcag

SEQ ID NO: 3974287 - DNA, 10 bp, Homo sapiens
attgctgtga

SEQ ID NO: 3974288 - DNA, 13 bp, Homo sapiens
attgctgttgttg

SEQ ID NO: 3974289 - DNA, 16 bp, Homo sapiens
attgcttaaaatagca

SEQ ID NO: 3974290 - DNA, 17 bp, Homo sapiens
attgcttaaaatagcaa

SEQ ID NO: 3974291 - DNA, 20 bp, Homo sapiens
attgcttttgttgtgacttt

SEQ ID NO: 3974292 - DNA, 21 bp, Homo sapiens
attgcttttgttgtgactttt

SEQ ID NO: 3974293 - DNA, 21 bp, Homo sapiens
attggaagtgttcaagaaata

SEQ ID NO: 3974294 - DNA, 15 bp, Homo sapiens
attggaattctggat

SEQ ID NO: 3974295 - DNA, 15 bp, Homo sapiens
attggaattttctta

SEQ ID NO: 3974296 - DNA, 13 bp, Homo sapiens
attggccactggg

SEQ ID NO: 3974297 - DNA, 23 bp, Homo sapiens
attggctttaaacacccttcaca

SEQ ID NO: 3974298 - DNA, 18 bp, Homo sapiens
attgggaagctgggggaa

SEQ ID NO: 3974299 - DNA, 18 bp, Homo sapiens
attgggagcttgggaatg

SEQ ID NO: 3974300 - DNA, 14 bp, Homo sapiens
attgggagggatga

SEQ ID NO: 3974301 - DNA, 15 bp, Homo sapiens
attgggagggatgag

SEQ ID NO: 3974302 - DNA, 17 bp, Homo sapiens
attgggtgccatgtgga

SEQ ID NO: 3974303 - DNA, 17 bp, Homo sapiens
attggtatcaagaaagt

SEQ ID NO: 3974304 - DNA, 18 bp, Homo sapiens
attggtatcaagaaagtc

SEQ ID NO: 3974305 - DNA, 18 bp, Homo sapiens
attggtattcactaatct

SEQ ID NO: 3974306 - DNA, 15 bp, Homo sapiens
attggtgataagtgg

SEQ ID NO: 3974307 - DNA, 16 bp, Homo sapiens
attggtgataagtgga

SEQ ID NO: 3974308 - DNA, 19 bp, Homo sapiens
attgtacactaacatattt

SEQ ID NO: 3974309 - DNA, 15 bp, Homo sapiens
attgtacactatcta

SEQ ID NO: 3974310 - DNA, 19 bp, Homo sapiens
attgtagaaacacagtttt

SEQ ID NO: 3974311 - DNA, 22 bp, Homo sapiens
attgtataagattagaatgaaa

SEQ ID NO: 3974312 - DNA, 13 bp, Homo sapiens
attgtatattctg

SEQ ID NO: 3974313 - DNA, 16 bp, Homo sapiens
attgtatattctggaa

SEQ ID NO: 3974314 - DNA, 12 bp, Homo sapiens
attgtccatatc

SEQ ID NO: 3974315 - DNA, 20 bp, Homo sapiens
attgtccatatcagacctct

SEQ ID NO: 3974316 - DNA, 11 bp, Homo sapiens
attgtccatgt

SEQ ID NO: 3974317 - DNA, 17 bp, Homo sapiens
attgtccttcagagctc

SEQ ID NO: 3974318 - DNA, 15 bp, Homo sapiens
attgtctccttgagt

SEQ ID NO: 3974319 - DNA, 18 bp, Homo sapiens
attgtcttccaaccccag

SEQ ID NO: 3974320 - DNA, 22 bp, Homo sapiens
attgtcttccaaccccagctgg

SEQ ID NO: 3974321 - DNA, 23 bp, Homo sapiens
attgtcttccaaccccagctggc

SEQ ID NO: 3974322 - DNA, 13 bp, Homo sapiens
attgtgatgtttt

SEQ ID NO: 3974323 - DNA, 15 bp, Homo sapiens
attgtgcaaatggaa

SEQ ID NO: 3974324 - DNA, 15 bp, Homo sapiens
attgtgcctatgata

SEQ ID NO: 3974325 - DNA, 19 bp, Homo sapiens
attgtgcctatgataaatt

SEQ ID NO: 3974326 - DNA, 17 bp, Homo sapiens
attgtgcttaaattatt

SEQ ID NO: 3974327 - DNA, 18 bp, Homo sapiens
attgtgttgccttagcac

SEQ ID NO: 3974328 - DNA, 20 bp, Homo sapiens
attgtgttgccttagcactt

SEQ ID NO: 3974329 - DNA, 21 bp, Homo sapiens
attgtgttgccttagcacttc

SEQ ID NO: 3974330 - DNA, 23 bp, Homo sapiens
attgtgttgccttagcacttctt

SEQ ID NO: 3974331 - DNA, 13 bp, Homo sapiens
attgttcctgtca

SEQ ID NO: 3974332 - DNA, 14 bp, Homo sapiens
attgttgattaatt

SEQ ID NO: 3974333 - DNA, 16 bp, Homo sapiens
attgttgctccctgtg

SEQ ID NO: 3974334 - DNA, 16 bp, Homo sapiens
caaaaggcagcccttt

SEQ ID NO: 3974335 - DNA, 12 bp, Homo sapiens
caaaagggcagc

SEQ ID NO: 3974336 - DNA, 16 bp, Homo sapiens
caaaagggcagccagg

SEQ ID NO: 3974337 - DNA, 17 bp, Homo sapiens
caaaagggcagccaggg

SEQ ID NO: 3974338 - DNA, 20 bp, Homo sapiens
caaaagggcagccaggggct

SEQ ID NO: 3974339 - DNA, 21 bp, Homo sapiens
caaaagggcagccaggggctg

SEQ ID NO: 3974340 - DNA, 18 bp, Homo sapiens
caaaaggtgcctgtgagg

SEQ ID NO: 3974341 - DNA, 23 bp, Homo sapiens
caaaaggtgcctgtgaggcaggg

SEQ ID NO: 3974342 - DNA, 14 bp, Homo sapiens
caaaagtgatctgt

SEQ ID NO: 3974343 - DNA, 20 bp, Homo sapiens
caaaagtggattttcctgaa

SEQ ID NO: 3974344 - DNA, 18 bp, Homo sapiens
caaaataaaattatggtg

SEQ ID NO: 3974345 - DNA, 21 bp, Homo sapiens
caaaataaaattatggtgaaa

SEQ ID NO: 3974346 - DNA, 14 bp, Homo sapiens
caaaataaatgttg

SEQ ID NO: 3974347 - DNA, 13 bp, Homo sapiens
caaaataatttaa

SEQ ID NO: 3974348 - DNA, 16 bp, Homo sapiens
caaaataatttaacta

SEQ ID NO: 3974349 - DNA, 16 bp, Homo sapiens
caaaatatttgtacat

SEQ ID NO: 3974350 - DNA, 17 bp, Homo sapiens
caaaatatttgtacata

SEQ ID NO: 3974351 - DNA, 18 bp, Homo sapiens
caaaatcacaagcaataa

SEQ ID NO: 3974352 - DNA, 21 bp, Homo sapiens
caaaatcacaagcaataatta

SEQ ID NO: 3974353 - DNA, 18 bp, Homo sapiens
caaaatcgattggcttta

SEQ ID NO: 3974354 - DNA, 21 bp, Homo sapiens
caaaatgaagttttatagaaa

SEQ ID NO: 3974355 - DNA, 11 bp, Homo sapiens
caaaatgcaag

SEQ ID NO: 3974356 - DNA, 17 bp, Homo sapiens
caaaatgttcgtattct

SEQ ID NO: 3974357 - DNA, 18 bp, Homo sapiens
caaaatgttcgtattcta

SEQ ID NO: 3974358 - DNA, 21 bp, Homo sapiens
caaaatttcaaaagtgatctg

SEQ ID NO: 3974359 - DNA, 18 bp, Homo sapiens
caaaattttattcctata

SEQ ID NO: 3974360 - DNA, 21 bp, Homo sapiens
caaacaaggggctgttacata

SEQ ID NO: 3974361 - DNA, 15 bp, Homo sapiens
caaacacactgtaaa

SEQ ID NO: 3974362 - DNA, 14 bp, Homo sapiens
caaacacctcccag

SEQ ID NO: 3974363 - DNA, 12 bp, Homo sapiens
caaacactccac

SEQ ID NO: 3974364 - DNA, 23 bp, Homo sapiens
caaacactccaccccctccagct

SEQ ID NO: 3974365 - DNA, 15 bp, Homo sapiens
caaacactgaatcat

SEQ ID NO: 3974366 - DNA, 11 bp, Homo sapiens
caaacatgtgg

SEQ ID NO: 3974367 - DNA, 20 bp, Homo sapiens
caaacattaatcaccaaagt

SEQ ID NO: 3974368 - DNA, 21 bp, Homo sapiens
caaaccacaactgacacagga

SEQ ID NO: 3974369 - DNA, 12 bp, Homo sapiens
caaaccaggatt

SEQ ID NO: 3974370 - DNA, 13 bp, Homo sapiens
caaaccatttaat

SEQ ID NO: 3974371 - DNA, 14 bp, Homo sapiens
caaaccatttaatt

SEQ ID NO: 3974372 - DNA, 23 bp, Homo sapiens
caaaccatttaattcataattag

SEQ ID NO: 3974373 - DNA, 17 bp, Homo sapiens
caaaccatttcaaatgg

SEQ ID NO: 3974374 - DNA, 23 bp, Homo sapiens
caaaccctgtggggcctgatggt

SEQ ID NO: 3974375 - DNA, 15 bp, Homo sapiens
caaacccttctcttc

SEQ ID NO: 3974376 - DNA, 22 bp, Homo sapiens
caaactacaaagctgaagaaaa

SEQ ID NO: 3974377 - DNA, 16 bp, Homo sapiens
caaactacatgtaatc

SEQ ID NO: 3974378 - DNA, 19 bp, Homo sapiens
caaactcactgctcaagaa

SEQ ID NO: 3974379 - DNA, 13 bp, Homo sapiens
caaactcctgcct

SEQ ID NO: 3974380 - DNA, 17 bp, Homo sapiens
caaactgagtaaattgg

SEQ ID NO: 3974381 - DNA, 20 bp, Homo sapiens
caaactgatgcgaaaacttg

SEQ ID NO: 3974382 - DNA, 21 bp, Homo sapiens
caaactgatgcgaaaacttga

SEQ ID NO: 3974383 - DNA, 14 bp, Homo sapiens
caaactgtgccctg

SEQ ID NO: 3974384 - DNA, 16 bp, Homo sapiens
caaactgttcaagaaa

SEQ ID NO: 3974385 - DNA, 13 bp, Homo sapiens
caaagaaataaaa

SEQ ID NO: 3974386 - DNA, 22 bp, Homo sapiens
caaagaaggcacaggtgtaaat

SEQ ID NO: 3974387 - DNA, 23 bp, Homo sapiens
caaagaaggcacaggtgtaaata

SEQ ID NO: 3974388 - DNA, 21 bp, Homo sapiens
caaagaatactagaatggtag

SEQ ID NO: 3974389 - DNA, 13 bp, Homo sapiens
caaagacaagaaa

SEQ ID NO: 3974390 - DNA, 16 bp, Homo sapiens
caaagagaaaaagaaa

SEQ ID NO: 3974391 - DNA, 21 bp, Homo sapiens
caaagagaaaaagaaatgcaa

SEQ ID NO: 3974392 - DNA, 15 bp, Homo sapiens
caaagagaaaactta

SEQ ID NO: 3974393 - DNA, 20 bp, Homo sapiens
caaagagaaatcacaggggc

SEQ ID NO: 3974394 - DNA, 19 bp, Homo sapiens
caaagaggcctttaaccat

SEQ ID NO: 3974395 - DNA, 23 bp, Homo sapiens
caaagatatatacacaggatcct

SEQ ID NO: 3974396 - DNA, 23 bp, Homo sapiens
caaagatgagctctgaacaaaca

SEQ ID NO: 3974397 - DNA, 18 bp, Homo sapiens
caaagatgtttgtcagat

SEQ ID NO: 3974398 - DNA, 22 bp, Homo sapiens
caaagattttacctgggatatg

SEQ ID NO: 3974399 - DNA, 22 bp, Homo sapiens
caaagcaaaagaagtaaaagct

SEQ ID NO: 3974400 - DNA, 14 bp, Homo sapiens
caaagcaagggctc

SEQ ID NO: 3974401 - DNA, 15 bp, Homo sapiens
caaagcaagggctcc

SEQ ID NO: 3974402 - DNA, 14 bp, Homo sapiens
caaagcccctggaa

SEQ ID NO: 3974403 - DNA, 18 bp, Homo sapiens
caaagcccttccatgtcg

SEQ ID NO: 3974404 - DNA, 23 bp, Homo sapiens
caaagccgtgcctttctctggct

SEQ ID NO: 3974405 - DNA, 19 bp, Homo sapiens
caaagcctgttcatggcag

SEQ ID NO: 3974406 - DNA, 20 bp, Homo sapiens
caaagcctgttcatggcaga

SEQ ID NO: 3974407 - DNA, 16 bp, Homo sapiens
caaagcggttgcttct

SEQ ID NO: 3974408 - DNA, 19 bp, Homo sapiens
caaagcttctatcccagga

SEQ ID NO: 3974409 - DNA, 22 bp, Homo sapiens
caaaggaatctccagttttcag

SEQ ID NO: 3974410 - DNA, 18 bp, Homo sapiens
caaaggacattatgtgtg

SEQ ID NO: 3974411 - DNA, 23 bp, Homo sapiens
caaaggagcctgtgaacccagga

SEQ ID NO: 3974412 - DNA, 16 bp, Homo sapiens
caaaggccagcagcag

SEQ ID NO: 3974413 - DNA, 22 bp, Homo sapiens
caaagggagcactgggttgact

SEQ ID NO: 3974414 - DNA, 18 bp, Homo sapiens
caaagggctgaaagccat

SEQ ID NO: 3974415 - DNA, 19 bp, Homo sapiens
caaaggggagaagggccag

SEQ ID NO: 3974416 - DNA, 11 bp, Homo sapiens
caaaggggctg

SEQ ID NO: 3974417 - DNA, 20 bp, Homo sapiens
caaaggggctgctggggcat

SEQ ID NO: 3974418 - DNA, 14 bp, Homo sapiens
caaaggtataattt

SEQ ID NO: 3974419 - DNA, 18 bp, Homo sapiens
caaaggtctttttaaacc

SEQ ID NO: 3974420 - DNA, 21 bp, Homo sapiens
caaggagttcgtggctgcaaa

SEQ ID NO: 3974421 - DNA, 19 bp, Homo sapiens
caaggcagcaaggcccgag

SEQ ID NO: 3974422 - DNA, 15 bp, Homo sapiens
caaggcagcctccag

SEQ ID NO: 3974423 - DNA, 19 bp, Homo sapiens
caaggcagcctccagagcc

SEQ ID NO: 3974424 - DNA, 21 bp, Homo sapiens
caaggcagcctccagagccag

SEQ ID NO: 3974425 - DNA, 24 bp, Homo sapiens
caaggcagcctccagagccagcct

SEQ ID NO: 3974426 - DNA, 13 bp, Homo sapiens
caaggcccgagca

SEQ ID NO: 3974427 - DNA, 16 bp, Homo sapiens
caaggcccgagcagct

SEQ ID NO: 3974428 - DNA, 19 bp, Homo sapiens
caaggcccgagcagctgag

SEQ ID NO: 3974429 - DNA, 20 bp, Homo sapiens
caaggcccgagcagctgagc

SEQ ID NO: 3974430 - DNA, 15 bp, Homo sapiens
caaggctctgagcaa

SEQ ID NO: 3974431 - DNA, 20 bp, Homo sapiens
caagggaagaaacactctta

SEQ ID NO: 3974432 - DNA, 19 bp, Homo sapiens
caagggacaaccccatcat

SEQ ID NO: 3974433 - DNA, 15 bp, Homo sapiens
caagggagaagaaat

SEQ ID NO: 3974434 - DNA, 16 bp, Homo sapiens
caagggcatcaggcac

SEQ ID NO: 3974435 - DNA, 18 bp, Homo sapiens
caagggcatcaggcactg

SEQ ID NO: 3974436 - DNA, 19 bp, Homo sapiens
caagggcatcaggcactgg

SEQ ID NO: 3974437 - DNA, 20 bp, Homo sapiens
caagggcatcaggcactggt

SEQ ID NO: 3974438 - DNA, 21 bp, Homo sapiens
caagggccatgctgaagggac

SEQ ID NO: 3974439 - DNA, 13 bp, Homo sapiens
caagggctccagc

SEQ ID NO: 3974440 - DNA, 19 bp, Homo sapiens
caagggctccagcatccag

SEQ ID NO: 3974441 - DNA, 21 bp, Homo sapiens
caaggggcccacaaaggggag

SEQ ID NO: 3974442 - DNA, 22 bp, Homo sapiens
caaggggcccacaaaggggaga

SEQ ID NO: 3974443 - DNA, 23 bp, Homo sapiens
caaggggtctgtatatacatttc

SEQ ID NO: 3974444 - DNA, 17 bp, Homo sapiens
caaggggtttctgtttc

SEQ ID NO: 3974445 - DNA, 14 bp, Homo sapiens
caagggtccagaag

SEQ ID NO: 3974446 - DNA, 21 bp, Homo sapiens
caagggtgatgggaaagcatt

SEQ ID NO: 3974447 - DNA, 23 bp, Homo sapiens
caagggtgatgggaaagcattgt

SEQ ID NO: 3974448 - DNA, 13 bp, Homo sapiens
caaggtagacatg

SEQ ID NO: 3974449 - DNA, 14 bp, Homo sapiens
caaggtctgctttt

SEQ ID NO: 3974450 - DNA, 16 bp, Homo sapiens
caaggtcttcagccat

SEQ ID NO: 3974451 - DNA, 17 bp, Homo sapiens
caaggtggccaaattat

SEQ ID NO: 3974452 - DNA, 16 bp, Homo sapiens
caaggttccctctgag

SEQ ID NO: 3974453 - DNA, 18 bp, Homo sapiens
caaggttccctctgagaa

SEQ ID NO: 3974454 - DNA, 16 bp, Homo sapiens
caaggttttggagtca

SEQ ID NO: 3974455 - DNA, 12 bp, Homo sapiens
caagtaatcact

SEQ ID NO: 3974456 - DNA, 14 bp, Homo sapiens
caagtactgctgta

SEQ ID NO: 3974457 - DNA, 20 bp, Homo sapiens
caagtatttattattgaaga

SEQ ID NO: 3974458 - DNA, 18 bp, Homo sapiens
caagtccaacctgcctgt

SEQ ID NO: 3974459 - DNA, 16 bp, Homo sapiens
caagtccacctgccta

SEQ ID NO: 3974460 - DNA, 13 bp, Homo sapiens
caagtccaggtcc

SEQ ID NO: 3974461 - DNA, 17 bp, Homo sapiens
caagtccaggtcctggt

SEQ ID NO: 3974462 - DNA, 18 bp, Homo sapiens
caagtcctgtgaatttct

SEQ ID NO: 3974463 - DNA, 17 bp, Homo sapiens
caagtctccttcccctt

SEQ ID NO: 3974464 - DNA, 13 bp, Homo sapiens
caagtctgcagcc

SEQ ID NO: 3974465 - DNA, 18 bp, Homo sapiens
caagtgatatatgtattt

SEQ ID NO: 3974466 - DNA, 11 bp, Homo sapiens
caagtggaggg

SEQ ID NO: 3974467 - DNA, 14 bp, Homo sapiens
caagtgggggcaga

SEQ ID NO: 3974468 - DNA, 23 bp, Homo sapiens
caagtgtggtagggacttaaaaa

SEQ ID NO: 3974469 - DNA, 19 bp, Homo sapiens
caagttatattgaatatat

SEQ ID NO: 3974470 - DNA, 16 bp, Homo sapiens
caagttattctcttca

SEQ ID NO: 3974471 - DNA, 15 bp, Homo sapiens
caagttcagggaagc

SEQ ID NO: 3974472 - DNA, 19 bp, Homo sapiens
caagttcagggaagcaggc

SEQ ID NO: 3974473 - DNA, 14 bp, Homo sapiens
caagttccagctgg

SEQ ID NO: 3974474 - DNA, 22 bp, Homo sapiens
caagtttctagctagaaatatg

SEQ ID NO: 3974475 - DNA, 13 bp, Homo sapiens
caagttttgtata

SEQ ID NO: 3974476 - DNA, 16 bp, Homo sapiens
caataaaaaaaagaaa

SEQ ID NO: 3974477 - DNA, 12 bp, Homo sapiens
caataaaagtga

SEQ ID NO: 3974478 - DNA, 13 bp, Homo sapiens
caataaaagtgac

SEQ ID NO: 3974479 - DNA, 14 bp, Homo sapiens
caataaaatagtat

SEQ ID NO: 3974480 - DNA, 22 bp, Homo sapiens
caataaagagttagaatgaaaa

SEQ ID NO: 3974481 - DNA, 22 bp, Homo sapiens
caataaagctgctgagaatcta

SEQ ID NO: 3974482 - DNA, 12 bp, Homo sapiens
caataaagctgg

SEQ ID NO: 3974483 - DNA, 17 bp, Homo sapiens
caataaagctggacaag

SEQ ID NO: 3974484 - DNA, 15 bp, Homo sapiens
caataaatgctgaat

SEQ ID NO: 3974485 - DNA, 20 bp, Homo sapiens
caataaatgctgaatgaatc

SEQ ID NO: 3974486 - DNA, 23 bp, Homo sapiens
caataaattatttttaagaaatc

SEQ ID NO: 3974487 - DNA, 12 bp, Homo sapiens
caataacaacaa

SEQ ID NO: 3974488 - DNA, 22 bp, Homo sapiens
caataacaacaatggtttacat

SEQ ID NO: 3974489 - DNA, 18 bp, Homo sapiens
caataaggtcaatgccag

SEQ ID NO: 3974490 - DNA, 22 bp, Homo sapiens
caataatgtgcaaattttgcat

SEQ ID NO: 3974491 - DNA, 22 bp, Homo sapiens
caataatttcaggttttgtaaa

SEQ ID NO: 3974492 - DNA, 17 bp, Homo sapiens
caatacatgctgctaat

SEQ ID NO: 3974493 - DNA, 13 bp, Homo sapiens
caataccactggt

SEQ ID NO: 3974494 - DNA, 18 bp, Homo sapiens
caataccagatcactcaa

SEQ ID NO: 3974495 - DNA, 23 bp, Homo sapiens
caataccccaagtccacctgcct

SEQ ID NO: 3974496 - DNA, 18 bp, Homo sapiens
caatactaattgagaaac

SEQ ID NO: 3974497 - DNA, 23 bp, Homo sapiens
caatagaaactcaccatgtaaaa

SEQ ID NO: 3974498 - DNA, 17 bp, Homo sapiens
caatagctattgcatgt

SEQ ID NO: 3974499 - DNA, 19 bp, Homo sapiens
caatagctattgcatgtaa

SEQ ID NO: 3974500 - DNA, 22 bp, Homo sapiens
caatagctattgcatgtaaaat

SEQ ID NO: 3974501 - DNA, 15 bp, Homo sapiens
caatagggtgcagtt

SEQ ID NO: 3974502 - DNA, 16 bp, Homo sapiens
caatagtcaagaaaaa

SEQ ID NO: 3974503 - DNA, 18 bp, Homo sapiens
caatatataaaaatatat

SEQ ID NO: 3974504 - DNA, 21 bp, Homo sapiens
caatatataaaaatatatata

SEQ ID NO: 3974505 - DNA, 18 bp, Homo sapiens
caatatgattttaaattt

SEQ ID NO: 3974506 - DNA, 12 bp, Homo sapiens
cacccaggctcc

SEQ ID NO: 3974507 - DNA, 14 bp, Homo sapiens
cacccaggctccat

SEQ ID NO: 3974508 - DNA, 18 bp, Homo sapiens
cacccaggctgcactgca

SEQ ID NO: 3974509 - DNA, 19 bp, Homo sapiens
cacccaggctgcactgcag

SEQ ID NO: 3974510 - DNA, 14 bp, Homo sapiens
cacccaggctggag

SEQ ID NO: 3974511 - DNA, 20 bp, Homo sapiens
cacccaggctggagtggagt

SEQ ID NO: 3974512 - DNA, 22 bp, Homo sapiens
cacccagggctccctcctggag

SEQ ID NO: 3974513 - DNA, 13 bp, Homo sapiens
cacccagtcctgg

SEQ ID NO: 3974514 - DNA, 15 bp, Homo sapiens
cacccagtcctggcc

SEQ ID NO: 3974515 - DNA, 16 bp, Homo sapiens
cacccagtcctggcca

SEQ ID NO: 3974516 - DNA, 14 bp, Homo sapiens
cacccagtgctgcc

SEQ ID NO: 3974517 - DNA, 15 bp, Homo sapiens
cacccagtgctgcca

SEQ ID NO: 3974518 - DNA, 19 bp, Homo sapiens
cacccagtgctgccatgcc

SEQ ID NO: 3974519 - DNA, 22 bp, Homo sapiens
cacccagtgctgccatgccact

SEQ ID NO: 3974520 - DNA, 22 bp, Homo sapiens
cacccatcctaccaatgcatgc

SEQ ID NO: 3974521 - DNA, 14 bp, Homo sapiens
cacccatgccatag

SEQ ID NO: 3974522 - DNA, 13 bp, Homo sapiens
caccccaagggac

SEQ ID NO: 3974523 - DNA, 13 bp, Homo sapiens
caccccaccccct

SEQ ID NO: 3974524 - DNA, 12 bp, Homo sapiens
caccccactcca

SEQ ID NO: 3974525 - DNA, 14 bp, Homo sapiens
caccccactccagc

SEQ ID NO: 3974526 - DNA, 15 bp, Homo sapiens
caccccactccagcc

SEQ ID NO: 3974527 - DNA, 17 bp, Homo sapiens
caccccactccagccct

SEQ ID NO: 3974528 - DNA, 18 bp, Homo sapiens
caccccactggatcttca

SEQ ID NO: 3974529 - DNA, 18 bp, Homo sapiens
caccccatctctcttccc

SEQ ID NO: 3974530 - DNA, 12 bp, Homo sapiens
cacccccagcct

SEQ ID NO: 3974531 - DNA, 13 bp, Homo sapiens
cacccccagcctg

SEQ ID NO: 3974532 - DNA, 14 bp, Homo sapiens
cacccccagcctgg

SEQ ID NO: 3974533 - DNA, 16 bp, Homo sapiens
cacccccagcctgggc

SEQ ID NO: 3974534 - DNA, 18 bp, Homo sapiens
cacccccagcctgggcct

SEQ ID NO: 3974535 - DNA, 14 bp, Homo sapiens
caccccccaagctg

SEQ ID NO: 3974536 - DNA, 14 bp, Homo sapiens
caccccctccccag

SEQ ID NO: 3974537 - DNA, 12 bp, Homo sapiens
caccccctgcag

SEQ ID NO: 3974538 - DNA, 17 bp, Homo sapiens
cacccccttcagtgccc

SEQ ID NO: 3974539 - DNA, 20 bp, Homo sapiens
cacccccttcagtgcccacc

SEQ ID NO: 3974540 - DNA, 14 bp, Homo sapiens
caccccggcctcca

SEQ ID NO: 3974541 - DNA, 19 bp, Homo sapiens
caccccggcctccactccc

SEQ ID NO: 3974542 - DNA, 19 bp, Homo sapiens
cacccctccaaagccccac

SEQ ID NO: 3974543 - DNA, 17 bp, Homo sapiens
caccccttatccaggac

SEQ ID NO: 3974544 - DNA, 12 bp, Homo sapiens
caccccttcctg

SEQ ID NO: 3974545 - DNA, 14 bp, Homo sapiens
cacccgactcctca

SEQ ID NO: 3974546 - DNA, 21 bp, Homo sapiens
cacccggttaccttggccgtg

SEQ ID NO: 3974547 - DNA, 21 bp, Homo sapiens
cacccgtaggcagcctctctg

SEQ ID NO: 3974548 - DNA, 16 bp, Homo sapiens
caccctacctgtgcct

SEQ ID NO: 3974549 - DNA, 18 bp, Homo sapiens
caccctcaaatgtcagag

SEQ ID NO: 3974550 - DNA, 15 bp, Homo sapiens
caccctcaccaggat

SEQ ID NO: 3974551 - DNA, 19 bp, Homo sapiens
caccctcgtggacacctgc

SEQ ID NO: 3974552 - DNA, 21 bp, Homo sapiens
caccctcgtggacacctgccc

SEQ ID NO: 3974553 - DNA, 22 bp, Homo sapiens
caccctctgggcagctgtcatg

SEQ ID NO: 3974554 - DNA, 23 bp, Homo sapiens
caccctgaatggttccatgcctg

SEQ ID NO: 3974555 - DNA, 19 bp, Homo sapiens
caccctgcagagctatggt

SEQ ID NO: 3974556 - DNA, 17 bp, Homo sapiens
caccctggaaaggggag

SEQ ID NO: 3974557 - DNA, 12 bp, Homo sapiens
caccctggcccg

SEQ ID NO: 3974558 - DNA, 19 bp, Homo sapiens
caccctggcccgcccctcg

SEQ ID NO: 3974559 - DNA, 14 bp, Homo sapiens
caccctgggtgcca

SEQ ID NO: 3974560 - DNA, 13 bp, Homo sapiens
cacccttctttcc

SEQ ID NO: 3974561 - DNA, 19 bp, Homo sapiens
cacccttctttcctcttcc

SEQ ID NO: 3974562 - DNA, 20 bp, Homo sapiens
cacccttctttcctcttccc

SEQ ID NO: 3974563 - DNA, 13 bp, Homo sapiens
cacccttggactt

SEQ ID NO: 3974564 - DNA, 16 bp, Homo sapiens
caccgaagaggaagca

SEQ ID NO: 3974565 - DNA, 16 bp, Homo sapiens
caccgatgcacacgca

SEQ ID NO: 3974566 - DNA, 23 bp, Homo sapiens
caccgccctccctccccagctcc

SEQ ID NO: 3974567 - DNA, 16 bp, Homo sapiens
caccgctgccttttgc

SEQ ID NO: 3974568 - DNA, 22 bp, Homo sapiens
caccggagctttcaaagaagga

SEQ ID NO: 3974569 - DNA, 16 bp, Homo sapiens
caccggcgctgcaggt

SEQ ID NO: 3974570 - DNA, 23 bp, Homo sapiens
caccgggccactccttcctgccc

SEQ ID NO: 3974571 - DNA, 15 bp, Homo sapiens
caccgtcatggctta

SEQ ID NO: 3974572 - DNA, 19 bp, Homo sapiens
caccgtcatggcttaatgt

SEQ ID NO: 3974573 - DNA, 23 bp, Homo sapiens
caccgtcatggcttaatgtttat

SEQ ID NO: 3974574 - DNA, 15 bp, Homo sapiens
caccgtggaccttcc

SEQ ID NO: 3974575 - DNA, 18 bp, Homo sapiens
caccgtggaccttcctgc

SEQ ID NO: 3974576 - DNA, 19 bp, Homo sapiens
caccgtggaccttcctgcc

SEQ ID NO: 3974577 - DNA, 21 bp, Homo sapiens
caccgtttgtcccccggggca

SEQ ID NO: 3974578 - DNA, 16 bp, Homo sapiens
cacctaccatgctgct

SEQ ID NO: 3974579 - DNA, 19 bp, Homo sapiens
cacctacttgtgactgaag

SEQ ID NO: 3974580 - DNA, 17 bp, Homo sapiens
cacctaggccactcctc

SEQ ID NO: 3974581 - DNA, 23 bp, Homo sapiens
cacctcaaaataccatgccattt

SEQ ID NO: 3974582 - DNA, 14 bp, Homo sapiens
cacctcacgctctg

SEQ ID NO: 3974583 - DNA, 18 bp, Homo sapiens
cacctcacgctctggaca

SEQ ID NO: 3974584 - DNA, 11 bp, Homo sapiens
cacctcagcct

SEQ ID NO: 3974585 - DNA, 13 bp, Homo sapiens
cacctccaccccc

SEQ ID NO: 3974586 - DNA, 21 bp, Homo sapiens
cacctccacccccgccacggc

SEQ ID NO: 3974587 - DNA, 13 bp, Homo sapiens
cacctcccacccc

SEQ ID NO: 3974588 - DNA, 16 bp, Homo sapiens
cacctcccaccccact

SEQ ID NO: 3974589 - DNA, 22 bp, Homo sapiens
cacctcccaccccactccagcc

SEQ ID NO: 3974590 - DNA, 17 bp, Homo sapiens
cacctccccccactgca

SEQ ID NO: 3974591 - DNA, 18 bp, Homo sapiens
cacctccccccactgcag

SEQ ID NO: 3974592 - DNA, 23 bp, Homo sapiens
cacctccccccactgcaggcccc

SEQ ID NO: 3974593 - DNA, 18 bp, Homo sapiens
cactttcctacaaaatgg

SEQ ID NO: 3974594 - DNA, 22 bp, Homo sapiens
cactttggcttctcctgtgacc

SEQ ID NO: 3974595 - DNA, 15 bp, Homo sapiens
cactttgttaaaaat

SEQ ID NO: 3974596 - DNA, 16 bp, Homo sapiens
cacttttcctccctca

SEQ ID NO: 3974597 - DNA, 19 bp, Homo sapiens
cacttttctttattgctgt

SEQ ID NO: 3974598 - DNA, 20 bp, Homo sapiens
cagaaaacaaaagagagaat

SEQ ID NO: 3974599 - DNA, 16 bp, Homo sapiens
cagaaaagcacctgcc

SEQ ID NO: 3974600 - DNA, 19 bp, Homo sapiens
cagaaaagcacctgccgac

SEQ ID NO: 3974601 - DNA, 18 bp, Homo sapiens
cagaaaagggaagttgtg

SEQ ID NO: 3974602 - DNA, 15 bp, Homo sapiens
cagaaaagtagaatt

SEQ ID NO: 3974603 - DNA, 17 bp, Homo sapiens
cagaaaagtagaattat

SEQ ID NO: 3974604 - DNA, 20 bp, Homo sapiens
cagaaaagtagaattatatc

SEQ ID NO: 3974605 - DNA, 21 bp, Homo sapiens
cagaaaagtagaattatatct

SEQ ID NO: 3974606 - DNA, 18 bp, Homo sapiens
cagaaaagtgcttagaaa

SEQ ID NO: 3974607 - DNA, 23 bp, Homo sapiens
cagaaaagtgcttagaaagttat

SEQ ID NO: 3974608 - DNA, 14 bp, Homo sapiens
cagaaaatataaat

SEQ ID NO: 3974609 - DNA, 15 bp, Homo sapiens
cagaaaatataaatg

SEQ ID NO: 3974610 - DNA, 17 bp, Homo sapiens
cagaaaatataaatgca

SEQ ID NO: 3974611 - DNA, 18 bp, Homo sapiens
cagaaaatataaatgcat

SEQ ID NO: 3974612 - DNA, 19 bp, Homo sapiens
cagaaaatgaacacagcag

SEQ ID NO: 3974613 - DNA, 20 bp, Homo sapiens
cagaaacaaaaacactaaaa

SEQ ID NO: 3974614 - DNA, 16 bp, Homo sapiens
cagaaacagagagaga

SEQ ID NO: 3974615 - DNA, 18 bp, Homo sapiens
cagaaacaggtgcatctg

SEQ ID NO: 3974616 - DNA, 23 bp, Homo sapiens
cagaaactccttttgctgtcttt

SEQ ID NO: 3974617 - DNA, 16 bp, Homo sapiens
cagaaagcaacagtta

SEQ ID NO: 3974618 - DNA, 16 bp, Homo sapiens
cagaaagcattacatt

SEQ ID NO: 3974619 - DNA, 15 bp, Homo sapiens
cagaaagggagggct

SEQ ID NO: 3974620 - DNA, 16 bp, Homo sapiens
cagaaagggagggctc

SEQ ID NO: 3974621 - DNA, 17 bp, Homo sapiens
cagaaagggagggctct

SEQ ID NO: 3974622 - DNA, 19 bp, Homo sapiens
cagaaagggagggctctga

SEQ ID NO: 3974623 - DNA, 20 bp, Homo sapiens
cagaaagggagggctctgag

SEQ ID NO: 3974624 - DNA, 22 bp, Homo sapiens
cagaaagggagggctctgaggc

SEQ ID NO: 3974625 - DNA, 17 bp, Homo sapiens
cagaaatactgctctga

SEQ ID NO: 3974626 - DNA, 18 bp, Homo sapiens
cagaaatatatatacata

SEQ ID NO: 3974627 - DNA, 19 bp, Homo sapiens
cagaaatatatatacatat

SEQ ID NO: 3974628 - DNA, 20 bp, Homo sapiens
cagaaatatatatacatatg

SEQ ID NO: 3974629 - DNA, 14 bp, Homo sapiens
cagaaattccttcc

SEQ ID NO: 3974630 - DNA, 18 bp, Homo sapiens
cagaaatttttatttttc

SEQ ID NO: 3974631 - DNA, 14 bp, Homo sapiens
cagaacagcagagg

SEQ ID NO: 3974632 - DNA, 21 bp, Homo sapiens
cagaacagcagaggttctttt

SEQ ID NO: 3974633 - DNA, 12 bp, Homo sapiens
cagaacagctga

SEQ ID NO: 3974634 - DNA, 15 bp, Homo sapiens
cagaaccacactgtt

SEQ ID NO: 3974635 - DNA, 21 bp, Homo sapiens
cagaaccacactgttgagttg

SEQ ID NO: 3974636 - DNA, 14 bp, Homo sapiens
cagaaccagagggt

SEQ ID NO: 3974637 - DNA, 20 bp, Homo sapiens
cagaacctggagggctagaa

SEQ ID NO: 3974638 - DNA, 23 bp, Homo sapiens
cagaactgctaaatactgtacat

SEQ ID NO: 3974639 - DNA, 21 bp, Homo sapiens
cagaactggacgcccagctga

SEQ ID NO: 3974640 - DNA, 23 bp, Homo sapiens
cagaacttcgaccctttctctga

SEQ ID NO: 3974641 - DNA, 15 bp, Homo sapiens
cagaagaaccctggc

SEQ ID NO: 3974642 - DNA, 16 bp, Homo sapiens
cagaagaatattcagg

SEQ ID NO: 3974643 - DNA, 17 bp, Homo sapiens
cagaagaattgaaccca

SEQ ID NO: 3974644 - DNA, 22 bp, Homo sapiens
cagaagataacttgagcaccgt

SEQ ID NO: 3974645 - DNA, 13 bp, Homo sapiens
cagaagatgccct

SEQ ID NO: 3974646 - DNA, 14 bp, Homo sapiens
cagaagatgccctc

SEQ ID NO: 3974647 - DNA, 19 bp, Homo sapiens
cagaagccaggagcaaatg

SEQ ID NO: 3974648 - DNA, 19 bp, Homo sapiens
cagaagcctgggggcctgg

SEQ ID NO: 3974649 - DNA, 20 bp, Homo sapiens
cagaagcctgggggcctggc

SEQ ID NO: 3974650 - DNA, 21 bp, Homo sapiens
cagaagcctgggggcctggct

SEQ ID NO: 3974651 - DNA, 14 bp, Homo sapiens
cagaagcttcagaa

SEQ ID NO: 3974652 - DNA, 22 bp, Homo sapiens
cagaaggaaggcagggaggagg

SEQ ID NO: 3974653 - DNA, 21 bp, Homo sapiens
cagaaggaagggcatccttct

SEQ ID NO: 3974654 - DNA, 14 bp, Homo sapiens
cagaaggagaagga

SEQ ID NO: 3974655 - DNA, 17 bp, Homo sapiens
cagaaggagggcagagc

SEQ ID NO: 3974656 - DNA, 18 bp, Homo sapiens
cagaaggccaagaatcaa

SEQ ID NO: 3974657 - DNA, 17 bp, Homo sapiens
cagaaggctggggccag

SEQ ID NO: 3974658 - DNA, 17 bp, Homo sapiens
cagaagggagttgctca

SEQ ID NO: 3974659 - DNA, 15 bp, Homo sapiens
cagaaggtattcctt

SEQ ID NO: 3974660 - DNA, 23 bp, Homo sapiens
cagaaggttgctctagattgaga

SEQ ID NO: 3974661 - DNA, 15 bp, Homo sapiens
cagaagtttctcagc

SEQ ID NO: 3974662 - DNA, 16 bp, Homo sapiens
cagaagtttggcaata

SEQ ID NO: 3974663 - DNA, 22 bp, Homo sapiens
cagaataaagttctgagtgttt

SEQ ID NO: 3974664 - DNA, 17 bp, Homo sapiens
cagaataagtgctgttt

SEQ ID NO: 3974665 - DNA, 22 bp, Homo sapiens
cagaatatggacaaagaaggca

SEQ ID NO: 3974666 - DNA, 18 bp, Homo sapiens
cagaatcataattttcaa

SEQ ID NO: 3974667 - DNA, 18 bp, Homo sapiens
cagaatctgctgttgcca

SEQ ID NO: 3974668 - DNA, 23 bp, Homo sapiens
cagaatctgctgttgccatagcc

SEQ ID NO: 3974669 - DNA, 20 bp, Homo sapiens
cagaatcttcgtcctgcccc

SEQ ID NO: 3974670 - DNA, 16 bp, Homo sapiens
cagaatcttgtatttg

SEQ ID NO: 3974671 - DNA, 11 bp, Homo sapiens
cagaatgaatc

SEQ ID NO: 3974672 - DNA, 12 bp, Homo sapiens
cagaatgctgtt

SEQ ID NO: 3974673 - DNA, 17 bp, Homo sapiens
cagaatgtttttaaaat

SEQ ID NO: 3974674 - DNA, 15 bp, Homo sapiens
cagaattccttttct

SEQ ID NO: 3974675 - DNA, 13 bp, Homo sapiens
cagaattttgtat

SEQ ID NO: 3974676 - DNA, 12 bp, Homo sapiens
cagaatttttaa

SEQ ID NO: 3974677 - DNA, 16 bp, Homo sapiens
cagaatttttaatgac

SEQ ID NO: 3974678 - DNA, 17 bp, Homo sapiens
cagaatttttaatgact

SEQ ID NO: 3974679 - DNA, 16 bp, Homo sapiens
cagcagccccctgccc

SEQ ID NO: 3974680 - DNA, 16 bp, Homo sapiens
cagcagcccctgcaca

SEQ ID NO: 3974681 - DNA, 23 bp, Homo sapiens
cagcagccctaaggatctctcag

SEQ ID NO: 3974682 - DNA, 11 bp, Homo sapiens
cagcagccctc

SEQ ID NO: 3974683 - DNA, 13 bp, Homo sapiens
cagcagccctcct

SEQ ID NO: 3974684 - DNA, 18 bp, Homo sapiens
cagcagccctcctcaccc

SEQ ID NO: 3974685 - DNA, 19 bp, Homo sapiens
cagcagccctggcctgtgg

SEQ ID NO: 3974686 - DNA, 17 bp, Homo sapiens
cagcagcggtaccccag

SEQ ID NO: 3974687 - DNA, 15 bp, Homo sapiens
cagcagctaggactg

SEQ ID NO: 3974688 - DNA, 17 bp, Homo sapiens
cagcagctaggactgag

SEQ ID NO: 3974689 - DNA, 23 bp, Homo sapiens
cagcagctgcgggtctgaaggaa

SEQ ID NO: 3974690 - DNA, 22 bp, Homo sapiens
cagcagctgggacccctcccaa

SEQ ID NO: 3974691 - DNA, 21 bp, Homo sapiens
cagcagctgggccggccagcc

SEQ ID NO: 3974692 - DNA, 19 bp, Homo sapiens
cagcaggccagggactcag

SEQ ID NO: 3974693 - DNA, 14 bp, Homo sapiens
cagcagggcctcaa

SEQ ID NO: 3974694 - DNA, 17 bp, Homo sapiens
cagcagggcctcaaagt

SEQ ID NO: 3974695 - DNA, 14 bp, Homo sapiens
cagcaggtgcaaga

SEQ ID NO: 3974696 - DNA, 20 bp, Homo sapiens
cagcaggtgcaagagacaga

SEQ ID NO: 3974697 - DNA, 22 bp, Homo sapiens
cagcaggtgcaagagacagagc

SEQ ID NO: 3974698 - DNA, 17 bp, Homo sapiens
cagcaggtgtggtggct

SEQ ID NO: 3974699 - DNA, 20 bp, Homo sapiens
cagcaggtgtggtggctcat

SEQ ID NO: 3974700 - DNA, 21 bp, Homo sapiens
cagcaggtgtggtggctcatg

SEQ ID NO: 3974701 - DNA, 21 bp, Homo sapiens
cagcagtcttcttcacccgct

SEQ ID NO: 3974702 - DNA, 21 bp, Homo sapiens
cagcagtgttccccatctggg

SEQ ID NO: 3974703 - DNA, 23 bp, Homo sapiens
cagcagtgttccccatctgggtc

SEQ ID NO: 3974704 - DNA, 23 bp, Homo sapiens
cagcagttgaatgacaacagaag

SEQ ID NO: 3974705 - DNA, 17 bp, Homo sapiens
cagcagtttgggaggtc

SEQ ID NO: 3974706 - DNA, 15 bp, Homo sapiens
cagcatccagcctgt

SEQ ID NO: 3974707 - DNA, 16 bp, Homo sapiens
cagcatccagcctgtg

SEQ ID NO: 3974708 - DNA, 14 bp, Homo sapiens
cagcatcctgcttc

SEQ ID NO: 3974709 - DNA, 18 bp, Homo sapiens
cagcatgatattttcaga

SEQ ID NO: 3974710 - DNA, 14 bp, Homo sapiens
cagcatgtacaaaa

SEQ ID NO: 3974711 - DNA, 15 bp, Homo sapiens
cagcattaggctttt

SEQ ID NO: 3974712 - DNA, 21 bp, Homo sapiens
cagcattaggcttttaagaaa

SEQ ID NO: 3974713 - DNA, 13 bp, Homo sapiens
cagcattcagcac

SEQ ID NO: 3974714 - DNA, 17 bp, Homo sapiens
cagcattcagcacaccc

SEQ ID NO: 3974715 - DNA, 12 bp, Homo sapiens
cagcattttact

SEQ ID NO: 3974716 - DNA, 15 bp, Homo sapiens
cagcattttactact

SEQ ID NO: 3974717 - DNA, 16 bp, Homo sapiens
cagccaaaaaggacca

SEQ ID NO: 3974718 - DNA, 16 bp, Homo sapiens
cagccaaacacagagc

SEQ ID NO: 3974719 - DNA, 20 bp, Homo sapiens
cagccaaacacagagcggga

SEQ ID NO: 3974720 - DNA, 18 bp, Homo sapiens
cagccaacaggtggcagg

SEQ ID NO: 3974721 - DNA, 16 bp, Homo sapiens
cagccaactgccccgg

SEQ ID NO: 3974722 - DNA, 16 bp, Homo sapiens
cagccacacttctcag

SEQ ID NO: 3974723 - DNA, 19 bp, Homo sapiens
cagccacacttctcaggac

SEQ ID NO: 3974724 - DNA, 21 bp, Homo sapiens
cagccacacttctcaggacac

SEQ ID NO: 3974725 - DNA, 15 bp, Homo sapiens
cagccacctctcttt

SEQ ID NO: 3974726 - DNA, 23 bp, Homo sapiens
cagccactcgggaggctgagaca

SEQ ID NO: 3974727 - DNA, 23 bp, Homo sapiens
cagccagcaatgatgtccagaag

SEQ ID NO: 3974728 - DNA, 15 bp, Homo sapiens
cagccagcccagccc

SEQ ID NO: 3974729 - DNA, 16 bp, Homo sapiens
cagccagcccagccca

SEQ ID NO: 3974730 - DNA, 19 bp, Homo sapiens
cagccagcccagcccagct

SEQ ID NO: 3974731 - DNA, 20 bp, Homo sapiens
cagccagccctgcctggagg

SEQ ID NO: 3974732 - DNA, 18 bp, Homo sapiens
cagccagccgccctgggc

SEQ ID NO: 3974733 - DNA, 18 bp, Homo sapiens
cagccagccggtgcctgg

SEQ ID NO: 3974734 - DNA, 20 bp, Homo sapiens
cagccagccggtgcctggcg

SEQ ID NO: 3974735 - DNA, 20 bp, Homo sapiens
cagccagggaggacaagcag

SEQ ID NO: 3974736 - DNA, 14 bp, Homo sapiens
cagccaggggctgc

SEQ ID NO: 3974737 - DNA, 17 bp, Homo sapiens
cagccaggggctgctca

SEQ ID NO: 3974738 - DNA, 21 bp, Homo sapiens
cagccaggggctgctcatcac

SEQ ID NO: 3974739 - DNA, 18 bp, Homo sapiens
cagccagtcttgcctagg

SEQ ID NO: 3974740 - DNA, 21 bp, Homo sapiens
cagccagtcttgcctaggcca

SEQ ID NO: 3974741 - DNA, 23 bp, Homo sapiens
cagccagtcttgcctaggccaaa

SEQ ID NO: 3974742 - DNA, 20 bp, Homo sapiens
cagccatcacaaggggaacg

SEQ ID NO: 3974743 - DNA, 16 bp, Homo sapiens
cagccatgaagtcacc

SEQ ID NO: 3974744 - DNA, 18 bp, Homo sapiens
cagccatgaggagttgct

SEQ ID NO: 3974745 - DNA, 11 bp, Homo sapiens
cagccatgcct

SEQ ID NO: 3974746 - DNA, 14 bp, Homo sapiens
cagccatgcctcat

SEQ ID NO: 3974747 - DNA, 12 bp, Homo sapiens
cagccatggtga

SEQ ID NO: 3974748 - DNA, 13 bp, Homo sapiens
cagccattataaa

SEQ ID NO: 3974749 - DNA, 11 bp, Homo sapiens
cagcccacacc

SEQ ID NO: 3974750 - DNA, 12 bp, Homo sapiens
cagcccacaccc

SEQ ID NO: 3974751 - DNA, 15 bp, Homo sapiens
cagcccacacccctc

SEQ ID NO: 3974752 - DNA, 23 bp, Homo sapiens
cagcccacacccctccaaagccc

SEQ ID NO: 3974753 - DNA, 13 bp, Homo sapiens
cagcccagcccag

SEQ ID NO: 3974754 - DNA, 15 bp, Homo sapiens
cagcccagcctagcc

SEQ ID NO: 3974755 - DNA, 21 bp, Homo sapiens
cagcccatggcctctggccag

SEQ ID NO: 3974756 - DNA, 14 bp, Homo sapiens
cagccccaaaccag

SEQ ID NO: 3974757 - DNA, 14 bp, Homo sapiens
cagccccacagcac

SEQ ID NO: 3974758 - DNA, 18 bp, Homo sapiens
cagccccacagcacccag

SEQ ID NO: 3974759 - DNA, 20 bp, Homo sapiens
cagccccacagcacccaggc

SEQ ID NO: 3974760 - DNA, 14 bp, Homo sapiens
cagccccagggccc

SEQ ID NO: 3974761 - DNA, 17 bp, Homo sapiens
cagccccctaagagagc

SEQ ID NO: 3974762 - DNA, 22 bp, Homo sapiens
cagccccctggatgggcattgg

SEQ ID NO: 3974763 - DNA, 12 bp, Homo sapiens
cagcccctcctc

SEQ ID NO: 3974764 - DNA, 17 bp, Homo sapiens
cagcccctcctctgcca

SEQ ID NO: 3974765 - DNA, 19 bp, Homo sapiens
cagcccctcctctgccacc

SEQ ID NO: 3974766 - DNA, 21 bp, Homo sapiens
caggccctccatgggctagtg

SEQ ID NO: 3974767 - DNA, 23 bp, Homo sapiens
caggccctccctgactccctgtg

SEQ ID NO: 3974768 - DNA, 13 bp, Homo sapiens
caggcccttgggg

SEQ ID NO: 3974769 - DNA, 21 bp, Homo sapiens
caggcccttggggttccccca

SEQ ID NO: 3974770 - DNA, 24 bp, Homo sapiens
caggccgcctgccataccgctggg

SEQ ID NO: 3974771 - DNA, 23 bp, Homo sapiens
caggccgttccccttggcttcct

SEQ ID NO: 3974772 - DNA, 15 bp, Homo sapiens
caggcctccagcctc

SEQ ID NO: 3974773 - DNA, 17 bp, Homo sapiens
caggcctccagcctctc

SEQ ID NO: 3974774 - DNA, 15 bp, Homo sapiens
caggcctctgtgtcc

SEQ ID NO: 3974775 - DNA, 20 bp, Homo sapiens
caggcctggcaagtgggtga

SEQ ID NO: 3974776 - DNA, 12 bp, Homo sapiens
caggcctgggac

SEQ ID NO: 3974777 - DNA, 18 bp, Homo sapiens
caggcctgggacccagct

SEQ ID NO: 3974778 - DNA, 19 bp, Homo sapiens
caggcctgtgtagctgtga

SEQ ID NO: 3974779 - DNA, 22 bp, Homo sapiens
caggcctgtgtagctgtgacct

SEQ ID NO: 3974780 - DNA, 12 bp, Homo sapiens
caggccttccgg

SEQ ID NO: 3974781 - DNA, 19 bp, Homo sapiens
caggcgggagatggacccc

SEQ ID NO: 3974782 - DNA, 16 bp, Homo sapiens
caggcgttggtgccac

SEQ ID NO: 3974783 - DNA, 15 bp, Homo sapiens
caggctaccccttca

SEQ ID NO: 3974784 - DNA, 20 bp, Homo sapiens
caggctaccccttcatggtg

SEQ ID NO: 3974785 - DNA, 15 bp, Homo sapiens
caggctactctcctc

SEQ ID NO: 3974786 - DNA, 16 bp, Homo sapiens
caggctactctcctcg

SEQ ID NO: 3974787 - DNA, 18 bp, Homo sapiens
caggctactctcctcggc

SEQ ID NO: 3974788 - DNA, 14 bp, Homo sapiens
caggctactgtcag

SEQ ID NO: 3974789 - DNA, 16 bp, Homo sapiens
caggctcagactctgg

SEQ ID NO: 3974790 - DNA, 12 bp, Homo sapiens
caggctccatgg

SEQ ID NO: 3974791 - DNA, 13 bp, Homo sapiens
caggctccatggg

SEQ ID NO: 3974792 - DNA, 16 bp, Homo sapiens
caggctccatggggaa

SEQ ID NO: 3974793 - DNA, 17 bp, Homo sapiens
caggctccatggggaag

SEQ ID NO: 3974794 - DNA, 23 bp, Homo sapiens
caggctccatggggaagtgctcc

SEQ ID NO: 3974795 - DNA, 16 bp, Homo sapiens
caggctccctttctct

SEQ ID NO: 3974796 - DNA, 18 bp, Homo sapiens
caggctctggagccagag

SEQ ID NO: 3974797 - DNA, 15 bp, Homo sapiens
caggctctgggaagg

SEQ ID NO: 3974798 - DNA, 20 bp, Homo sapiens
caggctctgggaaggggtgc

SEQ ID NO: 3974799 - DNA, 21 bp, Homo sapiens
caggctctgggctcagggctg

SEQ ID NO: 3974800 - DNA, 23 bp, Homo sapiens
caggctctgggctcagggctgga

SEQ ID NO: 3974801 - DNA, 13 bp, Homo sapiens
caggctcttcctg

SEQ ID NO: 3974802 - DNA, 14 bp, Homo sapiens
caggctcttctcct

SEQ ID NO: 3974803 - DNA, 22 bp, Homo sapiens
caggctcttctcctttcacaac

SEQ ID NO: 3974804 - DNA, 13 bp, Homo sapiens
caggctgcactgc

SEQ ID NO: 3974805 - DNA, 14 bp, Homo sapiens
caggctgcactgca

SEQ ID NO: 3974806 - DNA, 20 bp, Homo sapiens
caggctgttctgcactgaaa

SEQ ID NO: 3974807 - DNA, 15 bp, Homo sapiens
cagggaaagctccac

SEQ ID NO: 3974808 - DNA, 17 bp, Homo sapiens
cagggaaagctccacgg

SEQ ID NO: 3974809 - DNA, 14 bp, Homo sapiens
cagggaaaggctct

SEQ ID NO: 3974810 - DNA, 23 bp, Homo sapiens
cagggaaaggctctgaaagccag

SEQ ID NO: 3974811 - DNA, 16 bp, Homo sapiens
cagggaagagggcagt

SEQ ID NO: 3974812 - DNA, 17 bp, Homo sapiens
cagggaagagggcagta

SEQ ID NO: 3974813 - DNA, 13 bp, Homo sapiens
cagggaagcaggc

SEQ ID NO: 3974814 - DNA, 16 bp, Homo sapiens
cagggaagcaggcaga

SEQ ID NO: 3974815 - DNA, 18 bp, Homo sapiens
cagggaagcaggcagagc

SEQ ID NO: 3974816 - DNA, 12 bp, Homo sapiens
cagggaaggcag

SEQ ID NO: 3974817 - DNA, 21 bp, Homo sapiens
cagggaaggcaggcagggctc

SEQ ID NO: 3974818 - DNA, 22 bp, Homo sapiens
cagggaaggcaggcagggctct

SEQ ID NO: 3974819 - DNA, 23 bp, Homo sapiens
cagggaaggcaggcagggctctc

SEQ ID NO: 3974820 - DNA, 21 bp, Homo sapiens
cagggaagtcttacttaaaaa

SEQ ID NO: 3974821 - DNA, 23 bp, Homo sapiens
cagggaatccgcctgcagaggac

SEQ ID NO: 3974822 - DNA, 13 bp, Homo sapiens
cagggacaaagag

SEQ ID NO: 3974823 - DNA, 18 bp, Homo sapiens
cagggacaaagaggcctt

SEQ ID NO: 3974824 - DNA, 21 bp, Homo sapiens
cagggacagagacacctgcac

SEQ ID NO: 3974825 - DNA, 22 bp, Homo sapiens
cagggacagagacacctgcacc

SEQ ID NO: 3974826 - DNA, 23 bp, Homo sapiens
cagggacagagacacctgcacct

SEQ ID NO: 3974827 - DNA, 16 bp, Homo sapiens
cagggacagagatgga

SEQ ID NO: 3974828 - DNA, 18 bp, Homo sapiens
cagggacaggataagagg

SEQ ID NO: 3974829 - DNA, 16 bp, Homo sapiens
cagggacggggactgg

SEQ ID NO: 3974830 - DNA, 21 bp, Homo sapiens
cagggactcaagggtccagaa

SEQ ID NO: 3974831 - DNA, 23 bp, Homo sapiens
cagggactgttcctgtctcagca

SEQ ID NO: 3974832 - DNA, 20 bp, Homo sapiens
cagggagcaactctccactc

SEQ ID NO: 3974833 - DNA, 16 bp, Homo sapiens
cagggagcccctagga

SEQ ID NO: 3974834 - DNA, 19 bp, Homo sapiens
cagggagcccctaggaaag

SEQ ID NO: 3974835 - DNA, 22 bp, Homo sapiens
cagggagcccctaggaaagcag

SEQ ID NO: 3974836 - DNA, 14 bp, Homo sapiens
cagggaggatgcca

SEQ ID NO: 3974837 - DNA, 13 bp, Homo sapiens
cagggaggggact

SEQ ID NO: 3974838 - DNA, 17 bp, Homo sapiens
cagggatcttgcattcc

SEQ ID NO: 3974839 - DNA, 22 bp, Homo sapiens
cagggatgggggatgggccagg

SEQ ID NO: 3974840 - DNA, 21 bp, Homo sapiens
cagggatgtagattaaggtga

SEQ ID NO: 3974841 - DNA, 13 bp, Homo sapiens
cagggatttgagg

SEQ ID NO: 3974842 - DNA, 17 bp, Homo sapiens
cagggcaatcttgtcca

SEQ ID NO: 3974843 - DNA, 20 bp, Homo sapiens
cagggcaatcttgtccacag

SEQ ID NO: 3974844 - DNA, 22 bp, Homo sapiens
cagggcacaggagctacctgtg

SEQ ID NO: 3974845 - DNA, 17 bp, Homo sapiens
cagggcagcctccacct

SEQ ID NO: 3974846 - DNA, 13 bp, Homo sapiens
cagggcagtgaca

SEQ ID NO: 3974847 - DNA, 18 bp, Homo sapiens
cagggccacgtgccaggc

SEQ ID NO: 3974848 - DNA, 21 bp, Homo sapiens
cagggccacgtgccaggcccg

SEQ ID NO: 3974849 - DNA, 11 bp, Homo sapiens
cagggccagaa

SEQ ID NO: 3974850 - DNA, 19 bp, Homo sapiens
cagggccagaaggagggca

SEQ ID NO: 3974851 - DNA, 20 bp, Homo sapiens
cagggccagaaggagggcag

SEQ ID NO: 3974852 - DNA, 19 bp, Homo sapiens
catcacccagtcctggcca

SEQ ID NO: 3974853 - DNA, 20 bp, Homo sapiens
catcaccctctgggcagctg

SEQ ID NO: 3974854 - DNA, 22 bp, Homo sapiens
catcaccgacgcgtctcctgtt

SEQ ID NO: 3974855 - DNA, 13 bp, Homo sapiens
catcacctctgta

SEQ ID NO: 3974856 - DNA, 19 bp, Homo sapiens
catcactggagcaccaggc

SEQ ID NO: 3974857 - DNA, 19 bp, Homo sapiens
catcacttgtacaaaataa

SEQ ID NO: 3974858 - DNA, 17 bp, Homo sapiens
catcagaaagggagggc

SEQ ID NO: 3974859 - DNA, 20 bp, Homo sapiens
catcagaaagggagggctct

SEQ ID NO: 3974860 - DNA, 22 bp, Homo sapiens
catcagaaagggagggctctga

SEQ ID NO: 3974861 - DNA, 14 bp, Homo sapiens
catcagaaggagaa

SEQ ID NO: 3974862 - DNA, 21 bp, Homo sapiens
catcagacaggtaaatgggca

SEQ ID NO: 3974863 - DNA, 22 bp, Homo sapiens
catcagcagcccatggcctctg

SEQ ID NO: 3974864 - DNA, 13 bp, Homo sapiens
catcagcatacct

SEQ ID NO: 3974865 - DNA, 12 bp, Homo sapiens
catcagctccct

SEQ ID NO: 3974866 - DNA, 20 bp, Homo sapiens
catcagggtgggccactctc

SEQ ID NO: 3974867 - DNA, 19 bp, Homo sapiens
catcataaggaagttatta

SEQ ID NO: 3974868 - DNA, 21 bp, Homo sapiens
catcatacgcatggtcctgga

SEQ ID NO: 3974869 - DNA, 20 bp, Homo sapiens
catcatatgacatgccaccc

SEQ ID NO: 3974870 - DNA, 20 bp, Homo sapiens
catcatattgtatgtaagta

SEQ ID NO: 3974871 - DNA, 22 bp, Homo sapiens
catcatcaggcttggaatgaat

SEQ ID NO: 3974872 - DNA, 14 bp, Homo sapiens
catcatgcctctga

SEQ ID NO: 3974873 - DNA, 15 bp, Homo sapiens
catcatgcctctgag

SEQ ID NO: 3974874 - DNA, 16 bp, Homo sapiens
catcatgcctctgagg

SEQ ID NO: 3974875 - DNA, 17 bp, Homo sapiens
catcattccttgagaaa

SEQ ID NO: 3974876 - DNA, 22 bp, Homo sapiens
catcattccttgagaaaaacaa

SEQ ID NO: 3974877 - DNA, 14 bp, Homo sapiens
catcattgtatata

SEQ ID NO: 3974878 - DNA, 19 bp, Homo sapiens
catcattgtatatatgtgt

SEQ ID NO: 3974879 - DNA, 21 bp, Homo sapiens
catccaactcctggagatttc

SEQ ID NO: 3974880 - DNA, 22 bp, Homo sapiens
catccaaggagaaacagagaca

SEQ ID NO: 3974881 - DNA, 16 bp, Homo sapiens
catccaatctgctcag

SEQ ID NO: 3974882 - DNA, 15 bp, Homo sapiens
catccacccagtgct

SEQ ID NO: 3974883 - DNA, 17 bp, Homo sapiens
catccacccagtgctgc

SEQ ID NO: 3974884 - DNA, 20 bp, Homo sapiens
catccacccagtgctgccat

SEQ ID NO: 3974885 - DNA, 21 bp, Homo sapiens
catccacccagtgctgccatg

SEQ ID NO: 3974886 - DNA, 17 bp, Homo sapiens
catccacgcacacatgg

SEQ ID NO: 3974887 - DNA, 22 bp, Homo sapiens
catccacgcacacatggacaca

SEQ ID NO: 3974888 - DNA, 15 bp, Homo sapiens
catccagcctgtgtg

SEQ ID NO: 3974889 - DNA, 15 bp, Homo sapiens
catccagtttgttct

SEQ ID NO: 3974890 - DNA, 16 bp, Homo sapiens
catccataaagcaagc

SEQ ID NO: 3974891 - DNA, 18 bp, Homo sapiens
catccataaagcaagctc

SEQ ID NO: 3974892 - DNA, 21 bp, Homo sapiens
catccataaagcaagctcaac

SEQ ID NO: 3974893 - DNA, 18 bp, Homo sapiens
catccatgtttgtaaaac

SEQ ID NO: 3974894 - DNA, 14 bp, Homo sapiens
catccattcctcag

SEQ ID NO: 3974895 - DNA, 16 bp, Homo sapiens
catccattcctcaggg

SEQ ID NO: 3974896 - DNA, 18 bp, Homo sapiens
catccattcctcagggac

SEQ ID NO: 3974897 - DNA, 21 bp, Homo sapiens
catcccacattcggaccctgc

SEQ ID NO: 3974898 - DNA, 16 bp, Homo sapiens
catcccaggaggggcc

SEQ ID NO: 3974899 - DNA, 14 bp, Homo sapiens
catcccaggggacc

SEQ ID NO: 3974900 - DNA, 19 bp, Homo sapiens
catcccaggggaccacacc

SEQ ID NO: 3974901 - DNA, 12 bp, Homo sapiens
catcccatccct

SEQ ID NO: 3974902 - DNA, 23 bp, Homo sapiens
catccccaaactgtgccctgcct

SEQ ID NO: 3974903 - DNA, 19 bp, Homo sapiens
catcccctcgtcctgtccc

SEQ ID NO: 3974904 - DNA, 19 bp, Homo sapiens
catcccctggactgggagg

SEQ ID NO: 3974905 - DNA, 15 bp, Homo sapiens
catcccctttcctcc

SEQ ID NO: 3974906 - DNA, 19 bp, Homo sapiens
catcccctttcctccccac

SEQ ID NO: 3974907 - DNA, 22 bp, Homo sapiens
catcccgctggtgcctcccggg

SEQ ID NO: 3974908 - DNA, 12 bp, Homo sapiens
catcccggcctc

SEQ ID NO: 3974909 - DNA, 14 bp, Homo sapiens
catcccggcctctt

SEQ ID NO: 3974910 - DNA, 16 bp, Homo sapiens
catcccggcctcttcc

SEQ ID NO: 3974911 - DNA, 18 bp, Homo sapiens
catcccggcctcttccac

SEQ ID NO: 3974912 - DNA, 19 bp, Homo sapiens
catccctgggcctgctgct

SEQ ID NO: 3974913 - DNA, 16 bp, Homo sapiens
catcccttccctgtcc

SEQ ID NO: 3974914 - DNA, 19 bp, Homo sapiens
catcccttcctccccagtc

SEQ ID NO: 3974915 - DNA, 13 bp, Homo sapiens
catccctttccag

SEQ ID NO: 3974916 - DNA, 12 bp, Homo sapiens
catccggctcct

SEQ ID NO: 3974917 - DNA, 13 bp, Homo sapiens
catccgggacgct

SEQ ID NO: 3974918 - DNA, 15 bp, Homo sapiens
catccgggacgcttc

SEQ ID NO: 3974919 - DNA, 17 bp, Homo sapiens
catccgggacgcttcca

SEQ ID NO: 3974920 - DNA, 18 bp, Homo sapiens
catccgggacgcttccag

SEQ ID NO: 3974921 - DNA, 18 bp, Homo sapiens
catccgtagttccctgaa

SEQ ID NO: 3974922 - DNA, 14 bp, Homo sapiens
catcctaccaatgc

SEQ ID NO: 3974923 - DNA, 18 bp, Homo sapiens
catcctaccaatgcatgc

SEQ ID NO: 3974924 - DNA, 20 bp, Homo sapiens
catcctgcagcctcctcctg

SEQ ID NO: 3974925 - DNA, 19 bp, Homo sapiens
catcctgctttccctcccc

SEQ ID NO: 3974926 - DNA, 15 bp, Homo sapiens
catcctggcccctcc

SEQ ID NO: 3974927 - DNA, 19 bp, Homo sapiens
catcctggcccctccagac

SEQ ID NO: 3974928 - DNA, 23 bp, Homo sapiens
catcctggcccctccagaccctg

SEQ ID NO: 3974929 - DNA, 17 bp, Homo sapiens
catcctggcctcctttt

SEQ ID NO: 3974930 - DNA, 12 bp, Homo sapiens
catccttctgcc

SEQ ID NO: 3974931 - DNA, 15 bp, Homo sapiens
catccttctgccttt

SEQ ID NO: 3974932 - DNA, 15 bp, Homo sapiens
catccttggcctggc

SEQ ID NO: 3974933 - DNA, 17 bp, Homo sapiens
catccttggcctggcgc

SEQ ID NO: 3974934 - DNA, 14 bp, Homo sapiens
catcgcactgtgga

SEQ ID NO: 3974935 - DNA, 17 bp, Homo sapiens
catcggaggctgggccc

SEQ ID NO: 3974936 - DNA, 20 bp, Homo sapiens
catcggaggctgggcccctg

SEQ ID NO: 3974937 - DNA, 19 bp, Homo sapiens
catcgtgacccttcagggc

SEQ ID NO: 3974938 - DNA, 19 bp, Homo sapiens
cattatttaatgtttgatt

SEQ ID NO: 3974939 - DNA, 21 bp, Homo sapiens
cattatttaatgtttgattta

SEQ ID NO: 3974940 - DNA, 23 bp, Homo sapiens
cattcaaatgggtgatatcctga

SEQ ID NO: 3974941 - DNA, 22 bp, Homo sapiens
cattcaactttagtatttttac

SEQ ID NO: 3974942 - DNA, 17 bp, Homo sapiens
cattcacacagggctct

SEQ ID NO: 3974943 - DNA, 21 bp, Homo sapiens
cattcacatttgatgtacatg

SEQ ID NO: 3974944 - DNA, 16 bp, Homo sapiens
cattcagcacacccca

SEQ ID NO: 3974945 - DNA, 18 bp, Homo sapiens
cattcagcacaccccaag

SEQ ID NO: 3974946 - DNA, 16 bp, Homo sapiens
cattcatccagttgca

SEQ ID NO: 3974947 - DNA, 18 bp, Homo sapiens
cattccaagtcaacactc

SEQ ID NO: 3974948 - DNA, 17 bp, Homo sapiens
cattccaccttcccatg

SEQ ID NO: 3974949 - DNA, 17 bp, Homo sapiens
cattcccagagtcagag

SEQ ID NO: 3974950 - DNA, 23 bp, Homo sapiens
cattcccagagtcagaggagaag

SEQ ID NO: 3974951 - DNA, 17 bp, Homo sapiens
cattccccaggtggctg

SEQ ID NO: 3974952 - DNA, 13 bp, Homo sapiens
cattccccatggg

SEQ ID NO: 3974953 - DNA, 18 bp, Homo sapiens
cattcccccatgtggctg

SEQ ID NO: 3974954 - DNA, 21 bp, Homo sapiens
cattcccccatgtggctgaag

SEQ ID NO: 3974955 - DNA, 23 bp, Homo sapiens
cattcccgtggtctccttgcact

SEQ ID NO: 3974956 - DNA, 23 bp, Homo sapiens
cattccctatcaaaacatatcaa

SEQ ID NO: 3974957 - DNA, 20 bp, Homo sapiens
cattccctgagtcaccagga

SEQ ID NO: 3974958 - DNA, 15 bp, Homo sapiens
cattccctgcatcca

SEQ ID NO: 3974959 - DNA, 17 bp, Homo sapiens
cattcctagagagcaga

SEQ ID NO: 3974960 - DNA, 20 bp, Homo sapiens
cattcctagagagcagaaat

SEQ ID NO: 3974961 - DNA, 22 bp, Homo sapiens
cattcctagagagcagaaataa

SEQ ID NO: 3974962 - DNA, 23 bp, Homo sapiens
cattcctcagggacagagacacc

SEQ ID NO: 3974963 - DNA, 15 bp, Homo sapiens
cattccttgtcacca

SEQ ID NO: 3974964 - DNA, 18 bp, Homo sapiens
cattcgaggtgtcaccct

SEQ ID NO: 3974965 - DNA, 20 bp, Homo sapiens
cattcgaggtgtcaccctgc

SEQ ID NO: 3974966 - DNA, 19 bp, Homo sapiens
cattcgcctgtgggaagag

SEQ ID NO: 3974967 - DNA, 14 bp, Homo sapiens
cattcggaccctgc

SEQ ID NO: 3974968 - DNA, 19 bp, Homo sapiens
cattcggaccctgcccata

SEQ ID NO: 3974969 - DNA, 16 bp, Homo sapiens
cattctcactcctacc

SEQ ID NO: 3974970 - DNA, 17 bp, Homo sapiens
cattctcactcctacct

SEQ ID NO: 3974971 - DNA, 22 bp, Homo sapiens
cattctcatatgtagccctcat

SEQ ID NO: 3974972 - DNA, 16 bp, Homo sapiens
cattctcatctactca

SEQ ID NO: 3974973 - DNA, 22 bp, Homo sapiens
cattctcctgcctgtagcagtg

SEQ ID NO: 3974974 - DNA, 21 bp, Homo sapiens
cattctcctgtgcccctcaga

SEQ ID NO: 3974975 - DNA, 16 bp, Homo sapiens
cattctctctcctgtc

SEQ ID NO: 3974976 - DNA, 18 bp, Homo sapiens
cattctctctcctgtcca

SEQ ID NO: 3974977 - DNA, 17 bp, Homo sapiens
cattctgaccatttcag

SEQ ID NO: 3974978 - DNA, 20 bp, Homo sapiens
cattctgttgcccaggctgg

SEQ ID NO: 3974979 - DNA, 20 bp, Homo sapiens
cattcttaccgagaaaagga

SEQ ID NO: 3974980 - DNA, 23 bp, Homo sapiens
cattcttaccgagaaaaggagaa

SEQ ID NO: 3974981 - DNA, 18 bp, Homo sapiens
cattcttcagtgcctagc

SEQ ID NO: 3974982 - DNA, 15 bp, Homo sapiens
cattctttcccctca

SEQ ID NO: 3974983 - DNA, 20 bp, Homo sapiens
cattctttcccctcagagct

SEQ ID NO: 3974984 - DNA, 14 bp, Homo sapiens
cattgaacagcaaa

SEQ ID NO: 3974985 - DNA, 14 bp, Homo sapiens
cattgacctcagct

SEQ ID NO: 3974986 - DNA, 15 bp, Homo sapiens
cattgacctcagctg

SEQ ID NO: 3974987 - DNA, 23 bp, Homo sapiens
cattgacctcagctgcacattcc

SEQ ID NO: 3974988 - DNA, 11 bp, Homo sapiens
cattgcctcca

SEQ ID NO: 3974989 - DNA, 18 bp, Homo sapiens
cattgcttattcttgagc

SEQ ID NO: 3974990 - DNA, 16 bp, Homo sapiens
cattggacttccttgg

SEQ ID NO: 3974991 - DNA, 22 bp, Homo sapiens
cattgggctgacacctaccatg

SEQ ID NO: 3974992 - DNA, 16 bp, Homo sapiens
cattgtatgtatctat

SEQ ID NO: 3974993 - DNA, 13 bp, Homo sapiens
cattgtcttccaa

SEQ ID NO: 3974994 - DNA, 17 bp, Homo sapiens
cattgtcttccaacccc

SEQ ID NO: 3974995 - DNA, 20 bp, Homo sapiens
cattgtcttccaaccccagc

SEQ ID NO: 3974996 - DNA, 22 bp, Homo sapiens
cattgtcttccaaccccagctg

SEQ ID NO: 3974997 - DNA, 23 bp, Homo sapiens
cattgtcttccaaccccagctgg

SEQ ID NO: 3974998 - DNA, 18 bp, Homo sapiens
cattgtgtgagcttctac

SEQ ID NO: 3974999 - DNA, 19 bp, Homo sapiens
cattgtgtgagcttctaca

SEQ ID NO: 3975000 - DNA, 18 bp, Homo sapiens
cattgttccttaccttta

SEQ ID NO: 3975001 - DNA, 12 bp, Homo sapiens
catttaaaaaaa

SEQ ID NO: 3975002 - DNA, 13 bp, Homo sapiens
catttaaaatgat

SEQ ID NO: 3975003 - DNA, 19 bp, Homo sapiens
catttaaagcttattaaaa

SEQ ID NO: 3975004 - DNA, 12 bp, Homo sapiens
catttaattcat

SEQ ID NO: 3975005 - DNA, 14 bp, Homo sapiens
catttagttttatg

SEQ ID NO: 3975006 - DNA, 17 bp, Homo sapiens
catttatatatatatgt

SEQ ID NO: 3975007 - DNA, 20 bp, Homo sapiens
catttatatatatatgtata

SEQ ID NO: 3975008 - DNA, 21 bp, Homo sapiens
catttatatatatatgtatat

SEQ ID NO: 3975009 - DNA, 22 bp, Homo sapiens
catttatatatatatgtatatg

SEQ ID NO: 3975010 - DNA, 16 bp, Homo sapiens
catttatgaagcaagc

SEQ ID NO: 3975011 - DNA, 17 bp, Homo sapiens
catttcacacaggtcct

SEQ ID NO: 3975012 - DNA, 12 bp, Homo sapiens
catttcacatta

SEQ ID NO: 3975013 - DNA, 14 bp, Homo sapiens
catttcactttaaa

SEQ ID NO: 3975014 - DNA, 21 bp, Homo sapiens
catttcactttaaagtctttc

SEQ ID NO: 3975015 - DNA, 20 bp, Homo sapiens
catttcataaggcctgccct

SEQ ID NO: 3975016 - DNA, 20 bp, Homo sapiens
catttcatctactacagggt

SEQ ID NO: 3975017 - DNA, 17 bp, Homo sapiens
catttccaaatgaatga

SEQ ID NO: 3975018 - DNA, 21 bp, Homo sapiens
catttccacactgtcagagct

SEQ ID NO: 3975019 - DNA, 14 bp, Homo sapiens
catttcctgggtgg

SEQ ID NO: 3975020 - DNA, 20 bp, Homo sapiens
catttcctgggtggctactc

SEQ ID NO: 3975021 - DNA, 21 bp, Homo sapiens
catttcgcccctcatttatcc

SEQ ID NO: 3975022 - DNA, 17 bp, Homo sapiens
catttctcaatcagtgc

SEQ ID NO: 3975023 - DNA, 13 bp, Homo sapiens
catttctctgagc

SEQ ID NO: 3975024 - DNA, 18 bp, Homo sapiens
cccacgagtcacctgcaa

SEQ ID NO: 3975025 - DNA, 22 bp, Homo sapiens
cccacgagtcacctgcaagccc

SEQ ID NO: 3975026 - DNA, 20 bp, Homo sapiens
cccacgtgagagaatctgcc

SEQ ID NO: 3975027 - DNA, 20 bp, Homo sapiens
cccactaagctttctccttt

SEQ ID NO: 3975028 - DNA, 22 bp, Homo sapiens
cccactaagctttctcctttga

SEQ ID NO: 3975029 - DNA, 15 bp, Homo sapiens
cccactccagccctg

SEQ ID NO: 3975030 - DNA, 13 bp, Homo sapiens
cccactctcattc

SEQ ID NO: 3975031 - DNA, 14 bp, Homo sapiens
cccactctgctctg

SEQ ID NO: 3975032 - DNA, 15 bp, Homo sapiens
cccactctgctctga

SEQ ID NO: 3975033 - DNA, 19 bp, Homo sapiens
cccactctgctctgatgca

SEQ ID NO: 3975034 - DNA, 23 bp, Homo sapiens
cccactctttgctacaataaatg

SEQ ID NO: 3975035 - DNA, 16 bp, Homo sapiens
cccactggccagtcct

SEQ ID NO: 3975036 - DNA, 17 bp, Homo sapiens
cccactggccagtccta

SEQ ID NO: 3975037 - DNA, 22 bp, Homo sapiens
cccactggccagtcctagagct

SEQ ID NO: 3975038 - DNA, 19 bp, Homo sapiens
cccactgtgcttacagtga

SEQ ID NO: 3975039 - DNA, 20 bp, Homo sapiens
cccacttagccgtccatggc

SEQ ID NO: 3975040 - DNA, 21 bp, Homo sapiens
cccacttagccgtccatggca

SEQ ID NO: 3975041 - DNA, 14 bp, Homo sapiens
cccacttcagccca

SEQ ID NO: 3975042 - DNA, 19 bp, Homo sapiens
cccagaaattccttcccac

SEQ ID NO: 3975043 - DNA, 23 bp, Homo sapiens
cccagacacatcgcactgtggat

SEQ ID NO: 3975044 - DNA, 18 bp, Homo sapiens
cccagacacattctcctg

SEQ ID NO: 3975045 - DNA, 13 bp, Homo sapiens
cccagacagagcc

SEQ ID NO: 3975046 - DNA, 14 bp, Homo sapiens
cccagactcagctc

SEQ ID NO: 3975047 - DNA, 19 bp, Homo sapiens
cccagactttctacacctg

SEQ ID NO: 3975048 - DNA, 13 bp, Homo sapiens
cccagagacagga

SEQ ID NO: 3975049 - DNA, 15 bp, Homo sapiens
cccagagacaggaaa

SEQ ID NO: 3975050 - DNA, 16 bp, Homo sapiens
cccagagacaggaaaa

SEQ ID NO: 3975051 - DNA, 17 bp, Homo sapiens
cccagagacaggaaaat

SEQ ID NO: 3975052 - DNA, 19 bp, Homo sapiens
cccagagaggaatcagact

SEQ ID NO: 3975053 - DNA, 20 bp, Homo sapiens
cccagagatgcctccaccgc

SEQ ID NO: 3975054 - DNA, 22 bp, Homo sapiens
cccagagattgcttctcatccc

SEQ ID NO: 3975055 - DNA, 18 bp, Homo sapiens
cccagagcacaagttcca

SEQ ID NO: 3975056 - DNA, 18 bp, Homo sapiens
cccagagccactaccttt

SEQ ID NO: 3975057 - DNA, 21 bp, Homo sapiens
cccagagctgtggactttgtt

SEQ ID NO: 3975058 - DNA, 22 bp, Homo sapiens
cccagagcttattggccactgg

SEQ ID NO: 3975059 - DNA, 23 bp, Homo sapiens
cccagagcttattggccactggg

SEQ ID NO: 3975060 - DNA, 18 bp, Homo sapiens
cccagagggtagggcagc

SEQ ID NO: 3975061 - DNA, 19 bp, Homo sapiens
cccagagggtagggcagca

SEQ ID NO: 3975062 - DNA, 20 bp, Homo sapiens
cccagaggttatctgcctgg

SEQ ID NO: 3975063 - DNA, 22 bp, Homo sapiens
cccagaggttatctgcctggcc

SEQ ID NO: 3975064 - DNA, 17 bp, Homo sapiens
cccagagtcagaggaga

SEQ ID NO: 3975065 - DNA, 17 bp, Homo sapiens
cccagagtggagtctga

SEQ ID NO: 3975066 - DNA, 19 bp, Homo sapiens
cccagagtggagtctgagt

SEQ ID NO: 3975067 - DNA, 16 bp, Homo sapiens
cccagagtgtgggaag

SEQ ID NO: 3975068 - DNA, 23 bp, Homo sapiens
cccagagtgtgggaagggagagc

SEQ ID NO: 3975069 - DNA, 14 bp, Homo sapiens
cccagatctgcctg

SEQ ID NO: 3975070 - DNA, 20 bp, Homo sapiens
cccagatctgcctgggcctg

SEQ ID NO: 3975071 - DNA, 22 bp, Homo sapiens
cccagatctgcctgggcctgtg

SEQ ID NO: 3975072 - DNA, 21 bp, Homo sapiens
cccagcaagtttcaccttggg

SEQ ID NO: 3975073 - DNA, 17 bp, Homo sapiens
cccagcagccctaagga

SEQ ID NO: 3975074 - DNA, 22 bp, Homo sapiens
cccagcagccctaaggatctct

SEQ ID NO: 3975075 - DNA, 14 bp, Homo sapiens
cccagcagctgggc

SEQ ID NO: 3975076 - DNA, 23 bp, Homo sapiens
cccagcagctgggccggccagcc

SEQ ID NO: 3975077 - DNA, 13 bp, Homo sapiens
cccagccccaggg

SEQ ID NO: 3975078 - DNA, 16 bp, Homo sapiens
cccagccccaggggtg

SEQ ID NO: 3975079 - DNA, 15 bp, Homo sapiens
cccagccctgccagg

SEQ ID NO: 3975080 - DNA, 12 bp, Homo sapiens
cccagccctggc

SEQ ID NO: 3975081 - DNA, 16 bp, Homo sapiens
cccagccctggctctg

SEQ ID NO: 3975082 - DNA, 17 bp, Homo sapiens
cccagcccttctgcctt

SEQ ID NO: 3975083 - DNA, 16 bp, Homo sapiens
cccagcctagcccact

SEQ ID NO: 3975084 - DNA, 14 bp, Homo sapiens
cccagcctgggcct

SEQ ID NO: 3975085 - DNA, 15 bp, Homo sapiens
cccagcctgggccta

SEQ ID NO: 3975086 - DNA, 19 bp, Homo sapiens
cccagcctgtcctggtaca

SEQ ID NO: 3975087 - DNA, 14 bp, Homo sapiens
cccagcgattccct

SEQ ID NO: 3975088 - DNA, 20 bp, Homo sapiens
cccagcgcggcttggccgcc

SEQ ID NO: 3975089 - DNA, 21 bp, Homo sapiens
cccagcgcggcttggccgcca

SEQ ID NO: 3975090 - DNA, 14 bp, Homo sapiens
cccagctacattcc

SEQ ID NO: 3975091 - DNA, 18 bp, Homo sapiens
cccagctacattcctcag

SEQ ID NO: 3975092 - DNA, 19 bp, Homo sapiens
cccagctacattcctcagc

SEQ ID NO: 3975093 - DNA, 20 bp, Homo sapiens
cccagctacattcctcagct

SEQ ID NO: 3975094 - DNA, 21 bp, Homo sapiens
cccagctacattcctcagctg

SEQ ID NO: 3975095 - DNA, 18 bp, Homo sapiens
cccagctactctgtccag

SEQ ID NO: 3975096 - DNA, 12 bp, Homo sapiens
cccagctctccc

SEQ ID NO: 3975097 - DNA, 19 bp, Homo sapiens
cccagctctccctctggcc

SEQ ID NO: 3975098 - DNA, 21 bp, Homo sapiens
cccagctctccctctggccct

SEQ ID NO: 3975099 - DNA, 12 bp, Homo sapiens
cccagctgcaga

SEQ ID NO: 3975100 - DNA, 12 bp, Homo sapiens
cccagctggcct

SEQ ID NO: 3975101 - DNA, 18 bp, Homo sapiens
cccagctggcctctagaa

SEQ ID NO: 3975102 - DNA, 16 bp, Homo sapiens
cccagctggtgggaag

SEQ ID NO: 3975103 - DNA, 13 bp, Homo sapiens
cccagctgtagcc

SEQ ID NO: 3975104 - DNA, 14 bp, Homo sapiens
cccagctgtagcca

SEQ ID NO: 3975105 - DNA, 15 bp, Homo sapiens
cccagctgtagccat

SEQ ID NO: 3975106 - DNA, 22 bp, Homo sapiens
cccagctgtagccatggctcag

SEQ ID NO: 3975107 - DNA, 24 bp, Homo sapiens
cccagctgtagccatggctcaggc

SEQ ID NO: 3975108 - DNA, 15 bp, Homo sapiens
cccagctgtctgtgt

SEQ ID NO: 3975109 - DNA, 16 bp, Homo sapiens
cccagctgtctgtgtc

SEQ ID NO: 3975110 - DNA, 18 bp, Homo sapiens
ccctgccacctgtctgtc

SEQ ID NO: 3975111 - DNA, 16 bp, Homo sapiens
ccctgccccagcaaga

SEQ ID NO: 3975112 - DNA, 21 bp, Homo sapiens
ccctgcccccatctccccagg

SEQ ID NO: 3975113 - DNA, 18 bp, Homo sapiens
ccctgcccctcccttcaa

SEQ ID NO: 3975114 - DNA, 19 bp, Homo sapiens
ccctgcccgaccccatctc

SEQ ID NO: 3975115 - DNA, 11 bp, Homo sapiens
ccctgccctct

SEQ ID NO: 3975116 - DNA, 17 bp, Homo sapiens
ccctgccctctccttcc

SEQ ID NO: 3975117 - DNA, 15 bp, Homo sapiens
ccctgccctgccacc

SEQ ID NO: 3975118 - DNA, 13 bp, Homo sapiens
ccctgccctgctg

SEQ ID NO: 3975119 - DNA, 21 bp, Homo sapiens
ccctgcctgagcccaggagct

SEQ ID NO: 3975120 - DNA, 15 bp, Homo sapiens
ccctgcctgcccact

SEQ ID NO: 3975121 - DNA, 10 bp, Homo sapiens
ccctgcctgg

SEQ ID NO: 3975122 - DNA, 14 bp, Homo sapiens
ccctgcctggagga

SEQ ID NO: 3975123 - DNA, 15 bp, Homo sapiens
ccctgcctggaggac

SEQ ID NO: 3975124 - DNA, 16 bp, Homo sapiens
ccctgcctggaggacc

SEQ ID NO: 3975125 - DNA, 17 bp, Homo sapiens
ccctgcctggtatgagt

SEQ ID NO: 3975126 - DNA, 22 bp, Homo sapiens
ccctgcgttggagccactcctg

SEQ ID NO: 3975127 - DNA, 17 bp, Homo sapiens
ccctgctactcctgtgc

SEQ ID NO: 3975128 - DNA, 21 bp, Homo sapiens
ccctgctactcctgtgctctg

SEQ ID NO: 3975129 - DNA, 9 bp, Homo sapiens
ccctgctcc

SEQ ID NO: 3975130 - DNA, 13 bp, Homo sapiens
ccctgctcctccc

SEQ ID NO: 3975131 - DNA, 16 bp, Homo sapiens
ccctgctcctcccaac

SEQ ID NO: 3975132 - DNA, 12 bp, Homo sapiens
ccctgctgctca

SEQ ID NO: 3975133 - DNA, 14 bp, Homo sapiens
ccctgctgtgggag

SEQ ID NO: 3975134 - DNA, 18 bp, Homo sapiens
ccctggaattcagcaccc

SEQ ID NO: 3975135 - DNA, 21 bp, Homo sapiens
ccctggaattcagcaccctgg

SEQ ID NO: 3975136 - DNA, 17 bp, Homo sapiens
ccctggacaagcagagg

SEQ ID NO: 3975137 - DNA, 21 bp, Homo sapiens
ccctggatcagcgtggccttg

SEQ ID NO: 3975138 - DNA, 22 bp, Homo sapiens
ccctggatgggcattgggctga

SEQ ID NO: 3975139 - DNA, 13 bp, Homo sapiens
ccctggatgtccc

SEQ ID NO: 3975140 - DNA, 13 bp, Homo sapiens
ccctggatgtgtg

SEQ ID NO: 3975141 - DNA, 23 bp, Homo sapiens
ccctggcatgtcagagccaggct

SEQ ID NO: 3975142 - DNA, 20 bp, Homo sapiens
ccctggcccgcccctcgctg

SEQ ID NO: 3975143 - DNA, 14 bp, Homo sapiens
ccctggcctgctgg

SEQ ID NO: 3975144 - DNA, 21 bp, Homo sapiens
ccctggcctgctgggctctcc

SEQ ID NO: 3975145 - DNA, 22 bp, Homo sapiens
ccctggcctttgaggcaaaggc

SEQ ID NO: 3975146 - DNA, 13 bp, Homo sapiens
ccctggctctgca

SEQ ID NO: 3975147 - DNA, 19 bp, Homo sapiens
ccctggcttttcactgctg

SEQ ID NO: 3975148 - DNA, 17 bp, Homo sapiens
ccctgggaactcatcct

SEQ ID NO: 3975149 - DNA, 16 bp, Homo sapiens
ccctgggaaggctaag

SEQ ID NO: 3975150 - DNA, 14 bp, Homo sapiens
ccctgggccccacc

SEQ ID NO: 3975151 - DNA, 16 bp, Homo sapiens
ccctgggccccaccac

SEQ ID NO: 3975152 - DNA, 20 bp, Homo sapiens
ccctgggccccaccacctag

SEQ ID NO: 3975153 - DNA, 17 bp, Homo sapiens
ccctgggcccctccacg

SEQ ID NO: 3975154 - DNA, 15 bp, Homo sapiens
ccctgggcctgctgc

SEQ ID NO: 3975155 - DNA, 23 bp, Homo sapiens
ccctgggcctggaccgcttccca

SEQ ID NO: 3975156 - DNA, 16 bp, Homo sapiens
ccctgggctgtctgtc

SEQ ID NO: 3975157 - DNA, 20 bp, Homo sapiens
ccctggggcctgtactgcct

SEQ ID NO: 3975158 - DNA, 23 bp, Homo sapiens
ccctggggcctgtactgcctgct

SEQ ID NO: 3975159 - DNA, 16 bp, Homo sapiens
ccctgggggccagctg

SEQ ID NO: 3975160 - DNA, 17 bp, Homo sapiens
ccctgggggccagctgg

SEQ ID NO: 3975161 - DNA, 13 bp, Homo sapiens
ccctggtgctgcc

SEQ ID NO: 3975162 - DNA, 17 bp, Homo sapiens
ccctggtgctgccacac

SEQ ID NO: 3975163 - DNA, 17 bp, Homo sapiens
ccctggtgtcaggcagg

SEQ ID NO: 3975164 - DNA, 18 bp, Homo sapiens
ccctggttatattctcac

SEQ ID NO: 3975165 - DNA, 13 bp, Homo sapiens
ccctgtacccagc

SEQ ID NO: 3975166 - DNA, 17 bp, Homo sapiens
ccctgtacccagctcct

SEQ ID NO: 3975167 - DNA, 17 bp, Homo sapiens
ccctgtagctctgcctc

SEQ ID NO: 3975168 - DNA, 21 bp, Homo sapiens
ccctgtagctctgcctccctc

SEQ ID NO: 3975169 - DNA, 14 bp, Homo sapiens
ccctgtaggttgct

SEQ ID NO: 3975170 - DNA, 22 bp, Homo sapiens
ccctgtatataatactaaagtg

SEQ ID NO: 3975171 - DNA, 14 bp, Homo sapiens
ccctgtcaccaagc

SEQ ID NO: 3975172 - DNA, 19 bp, Homo sapiens
ccctgtcaccaagctcaca

SEQ ID NO: 3975173 - DNA, 15 bp, Homo sapiens
ccctgtcccaccaac

SEQ ID NO: 3975174 - DNA, 22 bp, Homo sapiens
ccctgtcccaccaactctgcac

SEQ ID NO: 3975175 - DNA, 18 bp, Homo sapiens
ccctgtcccctgaaaaac

SEQ ID NO: 3975176 - DNA, 15 bp, Homo sapiens
ccctgtcgagacact

SEQ ID NO: 3975177 - DNA, 19 bp, Homo sapiens
ccctgtcttctctcaaagg

SEQ ID NO: 3975178 - DNA, 18 bp, Homo sapiens
ccctgtgactatggctct

SEQ ID NO: 3975179 - DNA, 21 bp, Homo sapiens
ccctgtggattccagcatttg

SEQ ID NO: 3975180 - DNA, 21 bp, Homo sapiens
ccctgtggcagaccgggggcc

SEQ ID NO: 3975181 - DNA, 23 bp, Homo sapiens
ccctgtgggggtggccatccctg

SEQ ID NO: 3975182 - DNA, 22 bp, Homo sapiens
ccctgttcactctacttagcat

SEQ ID NO: 3975183 - DNA, 11 bp, Homo sapiens
ccctgtttaat

SEQ ID NO: 3975184 - DNA, 21 bp, Homo sapiens
ccctgtttaatatttaaacag

SEQ ID NO: 3975185 - DNA, 14 bp, Homo sapiens
ccctgtttcctgag

SEQ ID NO: 3975186 - DNA, 14 bp, Homo sapiens
ccctgttttatact

SEQ ID NO: 3975187 - DNA, 15 bp, Homo sapiens
ccctgttttccacac

SEQ ID NO: 3975188 - DNA, 20 bp, Homo sapiens
cccttaagggttgaaggcag

SEQ ID NO: 3975189 - DNA, 16 bp, Homo sapiens
cccttacacgtacctc

SEQ ID NO: 3975190 - DNA, 23 bp, Homo sapiens
cccttactacttcttggaaaaaa

SEQ ID NO: 3975191 - DNA, 18 bp, Homo sapiens
cccttagagattgcccca

SEQ ID NO: 3975192 - DNA, 22 bp, Homo sapiens
cccttagagattgccccagagc

SEQ ID NO: 3975193 - DNA, 12 bp, Homo sapiens
cccttatccagg

SEQ ID NO: 3975194 - DNA, 13 bp, Homo sapiens
cccttatccagga

SEQ ID NO: 3975195 - DNA, 16 bp, Homo sapiens
cccttatccaggactc

SEQ ID NO: 3975196 - DNA, 22 bp, Homo sapiens
cccttatcttttataatgtctt

SEQ ID NO: 3975197 - DNA, 22 bp, Homo sapiens
cctagaaccaagcttcagagcc

SEQ ID NO: 3975198 - DNA, 15 bp, Homo sapiens
cctagaactgtgcct

SEQ ID NO: 3975199 - DNA, 13 bp, Homo sapiens
cctagaagggcta

SEQ ID NO: 3975200 - DNA, 22 bp, Homo sapiens
cctagacctgggccaaaagggc

SEQ ID NO: 3975201 - DNA, 19 bp, Homo sapiens
cctagagagcagaaataaa

SEQ ID NO: 3975202 - DNA, 23 bp, Homo sapiens
cctagagagcagaaataaaaagc

SEQ ID NO: 3975203 - DNA, 13 bp, Homo sapiens
cctagagctcctg

SEQ ID NO: 3975204 - DNA, 14 bp, Homo sapiens
cctagagctcctgt

SEQ ID NO: 3975205 - DNA, 15 bp, Homo sapiens
cctagagctcctgtc

SEQ ID NO: 3975206 - DNA, 19 bp, Homo sapiens
cctagagctcctgtcccta

SEQ ID NO: 3975207 - DNA, 20 bp, Homo sapiens
cctagagctcctgtccctac

SEQ ID NO: 3975208 - DNA, 17 bp, Homo sapiens
cctagaggtgggcagct

SEQ ID NO: 3975209 - DNA, 18 bp, Homo sapiens
cctagaggtgggcagctg

SEQ ID NO: 3975210 - DNA, 20 bp, Homo sapiens
cctagaggtgggcagctggg

SEQ ID NO: 3975211 - DNA, 18 bp, Homo sapiens
cctagcaagacctgttgg

SEQ ID NO: 3975212 - DNA, 16 bp, Homo sapiens
cctagcagtgaactat

SEQ ID NO: 3975213 - DNA, 13 bp, Homo sapiens
cctagccacctcc

SEQ ID NO: 3975214 - DNA, 21 bp, Homo sapiens
cctagccacctcccaccccac

SEQ ID NO: 3975215 - DNA, 21 bp, Homo sapiens
cctagctccaccctcaccagg

SEQ ID NO: 3975216 - DNA, 22 bp, Homo sapiens
cctagctgggcaaacccttctc

SEQ ID NO: 3975217 - DNA, 16 bp, Homo sapiens
cctaggaattcccagc

SEQ ID NO: 3975218 - DNA, 20 bp, Homo sapiens
cctaggagttgagtacagtg

SEQ ID NO: 3975219 - DNA, 16 bp, Homo sapiens
cctaggattcctcccc

SEQ ID NO: 3975220 - DNA, 22 bp, Homo sapiens
cctaggccaaatgcacaagctc

SEQ ID NO: 3975221 - DNA, 21 bp, Homo sapiens
cctaggggtccacgggaagcc

SEQ ID NO: 3975222 - DNA, 13 bp, Homo sapiens
cctaggtgctgga

SEQ ID NO: 3975223 - DNA, 14 bp, Homo sapiens
cctaggtgctggat

SEQ ID NO: 3975224 - DNA, 18 bp, Homo sapiens
cctagtgctattctgtgt

SEQ ID NO: 3975225 - DNA, 20 bp, Homo sapiens
cctagtgctattctgtgttg

SEQ ID NO: 3975226 - DNA, 23 bp, Homo sapiens
cctagtgctattctgtgttgaac

SEQ ID NO: 3975227 - DNA, 15 bp, Homo sapiens
cctagtgcttccact

SEQ ID NO: 3975228 - DNA, 23 bp, Homo sapiens
cctagtggggtctccctctcctg

SEQ ID NO: 3975229 - DNA, 24 bp, Homo sapiens
cctagtggggtctccctctcctgc

SEQ ID NO: 3975230 - DNA, 17 bp, Homo sapiens
cctagttcctgtggcca

SEQ ID NO: 3975231 - DNA, 17 bp, Homo sapiens
cctagtttgacctcaca

SEQ ID NO: 3975232 - DNA, 19 bp, Homo sapiens
cctagttttctcctcccag

SEQ ID NO: 3975233 - DNA, 15 bp, Homo sapiens
cctataatgtgtgta

SEQ ID NO: 3975234 - DNA, 21 bp, Homo sapiens
cctatagagagggggctctcc

SEQ ID NO: 3975235 - DNA, 11 bp, Homo sapiens
cctatcaaaac

SEQ ID NO: 3975236 - DNA, 13 bp, Homo sapiens
cctatcaaaacat

SEQ ID NO: 3975237 - DNA, 16 bp, Homo sapiens
cctatcaatcctgccc

SEQ ID NO: 3975238 - DNA, 12 bp, Homo sapiens
cctatccaccca

SEQ ID NO: 3975239 - DNA, 14 bp, Homo sapiens
cctatccacccagc

SEQ ID NO: 3975240 - DNA, 16 bp, Homo sapiens
cctatccacccagccc

SEQ ID NO: 3975241 - DNA, 17 bp, Homo sapiens
cctatccacccagccca

SEQ ID NO: 3975242 - DNA, 12 bp, Homo sapiens
cctatccatcct

SEQ ID NO: 3975243 - DNA, 22 bp, Homo sapiens
cctatccttggagagcagctgg

SEQ ID NO: 3975244 - DNA, 13 bp, Homo sapiens
cctatggagagcc

SEQ ID NO: 3975245 - DNA, 19 bp, Homo sapiens
cctatggagagccctggga

SEQ ID NO: 3975246 - DNA, 11 bp, Homo sapiens
cctatggatgt

SEQ ID NO: 3975247 - DNA, 24 bp, Homo sapiens
cctatgtactctacgccaaagtgc

SEQ ID NO: 3975248 - DNA, 15 bp, Homo sapiens
cctatgtcctaagga

SEQ ID NO: 3975249 - DNA, 20 bp, Homo sapiens
cctatgtcctaaggacacac

SEQ ID NO: 3975250 - DNA, 14 bp, Homo sapiens
cctatttattgggg

SEQ ID NO: 3975251 - DNA, 19 bp, Homo sapiens
cctattttaaaaccatgca

SEQ ID NO: 3975252 - DNA, 17 bp, Homo sapiens
cctattttcttttccat

SEQ ID NO: 3975253 - DNA, 14 bp, Homo sapiens
cctatttttcagaa

SEQ ID NO: 3975254 - DNA, 14 bp, Homo sapiens
cctcaaaagcactt

SEQ ID NO: 3975255 - DNA, 14 bp, Homo sapiens
cctcaaaccctgtg

SEQ ID NO: 3975256 - DNA, 22 bp, Homo sapiens
cctcaagtgatccacctgcctt

SEQ ID NO: 3975257 - DNA, 14 bp, Homo sapiens
cctcaatgccctgc

SEQ ID NO: 3975258 - DNA, 22 bp, Homo sapiens
cctcaatgtgaatcagacccta

SEQ ID NO: 3975259 - DNA, 18 bp, Homo sapiens
cctcacagcctctccctt

SEQ ID NO: 3975260 - DNA, 12 bp, Homo sapiens
cctcacaggagc

SEQ ID NO: 3975261 - DNA, 19 bp, Homo sapiens
cctcacaggagcagacaga

SEQ ID NO: 3975262 - DNA, 13 bp, Homo sapiens
cctcacagtgacc

SEQ ID NO: 3975263 - DNA, 18 bp, Homo sapiens
cctcacagtgacccttcc

SEQ ID NO: 3975264 - DNA, 15 bp, Homo sapiens
cctcacctgggcctt

SEQ ID NO: 3975265 - DNA, 17 bp, Homo sapiens
cctcacctgggcctttc

SEQ ID NO: 3975266 - DNA, 20 bp, Homo sapiens
cctcacctgggcctttcctg

SEQ ID NO: 3975267 - DNA, 22 bp, Homo sapiens
cctcacctgggcctttcctgtg

SEQ ID NO: 3975268 - DNA, 14 bp, Homo sapiens
cctcacgctctgga

SEQ ID NO: 3975269 - DNA, 15 bp, Homo sapiens
cctcacgctctggac

SEQ ID NO: 3975270 - DNA, 20 bp, Homo sapiens
cctcactatggtatgctggc

SEQ ID NO: 3975271 - DNA, 21 bp, Homo sapiens
cctcactatggtatgctggcc

SEQ ID NO: 3975272 - DNA, 20 bp, Homo sapiens
cctcactattacttgaactt

SEQ ID NO: 3975273 - DNA, 17 bp, Homo sapiens
cctcactctgtcagcca

SEQ ID NO: 3975274 - DNA, 22 bp, Homo sapiens
cctcactctgtcagccagccgc

SEQ ID NO: 3975275 - DNA, 16 bp, Homo sapiens
cctcactggctggggc

SEQ ID NO: 3975276 - DNA, 18 bp, Homo sapiens
cctcacttccctgggaac

SEQ ID NO: 3975277 - DNA, 14 bp, Homo sapiens
cctcagaccaactc

SEQ ID NO: 3975278 - DNA, 14 bp, Homo sapiens
cctcagactgctca

SEQ ID NO: 3975279 - DNA, 17 bp, Homo sapiens
cctcagatctgaacaca

SEQ ID NO: 3975280 - DNA, 21 bp, Homo sapiens
cctcagcaggaacctgtactg

SEQ ID NO: 3975281 - DNA, 18 bp, Homo sapiens
cctcagccaaacacagag

SEQ ID NO: 3975282 - DNA, 22 bp, Homo sapiens
cctcagccaaacacagagcggg

SEQ ID NO: 3975283 - DNA, 21 bp, Homo sapiens
cctgaggagtctgaggtcctg

SEQ ID NO: 3975284 - DNA, 22 bp, Homo sapiens
cctgaggagtctgaggtcctga

SEQ ID NO: 3975285 - DNA, 20 bp, Homo sapiens
cctgaggctcaagaggccca

SEQ ID NO: 3975286 - DNA, 22 bp, Homo sapiens
cctgaggctcaagaggcccagg

SEQ ID NO: 3975287 - DNA, 17 bp, Homo sapiens
cctgaggctcctgtgct

SEQ ID NO: 3975288 - DNA, 18 bp, Homo sapiens
cctgaggctcctgtgcta

SEQ ID NO: 3975289 - DNA, 19 bp, Homo sapiens
cctgagggtccccacctgg

SEQ ID NO: 3975290 - DNA, 13 bp, Homo sapiens
cctgagtcaccag

SEQ ID NO: 3975291 - DNA, 14 bp, Homo sapiens
cctgagtcaccagg

SEQ ID NO: 3975292 - DNA, 23 bp, Homo sapiens
cctgagtcaccctacctgtgcct

SEQ ID NO: 3975293 - DNA, 23 bp, Homo sapiens
cctgagtctgctatattttcatg

SEQ ID NO: 3975294 - DNA, 12 bp, Homo sapiens
cctgagtcttgg

SEQ ID NO: 3975295 - DNA, 19 bp, Homo sapiens
cctgagtggatctccaagg

SEQ ID NO: 3975296 - DNA, 14 bp, Homo sapiens
cctgagtggggcca

SEQ ID NO: 3975297 - DNA, 19 bp, Homo sapiens
cctgataagcttcaaagct

SEQ ID NO: 3975298 - DNA, 18 bp, Homo sapiens
cctgatcatggtcagctc

SEQ ID NO: 3975299 - DNA, 20 bp, Homo sapiens
cctgatcattacatggctgt

SEQ ID NO: 3975300 - DNA, 20 bp, Homo sapiens
cctgatcttggctcactgca

SEQ ID NO: 3975301 - DNA, 22 bp, Homo sapiens
cctgatgaaaaatatgtgcttg

SEQ ID NO: 3975302 - DNA, 15 bp, Homo sapiens
cctgatgctgccccg

SEQ ID NO: 3975303 - DNA, 22 bp, Homo sapiens
cctgatgctgccccgttccctg

SEQ ID NO: 3975304 - DNA, 14 bp, Homo sapiens
cctgatggccaaga

SEQ ID NO: 3975305 - DNA, 16 bp, Homo sapiens
cctgatggccaagagc

SEQ ID NO: 3975306 - DNA, 17 bp, Homo sapiens
cctgatggccaggccag

SEQ ID NO: 3975307 - DNA, 21 bp, Homo sapiens
cctgatggtacaggaaagctc

SEQ ID NO: 3975308 - DNA, 16 bp, Homo sapiens
cctgatttctctgaac

SEQ ID NO: 3975309 - DNA, 21 bp, Homo sapiens
cctgcaaaaatataaccatta

SEQ ID NO: 3975310 - DNA, 17 bp, Homo sapiens
cctgcaaactcactgct

SEQ ID NO: 3975311 - DNA, 13 bp, Homo sapiens
cctgcaagcccca

SEQ ID NO: 3975312 - DNA, 14 bp, Homo sapiens
cctgcaagccccag

SEQ ID NO: 3975313 - DNA, 17 bp, Homo sapiens
cctgcaagccccagggc

SEQ ID NO: 3975314 - DNA, 18 bp, Homo sapiens
cctgcaagccccagggcc

SEQ ID NO: 3975315 - DNA, 20 bp, Homo sapiens
cctgcaagccccagggcctg

SEQ ID NO: 3975316 - DNA, 13 bp, Homo sapiens
cctgcaaggacta

SEQ ID NO: 3975317 - DNA, 15 bp, Homo sapiens
cctgcaatctccagg

SEQ ID NO: 3975318 - DNA, 20 bp, Homo sapiens
cctgcaatctccagggctgc

SEQ ID NO: 3975319 - DNA, 21 bp, Homo sapiens
cctgcaatctccagggctgcc

SEQ ID NO: 3975320 - DNA, 20 bp, Homo sapiens
cctgcacaaagcccttccat

SEQ ID NO: 3975321 - DNA, 21 bp, Homo sapiens
cctgcaccagcccttccctgc

SEQ ID NO: 3975322 - DNA, 12 bp, Homo sapiens
cctgcaccctgg

SEQ ID NO: 3975323 - DNA, 21 bp, Homo sapiens
cctgcaccctggaaaggggag

SEQ ID NO: 3975324 - DNA, 14 bp, Homo sapiens
cctgcacctccccc

SEQ ID NO: 3975325 - DNA, 14 bp, Homo sapiens
cctgcacctgtgca

SEQ ID NO: 3975326 - DNA, 15 bp, Homo sapiens
cctgcacctgtgcag

SEQ ID NO: 3975327 - DNA, 16 bp, Homo sapiens
cctgcacgccaccgct

SEQ ID NO: 3975328 - DNA, 14 bp, Homo sapiens
cctgcactccagaa

SEQ ID NO: 3975329 - DNA, 17 bp, Homo sapiens
cctgcacttcagacacc

SEQ ID NO: 3975330 - DNA, 13 bp, Homo sapiens
cctgcagaccctg

SEQ ID NO: 3975331 - DNA, 15 bp, Homo sapiens
cctgcagagagaagc

SEQ ID NO: 3975332 - DNA, 16 bp, Homo sapiens
cctgcagcctccccca

SEQ ID NO: 3975333 - DNA, 17 bp, Homo sapiens
cctgcagcttgtagcca

SEQ ID NO: 3975334 - DNA, 17 bp, Homo sapiens
cctgcaggaacgagcac

SEQ ID NO: 3975335 - DNA, 15 bp, Homo sapiens
cctgcagggccaagc

SEQ ID NO: 3975336 - DNA, 17 bp, Homo sapiens
cctgcatccggagaatt

SEQ ID NO: 3975337 - DNA, 16 bp, Homo sapiens
cctgcatttctgagtt

SEQ ID NO: 3975338 - DNA, 19 bp, Homo sapiens
cctgccaccagtcactgtc

SEQ ID NO: 3975339 - DNA, 12 bp, Homo sapiens
cctgccacctgt

SEQ ID NO: 3975340 - DNA, 14 bp, Homo sapiens
cctgccacctgtct

SEQ ID NO: 3975341 - DNA, 18 bp, Homo sapiens
cctgccagagctttgttt

SEQ ID NO: 3975342 - DNA, 13 bp, Homo sapiens
cctgccagccatc

SEQ ID NO: 3975343 - DNA, 15 bp, Homo sapiens
cctgccagccatcac

SEQ ID NO: 3975344 - DNA, 12 bp, Homo sapiens
cctgccagctgc

SEQ ID NO: 3975345 - DNA, 13 bp, Homo sapiens
cctgccagctgcc

SEQ ID NO: 3975346 - DNA, 16 bp, Homo sapiens
cctgccagctgccttc

SEQ ID NO: 3975347 - DNA, 21 bp, Homo sapiens
cctgccagtgccttacctcct

SEQ ID NO: 3975348 - DNA, 22 bp, Homo sapiens
cctgccagtgccttacctcctg

SEQ ID NO: 3975349 - DNA, 23 bp, Homo sapiens
cctgccagtgccttacctcctgc

SEQ ID NO: 3975350 - DNA, 19 bp, Homo sapiens
cctgccataccgctgggga

SEQ ID NO: 3975351 - DNA, 20 bp, Homo sapiens
cctgccataccgctggggaa

SEQ ID NO: 3975352 - DNA, 21 bp, Homo sapiens
cctgccataccgctggggaac

SEQ ID NO: 3975353 - DNA, 17 bp, Homo sapiens
cctgcccaatgctttgg

SEQ ID NO: 3975354 - DNA, 23 bp, Homo sapiens
cctgcccaggagagccagccctc

SEQ ID NO: 3975355 - DNA, 17 bp, Homo sapiens
cctgcccatacccctgc

SEQ ID NO: 3975356 - DNA, 19 bp, Homo sapiens
cctgcccatacccctgcct

SEQ ID NO: 3975357 - DNA, 20 bp, Homo sapiens
cctgcccatacccctgcctg

SEQ ID NO: 3975358 - DNA, 21 bp, Homo sapiens
cctgcccatacccctgcctgg

SEQ ID NO: 3975359 - DNA, 23 bp, Homo sapiens
cctgcccatacccctgcctgggt

SEQ ID NO: 3975360 - DNA, 16 bp, Homo sapiens
cctgcccatgtgtccc

SEQ ID NO: 3975361 - DNA, 19 bp, Homo sapiens
cctgcccatgtgtcccctc

SEQ ID NO: 3975362 - DNA, 17 bp, Homo sapiens
cctgccccagcgcggct

SEQ ID NO: 3975363 - DNA, 21 bp, Homo sapiens
cctgcccccatctccccaggc

SEQ ID NO: 3975364 - DNA, 23 bp, Homo sapiens
cctgcccccatctccccaggcct

SEQ ID NO: 3975365 - DNA, 15 bp, Homo sapiens
cctgcccccgacagc

SEQ ID NO: 3975366 - DNA, 19 bp, Homo sapiens
cctgcccccgacagcccag

SEQ ID NO: 3975367 - DNA, 17 bp, Homo sapiens
cctgcccctccccagcc

SEQ ID NO: 3975368 - DNA, 15 bp, Homo sapiens
cctgcccctcccttc

SEQ ID NO: 3975369 - DNA, 18 bp, Homo sapiens
cctgtgactatggctctg

SEQ ID NO: 3975370 - DNA, 18 bp, Homo sapiens
cctgtgacttcagctctg

SEQ ID NO: 3975371 - DNA, 19 bp, Homo sapiens
cctgtgaggtaactgggat

SEQ ID NO: 3975372 - DNA, 23 bp, Homo sapiens
cctgtgcaaattttaaaaaggaa

SEQ ID NO: 3975373 - DNA, 18 bp, Homo sapiens
cctgtgcagcagcccagc

SEQ ID NO: 3975374 - DNA, 20 bp, Homo sapiens
cctgtgcagcagcccagctt

SEQ ID NO: 3975375 - DNA, 14 bp, Homo sapiens
cctgtgcagtcccg

SEQ ID NO: 3975376 - DNA, 21 bp, Homo sapiens
cctgtgcagtcccgtggaggg

SEQ ID NO: 3975377 - DNA, 20 bp, Homo sapiens
cctgtgccaacctgatgccc

SEQ ID NO: 3975378 - DNA, 12 bp, Homo sapiens
cctgtgccagct

SEQ ID NO: 3975379 - DNA, 23 bp, Homo sapiens
cctgtgcccctcagagaggcatg

SEQ ID NO: 3975380 - DNA, 21 bp, Homo sapiens
cctgtgcctcctcacccccag

SEQ ID NO: 3975381 - DNA, 14 bp, Homo sapiens
cctgtgctgaggac

SEQ ID NO: 3975382 - DNA, 16 bp, Homo sapiens
cctgtgctgaggactc

SEQ ID NO: 3975383 - DNA, 21 bp, Homo sapiens
cctgtgctgaggactccctcc

SEQ ID NO: 3975384 - DNA, 16 bp, Homo sapiens
cctgtggcagaaaaga

SEQ ID NO: 3975385 - DNA, 21 bp, Homo sapiens
cctgtggcagaaaagaggaga

SEQ ID NO: 3975386 - DNA, 23 bp, Homo sapiens
cctgtggcagaaaagaggagacc

SEQ ID NO: 3975387 - DNA, 21 bp, Homo sapiens
cctgtggcagaccgggggcca

SEQ ID NO: 3975388 - DNA, 15 bp, Homo sapiens
cctgtggcggtgcct

SEQ ID NO: 3975389 - DNA, 17 bp, Homo sapiens
cctgtggcggtgcctgg

SEQ ID NO: 3975390 - DNA, 14 bp, Homo sapiens
cctgtgggagcctc

SEQ ID NO: 3975391 - DNA, 17 bp, Homo sapiens
cctgtgggagcctcgca

SEQ ID NO: 3975392 - DNA, 21 bp, Homo sapiens
cctgtgggccaggagctcagc

SEQ ID NO: 3975393 - DNA, 15 bp, Homo sapiens
cctgtgggggtggcc

SEQ ID NO: 3975394 - DNA, 20 bp, Homo sapiens
cctgtgtagctgtgacctgc

SEQ ID NO: 3975395 - DNA, 23 bp, Homo sapiens
cctgtgtagctgtgacctgctga

SEQ ID NO: 3975396 - DNA, 15 bp, Homo sapiens
cctgtgtccagcagc

SEQ ID NO: 3975397 - DNA, 16 bp, Homo sapiens
cctgtgtccagcagct

SEQ ID NO: 3975398 - DNA, 14 bp, Homo sapiens
cctgtgtggggagg

SEQ ID NO: 3975399 - DNA, 18 bp, Homo sapiens
cctgtgtggggaggcagc

SEQ ID NO: 3975400 - DNA, 21 bp, Homo sapiens
cctgtgtggggaggcagctcc

SEQ ID NO: 3975401 - DNA, 22 bp, Homo sapiens
cctgtgtggggaggcagctcca

SEQ ID NO: 3975402 - DNA, 21 bp, Homo sapiens
cctgtgtgtgaaaggaagctc

SEQ ID NO: 3975403 - DNA, 15 bp, Homo sapiens
cctgtgttcttgctg

SEQ ID NO: 3975404 - DNA, 21 bp, Homo sapiens
cctgttaaaagatgaaaatat

SEQ ID NO: 3975405 - DNA, 17 bp, Homo sapiens
cctgttaaaatgtacac

SEQ ID NO: 3975406 - DNA, 15 bp, Homo sapiens
cctgttacccagaga

SEQ ID NO: 3975407 - DNA, 20 bp, Homo sapiens
cctgttcaccttatgtatta

SEQ ID NO: 3975408 - DNA, 14 bp, Homo sapiens
cctgttccctaccc

SEQ ID NO: 3975409 - DNA, 14 bp, Homo sapiens
cctgttgcacctca

SEQ ID NO: 3975410 - DNA, 18 bp, Homo sapiens
cctgttgttcccatctgc

SEQ ID NO: 3975411 - DNA, 12 bp, Homo sapiens
cctgtttcctga

SEQ ID NO: 3975412 - DNA, 13 bp, Homo sapiens
cctgttttccaca

SEQ ID NO: 3975413 - DNA, 14 bp, Homo sapiens
cctgttttccacac

SEQ ID NO: 3975414 - DNA, 17 bp, Homo sapiens
cctgtttttctgggtgg

SEQ ID NO: 3975415 - DNA, 17 bp, Homo sapiens
ccttaaaaggagagaag

SEQ ID NO: 3975416 - DNA, 23 bp, Homo sapiens
ccttaaagaaagtcgaattaata

SEQ ID NO: 3975417 - DNA, 22 bp, Homo sapiens
ccttacacgtacctctcatcag

SEQ ID NO: 3975418 - DNA, 18 bp, Homo sapiens
ccttaccaactttctgta

SEQ ID NO: 3975419 - DNA, 20 bp, Homo sapiens
ccttacctcctgcccaggag

SEQ ID NO: 3975420 - DNA, 14 bp, Homo sapiens
ccttacctttacat

SEQ ID NO: 3975421 - DNA, 15 bp, Homo sapiens
ccttactcacctctc

SEQ ID NO: 3975422 - DNA, 16 bp, Homo sapiens
ccttactcccaggcac

SEQ ID NO: 3975423 - DNA, 19 bp, Homo sapiens
ccttactcctgtgggagcc

SEQ ID NO: 3975424 - DNA, 20 bp, Homo sapiens
ccttactcctgtgggagcct

SEQ ID NO: 3975425 - DNA, 14 bp, Homo sapiens
ccttactctgagcc

SEQ ID NO: 3975426 - DNA, 15 bp, Homo sapiens
ccttactctgagccc

SEQ ID NO: 3975427 - DNA, 17 bp, Homo sapiens
ccttactctgagcccag

SEQ ID NO: 3975428 - DNA, 20 bp, Homo sapiens
ccttactctgagcccaggcc

SEQ ID NO: 3975429 - DNA, 21 bp, Homo sapiens
ccttactctgagcccaggccg

SEQ ID NO: 3975430 - DNA, 21 bp, Homo sapiens
ccttacttaagtcgggggtgg

SEQ ID NO: 3975431 - DNA, 14 bp, Homo sapiens
ccttagaacctttc

SEQ ID NO: 3975432 - DNA, 15 bp, Homo sapiens
ccttagaacctttct

SEQ ID NO: 3975433 - DNA, 18 bp, Homo sapiens
ccttagaacctttcttac

SEQ ID NO: 3975434 - DNA, 17 bp, Homo sapiens
ccttagagattgcccca

SEQ ID NO: 3975435 - DNA, 20 bp, Homo sapiens
ccttagagattgccccagag

SEQ ID NO: 3975436 - DNA, 23 bp, Homo sapiens
ccttagagattgccccagagccc

SEQ ID NO: 3975437 - DNA, 19 bp, Homo sapiens
ccttagctggcattacagc

SEQ ID NO: 3975438 - DNA, 22 bp, Homo sapiens
ccttagctggcattacagctgg

SEQ ID NO: 3975439 - DNA, 19 bp, Homo sapiens
ccttaggaaaatgcttctg

SEQ ID NO: 3975440 - DNA, 23 bp, Homo sapiens
ccttaggcattatttaatgtttg

SEQ ID NO: 3975441 - DNA, 20 bp, Homo sapiens
ccttagtggcttttttcctc

SEQ ID NO: 3975442 - DNA, 14 bp, Homo sapiens
ccttataagcccag

SEQ ID NO: 3975443 - DNA, 13 bp, Homo sapiens
ccttatccaggac

SEQ ID NO: 3975444 - DNA, 15 bp, Homo sapiens
ccttatccaggactc

SEQ ID NO: 3975445 - DNA, 12 bp, Homo sapiens
ccttatgtatta

SEQ ID NO: 3975446 - DNA, 14 bp, Homo sapiens
ccttatttatatat

SEQ ID NO: 3975447 - DNA, 14 bp, Homo sapiens
ccttattttcaaga

SEQ ID NO: 3975448 - DNA, 13 bp, Homo sapiens
ccttcaactgaaa

SEQ ID NO: 3975449 - DNA, 23 bp, Homo sapiens
ccttcaagccagcaacacagagc

SEQ ID NO: 3975450 - DNA, 17 bp, Homo sapiens
ccttcacctttggtgca

SEQ ID NO: 3975451 - DNA, 12 bp, Homo sapiens
ccttcagagctc

SEQ ID NO: 3975452 - DNA, 20 bp, Homo sapiens
ccttcagatcagccacacct

SEQ ID NO: 3975453 - DNA, 12 bp, Homo sapiens
ccttcagggcca

SEQ ID NO: 3975454 - DNA, 11 bp, Homo sapiens
ccttcagtgcc

SEQ ID NO: 3975455 - DNA, 13 bp, Homo sapiens
atcctatatagaa

SEQ ID NO: 3975456 - DNA, 15 bp, Homo sapiens
atcctatatagaatg

SEQ ID NO: 3975457 - DNA, 20 bp, Homo sapiens
atcctattaaaacacagctt

SEQ ID NO: 3975458 - DNA, 16 bp, Homo sapiens
atcctattgttgatgg

SEQ ID NO: 3975459 - DNA, 14 bp, Homo sapiens
atcctcatccctga

SEQ ID NO: 3975460 - DNA, 20 bp, Homo sapiens
atcctccagtaccttgcttc

SEQ ID NO: 3975461 - DNA, 13 bp, Homo sapiens
atcctcctccagg

SEQ ID NO: 3975462 - DNA, 15 bp, Homo sapiens
atcctcctccagggt

SEQ ID NO: 3975463 - DNA, 17 bp, Homo sapiens
atcctcctccttcctag

SEQ ID NO: 3975464 - DNA, 11 bp, Homo sapiens
atcctcctgcc

SEQ ID NO: 3975465 - DNA, 14 bp, Homo sapiens
atcctcctgcctca

SEQ ID NO: 3975466 - DNA, 19 bp, Homo sapiens
atcctcctgcctcagcctt

SEQ ID NO: 3975467 - DNA, 23 bp, Homo sapiens
atcctcctggaaccttgctgtcc

SEQ ID NO: 3975468 - DNA, 19 bp, Homo sapiens
atcctctattttgtgatga

SEQ ID NO: 3975469 - DNA, 18 bp, Homo sapiens
atcctctgagtgtgacca

SEQ ID NO: 3975470 - DNA, 12 bp, Homo sapiens
atcctgagccat

SEQ ID NO: 3975471 - DNA, 23 bp, Homo sapiens
atcctgccagccccacacagcta

SEQ ID NO: 3975472 - DNA, 14 bp, Homo sapiens
atcctgccatcctc

SEQ ID NO: 3975473 - DNA, 14 bp, Homo sapiens
atcctgcccagtgt

SEQ ID NO: 3975474 - DNA, 16 bp, Homo sapiens
atcctggagaagcctc

SEQ ID NO: 3975475 - DNA, 17 bp, Homo sapiens
atcctggaggcccagtt

SEQ ID NO: 3975476 - DNA, 16 bp, Homo sapiens
atcctgggcaatcaga

SEQ ID NO: 3975477 - DNA, 21 bp, Homo sapiens
atcctgggggacccaatgtag

SEQ ID NO: 3975478 - DNA, 17 bp, Homo sapiens
atcctgtaccaaatctg

SEQ ID NO: 3975479 - DNA, 18 bp, Homo sapiens
atcctgtaccaaatctga

SEQ ID NO: 3975480 - DNA, 21 bp, Homo sapiens
atcctgtaccaaatctgacat

SEQ ID NO: 3975481 - DNA, 14 bp, Homo sapiens
atcctgtataagca

SEQ ID NO: 3975482 - DNA, 16 bp, Homo sapiens
atcctgtataagcact

SEQ ID NO: 3975483 - DNA, 11 bp, Homo sapiens
atcctgtgact

SEQ ID NO: 3975484 - DNA, 15 bp, Homo sapiens
atccttatcagagct

SEQ ID NO: 3975485 - DNA, 18 bp, Homo sapiens
atccttccaaaaaattaa

SEQ ID NO: 3975486 - DNA, 14 bp, Homo sapiens
atccttccaaagaa

SEQ ID NO: 3975487 - DNA, 13 bp, Homo sapiens
atccttccatcca

SEQ ID NO: 3975488 - DNA, 22 bp, Homo sapiens
atccttccctcatgcccgccag

SEQ ID NO: 3975489 - DNA, 23 bp, Homo sapiens
atccttccgccaatctggccctt

SEQ ID NO: 3975490 - DNA, 15 bp, Homo sapiens
atccttcctaaaccc

SEQ ID NO: 3975491 - DNA, 21 bp, Homo sapiens
atccttcggggcgatgctccc

SEQ ID NO: 3975492 - DNA, 22 bp, Homo sapiens
atccttcggggcgatgctccct

SEQ ID NO: 3975493 - DNA, 23 bp, Homo sapiens
atccttcgtgaacatcccctccc

SEQ ID NO: 3975494 - DNA, 14 bp, Homo sapiens
atccttctggctgt

SEQ ID NO: 3975495 - DNA, 19 bp, Homo sapiens
atccttctggctgtagata

SEQ ID NO: 3975496 - DNA, 22 bp, Homo sapiens
atccttgggggctcccagggca

SEQ ID NO: 3975497 - DNA, 17 bp, Homo sapiens
atccttggtctttgtat

SEQ ID NO: 3975498 - DNA, 22 bp, Homo sapiens
atcctttcacttctttcccttc

SEQ ID NO: 3975499 - DNA, 15 bp, Homo sapiens
atcctttgcagggca

SEQ ID NO: 3975500 - DNA, 17 bp, Homo sapiens
atcctttgcagggcagc

SEQ ID NO: 3975501 - DNA, 17 bp, Homo sapiens
atcctttgttctgagca

SEQ ID NO: 3975502 - DNA, 19 bp, Homo sapiens
atcctttgttctgagcatt

SEQ ID NO: 3975503 - DNA, 23 bp, Homo sapiens
atcctttgttttctgactaatta

SEQ ID NO: 3975504 - DNA, 13 bp, Homo sapiens
atcctttttccat

SEQ ID NO: 3975505 - DNA, 15 bp, Homo sapiens
atcctttttccatca

SEQ ID NO: 3975506 - DNA, 16 bp, Homo sapiens
atcctttttccatcat

SEQ ID NO: 3975507 - DNA, 17 bp, Homo sapiens
atcctttttccatcatt

SEQ ID NO: 3975508 - DNA, 21 bp, Homo sapiens
atcctttttccatcattttac

SEQ ID NO: 3975509 - DNA, 18 bp, Homo sapiens
atcctttttctttataaa

SEQ ID NO: 3975510 - DNA, 14 bp, Homo sapiens
atcgatatgtatat

SEQ ID NO: 3975511 - DNA, 16 bp, Homo sapiens
atcgatgttttattat

SEQ ID NO: 3975512 - DNA, 22 bp, Homo sapiens
atcgcatcattgcactctagcc

SEQ ID NO: 3975513 - DNA, 21 bp, Homo sapiens
atcttgttttaagcaaatgca

SEQ ID NO: 3975514 - DNA, 20 bp, Homo sapiens
atctttaaaaagcagtcctc

SEQ ID NO: 3975515 - DNA, 14 bp, Homo sapiens
atctttcacttgaa

SEQ ID NO: 3975516 - DNA, 13 bp, Homo sapiens
atctttcctcaag

SEQ ID NO: 3975517 - DNA, 22 bp, Homo sapiens
atctttcctcaagtatcttcta

SEQ ID NO: 3975518 - DNA, 17 bp, Homo sapiens
atctttctttacctgag

SEQ ID NO: 3975519 - DNA, 21 bp, Homo sapiens
atctttctttacctgagacca

SEQ ID NO: 3975520 - DNA, 21 bp, Homo sapiens
atctttgtgacaggaaagccc

SEQ ID NO: 3975521 - DNA, 19 bp, Homo sapiens
atctttgttacttccttat

SEQ ID NO: 3975522 - DNA, 18 bp, Homo sapiens
atcttttaaagtgttact

SEQ ID NO: 3975523 - DNA, 20 bp, Homo sapiens
atcttttaaagtgttacttt

SEQ ID NO: 3975524 - DNA, 11 bp, Homo sapiens
atcttttacat

SEQ ID NO: 3975525 - DNA, 13 bp, Homo sapiens
atcttttcattct

SEQ ID NO: 3975526 - DNA, 21 bp, Homo sapiens
atctttttaacctctgttcag

SEQ ID NO: 3975527 - DNA, 19 bp, Homo sapiens
atctttttacctttcatac

SEQ ID NO: 3975528 - DNA, 19 bp, Homo sapiens
atcttttttagcataaaat

SEQ ID NO: 3975529 - DNA, 23 bp, Homo sapiens
atcttttttagcataaaattttc

SEQ ID NO: 3975530 - DNA, 18 bp, Homo sapiens
atgaaaaattggggagga

SEQ ID NO: 3975531 - DNA, 16 bp, Homo sapiens
atgaaaaatttaagca

SEQ ID NO: 3975532 - DNA, 20 bp, Homo sapiens
atgaaaaatttaagcattgt

SEQ ID NO: 3975533 - DNA, 13 bp, Homo sapiens
atgaaaacatgta

SEQ ID NO: 3975534 - DNA, 18 bp, Homo sapiens
atgaaaacgttttattgt

SEQ ID NO: 3975535 - DNA, 18 bp, Homo sapiens
atgaaaatattttttaca

SEQ ID NO: 3975536 - DNA, 11 bp, Homo sapiens
atgaaaattgt

SEQ ID NO: 3975537 - DNA, 16 bp, Homo sapiens
atgaaagactgtacaa

SEQ ID NO: 3975538 - DNA, 17 bp, Homo sapiens
atgaaagactgtacaaa

SEQ ID NO: 3975539 - DNA, 18 bp, Homo sapiens
atgaaagattaaacagat

SEQ ID NO: 3975540 - DNA, 18 bp, Homo sapiens
atgaaagcatgtggcatg

SEQ ID NO: 3975541 - DNA, 21 bp, Homo sapiens
atgaaagctgattactgtcaa

SEQ ID NO: 3975542 - DNA, 22 bp, Homo sapiens
atgaaagctgattactgtcaat

SEQ ID NO: 3975543 - DNA, 20 bp, Homo sapiens
atgaaaggtactatatttgc

SEQ ID NO: 3975544 - DNA, 22 bp, Homo sapiens
atgaaataaagacccaggggga

SEQ ID NO: 3975545 - DNA, 19 bp, Homo sapiens
atgaaatctgctagaaagt

SEQ ID NO: 3975546 - DNA, 13 bp, Homo sapiens
atgaaatgtatgt

SEQ ID NO: 3975547 - DNA, 15 bp, Homo sapiens
atgaaattcttccta

SEQ ID NO: 3975548 - DNA, 14 bp, Homo sapiens
atgaacactcccca

SEQ ID NO: 3975549 - DNA, 13 bp, Homo sapiens
atgaacacttata

SEQ ID NO: 3975550 - DNA, 13 bp, Homo sapiens
atgaacagtgcac

SEQ ID NO: 3975551 - DNA, 20 bp, Homo sapiens
atgaaccagccggggcctta

SEQ ID NO: 3975552 - DNA, 21 bp, Homo sapiens
atgaacccaggacgcttctga

SEQ ID NO: 3975553 - DNA, 14 bp, Homo sapiens
atgaactcaacttt

SEQ ID NO: 3975554 - DNA, 20 bp, Homo sapiens
atgaactgaagtttcacatg

SEQ ID NO: 3975555 - DNA, 17 bp, Homo sapiens
atgaagaatagaaacaa

SEQ ID NO: 3975556 - DNA, 19 bp, Homo sapiens
atgaagaattgccaatctt

SEQ ID NO: 3975557 - DNA, 13 bp, Homo sapiens
atgaagacaatga

SEQ ID NO: 3975558 - DNA, 18 bp, Homo sapiens
atgaagagcttgctttga

SEQ ID NO: 3975559 - DNA, 14 bp, Homo sapiens
atgaagagtattaa

SEQ ID NO: 3975560 - DNA, 22 bp, Homo sapiens
ctaaggccgtgtctctgaggac

SEQ ID NO: 3975561 - DNA, 17 bp, Homo sapiens
ctaagggaagacatttc

SEQ ID NO: 3975562 - DNA, 23 bp, Homo sapiens
ctaaggggcttgtgttctgctcc

SEQ ID NO: 3975563 - DNA, 19 bp, Homo sapiens
ctaagggtgggtgctcaga

SEQ ID NO: 3975564 - DNA, 18 bp, Homo sapiens
ctaagtaaatctcttctg

SEQ ID NO: 3975565 - DNA, 20 bp, Homo sapiens
ctaagtaggggcagtgatgg

SEQ ID NO: 3975566 - DNA, 19 bp, Homo sapiens
ctaagtccagtgtttcttt

SEQ ID NO: 3975567 - DNA, 14 bp, Homo sapiens
ctaagtgaaaaggt

SEQ ID NO: 3975568 - DNA, 15 bp, Homo sapiens
ctaagtggctgcctt

SEQ ID NO: 3975569 - DNA, 12 bp, Homo sapiens
ctaagtgggaga

SEQ ID NO: 3975570 - DNA, 22 bp, Homo sapiens
ctaagtgtttactatgtgccag

SEQ ID NO: 3975571 - DNA, 18 bp, Homo sapiens
ctaagttcacattagaat

SEQ ID NO: 3975572 - DNA, 10 bp, Homo sapiens
ctaataaaac

SEQ ID NO: 3975573 - DNA, 17 bp, Homo sapiens
ctaatatatatgaataa

SEQ ID NO: 3975574 - DNA, 14 bp, Homo sapiens
ctaatattttatgt

SEQ ID NO: 3975575 - DNA, 17 bp, Homo sapiens
ctaatcagaaattttta

SEQ ID NO: 3975576 - DNA, 17 bp, Homo sapiens
ctaatcagcattctcac

SEQ ID NO: 3975577 - DNA, 21 bp, Homo sapiens
ctaatcagcattctcactcct

SEQ ID NO: 3975578 - DNA, 19 bp, Homo sapiens
ctaatcagggaggtcattt

SEQ ID NO: 3975579 - DNA, 23 bp, Homo sapiens
ctaatccaggcagatccaggact

SEQ ID NO: 3975580 - DNA, 19 bp, Homo sapiens
ctaatccctgggcattgct

SEQ ID NO: 3975581 - DNA, 22 bp, Homo sapiens
ctaatccctgggcattgctttc

SEQ ID NO: 3975582 - DNA, 22 bp, Homo sapiens
ctaatccttctcattacccacc

SEQ ID NO: 3975583 - DNA, 12 bp, Homo sapiens
ctaatccttttc

SEQ ID NO: 3975584 - DNA, 14 bp, Homo sapiens
ctaatccttttcct

SEQ ID NO: 3975585 - DNA, 15 bp, Homo sapiens
ctaatcgaactatga

SEQ ID NO: 3975586 - DNA, 14 bp, Homo sapiens
ctaatctattgggt

SEQ ID NO: 3975587 - DNA, 21 bp, Homo sapiens
ctaatctattgggttcattat

SEQ ID NO: 3975588 - DNA, 22 bp, Homo sapiens
ctaatctgagctgcagcctggc

SEQ ID NO: 3975589 - DNA, 14 bp, Homo sapiens
ctaatctgtagggc

SEQ ID NO: 3975590 - DNA, 20 bp, Homo sapiens
ctaatcttaaatcagaataa

SEQ ID NO: 3975591 - DNA, 18 bp, Homo sapiens
ctaatgaagggaaaggat

SEQ ID NO: 3975592 - DNA, 14 bp, Homo sapiens
ctaatgtactgcat

SEQ ID NO: 3975593 - DNA, 23 bp, Homo sapiens
ctaatgtggaccttagaatacag

SEQ ID NO: 3975594 - DNA, 19 bp, Homo sapiens
ctaatgtggttatttctct

SEQ ID NO: 3975595 - DNA, 22 bp, Homo sapiens
ctaatgttggcagatgcagctc

SEQ ID NO: 3975596 - DNA, 17 bp, Homo sapiens
ctaattaactgaaacat

SEQ ID NO: 3975597 - DNA, 12 bp, Homo sapiens
ctaattatttaa

SEQ ID NO: 3975598 - DNA, 15 bp, Homo sapiens
ctaattccacacctt

SEQ ID NO: 3975599 - DNA, 14 bp, Homo sapiens
ctaattcccagagt

SEQ ID NO: 3975600 - DNA, 19 bp, Homo sapiens
ctaattcccattttgcaaa

SEQ ID NO: 3975601 - DNA, 16 bp, Homo sapiens
ctaattcgatgaaggc

SEQ ID NO: 3975602 - DNA, 20 bp, Homo sapiens
ctaattctcacatccctcta

SEQ ID NO: 3975603 - DNA, 13 bp, Homo sapiens
ctaatttaacacc

SEQ ID NO: 3975604 - DNA, 21 bp, Homo sapiens
ctaatttcaaaaatataactt

SEQ ID NO: 3975605 - DNA, 17 bp, Homo sapiens
ctaatttcaaaatgctt

SEQ ID NO: 3975606 - DNA, 18 bp, Homo sapiens
ctaatttctcctcccttc

SEQ ID NO: 3975607 - DNA, 16 bp, Homo sapiens
ctaatttgatgtttac

SEQ ID NO: 3975608 - DNA, 19 bp, Homo sapiens
ctaatttgcattaaattca

SEQ ID NO: 3975609 - DNA, 22 bp, Homo sapiens
ctaatttgtaggaaaaagcaag

SEQ ID NO: 3975610 - DNA, 20 bp, Homo sapiens
ctaattttctcaaaagcatt

SEQ ID NO: 3975611 - DNA, 22 bp, Homo sapiens
ctaattttctcaaaagcattta

SEQ ID NO: 3975612 - DNA, 20 bp, Homo sapiens
ctaatttttgtaattttagt

SEQ ID NO: 3975613 - DNA, 13 bp, Homo sapiens
ctaatttttttgt

SEQ ID NO: 3975614 - DNA, 18 bp, Homo sapiens
ctacaaaatttgaaattt

SEQ ID NO: 3975615 - DNA, 13 bp, Homo sapiens
ctacaaccagagc

SEQ ID NO: 3975616 - DNA, 15 bp, Homo sapiens
ctacaaccagagccc

SEQ ID NO: 3975617 - DNA, 16 bp, Homo sapiens
ctacaaccagagcccc

SEQ ID NO: 3975618 - DNA, 22 bp, Homo sapiens
ctacaaccagagccccccacaa

SEQ ID NO: 3975619 - DNA, 14 bp, Homo sapiens
ctacaacttcagca

SEQ ID NO: 3975620 - DNA, 16 bp, Homo sapiens
ctacaacttcagcagt

SEQ ID NO: 3975621 - DNA, 17 bp, Homo sapiens
ctacaagagcagcctgt

SEQ ID NO: 3975622 - DNA, 22 bp, Homo sapiens
ctacaagccaaaagtccctccc

SEQ ID NO: 3975623 - DNA, 18 bp, Homo sapiens
ctacaatgtgaactttat

SEQ ID NO: 3975624 - DNA, 10 bp, Homo sapiens
ctacacacac

SEQ ID NO: 3975625 - DNA, 11 bp, Homo sapiens
ctacacacaca

SEQ ID NO: 3975626 - DNA, 13 bp, Homo sapiens
ctacacacacact

SEQ ID NO: 3975627 - DNA, 19 bp, Homo sapiens
ctacacacacactccctgc

SEQ ID NO: 3975628 - DNA, 13 bp, Homo sapiens
ctacacctggctg

SEQ ID NO: 3975629 - DNA, 15 bp, Homo sapiens
ctacacctggctgag

SEQ ID NO: 3975630 - DNA, 18 bp, Homo sapiens
ctacagactccatctctt

SEQ ID NO: 3975631 - DNA, 20 bp, Homo sapiens
ctacagactccatctcttct

SEQ ID NO: 3975632 - DNA, 15 bp, Homo sapiens
ctacagagcagctcc

SEQ ID NO: 3975633 - DNA, 16 bp, Homo sapiens
ctacagagcagctccc

SEQ ID NO: 3975634 - DNA, 12 bp, Homo sapiens
ctacagagctgt

SEQ ID NO: 3975635 - DNA, 22 bp, Homo sapiens
ctacagcactactgggtgtcat

SEQ ID NO: 3975636 - DNA, 19 bp, Homo sapiens
ctacagctaatcagcattc

SEQ ID NO: 3975637 - DNA, 22 bp, Homo sapiens
ctacagctaatcagcattctca

SEQ ID NO: 3975638 - DNA, 14 bp, Homo sapiens
ctacagctccccca

SEQ ID NO: 3975639 - DNA, 19 bp, Homo sapiens
ctacagctcttaaatgtag

SEQ ID NO: 3975640 - DNA, 11 bp, Homo sapiens
ctacagctttc

SEQ ID NO: 3975641 - DNA, 19 bp, Homo sapiens
ctacagctttcttgctccc

SEQ ID NO: 3975642 - DNA, 11 bp, Homo sapiens
ctacagtgcca

SEQ ID NO: 3975643 - DNA, 12 bp, Homo sapiens
ctacagtgccaa

SEQ ID NO: 3975644 - DNA, 18 bp, Homo sapiens
ctacagtgccaactcctc

SEQ ID NO: 3975645 - DNA, 19 bp, Homo sapiens
ctacagtgccaactcctca

SEQ ID NO: 3975646 - DNA, 16 bp, Homo sapiens
ctacagtggttttata

SEQ ID NO: 3975647 - DNA, 21 bp, Homo sapiens
ctacagttgtgttagcctctt

SEQ ID NO: 3975648 - DNA, 22 bp, Homo sapiens
ctacataagtaattcaagaaaa

SEQ ID NO: 3975649 - DNA, 18 bp, Homo sapiens
ctacatacaattccaaac

SEQ ID NO: 3975650 - DNA, 12 bp, Homo sapiens
ctacatgactgg

SEQ ID NO: 3975651 - DNA, 14 bp, Homo sapiens
ctacatgactgggc

SEQ ID NO: 3975652 - DNA, 16 bp, Homo sapiens
ctacatgactgggcct

SEQ ID NO: 3975653 - DNA, 17 bp, Homo sapiens
ctacatgcagcccatgc

SEQ ID NO: 3975654 - DNA, 14 bp, Homo sapiens
ctacatgctggggt

SEQ ID NO: 3975655 - DNA, 21 bp, Homo sapiens
ctacatgtattgcacattgta

SEQ ID NO: 3975656 - DNA, 12 bp, Homo sapiens
ctacattcattt

SEQ ID NO: 3975657 - DNA, 20 bp, Homo sapiens
ctacattccctctcctgccc

SEQ ID NO: 3975658 - DNA, 21 bp, Homo sapiens
ctacattccctctcctgccca

SEQ ID NO: 3975659 - DNA, 23 bp, Homo sapiens
ctacattccctctcctgcccaga

SEQ ID NO: 3975660 - DNA, 15 bp, Homo sapiens
ctaccaaaggacact

SEQ ID NO: 3975661 - DNA, 15 bp, Homo sapiens
ctaccacaaggaaaa

SEQ ID NO: 3975662 - DNA, 16 bp, Homo sapiens
ctaccacaaggaaaat

SEQ ID NO: 3975663 - DNA, 17 bp, Homo sapiens
cttatttaaaattccat

SEQ ID NO: 3975664 - DNA, 15 bp, Homo sapiens
cttatttaatgaaag

SEQ ID NO: 3975665 - DNA, 15 bp, Homo sapiens
cttatttaccctttt

SEQ ID NO: 3975666 - DNA, 19 bp, Homo sapiens
cttatttatgttaaaagat

SEQ ID NO: 3975667 - DNA, 22 bp, Homo sapiens
cttatttcactatcttcttcaa

SEQ ID NO: 3975668 - DNA, 19 bp, Homo sapiens
cttatttctagaagcacat

SEQ ID NO: 3975669 - DNA, 11 bp, Homo sapiens
cttatttctgc

SEQ ID NO: 3975670 - DNA, 19 bp, Homo sapiens
cttatttctgctctggaat

SEQ ID NO: 3975671 - DNA, 21 bp, Homo sapiens
cttatttgccttctactcccc

SEQ ID NO: 3975672 - DNA, 22 bp, Homo sapiens
cttatttgccttctactcccct

SEQ ID NO: 3975673 - DNA, 23 bp, Homo sapiens
cttatttgccttctactcccctt

SEQ ID NO: 3975674 - DNA, 16 bp, Homo sapiens
cttattttcatgtata

SEQ ID NO: 3975675 - DNA, 23 bp, Homo sapiens
cttattttgcattccagaatctt

SEQ ID NO: 3975676 - DNA, 13 bp, Homo sapiens
cttatttttccta

SEQ ID NO: 3975677 - DNA, 14 bp, Homo sapiens
cttatttttctgag

SEQ ID NO: 3975678 - DNA, 15 bp, Homo sapiens
cttatttttctgtga

SEQ ID NO: 3975679 - DNA, 14 bp, Homo sapiens
cttcaaactttcac

SEQ ID NO: 3975680 - DNA, 18 bp, Homo sapiens
cttcaaactttcactttg

SEQ ID NO: 3975681 - DNA, 15 bp, Homo sapiens
cttcaaatacaaagt

SEQ ID NO: 3975682 - DNA, 17 bp, Homo sapiens
cttcaaattgtcttttg

SEQ ID NO: 3975683 - DNA, 12 bp, Homo sapiens
cttcaacaaggc

SEQ ID NO: 3975684 - DNA, 23 bp, Homo sapiens
cttcaacagaccccctctagaaa

SEQ ID NO: 3975685 - DNA, 16 bp, Homo sapiens
cttcaacatcaatgtt

SEQ ID NO: 3975686 - DNA, 18 bp, Homo sapiens
cttcaacatcaatgttca

SEQ ID NO: 3975687 - DNA, 19 bp, Homo sapiens
cttcaacatcaatgttcat

SEQ ID NO: 3975688 - DNA, 22 bp, Homo sapiens
cttcaacatcaatgttcattgt

SEQ ID NO: 3975689 - DNA, 13 bp, Homo sapiens
cttcaacatcctg

SEQ ID NO: 3975690 - DNA, 20 bp, Homo sapiens
cttcaacatcctgccagccc

SEQ ID NO: 3975691 - DNA, 16 bp, Homo sapiens
cttcaaccattcccca

SEQ ID NO: 3975692 - DNA, 15 bp, Homo sapiens
cttcaacccagtggg

SEQ ID NO: 3975693 - DNA, 18 bp, Homo sapiens
cttcaagaactctgggct

SEQ ID NO: 3975694 - DNA, 13 bp, Homo sapiens
cttcaagttgtaa

SEQ ID NO: 3975695 - DNA, 22 bp, Homo sapiens
cttcaagttgtaaaaatgaaag

SEQ ID NO: 3975696 - DNA, 17 bp, Homo sapiens
cttcaatacttaaaaat

SEQ ID NO: 3975697 - DNA, 16 bp, Homo sapiens
cttcaatgctagaaaa

SEQ ID NO: 3975698 - DNA, 18 bp, Homo sapiens
cttcaatgctagaaaatc

SEQ ID NO: 3975699 - DNA, 15 bp, Homo sapiens
cttcaattaataaaa

SEQ ID NO: 3975700 - DNA, 14 bp, Homo sapiens
cttcacaccattca

SEQ ID NO: 3975701 - DNA, 14 bp, Homo sapiens
cttcacagtctggt

SEQ ID NO: 3975702 - DNA, 15 bp, Homo sapiens
cttcacagtctggtg

SEQ ID NO: 3975703 - DNA, 21 bp, Homo sapiens
cttcacagtctggtgcttggg

SEQ ID NO: 3975704 - DNA, 12 bp, Homo sapiens
cttcacagtgtt

SEQ ID NO: 3975705 - DNA, 13 bp, Homo sapiens
cttcacagtgttt

SEQ ID NO: 3975706 - DNA, 15 bp, Homo sapiens
cttcacattaaaaaa

SEQ ID NO: 3975707 - DNA, 14 bp, Homo sapiens
cttcaccagagccc

SEQ ID NO: 3975708 - DNA, 14 bp, Homo sapiens
cttcaccaggtgca

SEQ ID NO: 3975709 - DNA, 15 bp, Homo sapiens
cttcaccaggtgcat

SEQ ID NO: 3975710 - DNA, 22 bp, Homo sapiens
cttcacccagctaatctgtagg

SEQ ID NO: 3975711 - DNA, 13 bp, Homo sapiens
tcaggtgctgtcc

SEQ ID NO: 3975712 - DNA, 16 bp, Homo sapiens
tcaggtgctgtccatg

SEQ ID NO: 3975713 - DNA, 22 bp, Homo sapiens
tcaggtggggagtccagggctc

SEQ ID NO: 3975714 - DNA, 22 bp, Homo sapiens
tcaggtgtcatggactgttgcc

SEQ ID NO: 3975715 - DNA, 22 bp, Homo sapiens
tcaggtgttttttatgaagtgc

SEQ ID NO: 3975716 - DNA, 18 bp, Homo sapiens
tcaggttatcgaaataac

SEQ ID NO: 3975717 - DNA, 23 bp, Homo sapiens
tcaggttatcgaaataacaatgt

SEQ ID NO: 3975718 - DNA, 16 bp, Homo sapiens
tcagtaaacctgtctg

SEQ ID NO: 3975719 - DNA, 12 bp, Homo sapiens
tcagtaagaggt

SEQ ID NO: 3975720 - DNA, 19 bp, Homo sapiens
tcagtaataaactgtgttt

SEQ ID NO: 3975721 - DNA, 19 bp, Homo sapiens
tcagtaccctctcagctcc

SEQ ID NO: 3975722 - DNA, 20 bp, Homo sapiens
tcagtacttgtgaaacacag

SEQ ID NO: 3975723 - DNA, 16 bp, Homo sapiens
tcagtataatttttta

SEQ ID NO: 3975724 - DNA, 17 bp, Homo sapiens
tcagtatccaggctttg

SEQ ID NO: 3975725 - DNA, 23 bp, Homo sapiens
tcagtatgctgcccctgtcttgc

SEQ ID NO: 3975726 - DNA, 16 bp, Homo sapiens
tcagtcacacacacat

SEQ ID NO: 3975727 - DNA, 15 bp, Homo sapiens
tcagtcacagccacc

SEQ ID NO: 3975728 - DNA, 14 bp, Homo sapiens
tcagtcatgtgtaa

SEQ ID NO: 3975729 - DNA, 21 bp, Homo sapiens
tcagtcattagactcctcctc

SEQ ID NO: 3975730 - DNA, 23 bp, Homo sapiens
tcagtccaaggggtcccctccag

SEQ ID NO: 3975731 - DNA, 12 bp, Homo sapiens
tcagtccaggat

SEQ ID NO: 3975732 - DNA, 14 bp, Homo sapiens
tcagtccatttata

SEQ ID NO: 3975733 - DNA, 23 bp, Homo sapiens
tcagtccatttatatatgaaaac

SEQ ID NO: 3975734 - DNA, 17 bp, Homo sapiens
tcagtccccctgtgcat

SEQ ID NO: 3975735 - DNA, 13 bp, Homo sapiens
tcagtctggtggg

SEQ ID NO: 3975736 - DNA, 16 bp, Homo sapiens
tcagtctggtgggagg

SEQ ID NO: 3975737 - DNA, 15 bp, Homo sapiens
tcagtgacagagttc

SEQ ID NO: 3975738 - DNA, 17 bp, Homo sapiens
tcagtgactgaaaccat

SEQ ID NO: 3975739 - DNA, 19 bp, Homo sapiens
tcagtgactgaaaccattt

SEQ ID NO: 3975740 - DNA, 21 bp, Homo sapiens
tcagtgagcctcctgtgcctg

SEQ ID NO: 3975741 - DNA, 22 bp, Homo sapiens
tcagtgagcctcctgtgcctgg

SEQ ID NO: 3975742 - DNA, 19 bp, Homo sapiens
tcagtgatgtaccatgaaa

SEQ ID NO: 3975743 - DNA, 17 bp, Homo sapiens
tcagtggcgagaaataa

SEQ ID NO: 3975744 - DNA, 17 bp, Homo sapiens
tcagtggcttcatctgt

SEQ ID NO: 3975745 - DNA, 11 bp, Homo sapiens
tcagtgtacat

SEQ ID NO: 3975746 - DNA, 16 bp, Homo sapiens
tcagtgtcccaggcag

SEQ ID NO: 3975747 - DNA, 21 bp, Homo sapiens
tcagtgtcccaggcagcacag

SEQ ID NO: 3975748 - DNA, 19 bp, Homo sapiens
tcagtgtgtctaaatttga

SEQ ID NO: 3975749 - DNA, 13 bp, Homo sapiens
tcagtgtgtgtgt

SEQ ID NO: 3975750 - DNA, 15 bp, Homo sapiens
tcagtgttacctgtg

SEQ ID NO: 3975751 - DNA, 18 bp, Homo sapiens
tcagtgttgttgctctag

SEQ ID NO: 3975752 - DNA, 17 bp, Homo sapiens
tcagtgttttaaattct

SEQ ID NO: 3975753 - DNA, 20 bp, Homo sapiens
tcagtgttttggactccatc

SEQ ID NO: 3975754 - DNA, 20 bp, Homo sapiens
tcagttaactattgcattta

SEQ ID NO: 3975755 - DNA, 16 bp, Homo sapiens
tcagttacccactcgg

SEQ ID NO: 3975756 - DNA, 19 bp, Homo sapiens
tcagttcattgtggtcctt

SEQ ID NO: 3975757 - DNA, 17 bp, Homo sapiens
tcagttcccaccatctg

SEQ ID NO: 3975758 - DNA, 16 bp, Homo sapiens
tcagttcccttggcct

SEQ ID NO: 3975759 - DNA, 17 bp, Homo sapiens
tcagttcccttggcctc

SEQ ID NO: 3975760 - DNA, 19 bp, Homo sapiens
tcagttcccttggcctcag

SEQ ID NO: 3975761 - DNA, 20 bp, Homo sapiens
tcagttcccttggcctcaga

SEQ ID NO: 3975762 - DNA, 12 bp, Homo sapiens
tcagttccttca

SEQ ID NO: 3975763 - DNA, 20 bp, Homo sapiens
tcagttcctttgtgtgtact

SEQ ID NO: 3975764 - DNA, 22 bp, Homo sapiens
tcagttcctttgtgtgtactca

SEQ ID NO: 3975765 - DNA, 18 bp, Homo sapiens
tcagttctctcccttcct

SEQ ID NO: 3975766 - DNA, 14 bp, Homo sapiens
tcagtttcataaaa

SEQ ID NO: 3975767 - DNA, 14 bp, Homo sapiens
tcagtttcatgaaa

SEQ ID NO: 3975768 - DNA, 17 bp, Homo sapiens
tcagtttcatgaaatga

SEQ ID NO: 3975769 - DNA, 16 bp, Homo sapiens
tcagtttgtgtgtctt

SEQ ID NO: 3975770 - DNA, 13 bp, Homo sapiens
tcagttttaacta

SEQ ID NO: 3975771 - DNA, 17 bp, Homo sapiens
tcagttttatcattttc

SEQ ID NO: 3975772 - DNA, 17 bp, Homo sapiens
tcagttttcagctatac

SEQ ID NO: 3975773 - DNA, 17 bp, Homo sapiens
tcagtttttgtatcttg

SEQ ID NO: 3975774 - DNA, 18 bp, Homo sapiens
tcagttttttgttttaca

SEQ ID NO: 3975775 - DNA, 13 bp, Homo sapiens
tcatgctgcccct

SEQ ID NO: 3975776 - DNA, 17 bp, Homo sapiens
tcatgctgcccctgcct

SEQ ID NO: 3975777 - DNA, 18 bp, Homo sapiens
tcatgctgggatttccaa

SEQ ID NO: 3975778 - DNA, 23 bp, Homo sapiens
tcatggaatatttataggccagg

SEQ ID NO: 3975779 - DNA, 20 bp, Homo sapiens
tcatggaatggacatcctgt

SEQ ID NO: 3975780 - DNA, 23 bp, Homo sapiens
tcatggagtgacggtcccacact

SEQ ID NO: 3975781 - DNA, 11 bp, Homo sapiens
tcatggcagct

SEQ ID NO: 3975782 - DNA, 17 bp, Homo sapiens
tcatggcagctgtttct

SEQ ID NO: 3975783 - DNA, 18 bp, Homo sapiens
tcatggcccccaggggca

SEQ ID NO: 3975784 - DNA, 17 bp, Homo sapiens
tcatgggaagcatgtgg

SEQ ID NO: 3975785 - DNA, 23 bp, Homo sapiens
tcatgggagggggcttgaagcca

SEQ ID NO: 3975786 - DNA, 22 bp, Homo sapiens
tcatggtggatatggtgcagag

SEQ ID NO: 3975787 - DNA, 15 bp, Homo sapiens
tcatggtgtaataag

SEQ ID NO: 3975788 - DNA, 21 bp, Homo sapiens
tcatggtgtaataagacataa

SEQ ID NO: 3975789 - DNA, 16 bp, Homo sapiens
tcatgtaaagaaatgt

SEQ ID NO: 3975790 - DNA, 16 bp, Homo sapiens
tcatgtacaagatgaa

SEQ ID NO: 3975791 - DNA, 17 bp, Homo sapiens
tcatgtacaagatgaag

SEQ ID NO: 3975792 - DNA, 18 bp, Homo sapiens
tcatgtacaagatgaagg

SEQ ID NO: 3975793 - DNA, 16 bp, Homo sapiens
tcatgtagagaaaagc

SEQ ID NO: 3975794 - DNA, 17 bp, Homo sapiens
tcatgtagagaaaagca

SEQ ID NO: 3975795 - DNA, 19 bp, Homo sapiens
tcatgtagagaaaagcaca

SEQ ID NO: 3975796 - DNA, 18 bp, Homo sapiens
tcatgtatcatctggata

SEQ ID NO: 3975797 - DNA, 17 bp, Homo sapiens
tcatgtcaggcctgtgt

SEQ ID NO: 3975798 - DNA, 19 bp, Homo sapiens
tcatgtcaggcctgtgtgt

SEQ ID NO: 3975799 - DNA, 13 bp, Homo sapiens
tcatgtcctgctg

SEQ ID NO: 3975800 - DNA, 16 bp, Homo sapiens
tcatgttactcagtgt

SEQ ID NO: 3975801 - DNA, 13 bp, Homo sapiens
tcatgttcctcaa

SEQ ID NO: 3975802 - DNA, 12 bp, Homo sapiens
tcatgtttttga

SEQ ID NO: 3975803 - DNA, 16 bp, Homo sapiens
tcattaaactttttta

SEQ ID NO: 3975804 - DNA, 14 bp, Homo sapiens
tcattaatgtaata

SEQ ID NO: 3975805 - DNA, 13 bp, Homo sapiens
tcattaattctat

SEQ ID NO: 3975806 - DNA, 14 bp, Homo sapiens
tcattaattctata

SEQ ID NO: 3975807 - DNA, 23 bp, Homo sapiens
tcattacccacccgacctggctg

SEQ ID NO: 3975808 - DNA, 15 bp, Homo sapiens
tcattacttgattaa

SEQ ID NO: 3975809 - DNA, 18 bp, Homo sapiens
tcattagactcctcctcc

SEQ ID NO: 3975810 - DNA, 17 bp, Homo sapiens
tcattagctgtgatttt

SEQ ID NO: 3975811 - DNA, 15 bp, Homo sapiens
tcattataaacgtga

SEQ ID NO: 3975812 - DNA, 14 bp, Homo sapiens
tcattattctctgc

SEQ ID NO: 3975813 - DNA, 17 bp, Homo sapiens
tcattattctctgctat

SEQ ID NO: 3975814 - DNA, 18 bp, Homo sapiens
tcattattggaattaacc

SEQ ID NO: 3975815 - DNA, 23 bp, Homo sapiens
tcattattttgtggttctatttt

SEQ ID NO: 3975816 - DNA, 16 bp, Homo sapiens
ctttgttgcccaggct

SEQ ID NO: 3975817 - DNA, 20 bp, Homo sapiens
ctttgtttggatgtaattta

SEQ ID NO: 3975818 - DNA, 16 bp, Homo sapiens
ctttgttttaataaac

SEQ ID NO: 3975819 - DNA, 16 bp, Homo sapiens
ctttgttttcttagtt

SEQ ID NO: 3975820 - DNA, 18 bp, Homo sapiens
ctttgttttttgttggag

SEQ ID NO: 3975821 - DNA, 23 bp, Homo sapiens
cttttaaaggggcagaaaaactc

SEQ ID NO: 3975822 - DNA, 17 bp, Homo sapiens
cttttaaagtgttactt

SEQ ID NO: 3975823 - DNA, 20 bp, Homo sapiens
cttttaaagtgttacttttt

SEQ ID NO: 3975824 - DNA, 16 bp, Homo sapiens
cttttaaagtgtttca

SEQ ID NO: 3975825 - DNA, 19 bp, Homo sapiens
cttttaaagtgtttcagct

SEQ ID NO: 3975826 - DNA, 22 bp, Homo sapiens
cttttaaatggcagtatttcat

SEQ ID NO: 3975827 - DNA, 15 bp, Homo sapiens
cttttaatgcttcat

SEQ ID NO: 3975828 - DNA, 20 bp, Homo sapiens
cttttaattaaataaaagct

SEQ ID NO: 3975829 - DNA, 12 bp, Homo sapiens
cttttaattcat

SEQ ID NO: 3975830 - DNA, 13 bp, Homo sapiens
cttttaattcatt

SEQ ID NO: 3975831 - DNA, 16 bp, Homo sapiens
cttttaattctcattt

SEQ ID NO: 3975832 - DNA, 22 bp, Homo sapiens
cttttaccgttggggcccttaa

SEQ ID NO: 3975833 - DNA, 23 bp, Homo sapiens
cttttacttgaaaagaaagtgtt

SEQ ID NO: 3975834 - DNA, 21 bp, Homo sapiens
cttttataataaaaggaaaag

SEQ ID NO: 3975835 - DNA, 17 bp, Homo sapiens
cttttatactctttctg

SEQ ID NO: 3975836 - DNA, 19 bp, Homo sapiens
cttttatactctttctgta

SEQ ID NO: 3975837 - DNA, 19 bp, Homo sapiens
cttttataggtgagaaaaa

SEQ ID NO: 3975838 - DNA, 20 bp, Homo sapiens
cttttataggtgagaaaaaa

SEQ ID NO: 3975839 - DNA, 17 bp, Homo sapiens
cttttatatttgtatcg

SEQ ID NO: 3975840 - DNA, 18 bp, Homo sapiens
cttttatgatgtatattt

SEQ ID NO: 3975841 - DNA, 15 bp, Homo sapiens
cttttatgtttgaat

SEQ ID NO: 3975842 - DNA, 18 bp, Homo sapiens
cttttatgtttgaatatg

SEQ ID NO: 3975843 - DNA, 17 bp, Homo sapiens
cttttattgacacagaa

SEQ ID NO: 3975844 - DNA, 12 bp, Homo sapiens
cttttattttga

SEQ ID NO: 3975845 - DNA, 14 bp, Homo sapiens
cttttattttgaaa

SEQ ID NO: 3975846 - DNA, 23 bp, Homo sapiens
cttttattttttcttttgtaatt

SEQ ID NO: 3975847 - DNA, 21 bp, Homo sapiens
cttttcacatccatttcccct

SEQ ID NO: 3975848 - DNA, 12 bp, Homo sapiens
cttttcactgct

SEQ ID NO: 3975849 - DNA, 17 bp, Homo sapiens
cttttcactgctggctg

SEQ ID NO: 3975850 - DNA, 18 bp, Homo sapiens
cttttcactgctggctgc

SEQ ID NO: 3975851 - DNA, 20 bp, Homo sapiens
cttttcagaagcaagccaga

SEQ ID NO: 3975852 - DNA, 15 bp, Homo sapiens
cttttcagctgagcc

SEQ ID NO: 3975853 - DNA, 18 bp, Homo sapiens
cttttcagctgagccctg

SEQ ID NO: 3975854 - DNA, 22 bp, Homo sapiens
cttttcagctgagccctgggga

SEQ ID NO: 3975855 - DNA, 23 bp, Homo sapiens
cttttcataaagggttgaaaatg

SEQ ID NO: 3975856 - DNA, 14 bp, Homo sapiens
cttttcccctgtta

SEQ ID NO: 3975857 - DNA, 15 bp, Homo sapiens
cttttcccctgttaa

SEQ ID NO: 3975858 - DNA, 18 bp, Homo sapiens
cttttcccctttcctgtc

SEQ ID NO: 3975859 - DNA, 22 bp, Homo sapiens
cttttccctctttggctcccct

SEQ ID NO: 3975860 - DNA, 13 bp, Homo sapiens
cttttccctgctt

SEQ ID NO: 3975861 - DNA, 15 bp, Homo sapiens
cttttccctgcttcc

SEQ ID NO: 3975862 - DNA, 18 bp, Homo sapiens
cttttccctgcttccagg

SEQ ID NO: 3975863 - DNA, 18 bp, Homo sapiens
cttttccgttctgttctg

SEQ ID NO: 3975864 - DNA, 12 bp, Homo sapiens
cttttcctatcc

SEQ ID NO: 3975865 - DNA, 15 bp, Homo sapiens
cttttcctcccttgg

SEQ ID NO: 3975866 - DNA, 17 bp, Homo sapiens
cttttcctcgcttcttt

SEQ ID NO: 3975867 - DNA, 16 bp, Homo sapiens
cttttcctctctcccg

SEQ ID NO: 3975868 - DNA, 18 bp, Homo sapiens
cttttcctctctcccgga

SEQ ID NO: 3975869 - DNA, 19 bp, Homo sapiens
cttttcctgataaagcaca

SEQ ID NO: 3975870 - DNA, 16 bp, Homo sapiens
cttttcctggtgctct

SEQ ID NO: 3975871 - DNA, 22 bp, Homo sapiens
cttttctaaactaggctccttc

SEQ ID NO: 3975872 - DNA, 23 bp, Homo sapiens
cttttctaaactaggctccttca

SEQ ID NO: 3975873 - DNA, 20 bp, Homo sapiens
cttttctaacagaaagcatg

SEQ ID NO: 3975874 - DNA, 14 bp, Homo sapiens
cttttctctttctc

SEQ ID NO: 3975875 - DNA, 13 bp, Homo sapiens
cttttctcttttc

SEQ ID NO: 3975876 - DNA, 14 bp, Homo sapiens
cttttctgcatttt

SEQ ID NO: 3975877 - DNA, 13 bp, Homo sapiens
cttttctgccctg

SEQ ID NO: 3975878 - DNA, 17 bp, Homo sapiens
cttttctgccctggctg

SEQ ID NO: 3975879 - DNA, 11 bp, Homo sapiens
cttttctgctg

SEQ ID NO: 3975880 - DNA, 18 bp, Homo sapiens
cttttctggaatgtaatc

SEQ ID NO: 3975881 - DNA, 19 bp, Homo sapiens
cttttctggaatgtaatca

SEQ ID NO: 3975882 - DNA, 13 bp, Homo sapiens
cttttctgtaatg

SEQ ID NO: 3975883 - DNA, 13 bp, Homo sapiens
cttttctgtattt

SEQ ID NO: 3975884 - DNA, 21 bp, Homo sapiens
cttttctgtcaccaaatttgt

SEQ ID NO: 3975885 - DNA, 15 bp, Homo sapiens
cttttctgtcctggg

SEQ ID NO: 3975886 - DNA, 16 bp, Homo sapiens
cttttctgtcctgggc

SEQ ID NO: 3975887 - DNA, 17 bp, Homo sapiens
cttttctgtcctgggca

SEQ ID NO: 3975888 - DNA, 18 bp, Homo sapiens
cttttctgtggctggctc

SEQ ID NO: 3975889 - DNA, 15 bp, Homo sapiens
cttttcttatttaaa

SEQ ID NO: 3975890 - DNA, 13 bp, Homo sapiens
cttttcttcattt

SEQ ID NO: 3975891 - DNA, 16 bp, Homo sapiens
cttttcttcattttgg

SEQ ID NO: 3975892 - DNA, 11 bp, Homo sapiens
cttttcttggc

SEQ ID NO: 3975893 - DNA, 12 bp, Homo sapiens
cttttcttggca

SEQ ID NO: 3975894 - DNA, 23 bp, Homo sapiens
cttttcttggcaaaagccttgtg

SEQ ID NO: 3975895 - DNA, 14 bp, Homo sapiens
cttttctttaaaga

SEQ ID NO: 3975896 - DNA, 13 bp, Homo sapiens
cttttctttttcc

SEQ ID NO: 3975897 - DNA, 22 bp, Homo sapiens
cttttgaactggcaattgtcta

SEQ ID NO: 3975898 - DNA, 14 bp, Homo sapiens
cttttgaattgttt

SEQ ID NO: 3975899 - DNA, 14 bp, Homo sapiens
cttttgacatgtgg

SEQ ID NO: 3975900 - DNA, 16 bp, Homo sapiens
cttttgaggcttctcc

SEQ ID NO: 3975901 - DNA, 19 bp, Homo sapiens
cttttgccagtattatgca

SEQ ID NO: 3975902 - DNA, 20 bp, Homo sapiens
cttttgcccttcacagtgtt

SEQ ID NO: 3975903 - DNA, 22 bp, Homo sapiens
cttttgctcgatgcagacaggg

SEQ ID NO: 3975904 - DNA, 21 bp, Homo sapiens
cttttgctgcgcaccaatgcc

SEQ ID NO: 3975905 - DNA, 21 bp, Homo sapiens
cttttgggaagaatccagtat

SEQ ID NO: 3975906 - DNA, 20 bp, Homo sapiens
cttttgtaattgtgtaaaaa

SEQ ID NO: 3975907 - DNA, 21 bp, Homo sapiens
cttttgtaattgtgtaaaaaa

SEQ ID NO: 3975908 - DNA, 17 bp, Homo sapiens
cttttgtactgaatttt

SEQ ID NO: 3975909 - DNA, 14 bp, Homo sapiens
cttttgtatctttt

SEQ ID NO: 3975910 - DNA, 17 bp, Homo sapiens
cttttgtcatgtggcta

SEQ ID NO: 3975911 - DNA, 17 bp, Homo sapiens
cttttgtgtaatgaaaa

SEQ ID NO: 3975912 - DNA, 14 bp, Homo sapiens
cttttgtgtacagt

SEQ ID NO: 3975913 - DNA, 19 bp, Homo sapiens
cttttgtgtgaattgacta

SEQ ID NO: 3975914 - DNA, 23 bp, Homo sapiens
cttttgtgtgatgcgccttgctg

SEQ ID NO: 3975915 - DNA, 15 bp, Homo sapiens
cttttgttaaataat

SEQ ID NO: 3975916 - DNA, 18 bp, Homo sapiens
cttttgttaaataatatg

SEQ ID NO: 3975917 - DNA, 14 bp, Homo sapiens
cttttgttattcca

SEQ ID NO: 3975918 - DNA, 18 bp, Homo sapiens
cttttgttcatttcatcc

SEQ ID NO: 3975919 - DNA, 16 bp, Homo sapiens
cttttgttctgcttta

SEQ ID NO: 3975920 - DNA, 13 bp, Homo sapiens
cttttgtttattt

SEQ ID NO: 3975921 - DNA, 12 bp, Homo sapiens
cttttgtttcca

SEQ ID NO: 3975922 - DNA, 22 bp, Homo sapiens
cttttgtttcccttgctttgtt

SEQ ID NO: 3975923 - DNA, 21 bp, Homo sapiens
ctttttaaatgtgaattttta

SEQ ID NO: 3975924 - DNA, 16 bp, Homo sapiens
ctttttaacctgcaaa

SEQ ID NO: 3975925 - DNA, 14 bp, Homo sapiens
ctttttaatatgct

SEQ ID NO: 3975926 - DNA, 14 bp, Homo sapiens
ctttttaattgttg

SEQ ID NO: 3975927 - DNA, 15 bp, Homo sapiens
ctttttaattgttgt

SEQ ID NO: 3975928 - DNA, 11 bp, Homo sapiens
ctttttacata

SEQ ID NO: 3975929 - DNA, 21 bp, Homo sapiens
ctttttacataactgccttga

SEQ ID NO: 3975930 - DNA, 16 bp, Homo sapiens
ctttttacctttcata

SEQ ID NO: 3975931 - DNA, 23 bp, Homo sapiens
ctttttatgctatttctgtatat

SEQ ID NO: 3975932 - DNA, 18 bp, Homo sapiens
ctttttatttaattaaat

SEQ ID NO: 3975933 - DNA, 16 bp, Homo sapiens
ctttttatttctgcat

SEQ ID NO: 3975934 - DNA, 12 bp, Homo sapiens
ctttttccacaa

SEQ ID NO: 3975935 - DNA, 17 bp, Homo sapiens
ctttttccatcatttta

SEQ ID NO: 3975936 - DNA, 19 bp, Homo sapiens
ctttttccatcattttaca

SEQ ID NO: 3975937 - DNA, 21 bp, Homo sapiens
ctttttccgtgccgtgtattt

SEQ ID NO: 3975938 - DNA, 13 bp, Homo sapiens
ctttttcctctga

SEQ ID NO: 3975939 - DNA, 19 bp, Homo sapiens
ctttttctgattagctttg

SEQ ID NO: 3975940 - DNA, 21 bp, Homo sapiens
ctttttctgattagctttgtg

SEQ ID NO: 3975941 - DNA, 22 bp, Homo sapiens
ctttttctggactgaagcctgc

SEQ ID NO: 3975942 - DNA, 15 bp, Homo sapiens
ctttttgacactgaa

SEQ ID NO: 3975943 - DNA, 23 bp, Homo sapiens
ctttttgccagttttccctggaa

SEQ ID NO: 3975944 - DNA, 21 bp, Homo sapiens
ctttttggctgacttcatctg

SEQ ID NO: 3975945 - DNA, 16 bp, Homo sapiens
ctttttggtaataaca

SEQ ID NO: 3975946 - DNA, 23 bp, Homo sapiens
ctttttggtcgaggagtaacaat

SEQ ID NO: 3975947 - DNA, 17 bp, Homo sapiens
ctttttgtaaatactgc

SEQ ID NO: 3975948 - DNA, 18 bp, Homo sapiens
ctttttgtaaatactgct

SEQ ID NO: 3975949 - DNA, 21 bp, Homo sapiens
ctttttgtaaatactgcttga

SEQ ID NO: 3975950 - DNA, 12 bp, Homo sapiens
ctttttgtttct

SEQ ID NO: 3975951 - DNA, 17 bp, Homo sapiens
cttttttaaaaaagcaa

SEQ ID NO: 3975952 - DNA, 18 bp, Homo sapiens
cttttttatagcttaact

SEQ ID NO: 3975953 - DNA, 23 bp, Homo sapiens
cttttttatgtgccgtgttattg

SEQ ID NO: 3975954 - DNA, 22 bp, Homo sapiens
cttttttgtttgtttctttgtg

SEQ ID NO: 3975955 - DNA, 17 bp, Homo sapiens
ctttttttgtatgtgtg

SEQ ID NO: 3975956 - DNA, 15 bp, Homo sapiens
cttttttttccttct

SEQ ID NO: 3975957 - DNA, 21 bp, Homo sapiens
ctttttttttgaaacagcagt

SEQ ID NO: 3975958 - DNA, 18 bp, Homo sapiens
cttttttttttttttaca

SEQ ID NO: 3975959 - DNA, 18 bp, Homo sapiens
ctttttttttttttttga

SEQ ID NO: 3975960 - DNA, 19 bp, Homo sapiens
ctttttttttttttttgaa

SEQ ID NO: 3975961 - DNA, 18 bp, Homo sapiens
gaaaaaaaaaaaagaaaa

SEQ ID NO: 3975962 - DNA, 15 bp, Homo sapiens
gaaaaaaaagaaagc

SEQ ID NO: 3975963 - DNA, 21 bp, Homo sapiens
gaaaaaaaccacacaaagaca

SEQ ID NO: 3975964 - DNA, 19 bp, Homo sapiens
gaaaaaaacttggcacttt

SEQ ID NO: 3975965 - DNA, 13 bp, Homo sapiens
gaaaaaaatcttc

SEQ ID NO: 3975966 - DNA, 16 bp, Homo sapiens
gaaaaaaatgactaaa

SEQ ID NO: 3975967 - DNA, 16 bp, Homo sapiens
gaaaaaaatggcatca

SEQ ID NO: 3975968 - DNA, 12 bp, Homo sapiens
gaaaaaagcaca

SEQ ID NO: 3975969 - DNA, 14 bp, Homo sapiens
gaaaaaatgttgga

SEQ ID NO: 3975970 - DNA, 14 bp, Homo sapiens
gaaaaacacaagca

SEQ ID NO: 3975971 - DNA, 23 bp, Homo sapiens
gaaaaacaccgcttctgcctttt

SEQ ID NO: 3975972 - DNA, 23 bp, Homo sapiens
gaaaaactctgggaaataagaga

SEQ ID NO: 3975973 - DNA, 20 bp, Homo sapiens
gaaaaacttccatgaggcca

SEQ ID NO: 3975974 - DNA, 19 bp, Homo sapiens
gaaaaagacgatgtttatg

SEQ ID NO: 3975975 - DNA, 12 bp, Homo sapiens
gaaaaagcatga

SEQ ID NO: 3975976 - DNA, 14 bp, Homo sapiens
gaaaaagcatgatg

SEQ ID NO: 3975977 - DNA, 19 bp, Homo sapiens
gaaaaagcatgatgggaaa

SEQ ID NO: 3975978 - DNA, 19 bp, Homo sapiens
gaaaaagccaaaattgtca

SEQ ID NO: 3975979 - DNA, 21 bp, Homo sapiens
gaaaaagctcctgtcctccca

SEQ ID NO: 3975980 - DNA, 15 bp, Homo sapiens
gaaaaatatttctga

SEQ ID NO: 3975981 - DNA, 20 bp, Homo sapiens
gaaaaatgagaattttatat

SEQ ID NO: 3975982 - DNA, 16 bp, Homo sapiens
gaaaaatggttgatgg

SEQ ID NO: 3975983 - DNA, 20 bp, Homo sapiens
gaaaaatggttgatggaaaa

SEQ ID NO: 3975984 - DNA, 23 bp, Homo sapiens
gaaaaatggttgatggaaaataa

SEQ ID NO: 3975985 - DNA, 19 bp, Homo sapiens
gaaaaattggggaggaggg

SEQ ID NO: 3975986 - DNA, 16 bp, Homo sapiens
gaaaaatttaagcatt

SEQ ID NO: 3975987 - DNA, 17 bp, Homo sapiens
gaaaaatttaagcattg

SEQ ID NO: 3975988 - DNA, 15 bp, Homo sapiens
gaaaacatctcctta

SEQ ID NO: 3975989 - DNA, 19 bp, Homo sapiens
gaaaacattttatttttaa

SEQ ID NO: 3975990 - DNA, 18 bp, Homo sapiens
gaaaaccaagccgtggct

SEQ ID NO: 3975991 - DNA, 19 bp, Homo sapiens
gaaaaccaagccgtggctt

SEQ ID NO: 3975992 - DNA, 13 bp, Homo sapiens
gaaaacggagctg

SEQ ID NO: 3975993 - DNA, 20 bp, Homo sapiens
gaaaacgttttattgtgttt

SEQ ID NO: 3975994 - DNA, 16 bp, Homo sapiens
gaaaactctttgctgc

SEQ ID NO: 3975995 - DNA, 13 bp, Homo sapiens
gaaaactgtgttg

SEQ ID NO: 3975996 - DNA, 16 bp, Homo sapiens
gaaaacttcagaagca

SEQ ID NO: 3975997 - DNA, 16 bp, Homo sapiens
gaaaagaatacagaaa

SEQ ID NO: 3975998 - DNA, 21 bp, Homo sapiens
gaaaagagatattttaaaatg

SEQ ID NO: 3975999 - DNA, 20 bp, Homo sapiens
gaaaagatacgactttattt

SEQ ID NO: 3976000 - DNA, 14 bp, Homo sapiens
gaaaagatttaagc

SEQ ID NO: 3976001 - DNA, 13 bp, Homo sapiens
gaaaagattttaa

SEQ ID NO: 3976002 - DNA, 23 bp, Homo sapiens
gaaaagattttaatcaagttgaa

SEQ ID NO: 3976003 - DNA, 14 bp, Homo sapiens
gaaaagattttatt

SEQ ID NO: 3976004 - DNA, 17 bp, Homo sapiens
gaaaagattttatttat

SEQ ID NO: 3976005 - DNA, 12 bp, Homo sapiens
gaaaagcacttt

SEQ ID NO: 3976006 - DNA, 14 bp, Homo sapiens
gaaaagcacttttg

SEQ ID NO: 3976007 - DNA, 17 bp, Homo sapiens
gaaaagcataacaccaa

SEQ ID NO: 3976008 - DNA, 22 bp, Homo sapiens
gaaaagctagtgtacctcctct

SEQ ID NO: 3976009 - DNA, 14 bp, Homo sapiens
gaaaagctattagc

SEQ ID NO: 3976010 - DNA, 17 bp, Homo sapiens
gaaaagctattagccag

SEQ ID NO: 3976011 - DNA, 21 bp, Homo sapiens
gaaaagctgccatttcccttc

SEQ ID NO: 3976012 - DNA, 22 bp, Homo sapiens
gaaaagcttcttaattaatttg

SEQ ID NO: 3976013 - DNA, 23 bp, Homo sapiens
gaaaagcttcttaattaatttga

SEQ ID NO: 3976014 - DNA, 12 bp, Homo sapiens
gaaaaggaaaaa

SEQ ID NO: 3976015 - DNA, 13 bp, Homo sapiens
gaaaaggaagact

SEQ ID NO: 3976016 - DNA, 15 bp, Homo sapiens
gaaaaggaagactag

SEQ ID NO: 3976017 - DNA, 17 bp, Homo sapiens
gaaaagtattttgaagt

SEQ ID NO: 3976018 - DNA, 18 bp, Homo sapiens
gaaaagtattttgaagtt

SEQ ID NO: 3976019 - DNA, 19 bp, Homo sapiens
gaaaagtgcatatttatcc

SEQ ID NO: 3976020 - DNA, 17 bp, Homo sapiens
gaaaagtgcctgagctg

SEQ ID NO: 3976021 - DNA, 23 bp, Homo sapiens
gaaaagtggcgtgggagccagcc

SEQ ID NO: 3976022 - DNA, 13 bp, Homo sapiens
gaaaagtttccta

SEQ ID NO: 3976023 - DNA, 22 bp, Homo sapiens
gaaaagtttcctaggatgtcat

SEQ ID NO: 3976024 - DNA, 12 bp, Homo sapiens
gaaaataaacat

SEQ ID NO: 3976025 - DNA, 13 bp, Homo sapiens
gaaaataaagcta

SEQ ID NO: 3976026 - DNA, 22 bp, Homo sapiens
gaaaataaatatcacagtatta

SEQ ID NO: 3976027 - DNA, 18 bp, Homo sapiens
gaaaataagaatagaaat

SEQ ID NO: 3976028 - DNA, 15 bp, Homo sapiens
gaaaatacaataaac

SEQ ID NO: 3976029 - DNA, 18 bp, Homo sapiens
gaaaatagtttaggagaa

SEQ ID NO: 3976030 - DNA, 20 bp, Homo sapiens
gaaaatgaatatctattaat

SEQ ID NO: 3976031 - DNA, 22 bp, Homo sapiens
gaaaatgaatatctattaatat

SEQ ID NO: 3976032 - DNA, 13 bp, Homo sapiens
gaaaatgtaaatt

SEQ ID NO: 3976033 - DNA, 22 bp, Homo sapiens
gaaaatgtcagaaaccagttat

SEQ ID NO: 3976034 - DNA, 23 bp, Homo sapiens
gaaaatgtcagaaaccagttatg

SEQ ID NO: 3976035 - DNA, 19 bp, Homo sapiens
gaaaatgtgtttgctgcct

SEQ ID NO: 3976036 - DNA, 16 bp, Homo sapiens
gaaaatgttatttaac

SEQ ID NO: 3976037 - DNA, 17 bp, Homo sapiens
gaaaatgttgagaatcc

SEQ ID NO: 3976038 - DNA, 20 bp, Homo sapiens
gaaaatgttgagaatcccaa

SEQ ID NO: 3976039 - DNA, 22 bp, Homo sapiens
gaaaattctgtgccttgttttt

SEQ ID NO: 3976040 - DNA, 12 bp, Homo sapiens
gaaaattgcact

SEQ ID NO: 3976041 - DNA, 14 bp, Homo sapiens
gaaaattttaaaaa

SEQ ID NO: 3976042 - DNA, 15 bp, Homo sapiens
gaaaatttttacatt

SEQ ID NO: 3976043 - DNA, 14 bp, Homo sapiens
gaaacaacttggaa

SEQ ID NO: 3976044 - DNA, 23 bp, Homo sapiens
gaaacacaccaggctgtgggcct

SEQ ID NO: 3976045 - DNA, 13 bp, Homo sapiens
gaaacacagctgt

SEQ ID NO: 3976046 - DNA, 14 bp, Homo sapiens
gaaacacagctgtt

SEQ ID NO: 3976047 - DNA, 23 bp, Homo sapiens
gaaacactgcaaattttaactgt

SEQ ID NO: 3976048 - DNA, 17 bp, Homo sapiens
gaaacagagtggcctcc

SEQ ID NO: 3976049 - DNA, 20 bp, Homo sapiens
gaaacagattcaggccagcc

SEQ ID NO: 3976050 - DNA, 22 bp, Homo sapiens
gaaacagattcaggccagccca

SEQ ID NO: 3976051 - DNA, 15 bp, Homo sapiens
gaaacagccagcaag

SEQ ID NO: 3976052 - DNA, 19 bp, Homo sapiens
gaaacagccatgtccaagt

SEQ ID NO: 3976053 - DNA, 22 bp, Homo sapiens
gaaacagccattgcggccccag

SEQ ID NO: 3976054 - DNA, 17 bp, Homo sapiens
gaaacattacagttcat

SEQ ID NO: 3976055 - DNA, 12 bp, Homo sapiens
gaaacatttata

SEQ ID NO: 3976056 - DNA, 20 bp, Homo sapiens
gaaacattttttcttctgaa

SEQ ID NO: 3976057 - DNA, 19 bp, Homo sapiens
gaaaccaccgtgaaccaga

SEQ ID NO: 3976058 - DNA, 12 bp, Homo sapiens
gaaaccgaggcg

SEQ ID NO: 3976059 - DNA, 15 bp, Homo sapiens
gaaacctcagggctg

SEQ ID NO: 3976060 - DNA, 19 bp, Homo sapiens
gaaacctcagggctgtccc

SEQ ID NO: 3976061 - DNA, 17 bp, Homo sapiens
gaaaccttttttaagat

SEQ ID NO: 3976062 - DNA, 18 bp, Homo sapiens
gaaaccttttttaagatt

SEQ ID NO: 3976063 - DNA, 20 bp, Homo sapiens
gaaaccttttttaagatttt

SEQ ID NO: 3976064 - DNA, 21 bp, Homo sapiens
gaaaccttttttaagattttt

SEQ ID NO: 3976065 - DNA, 15 bp, Homo sapiens
gaaactaacagataa

SEQ ID NO: 3976066 - DNA, 14 bp, Homo sapiens
gaaactagaaatgt

SEQ ID NO: 3976067 - DNA, 18 bp, Homo sapiens
gaaactagttattttata

SEQ ID NO: 3976068 - DNA, 20 bp, Homo sapiens
gaaactcaccatgtaaaaga

SEQ ID NO: 3976069 - DNA, 15 bp, Homo sapiens
gaaactcttatctca

SEQ ID NO: 3976070 - DNA, 16 bp, Homo sapiens
gaaactcttatctcag

SEQ ID NO: 3976071 - DNA, 21 bp, Homo sapiens
gaaactcttatctcagtcatg

SEQ ID NO: 3976072 - DNA, 23 bp, Homo sapiens
gaaactcttatctcagtcatgca

SEQ ID NO: 3976073 - DNA, 13 bp, Homo sapiens
gaaactgctaaat

SEQ ID NO: 3976074 - DNA, 22 bp, Homo sapiens
gaaactgctcccatcattcctt

SEQ ID NO: 3976075 - DNA, 14 bp, Homo sapiens
gaaactgctgcaga

SEQ ID NO: 3976076 - DNA, 17 bp, Homo sapiens
gaaactggattaaaaca

SEQ ID NO: 3976077 - DNA, 16 bp, Homo sapiens
gaaacttgttcttcca

SEQ ID NO: 3976078 - DNA, 16 bp, Homo sapiens
gaaactttatacatta

SEQ ID NO: 3976079 - DNA, 15 bp, Homo sapiens
gaaagaaagaaggaa

SEQ ID NO: 3976080 - DNA, 21 bp, Homo sapiens
gaaagaaagggaaaagggaga

SEQ ID NO: 3976081 - DNA, 23 bp, Homo sapiens
gaaagaacatggacttgtatatt

SEQ ID NO: 3976082 - DNA, 14 bp, Homo sapiens
gaaagaagagaagt

SEQ ID NO: 3976083 - DNA, 16 bp, Homo sapiens
gaaagaatatatttat

SEQ ID NO: 3976084 - DNA, 21 bp, Homo sapiens
gaaagacctacattccctctc

SEQ ID NO: 3976085 - DNA, 22 bp, Homo sapiens
gaaagacctacattccctctcc

SEQ ID NO: 3976086 - DNA, 22 bp, Homo sapiens
gaaagagggtaataaccagaca

SEQ ID NO: 3976087 - DNA, 15 bp, Homo sapiens
gaaagatgtgttttt

SEQ ID NO: 3976088 - DNA, 12 bp, Homo sapiens
gaaagattttat

SEQ ID NO: 3976089 - DNA, 13 bp, Homo sapiens
gaaagattttatt

SEQ ID NO: 3976090 - DNA, 19 bp, Homo sapiens
gaaagattttattgtataa

SEQ ID NO: 3976091 - DNA, 20 bp, Homo sapiens
gaaagcacagaggcctcctg

SEQ ID NO: 3976092 - DNA, 17 bp, Homo sapiens
gaaagcatccatgtgtg

SEQ ID NO: 3976093 - DNA, 21 bp, Homo sapiens
gaaagcatgtggcatgttcat

SEQ ID NO: 3976094 - DNA, 13 bp, Homo sapiens
gaaagccacctct

SEQ ID NO: 3976095 - DNA, 15 bp, Homo sapiens
gaaagccacctctcc

SEQ ID NO: 3976096 - DNA, 19 bp, Homo sapiens
gaaagccacctctccctca

SEQ ID NO: 3976097 - DNA, 19 bp, Homo sapiens
gaaagccattgaccaccca

SEQ ID NO: 3976098 - DNA, 17 bp, Homo sapiens
gaaagccctcttggggg

SEQ ID NO: 3976099 - DNA, 18 bp, Homo sapiens
gaaagcctcactgatata

SEQ ID NO: 3976100 - DNA, 24 bp, Homo sapiens
gaaagcctgttcccctcactggat

SEQ ID NO: 3976101 - DNA, 19 bp, Homo sapiens
gaaagccttaagctgcagg

SEQ ID NO: 3976102 - DNA, 17 bp, Homo sapiens
gaaagctgagaactcct

SEQ ID NO: 3976103 - DNA, 13 bp, Homo sapiens
gaaagctgagaag

SEQ ID NO: 3976104 - DNA, 23 bp, Homo sapiens
gaaagctgattactgtcaataaa

SEQ ID NO: 3976105 - DNA, 20 bp, Homo sapiens
gaaaggaaaacctgaagact

SEQ ID NO: 3976106 - DNA, 19 bp, Homo sapiens
gaaaggaagccttgctcat

SEQ ID NO: 3976107 - DNA, 18 bp, Homo sapiens
gaaaggaagctccactgt

SEQ ID NO: 3976108 - DNA, 11 bp, Homo sapiens
gaaaggagact

SEQ ID NO: 3976109 - DNA, 12 bp, Homo sapiens
gaaaggagatgt

SEQ ID NO: 3976110 - DNA, 22 bp, Homo sapiens
gaaaggagtttctttagctgac

SEQ ID NO: 3976111 - DNA, 16 bp, Homo sapiens
gaaaggatatttaaga

SEQ ID NO: 3976112 - DNA, 14 bp, Homo sapiens
gaaaggcctcaaga

SEQ ID NO: 3976113 - DNA, 14 bp, Homo sapiens
gaaagggctggctc

SEQ ID NO: 3976114 - DNA, 15 bp, Homo sapiens
gaaaggggaaagaaa

SEQ ID NO: 3976115 - DNA, 15 bp, Homo sapiens
gaaaggggagcccac

SEQ ID NO: 3976116 - DNA, 21 bp, Homo sapiens
gaaaggtactatatttgctag

SEQ ID NO: 3976117 - DNA, 13 bp, Homo sapiens
gaaaggttctgcc

SEQ ID NO: 3976118 - DNA, 15 bp, Homo sapiens
gaaaggttctgcccg

SEQ ID NO: 3976119 - DNA, 16 bp, Homo sapiens
gaaaggtttacattgt

SEQ ID NO: 3976120 - DNA, 17 bp, Homo sapiens
gaaagtacactctgctg

SEQ ID NO: 3976121 - DNA, 19 bp, Homo sapiens
gaaagtacactctgctgtt

SEQ ID NO: 3976122 - DNA, 20 bp, Homo sapiens
gaaagtacactctgctgttt

SEQ ID NO: 3976123 - DNA, 18 bp, Homo sapiens
gaacactcttttgcttta

SEQ ID NO: 3976124 - DNA, 22 bp, Homo sapiens
gaacactggcacactgctctta

SEQ ID NO: 3976125 - DNA, 14 bp, Homo sapiens
gaacagaaggatga

SEQ ID NO: 3976126 - DNA, 15 bp, Homo sapiens
gaacagaatgtttta

SEQ ID NO: 3976127 - DNA, 21 bp, Homo sapiens
gaacagcgaagtagcttgctc

SEQ ID NO: 3976128 - DNA, 19 bp, Homo sapiens
gaacagcgggagacctgtg

SEQ ID NO: 3976129 - DNA, 15 bp, Homo sapiens
gaacagcttcaggtt

SEQ ID NO: 3976130 - DNA, 14 bp, Homo sapiens
gaacaggctgggct

SEQ ID NO: 3976131 - DNA, 19 bp, Homo sapiens
gaacaggttcttaaaaagg

SEQ ID NO: 3976132 - DNA, 21 bp, Homo sapiens
gaacaggttcttaaaaaggaa
